United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 122

SEQ ID NO: 5171958 - DNA, 12 bp, Homo sapiens
acttgtgcctcc

SEQ ID NO: 5171959 - DNA, 22 bp, Homo sapiens
acttgtgctgatcgtgctaaat

SEQ ID NO: 5171960 - DNA, 16 bp, Homo sapiens
acttgtgctttaccaa

SEQ ID NO: 5171961 - DNA, 15 bp, Homo sapiens
acttgtgctttgctc

SEQ ID NO: 5171962 - DNA, 17 bp, Homo sapiens
acttgtggacacagctc

SEQ ID NO: 5171963 - DNA, 18 bp, Homo sapiens
acttgtggacacagctct

SEQ ID NO: 5171964 - DNA, 22 bp, Homo sapiens
acttgtggacacagctcttctc

SEQ ID NO: 5171965 - DNA, 16 bp, Homo sapiens
acttgtggacactaca

SEQ ID NO: 5171966 - DNA, 20 bp, Homo sapiens
acttgtggactaaaagatat

SEQ ID NO: 5171967 - DNA, 15 bp, Homo sapiens
acttgtggcctcaag

SEQ ID NO: 5171968 - DNA, 16 bp, Homo sapiens
acttgtgggtcctggg

SEQ ID NO: 5171969 - DNA, 16 bp, Homo sapiens
acttgtggtatagtat

SEQ ID NO: 5171970 - DNA, 15 bp, Homo sapiens
acttgtggtgtgacc

SEQ ID NO: 5171971 - DNA, 22 bp, Homo sapiens
acttgtggtgtgaccatgttca

SEQ ID NO: 5171972 - DNA, 16 bp, Homo sapiens
acttgtggttttcaaa

SEQ ID NO: 5171973 - DNA, 13 bp, Homo sapiens
acttgtgtaaata

SEQ ID NO: 5171974 - DNA, 22 bp, Homo sapiens
acttgtgtaaatacaattttgt

SEQ ID NO: 5171975 - DNA, 22 bp, Homo sapiens
acttgtgtatattttaatgaat

SEQ ID NO: 5171976 - DNA, 22 bp, Homo sapiens
acttgtgtccctaatgtgttta

SEQ ID NO: 5171977 - DNA, 16 bp, Homo sapiens
acttgtgtctctgtgc

SEQ ID NO: 5171978 - DNA, 12 bp, Homo sapiens
acttgtgtgcat

SEQ ID NO: 5171979 - DNA, 13 bp, Homo sapiens
acttgtgtgcatg

SEQ ID NO: 5171980 - DNA, 15 bp, Homo sapiens
acttgtgtgcatgga

SEQ ID NO: 5171981 - DNA, 16 bp, Homo sapiens
acttgtgtgcatggaa

SEQ ID NO: 5171982 - DNA, 14 bp, Homo sapiens
acttgtgtgccaca

SEQ ID NO: 5171983 - DNA, 20 bp, Homo sapiens
acttgtgtgtgggctgtgag

SEQ ID NO: 5171984 - DNA, 21 bp, Homo sapiens
acttgtgtgtgggctgtgagt

SEQ ID NO: 5171985 - DNA, 22 bp, Homo sapiens
acttgtgtgtgggctgtgagtg

SEQ ID NO: 5171986 - DNA, 22 bp, Homo sapiens
acttgtgtgtgtacctgtggct

SEQ ID NO: 5171987 - DNA, 15 bp, Homo sapiens
acttgtgttcaatct

SEQ ID NO: 5171988 - DNA, 22 bp, Homo sapiens
acttgtgtttgcttaaacaaag

SEQ ID NO: 5171989 - DNA, 18 bp, Homo sapiens
acttgttatgttgtaata

SEQ ID NO: 5171990 - DNA, 15 bp, Homo sapiens
acttgttattgtgaa

SEQ ID NO: 5171991 - DNA, 19 bp, Homo sapiens
acttgttattgtgaatgat

SEQ ID NO: 5171992 - DNA, 15 bp, Homo sapiens
acttgttcacaggtt

SEQ ID NO: 5171993 - DNA, 17 bp, Homo sapiens
acttgttcattctgtga

SEQ ID NO: 5171994 - DNA, 14 bp, Homo sapiens
acttgttccagatg

SEQ ID NO: 5171995 - DNA, 12 bp, Homo sapiens
acttgttctaga

SEQ ID NO: 5171996 - DNA, 19 bp, Homo sapiens
acttgttctcagagcactg

SEQ ID NO: 5171997 - DNA, 13 bp, Homo sapiens
acttgttcttcca

SEQ ID NO: 5171998 - DNA, 21 bp, Homo sapiens
acttgttcttccaaagcagag

SEQ ID NO: 5171999 - DNA, 13 bp, Homo sapiens
acttgttcttggt

SEQ ID NO: 5172000 - DNA, 14 bp, Homo sapiens
acttgttgcagact

SEQ ID NO: 5172001 - DNA, 19 bp, Homo sapiens
acttgttgcagactggtgt

SEQ ID NO: 5172002 - DNA, 21 bp, Homo sapiens
acttgttgcctataagccaaa

SEQ ID NO: 5172003 - DNA, 22 bp, Homo sapiens
acttgttgctgattttgacctt

SEQ ID NO: 5172004 - DNA, 19 bp, Homo sapiens
acttgttgtatctgctgga

SEQ ID NO: 5172005 - DNA, 16 bp, Homo sapiens
acttgttgtggctctt

SEQ ID NO: 5172006 - DNA, 13 bp, Homo sapiens
acttgttgtttaa

SEQ ID NO: 5172007 - DNA, 13 bp, Homo sapiens
acttgtttaataa

SEQ ID NO: 5172008 - DNA, 17 bp, Homo sapiens
acttgtttacaacattt

SEQ ID NO: 5172009 - DNA, 15 bp, Homo sapiens
acttgtttagagagc

SEQ ID NO: 5172010 - DNA, 21 bp, Homo sapiens
acttgtttagagagcctgtca

SEQ ID NO: 5172011 - DNA, 23 bp, Homo sapiens
acttgtttagagagcctgtcacc

SEQ ID NO: 5172012 - DNA, 18 bp, Homo sapiens
acttgtttcatctggttt

SEQ ID NO: 5172013 - DNA, 13 bp, Homo sapiens
acttgtttctttc

SEQ ID NO: 5172014 - DNA, 22 bp, Homo sapiens
acttgtttctttctgtctctct

SEQ ID NO: 5172015 - DNA, 16 bp, Homo sapiens
acttgtttgaatattt

SEQ ID NO: 5172016 - DNA, 18 bp, Homo sapiens
acttgtttgaatatttgt

SEQ ID NO: 5172017 - DNA, 14 bp, Homo sapiens
acttgtttgctatg

SEQ ID NO: 5172018 - DNA, 18 bp, Homo sapiens
acttgtttggtctcttac

SEQ ID NO: 5172019 - DNA, 16 bp, Homo sapiens
acttgtttgtcttcca

SEQ ID NO: 5172020 - DNA, 15 bp, Homo sapiens
acttgtttgtgcatc

SEQ ID NO: 5172021 - DNA, 17 bp, Homo sapiens
acttgttttatgctcag

SEQ ID NO: 5172022 - DNA, 15 bp, Homo sapiens
acttgttttatttaa

SEQ ID NO: 5172023 - DNA, 13 bp, Homo sapiens
acttgttttcccc

SEQ ID NO: 5172024 - DNA, 18 bp, Homo sapiens
acttgttttggatggctt

SEQ ID NO: 5172025 - DNA, 20 bp, Homo sapiens
acttgtttttattgcatttg

SEQ ID NO: 5172026 - DNA, 16 bp, Homo sapiens
acttgtttttgtaaag

SEQ ID NO: 5172027 - DNA, 16 bp, Homo sapiens
actttaaaaaaacaat

SEQ ID NO: 5172028 - DNA, 17 bp, Homo sapiens
actttaaaaagaaatta

SEQ ID NO: 5172029 - DNA, 21 bp, Homo sapiens
actttaaaaagaaattaatat

SEQ ID NO: 5172030 - DNA, 14 bp, Homo sapiens
actttaaaaattta

SEQ ID NO: 5172031 - DNA, 19 bp, Homo sapiens
actttaaaaatttactaca

SEQ ID NO: 5172032 - DNA, 12 bp, Homo sapiens
actttaaaacac

SEQ ID NO: 5172033 - DNA, 12 bp, Homo sapiens
actttaaaactg

SEQ ID NO: 5172034 - DNA, 22 bp, Homo sapiens
actttaaaactgctcatttcat

SEQ ID NO: 5172035 - DNA, 18 bp, Homo sapiens
actttaaaactgtattta

SEQ ID NO: 5172036 - DNA, 16 bp, Homo sapiens
actttaaaaggattaa

SEQ ID NO: 5172037 - DNA, 19 bp, Homo sapiens
actttaaaaggattaatct

SEQ ID NO: 5172038 - DNA, 14 bp, Homo sapiens
actttaaaaggcaa

SEQ ID NO: 5172039 - DNA, 15 bp, Homo sapiens
actttaaaaggcaac

SEQ ID NO: 5172040 - DNA, 15 bp, Homo sapiens
actttaaaatgcgaa

SEQ ID NO: 5172041 - DNA, 14 bp, Homo sapiens
actttaaacatcta

SEQ ID NO: 5172042 - DNA, 15 bp, Homo sapiens
actttaaacatctag

SEQ ID NO: 5172043 - DNA, 14 bp, Homo sapiens
actttaaactttcc

SEQ ID NO: 5172044 - DNA, 17 bp, Homo sapiens
actttaaactttccctt

SEQ ID NO: 5172045 - DNA, 12 bp, Homo sapiens
actttaaagcgt

SEQ ID NO: 5172046 - DNA, 19 bp, Homo sapiens
actttaaagctcaggaggg

SEQ ID NO: 5172047 - DNA, 14 bp, Homo sapiens
actttaaagtcttt

SEQ ID NO: 5172048 - DNA, 18 bp, Homo sapiens
actttaaatcctaccaaa

SEQ ID NO: 5172049 - DNA, 21 bp, Homo sapiens
actttaaatcttttcttcaac

SEQ ID NO: 5172050 - DNA, 13 bp, Homo sapiens
actttaaatggaa

SEQ ID NO: 5172051 - DNA, 18 bp, Homo sapiens
actttaaatggaataatt

SEQ ID NO: 5172052 - DNA, 18 bp, Homo sapiens
actttaaattatatgata

SEQ ID NO: 5172053 - DNA, 15 bp, Homo sapiens
actttaaattgtgga

SEQ ID NO: 5172054 - DNA, 14 bp, Homo sapiens
actttaaatttttt

SEQ ID NO: 5172055 - DNA, 18 bp, Homo sapiens
actttaacacagtgtctg

SEQ ID NO: 5172056 - DNA, 21 bp, Homo sapiens
actttaacctccctcaacaag

SEQ ID NO: 5172057 - DNA, 22 bp, Homo sapiens
actttaacttagttttgcatag

SEQ ID NO: 5172058 - DNA, 16 bp, Homo sapiens
actttaacttctgttt

SEQ ID NO: 5172059 - DNA, 21 bp, Homo sapiens
actttaagaagcgaacaaaaa

SEQ ID NO: 5172060 - DNA, 17 bp, Homo sapiens
actttaagactgagcac

SEQ ID NO: 5172061 - DNA, 12 bp, Homo sapiens
actttaagagag

SEQ ID NO: 5172062 - DNA, 18 bp, Homo sapiens
actttaagtttcaggata

SEQ ID NO: 5172063 - DNA, 20 bp, Homo sapiens
actttaatactcacctcctc

SEQ ID NO: 5172064 - DNA, 23 bp, Homo sapiens
actttaatgtacatgggccgcac

SEQ ID NO: 5172065 - DNA, 19 bp, Homo sapiens
actttaattaccaacctgt

SEQ ID NO: 5172066 - DNA, 20 bp, Homo sapiens
actttaattaccaacctgtt

SEQ ID NO: 5172067 - DNA, 17 bp, Homo sapiens
actttaattaggatcat

SEQ ID NO: 5172068 - DNA, 19 bp, Homo sapiens
actttaattctcatgtgat

SEQ ID NO: 5172069 - DNA, 23 bp, Homo sapiens
actttaattctcatgtgatcctt

SEQ ID NO: 5172070 - DNA, 16 bp, Homo sapiens
actttaatttattttg

SEQ ID NO: 5172071 - DNA, 17 bp, Homo sapiens
actttaatttattttgt

SEQ ID NO: 5172072 - DNA, 15 bp, Homo sapiens
actttacaaaccttt

SEQ ID NO: 5172073 - DNA, 17 bp, Homo sapiens
actttacaaacctttgt

SEQ ID NO: 5172074 - DNA, 14 bp, Homo sapiens
actttacaatcatg

SEQ ID NO: 5172075 - DNA, 20 bp, Homo sapiens
actttacaatgttcatccca

SEQ ID NO: 5172076 - DNA, 22 bp, Homo sapiens
actttacactctctgtacaaaa

SEQ ID NO: 5172077 - DNA, 15 bp, Homo sapiens
actttacagaaatgg

SEQ ID NO: 5172078 - DNA, 23 bp, Homo sapiens
actttacaggaggttgtggatgc

SEQ ID NO: 5172079 - DNA, 22 bp, Homo sapiens
actttacagttctggaggagga

SEQ ID NO: 5172080 - DNA, 22 bp, Homo sapiens
actttacataagaaatgtattc

SEQ ID NO: 5172081 - DNA, 20 bp, Homo sapiens
actttacatcctactaagaa

SEQ ID NO: 5172082 - DNA, 15 bp, Homo sapiens
actttacatgacaca

SEQ ID NO: 5172083 - DNA, 19 bp, Homo sapiens
actttaccagaggcataaa

SEQ ID NO: 5172084 - DNA, 19 bp, Homo sapiens
actttaccataaagccttt

SEQ ID NO: 5172085 - DNA, 22 bp, Homo sapiens
actttaccataaagcctttaaa

SEQ ID NO: 5172086 - DNA, 17 bp, Homo sapiens
actttacccaaaaacta

SEQ ID NO: 5172087 - DNA, 18 bp, Homo sapiens
actttacccacctagaac

SEQ ID NO: 5172088 - DNA, 13 bp, Homo sapiens
actttacccattt

SEQ ID NO: 5172089 - DNA, 18 bp, Homo sapiens
actttaccttttttatac

SEQ ID NO: 5172090 - DNA, 23 bp, Homo sapiens
actttaccttttttatacataaa

SEQ ID NO: 5172091 - DNA, 18 bp, Homo sapiens
actttactaagatgacat

SEQ ID NO: 5172092 - DNA, 13 bp, Homo sapiens
actttacttttgc

SEQ ID NO: 5172093 - DNA, 15 bp, Homo sapiens
actttactttttcca

SEQ ID NO: 5172094 - DNA, 17 bp, Homo sapiens
actttagaaagctgaca

SEQ ID NO: 5172095 - DNA, 18 bp, Homo sapiens
actttagaaagctgacat

SEQ ID NO: 5172096 - DNA, 21 bp, Homo sapiens
actttagaagcacagtaaata

SEQ ID NO: 5172097 - DNA, 16 bp, Homo sapiens
actttagaagcctgca

SEQ ID NO: 5172098 - DNA, 21 bp, Homo sapiens
actttagaagtagaattgaca

SEQ ID NO: 5172099 - DNA, 17 bp, Homo sapiens
actttagaatatgcctt

SEQ ID NO: 5172100 - DNA, 14 bp, Homo sapiens
actttagacatttt

SEQ ID NO: 5172101 - DNA, 17 bp, Homo sapiens
actttagagtgactaaa

SEQ ID NO: 5172102 - DNA, 15 bp, Homo sapiens
actttagatgctgat

SEQ ID NO: 5172103 - DNA, 20 bp, Homo sapiens
actttagcagaatcaaaatg

SEQ ID NO: 5172104 - DNA, 15 bp, Homo sapiens
actttagctatgtgg

SEQ ID NO: 5172105 - DNA, 21 bp, Homo sapiens
actttaggctttcagcttaca

SEQ ID NO: 5172106 - DNA, 23 bp, Homo sapiens
actttagggatctggggaaggac

SEQ ID NO: 5172107 - DNA, 23 bp, Homo sapiens
actttagggctaaccagttctct

SEQ ID NO: 5172108 - DNA, 22 bp, Homo sapiens
actttagggctgtaaaatgcat

SEQ ID NO: 5172109 - DNA, 20 bp, Homo sapiens
actttagggggtgggagggg

SEQ ID NO: 5172110 - DNA, 24 bp, Homo sapiens
actttaggtagtagaatctcagca

SEQ ID NO: 5172111 - DNA, 19 bp, Homo sapiens
actttagtacaatttcaac

SEQ ID NO: 5172112 - DNA, 17 bp, Homo sapiens
actttagtctgcaaaat

SEQ ID NO: 5172113 - DNA, 18 bp, Homo sapiens
actttagtgaaacataat

SEQ ID NO: 5172114 - DNA, 17 bp, Homo sapiens
actttagtgattgcttt

SEQ ID NO: 5172115 - DNA, 19 bp, Homo sapiens
actttagtgattgctttta

SEQ ID NO: 5172116 - DNA, 17 bp, Homo sapiens
actttagtgccctgccc

SEQ ID NO: 5172117 - DNA, 20 bp, Homo sapiens
actttagtttgcctgcagtt

SEQ ID NO: 5172118 - DNA, 14 bp, Homo sapiens
actttataaacact

SEQ ID NO: 5172119 - DNA, 13 bp, Homo sapiens
actttataaatcc

SEQ ID NO: 5172120 - DNA, 13 bp, Homo sapiens
actttataaattt

SEQ ID NO: 5172121 - DNA, 20 bp, Homo sapiens
actttataaccaaagcaatt

SEQ ID NO: 5172122 - DNA, 20 bp, Homo sapiens
actttataacttaaatattg

SEQ ID NO: 5172123 - DNA, 14 bp, Homo sapiens
agacacccaggact

SEQ ID NO: 5172124 - DNA, 15 bp, Homo sapiens
agacacccaggactt

SEQ ID NO: 5172125 - DNA, 16 bp, Homo sapiens
agacacccaggactta

SEQ ID NO: 5172126 - DNA, 18 bp, Homo sapiens
agacaccctaatgtggca

SEQ ID NO: 5172127 - DNA, 21 bp, Homo sapiens
agacaccctcaacctcttctg

SEQ ID NO: 5172128 - DNA, 16 bp, Homo sapiens
agacaccctctggggg

SEQ ID NO: 5172129 - DNA, 22 bp, Homo sapiens
agacaccgccacatggcttcct

SEQ ID NO: 5172130 - DNA, 19 bp, Homo sapiens
agacaccgttcattcaggc

SEQ ID NO: 5172131 - DNA, 19 bp, Homo sapiens
agacacctccccctaccca

SEQ ID NO: 5172132 - DNA, 14 bp, Homo sapiens
agacacctgcacct

SEQ ID NO: 5172133 - DNA, 20 bp, Homo sapiens
agacacctgcacctcccccc

SEQ ID NO: 5172134 - DNA, 18 bp, Homo sapiens
agacaccttgacagggca

SEQ ID NO: 5172135 - DNA, 22 bp, Homo sapiens
agacaccttgacagggcacacc

SEQ ID NO: 5172136 - DNA, 19 bp, Homo sapiens
agacaccttttgtatttaa

SEQ ID NO: 5172137 - DNA, 22 bp, Homo sapiens
agacacgacagcacacacagtg

SEQ ID NO: 5172138 - DNA, 21 bp, Homo sapiens
agacacgagcttaatcaacag

SEQ ID NO: 5172139 - DNA, 15 bp, Homo sapiens
agacacgcacggcag

SEQ ID NO: 5172140 - DNA, 20 bp, Homo sapiens
agacacgcacggcagccaca

SEQ ID NO: 5172141 - DNA, 22 bp, Homo sapiens
agacacgcacggcagccacagc

SEQ ID NO: 5172142 - DNA, 22 bp, Homo sapiens
agacacggggcaggaccttcct

SEQ ID NO: 5172143 - DNA, 19 bp, Homo sapiens
agacacgtggcctcgtgag

SEQ ID NO: 5172144 - DNA, 14 bp, Homo sapiens
agacacgtgttttt

SEQ ID NO: 5172145 - DNA, 16 bp, Homo sapiens
agacacgtgtttttgt

SEQ ID NO: 5172146 - DNA, 19 bp, Homo sapiens
agacacgtgtttttgtatc

SEQ ID NO: 5172147 - DNA, 20 bp, Homo sapiens
agacacgtgtttttgtatct

SEQ ID NO: 5172148 - DNA, 15 bp, Homo sapiens
agacacgttctgatt

SEQ ID NO: 5172149 - DNA, 17 bp, Homo sapiens
agacactaaatgcagac

SEQ ID NO: 5172150 - DNA, 20 bp, Homo sapiens
agacactaacgaaatatcaa

SEQ ID NO: 5172151 - DNA, 22 bp, Homo sapiens
agacactaacgacttcagggca

SEQ ID NO: 5172152 - DNA, 17 bp, Homo sapiens
agacactaattccttaa

SEQ ID NO: 5172153 - DNA, 16 bp, Homo sapiens
agacactcaaatatga

SEQ ID NO: 5172154 - DNA, 16 bp, Homo sapiens
agacactcaagagccc

SEQ ID NO: 5172155 - DNA, 17 bp, Homo sapiens
agacactcaagagccct

SEQ ID NO: 5172156 - DNA, 19 bp, Homo sapiens
agacactcccagggacaag

SEQ ID NO: 5172157 - DNA, 20 bp, Homo sapiens
agacactcccccctccattc

SEQ ID NO: 5172158 - DNA, 18 bp, Homo sapiens
agacactctgacaagctg

SEQ ID NO: 5172159 - DNA, 14 bp, Homo sapiens
agacactctgctct

SEQ ID NO: 5172160 - DNA, 18 bp, Homo sapiens
agacactctgctctgccc

SEQ ID NO: 5172161 - DNA, 13 bp, Homo sapiens
agacactgaaata

SEQ ID NO: 5172162 - DNA, 22 bp, Homo sapiens
agacactgaaatatacacacag

SEQ ID NO: 5172163 - DNA, 18 bp, Homo sapiens
agacactgatctggctgc

SEQ ID NO: 5172164 - DNA, 13 bp, Homo sapiens
agacactgcctgg

SEQ ID NO: 5172165 - DNA, 12 bp, Homo sapiens
agacactggttt

SEQ ID NO: 5172166 - DNA, 13 bp, Homo sapiens
agacactgtaaaa

SEQ ID NO: 5172167 - DNA, 15 bp, Homo sapiens
agacactgtaaaata

SEQ ID NO: 5172168 - DNA, 23 bp, Homo sapiens
agacactgtctctaccaaaaaaa

SEQ ID NO: 5172169 - DNA, 20 bp, Homo sapiens
agacactgtgagagttgtct

SEQ ID NO: 5172170 - DNA, 23 bp, Homo sapiens
agacactgtgagagttgtctctg

SEQ ID NO: 5172171 - DNA, 23 bp, Homo sapiens
agacactgtgcaaattttttgaa

SEQ ID NO: 5172172 - DNA, 17 bp, Homo sapiens
agacactgttgataaaa

SEQ ID NO: 5172173 - DNA, 19 bp, Homo sapiens
agacactgttgataaaaac

SEQ ID NO: 5172174 - DNA, 18 bp, Homo sapiens
agacactgttgcaaaggt

SEQ ID NO: 5172175 - DNA, 22 bp, Homo sapiens
agacactgtttacaagaaaaaa

SEQ ID NO: 5172176 - DNA, 22 bp, Homo sapiens
agacacttatattttgatttta

SEQ ID NO: 5172177 - DNA, 16 bp, Homo sapiens
agacacttcaatggga

SEQ ID NO: 5172178 - DNA, 14 bp, Homo sapiens
agacacttcccctt

SEQ ID NO: 5172179 - DNA, 23 bp, Homo sapiens
agacacttccccttgtctccctg

SEQ ID NO: 5172180 - DNA, 20 bp, Homo sapiens
agacacttccgtcacatccc

SEQ ID NO: 5172181 - DNA, 14 bp, Homo sapiens
agacacttgctccc

SEQ ID NO: 5172182 - DNA, 11 bp, Homo sapiens
agacagaaaag

SEQ ID NO: 5172183 - DNA, 13 bp, Homo sapiens
agacagaaaagtg

SEQ ID NO: 5172184 - DNA, 20 bp, Homo sapiens
agacagaaacagagagagac

SEQ ID NO: 5172185 - DNA, 17 bp, Homo sapiens
agacagaaacatgtctt

SEQ ID NO: 5172186 - DNA, 15 bp, Homo sapiens
agacagaaaccaagc

SEQ ID NO: 5172187 - DNA, 13 bp, Homo sapiens
agacagaaactgg

SEQ ID NO: 5172188 - DNA, 13 bp, Homo sapiens
agacagaaagcct

SEQ ID NO: 5172189 - DNA, 14 bp, Homo sapiens
agacagaacaccta

SEQ ID NO: 5172190 - DNA, 18 bp, Homo sapiens
agacagaacacctatgca

SEQ ID NO: 5172191 - DNA, 19 bp, Homo sapiens
agacagaaccacagggcta

SEQ ID NO: 5172192 - DNA, 17 bp, Homo sapiens
agacagaacccctacat

SEQ ID NO: 5172193 - DNA, 17 bp, Homo sapiens
agacagaaccttgttat

SEQ ID NO: 5172194 - DNA, 18 bp, Homo sapiens
agacagaaccttgttatt

SEQ ID NO: 5172195 - DNA, 12 bp, Homo sapiens
agacagaagaaa

SEQ ID NO: 5172196 - DNA, 14 bp, Homo sapiens
agacagaagaaaca

SEQ ID NO: 5172197 - DNA, 15 bp, Homo sapiens
agacagaagaaacaa

SEQ ID NO: 5172198 - DNA, 20 bp, Homo sapiens
agacagaagcaggctggagg

SEQ ID NO: 5172199 - DNA, 16 bp, Homo sapiens
agacagaagtctcctc

SEQ ID NO: 5172200 - DNA, 17 bp, Homo sapiens
agacagaagtctcctca

SEQ ID NO: 5172201 - DNA, 22 bp, Homo sapiens
agacagaatctcgctctgtcgc

SEQ ID NO: 5172202 - DNA, 19 bp, Homo sapiens
agacagaatgagagagaaa

SEQ ID NO: 5172203 - DNA, 22 bp, Homo sapiens
agacagaatgagagagaaaaga

SEQ ID NO: 5172204 - DNA, 15 bp, Homo sapiens
agacagaatgtatct

SEQ ID NO: 5172205 - DNA, 18 bp, Homo sapiens
agacagaatgtatctgtg

SEQ ID NO: 5172206 - DNA, 19 bp, Homo sapiens
agacagaatgtatctgtga

SEQ ID NO: 5172207 - DNA, 24 bp, Homo sapiens
agacagaattcactgtctgttgct

SEQ ID NO: 5172208 - DNA, 20 bp, Homo sapiens
agacagacacacactggctc

SEQ ID NO: 5172209 - DNA, 21 bp, Homo sapiens
agacagacaccacagcctccc

SEQ ID NO: 5172210 - DNA, 14 bp, Homo sapiens
agacagacatacat

SEQ ID NO: 5172211 - DNA, 11 bp, Homo sapiens
agacagaccac

SEQ ID NO: 5172212 - DNA, 13 bp, Homo sapiens
agacagaccttca

SEQ ID NO: 5172213 - DNA, 16 bp, Homo sapiens
agacagacgcatgtgg

SEQ ID NO: 5172214 - DNA, 20 bp, Homo sapiens
agacagagaaaacttgcctt

SEQ ID NO: 5172215 - DNA, 19 bp, Homo sapiens
agacagagaaatgtgaagg

SEQ ID NO: 5172216 - DNA, 21 bp, Homo sapiens
agacagagaaatgtgaagggt

SEQ ID NO: 5172217 - DNA, 14 bp, Homo sapiens
agacagagacaagt

SEQ ID NO: 5172218 - DNA, 15 bp, Homo sapiens
agacagagacaagta

SEQ ID NO: 5172219 - DNA, 18 bp, Homo sapiens
agacagagacgcaggaat

SEQ ID NO: 5172220 - DNA, 13 bp, Homo sapiens
agacagagagaga

SEQ ID NO: 5172221 - DNA, 20 bp, Homo sapiens
agacagagaggactgtaggg

SEQ ID NO: 5172222 - DNA, 19 bp, Homo sapiens
agacagagatggcagagcc

SEQ ID NO: 5172223 - DNA, 12 bp, Homo sapiens
agacagagcagg

SEQ ID NO: 5172224 - DNA, 21 bp, Homo sapiens
agacagagccaagcactgctc

SEQ ID NO: 5172225 - DNA, 20 bp, Homo sapiens
agacagagccaggagaagct

SEQ ID NO: 5172226 - DNA, 22 bp, Homo sapiens
agacagagccccaccctcagat

SEQ ID NO: 5172227 - DNA, 14 bp, Homo sapiens
agacagagccccca

SEQ ID NO: 5172228 - DNA, 15 bp, Homo sapiens
agacagaggatgtgg

SEQ ID NO: 5172229 - DNA, 18 bp, Homo sapiens
agacagaggccctcaagt

SEQ ID NO: 5172230 - DNA, 22 bp, Homo sapiens
agacagaggggatggggataga

SEQ ID NO: 5172231 - DNA, 17 bp, Homo sapiens
agacagagggtcacagt

SEQ ID NO: 5172232 - DNA, 20 bp, Homo sapiens
agacagaggtttcattttca

SEQ ID NO: 5172233 - DNA, 20 bp, Homo sapiens
agacagagtccctggctcct

SEQ ID NO: 5172234 - DNA, 19 bp, Homo sapiens
agacagagtctcactgttg

SEQ ID NO: 5172235 - DNA, 23 bp, Homo sapiens
agacagagtctcgctctgtcgcc

SEQ ID NO: 5172236 - DNA, 19 bp, Homo sapiens
agacagagtgaatttcagt

SEQ ID NO: 5172237 - DNA, 16 bp, Homo sapiens
agacagagtggatctg

SEQ ID NO: 5172238 - DNA, 12 bp, Homo sapiens
agacagatacag

SEQ ID NO: 5172239 - DNA, 16 bp, Homo sapiens
agacagatacctccaa

SEQ ID NO: 5172240 - DNA, 23 bp, Homo sapiens
agacagatacctccaaccctgcc

SEQ ID NO: 5172241 - DNA, 18 bp, Homo sapiens
agacagatgagcaggagc

SEQ ID NO: 5172242 - DNA, 16 bp, Homo sapiens
agacagatgccccaga

SEQ ID NO: 5172243 - DNA, 15 bp, Homo sapiens
agacagatgtcagct

SEQ ID NO: 5172244 - DNA, 16 bp, Homo sapiens
agacagatgtggacat

SEQ ID NO: 5172245 - DNA, 17 bp, Homo sapiens
agacagatgtggacatg

SEQ ID NO: 5172246 - DNA, 20 bp, Homo sapiens
agacagatgtggacatgcac

SEQ ID NO: 5172247 - DNA, 12 bp, Homo sapiens
agacagcaagtt

SEQ ID NO: 5172248 - DNA, 18 bp, Homo sapiens
agacagcacagggcaggg

SEQ ID NO: 5172249 - DNA, 15 bp, Homo sapiens
agacagcaccactgc

SEQ ID NO: 5172250 - DNA, 17 bp, Homo sapiens
agacagcaccactgctg

SEQ ID NO: 5172251 - DNA, 14 bp, Homo sapiens
agacagcagacaaa

SEQ ID NO: 5172252 - DNA, 14 bp, Homo sapiens
agacagcagcagcc

SEQ ID NO: 5172253 - DNA, 15 bp, Homo sapiens
agacagcagcagcct

SEQ ID NO: 5172254 - DNA, 16 bp, Homo sapiens
agacagcagctcaggc

SEQ ID NO: 5172255 - DNA, 18 bp, Homo sapiens
agacagcaggcagcgcca

SEQ ID NO: 5172256 - DNA, 21 bp, Homo sapiens
agacagcattgatctcctgga

SEQ ID NO: 5172257 - DNA, 15 bp, Homo sapiens
agacagcatttgtgt

SEQ ID NO: 5172258 - DNA, 18 bp, Homo sapiens
agacagccacattgggca

SEQ ID NO: 5172259 - DNA, 13 bp, Homo sapiens
agacagccaggta

SEQ ID NO: 5172260 - DNA, 23 bp, Homo sapiens
agacagcccaggatactggcaca

SEQ ID NO: 5172261 - DNA, 18 bp, Homo sapiens
agacagccccaagcttct

SEQ ID NO: 5172262 - DNA, 19 bp, Homo sapiens
agacagccccaagcttctg

SEQ ID NO: 5172263 - DNA, 18 bp, Homo sapiens
agacagccccagagcagg

SEQ ID NO: 5172264 - DNA, 17 bp, Homo sapiens
agacagcccgggctctg

SEQ ID NO: 5172265 - DNA, 14 bp, Homo sapiens
agacagccctgcct

SEQ ID NO: 5172266 - DNA, 15 bp, Homo sapiens
agacagccctgccta

SEQ ID NO: 5172267 - DNA, 21 bp, Homo sapiens
agacagccctgcctatcctct

SEQ ID NO: 5172268 - DNA, 16 bp, Homo sapiens
agacagccgtttgttc

SEQ ID NO: 5172269 - DNA, 11 bp, Homo sapiens
agacagcctgt

SEQ ID NO: 5172270 - DNA, 19 bp, Homo sapiens
agacagcgaactagaagaa

SEQ ID NO: 5172271 - DNA, 18 bp, Homo sapiens
agacagcggtcccagggg

SEQ ID NO: 5172272 - DNA, 12 bp, Homo sapiens
agacagctctta

SEQ ID NO: 5172273 - DNA, 12 bp, Homo sapiens
agacagctcttc

SEQ ID NO: 5172274 - DNA, 14 bp, Homo sapiens
agacagctgacaga

SEQ ID NO: 5172275 - DNA, 19 bp, Homo sapiens
agacagctgatacttcatt

SEQ ID NO: 5172276 - DNA, 14 bp, Homo sapiens
agacagctgcctgg

SEQ ID NO: 5172277 - DNA, 19 bp, Homo sapiens
agacagctgctcagagcca

SEQ ID NO: 5172278 - DNA, 13 bp, Homo sapiens
agacagctggacc

SEQ ID NO: 5172279 - DNA, 16 bp, Homo sapiens
agacagctggacccat

SEQ ID NO: 5172280 - DNA, 17 bp, Homo sapiens
agacagctggcggaggc

SEQ ID NO: 5172281 - DNA, 19 bp, Homo sapiens
agacagcttacagaatggg

SEQ ID NO: 5172282 - DNA, 12 bp, Homo sapiens
agacagcttctc

SEQ ID NO: 5172283 - DNA, 22 bp, Homo sapiens
agacagcttctcatcctgcagg

SEQ ID NO: 5172284 - DNA, 15 bp, Homo sapiens
agacagcttctctgc

SEQ ID NO: 5172285 - DNA, 16 bp, Homo sapiens
agacagcttctctgca

SEQ ID NO: 5172286 - DNA, 18 bp, Homo sapiens
agacagcttctctgcagt

SEQ ID NO: 5172287 - DNA, 22 bp, Homo sapiens
agacagcttctctgcagtaaaa

SEQ ID NO: 5172288 - DNA, 19 bp, Homo sapiens
agacagcttgactgctttt

SEQ ID NO: 5172289 - DNA, 18 bp, Homo sapiens
agacagcttttctcaact

SEQ ID NO: 5172290 - DNA, 19 bp, Homo sapiens
agacagcttttctcaactg

SEQ ID NO: 5172291 - DNA, 18 bp, Homo sapiens
agacaggaaaatcctctg

SEQ ID NO: 5172292 - DNA, 14 bp, Homo sapiens
agacaggaaagaat

SEQ ID NO: 5172293 - DNA, 19 bp, Homo sapiens
agacaggaaagttcagagt

SEQ ID NO: 5172294 - DNA, 16 bp, Homo sapiens
agacaggaaggaagca

SEQ ID NO: 5172295 - DNA, 19 bp, Homo sapiens
agacaggacagaatgtgtt

SEQ ID NO: 5172296 - DNA, 14 bp, Homo sapiens
agacaggacccctg

SEQ ID NO: 5172297 - DNA, 18 bp, Homo sapiens
agacaggagaagaaagaa

SEQ ID NO: 5172298 - DNA, 22 bp, Homo sapiens
agacaggaggagtgggacagac

SEQ ID NO: 5172299 - DNA, 23 bp, Homo sapiens
agacaggagggcaagggccatgc

SEQ ID NO: 5172300 - DNA, 14 bp, Homo sapiens
agacaggatgaggt

SEQ ID NO: 5172301 - DNA, 14 bp, Homo sapiens
agacaggcacaaaa

SEQ ID NO: 5172302 - DNA, 22 bp, Homo sapiens
actttataagtcattgtatgtt

SEQ ID NO: 5172303 - DNA, 18 bp, Homo sapiens
actttataatcaagacaa

SEQ ID NO: 5172304 - DNA, 16 bp, Homo sapiens
actttatacacttgga

SEQ ID NO: 5172305 - DNA, 12 bp, Homo sapiens
actttatacatt

SEQ ID NO: 5172306 - DNA, 17 bp, Homo sapiens
actttatagaagaatgc

SEQ ID NO: 5172307 - DNA, 20 bp, Homo sapiens
actttatatatgtacataca

SEQ ID NO: 5172308 - DNA, 15 bp, Homo sapiens
actttatatctgtaa

SEQ ID NO: 5172309 - DNA, 20 bp, Homo sapiens
actttatatctgtaatgata

SEQ ID NO: 5172310 - DNA, 22 bp, Homo sapiens
actttatatctgtaatgatact

SEQ ID NO: 5172311 - DNA, 14 bp, Homo sapiens
actttatatcttgt

SEQ ID NO: 5172312 - DNA, 17 bp, Homo sapiens
actttatatcttgttta

SEQ ID NO: 5172313 - DNA, 21 bp, Homo sapiens
actttatcacattatttgcat

SEQ ID NO: 5172314 - DNA, 13 bp, Homo sapiens
actttatcactta

SEQ ID NO: 5172315 - DNA, 22 bp, Homo sapiens
actttatcctcattccataaat

SEQ ID NO: 5172316 - DNA, 22 bp, Homo sapiens
actttatcttgaataatgtaag

SEQ ID NO: 5172317 - DNA, 21 bp, Homo sapiens
actttatgaaaaaaatatatt

SEQ ID NO: 5172318 - DNA, 22 bp, Homo sapiens
actttatgaaaaaaatatattt

SEQ ID NO: 5172319 - DNA, 16 bp, Homo sapiens
actttatgaagtgcta

SEQ ID NO: 5172320 - DNA, 15 bp, Homo sapiens
actttatgccggatg

SEQ ID NO: 5172321 - DNA, 12 bp, Homo sapiens
actttatggtaa

SEQ ID NO: 5172322 - DNA, 22 bp, Homo sapiens
actttatgtagagaaaaggagg

SEQ ID NO: 5172323 - DNA, 13 bp, Homo sapiens
actttatgttcta

SEQ ID NO: 5172324 - DNA, 16 bp, Homo sapiens
actttatgttgtatga

SEQ ID NO: 5172325 - DNA, 17 bp, Homo sapiens
actttattaaaagaatg

SEQ ID NO: 5172326 - DNA, 15 bp, Homo sapiens
actttattaaataca

SEQ ID NO: 5172327 - DNA, 15 bp, Homo sapiens
actttattaacttac

SEQ ID NO: 5172328 - DNA, 17 bp, Homo sapiens
actttattaagtaaaat

SEQ ID NO: 5172329 - DNA, 15 bp, Homo sapiens
actttattacaattt

SEQ ID NO: 5172330 - DNA, 12 bp, Homo sapiens
actttattatcc

SEQ ID NO: 5172331 - DNA, 16 bp, Homo sapiens
actttattgattttct

SEQ ID NO: 5172332 - DNA, 16 bp, Homo sapiens
actttattgcaatgca

SEQ ID NO: 5172333 - DNA, 18 bp, Homo sapiens
actttattgcatatagat

SEQ ID NO: 5172334 - DNA, 19 bp, Homo sapiens
actttattgcatatagatt

SEQ ID NO: 5172335 - DNA, 13 bp, Homo sapiens
actttattgctat

SEQ ID NO: 5172336 - DNA, 22 bp, Homo sapiens
actttattgctatcgccctcct

SEQ ID NO: 5172337 - DNA, 22 bp, Homo sapiens
actttatttaaaaaagaaaaaa

SEQ ID NO: 5172338 - DNA, 16 bp, Homo sapiens
actttatttaaatgca

SEQ ID NO: 5172339 - DNA, 19 bp, Homo sapiens
actttatttaaatgcatgt

SEQ ID NO: 5172340 - DNA, 21 bp, Homo sapiens
actttatttaaatgcatgtct

SEQ ID NO: 5172341 - DNA, 15 bp, Homo sapiens
actttatttaatttc

SEQ ID NO: 5172342 - DNA, 19 bp, Homo sapiens
actttatttaatttcataa

SEQ ID NO: 5172343 - DNA, 21 bp, Homo sapiens
actttatttaatttcataaat

SEQ ID NO: 5172344 - DNA, 15 bp, Homo sapiens
actttatttatttct

SEQ ID NO: 5172345 - DNA, 17 bp, Homo sapiens
actttatttatttctag

SEQ ID NO: 5172346 - DNA, 18 bp, Homo sapiens
actttatttatttctagt

SEQ ID NO: 5172347 - DNA, 21 bp, Homo sapiens
actttatttccaagttgttca

SEQ ID NO: 5172348 - DNA, 13 bp, Homo sapiens
actttatttctga

SEQ ID NO: 5172349 - DNA, 22 bp, Homo sapiens
actttatttctgagcaaagcat

SEQ ID NO: 5172350 - DNA, 21 bp, Homo sapiens
actttattttatataataaag

SEQ ID NO: 5172351 - DNA, 12 bp, Homo sapiens
actttattttga

SEQ ID NO: 5172352 - DNA, 13 bp, Homo sapiens
actttattttgaa

SEQ ID NO: 5172353 - DNA, 17 bp, Homo sapiens
actttattttgaatgta

SEQ ID NO: 5172354 - DNA, 23 bp, Homo sapiens
actttattttgaatgtacctcta

SEQ ID NO: 5172355 - DNA, 17 bp, Homo sapiens
actttattttgcttttc

SEQ ID NO: 5172356 - DNA, 22 bp, Homo sapiens
actttattttggattgtggatg

SEQ ID NO: 5172357 - DNA, 20 bp, Homo sapiens
actttatttttctaagtgta

SEQ ID NO: 5172358 - DNA, 16 bp, Homo sapiens
actttatttttgtata

SEQ ID NO: 5172359 - DNA, 15 bp, Homo sapiens
actttcaaaatatat

SEQ ID NO: 5172360 - DNA, 16 bp, Homo sapiens
actttcaagacagatg

SEQ ID NO: 5172361 - DNA, 16 bp, Homo sapiens
actttcaagctgcact

SEQ ID NO: 5172362 - DNA, 21 bp, Homo sapiens
actttcaagtattatatttta

SEQ ID NO: 5172363 - DNA, 20 bp, Homo sapiens
actttcaattgtcacttttt

SEQ ID NO: 5172364 - DNA, 23 bp, Homo sapiens
actttcacgtggcctccgcagtg

SEQ ID NO: 5172365 - DNA, 17 bp, Homo sapiens
actttcacttcttccta

SEQ ID NO: 5172366 - DNA, 13 bp, Homo sapiens
actttcagaatgt

SEQ ID NO: 5172367 - DNA, 15 bp, Homo sapiens
actttcagattgtat

SEQ ID NO: 5172368 - DNA, 16 bp, Homo sapiens
actttcagcagtctaa

SEQ ID NO: 5172369 - DNA, 18 bp, Homo sapiens
actttcagcagtctaaat

SEQ ID NO: 5172370 - DNA, 22 bp, Homo sapiens
actttcagcagtctaaattttc

SEQ ID NO: 5172371 - DNA, 22 bp, Homo sapiens
actttcaggaaggggtgtcagt

SEQ ID NO: 5172372 - DNA, 24 bp, Homo sapiens
actttcaggctactgttcttgaca

SEQ ID NO: 5172373 - DNA, 16 bp, Homo sapiens
actttcagtaaacata

SEQ ID NO: 5172374 - DNA, 11 bp, Homo sapiens
actttcagttt

SEQ ID NO: 5172375 - DNA, 15 bp, Homo sapiens
actttcatacgtaaa

SEQ ID NO: 5172376 - DNA, 23 bp, Homo sapiens
actttcatcctgactctgccccc

SEQ ID NO: 5172377 - DNA, 15 bp, Homo sapiens
actttcatctacctt

SEQ ID NO: 5172378 - DNA, 15 bp, Homo sapiens
actttcatcttaaac

SEQ ID NO: 5172379 - DNA, 22 bp, Homo sapiens
actttcatcttaaactaatacg

SEQ ID NO: 5172380 - DNA, 18 bp, Homo sapiens
actttcattacttttaaa

SEQ ID NO: 5172381 - DNA, 20 bp, Homo sapiens
actttcattccctttcatga

SEQ ID NO: 5172382 - DNA, 17 bp, Homo sapiens
actttcattgccagtgt

SEQ ID NO: 5172383 - DNA, 20 bp, Homo sapiens
actttcattgccagtgtctt

SEQ ID NO: 5172384 - DNA, 19 bp, Homo sapiens
actttccaattctccttta

SEQ ID NO: 5172385 - DNA, 18 bp, Homo sapiens
actttccaccccctccct

SEQ ID NO: 5172386 - DNA, 20 bp, Homo sapiens
actttccaccccctccctgg

SEQ ID NO: 5172387 - DNA, 17 bp, Homo sapiens
actttccacttcttcct

SEQ ID NO: 5172388 - DNA, 18 bp, Homo sapiens
actttccacttcttcctt

SEQ ID NO: 5172389 - DNA, 15 bp, Homo sapiens
actttccatgacagt

SEQ ID NO: 5172390 - DNA, 20 bp, Homo sapiens
actttccatgacagtagcat

SEQ ID NO: 5172391 - DNA, 16 bp, Homo sapiens
actttccattaaatca

SEQ ID NO: 5172392 - DNA, 17 bp, Homo sapiens
actttccattacaagta

SEQ ID NO: 5172393 - DNA, 18 bp, Homo sapiens
actttcccacactgtgaa

SEQ ID NO: 5172394 - DNA, 13 bp, Homo sapiens
actttcccaccca

SEQ ID NO: 5172395 - DNA, 19 bp, Homo sapiens
actttcccacccaggaaag

SEQ ID NO: 5172396 - DNA, 16 bp, Homo sapiens
actttcccaggttctg

SEQ ID NO: 5172397 - DNA, 17 bp, Homo sapiens
actttccccaccagatg

SEQ ID NO: 5172398 - DNA, 19 bp, Homo sapiens
actttccccaccagatgct

SEQ ID NO: 5172399 - DNA, 23 bp, Homo sapiens
actttccccaccagatgctgaaa

SEQ ID NO: 5172400 - DNA, 10 bp, Homo sapiens
actttccccc

SEQ ID NO: 5172401 - DNA, 16 bp, Homo sapiens
actttcccccacaccc

SEQ ID NO: 5172402 - DNA, 11 bp, Homo sapiens
actttcccccc

SEQ ID NO: 5172403 - DNA, 16 bp, Homo sapiens
actttccccccaaccc

SEQ ID NO: 5172404 - DNA, 14 bp, Homo sapiens
actttcccccttcc

SEQ ID NO: 5172405 - DNA, 20 bp, Homo sapiens
actttcccccttcccgcctt

SEQ ID NO: 5172406 - DNA, 13 bp, Homo sapiens
actttcccctctc

SEQ ID NO: 5172407 - DNA, 14 bp, Homo sapiens
actttcccctctcg

SEQ ID NO: 5172408 - DNA, 19 bp, Homo sapiens
actttccctagaaagccat

SEQ ID NO: 5172409 - DNA, 21 bp, Homo sapiens
actttccctagaaagccatat

SEQ ID NO: 5172410 - DNA, 17 bp, Homo sapiens
actttcccttgcttttc

SEQ ID NO: 5172411 - DNA, 19 bp, Homo sapiens
actttcccttggctgttaa

SEQ ID NO: 5172412 - DNA, 17 bp, Homo sapiens
actttccgagcctccag

SEQ ID NO: 5172413 - DNA, 13 bp, Homo sapiens
actttcctcaaat

SEQ ID NO: 5172414 - DNA, 12 bp, Homo sapiens
actttcctctct

SEQ ID NO: 5172415 - DNA, 18 bp, Homo sapiens
actttcctcttcctgcct

SEQ ID NO: 5172416 - DNA, 12 bp, Homo sapiens
actttcctgagc

SEQ ID NO: 5172417 - DNA, 13 bp, Homo sapiens
actttcctgagct

SEQ ID NO: 5172418 - DNA, 13 bp, Homo sapiens
actttcctgatgt

SEQ ID NO: 5172419 - DNA, 22 bp, Homo sapiens
actttcctgatgttgataatag

SEQ ID NO: 5172420 - DNA, 15 bp, Homo sapiens
actttcctggataaa

SEQ ID NO: 5172421 - DNA, 18 bp, Homo sapiens
actttcctggatgtctga

SEQ ID NO: 5172422 - DNA, 23 bp, Homo sapiens
actttcctggatgtctgaacttt

SEQ ID NO: 5172423 - DNA, 16 bp, Homo sapiens
actttcgaaatttcat

SEQ ID NO: 5172424 - DNA, 20 bp, Homo sapiens
actttcgaccgactttcccc

SEQ ID NO: 5172425 - DNA, 22 bp, Homo sapiens
actttcggagaaattctcttta

SEQ ID NO: 5172426 - DNA, 18 bp, Homo sapiens
actttcgtaatagctcag

SEQ ID NO: 5172427 - DNA, 16 bp, Homo sapiens
actttcgtacattggc

SEQ ID NO: 5172428 - DNA, 20 bp, Homo sapiens
actttcgtatcataatttct

SEQ ID NO: 5172429 - DNA, 13 bp, Homo sapiens
actttctacatgc

SEQ ID NO: 5172430 - DNA, 16 bp, Homo sapiens
actttctagccagagg

SEQ ID NO: 5172431 - DNA, 21 bp, Homo sapiens
actttctattaatatttatgt

SEQ ID NO: 5172432 - DNA, 19 bp, Homo sapiens
actttctattttaatcttg

SEQ ID NO: 5172433 - DNA, 18 bp, Homo sapiens
actttctcactgctgtca

SEQ ID NO: 5172434 - DNA, 12 bp, Homo sapiens
actttctcagca

SEQ ID NO: 5172435 - DNA, 18 bp, Homo sapiens
actttctcagcatatata

SEQ ID NO: 5172436 - DNA, 19 bp, Homo sapiens
actttctcagcatatatat

SEQ ID NO: 5172437 - DNA, 16 bp, Homo sapiens
actttctcctggtgtt

SEQ ID NO: 5172438 - DNA, 15 bp, Homo sapiens
actttctctaataat

SEQ ID NO: 5172439 - DNA, 15 bp, Homo sapiens
actttctctctcttt

SEQ ID NO: 5172440 - DNA, 16 bp, Homo sapiens
actttctctgccatca

SEQ ID NO: 5172441 - DNA, 14 bp, Homo sapiens
actttctctgtgaa

SEQ ID NO: 5172442 - DNA, 13 bp, Homo sapiens
actttctcttaag

SEQ ID NO: 5172443 - DNA, 22 bp, Homo sapiens
actttctcttaagattaatttt

SEQ ID NO: 5172444 - DNA, 15 bp, Homo sapiens
actttctcttgtaaa

SEQ ID NO: 5172445 - DNA, 14 bp, Homo sapiens
actttctctttgcc

SEQ ID NO: 5172446 - DNA, 20 bp, Homo sapiens
actttctgaaaatttatata

SEQ ID NO: 5172447 - DNA, 14 bp, Homo sapiens
actttctgaaataa

SEQ ID NO: 5172448 - DNA, 19 bp, Homo sapiens
actttctgaaattcacaaa

SEQ ID NO: 5172449 - DNA, 14 bp, Homo sapiens
actttctgactgca

SEQ ID NO: 5172450 - DNA, 13 bp, Homo sapiens
actttctgcctgg

SEQ ID NO: 5172451 - DNA, 13 bp, Homo sapiens
actttctgctttg

SEQ ID NO: 5172452 - DNA, 22 bp, Homo sapiens
actttctggtggcaaatgaatt

SEQ ID NO: 5172453 - DNA, 18 bp, Homo sapiens
actttctgtaaactcaaa

SEQ ID NO: 5172454 - DNA, 20 bp, Homo sapiens
actttctgtactaaacattt

SEQ ID NO: 5172455 - DNA, 22 bp, Homo sapiens
actttctgtctaggttaaagct

SEQ ID NO: 5172456 - DNA, 17 bp, Homo sapiens
actttctgtctcaaacc

SEQ ID NO: 5172457 - DNA, 17 bp, Homo sapiens
actttctgttaaaatgc

SEQ ID NO: 5172458 - DNA, 22 bp, Homo sapiens
actttctgttaaaatgcatgat

SEQ ID NO: 5172459 - DNA, 14 bp, Homo sapiens
actttctgttatgg

SEQ ID NO: 5172460 - DNA, 19 bp, Homo sapiens
actttctgttccctatgga

SEQ ID NO: 5172461 - DNA, 19 bp, Homo sapiens
actttctgttgccacaacc

SEQ ID NO: 5172462 - DNA, 14 bp, Homo sapiens
actttctgttttct

SEQ ID NO: 5172463 - DNA, 12 bp, Homo sapiens
actttcttaaaa

SEQ ID NO: 5172464 - DNA, 16 bp, Homo sapiens
actttcttattttgct

SEQ ID NO: 5172465 - DNA, 12 bp, Homo sapiens
actttcttcaaa

SEQ ID NO: 5172466 - DNA, 14 bp, Homo sapiens
actttcttcaaaat

SEQ ID NO: 5172467 - DNA, 23 bp, Homo sapiens
actttcttctaccagacccttct

SEQ ID NO: 5172468 - DNA, 20 bp, Homo sapiens
actttcttctgaatatttta

SEQ ID NO: 5172469 - DNA, 17 bp, Homo sapiens
actttcttttattaata

SEQ ID NO: 5172470 - DNA, 18 bp, Homo sapiens
actttcttttattaatat

SEQ ID NO: 5172471 - DNA, 21 bp, Homo sapiens
actttcttttattaatatatg

SEQ ID NO: 5172472 - DNA, 17 bp, Homo sapiens
actttctttttctacat

SEQ ID NO: 5172473 - DNA, 20 bp, Homo sapiens
actttctttttctacatgtg

SEQ ID NO: 5172474 - DNA, 21 bp, Homo sapiens
actttctttttctacatgtga

SEQ ID NO: 5172475 - DNA, 11 bp, Homo sapiens
actttgaaaac

SEQ ID NO: 5172476 - DNA, 13 bp, Homo sapiens
actttgaaaactg

SEQ ID NO: 5172477 - DNA, 17 bp, Homo sapiens
actttgaaaatatttct

SEQ ID NO: 5172478 - DNA, 23 bp, Homo sapiens
actttgaaagttaactcttcaaa

SEQ ID NO: 5172479 - DNA, 14 bp, Homo sapiens
actttgaaatacct

SEQ ID NO: 5172480 - DNA, 23 bp, Homo sapiens
actttgaaatacctcatgtttat

SEQ ID NO: 5172481 - DNA, 11 bp, Homo sapiens
agacaggcagc

SEQ ID NO: 5172482 - DNA, 19 bp, Homo sapiens
agacaggcagggagggctt

SEQ ID NO: 5172483 - DNA, 18 bp, Homo sapiens
agacaggcccaagagatg

SEQ ID NO: 5172484 - DNA, 19 bp, Homo sapiens
agacaggcgctggacagag

SEQ ID NO: 5172485 - DNA, 15 bp, Homo sapiens
agacaggctgagctt

SEQ ID NO: 5172486 - DNA, 21 bp, Homo sapiens
agacaggctggtatttaacag

SEQ ID NO: 5172487 - DNA, 21 bp, Homo sapiens
agacagggaattaggccccca

SEQ ID NO: 5172488 - DNA, 22 bp, Homo sapiens
agacagggaattaggcccccat

SEQ ID NO: 5172489 - DNA, 13 bp, Homo sapiens
agacagggagaag

SEQ ID NO: 5172490 - DNA, 15 bp, Homo sapiens
agacagggagaagtt

SEQ ID NO: 5172491 - DNA, 11 bp, Homo sapiens
agacagggcaa

SEQ ID NO: 5172492 - DNA, 17 bp, Homo sapiens
agacagggcgtcctctc

SEQ ID NO: 5172493 - DNA, 15 bp, Homo sapiens
agacagggctccagc

SEQ ID NO: 5172494 - DNA, 16 bp, Homo sapiens
agacagggctccagcc

SEQ ID NO: 5172495 - DNA, 18 bp, Homo sapiens
agacagggctccagcctg

SEQ ID NO: 5172496 - DNA, 19 bp, Homo sapiens
agacagggtaggaaagggc

SEQ ID NO: 5172497 - DNA, 23 bp, Homo sapiens
agacagggtctcactctgtcgct

SEQ ID NO: 5172498 - DNA, 23 bp, Homo sapiens
agacagggtctcactgtgttgcc

SEQ ID NO: 5172499 - DNA, 13 bp, Homo sapiens
agacagggtggga

SEQ ID NO: 5172500 - DNA, 19 bp, Homo sapiens
agacagggtgggcttcctg

SEQ ID NO: 5172501 - DNA, 21 bp, Homo sapiens
agacagggtgggcttcctgcc

SEQ ID NO: 5172502 - DNA, 14 bp, Homo sapiens
agacagggtggggc

SEQ ID NO: 5172503 - DNA, 23 bp, Homo sapiens
agacagggtggggcttagaatgg

SEQ ID NO: 5172504 - DNA, 21 bp, Homo sapiens
agacagggttttgccatgttg

SEQ ID NO: 5172505 - DNA, 22 bp, Homo sapiens
agacaggtccctccccttctct

SEQ ID NO: 5172506 - DNA, 15 bp, Homo sapiens
agacaggtctagact

SEQ ID NO: 5172507 - DNA, 17 bp, Homo sapiens
agacaggtggaaaaact

SEQ ID NO: 5172508 - DNA, 19 bp, Homo sapiens
agacaggtgggagatggag

SEQ ID NO: 5172509 - DNA, 14 bp, Homo sapiens
agacagtaagagtt

SEQ ID NO: 5172510 - DNA, 19 bp, Homo sapiens
agacagtaagagtttacaa

SEQ ID NO: 5172511 - DNA, 17 bp, Homo sapiens
agacagtaagtatcttc

SEQ ID NO: 5172512 - DNA, 17 bp, Homo sapiens
agacagtagaggcatga

SEQ ID NO: 5172513 - DNA, 14 bp, Homo sapiens
agacagtatacagt

SEQ ID NO: 5172514 - DNA, 18 bp, Homo sapiens
agacagtatataactaac

SEQ ID NO: 5172515 - DNA, 22 bp, Homo sapiens
agacagtatgagtcaatgtgca

SEQ ID NO: 5172516 - DNA, 15 bp, Homo sapiens
agacagtattgccac

SEQ ID NO: 5172517 - DNA, 21 bp, Homo sapiens
agacagtattgccacctctgg

SEQ ID NO: 5172518 - DNA, 17 bp, Homo sapiens
agacagtatttattggt

SEQ ID NO: 5172519 - DNA, 19 bp, Homo sapiens
agacagtatttattggtgg

SEQ ID NO: 5172520 - DNA, 23 bp, Homo sapiens
agacagtatttattggtgggttg

SEQ ID NO: 5172521 - DNA, 20 bp, Homo sapiens
agacagtcaaggagtggctt

SEQ ID NO: 5172522 - DNA, 21 bp, Homo sapiens
agacagtcaggaagcctcctg

SEQ ID NO: 5172523 - DNA, 17 bp, Homo sapiens
agacagtccagcctgga

SEQ ID NO: 5172524 - DNA, 13 bp, Homo sapiens
agacagtccctgc

SEQ ID NO: 5172525 - DNA, 14 bp, Homo sapiens
agacagtccctgcc

SEQ ID NO: 5172526 - DNA, 19 bp, Homo sapiens
agacagtcgctcagtctgt

SEQ ID NO: 5172527 - DNA, 22 bp, Homo sapiens
agacagtcgctcagtctgttca

SEQ ID NO: 5172528 - DNA, 21 bp, Homo sapiens
agacagtctgttatgcactgt

SEQ ID NO: 5172529 - DNA, 12 bp, Homo sapiens
agacagtcttgc

SEQ ID NO: 5172530 - DNA, 15 bp, Homo sapiens
agacagtgatctcca

SEQ ID NO: 5172531 - DNA, 11 bp, Homo sapiens
agacagtgccc

SEQ ID NO: 5172532 - DNA, 18 bp, Homo sapiens
agacagtggatatgaccc

SEQ ID NO: 5172533 - DNA, 22 bp, Homo sapiens
agacagtggatcatgaaaagtg

SEQ ID NO: 5172534 - DNA, 17 bp, Homo sapiens
agacagtggcactaaaa

SEQ ID NO: 5172535 - DNA, 20 bp, Homo sapiens
agacagtggcagcaaaggaa

SEQ ID NO: 5172536 - DNA, 21 bp, Homo sapiens
agacagtggcagcaaaggaag

SEQ ID NO: 5172537 - DNA, 22 bp, Homo sapiens
agacagtggcagcaaaggaaga

SEQ ID NO: 5172538 - DNA, 14 bp, Homo sapiens
agacagtgggaaat

SEQ ID NO: 5172539 - DNA, 20 bp, Homo sapiens
agacagtggtagagaggttt

SEQ ID NO: 5172540 - DNA, 17 bp, Homo sapiens
agacagtgtatgtagaa

SEQ ID NO: 5172541 - DNA, 13 bp, Homo sapiens
agacagtgtgtgt

SEQ ID NO: 5172542 - DNA, 15 bp, Homo sapiens
agacagttcaagaaa

SEQ ID NO: 5172543 - DNA, 14 bp, Homo sapiens
agacagttgggttt

SEQ ID NO: 5172544 - DNA, 14 bp, Homo sapiens
agacagtttcttag

SEQ ID NO: 5172545 - DNA, 21 bp, Homo sapiens
agacagtttcttagcttttta

SEQ ID NO: 5172546 - DNA, 22 bp, Homo sapiens
agacagtttcttgcaagctcca

SEQ ID NO: 5172547 - DNA, 11 bp, Homo sapiens
agacagtttgt

SEQ ID NO: 5172548 - DNA, 14 bp, Homo sapiens
agacagtttgtaaa

SEQ ID NO: 5172549 - DNA, 18 bp, Homo sapiens
agacagtttgtaaatgtt

SEQ ID NO: 5172550 - DNA, 21 bp, Homo sapiens
agacagtttgtaaatgttatt

SEQ ID NO: 5172551 - DNA, 20 bp, Homo sapiens
agacagttttgagaacgtaa

SEQ ID NO: 5172552 - DNA, 17 bp, Homo sapiens
agacataaaacagaatt

SEQ ID NO: 5172553 - DNA, 12 bp, Homo sapiens
agacataaaact

SEQ ID NO: 5172554 - DNA, 13 bp, Homo sapiens
agacataaaactt

SEQ ID NO: 5172555 - DNA, 22 bp, Homo sapiens
agacataaaactttaaaaggca

SEQ ID NO: 5172556 - DNA, 23 bp, Homo sapiens
agacataaaactttaaaaggcaa

SEQ ID NO: 5172557 - DNA, 14 bp, Homo sapiens
agacataaacaaag

SEQ ID NO: 5172558 - DNA, 13 bp, Homo sapiens
agacataaagcca

SEQ ID NO: 5172559 - DNA, 15 bp, Homo sapiens
agacataaaggaaaa

SEQ ID NO: 5172560 - DNA, 13 bp, Homo sapiens
agacataaattgt

SEQ ID NO: 5172561 - DNA, 18 bp, Homo sapiens
agacataaattgtaattt

SEQ ID NO: 5172562 - DNA, 18 bp, Homo sapiens
agacataaccactgcttc

SEQ ID NO: 5172563 - DNA, 13 bp, Homo sapiens
agacataactggt

SEQ ID NO: 5172564 - DNA, 15 bp, Homo sapiens
agacataatttaaaa

SEQ ID NO: 5172565 - DNA, 21 bp, Homo sapiens
agacatacagagatatacaaa

SEQ ID NO: 5172566 - DNA, 15 bp, Homo sapiens
agacatactgcttga

SEQ ID NO: 5172567 - DNA, 16 bp, Homo sapiens
agacatacttgaaggg

SEQ ID NO: 5172568 - DNA, 20 bp, Homo sapiens
agacatacttgaagggccag

SEQ ID NO: 5172569 - DNA, 14 bp, Homo sapiens
agacatagaattaa

SEQ ID NO: 5172570 - DNA, 21 bp, Homo sapiens
agacatagaattaacacatga

SEQ ID NO: 5172571 - DNA, 22 bp, Homo sapiens
agacatagccgattctctgccc

SEQ ID NO: 5172572 - DNA, 18 bp, Homo sapiens
agacatagtctctaccta

SEQ ID NO: 5172573 - DNA, 19 bp, Homo sapiens
agacatataccaaaaacaa

SEQ ID NO: 5172574 - DNA, 17 bp, Homo sapiens
agacatatcactgctgc

SEQ ID NO: 5172575 - DNA, 23 bp, Homo sapiens
agacatatgggatattcccaagc

SEQ ID NO: 5172576 - DNA, 16 bp, Homo sapiens
agacatatttaactgg

SEQ ID NO: 5172577 - DNA, 22 bp, Homo sapiens
agacatcaagatacacttgtaa

SEQ ID NO: 5172578 - DNA, 17 bp, Homo sapiens
agacatcaagcacagaa

SEQ ID NO: 5172579 - DNA, 14 bp, Homo sapiens
agacatcaatgaaa

SEQ ID NO: 5172580 - DNA, 17 bp, Homo sapiens
agacatcaccctttgcc

SEQ ID NO: 5172581 - DNA, 14 bp, Homo sapiens
agacatcagggagt

SEQ ID NO: 5172582 - DNA, 17 bp, Homo sapiens
agacatcagtattctgc

SEQ ID NO: 5172583 - DNA, 20 bp, Homo sapiens
agacatcattgtcagccttg

SEQ ID NO: 5172584 - DNA, 16 bp, Homo sapiens
agacatccacaatgga

SEQ ID NO: 5172585 - DNA, 22 bp, Homo sapiens
agacatccataaagaagcaata

SEQ ID NO: 5172586 - DNA, 17 bp, Homo sapiens
agacatccatgtttgta

SEQ ID NO: 5172587 - DNA, 18 bp, Homo sapiens
agacatccatgtttgtaa

SEQ ID NO: 5172588 - DNA, 21 bp, Homo sapiens
agacatccctcatctagtctt

SEQ ID NO: 5172589 - DNA, 22 bp, Homo sapiens
agacatcctgggcagcttgggc

SEQ ID NO: 5172590 - DNA, 21 bp, Homo sapiens
agacatcgatatacatttatt

SEQ ID NO: 5172591 - DNA, 17 bp, Homo sapiens
agacatctccagtgtgc

SEQ ID NO: 5172592 - DNA, 18 bp, Homo sapiens
agacatctccagtgtgcc

SEQ ID NO: 5172593 - DNA, 14 bp, Homo sapiens
agacatctctggag

SEQ ID NO: 5172594 - DNA, 20 bp, Homo sapiens
agacatctctggagccagag

SEQ ID NO: 5172595 - DNA, 14 bp, Homo sapiens
agacatctgaggaa

SEQ ID NO: 5172596 - DNA, 14 bp, Homo sapiens
agacatctgcaccc

SEQ ID NO: 5172597 - DNA, 14 bp, Homo sapiens
agacatctgcctgt

SEQ ID NO: 5172598 - DNA, 15 bp, Homo sapiens
agacatctgcctgta

SEQ ID NO: 5172599 - DNA, 15 bp, Homo sapiens
agacatctgctgtta

SEQ ID NO: 5172600 - DNA, 12 bp, Homo sapiens
agacatctgtag

SEQ ID NO: 5172601 - DNA, 12 bp, Homo sapiens
agacatctttaa

SEQ ID NO: 5172602 - DNA, 13 bp, Homo sapiens
agacatctttctc

SEQ ID NO: 5172603 - DNA, 18 bp, Homo sapiens
agacatgaaaactatttt

SEQ ID NO: 5172604 - DNA, 20 bp, Homo sapiens
agacatgaaaactattttaa

SEQ ID NO: 5172605 - DNA, 12 bp, Homo sapiens
agacatgaaata

SEQ ID NO: 5172606 - DNA, 18 bp, Homo sapiens
agacatgaaatgtacatg

SEQ ID NO: 5172607 - DNA, 13 bp, Homo sapiens
agacatgaagcca

SEQ ID NO: 5172608 - DNA, 12 bp, Homo sapiens
agacatgaatac

SEQ ID NO: 5172609 - DNA, 17 bp, Homo sapiens
agacatgaatatgatta

SEQ ID NO: 5172610 - DNA, 20 bp, Homo sapiens
agacatgagtgcgtgctcag

SEQ ID NO: 5172611 - DNA, 22 bp, Homo sapiens
agacatgctctttttttaagtg

SEQ ID NO: 5172612 - DNA, 13 bp, Homo sapiens
agacatgctgccc

SEQ ID NO: 5172613 - DNA, 18 bp, Homo sapiens
agacatgctgcccacccc

SEQ ID NO: 5172614 - DNA, 17 bp, Homo sapiens
agacatgcttacttttt

SEQ ID NO: 5172615 - DNA, 22 bp, Homo sapiens
agacatggaagattagaggttt

SEQ ID NO: 5172616 - DNA, 14 bp, Homo sapiens
agacatggaaggtt

SEQ ID NO: 5172617 - DNA, 17 bp, Homo sapiens
agacatggaaggttagg

SEQ ID NO: 5172618 - DNA, 18 bp, Homo sapiens
agacatggaccagcatct

SEQ ID NO: 5172619 - DNA, 15 bp, Homo sapiens
agacatggagatgta

SEQ ID NO: 5172620 - DNA, 16 bp, Homo sapiens
agacatggcttgccac

SEQ ID NO: 5172621 - DNA, 20 bp, Homo sapiens
agacatggctttcagaaaac

SEQ ID NO: 5172622 - DNA, 22 bp, Homo sapiens
agacatgggctatcagggagga

SEQ ID NO: 5172623 - DNA, 16 bp, Homo sapiens
agacatggggaggaag

SEQ ID NO: 5172624 - DNA, 18 bp, Homo sapiens
agacatggggaggaagga

SEQ ID NO: 5172625 - DNA, 21 bp, Homo sapiens
agacatgtaatttgtgtaaat

SEQ ID NO: 5172626 - DNA, 16 bp, Homo sapiens
agacatgtaggtgttt

SEQ ID NO: 5172627 - DNA, 17 bp, Homo sapiens
agacatgtgaggaggaa

SEQ ID NO: 5172628 - DNA, 20 bp, Homo sapiens
agacatgtgaggaggaaaag

SEQ ID NO: 5172629 - DNA, 21 bp, Homo sapiens
agacatgtgaggaggaaaagg

SEQ ID NO: 5172630 - DNA, 15 bp, Homo sapiens
agacatgtggcagca

SEQ ID NO: 5172631 - DNA, 15 bp, Homo sapiens
agacatgtgtcaaca

SEQ ID NO: 5172632 - DNA, 17 bp, Homo sapiens
agacatgttttagacaa

SEQ ID NO: 5172633 - DNA, 22 bp, Homo sapiens
agacattaaatctatgaagtat

SEQ ID NO: 5172634 - DNA, 20 bp, Homo sapiens
agacattaactcattagact

SEQ ID NO: 5172635 - DNA, 19 bp, Homo sapiens
agacattaagaagagcaga

SEQ ID NO: 5172636 - DNA, 20 bp, Homo sapiens
agacattaagagaacaaaga

SEQ ID NO: 5172637 - DNA, 17 bp, Homo sapiens
agacattaatttgtacc

SEQ ID NO: 5172638 - DNA, 19 bp, Homo sapiens
agacattcaccaacaacag

SEQ ID NO: 5172639 - DNA, 15 bp, Homo sapiens
agacattcagactaa

SEQ ID NO: 5172640 - DNA, 17 bp, Homo sapiens
agacattccaaaacgaa

SEQ ID NO: 5172641 - DNA, 19 bp, Homo sapiens
agacattctcacataagcc

SEQ ID NO: 5172642 - DNA, 20 bp, Homo sapiens
agacattctcgcttccctga

SEQ ID NO: 5172643 - DNA, 23 bp, Homo sapiens
agacattctcttactttttgtaa

SEQ ID NO: 5172644 - DNA, 15 bp, Homo sapiens
agacattctgccagg

SEQ ID NO: 5172645 - DNA, 19 bp, Homo sapiens
agacattctgccaggcccc

SEQ ID NO: 5172646 - DNA, 13 bp, Homo sapiens
agacattctggtg

SEQ ID NO: 5172647 - DNA, 12 bp, Homo sapiens
agacattctgtc

SEQ ID NO: 5172648 - DNA, 18 bp, Homo sapiens
agacattctgtctttcaa

SEQ ID NO: 5172649 - DNA, 16 bp, Homo sapiens
agacattcttttaatg

SEQ ID NO: 5172650 - DNA, 21 bp, Homo sapiens
agacattgcaattttgcatag

SEQ ID NO: 5172651 - DNA, 12 bp, Homo sapiens
agacattgcacc

SEQ ID NO: 5172652 - DNA, 14 bp, Homo sapiens
agacattgcctcca

SEQ ID NO: 5172653 - DNA, 19 bp, Homo sapiens
agacattgggtctattcca

SEQ ID NO: 5172654 - DNA, 14 bp, Homo sapiens
agacattgtaaata

SEQ ID NO: 5172655 - DNA, 14 bp, Homo sapiens
agacattgtatttt

SEQ ID NO: 5172656 - DNA, 16 bp, Homo sapiens
agacattgtcaataaa

SEQ ID NO: 5172657 - DNA, 13 bp, Homo sapiens
agacattgtcagc

SEQ ID NO: 5172658 - DNA, 23 bp, Homo sapiens
agacattgttttgccaacattgc

SEQ ID NO: 5172659 - DNA, 18 bp, Homo sapiens
agacattgtttttaaaaa

SEQ ID NO: 5172660 - DNA, 15 bp, Homo sapiens
actttgaacacatct

SEQ ID NO: 5172661 - DNA, 18 bp, Homo sapiens
actttgaacattaatgtt

SEQ ID NO: 5172662 - DNA, 23 bp, Homo sapiens
actttgaactcctcaagggcaga

SEQ ID NO: 5172663 - DNA, 16 bp, Homo sapiens
actttgaactgaaact

SEQ ID NO: 5172664 - DNA, 21 bp, Homo sapiens
actttgaagcaaatacaattc

SEQ ID NO: 5172665 - DNA, 19 bp, Homo sapiens
actttgaagggcaagaaat

SEQ ID NO: 5172666 - DNA, 23 bp, Homo sapiens
actttgaagtgcagctcatgttt

SEQ ID NO: 5172667 - DNA, 14 bp, Homo sapiens
actttgaataaaga

SEQ ID NO: 5172668 - DNA, 15 bp, Homo sapiens
actttgaataaagaa

SEQ ID NO: 5172669 - DNA, 21 bp, Homo sapiens
actttgaataaagaatacttg

SEQ ID NO: 5172670 - DNA, 23 bp, Homo sapiens
actttgaataaagaatacttgaa

SEQ ID NO: 5172671 - DNA, 21 bp, Homo sapiens
actttgaatagtcctaaaaag

SEQ ID NO: 5172672 - DNA, 12 bp, Homo sapiens
actttgaatgtg

SEQ ID NO: 5172673 - DNA, 22 bp, Homo sapiens
actttgaatgtgtttcacagtt

SEQ ID NO: 5172674 - DNA, 13 bp, Homo sapiens
actttgaatgttg

SEQ ID NO: 5172675 - DNA, 15 bp, Homo sapiens
actttgaatttatat

SEQ ID NO: 5172676 - DNA, 14 bp, Homo sapiens
actttgacaaggaa

SEQ ID NO: 5172677 - DNA, 18 bp, Homo sapiens
actttgacacttttcata

SEQ ID NO: 5172678 - DNA, 18 bp, Homo sapiens
actttgacagtgttttta

SEQ ID NO: 5172679 - DNA, 13 bp, Homo sapiens
actttgacctctg

SEQ ID NO: 5172680 - DNA, 19 bp, Homo sapiens
actttgacctctgcagcaa

SEQ ID NO: 5172681 - DNA, 20 bp, Homo sapiens
actttgactttttgcattta

SEQ ID NO: 5172682 - DNA, 14 bp, Homo sapiens
actttgagaagatg

SEQ ID NO: 5172683 - DNA, 23 bp, Homo sapiens
actttgagaatcccaattattta

SEQ ID NO: 5172684 - DNA, 16 bp, Homo sapiens
actttgagaccagcca

SEQ ID NO: 5172685 - DNA, 16 bp, Homo sapiens
actttgagatctaaaa

SEQ ID NO: 5172686 - DNA, 18 bp, Homo sapiens
actttgagatctaaaaat

SEQ ID NO: 5172687 - DNA, 23 bp, Homo sapiens
actttgagatgtgttcctcctgc

SEQ ID NO: 5172688 - DNA, 20 bp, Homo sapiens
actttgagcatttttaaggg

SEQ ID NO: 5172689 - DNA, 14 bp, Homo sapiens
actttgaggaggaa

SEQ ID NO: 5172690 - DNA, 20 bp, Homo sapiens
actttgaggaggaagcagaa

SEQ ID NO: 5172691 - DNA, 21 bp, Homo sapiens
actttgaggataactttttaa

SEQ ID NO: 5172692 - DNA, 21 bp, Homo sapiens
actttgaggcagcgcattgtt

SEQ ID NO: 5172693 - DNA, 16 bp, Homo sapiens
actttgagtacagata

SEQ ID NO: 5172694 - DNA, 14 bp, Homo sapiens
actttgataaagta

SEQ ID NO: 5172695 - DNA, 20 bp, Homo sapiens
actttgatactaccagggtc

SEQ ID NO: 5172696 - DNA, 11 bp, Homo sapiens
actttgatgtc

SEQ ID NO: 5172697 - DNA, 14 bp, Homo sapiens
actttgatgtcatg

SEQ ID NO: 5172698 - DNA, 21 bp, Homo sapiens
actttgatgtcatgtgttccc

SEQ ID NO: 5172699 - DNA, 15 bp, Homo sapiens
actttgatgtgtttt

SEQ ID NO: 5172700 - DNA, 20 bp, Homo sapiens
actttgatgtgtttttgtat

SEQ ID NO: 5172701 - DNA, 19 bp, Homo sapiens
actttgattcacatgtttt

SEQ ID NO: 5172702 - DNA, 20 bp, Homo sapiens
actttgattccattttaagt

SEQ ID NO: 5172703 - DNA, 14 bp, Homo sapiens
actttgattctgat

SEQ ID NO: 5172704 - DNA, 22 bp, Homo sapiens
actttgatttacagtgcctgta

SEQ ID NO: 5172705 - DNA, 12 bp, Homo sapiens
actttgcaaatt

SEQ ID NO: 5172706 - DNA, 14 bp, Homo sapiens
actttgcaaattat

SEQ ID NO: 5172707 - DNA, 18 bp, Homo sapiens
actttgcaaattatttat

SEQ ID NO: 5172708 - DNA, 20 bp, Homo sapiens
actttgcaaattatttatta

SEQ ID NO: 5172709 - DNA, 20 bp, Homo sapiens
actttgcaatccaaataaag

SEQ ID NO: 5172710 - DNA, 15 bp, Homo sapiens
actttgcacacttca

SEQ ID NO: 5172711 - DNA, 14 bp, Homo sapiens
actttgcacatttt

SEQ ID NO: 5172712 - DNA, 15 bp, Homo sapiens
actttgcacattttg

SEQ ID NO: 5172713 - DNA, 21 bp, Homo sapiens
actttgcactgatatatcatg

SEQ ID NO: 5172714 - DNA, 17 bp, Homo sapiens
actttgcagacctggga

SEQ ID NO: 5172715 - DNA, 22 bp, Homo sapiens
actttgcagcacagctgagagg

SEQ ID NO: 5172716 - DNA, 21 bp, Homo sapiens
actttgcaggcggccctcagt

SEQ ID NO: 5172717 - DNA, 15 bp, Homo sapiens
actttgcataaatta

SEQ ID NO: 5172718 - DNA, 16 bp, Homo sapiens
actttgcatctcagta

SEQ ID NO: 5172719 - DNA, 15 bp, Homo sapiens
actttgcatgttctt

SEQ ID NO: 5172720 - DNA, 17 bp, Homo sapiens
actttgccaaggctctc

SEQ ID NO: 5172721 - DNA, 14 bp, Homo sapiens
actttgccactgct

SEQ ID NO: 5172722 - DNA, 18 bp, Homo sapiens
actttgccactgctgtat

SEQ ID NO: 5172723 - DNA, 21 bp, Homo sapiens
actttgcccagggtcctgtgc

SEQ ID NO: 5172724 - DNA, 22 bp, Homo sapiens
actttgcccagggtcctgtgcc

SEQ ID NO: 5172725 - DNA, 23 bp, Homo sapiens
actttgcccagggtcctgtgcct

SEQ ID NO: 5172726 - DNA, 21 bp, Homo sapiens
actttgccccagttacaaaaa

SEQ ID NO: 5172727 - DNA, 23 bp, Homo sapiens
actttgcccccttgcccatcagc

SEQ ID NO: 5172728 - DNA, 16 bp, Homo sapiens
actttgccctatgaca

SEQ ID NO: 5172729 - DNA, 15 bp, Homo sapiens
actttgcctcaagac

SEQ ID NO: 5172730 - DNA, 15 bp, Homo sapiens
actttgccttaagtt

SEQ ID NO: 5172731 - DNA, 16 bp, Homo sapiens
actttgccttctggtt

SEQ ID NO: 5172732 - DNA, 20 bp, Homo sapiens
actttgctaaagacatgaag

SEQ ID NO: 5172733 - DNA, 16 bp, Homo sapiens
actttgctacgaagaa

SEQ ID NO: 5172734 - DNA, 13 bp, Homo sapiens
actttgctcctca

SEQ ID NO: 5172735 - DNA, 20 bp, Homo sapiens
actttgctctcaattaaagt

SEQ ID NO: 5172736 - DNA, 15 bp, Homo sapiens
actttgctctcttct

SEQ ID NO: 5172737 - DNA, 17 bp, Homo sapiens
actttgctctttcttga

SEQ ID NO: 5172738 - DNA, 19 bp, Homo sapiens
actttgctgcattttacac

SEQ ID NO: 5172739 - DNA, 22 bp, Homo sapiens
actttgctggaaaatctgtaaa

SEQ ID NO: 5172740 - DNA, 15 bp, Homo sapiens
actttgctgttactg

SEQ ID NO: 5172741 - DNA, 16 bp, Homo sapiens
actttgctgttactgc

SEQ ID NO: 5172742 - DNA, 12 bp, Homo sapiens
actttgcttcat

SEQ ID NO: 5172743 - DNA, 13 bp, Homo sapiens
actttgcttcata

SEQ ID NO: 5172744 - DNA, 20 bp, Homo sapiens
actttgcttcatagtattgg

SEQ ID NO: 5172745 - DNA, 23 bp, Homo sapiens
actttgcttccgccactcagcca

SEQ ID NO: 5172746 - DNA, 13 bp, Homo sapiens
actttgcttctcc

SEQ ID NO: 5172747 - DNA, 13 bp, Homo sapiens
actttgcttctct

SEQ ID NO: 5172748 - DNA, 17 bp, Homo sapiens
actttgcttctctccac

SEQ ID NO: 5172749 - DNA, 14 bp, Homo sapiens
actttgcttgatta

SEQ ID NO: 5172750 - DNA, 16 bp, Homo sapiens
actttgcttgattaaa

SEQ ID NO: 5172751 - DNA, 20 bp, Homo sapiens
actttgcttgcagtagattt

SEQ ID NO: 5172752 - DNA, 15 bp, Homo sapiens
actttgcttgctttg

SEQ ID NO: 5172753 - DNA, 21 bp, Homo sapiens
actttgctttaatataaatgc

SEQ ID NO: 5172754 - DNA, 15 bp, Homo sapiens
actttgctttcatga

SEQ ID NO: 5172755 - DNA, 11 bp, Homo sapiens
actttggaaaa

SEQ ID NO: 5172756 - DNA, 23 bp, Homo sapiens
actttggaaaatatttttttcct

SEQ ID NO: 5172757 - DNA, 18 bp, Homo sapiens
actttggaaaatgcattg

SEQ ID NO: 5172758 - DNA, 14 bp, Homo sapiens
actttggaaagact

SEQ ID NO: 5172759 - DNA, 13 bp, Homo sapiens
actttggaaagag

SEQ ID NO: 5172760 - DNA, 14 bp, Homo sapiens
actttggaaagagt

SEQ ID NO: 5172761 - DNA, 21 bp, Homo sapiens
actttggaaccagactcttgc

SEQ ID NO: 5172762 - DNA, 23 bp, Homo sapiens
actttggaaccagactcttgcct

SEQ ID NO: 5172763 - DNA, 13 bp, Homo sapiens
actttggaagttt

SEQ ID NO: 5172764 - DNA, 17 bp, Homo sapiens
actttggaagtttgtgt

SEQ ID NO: 5172765 - DNA, 21 bp, Homo sapiens
actttggaagtttgtgttctg

SEQ ID NO: 5172766 - DNA, 15 bp, Homo sapiens
actttggaatttgca

SEQ ID NO: 5172767 - DNA, 17 bp, Homo sapiens
actttggaatttgcacc

SEQ ID NO: 5172768 - DNA, 16 bp, Homo sapiens
actttggacagtggcc

SEQ ID NO: 5172769 - DNA, 21 bp, Homo sapiens
actttggagagggaaaatctt

SEQ ID NO: 5172770 - DNA, 17 bp, Homo sapiens
actttggataataagga

SEQ ID NO: 5172771 - DNA, 19 bp, Homo sapiens
actttggataataaggaaa

SEQ ID NO: 5172772 - DNA, 18 bp, Homo sapiens
actttggcaatttcctgg

SEQ ID NO: 5172773 - DNA, 13 bp, Homo sapiens
actttggctgcat

SEQ ID NO: 5172774 - DNA, 19 bp, Homo sapiens
actttggcttacatttgaa

SEQ ID NO: 5172775 - DNA, 18 bp, Homo sapiens
actttggcttctcctgtg

SEQ ID NO: 5172776 - DNA, 20 bp, Homo sapiens
actttggcttctcctgtgac

SEQ ID NO: 5172777 - DNA, 19 bp, Homo sapiens
actttgggaaaacatgtta

SEQ ID NO: 5172778 - DNA, 16 bp, Homo sapiens
actttgggaggccaag

SEQ ID NO: 5172779 - DNA, 23 bp, Homo sapiens
actttgggcttagtatttctcag

SEQ ID NO: 5172780 - DNA, 15 bp, Homo sapiens
actttggggaaggga

SEQ ID NO: 5172781 - DNA, 18 bp, Homo sapiens
actttgggtttttaactc

SEQ ID NO: 5172782 - DNA, 21 bp, Homo sapiens
actttgggtttttaactcatc

SEQ ID NO: 5172783 - DNA, 12 bp, Homo sapiens
actttggtaatg

SEQ ID NO: 5172784 - DNA, 19 bp, Homo sapiens
actttggtacatggccagt

SEQ ID NO: 5172785 - DNA, 22 bp, Homo sapiens
actttggtaccagataactttt

SEQ ID NO: 5172786 - DNA, 18 bp, Homo sapiens
actttggtcacccagact

SEQ ID NO: 5172787 - DNA, 20 bp, Homo sapiens
actttggtcacccagactag

SEQ ID NO: 5172788 - DNA, 22 bp, Homo sapiens
actttggtgcgggcacaataaa

SEQ ID NO: 5172789 - DNA, 16 bp, Homo sapiens
actttggttcctgtga

SEQ ID NO: 5172790 - DNA, 19 bp, Homo sapiens
actttggttctctccagga

SEQ ID NO: 5172791 - DNA, 21 bp, Homo sapiens
actttggtttatgcggtgctg

SEQ ID NO: 5172792 - DNA, 15 bp, Homo sapiens
actttggttttgggg

SEQ ID NO: 5172793 - DNA, 23 bp, Homo sapiens
actttggttttggggtgttcctg

SEQ ID NO: 5172794 - DNA, 12 bp, Homo sapiens
actttgtaaata

SEQ ID NO: 5172795 - DNA, 23 bp, Homo sapiens
actttgtaaataggatttttaga

SEQ ID NO: 5172796 - DNA, 13 bp, Homo sapiens
actttgtaaattc

SEQ ID NO: 5172797 - DNA, 22 bp, Homo sapiens
actttgtaattctaataatgca

SEQ ID NO: 5172798 - DNA, 22 bp, Homo sapiens
actttgtacagtggagaaatat

SEQ ID NO: 5172799 - DNA, 22 bp, Homo sapiens
actttgtacttgtgtttgctta

SEQ ID NO: 5172800 - DNA, 15 bp, Homo sapiens
actttgtagacattt

SEQ ID NO: 5172801 - DNA, 18 bp, Homo sapiens
actttgtagactgtttca

SEQ ID NO: 5172802 - DNA, 14 bp, Homo sapiens
actttgtaggacaa

SEQ ID NO: 5172803 - DNA, 15 bp, Homo sapiens
actttgtataaattt

SEQ ID NO: 5172804 - DNA, 16 bp, Homo sapiens
actttgtataaatttt

SEQ ID NO: 5172805 - DNA, 19 bp, Homo sapiens
actttgtataaatttttaa

SEQ ID NO: 5172806 - DNA, 16 bp, Homo sapiens
actttgtatacaagta

SEQ ID NO: 5172807 - DNA, 17 bp, Homo sapiens
actttgtatactttaaa

SEQ ID NO: 5172808 - DNA, 21 bp, Homo sapiens
actttgtatactttaaataat

SEQ ID NO: 5172809 - DNA, 21 bp, Homo sapiens
actttgtatagttatgtaaat

SEQ ID NO: 5172810 - DNA, 15 bp, Homo sapiens
actttgtatgatatt

SEQ ID NO: 5172811 - DNA, 16 bp, Homo sapiens
actttgtatgatattc

SEQ ID NO: 5172812 - DNA, 20 bp, Homo sapiens
actttgtatgatattccata

SEQ ID NO: 5172813 - DNA, 22 bp, Homo sapiens
actttgtattacttaggttatt

SEQ ID NO: 5172814 - DNA, 13 bp, Homo sapiens
actttgtcaccct

SEQ ID NO: 5172815 - DNA, 16 bp, Homo sapiens
actttgtcattatgat

SEQ ID NO: 5172816 - DNA, 21 bp, Homo sapiens
actttgtcccctcacctccac

SEQ ID NO: 5172817 - DNA, 18 bp, Homo sapiens
actttgtcctaagagatt

SEQ ID NO: 5172818 - DNA, 23 bp, Homo sapiens
actttgtcgtggttcttaaatgt

SEQ ID NO: 5172819 - DNA, 14 bp, Homo sapiens
actttgtctctcct

SEQ ID NO: 5172820 - DNA, 19 bp, Homo sapiens
actttgtctctcctggctg

SEQ ID NO: 5172821 - DNA, 17 bp, Homo sapiens
actttgtctgaaaaatt

SEQ ID NO: 5172822 - DNA, 16 bp, Homo sapiens
actttgtctgtacata

SEQ ID NO: 5172823 - DNA, 18 bp, Homo sapiens
actttgtctgtacatact

SEQ ID NO: 5172824 - DNA, 22 bp, Homo sapiens
actttgtctttctgcagaaaat

SEQ ID NO: 5172825 - DNA, 13 bp, Homo sapiens
actttgtcttttc

SEQ ID NO: 5172826 - DNA, 11 bp, Homo sapiens
actttgtgaat

SEQ ID NO: 5172827 - DNA, 14 bp, Homo sapiens
actttgtgaataga

SEQ ID NO: 5172828 - DNA, 13 bp, Homo sapiens
actttgtgaatta

SEQ ID NO: 5172829 - DNA, 16 bp, Homo sapiens
actttgtgactgtcac

SEQ ID NO: 5172830 - DNA, 17 bp, Homo sapiens
actttgtgcaaaagcag

SEQ ID NO: 5172831 - DNA, 14 bp, Homo sapiens
actttgtgcaatat

SEQ ID NO: 5172832 - DNA, 10 bp, Homo sapiens
actttgtgct

SEQ ID NO: 5172833 - DNA, 16 bp, Homo sapiens
actttgtgctcataaa

SEQ ID NO: 5172834 - DNA, 21 bp, Homo sapiens
actttgtggtaacttctttga

SEQ ID NO: 5172835 - DNA, 15 bp, Homo sapiens
actttgtggtctaaa

SEQ ID NO: 5172836 - DNA, 16 bp, Homo sapiens
actttgtgtattaaat

SEQ ID NO: 5172837 - DNA, 16 bp, Homo sapiens
actttgtgttcacctt

SEQ ID NO: 5172838 - DNA, 14 bp, Homo sapiens
agacatttaaaata

SEQ ID NO: 5172839 - DNA, 14 bp, Homo sapiens
agacatttacatgt

SEQ ID NO: 5172840 - DNA, 23 bp, Homo sapiens
agacatttatactcttttttcat

SEQ ID NO: 5172841 - DNA, 14 bp, Homo sapiens
agacatttatcttt

SEQ ID NO: 5172842 - DNA, 21 bp, Homo sapiens
agacatttatctttgtattct

SEQ ID NO: 5172843 - DNA, 13 bp, Homo sapiens
agacatttcaaaa

SEQ ID NO: 5172844 - DNA, 15 bp, Homo sapiens
agacatttcaaaatt

SEQ ID NO: 5172845 - DNA, 16 bp, Homo sapiens
agacatttcaaaatta

SEQ ID NO: 5172846 - DNA, 19 bp, Homo sapiens
agacatttcaaaattaata

SEQ ID NO: 5172847 - DNA, 14 bp, Homo sapiens
agacatttcctttt

SEQ ID NO: 5172848 - DNA, 23 bp, Homo sapiens
agacatttctcttactgcaaatg

SEQ ID NO: 5172849 - DNA, 23 bp, Homo sapiens
agacatttcttttctttttacat

SEQ ID NO: 5172850 - DNA, 17 bp, Homo sapiens
agacatttgatagaaag

SEQ ID NO: 5172851 - DNA, 17 bp, Homo sapiens
agacatttgctgaactc

SEQ ID NO: 5172852 - DNA, 18 bp, Homo sapiens
agacatttgctgaactca

SEQ ID NO: 5172853 - DNA, 20 bp, Homo sapiens
agacatttgctgaactcagc

SEQ ID NO: 5172854 - DNA, 11 bp, Homo sapiens
agacatttgta

SEQ ID NO: 5172855 - DNA, 22 bp, Homo sapiens
agacatttgtaaatctatagct

SEQ ID NO: 5172856 - DNA, 22 bp, Homo sapiens
agacatttgtaaatgtaaaact

SEQ ID NO: 5172857 - DNA, 14 bp, Homo sapiens
agacatttgtatat

SEQ ID NO: 5172858 - DNA, 19 bp, Homo sapiens
agacattttaaaaaatggt

SEQ ID NO: 5172859 - DNA, 16 bp, Homo sapiens
agacattttaacaaga

SEQ ID NO: 5172860 - DNA, 20 bp, Homo sapiens
agacattttaacaagaagat

SEQ ID NO: 5172861 - DNA, 22 bp, Homo sapiens
agacattttaacaagaagatga

SEQ ID NO: 5172862 - DNA, 19 bp, Homo sapiens
agacattttcactggaaga

SEQ ID NO: 5172863 - DNA, 13 bp, Homo sapiens
agacattttcata

SEQ ID NO: 5172864 - DNA, 13 bp, Homo sapiens
agacattttcctc

SEQ ID NO: 5172865 - DNA, 15 bp, Homo sapiens
agacattttctctta

SEQ ID NO: 5172866 - DNA, 16 bp, Homo sapiens
agacattttctcttag

SEQ ID NO: 5172867 - DNA, 17 bp, Homo sapiens
agacattttctcttaga

SEQ ID NO: 5172868 - DNA, 14 bp, Homo sapiens
agacattttctttt

SEQ ID NO: 5172869 - DNA, 23 bp, Homo sapiens
agacattttgaaataaaaatgga

SEQ ID NO: 5172870 - DNA, 20 bp, Homo sapiens
agacattttgtgtgagactt

SEQ ID NO: 5172871 - DNA, 22 bp, Homo sapiens
agacattttgtgtgagacttaa

SEQ ID NO: 5172872 - DNA, 13 bp, Homo sapiens
agacatttttatt

SEQ ID NO: 5172873 - DNA, 15 bp, Homo sapiens
agacatttttcattc

SEQ ID NO: 5172874 - DNA, 18 bp, Homo sapiens
agacatttttgtgccatt

SEQ ID NO: 5172875 - DNA, 16 bp, Homo sapiens
agacatttttttccct

SEQ ID NO: 5172876 - DNA, 15 bp, Homo sapiens
agaccaaaaatcaac

SEQ ID NO: 5172877 - DNA, 15 bp, Homo sapiens
agaccaaaaggagag

SEQ ID NO: 5172878 - DNA, 13 bp, Homo sapiens
agaccaaaataaa

SEQ ID NO: 5172879 - DNA, 18 bp, Homo sapiens
agaccaaaatgacaatga

SEQ ID NO: 5172880 - DNA, 21 bp, Homo sapiens
agaccaaaattactaataaat

SEQ ID NO: 5172881 - DNA, 22 bp, Homo sapiens
agaccaaaattactaataaatt

SEQ ID NO: 5172882 - DNA, 20 bp, Homo sapiens
agaccaaaatttaagttaac

SEQ ID NO: 5172883 - DNA, 11 bp, Homo sapiens
agaccaaagca

SEQ ID NO: 5172884 - DNA, 15 bp, Homo sapiens
agaccaaagcaaaga

SEQ ID NO: 5172885 - DNA, 17 bp, Homo sapiens
agaccaaagtttgcaac

SEQ ID NO: 5172886 - DNA, 19 bp, Homo sapiens
agaccaaatcattgtatca

SEQ ID NO: 5172887 - DNA, 15 bp, Homo sapiens
agaccaaatctcagt

SEQ ID NO: 5172888 - DNA, 24 bp, Homo sapiens
agaccaaatctcagttgtttgctt

SEQ ID NO: 5172889 - DNA, 23 bp, Homo sapiens
agaccaaatgtcggggttggggt

SEQ ID NO: 5172890 - DNA, 15 bp, Homo sapiens
agaccaaccctggga

SEQ ID NO: 5172891 - DNA, 17 bp, Homo sapiens
agaccaaccctgggacc

SEQ ID NO: 5172892 - DNA, 14 bp, Homo sapiens
agaccaacctgacc

SEQ ID NO: 5172893 - DNA, 22 bp, Homo sapiens
agaccaacgttactcagggctc

SEQ ID NO: 5172894 - DNA, 13 bp, Homo sapiens
agaccaacttttt

SEQ ID NO: 5172895 - DNA, 16 bp, Homo sapiens
agaccaactttttcat

SEQ ID NO: 5172896 - DNA, 21 bp, Homo sapiens
agaccaagatggcccatcctg

SEQ ID NO: 5172897 - DNA, 18 bp, Homo sapiens
agaccaaggcctcggcag

SEQ ID NO: 5172898 - DNA, 21 bp, Homo sapiens
agaccaaggcctcggcagaac

SEQ ID NO: 5172899 - DNA, 17 bp, Homo sapiens
agaccaaggcgggagca

SEQ ID NO: 5172900 - DNA, 19 bp, Homo sapiens
agaccaaggctttctctac

SEQ ID NO: 5172901 - DNA, 16 bp, Homo sapiens
agaccaagtcctcaaa

SEQ ID NO: 5172902 - DNA, 22 bp, Homo sapiens
agaccaataaacttcctttttt

SEQ ID NO: 5172903 - DNA, 22 bp, Homo sapiens
agaccaataaatttgtaacttt

SEQ ID NO: 5172904 - DNA, 18 bp, Homo sapiens
agaccaataggtgcaaaa

SEQ ID NO: 5172905 - DNA, 17 bp, Homo sapiens
agaccaattgaagcatg

SEQ ID NO: 5172906 - DNA, 22 bp, Homo sapiens
agaccacaaggctgaaaagtgc

SEQ ID NO: 5172907 - DNA, 15 bp, Homo sapiens
agaccacacatttta

SEQ ID NO: 5172908 - DNA, 21 bp, Homo sapiens
agaccacagcaattggctcct

SEQ ID NO: 5172909 - DNA, 15 bp, Homo sapiens
agaccacatatacag

SEQ ID NO: 5172910 - DNA, 17 bp, Homo sapiens
agaccacatatacagca

SEQ ID NO: 5172911 - DNA, 20 bp, Homo sapiens
agaccaccagccgccccagc

SEQ ID NO: 5172912 - DNA, 15 bp, Homo sapiens
agaccaccagggtcc

SEQ ID NO: 5172913 - DNA, 20 bp, Homo sapiens
agaccacccaacctcaccct

SEQ ID NO: 5172914 - DNA, 18 bp, Homo sapiens
agaccacccatatcatgc

SEQ ID NO: 5172915 - DNA, 13 bp, Homo sapiens
agaccacctccaa

SEQ ID NO: 5172916 - DNA, 13 bp, Homo sapiens
agaccacctccct

SEQ ID NO: 5172917 - DNA, 15 bp, Homo sapiens
agaccacctccctgc

SEQ ID NO: 5172918 - DNA, 21 bp, Homo sapiens
agaccacctccctgccctgtc

SEQ ID NO: 5172919 - DNA, 12 bp, Homo sapiens
agaccacctctc

SEQ ID NO: 5172920 - DNA, 13 bp, Homo sapiens
agaccacctgcca

SEQ ID NO: 5172921 - DNA, 15 bp, Homo sapiens
agaccacctgccagc

SEQ ID NO: 5172922 - DNA, 16 bp, Homo sapiens
agaccacctgccagcc

SEQ ID NO: 5172923 - DNA, 18 bp, Homo sapiens
agaccacctgccagccat

SEQ ID NO: 5172924 - DNA, 23 bp, Homo sapiens
agaccaccttcccttcctcagca

SEQ ID NO: 5172925 - DNA, 17 bp, Homo sapiens
agaccacgcccctgcct

SEQ ID NO: 5172926 - DNA, 19 bp, Homo sapiens
agaccacgcccgtcctgcc

SEQ ID NO: 5172927 - DNA, 19 bp, Homo sapiens
agaccactgtcctggctgc

SEQ ID NO: 5172928 - DNA, 12 bp, Homo sapiens
agaccagaaatt

SEQ ID NO: 5172929 - DNA, 14 bp, Homo sapiens
agaccagaaattcc

SEQ ID NO: 5172930 - DNA, 13 bp, Homo sapiens
agaccagaagaaa

SEQ ID NO: 5172931 - DNA, 14 bp, Homo sapiens
agaccagaagaaaa

SEQ ID NO: 5172932 - DNA, 16 bp, Homo sapiens
agaccagaagaaaaga

SEQ ID NO: 5172933 - DNA, 20 bp, Homo sapiens
agaccagaagaaaagactta

SEQ ID NO: 5172934 - DNA, 13 bp, Homo sapiens
agaccagaattcc

SEQ ID NO: 5172935 - DNA, 18 bp, Homo sapiens
agaccagaattcccttga

SEQ ID NO: 5172936 - DNA, 21 bp, Homo sapiens
agaccagaattcccttgaatt

SEQ ID NO: 5172937 - DNA, 22 bp, Homo sapiens
agaccagaattcccttgaattg

SEQ ID NO: 5172938 - DNA, 14 bp, Homo sapiens
agaccagactgtgg

SEQ ID NO: 5172939 - DNA, 12 bp, Homo sapiens
agaccagagagc

SEQ ID NO: 5172940 - DNA, 16 bp, Homo sapiens
agaccagagcagtttc

SEQ ID NO: 5172941 - DNA, 12 bp, Homo sapiens
agaccagagctc

SEQ ID NO: 5172942 - DNA, 17 bp, Homo sapiens
agaccagagctctggag

SEQ ID NO: 5172943 - DNA, 16 bp, Homo sapiens
agaccagatccaagat

SEQ ID NO: 5172944 - DNA, 15 bp, Homo sapiens
agaccagattaaact

SEQ ID NO: 5172945 - DNA, 15 bp, Homo sapiens
agaccagcagacaga

SEQ ID NO: 5172946 - DNA, 15 bp, Homo sapiens
agaccagccctgcag

SEQ ID NO: 5172947 - DNA, 17 bp, Homo sapiens
agaccagcccttcccca

SEQ ID NO: 5172948 - DNA, 15 bp, Homo sapiens
agaccagcctgccag

SEQ ID NO: 5172949 - DNA, 14 bp, Homo sapiens
agaccagcctggcc

SEQ ID NO: 5172950 - DNA, 19 bp, Homo sapiens
agaccagcctggccaacat

SEQ ID NO: 5172951 - DNA, 22 bp, Homo sapiens
agaccagcctggccaacatggc

SEQ ID NO: 5172952 - DNA, 15 bp, Homo sapiens
agaccagcctgtcca

SEQ ID NO: 5172953 - DNA, 13 bp, Homo sapiens
agaccagctcaga

SEQ ID NO: 5172954 - DNA, 22 bp, Homo sapiens
agaccagctcagaggcccagga

SEQ ID NO: 5172955 - DNA, 16 bp, Homo sapiens
agaccaggagggagag

SEQ ID NO: 5172956 - DNA, 19 bp, Homo sapiens
agaccaggagggagagcct

SEQ ID NO: 5172957 - DNA, 17 bp, Homo sapiens
agaccaggcaaagcaag

SEQ ID NO: 5172958 - DNA, 13 bp, Homo sapiens
agaccaggctgca

SEQ ID NO: 5172959 - DNA, 15 bp, Homo sapiens
agaccaggctgcagc

SEQ ID NO: 5172960 - DNA, 20 bp, Homo sapiens
agaccaggctgcagcctcca

SEQ ID NO: 5172961 - DNA, 21 bp, Homo sapiens
agaccaggctgcagcctccac

SEQ ID NO: 5172962 - DNA, 16 bp, Homo sapiens
agaccaggctgtgtcc

SEQ ID NO: 5172963 - DNA, 13 bp, Homo sapiens
agaccaggcttcc

SEQ ID NO: 5172964 - DNA, 16 bp, Homo sapiens
agaccaggcttcccaa

SEQ ID NO: 5172965 - DNA, 17 bp, Homo sapiens
agaccaggggaccagag

SEQ ID NO: 5172966 - DNA, 22 bp, Homo sapiens
agaccagggtcttacctctctg

SEQ ID NO: 5172967 - DNA, 20 bp, Homo sapiens
agaccagggtggccacacag

SEQ ID NO: 5172968 - DNA, 16 bp, Homo sapiens
agaccaggtgacctta

SEQ ID NO: 5172969 - DNA, 13 bp, Homo sapiens
agaccagtagtga

SEQ ID NO: 5172970 - DNA, 17 bp, Homo sapiens
agaccagtagtgaccaa

SEQ ID NO: 5172971 - DNA, 18 bp, Homo sapiens
agaccagtagtgaccaat

SEQ ID NO: 5172972 - DNA, 23 bp, Homo sapiens
agaccagtagtgaccaatcggga

SEQ ID NO: 5172973 - DNA, 16 bp, Homo sapiens
agaccagtcacagcca

SEQ ID NO: 5172974 - DNA, 19 bp, Homo sapiens
agaccagtggtctggaaac

SEQ ID NO: 5172975 - DNA, 20 bp, Homo sapiens
agaccagtggtctggaaaca

SEQ ID NO: 5172976 - DNA, 22 bp, Homo sapiens
agaccagttgaataaaagtgca

SEQ ID NO: 5172977 - DNA, 18 bp, Homo sapiens
agaccagttgggagcact

SEQ ID NO: 5172978 - DNA, 22 bp, Homo sapiens
agaccagttgggagcactggag

SEQ ID NO: 5172979 - DNA, 19 bp, Homo sapiens
agaccataaagatattctt

SEQ ID NO: 5172980 - DNA, 13 bp, Homo sapiens
agaccataagaga

SEQ ID NO: 5172981 - DNA, 16 bp, Homo sapiens
agaccataagagaaac

SEQ ID NO: 5172982 - DNA, 22 bp, Homo sapiens
agaccataagagaaacctgcca

SEQ ID NO: 5172983 - DNA, 13 bp, Homo sapiens
agaccataatgtt

SEQ ID NO: 5172984 - DNA, 14 bp, Homo sapiens
agaccatattctaa

SEQ ID NO: 5172985 - DNA, 15 bp, Homo sapiens
agaccatccctgaag

SEQ ID NO: 5172986 - DNA, 21 bp, Homo sapiens
agaccatcctggccaacatga

SEQ ID NO: 5172987 - DNA, 20 bp, Homo sapiens
agaccatcctggcccctcca

SEQ ID NO: 5172988 - DNA, 17 bp, Homo sapiens
agaccatcgcacaccaa

SEQ ID NO: 5172989 - DNA, 12 bp, Homo sapiens
agaccatctctc

SEQ ID NO: 5172990 - DNA, 13 bp, Homo sapiens
agaccatgcattc

SEQ ID NO: 5172991 - DNA, 21 bp, Homo sapiens
agaccatgcattcagatctga

SEQ ID NO: 5172992 - DNA, 13 bp, Homo sapiens
agaccatgccaga

SEQ ID NO: 5172993 - DNA, 23 bp, Homo sapiens
agaccatggacactacacccagc

SEQ ID NO: 5172994 - DNA, 22 bp, Homo sapiens
agaccatggatatgttgtatta

SEQ ID NO: 5172995 - DNA, 17 bp, Homo sapiens
agaccattgtcttccaa

SEQ ID NO: 5172996 - DNA, 16 bp, Homo sapiens
agaccatttcacagaa

SEQ ID NO: 5172997 - DNA, 15 bp, Homo sapiens
agacccaaaacagct

SEQ ID NO: 5172998 - DNA, 22 bp, Homo sapiens
agacccaaagcggtccctgtcc

SEQ ID NO: 5172999 - DNA, 21 bp, Homo sapiens
agacccaaattataagggccc

SEQ ID NO: 5173000 - DNA, 15 bp, Homo sapiens
agacccaacaatgag

SEQ ID NO: 5173001 - DNA, 23 bp, Homo sapiens
agacccaacccatgaaggctgga

SEQ ID NO: 5173002 - DNA, 21 bp, Homo sapiens
agacccaactcgcctgtggac

SEQ ID NO: 5173003 - DNA, 14 bp, Homo sapiens
agacccaaggagga

SEQ ID NO: 5173004 - DNA, 15 bp, Homo sapiens
agacccaaggctcac

SEQ ID NO: 5173005 - DNA, 23 bp, Homo sapiens
agacccaagtcaaagatgcccca

SEQ ID NO: 5173006 - DNA, 13 bp, Homo sapiens
agacccaataaag

SEQ ID NO: 5173007 - DNA, 13 bp, Homo sapiens
agacccacacatg

SEQ ID NO: 5173008 - DNA, 13 bp, Homo sapiens
agacccacagccc

SEQ ID NO: 5173009 - DNA, 14 bp, Homo sapiens
agacccacagccct

SEQ ID NO: 5173010 - DNA, 15 bp, Homo sapiens
agacccacagccctg

SEQ ID NO: 5173011 - DNA, 17 bp, Homo sapiens
agacccacagccctgaa

SEQ ID NO: 5173012 - DNA, 19 bp, Homo sapiens
agacccacagccctgaaac

SEQ ID NO: 5173013 - DNA, 17 bp, Homo sapiens
agacccaccatccttcc

SEQ ID NO: 5173014 - DNA, 22 bp, Homo sapiens
agacccaccatccttccatcct

SEQ ID NO: 5173015 - DNA, 23 bp, Homo sapiens
agacccaccatccttccatcctg

SEQ ID NO: 5173016 - DNA, 19 bp, Homo sapiens
agacccaccccacctgcag

SEQ ID NO: 5173017 - DNA, 23 bp, Homo sapiens
actttgtgtttttttaatttcta

SEQ ID NO: 5173018 - DNA, 17 bp, Homo sapiens
actttgttaaaaatatt

SEQ ID NO: 5173019 - DNA, 17 bp, Homo sapiens
actttgttaatttatct

SEQ ID NO: 5173020 - DNA, 14 bp, Homo sapiens
actttgttaggcca

SEQ ID NO: 5173021 - DNA, 20 bp, Homo sapiens
actttgttagtttctccaag

SEQ ID NO: 5173022 - DNA, 23 bp, Homo sapiens
actttgttctgttgtctgcgcct

SEQ ID NO: 5173023 - DNA, 15 bp, Homo sapiens
actttgttctttagg

SEQ ID NO: 5173024 - DNA, 19 bp, Homo sapiens
actttgttctttaggagat

SEQ ID NO: 5173025 - DNA, 20 bp, Homo sapiens
actttgttctttaggagatt

SEQ ID NO: 5173026 - DNA, 15 bp, Homo sapiens
actttgttgcaagat

SEQ ID NO: 5173027 - DNA, 22 bp, Homo sapiens
actttgttgcaagatgtgaatt

SEQ ID NO: 5173028 - DNA, 19 bp, Homo sapiens
actttgttgccttatcttg

SEQ ID NO: 5173029 - DNA, 17 bp, Homo sapiens
actttgttggcccttcc

SEQ ID NO: 5173030 - DNA, 18 bp, Homo sapiens
actttgttggcccttcca

SEQ ID NO: 5173031 - DNA, 19 bp, Homo sapiens
actttgttggcccttccag

SEQ ID NO: 5173032 - DNA, 21 bp, Homo sapiens
actttgttggtagccatttgg

SEQ ID NO: 5173033 - DNA, 23 bp, Homo sapiens
actttgttgtttggattcctcac

SEQ ID NO: 5173034 - DNA, 15 bp, Homo sapiens
actttgttgttttta

SEQ ID NO: 5173035 - DNA, 14 bp, Homo sapiens
actttgtttagaaa

SEQ ID NO: 5173036 - DNA, 16 bp, Homo sapiens
actttgtttatgcata

SEQ ID NO: 5173037 - DNA, 16 bp, Homo sapiens
actttgttttcaagat

SEQ ID NO: 5173038 - DNA, 13 bp, Homo sapiens
acttttaaaataa

SEQ ID NO: 5173039 - DNA, 16 bp, Homo sapiens
acttttaaaataaaat

SEQ ID NO: 5173040 - DNA, 18 bp, Homo sapiens
acttttaaaataaattct

SEQ ID NO: 5173041 - DNA, 19 bp, Homo sapiens
acttttaaaataaattctc

SEQ ID NO: 5173042 - DNA, 21 bp, Homo sapiens
acttttaaaataaattctctc

SEQ ID NO: 5173043 - DNA, 14 bp, Homo sapiens
acttttaaacaaaa

SEQ ID NO: 5173044 - DNA, 15 bp, Homo sapiens
acttttaaactgtgt

SEQ ID NO: 5173045 - DNA, 17 bp, Homo sapiens
acttttaaactgtgtac

SEQ ID NO: 5173046 - DNA, 13 bp, Homo sapiens
acttttaaagatt

SEQ ID NO: 5173047 - DNA, 19 bp, Homo sapiens
acttttaaaggaatgtgaa

SEQ ID NO: 5173048 - DNA, 20 bp, Homo sapiens
acttttaaatggcagtattt

SEQ ID NO: 5173049 - DNA, 22 bp, Homo sapiens
acttttaacgtatgtatttcat

SEQ ID NO: 5173050 - DNA, 19 bp, Homo sapiens
acttttaactatgtaataa

SEQ ID NO: 5173051 - DNA, 18 bp, Homo sapiens
acttttaaggataaatca

SEQ ID NO: 5173052 - DNA, 11 bp, Homo sapiens
acttttaataa

SEQ ID NO: 5173053 - DNA, 21 bp, Homo sapiens
acttttaatccctatgtttgt

SEQ ID NO: 5173054 - DNA, 12 bp, Homo sapiens
acttttaatggt

SEQ ID NO: 5173055 - DNA, 13 bp, Homo sapiens
acttttaattagt

SEQ ID NO: 5173056 - DNA, 13 bp, Homo sapiens
acttttaatttaa

SEQ ID NO: 5173057 - DNA, 17 bp, Homo sapiens
acttttacagaatgcat

SEQ ID NO: 5173058 - DNA, 13 bp, Homo sapiens
acttttacagctt

SEQ ID NO: 5173059 - DNA, 19 bp, Homo sapiens
acttttacagcttttctct

SEQ ID NO: 5173060 - DNA, 21 bp, Homo sapiens
acttttaccactatttaagtt

SEQ ID NO: 5173061 - DNA, 16 bp, Homo sapiens
acttttactctgccta

SEQ ID NO: 5173062 - DNA, 19 bp, Homo sapiens
acttttactctgcctacag

SEQ ID NO: 5173063 - DNA, 15 bp, Homo sapiens
acttttacttgttca

SEQ ID NO: 5173064 - DNA, 19 bp, Homo sapiens
acttttagacagtggtaaa

SEQ ID NO: 5173065 - DNA, 22 bp, Homo sapiens
acttttagccagagatgcaata

SEQ ID NO: 5173066 - DNA, 16 bp, Homo sapiens
acttttagtaaagtca

SEQ ID NO: 5173067 - DNA, 21 bp, Homo sapiens
acttttagtattaccgatggg

SEQ ID NO: 5173068 - DNA, 14 bp, Homo sapiens
acttttataaatgt

SEQ ID NO: 5173069 - DNA, 17 bp, Homo sapiens
acttttataaatgtttt

SEQ ID NO: 5173070 - DNA, 21 bp, Homo sapiens
acttttataaattaaatatat

SEQ ID NO: 5173071 - DNA, 16 bp, Homo sapiens
acttttataatgaaaa

SEQ ID NO: 5173072 - DNA, 23 bp, Homo sapiens
acttttatactctttctgtatat

SEQ ID NO: 5173073 - DNA, 15 bp, Homo sapiens
acttttatgagcttc

SEQ ID NO: 5173074 - DNA, 22 bp, Homo sapiens
acttttatgcagcaaatatatg

SEQ ID NO: 5173075 - DNA, 21 bp, Homo sapiens
acttttatggaattaagagat

SEQ ID NO: 5173076 - DNA, 13 bp, Homo sapiens
acttttattattt

SEQ ID NO: 5173077 - DNA, 18 bp, Homo sapiens
acttttattgatggatat

SEQ ID NO: 5173078 - DNA, 22 bp, Homo sapiens
acttttattgtataattatgaa

SEQ ID NO: 5173079 - DNA, 20 bp, Homo sapiens
acttttatttcctgtatgtt

SEQ ID NO: 5173080 - DNA, 14 bp, Homo sapiens
acttttatttgcaa

SEQ ID NO: 5173081 - DNA, 22 bp, Homo sapiens
acttttattttacacagaaaca

SEQ ID NO: 5173082 - DNA, 16 bp, Homo sapiens
acttttcaaaataaag

SEQ ID NO: 5173083 - DNA, 17 bp, Homo sapiens
acttttcaataaatcag

SEQ ID NO: 5173084 - DNA, 19 bp, Homo sapiens
acttttcaatgtctaaaaa

SEQ ID NO: 5173085 - DNA, 13 bp, Homo sapiens
acttttcacactg

SEQ ID NO: 5173086 - DNA, 15 bp, Homo sapiens
acttttcaccaatga

SEQ ID NO: 5173087 - DNA, 22 bp, Homo sapiens
acttttcaggcactttagaaat

SEQ ID NO: 5173088 - DNA, 18 bp, Homo sapiens
acttttcatatcatttct

SEQ ID NO: 5173089 - DNA, 18 bp, Homo sapiens
acttttcatccttcccca

SEQ ID NO: 5173090 - DNA, 14 bp, Homo sapiens
acttttcattccct

SEQ ID NO: 5173091 - DNA, 18 bp, Homo sapiens
acttttcattctctttta

SEQ ID NO: 5173092 - DNA, 12 bp, Homo sapiens
acttttcatttc

SEQ ID NO: 5173093 - DNA, 19 bp, Homo sapiens
acttttcatttttgctttt

SEQ ID NO: 5173094 - DNA, 21 bp, Homo sapiens
acttttccaatatgtgatttt

SEQ ID NO: 5173095 - DNA, 15 bp, Homo sapiens
acttttccagtattt

SEQ ID NO: 5173096 - DNA, 18 bp, Homo sapiens
acttttccagtattttag

SEQ ID NO: 5173097 - DNA, 19 bp, Homo sapiens
acttttccagtattttagt

SEQ ID NO: 5173098 - DNA, 15 bp, Homo sapiens
acttttccagtctgt

SEQ ID NO: 5173099 - DNA, 21 bp, Homo sapiens
acttttccatgtatctacctc

SEQ ID NO: 5173100 - DNA, 15 bp, Homo sapiens
acttttcccactcca

SEQ ID NO: 5173101 - DNA, 19 bp, Homo sapiens
acttttccccaattcatgt

SEQ ID NO: 5173102 - DNA, 22 bp, Homo sapiens
acttttcccctgttaaacagta

SEQ ID NO: 5173103 - DNA, 23 bp, Homo sapiens
acttttcctggacttaaagaaaa

SEQ ID NO: 5173104 - DNA, 22 bp, Homo sapiens
acttttccttaattttaatcca

SEQ ID NO: 5173105 - DNA, 18 bp, Homo sapiens
acttttccttgcatacaa

SEQ ID NO: 5173106 - DNA, 21 bp, Homo sapiens
acttttcctttgctagttgtt

SEQ ID NO: 5173107 - DNA, 17 bp, Homo sapiens
acttttccttttcttaa

SEQ ID NO: 5173108 - DNA, 22 bp, Homo sapiens
acttttcgttaacattgaccaa

SEQ ID NO: 5173109 - DNA, 15 bp, Homo sapiens
acttttctaaagctc

SEQ ID NO: 5173110 - DNA, 20 bp, Homo sapiens
acttttctaagaaaagcatt

SEQ ID NO: 5173111 - DNA, 18 bp, Homo sapiens
acttttctaccatttctg

SEQ ID NO: 5173112 - DNA, 15 bp, Homo sapiens
acttttctccatgag

SEQ ID NO: 5173113 - DNA, 18 bp, Homo sapiens
acttttctcctgcatgtg

SEQ ID NO: 5173114 - DNA, 21 bp, Homo sapiens
acttttctcctgcatgtgtat

SEQ ID NO: 5173115 - DNA, 19 bp, Homo sapiens
acttttctctactttaaat

SEQ ID NO: 5173116 - DNA, 22 bp, Homo sapiens
acttttctctactttaaatttt

SEQ ID NO: 5173117 - DNA, 23 bp, Homo sapiens
acttttctctttaattttaactg

SEQ ID NO: 5173118 - DNA, 17 bp, Homo sapiens
acttttctgaccatgtg

SEQ ID NO: 5173119 - DNA, 17 bp, Homo sapiens
acttttctgattaatat

SEQ ID NO: 5173120 - DNA, 19 bp, Homo sapiens
acttttctgattaatatat

SEQ ID NO: 5173121 - DNA, 13 bp, Homo sapiens
acttttctgcatt

SEQ ID NO: 5173122 - DNA, 14 bp, Homo sapiens
acttttctgccaaa

SEQ ID NO: 5173123 - DNA, 18 bp, Homo sapiens
acttttctgccaaaataa

SEQ ID NO: 5173124 - DNA, 11 bp, Homo sapiens
acttttctggg

SEQ ID NO: 5173125 - DNA, 16 bp, Homo sapiens
acttttctggttccaa

SEQ ID NO: 5173126 - DNA, 18 bp, Homo sapiens
acttttctggttccaaac

SEQ ID NO: 5173127 - DNA, 18 bp, Homo sapiens
acttttcttacagcacat

SEQ ID NO: 5173128 - DNA, 19 bp, Homo sapiens
acttttctttattagcttt

SEQ ID NO: 5173129 - DNA, 21 bp, Homo sapiens
acttttctttattgctgtgaa

SEQ ID NO: 5173130 - DNA, 12 bp, Homo sapiens
acttttgaaaaa

SEQ ID NO: 5173131 - DNA, 19 bp, Homo sapiens
acttttgaaaaaggatcat

SEQ ID NO: 5173132 - DNA, 20 bp, Homo sapiens
acttttgaaaatgtacatgt

SEQ ID NO: 5173133 - DNA, 15 bp, Homo sapiens
acttttgaaagatgt

SEQ ID NO: 5173134 - DNA, 21 bp, Homo sapiens
acttttgaagtcttccctcag

SEQ ID NO: 5173135 - DNA, 20 bp, Homo sapiens
acttttgaattacagagata

SEQ ID NO: 5173136 - DNA, 18 bp, Homo sapiens
acttttgaggacaagtta

SEQ ID NO: 5173137 - DNA, 16 bp, Homo sapiens
acttttgagtgtgtgt

SEQ ID NO: 5173138 - DNA, 21 bp, Homo sapiens
acttttgagtgtgtgtgtgca

SEQ ID NO: 5173139 - DNA, 19 bp, Homo sapiens
acttttgcaaaataagtaa

SEQ ID NO: 5173140 - DNA, 14 bp, Homo sapiens
acttttgcaaataa

SEQ ID NO: 5173141 - DNA, 15 bp, Homo sapiens
acttttgcaaataag

SEQ ID NO: 5173142 - DNA, 11 bp, Homo sapiens
acttttgcaag

SEQ ID NO: 5173143 - DNA, 21 bp, Homo sapiens
acttttgcaatcttaagcaga

SEQ ID NO: 5173144 - DNA, 16 bp, Homo sapiens
acttttgcacatatat

SEQ ID NO: 5173145 - DNA, 17 bp, Homo sapiens
acttttgcatttttcct

SEQ ID NO: 5173146 - DNA, 17 bp, Homo sapiens
acttttgccaatgaact

SEQ ID NO: 5173147 - DNA, 15 bp, Homo sapiens
acttttgccctttga

SEQ ID NO: 5173148 - DNA, 20 bp, Homo sapiens
acttttgctgtttatacttg

SEQ ID NO: 5173149 - DNA, 19 bp, Homo sapiens
acttttgcttaccttttcc

SEQ ID NO: 5173150 - DNA, 22 bp, Homo sapiens
acttttgcttaccttttcctat

SEQ ID NO: 5173151 - DNA, 14 bp, Homo sapiens
acttttggaatcta

SEQ ID NO: 5173152 - DNA, 14 bp, Homo sapiens
acttttggcatttt

SEQ ID NO: 5173153 - DNA, 14 bp, Homo sapiens
acttttggcctcat

SEQ ID NO: 5173154 - DNA, 22 bp, Homo sapiens
acttttgggaggtccaggcagg

SEQ ID NO: 5173155 - DNA, 19 bp, Homo sapiens
acttttgggatttgttgaa

SEQ ID NO: 5173156 - DNA, 20 bp, Homo sapiens
acttttgggatttgttgaaa

SEQ ID NO: 5173157 - DNA, 21 bp, Homo sapiens
acttttggtttttatatttct

SEQ ID NO: 5173158 - DNA, 11 bp, Homo sapiens
acttttgtaaa

SEQ ID NO: 5173159 - DNA, 17 bp, Homo sapiens
acttttgtaaaatcaaa

SEQ ID NO: 5173160 - DNA, 17 bp, Homo sapiens
acttttgtaaatattct

SEQ ID NO: 5173161 - DNA, 12 bp, Homo sapiens
acttttgtaaga

SEQ ID NO: 5173162 - DNA, 15 bp, Homo sapiens
acttttgtaatttga

SEQ ID NO: 5173163 - DNA, 17 bp, Homo sapiens
acttttgtaatttgaat

SEQ ID NO: 5173164 - DNA, 14 bp, Homo sapiens
acttttgtacatct

SEQ ID NO: 5173165 - DNA, 17 bp, Homo sapiens
acttttgtaccagtgtg

SEQ ID NO: 5173166 - DNA, 16 bp, Homo sapiens
acttttgtactgaatt

SEQ ID NO: 5173167 - DNA, 18 bp, Homo sapiens
acttttgtagtcttatga

SEQ ID NO: 5173168 - DNA, 17 bp, Homo sapiens
acttttgtcttcctcac

SEQ ID NO: 5173169 - DNA, 22 bp, Homo sapiens
acttttgtgaattaggctgtaa

SEQ ID NO: 5173170 - DNA, 22 bp, Homo sapiens
acttttgtgctatcaatgagtt

SEQ ID NO: 5173171 - DNA, 14 bp, Homo sapiens
acttttgtgtgaaa

SEQ ID NO: 5173172 - DNA, 13 bp, Homo sapiens
acttttgtgttac

SEQ ID NO: 5173173 - DNA, 21 bp, Homo sapiens
acttttgtgttactgcagtga

SEQ ID NO: 5173174 - DNA, 16 bp, Homo sapiens
acttttgttaaattca

SEQ ID NO: 5173175 - DNA, 17 bp, Homo sapiens
acttttgttaaattcag

SEQ ID NO: 5173176 - DNA, 18 bp, Homo sapiens
acttttgttaacagtatt

SEQ ID NO: 5173177 - DNA, 17 bp, Homo sapiens
acttttgttattccatc

SEQ ID NO: 5173178 - DNA, 12 bp, Homo sapiens
acttttgttcta

SEQ ID NO: 5173179 - DNA, 15 bp, Homo sapiens
acttttgttctcttc

SEQ ID NO: 5173180 - DNA, 14 bp, Homo sapiens
acttttgttctgct

SEQ ID NO: 5173181 - DNA, 14 bp, Homo sapiens
acttttgttttttg

SEQ ID NO: 5173182 - DNA, 22 bp, Homo sapiens
actttttaaaaaaataaaacag

SEQ ID NO: 5173183 - DNA, 15 bp, Homo sapiens
actttttaaaaataa

SEQ ID NO: 5173184 - DNA, 17 bp, Homo sapiens
actttttaaaaataact

SEQ ID NO: 5173185 - DNA, 13 bp, Homo sapiens
actttttaaaata

SEQ ID NO: 5173186 - DNA, 17 bp, Homo sapiens
actttttaaaatataag

SEQ ID NO: 5173187 - DNA, 21 bp, Homo sapiens
actttttaaaatcttttctat

SEQ ID NO: 5173188 - DNA, 14 bp, Homo sapiens
actttttaaacagt

SEQ ID NO: 5173189 - DNA, 18 bp, Homo sapiens
actttttaaagaagtgca

SEQ ID NO: 5173190 - DNA, 13 bp, Homo sapiens
actttttaaagta

SEQ ID NO: 5173191 - DNA, 18 bp, Homo sapiens
actttttaaagtaaatta

SEQ ID NO: 5173192 - DNA, 18 bp, Homo sapiens
actttttaaatgtaaaga

SEQ ID NO: 5173193 - DNA, 11 bp, Homo sapiens
actttttaatt

SEQ ID NO: 5173194 - DNA, 14 bp, Homo sapiens
actttttaattttt

SEQ ID NO: 5173195 - DNA, 11 bp, Homo sapiens
actttttacaa

SEQ ID NO: 5173196 - DNA, 20 bp, Homo sapiens
agacccaccccacctgcagg

SEQ ID NO: 5173197 - DNA, 21 bp, Homo sapiens
agacccaccccacctgcaggg

SEQ ID NO: 5173198 - DNA, 18 bp, Homo sapiens
agacccacccccagcctt

SEQ ID NO: 5173199 - DNA, 21 bp, Homo sapiens
agacccacctgaggctcagcc

SEQ ID NO: 5173200 - DNA, 23 bp, Homo sapiens
agacccacctgaggctcagccct

SEQ ID NO: 5173201 - DNA, 20 bp, Homo sapiens
agacccacctggagcccgct

SEQ ID NO: 5173202 - DNA, 19 bp, Homo sapiens
agacccagaggccctgaag

SEQ ID NO: 5173203 - DNA, 22 bp, Homo sapiens
agacccagaggccctgaagcct

SEQ ID NO: 5173204 - DNA, 20 bp, Homo sapiens
agacccagaggtccaggtcc

SEQ ID NO: 5173205 - DNA, 16 bp, Homo sapiens
agacccagatctcatg

SEQ ID NO: 5173206 - DNA, 16 bp, Homo sapiens
agacccagcaggaagc

SEQ ID NO: 5173207 - DNA, 20 bp, Homo sapiens
agacccagcaggaagccagg

SEQ ID NO: 5173208 - DNA, 14 bp, Homo sapiens
agacccagcccctt

SEQ ID NO: 5173209 - DNA, 17 bp, Homo sapiens
agacccagccccttccc

SEQ ID NO: 5173210 - DNA, 22 bp, Homo sapiens
agacccagccccttcccctggg

SEQ ID NO: 5173211 - DNA, 19 bp, Homo sapiens
agacccagcccgcggcctg

SEQ ID NO: 5173212 - DNA, 18 bp, Homo sapiens
agacccagccctcatccc

SEQ ID NO: 5173213 - DNA, 14 bp, Homo sapiens
agacccagcggaca

SEQ ID NO: 5173214 - DNA, 11 bp, Homo sapiens
agacccaggac

SEQ ID NO: 5173215 - DNA, 13 bp, Homo sapiens
agacccaggagtc

SEQ ID NO: 5173216 - DNA, 17 bp, Homo sapiens
agacccaggagtccaga

SEQ ID NO: 5173217 - DNA, 19 bp, Homo sapiens
agacccaggagtccagccc

SEQ ID NO: 5173218 - DNA, 21 bp, Homo sapiens
agacccaggagtccagcccct

SEQ ID NO: 5173219 - DNA, 22 bp, Homo sapiens
agacccagggggctgaaacttg

SEQ ID NO: 5173220 - DNA, 21 bp, Homo sapiens
agacccaggggtccaggcccc

SEQ ID NO: 5173221 - DNA, 14 bp, Homo sapiens
agacccaggtcttc

SEQ ID NO: 5173222 - DNA, 17 bp, Homo sapiens
agacccagtcccacact

SEQ ID NO: 5173223 - DNA, 21 bp, Homo sapiens
agacccataaaccacctccca

SEQ ID NO: 5173224 - DNA, 17 bp, Homo sapiens
agacccatctctccctt

SEQ ID NO: 5173225 - DNA, 20 bp, Homo sapiens
agacccatctggaggctccc

SEQ ID NO: 5173226 - DNA, 14 bp, Homo sapiens
agacccatgctggt

SEQ ID NO: 5173227 - DNA, 22 bp, Homo sapiens
agacccattccttcccagaggg

SEQ ID NO: 5173228 - DNA, 18 bp, Homo sapiens
agaccccaagaggaagtt

SEQ ID NO: 5173229 - DNA, 23 bp, Homo sapiens
agaccccacccaagcttggcagc

SEQ ID NO: 5173230 - DNA, 21 bp, Homo sapiens
agaccccaccctgtctgcagg

SEQ ID NO: 5173231 - DNA, 17 bp, Homo sapiens
agaccccacctccttgg

SEQ ID NO: 5173232 - DNA, 13 bp, Homo sapiens
agaccccaggctg

SEQ ID NO: 5173233 - DNA, 15 bp, Homo sapiens
agaccccagggcagg

SEQ ID NO: 5173234 - DNA, 19 bp, Homo sapiens
agaccccatcttccagcca

SEQ ID NO: 5173235 - DNA, 20 bp, Homo sapiens
agaccccatggtccatcccc

SEQ ID NO: 5173236 - DNA, 14 bp, Homo sapiens
agacccccacacct

SEQ ID NO: 5173237 - DNA, 12 bp, Homo sapiens
agacccccaccc

SEQ ID NO: 5173238 - DNA, 12 bp, Homo sapiens
agacccccaggc

SEQ ID NO: 5173239 - DNA, 15 bp, Homo sapiens
agacccccaggcaga

SEQ ID NO: 5173240 - DNA, 13 bp, Homo sapiens
agacccccaggcc

SEQ ID NO: 5173241 - DNA, 15 bp, Homo sapiens
agacccccaggcctg

SEQ ID NO: 5173242 - DNA, 12 bp, Homo sapiens
agacccccatcc

SEQ ID NO: 5173243 - DNA, 19 bp, Homo sapiens
agacccccatccagcctcc

SEQ ID NO: 5173244 - DNA, 21 bp, Homo sapiens
agacccccatccagcctccag

SEQ ID NO: 5173245 - DNA, 22 bp, Homo sapiens
agacccccatggtaatgtaact

SEQ ID NO: 5173246 - DNA, 23 bp, Homo sapiens
agaccccccagcccctcctccct

SEQ ID NO: 5173247 - DNA, 13 bp, Homo sapiens
agacccccccatt

SEQ ID NO: 5173248 - DNA, 13 bp, Homo sapiens
agaccccctcagc

SEQ ID NO: 5173249 - DNA, 20 bp, Homo sapiens
agaccccctcagccttggga

SEQ ID NO: 5173250 - DNA, 13 bp, Homo sapiens
agaccccctggag

SEQ ID NO: 5173251 - DNA, 19 bp, Homo sapiens
agacccccttgcccaggcc

SEQ ID NO: 5173252 - DNA, 16 bp, Homo sapiens
agaccccgcactgcag

SEQ ID NO: 5173253 - DNA, 17 bp, Homo sapiens
agaccccgcactgcaga

SEQ ID NO: 5173254 - DNA, 22 bp, Homo sapiens
agaccccgcaggatccctcctg

SEQ ID NO: 5173255 - DNA, 11 bp, Homo sapiens
agaccccgccc

SEQ ID NO: 5173256 - DNA, 21 bp, Homo sapiens
agaccccggcttcctttccca

SEQ ID NO: 5173257 - DNA, 19 bp, Homo sapiens
agaccccgggtctccttgg

SEQ ID NO: 5173258 - DNA, 21 bp, Homo sapiens
agaccccgtggctctgggaga

SEQ ID NO: 5173259 - DNA, 19 bp, Homo sapiens
agacccctaccctttccca

SEQ ID NO: 5173260 - DNA, 12 bp, Homo sapiens
agacccctgccc

SEQ ID NO: 5173261 - DNA, 14 bp, Homo sapiens
agacccctgcccaa

SEQ ID NO: 5173262 - DNA, 17 bp, Homo sapiens
agacccctgcccaagtg

SEQ ID NO: 5173263 - DNA, 22 bp, Homo sapiens
agacccctgcccaagtggctct

SEQ ID NO: 5173264 - DNA, 15 bp, Homo sapiens
agacccctggctttt

SEQ ID NO: 5173265 - DNA, 23 bp, Homo sapiens
agacccctgggggaggcttccag

SEQ ID NO: 5173266 - DNA, 13 bp, Homo sapiens
agacccctgggtg

SEQ ID NO: 5173267 - DNA, 13 bp, Homo sapiens
agacccctgtctc

SEQ ID NO: 5173268 - DNA, 13 bp, Homo sapiens
agacccctgtggc

SEQ ID NO: 5173269 - DNA, 15 bp, Homo sapiens
agacccctgtggcag

SEQ ID NO: 5173270 - DNA, 19 bp, Homo sapiens
agaccccttgttgcactgc

SEQ ID NO: 5173271 - DNA, 23 bp, Homo sapiens
agacccgaaaatccagcgtgcac

SEQ ID NO: 5173272 - DNA, 15 bp, Homo sapiens
agacccgaggaaact

SEQ ID NO: 5173273 - DNA, 14 bp, Homo sapiens
agacccgccaggtc

SEQ ID NO: 5173274 - DNA, 22 bp, Homo sapiens
agacccgggaaggaaggctctc

SEQ ID NO: 5173275 - DNA, 17 bp, Homo sapiens
agacccggtcctgccct

SEQ ID NO: 5173276 - DNA, 23 bp, Homo sapiens
agacccggttattcgcccacccg

SEQ ID NO: 5173277 - DNA, 19 bp, Homo sapiens
agaccctaagcctcctttt

SEQ ID NO: 5173278 - DNA, 14 bp, Homo sapiens
agaccctatctccc

SEQ ID NO: 5173279 - DNA, 17 bp, Homo sapiens
agaccctatttgtttca

SEQ ID NO: 5173280 - DNA, 21 bp, Homo sapiens
agaccctcactgctggggagt

SEQ ID NO: 5173281 - DNA, 15 bp, Homo sapiens
agaccctccccacag

SEQ ID NO: 5173282 - DNA, 21 bp, Homo sapiens
agaccctccccacagtgccac

SEQ ID NO: 5173283 - DNA, 19 bp, Homo sapiens
agaccctccttccccaccc

SEQ ID NO: 5173284 - DNA, 16 bp, Homo sapiens
agaccctcgcagacct

SEQ ID NO: 5173285 - DNA, 17 bp, Homo sapiens
agaccctcgcagaccta

SEQ ID NO: 5173286 - DNA, 19 bp, Homo sapiens
agaccctcgcccaactcca

SEQ ID NO: 5173287 - DNA, 14 bp, Homo sapiens
agaccctcgtggcc

SEQ ID NO: 5173288 - DNA, 19 bp, Homo sapiens
agaccctctcaggctgtcc

SEQ ID NO: 5173289 - DNA, 16 bp, Homo sapiens
agaccctcttctctgg

SEQ ID NO: 5173290 - DNA, 19 bp, Homo sapiens
agaccctcttctctgggcc

SEQ ID NO: 5173291 - DNA, 20 bp, Homo sapiens
agaccctcttgcccatcctg

SEQ ID NO: 5173292 - DNA, 16 bp, Homo sapiens
agaccctctttcttgt

SEQ ID NO: 5173293 - DNA, 17 bp, Homo sapiens
agaccctctttcttgtt

SEQ ID NO: 5173294 - DNA, 22 bp, Homo sapiens
agaccctctttcttgtttgtca

SEQ ID NO: 5173295 - DNA, 14 bp, Homo sapiens
agaccctgagactc

SEQ ID NO: 5173296 - DNA, 18 bp, Homo sapiens
agaccctgaggccctggg

SEQ ID NO: 5173297 - DNA, 21 bp, Homo sapiens
agaccctgaggccctgggctg

SEQ ID NO: 5173298 - DNA, 20 bp, Homo sapiens
agaccctgcaaacagaacag

SEQ ID NO: 5173299 - DNA, 22 bp, Homo sapiens
agaccctgcaaacagaacaggg

SEQ ID NO: 5173300 - DNA, 17 bp, Homo sapiens
agaccctgccacagcca

SEQ ID NO: 5173301 - DNA, 20 bp, Homo sapiens
agaccctgccacagccagag

SEQ ID NO: 5173302 - DNA, 12 bp, Homo sapiens
agaccctgccag

SEQ ID NO: 5173303 - DNA, 13 bp, Homo sapiens
agaccctgcccac

SEQ ID NO: 5173304 - DNA, 15 bp, Homo sapiens
agaccctgcccaccc

SEQ ID NO: 5173305 - DNA, 19 bp, Homo sapiens
agaccctgcccaccccatc

SEQ ID NO: 5173306 - DNA, 14 bp, Homo sapiens
agaccctgccccct

SEQ ID NO: 5173307 - DNA, 14 bp, Homo sapiens
agaccctgccctgt

SEQ ID NO: 5173308 - DNA, 16 bp, Homo sapiens
agaccctgcgcccctg

SEQ ID NO: 5173309 - DNA, 13 bp, Homo sapiens
agaccctggagga

SEQ ID NO: 5173310 - DNA, 19 bp, Homo sapiens
agaccctgggtgggctctg

SEQ ID NO: 5173311 - DNA, 12 bp, Homo sapiens
agaccctgtctc

SEQ ID NO: 5173312 - DNA, 13 bp, Homo sapiens
agaccctgtctca

SEQ ID NO: 5173313 - DNA, 20 bp, Homo sapiens
agaccctgtgtcctccacca

SEQ ID NO: 5173314 - DNA, 21 bp, Homo sapiens
agaccctgtgtcctccaccat

SEQ ID NO: 5173315 - DNA, 13 bp, Homo sapiens
agaccctgttcta

SEQ ID NO: 5173316 - DNA, 21 bp, Homo sapiens
agacccttattgctgtcctgg

SEQ ID NO: 5173317 - DNA, 16 bp, Homo sapiens
agacccttatttaaaa

SEQ ID NO: 5173318 - DNA, 19 bp, Homo sapiens
agacccttcttgcctgctg

SEQ ID NO: 5173319 - DNA, 21 bp, Homo sapiens
agacccttcttgcctgctggg

SEQ ID NO: 5173320 - DNA, 20 bp, Homo sapiens
agacccttgaagatgtagct

SEQ ID NO: 5173321 - DNA, 18 bp, Homo sapiens
agacccttgacacctgct

SEQ ID NO: 5173322 - DNA, 16 bp, Homo sapiens
agacccttgcattaga

SEQ ID NO: 5173323 - DNA, 15 bp, Homo sapiens
agacccttgtggtcc

SEQ ID NO: 5173324 - DNA, 20 bp, Homo sapiens
agacccttgtggtcccaccc

SEQ ID NO: 5173325 - DNA, 14 bp, Homo sapiens
agaccgagaggcca

SEQ ID NO: 5173326 - DNA, 19 bp, Homo sapiens
agaccgagtgtggagctgc

SEQ ID NO: 5173327 - DNA, 13 bp, Homo sapiens
agaccgccaaata

SEQ ID NO: 5173328 - DNA, 14 bp, Homo sapiens
agaccgccccaggg

SEQ ID NO: 5173329 - DNA, 15 bp, Homo sapiens
agaccgccccagggc

SEQ ID NO: 5173330 - DNA, 16 bp, Homo sapiens
agaccgccccagggct

SEQ ID NO: 5173331 - DNA, 18 bp, Homo sapiens
agaccgccgtctaactca

SEQ ID NO: 5173332 - DNA, 15 bp, Homo sapiens
agaccgcgcccctgg

SEQ ID NO: 5173333 - DNA, 17 bp, Homo sapiens
agaccgcttcacccctg

SEQ ID NO: 5173334 - DNA, 18 bp, Homo sapiens
agaccgcttcacccctgc

SEQ ID NO: 5173335 - DNA, 20 bp, Homo sapiens
agaccgcttcacccctgcac

SEQ ID NO: 5173336 - DNA, 16 bp, Homo sapiens
agaccggaagctcctg

SEQ ID NO: 5173337 - DNA, 18 bp, Homo sapiens
agaccggaagctcctggt

SEQ ID NO: 5173338 - DNA, 15 bp, Homo sapiens
agaccggcctgccag

SEQ ID NO: 5173339 - DNA, 20 bp, Homo sapiens
agaccggcctgccaggagga

SEQ ID NO: 5173340 - DNA, 16 bp, Homo sapiens
agaccgggcccccctg

SEQ ID NO: 5173341 - DNA, 15 bp, Homo sapiens
agaccgtacaaactc

SEQ ID NO: 5173342 - DNA, 13 bp, Homo sapiens
agaccgtcctcac

SEQ ID NO: 5173343 - DNA, 18 bp, Homo sapiens
agaccgtcctcacccctg

SEQ ID NO: 5173344 - DNA, 14 bp, Homo sapiens
agaccgtcttcctc

SEQ ID NO: 5173345 - DNA, 18 bp, Homo sapiens
agaccgtgaagatacttt

SEQ ID NO: 5173346 - DNA, 19 bp, Homo sapiens
agaccgtgaagatactttg

SEQ ID NO: 5173347 - DNA, 20 bp, Homo sapiens
agaccgtgaagatactttgt

SEQ ID NO: 5173348 - DNA, 19 bp, Homo sapiens
agaccgtgatttggaagag

SEQ ID NO: 5173349 - DNA, 17 bp, Homo sapiens
agaccgtggtgtcctct

SEQ ID NO: 5173350 - DNA, 22 bp, Homo sapiens
agaccgtgtcccaaggagctga

SEQ ID NO: 5173351 - DNA, 21 bp, Homo sapiens
agacctaaagtgcttgctttt

SEQ ID NO: 5173352 - DNA, 12 bp, Homo sapiens
agacctaaccag

SEQ ID NO: 5173353 - DNA, 19 bp, Homo sapiens
agacctaacgagaaataga

SEQ ID NO: 5173354 - DNA, 15 bp, Homo sapiens
agacctaatgctcct

SEQ ID NO: 5173355 - DNA, 14 bp, Homo sapiens
agacctacagacct

SEQ ID NO: 5173356 - DNA, 14 bp, Homo sapiens
agacctacaggggg

SEQ ID NO: 5173357 - DNA, 20 bp, Homo sapiens
agacctacattccctctcct

SEQ ID NO: 5173358 - DNA, 14 bp, Homo sapiens
agacctacctcagg

SEQ ID NO: 5173359 - DNA, 18 bp, Homo sapiens
agacctactgcactgagt

SEQ ID NO: 5173360 - DNA, 15 bp, Homo sapiens
agacctactgttcta

SEQ ID NO: 5173361 - DNA, 17 bp, Homo sapiens
agacctactgttctaaa

SEQ ID NO: 5173362 - DNA, 18 bp, Homo sapiens
agacctactgttctaaag

SEQ ID NO: 5173363 - DNA, 19 bp, Homo sapiens
agacctactgttctaaagc

SEQ ID NO: 5173364 - DNA, 14 bp, Homo sapiens
agacctagacctgg

SEQ ID NO: 5173365 - DNA, 18 bp, Homo sapiens
agacctagacctgggcca

SEQ ID NO: 5173366 - DNA, 17 bp, Homo sapiens
agacctatactgaaaga

SEQ ID NO: 5173367 - DNA, 23 bp, Homo sapiens
agacctatactgaaagatctctg

SEQ ID NO: 5173368 - DNA, 14 bp, Homo sapiens
agacctatgataaa

SEQ ID NO: 5173369 - DNA, 15 bp, Homo sapiens
agacctatgataaat

SEQ ID NO: 5173370 - DNA, 16 bp, Homo sapiens
agacctatgtaagaat

SEQ ID NO: 5173371 - DNA, 14 bp, Homo sapiens
agacctcaagccct

SEQ ID NO: 5173372 - DNA, 17 bp, Homo sapiens
agacctcaagccctgag

SEQ ID NO: 5173373 - DNA, 15 bp, Homo sapiens
agacctcagaagtaa

SEQ ID NO: 5173374 - DNA, 15 bp, Homo sapiens
agacctcagatgtgt

SEQ ID NO: 5173375 - DNA, 19 bp, Homo sapiens
actttttacagcagcaata

SEQ ID NO: 5173376 - DNA, 14 bp, Homo sapiens
actttttacattac

SEQ ID NO: 5173377 - DNA, 16 bp, Homo sapiens
actttttagattattc

SEQ ID NO: 5173378 - DNA, 22 bp, Homo sapiens
actttttagccagtgacttttt

SEQ ID NO: 5173379 - DNA, 15 bp, Homo sapiens
actttttagtaattt

SEQ ID NO: 5173380 - DNA, 12 bp, Homo sapiens
actttttataat

SEQ ID NO: 5173381 - DNA, 12 bp, Homo sapiens
actttttatact

SEQ ID NO: 5173382 - DNA, 21 bp, Homo sapiens
actttttatactccatacata

SEQ ID NO: 5173383 - DNA, 12 bp, Homo sapiens
actttttatata

SEQ ID NO: 5173384 - DNA, 15 bp, Homo sapiens
actttttatatagca

SEQ ID NO: 5173385 - DNA, 21 bp, Homo sapiens
actttttatatagcaaaatga

SEQ ID NO: 5173386 - DNA, 15 bp, Homo sapiens
actttttatattctc

SEQ ID NO: 5173387 - DNA, 19 bp, Homo sapiens
actttttatgtaatacttt

SEQ ID NO: 5173388 - DNA, 15 bp, Homo sapiens
actttttatgtgcta

SEQ ID NO: 5173389 - DNA, 15 bp, Homo sapiens
actttttattgattt

SEQ ID NO: 5173390 - DNA, 14 bp, Homo sapiens
actttttattgcct

SEQ ID NO: 5173391 - DNA, 17 bp, Homo sapiens
actttttattgccttct

SEQ ID NO: 5173392 - DNA, 22 bp, Homo sapiens
actttttatttaattaaatgta

SEQ ID NO: 5173393 - DNA, 17 bp, Homo sapiens
actttttatttctaaat

SEQ ID NO: 5173394 - DNA, 19 bp, Homo sapiens
actttttatttgaggagac

SEQ ID NO: 5173395 - DNA, 21 bp, Homo sapiens
actttttcaagattgatcatt

SEQ ID NO: 5173396 - DNA, 11 bp, Homo sapiens
actttttcaca

SEQ ID NO: 5173397 - DNA, 21 bp, Homo sapiens
actttttcagagttgctttaa

SEQ ID NO: 5173398 - DNA, 16 bp, Homo sapiens
actttttcatgaaaat

SEQ ID NO: 5173399 - DNA, 13 bp, Homo sapiens
actttttcattcc

SEQ ID NO: 5173400 - DNA, 11 bp, Homo sapiens
actttttccag

SEQ ID NO: 5173401 - DNA, 17 bp, Homo sapiens
actttttcccctgcaat

SEQ ID NO: 5173402 - DNA, 19 bp, Homo sapiens
actttttcccctgcaatgc

SEQ ID NO: 5173403 - DNA, 12 bp, Homo sapiens
actttttcctct

SEQ ID NO: 5173404 - DNA, 13 bp, Homo sapiens
actttttcctggc

SEQ ID NO: 5173405 - DNA, 18 bp, Homo sapiens
actttttccttactgtgc

SEQ ID NO: 5173406 - DNA, 13 bp, Homo sapiens
actttttccttcc

SEQ ID NO: 5173407 - DNA, 19 bp, Homo sapiens
actttttccttcctgccct

SEQ ID NO: 5173408 - DNA, 16 bp, Homo sapiens
actttttcgtgtggat

SEQ ID NO: 5173409 - DNA, 12 bp, Homo sapiens
actttttctgta

SEQ ID NO: 5173410 - DNA, 17 bp, Homo sapiens
actttttcttgtattca

SEQ ID NO: 5173411 - DNA, 16 bp, Homo sapiens
actttttcttttgctt

SEQ ID NO: 5173412 - DNA, 17 bp, Homo sapiens
actttttcttttgcttt

SEQ ID NO: 5173413 - DNA, 20 bp, Homo sapiens
actttttgaactaagaaact

SEQ ID NO: 5173414 - DNA, 11 bp, Homo sapiens
actttttgatg

SEQ ID NO: 5173415 - DNA, 12 bp, Homo sapiens
actttttgcagc

SEQ ID NO: 5173416 - DNA, 23 bp, Homo sapiens
actttttggtaatatatatattt

SEQ ID NO: 5173417 - DNA, 19 bp, Homo sapiens
actttttggtggatgtaaa

SEQ ID NO: 5173418 - DNA, 16 bp, Homo sapiens
actttttgtaaatgct

SEQ ID NO: 5173419 - DNA, 17 bp, Homo sapiens
actttttgtaaatgctg

SEQ ID NO: 5173420 - DNA, 15 bp, Homo sapiens
actttttgtatttag

SEQ ID NO: 5173421 - DNA, 21 bp, Homo sapiens
actttttgtattttttcctta

SEQ ID NO: 5173422 - DNA, 13 bp, Homo sapiens
actttttgtgaag

SEQ ID NO: 5173423 - DNA, 17 bp, Homo sapiens
actttttgttccagagc

SEQ ID NO: 5173424 - DNA, 19 bp, Homo sapiens
actttttgtttttatttct

SEQ ID NO: 5173425 - DNA, 20 bp, Homo sapiens
actttttgtttttatttctt

SEQ ID NO: 5173426 - DNA, 21 bp, Homo sapiens
acttttttaaaaagaaactat

SEQ ID NO: 5173427 - DNA, 15 bp, Homo sapiens
acttttttaaaattg

SEQ ID NO: 5173428 - DNA, 23 bp, Homo sapiens
acttttttaaaattgtgttctta

SEQ ID NO: 5173429 - DNA, 13 bp, Homo sapiens
acttttttaaact

SEQ ID NO: 5173430 - DNA, 17 bp, Homo sapiens
acttttttaaataaact

SEQ ID NO: 5173431 - DNA, 21 bp, Homo sapiens
acttttttaaattaagacaaa

SEQ ID NO: 5173432 - DNA, 20 bp, Homo sapiens
acttttttacactgataaaa

SEQ ID NO: 5173433 - DNA, 15 bp, Homo sapiens
acttttttagaatga

SEQ ID NO: 5173434 - DNA, 12 bp, Homo sapiens
acttttttataa

SEQ ID NO: 5173435 - DNA, 13 bp, Homo sapiens
acttttttatagc

SEQ ID NO: 5173436 - DNA, 20 bp, Homo sapiens
acttttttatccacctccct

SEQ ID NO: 5173437 - DNA, 22 bp, Homo sapiens
acttttttatgaagaaaaagta

SEQ ID NO: 5173438 - DNA, 15 bp, Homo sapiens
acttttttatttaaa

SEQ ID NO: 5173439 - DNA, 23 bp, Homo sapiens
acttttttatttaaaaaactaaa

SEQ ID NO: 5173440 - DNA, 22 bp, Homo sapiens
acttttttattttttaaatctt

SEQ ID NO: 5173441 - DNA, 13 bp, Homo sapiens
acttttttcaaat

SEQ ID NO: 5173442 - DNA, 22 bp, Homo sapiens
acttttttcaaatattgaatgc

SEQ ID NO: 5173443 - DNA, 19 bp, Homo sapiens
acttttttcattttgaaaa

SEQ ID NO: 5173444 - DNA, 11 bp, Homo sapiens
acttttttccc

SEQ ID NO: 5173445 - DNA, 15 bp, Homo sapiens
acttttttcctgtca

SEQ ID NO: 5173446 - DNA, 17 bp, Homo sapiens
acttttttcctgtcaat

SEQ ID NO: 5173447 - DNA, 17 bp, Homo sapiens
acttttttctattttgt

SEQ ID NO: 5173448 - DNA, 13 bp, Homo sapiens
acttttttctcta

SEQ ID NO: 5173449 - DNA, 22 bp, Homo sapiens
acttttttctttaaattttgtt

SEQ ID NO: 5173450 - DNA, 14 bp, Homo sapiens
acttttttctttga

SEQ ID NO: 5173451 - DNA, 16 bp, Homo sapiens
acttttttgaaatcag

SEQ ID NO: 5173452 - DNA, 18 bp, Homo sapiens
acttttttgaaatcagta

SEQ ID NO: 5173453 - DNA, 20 bp, Homo sapiens
acttttttgagacatgggat

SEQ ID NO: 5173454 - DNA, 22 bp, Homo sapiens
acttttttgagtggatgatgtt

SEQ ID NO: 5173455 - DNA, 22 bp, Homo sapiens
acttttttggggatatgcttag

SEQ ID NO: 5173456 - DNA, 18 bp, Homo sapiens
acttttttgtacataaat

SEQ ID NO: 5173457 - DNA, 14 bp, Homo sapiens
acttttttgtgtat

SEQ ID NO: 5173458 - DNA, 13 bp, Homo sapiens
actttttttagta

SEQ ID NO: 5173459 - DNA, 15 bp, Homo sapiens
actttttttcaatgt

SEQ ID NO: 5173460 - DNA, 14 bp, Homo sapiens
actttttttcagtt

SEQ ID NO: 5173461 - DNA, 19 bp, Homo sapiens
actttttttctatattatt

SEQ ID NO: 5173462 - DNA, 21 bp, Homo sapiens
actttttttctgtaccagtta

SEQ ID NO: 5173463 - DNA, 20 bp, Homo sapiens
actttttttctgtgacattt

SEQ ID NO: 5173464 - DNA, 13 bp, Homo sapiens
actttttttcttt

SEQ ID NO: 5173465 - DNA, 19 bp, Homo sapiens
actttttttggaagttatt

SEQ ID NO: 5173466 - DNA, 17 bp, Homo sapiens
actttttttgtatgtgt

SEQ ID NO: 5173467 - DNA, 18 bp, Homo sapiens
acttttttttagttcaat

SEQ ID NO: 5173468 - DNA, 15 bp, Homo sapiens
acttttttttgagaa

SEQ ID NO: 5173469 - DNA, 16 bp, Homo sapiens
acttttttttgagaat

SEQ ID NO: 5173470 - DNA, 16 bp, Homo sapiens
actttttttttatact

SEQ ID NO: 5173471 - DNA, 18 bp, Homo sapiens
actttttttttattttat

SEQ ID NO: 5173472 - DNA, 20 bp, Homo sapiens
agaaaaaaaaaaacttacac

SEQ ID NO: 5173473 - DNA, 13 bp, Homo sapiens
agaaaaaaaaaag

SEQ ID NO: 5173474 - DNA, 16 bp, Homo sapiens
agaaaaaaaaaatgat

SEQ ID NO: 5173475 - DNA, 17 bp, Homo sapiens
agaaaaaaaaaatgatt

SEQ ID NO: 5173476 - DNA, 14 bp, Homo sapiens
agaaaaaaaaacac

SEQ ID NO: 5173477 - DNA, 17 bp, Homo sapiens
agaaaaaaaaactgggg

SEQ ID NO: 5173478 - DNA, 16 bp, Homo sapiens
agaaaaaaaaagaaaa

SEQ ID NO: 5173479 - DNA, 20 bp, Homo sapiens
agaaaaaaaaagaaaaatca

SEQ ID NO: 5173480 - DNA, 17 bp, Homo sapiens
agaaaaaaaaagcaaat

SEQ ID NO: 5173481 - DNA, 23 bp, Homo sapiens
agaaaaaaaaagcaaatcagaaa

SEQ ID NO: 5173482 - DNA, 17 bp, Homo sapiens
agaaaaaaaaataacac

SEQ ID NO: 5173483 - DNA, 17 bp, Homo sapiens
agaaaaaaaaatactta

SEQ ID NO: 5173484 - DNA, 20 bp, Homo sapiens
agaaaaaaaaatacttaaat

SEQ ID NO: 5173485 - DNA, 19 bp, Homo sapiens
agaaaaaaaaccttgtaaa

SEQ ID NO: 5173486 - DNA, 21 bp, Homo sapiens
agaaaaaaaaccttgtaaaaa

SEQ ID NO: 5173487 - DNA, 22 bp, Homo sapiens
agaaaaaaaagaaaaaagtcct

SEQ ID NO: 5173488 - DNA, 18 bp, Homo sapiens
agaaaaaaaatagacttt

SEQ ID NO: 5173489 - DNA, 14 bp, Homo sapiens
agaaaaaaacaaac

SEQ ID NO: 5173490 - DNA, 13 bp, Homo sapiens
agaaaaaaaccat

SEQ ID NO: 5173491 - DNA, 18 bp, Homo sapiens
agaaaaaaactataaata

SEQ ID NO: 5173492 - DNA, 16 bp, Homo sapiens
agaaaaaaagaaaaaa

SEQ ID NO: 5173493 - DNA, 20 bp, Homo sapiens
agaaaaaaagaaaagaaaaa

SEQ ID NO: 5173494 - DNA, 19 bp, Homo sapiens
agaaaaaaagctgcaaaaa

SEQ ID NO: 5173495 - DNA, 16 bp, Homo sapiens
agaaaaaaagggagaa

SEQ ID NO: 5173496 - DNA, 14 bp, Homo sapiens
agaaaaaaataatt

SEQ ID NO: 5173497 - DNA, 16 bp, Homo sapiens
agaaaaaaatactatt

SEQ ID NO: 5173498 - DNA, 22 bp, Homo sapiens
agaaaaaaatataaaatttctg

SEQ ID NO: 5173499 - DNA, 14 bp, Homo sapiens
agaaaaaaatcttc

SEQ ID NO: 5173500 - DNA, 21 bp, Homo sapiens
agaaaaaaatcttctccagat

SEQ ID NO: 5173501 - DNA, 21 bp, Homo sapiens
agaaaaaaatgattgttttag

SEQ ID NO: 5173502 - DNA, 16 bp, Homo sapiens
agaaaaaaatgtacat

SEQ ID NO: 5173503 - DNA, 22 bp, Homo sapiens
agaaaaaaatgtattttatgtt

SEQ ID NO: 5173504 - DNA, 23 bp, Homo sapiens
agaaaaaaatgtattttatgtta

SEQ ID NO: 5173505 - DNA, 15 bp, Homo sapiens
agaaaaaaattcatg

SEQ ID NO: 5173506 - DNA, 12 bp, Homo sapiens
agaaaaaaattg

SEQ ID NO: 5173507 - DNA, 14 bp, Homo sapiens
agaaaaaaattgaa

SEQ ID NO: 5173508 - DNA, 15 bp, Homo sapiens
agaaaaaaattgctc

SEQ ID NO: 5173509 - DNA, 11 bp, Homo sapiens
agaaaaaacaa

SEQ ID NO: 5173510 - DNA, 14 bp, Homo sapiens
agaaaaaacaaaaa

SEQ ID NO: 5173511 - DNA, 12 bp, Homo sapiens
agaaaaaacaac

SEQ ID NO: 5173512 - DNA, 18 bp, Homo sapiens
agaaaaaacaatttttga

SEQ ID NO: 5173513 - DNA, 19 bp, Homo sapiens
agaaaaaacaatttttgaa

SEQ ID NO: 5173514 - DNA, 15 bp, Homo sapiens
agaaaaaactggaaa

SEQ ID NO: 5173515 - DNA, 18 bp, Homo sapiens
agaaaaaactggaaacat

SEQ ID NO: 5173516 - DNA, 19 bp, Homo sapiens
agaaaaaactggaaacatc

SEQ ID NO: 5173517 - DNA, 17 bp, Homo sapiens
agaaaaaagaaaaatct

SEQ ID NO: 5173518 - DNA, 19 bp, Homo sapiens
agaaaaaagaaaaatctca

SEQ ID NO: 5173519 - DNA, 18 bp, Homo sapiens
agaaaaaagagaaaagaa

SEQ ID NO: 5173520 - DNA, 13 bp, Homo sapiens
agaaaaaagcaag

SEQ ID NO: 5173521 - DNA, 14 bp, Homo sapiens
agaaaaaagcaatt

SEQ ID NO: 5173522 - DNA, 13 bp, Homo sapiens
agaaaaaaggact

SEQ ID NO: 5173523 - DNA, 23 bp, Homo sapiens
agaaaaaagtcaccattctgcat

SEQ ID NO: 5173524 - DNA, 17 bp, Homo sapiens
agaaaaaagtccagatt

SEQ ID NO: 5173525 - DNA, 19 bp, Homo sapiens
agaaaaaagtccttcagtt

SEQ ID NO: 5173526 - DNA, 13 bp, Homo sapiens
agaaaaaagtgtt

SEQ ID NO: 5173527 - DNA, 15 bp, Homo sapiens
agaaaaaagtgttga

SEQ ID NO: 5173528 - DNA, 14 bp, Homo sapiens
agaaaaaagtgttt

SEQ ID NO: 5173529 - DNA, 14 bp, Homo sapiens
agaaaaaagttgta

SEQ ID NO: 5173530 - DNA, 13 bp, Homo sapiens
agaaaaaataaat

SEQ ID NO: 5173531 - DNA, 22 bp, Homo sapiens
agaaaaaatacattttatatta

SEQ ID NO: 5173532 - DNA, 19 bp, Homo sapiens
agaaaaaatattttcccta

SEQ ID NO: 5173533 - DNA, 17 bp, Homo sapiens
agaaaaaatattttcct

SEQ ID NO: 5173534 - DNA, 23 bp, Homo sapiens
agaaaaaatattttcctgccagg

SEQ ID NO: 5173535 - DNA, 17 bp, Homo sapiens
agaaaaaatcactgttt

SEQ ID NO: 5173536 - DNA, 13 bp, Homo sapiens
agaaaaaatcaga

SEQ ID NO: 5173537 - DNA, 14 bp, Homo sapiens
agaaaaaatgtaga

SEQ ID NO: 5173538 - DNA, 17 bp, Homo sapiens
agaaaaaattaactagg

SEQ ID NO: 5173539 - DNA, 15 bp, Homo sapiens
agaaaaaattttaaa

SEQ ID NO: 5173540 - DNA, 23 bp, Homo sapiens
agaaaaacaaactcgttttttac

SEQ ID NO: 5173541 - DNA, 12 bp, Homo sapiens
agaaaaacaaag

SEQ ID NO: 5173542 - DNA, 16 bp, Homo sapiens
agaaaaacaataagag

SEQ ID NO: 5173543 - DNA, 22 bp, Homo sapiens
agaaaaacaatggtaacatttt

SEQ ID NO: 5173544 - DNA, 16 bp, Homo sapiens
agaaaaacacgagaaa

SEQ ID NO: 5173545 - DNA, 12 bp, Homo sapiens
agaaaaacattt

SEQ ID NO: 5173546 - DNA, 18 bp, Homo sapiens
agaaaaaccaatgattca

SEQ ID NO: 5173547 - DNA, 14 bp, Homo sapiens
agaaaaactaactt

SEQ ID NO: 5173548 - DNA, 20 bp, Homo sapiens
agaaaaactggctctgattg

SEQ ID NO: 5173549 - DNA, 17 bp, Homo sapiens
agaaaaactttaaaaat

SEQ ID NO: 5173550 - DNA, 13 bp, Homo sapiens
agaaaaagaaaca

SEQ ID NO: 5173551 - DNA, 13 bp, Homo sapiens
agaaaaagaaatg

SEQ ID NO: 5173552 - DNA, 22 bp, Homo sapiens
agaaaaagaacatgcagtttga

SEQ ID NO: 5173553 - DNA, 15 bp, Homo sapiens
agaaaaagaagaagg

SEQ ID NO: 5173554 - DNA, 15 bp, Homo sapiens
agaaaaagaagctga

SEQ ID NO: 5173555 - DNA, 11 bp, Homo sapiens
agaaaaagaat

SEQ ID NO: 5173556 - DNA, 17 bp, Homo sapiens
agacctcagatgtgttg

SEQ ID NO: 5173557 - DNA, 12 bp, Homo sapiens
agacctcagcca

SEQ ID NO: 5173558 - DNA, 13 bp, Homo sapiens
agacctcagcctg

SEQ ID NO: 5173559 - DNA, 17 bp, Homo sapiens
agacctcagcctgtgct

SEQ ID NO: 5173560 - DNA, 13 bp, Homo sapiens
agacctcagggca

SEQ ID NO: 5173561 - DNA, 20 bp, Homo sapiens
agacctcatcagccttggga

SEQ ID NO: 5173562 - DNA, 14 bp, Homo sapiens
agacctcatctcca

SEQ ID NO: 5173563 - DNA, 17 bp, Homo sapiens
agacctcatctctacta

SEQ ID NO: 5173564 - DNA, 21 bp, Homo sapiens
agacctcatctgcctgcagtg

SEQ ID NO: 5173565 - DNA, 16 bp, Homo sapiens
agacctccaataaagt

SEQ ID NO: 5173566 - DNA, 15 bp, Homo sapiens
agacctccacttgct

SEQ ID NO: 5173567 - DNA, 15 bp, Homo sapiens
agacctccagattat

SEQ ID NO: 5173568 - DNA, 20 bp, Homo sapiens
agacctccccagcccctagc

SEQ ID NO: 5173569 - DNA, 23 bp, Homo sapiens
agacctccccagcccctagccca

SEQ ID NO: 5173570 - DNA, 12 bp, Homo sapiens
agacctccccca

SEQ ID NO: 5173571 - DNA, 19 bp, Homo sapiens
agacctcccccagggaggg

SEQ ID NO: 5173572 - DNA, 17 bp, Homo sapiens
agacctccccctcactt

SEQ ID NO: 5173573 - DNA, 15 bp, Homo sapiens
agacctcccctcttc

SEQ ID NO: 5173574 - DNA, 20 bp, Homo sapiens
agacctcccctcttcctgga

SEQ ID NO: 5173575 - DNA, 17 bp, Homo sapiens
agacctccctgtgagag

SEQ ID NO: 5173576 - DNA, 20 bp, Homo sapiens
agacctccctgtgagagagt

SEQ ID NO: 5173577 - DNA, 16 bp, Homo sapiens
agacctcgagcagatg

SEQ ID NO: 5173578 - DNA, 16 bp, Homo sapiens
agacctcggctgtgtg

SEQ ID NO: 5173579 - DNA, 20 bp, Homo sapiens
agacctctcaacagatctgt

SEQ ID NO: 5173580 - DNA, 22 bp, Homo sapiens
agacctctcaacagatctgtgg

SEQ ID NO: 5173581 - DNA, 20 bp, Homo sapiens
agacctctgaatgtcccaga

SEQ ID NO: 5173582 - DNA, 23 bp, Homo sapiens
agacctctgaatgtcccagaggc

SEQ ID NO: 5173583 - DNA, 13 bp, Homo sapiens
agacctctgccta

SEQ ID NO: 5173584 - DNA, 12 bp, Homo sapiens
agacctctggat

SEQ ID NO: 5173585 - DNA, 18 bp, Homo sapiens
agacctctgtgcacttat

SEQ ID NO: 5173586 - DNA, 15 bp, Homo sapiens
agacctcttcatgtt

SEQ ID NO: 5173587 - DNA, 18 bp, Homo sapiens
agacctcttccctctggg

SEQ ID NO: 5173588 - DNA, 21 bp, Homo sapiens
agacctcttccctctgggcct

SEQ ID NO: 5173589 - DNA, 19 bp, Homo sapiens
agacctcttcctggaataa

SEQ ID NO: 5173590 - DNA, 19 bp, Homo sapiens
agacctgacaagcactgct

SEQ ID NO: 5173591 - DNA, 20 bp, Homo sapiens
agacctgacaccgtccctca

SEQ ID NO: 5173592 - DNA, 23 bp, Homo sapiens
agacctgacaccgtccctcagtg

SEQ ID NO: 5173593 - DNA, 24 bp, Homo sapiens
agacctgagatgaagattcatgtt

SEQ ID NO: 5173594 - DNA, 20 bp, Homo sapiens
agacctgagatgctggtcaa

SEQ ID NO: 5173595 - DNA, 17 bp, Homo sapiens
agacctgagggaccctt

SEQ ID NO: 5173596 - DNA, 14 bp, Homo sapiens
agacctgagtattt

SEQ ID NO: 5173597 - DNA, 15 bp, Homo sapiens
agacctgagtatttt

SEQ ID NO: 5173598 - DNA, 22 bp, Homo sapiens
agacctgagtattttttataat

SEQ ID NO: 5173599 - DNA, 14 bp, Homo sapiens
agacctgatcctgg

SEQ ID NO: 5173600 - DNA, 15 bp, Homo sapiens
agacctgatcctgga

SEQ ID NO: 5173601 - DNA, 18 bp, Homo sapiens
agacctgatcctggaggc

SEQ ID NO: 5173602 - DNA, 19 bp, Homo sapiens
agacctgatcctggaggcc

SEQ ID NO: 5173603 - DNA, 22 bp, Homo sapiens
agacctgatcctggaggcccag

SEQ ID NO: 5173604 - DNA, 19 bp, Homo sapiens
agacctgcagacgcccaga

SEQ ID NO: 5173605 - DNA, 14 bp, Homo sapiens
agacctgcagtgag

SEQ ID NO: 5173606 - DNA, 17 bp, Homo sapiens
agacctgcatggtcaag

SEQ ID NO: 5173607 - DNA, 12 bp, Homo sapiens
agacctgccagc

SEQ ID NO: 5173608 - DNA, 14 bp, Homo sapiens
agacctgccagcca

SEQ ID NO: 5173609 - DNA, 23 bp, Homo sapiens
agacctgccagccactgtcaccg

SEQ ID NO: 5173610 - DNA, 16 bp, Homo sapiens
agacctgcccctccct

SEQ ID NO: 5173611 - DNA, 16 bp, Homo sapiens
agacctgcccctcctc

SEQ ID NO: 5173612 - DNA, 23 bp, Homo sapiens
agacctgcccctcctctctgccc

SEQ ID NO: 5173613 - DNA, 22 bp, Homo sapiens
agacctgccctcaagagcaaag

SEQ ID NO: 5173614 - DNA, 15 bp, Homo sapiens
agacctgccctctct

SEQ ID NO: 5173615 - DNA, 12 bp, Homo sapiens
agacctgcctgt

SEQ ID NO: 5173616 - DNA, 15 bp, Homo sapiens
agacctgcctgtgtg

SEQ ID NO: 5173617 - DNA, 13 bp, Homo sapiens
agacctgcgaagg

SEQ ID NO: 5173618 - DNA, 14 bp, Homo sapiens
agacctgctcaggc

SEQ ID NO: 5173619 - DNA, 12 bp, Homo sapiens
agacctgctcca

SEQ ID NO: 5173620 - DNA, 16 bp, Homo sapiens
agacctgctccagatc

SEQ ID NO: 5173621 - DNA, 13 bp, Homo sapiens
agacctgctctcc

SEQ ID NO: 5173622 - DNA, 23 bp, Homo sapiens
agacctgctctccggcgcagaca

SEQ ID NO: 5173623 - DNA, 14 bp, Homo sapiens
agacctgctctgga

SEQ ID NO: 5173624 - DNA, 17 bp, Homo sapiens
agacctgctctggacac

SEQ ID NO: 5173625 - DNA, 19 bp, Homo sapiens
agacctgcttcctgaaata

SEQ ID NO: 5173626 - DNA, 20 bp, Homo sapiens
agacctgctttttgaaatga

SEQ ID NO: 5173627 - DNA, 15 bp, Homo sapiens
agacctggaaccaga

SEQ ID NO: 5173628 - DNA, 20 bp, Homo sapiens
agacctggagcccctgggtg

SEQ ID NO: 5173629 - DNA, 12 bp, Homo sapiens
agacctggagct

SEQ ID NO: 5173630 - DNA, 13 bp, Homo sapiens
agacctggagctt

SEQ ID NO: 5173631 - DNA, 22 bp, Homo sapiens
agacctggagcttcagccaggt

SEQ ID NO: 5173632 - DNA, 22 bp, Homo sapiens
agacctggcaaggacacagatg

SEQ ID NO: 5173633 - DNA, 23 bp, Homo sapiens
agacctggcagctctggacagcc

SEQ ID NO: 5173634 - DNA, 12 bp, Homo sapiens
agacctggcctt

SEQ ID NO: 5173635 - DNA, 15 bp, Homo sapiens
agacctggcctttca

SEQ ID NO: 5173636 - DNA, 17 bp, Homo sapiens
agacctggctgggcctg

SEQ ID NO: 5173637 - DNA, 18 bp, Homo sapiens
agacctgggatttgagat

SEQ ID NO: 5173638 - DNA, 16 bp, Homo sapiens
agacctgggccaaaag

SEQ ID NO: 5173639 - DNA, 21 bp, Homo sapiens
agacctgggccaaaagggcag

SEQ ID NO: 5173640 - DNA, 14 bp, Homo sapiens
agacctgggccctg

SEQ ID NO: 5173641 - DNA, 18 bp, Homo sapiens
agacctggtgtgcggagg

SEQ ID NO: 5173642 - DNA, 15 bp, Homo sapiens
agacctgtcaccctg

SEQ ID NO: 5173643 - DNA, 17 bp, Homo sapiens
agacctgtcctcctggt

SEQ ID NO: 5173644 - DNA, 15 bp, Homo sapiens
agacctgtctcctgg

SEQ ID NO: 5173645 - DNA, 19 bp, Homo sapiens
agacctgtgacctggtctg

SEQ ID NO: 5173646 - DNA, 15 bp, Homo sapiens
agacctgtgagggga

SEQ ID NO: 5173647 - DNA, 15 bp, Homo sapiens
agacctgtgtgaact

SEQ ID NO: 5173648 - DNA, 16 bp, Homo sapiens
agacctgtgtgaacta

SEQ ID NO: 5173649 - DNA, 19 bp, Homo sapiens
agacctgttagcagacagg

SEQ ID NO: 5173650 - DNA, 21 bp, Homo sapiens
agacctgttggcctgtgggcc

SEQ ID NO: 5173651 - DNA, 21 bp, Homo sapiens
agacctgttggttccaagccc

SEQ ID NO: 5173652 - DNA, 19 bp, Homo sapiens
agaccttaagacactgtga

SEQ ID NO: 5173653 - DNA, 22 bp, Homo sapiens
agaccttaataaaggcccccac

SEQ ID NO: 5173654 - DNA, 18 bp, Homo sapiens
agaccttactcaggggat

SEQ ID NO: 5173655 - DNA, 15 bp, Homo sapiens
agaccttcacagatg

SEQ ID NO: 5173656 - DNA, 16 bp, Homo sapiens
agaccttcacagatgc

SEQ ID NO: 5173657 - DNA, 16 bp, Homo sapiens
agaccttcaccaaaca

SEQ ID NO: 5173658 - DNA, 23 bp, Homo sapiens
agaccttccataatgctactgtc

SEQ ID NO: 5173659 - DNA, 20 bp, Homo sapiens
agaccttctagtgagcctgg

SEQ ID NO: 5173660 - DNA, 23 bp, Homo sapiens
agaccttctagtgagcctgggcc

SEQ ID NO: 5173661 - DNA, 20 bp, Homo sapiens
agaccttctccctagccctt

SEQ ID NO: 5173662 - DNA, 18 bp, Homo sapiens
agaccttctccttcacct

SEQ ID NO: 5173663 - DNA, 23 bp, Homo sapiens
agaccttctccttcacctttgtc

SEQ ID NO: 5173664 - DNA, 19 bp, Homo sapiens
agaccttctgaagatctca

SEQ ID NO: 5173665 - DNA, 16 bp, Homo sapiens
agaccttgcctcccct

SEQ ID NO: 5173666 - DNA, 21 bp, Homo sapiens
agaccttgctttgagactcct

SEQ ID NO: 5173667 - DNA, 16 bp, Homo sapiens
agaccttgttcacact

SEQ ID NO: 5173668 - DNA, 18 bp, Homo sapiens
agacctttatttttctat

SEQ ID NO: 5173669 - DNA, 20 bp, Homo sapiens
agacctttgaggatatcaaa

SEQ ID NO: 5173670 - DNA, 17 bp, Homo sapiens
agacctttgtctgaagg

SEQ ID NO: 5173671 - DNA, 17 bp, Homo sapiens
agaccttttcaacttgg

SEQ ID NO: 5173672 - DNA, 14 bp, Homo sapiens
agacctttttctgc

SEQ ID NO: 5173673 - DNA, 18 bp, Homo sapiens
agacctttttctgcacta

SEQ ID NO: 5173674 - DNA, 20 bp, Homo sapiens
agaccttttttttttttcca

SEQ ID NO: 5173675 - DNA, 22 bp, Homo sapiens
agacgacacctggagactgtcc

SEQ ID NO: 5173676 - DNA, 15 bp, Homo sapiens
agacgacagcccctg

SEQ ID NO: 5173677 - DNA, 23 bp, Homo sapiens
agacgacttatatatttgaaaga

SEQ ID NO: 5173678 - DNA, 24 bp, Homo sapiens
agacgagcatccccctcctctccc

SEQ ID NO: 5173679 - DNA, 19 bp, Homo sapiens
agacgagctgtctgctgcc

SEQ ID NO: 5173680 - DNA, 23 bp, Homo sapiens
agacgaggccctcgggcccagcc

SEQ ID NO: 5173681 - DNA, 23 bp, Homo sapiens
agacgatatttaattcacctcag

SEQ ID NO: 5173682 - DNA, 18 bp, Homo sapiens
agacgatcttgctggcag

SEQ ID NO: 5173683 - DNA, 19 bp, Homo sapiens
agacgatgtcttcatacct

SEQ ID NO: 5173684 - DNA, 17 bp, Homo sapiens
agacgatgtttatgttc

SEQ ID NO: 5173685 - DNA, 19 bp, Homo sapiens
agacgatgtttatgttctt

SEQ ID NO: 5173686 - DNA, 13 bp, Homo sapiens
agacgcagccctg

SEQ ID NO: 5173687 - DNA, 23 bp, Homo sapiens
agacgcagccctgggggccagct

SEQ ID NO: 5173688 - DNA, 15 bp, Homo sapiens
agacgccaccattcc

SEQ ID NO: 5173689 - DNA, 17 bp, Homo sapiens
agacgccaccattcctg

SEQ ID NO: 5173690 - DNA, 18 bp, Homo sapiens
agacgccactccctggga

SEQ ID NO: 5173691 - DNA, 14 bp, Homo sapiens
agacgccagtagca

SEQ ID NO: 5173692 - DNA, 12 bp, Homo sapiens
agacgcccagcc

SEQ ID NO: 5173693 - DNA, 13 bp, Homo sapiens
agacgcccctccc

SEQ ID NO: 5173694 - DNA, 16 bp, Homo sapiens
agacgccctatttcta

SEQ ID NO: 5173695 - DNA, 22 bp, Homo sapiens
agacgccggcttcctccttcca

SEQ ID NO: 5173696 - DNA, 23 bp, Homo sapiens
agacgccggcttcctccttccag

SEQ ID NO: 5173697 - DNA, 13 bp, Homo sapiens
agacgcctggctg

SEQ ID NO: 5173698 - DNA, 18 bp, Homo sapiens
agacgcctttctcctcca

SEQ ID NO: 5173699 - DNA, 18 bp, Homo sapiens
agacgctgtgctgccctg

SEQ ID NO: 5173700 - DNA, 21 bp, Homo sapiens
agacgctgtgctgccctgccc

SEQ ID NO: 5173701 - DNA, 20 bp, Homo sapiens
agacggaagggtaaacaata

SEQ ID NO: 5173702 - DNA, 15 bp, Homo sapiens
agacggacgggacag

SEQ ID NO: 5173703 - DNA, 16 bp, Homo sapiens
agacggagatgcatgg

SEQ ID NO: 5173704 - DNA, 18 bp, Homo sapiens
agacggagccttgctctg

SEQ ID NO: 5173705 - DNA, 18 bp, Homo sapiens
agacggaggaggggaagg

SEQ ID NO: 5173706 - DNA, 21 bp, Homo sapiens
agacggaggcctactcttcca

SEQ ID NO: 5173707 - DNA, 19 bp, Homo sapiens
agacggagtcccaccttgg

SEQ ID NO: 5173708 - DNA, 15 bp, Homo sapiens
agacggagtctcgct

SEQ ID NO: 5173709 - DNA, 23 bp, Homo sapiens
agacggagtcttgccctctcgcc

SEQ ID NO: 5173710 - DNA, 23 bp, Homo sapiens
agacggagtcttgctctgtagcc

SEQ ID NO: 5173711 - DNA, 17 bp, Homo sapiens
agacggagtgtgggagt

SEQ ID NO: 5173712 - DNA, 14 bp, Homo sapiens
agacggatccacag

SEQ ID NO: 5173713 - DNA, 21 bp, Homo sapiens
agacggatgcccattcctgcc

SEQ ID NO: 5173714 - DNA, 15 bp, Homo sapiens
agacggatggaagga

SEQ ID NO: 5173715 - DNA, 14 bp, Homo sapiens
agacggatggcagg

SEQ ID NO: 5173716 - DNA, 22 bp, Homo sapiens
agacggattatctagagaataa

SEQ ID NO: 5173717 - DNA, 14 bp, Homo sapiens
agacggattgcatt

SEQ ID NO: 5173718 - DNA, 22 bp, Homo sapiens
agacggcagaaaacagagcctg

SEQ ID NO: 5173719 - DNA, 23 bp, Homo sapiens
agacggccggccggacctctgag

SEQ ID NO: 5173720 - DNA, 19 bp, Homo sapiens
agacggcctaggggtggcg

SEQ ID NO: 5173721 - DNA, 12 bp, Homo sapiens
agacggcggcca

SEQ ID NO: 5173722 - DNA, 16 bp, Homo sapiens
agacggcggccaggca

SEQ ID NO: 5173723 - DNA, 20 bp, Homo sapiens
agacggcggccaggcacagg

SEQ ID NO: 5173724 - DNA, 22 bp, Homo sapiens
agacggcggccaggcacagggc

SEQ ID NO: 5173725 - DNA, 17 bp, Homo sapiens
agacggctggacctgca

SEQ ID NO: 5173726 - DNA, 15 bp, Homo sapiens
agacgggaggggagg

SEQ ID NO: 5173727 - DNA, 13 bp, Homo sapiens
agacgggcacaga

SEQ ID NO: 5173728 - DNA, 17 bp, Homo sapiens
agacgggcacagacacg

SEQ ID NO: 5173729 - DNA, 14 bp, Homo sapiens
agacgggccctggt

SEQ ID NO: 5173730 - DNA, 19 bp, Homo sapiens
agacggggtttcaccatgt

SEQ ID NO: 5173731 - DNA, 21 bp, Homo sapiens
agacggggtttcaccatgttg

SEQ ID NO: 5173732 - DNA, 23 bp, Homo sapiens
agacggggtttgccatgctggcc

SEQ ID NO: 5173733 - DNA, 13 bp, Homo sapiens
agaaaaagagaga

SEQ ID NO: 5173734 - DNA, 16 bp, Homo sapiens
agaaaaagatctttca

SEQ ID NO: 5173735 - DNA, 17 bp, Homo sapiens
agaaaaagcaaaaggca

SEQ ID NO: 5173736 - DNA, 14 bp, Homo sapiens
agaaaaagcacagc

SEQ ID NO: 5173737 - DNA, 15 bp, Homo sapiens
agaaaaagcacagct

SEQ ID NO: 5173738 - DNA, 13 bp, Homo sapiens
agaaaaagccctc

SEQ ID NO: 5173739 - DNA, 21 bp, Homo sapiens
agaaaaagcttaatgattctg

SEQ ID NO: 5173740 - DNA, 17 bp, Homo sapiens
agaaaaaggaaacaagc

SEQ ID NO: 5173741 - DNA, 17 bp, Homo sapiens
agaaaaaggacaaataa

SEQ ID NO: 5173742 - DNA, 18 bp, Homo sapiens
agaaaaaggatgcacaga

SEQ ID NO: 5173743 - DNA, 13 bp, Homo sapiens
agaaaaagggtca

SEQ ID NO: 5173744 - DNA, 15 bp, Homo sapiens
agaaaaagtaaaaga

SEQ ID NO: 5173745 - DNA, 22 bp, Homo sapiens
agaaaaagtcctgtcagttcag

SEQ ID NO: 5173746 - DNA, 21 bp, Homo sapiens
agaaaaagttgcagtctcaga

SEQ ID NO: 5173747 - DNA, 23 bp, Homo sapiens
agaaaaataagctcgagtgaatt

SEQ ID NO: 5173748 - DNA, 17 bp, Homo sapiens
agaaaaataagtcaaaa

SEQ ID NO: 5173749 - DNA, 17 bp, Homo sapiens
agaaaaatatatactaa

SEQ ID NO: 5173750 - DNA, 23 bp, Homo sapiens
agaaaaatatatatgtgcagtat

SEQ ID NO: 5173751 - DNA, 13 bp, Homo sapiens
agaaaaatatgag

SEQ ID NO: 5173752 - DNA, 12 bp, Homo sapiens
agaaaaatattt

SEQ ID NO: 5173753 - DNA, 13 bp, Homo sapiens
agaaaaatattta

SEQ ID NO: 5173754 - DNA, 21 bp, Homo sapiens
agaaaaatcatgtttgctctc

SEQ ID NO: 5173755 - DNA, 21 bp, Homo sapiens
agaaaaatctcattatttcaa

SEQ ID NO: 5173756 - DNA, 21 bp, Homo sapiens
agaaaaatcttgtgctagaat

SEQ ID NO: 5173757 - DNA, 14 bp, Homo sapiens
agaaaaatgaaaac

SEQ ID NO: 5173758 - DNA, 22 bp, Homo sapiens
agaaaaatgaaaacttttgtaa

SEQ ID NO: 5173759 - DNA, 14 bp, Homo sapiens
agaaaaatgaaaga

SEQ ID NO: 5173760 - DNA, 18 bp, Homo sapiens
agaaaaatgaaatttaag

SEQ ID NO: 5173761 - DNA, 14 bp, Homo sapiens
agaaaaatgtataa

SEQ ID NO: 5173762 - DNA, 20 bp, Homo sapiens
agaaaaattaattaggaatt

SEQ ID NO: 5173763 - DNA, 14 bp, Homo sapiens
agaaaaattacaga

SEQ ID NO: 5173764 - DNA, 14 bp, Homo sapiens
agaaaaattcacaa

SEQ ID NO: 5173765 - DNA, 18 bp, Homo sapiens
agaaaaattgtttccaaa

SEQ ID NO: 5173766 - DNA, 19 bp, Homo sapiens
agaaaaattgtttccaaag

SEQ ID NO: 5173767 - DNA, 22 bp, Homo sapiens
agaaaaattgtttccaaagtgc

SEQ ID NO: 5173768 - DNA, 16 bp, Homo sapiens
agaaaaatttcacgat

SEQ ID NO: 5173769 - DNA, 20 bp, Homo sapiens
agaaaacaaaaaaacctcta

SEQ ID NO: 5173770 - DNA, 16 bp, Homo sapiens
agaaaacaaaggagca

SEQ ID NO: 5173771 - DNA, 22 bp, Homo sapiens
agaaaacaaccaaagaaaattg

SEQ ID NO: 5173772 - DNA, 21 bp, Homo sapiens
agaaaacaacttggcatttct

SEQ ID NO: 5173773 - DNA, 22 bp, Homo sapiens
agaaaacaagatgagattggca

SEQ ID NO: 5173774 - DNA, 15 bp, Homo sapiens
agaaaacaagcgttt

SEQ ID NO: 5173775 - DNA, 18 bp, Homo sapiens
agaaaacaatctgcccac

SEQ ID NO: 5173776 - DNA, 13 bp, Homo sapiens
agaaaacactgtt

SEQ ID NO: 5173777 - DNA, 16 bp, Homo sapiens
agaaaacactttcctg

SEQ ID NO: 5173778 - DNA, 14 bp, Homo sapiens
agaaaacagaaaaa

SEQ ID NO: 5173779 - DNA, 19 bp, Homo sapiens
agaaaacagaaaaaaaaca

SEQ ID NO: 5173780 - DNA, 18 bp, Homo sapiens
agaaaacagaccagcata

SEQ ID NO: 5173781 - DNA, 20 bp, Homo sapiens
agaaaacagaccagcatagt

SEQ ID NO: 5173782 - DNA, 16 bp, Homo sapiens
agaaaacagagcctgc

SEQ ID NO: 5173783 - DNA, 23 bp, Homo sapiens
agaaaacaggaaaaaaactttta

SEQ ID NO: 5173784 - DNA, 20 bp, Homo sapiens
agaaaacaggcactgccctg

SEQ ID NO: 5173785 - DNA, 14 bp, Homo sapiens
agaaaacagtacag

SEQ ID NO: 5173786 - DNA, 19 bp, Homo sapiens
agaaaacataatatagctt

SEQ ID NO: 5173787 - DNA, 22 bp, Homo sapiens
agaaaacataatatagcttaaa

SEQ ID NO: 5173788 - DNA, 19 bp, Homo sapiens
agaaaacatagcactagca

SEQ ID NO: 5173789 - DNA, 14 bp, Homo sapiens
agaaaacatatatt

SEQ ID NO: 5173790 - DNA, 18 bp, Homo sapiens
agaaaacatatattttat

SEQ ID NO: 5173791 - DNA, 13 bp, Homo sapiens
agaaaacatgtaa

SEQ ID NO: 5173792 - DNA, 20 bp, Homo sapiens
agaaaacatgtctgtgaact

SEQ ID NO: 5173793 - DNA, 16 bp, Homo sapiens
agaaaacatttaacat

SEQ ID NO: 5173794 - DNA, 13 bp, Homo sapiens
agaaaacattttt

SEQ ID NO: 5173795 - DNA, 12 bp, Homo sapiens
agaaaaccactt

SEQ ID NO: 5173796 - DNA, 21 bp, Homo sapiens
agaaaaccagctcagcactgc

SEQ ID NO: 5173797 - DNA, 20 bp, Homo sapiens
agaaaacccacggtttttct

SEQ ID NO: 5173798 - DNA, 23 bp, Homo sapiens
agaaaacccgacaacatttctgc

SEQ ID NO: 5173799 - DNA, 13 bp, Homo sapiens
agaaaacccgagg

SEQ ID NO: 5173800 - DNA, 17 bp, Homo sapiens
agaaaaccctaagtgtg

SEQ ID NO: 5173801 - DNA, 14 bp, Homo sapiens
agaaaacccttccc

SEQ ID NO: 5173802 - DNA, 20 bp, Homo sapiens
agaaaacccttcccgccctc

SEQ ID NO: 5173803 - DNA, 19 bp, Homo sapiens
agaaaacccttgggccaga

SEQ ID NO: 5173804 - DNA, 16 bp, Homo sapiens
agaaaacctccagtag

SEQ ID NO: 5173805 - DNA, 22 bp, Homo sapiens
agaaaacctgtatttttgttag

SEQ ID NO: 5173806 - DNA, 14 bp, Homo sapiens
agaaaacctgtttt

SEQ ID NO: 5173807 - DNA, 18 bp, Homo sapiens
agaaaacctgtttttaac

SEQ ID NO: 5173808 - DNA, 22 bp, Homo sapiens
agaaaaccttaaaagtaataaa

SEQ ID NO: 5173809 - DNA, 16 bp, Homo sapiens
agaaaacctttcttca

SEQ ID NO: 5173810 - DNA, 21 bp, Homo sapiens
agaaaacggagagtgcttggg

SEQ ID NO: 5173811 - DNA, 15 bp, Homo sapiens
agaaaacgtggcaca

SEQ ID NO: 5173812 - DNA, 13 bp, Homo sapiens
agaaaactaacaa

SEQ ID NO: 5173813 - DNA, 16 bp, Homo sapiens
agaaaactaatctaaa

SEQ ID NO: 5173814 - DNA, 18 bp, Homo sapiens
agaaaactacatgtaaaa

SEQ ID NO: 5173815 - DNA, 18 bp, Homo sapiens
agaaaactagaatttcat

SEQ ID NO: 5173816 - DNA, 18 bp, Homo sapiens
agaaaactcccaatacaa

SEQ ID NO: 5173817 - DNA, 16 bp, Homo sapiens
agaaaactgaaaatct

SEQ ID NO: 5173818 - DNA, 16 bp, Homo sapiens
agaaaactgagaggtg

SEQ ID NO: 5173819 - DNA, 13 bp, Homo sapiens
agaaaactggaaa

SEQ ID NO: 5173820 - DNA, 12 bp, Homo sapiens
agaaaactgttg

SEQ ID NO: 5173821 - DNA, 15 bp, Homo sapiens
agaaaacttcaagga

SEQ ID NO: 5173822 - DNA, 20 bp, Homo sapiens
agaaaacttgcacttgtttt

SEQ ID NO: 5173823 - DNA, 19 bp, Homo sapiens
agaaaactttaaaaaatat

SEQ ID NO: 5173824 - DNA, 12 bp, Homo sapiens
agaaaactttgt

SEQ ID NO: 5173825 - DNA, 14 bp, Homo sapiens
agaaaactttgtta

SEQ ID NO: 5173826 - DNA, 9 bp, Homo sapiens
agaaaagaa

SEQ ID NO: 5173827 - DNA, 11 bp, Homo sapiens
agaaaagaaaa

SEQ ID NO: 5173828 - DNA, 13 bp, Homo sapiens
agaaaagaaaaaa

SEQ ID NO: 5173829 - DNA, 18 bp, Homo sapiens
agaaaagaaaaaaaaaga

SEQ ID NO: 5173830 - DNA, 13 bp, Homo sapiens
agaaaagaaaaat

SEQ ID NO: 5173831 - DNA, 17 bp, Homo sapiens
agaaaagaaaacattta

SEQ ID NO: 5173832 - DNA, 13 bp, Homo sapiens
agaaaagaagtga

SEQ ID NO: 5173833 - DNA, 15 bp, Homo sapiens
agaaaagacaaatgt

SEQ ID NO: 5173834 - DNA, 18 bp, Homo sapiens
agaaaagaccctgagact

SEQ ID NO: 5173835 - DNA, 15 bp, Homo sapiens
agaaaagacttttgt

SEQ ID NO: 5173836 - DNA, 13 bp, Homo sapiens
agaaaagagaaaa

SEQ ID NO: 5173837 - DNA, 15 bp, Homo sapiens
agaaaagagaaaaaa

SEQ ID NO: 5173838 - DNA, 13 bp, Homo sapiens
agaaaagagaaga

SEQ ID NO: 5173839 - DNA, 18 bp, Homo sapiens
agaaaagagaagaaagaa

SEQ ID NO: 5173840 - DNA, 16 bp, Homo sapiens
agaaaagagaagaaga

SEQ ID NO: 5173841 - DNA, 16 bp, Homo sapiens
agaaaagagacttctc

SEQ ID NO: 5173842 - DNA, 19 bp, Homo sapiens
agaaaagagacttctctgt

SEQ ID NO: 5173843 - DNA, 23 bp, Homo sapiens
agaaaagagatattttaaaatga

SEQ ID NO: 5173844 - DNA, 17 bp, Homo sapiens
agaaaagagggagagat

SEQ ID NO: 5173845 - DNA, 19 bp, Homo sapiens
agaaaagatgaatttgtcc

SEQ ID NO: 5173846 - DNA, 16 bp, Homo sapiens
agaaaagatgcacttt

SEQ ID NO: 5173847 - DNA, 18 bp, Homo sapiens
agaaaagcacctgccgac

SEQ ID NO: 5173848 - DNA, 13 bp, Homo sapiens
agaaaagcactta

SEQ ID NO: 5173849 - DNA, 19 bp, Homo sapiens
agaaaagcacttaaagttt

SEQ ID NO: 5173850 - DNA, 23 bp, Homo sapiens
agaaaagcagtcccattcatatt

SEQ ID NO: 5173851 - DNA, 13 bp, Homo sapiens
agaaaagccagat

SEQ ID NO: 5173852 - DNA, 13 bp, Homo sapiens
agaaaagcccatt

SEQ ID NO: 5173853 - DNA, 16 bp, Homo sapiens
agaaaagcctgaacta

SEQ ID NO: 5173854 - DNA, 17 bp, Homo sapiens
agaaaagctaagagaag

SEQ ID NO: 5173855 - DNA, 21 bp, Homo sapiens
agaaaagctataaaatgaata

SEQ ID NO: 5173856 - DNA, 13 bp, Homo sapiens
agaaaagctatta

SEQ ID NO: 5173857 - DNA, 12 bp, Homo sapiens
agaaaaggaaat

SEQ ID NO: 5173858 - DNA, 23 bp, Homo sapiens
agaaaaggaaataggttttaggt

SEQ ID NO: 5173859 - DNA, 11 bp, Homo sapiens
agaaaaggaag

SEQ ID NO: 5173860 - DNA, 14 bp, Homo sapiens
agaaaaggacagaa

SEQ ID NO: 5173861 - DNA, 18 bp, Homo sapiens
agaaaaggatttaagcaa

SEQ ID NO: 5173862 - DNA, 14 bp, Homo sapiens
agaaaaggcaaaag

SEQ ID NO: 5173863 - DNA, 15 bp, Homo sapiens
agaaaaggcaaaaga

SEQ ID NO: 5173864 - DNA, 14 bp, Homo sapiens
agaaaaggcagcca

SEQ ID NO: 5173865 - DNA, 14 bp, Homo sapiens
agaaaaggcatgga

SEQ ID NO: 5173866 - DNA, 15 bp, Homo sapiens
agaaaagggaaaaaa

SEQ ID NO: 5173867 - DNA, 18 bp, Homo sapiens
agaaaagggaaaaaagaa

SEQ ID NO: 5173868 - DNA, 20 bp, Homo sapiens
agaaaagggaactgaacatt

SEQ ID NO: 5173869 - DNA, 23 bp, Homo sapiens
agaaaagggaagttgtgcctttt

SEQ ID NO: 5173870 - DNA, 20 bp, Homo sapiens
agaaaagggagctaaattga

SEQ ID NO: 5173871 - DNA, 20 bp, Homo sapiens
agaaaaggtccaaaactgta

SEQ ID NO: 5173872 - DNA, 16 bp, Homo sapiens
agaaaagtaatgaaga

SEQ ID NO: 5173873 - DNA, 21 bp, Homo sapiens
agaaaagtaatgaagaatcac

SEQ ID NO: 5173874 - DNA, 20 bp, Homo sapiens
agaaaagtaattttgtcaca

SEQ ID NO: 5173875 - DNA, 14 bp, Homo sapiens
agaaaagtagaatt

SEQ ID NO: 5173876 - DNA, 16 bp, Homo sapiens
agaaaagtagaattat

SEQ ID NO: 5173877 - DNA, 19 bp, Homo sapiens
agaaaagtagaattatatc

SEQ ID NO: 5173878 - DNA, 22 bp, Homo sapiens
agaaaagtagaattatatctaa

SEQ ID NO: 5173879 - DNA, 23 bp, Homo sapiens
agaaaagtagacaatcattgttt

SEQ ID NO: 5173880 - DNA, 21 bp, Homo sapiens
agaaaagtattgtttggagga

SEQ ID NO: 5173881 - DNA, 15 bp, Homo sapiens
agaaaagtattttga

SEQ ID NO: 5173882 - DNA, 18 bp, Homo sapiens
agaaaagtattttgaagt

SEQ ID NO: 5173883 - DNA, 17 bp, Homo sapiens
agaaaagtctccacccc

SEQ ID NO: 5173884 - DNA, 15 bp, Homo sapiens
agaaaagtgaaagta

SEQ ID NO: 5173885 - DNA, 16 bp, Homo sapiens
agaaaagtgaaagtaa

SEQ ID NO: 5173886 - DNA, 17 bp, Homo sapiens
agaaaagtgcaaagtta

SEQ ID NO: 5173887 - DNA, 19 bp, Homo sapiens
agaaaagtgcttagaaagt

SEQ ID NO: 5173888 - DNA, 20 bp, Homo sapiens
agaaaagtgcttagaaagtt

SEQ ID NO: 5173889 - DNA, 22 bp, Homo sapiens
agaaaagtgcttagaaagttat

SEQ ID NO: 5173890 - DNA, 13 bp, Homo sapiens
agaaaagtgtgta

SEQ ID NO: 5173891 - DNA, 22 bp, Homo sapiens
agaaaagttgacacctgagaaa

SEQ ID NO: 5173892 - DNA, 18 bp, Homo sapiens
agaaaagttgctcttaaa

SEQ ID NO: 5173893 - DNA, 16 bp, Homo sapiens
agaaaataaaataaat

SEQ ID NO: 5173894 - DNA, 17 bp, Homo sapiens
agaaaataaaataaatt

SEQ ID NO: 5173895 - DNA, 19 bp, Homo sapiens
agaaaataaaataaattat

SEQ ID NO: 5173896 - DNA, 23 bp, Homo sapiens
agaaaataaaatattcactctcc

SEQ ID NO: 5173897 - DNA, 21 bp, Homo sapiens
agaaaataaaattaagaatgt

SEQ ID NO: 5173898 - DNA, 22 bp, Homo sapiens
agaaaataaaattaagaatgtt

SEQ ID NO: 5173899 - DNA, 15 bp, Homo sapiens
agaaaataaactcat

SEQ ID NO: 5173900 - DNA, 22 bp, Homo sapiens
agaaaataaatacaagtttgaa

SEQ ID NO: 5173901 - DNA, 16 bp, Homo sapiens
agaaaataaattccaa

SEQ ID NO: 5173902 - DNA, 11 bp, Homo sapiens
agaaaataacc

SEQ ID NO: 5173903 - DNA, 22 bp, Homo sapiens
agaaaataaggcacccatctgt

SEQ ID NO: 5173904 - DNA, 16 bp, Homo sapiens
agaaaatacaataaac

SEQ ID NO: 5173905 - DNA, 17 bp, Homo sapiens
agaaaatacaataaact

SEQ ID NO: 5173906 - DNA, 19 bp, Homo sapiens
agaaaatacttaaatgtta

SEQ ID NO: 5173907 - DNA, 19 bp, Homo sapiens
agaaaatagcttttattga

SEQ ID NO: 5173908 - DNA, 20 bp, Homo sapiens
agaaaataggggatggtcca

SEQ ID NO: 5173909 - DNA, 15 bp, Homo sapiens
agaaaatagggtgga

SEQ ID NO: 5173910 - DNA, 12 bp, Homo sapiens
agaaaatataaa

SEQ ID NO: 5173911 - DNA, 15 bp, Homo sapiens
agaaaatataaatgc

SEQ ID NO: 5173912 - DNA, 20 bp, Homo sapiens
agaaaatataaggacttttt

SEQ ID NO: 5173913 - DNA, 19 bp, Homo sapiens
agacgggttcaccatgttg

SEQ ID NO: 5173914 - DNA, 19 bp, Homo sapiens
agacgggttgaaagacatc

SEQ ID NO: 5173915 - DNA, 22 bp, Homo sapiens
agacgggttgaaagacatcaat

SEQ ID NO: 5173916 - DNA, 21 bp, Homo sapiens
agacggtagaattaaagaaga

SEQ ID NO: 5173917 - DNA, 15 bp, Homo sapiens
agacggtgctcgctt

SEQ ID NO: 5173918 - DNA, 19 bp, Homo sapiens
agacggtttccagggaggg

SEQ ID NO: 5173919 - DNA, 15 bp, Homo sapiens
agacgtaaagaattt

SEQ ID NO: 5173920 - DNA, 16 bp, Homo sapiens
agacgtaaagaatttt

SEQ ID NO: 5173921 - DNA, 19 bp, Homo sapiens
agacgtatgcttattttaa

SEQ ID NO: 5173922 - DNA, 17 bp, Homo sapiens
agacgtcaggccctgac

SEQ ID NO: 5173923 - DNA, 21 bp, Homo sapiens
agacgtccacccgtttccaag

SEQ ID NO: 5173924 - DNA, 15 bp, Homo sapiens
agacgtcctggaatg

SEQ ID NO: 5173925 - DNA, 17 bp, Homo sapiens
agacgtcctggaatgaa

SEQ ID NO: 5173926 - DNA, 19 bp, Homo sapiens
agacgtctggccctggcgg

SEQ ID NO: 5173927 - DNA, 21 bp, Homo sapiens
agacgtgagtgtgactttttg

SEQ ID NO: 5173928 - DNA, 17 bp, Homo sapiens
agacgtgattttgctgt

SEQ ID NO: 5173929 - DNA, 21 bp, Homo sapiens
agacgtgcacgcacactgtct

SEQ ID NO: 5173930 - DNA, 22 bp, Homo sapiens
agacgtgcacgcacactgtctg

SEQ ID NO: 5173931 - DNA, 18 bp, Homo sapiens
agacgtggaacctctgtc

SEQ ID NO: 5173932 - DNA, 14 bp, Homo sapiens
agacgtggactcct

SEQ ID NO: 5173933 - DNA, 16 bp, Homo sapiens
agacgtggtgcttctc

SEQ ID NO: 5173934 - DNA, 16 bp, Homo sapiens
agacgtggtgggactc

SEQ ID NO: 5173935 - DNA, 13 bp, Homo sapiens
agacgtgtacata

SEQ ID NO: 5173936 - DNA, 19 bp, Homo sapiens
agacgtgtggcaatagtgg

SEQ ID NO: 5173937 - DNA, 14 bp, Homo sapiens
agacgttgcctgag

SEQ ID NO: 5173938 - DNA, 15 bp, Homo sapiens
agacgttgcctgaga

SEQ ID NO: 5173939 - DNA, 16 bp, Homo sapiens
agacgttttataagca

SEQ ID NO: 5173940 - DNA, 16 bp, Homo sapiens
agacgttttctttatc

SEQ ID NO: 5173941 - DNA, 12 bp, Homo sapiens
agactaaaagat

SEQ ID NO: 5173942 - DNA, 16 bp, Homo sapiens
agactaaaagttgcat

SEQ ID NO: 5173943 - DNA, 15 bp, Homo sapiens
agactaaaggatcca

SEQ ID NO: 5173944 - DNA, 18 bp, Homo sapiens
agactaaaggatccagag

SEQ ID NO: 5173945 - DNA, 19 bp, Homo sapiens
agactaaaggatccagaga

SEQ ID NO: 5173946 - DNA, 14 bp, Homo sapiens
agactaacttattt

SEQ ID NO: 5173947 - DNA, 17 bp, Homo sapiens
agactaagaaatattcc

SEQ ID NO: 5173948 - DNA, 13 bp, Homo sapiens
agactaagccagc

SEQ ID NO: 5173949 - DNA, 23 bp, Homo sapiens
agactaagccctgtcgagacact

SEQ ID NO: 5173950 - DNA, 16 bp, Homo sapiens
agactaagggcaggaa

SEQ ID NO: 5173951 - DNA, 19 bp, Homo sapiens
agactaaggggcagctcct

SEQ ID NO: 5173952 - DNA, 18 bp, Homo sapiens
agactaatgctttctgtg

SEQ ID NO: 5173953 - DNA, 14 bp, Homo sapiens
agactaattaaaat

SEQ ID NO: 5173954 - DNA, 16 bp, Homo sapiens
agactaattaaaatct

SEQ ID NO: 5173955 - DNA, 18 bp, Homo sapiens
agactaattaaaatctgg

SEQ ID NO: 5173956 - DNA, 14 bp, Homo sapiens
agactactaagagg

SEQ ID NO: 5173957 - DNA, 14 bp, Homo sapiens
agactagaattcta

SEQ ID NO: 5173958 - DNA, 19 bp, Homo sapiens
agactagaattctagtgct

SEQ ID NO: 5173959 - DNA, 12 bp, Homo sapiens
agactagagaaa

SEQ ID NO: 5173960 - DNA, 13 bp, Homo sapiens
agactagagaaac

SEQ ID NO: 5173961 - DNA, 15 bp, Homo sapiens
agactagagaaaccg

SEQ ID NO: 5173962 - DNA, 12 bp, Homo sapiens
agactagagcaa

SEQ ID NO: 5173963 - DNA, 15 bp, Homo sapiens
agactagaggccagg

SEQ ID NO: 5173964 - DNA, 12 bp, Homo sapiens
agactagatgta

SEQ ID NO: 5173965 - DNA, 13 bp, Homo sapiens
agactagatgtag

SEQ ID NO: 5173966 - DNA, 19 bp, Homo sapiens
agactagattgcctttgtt

SEQ ID NO: 5173967 - DNA, 19 bp, Homo sapiens
agactagcagctagcaagg

SEQ ID NO: 5173968 - DNA, 21 bp, Homo sapiens
agactagttctcttgtcctgt

SEQ ID NO: 5173969 - DNA, 24 bp, Homo sapiens
agactagttctcttgtcctgtgat

SEQ ID NO: 5173970 - DNA, 23 bp, Homo sapiens
agactagttgaacatctcacttt

SEQ ID NO: 5173971 - DNA, 20 bp, Homo sapiens
agactataaaatctggatat

SEQ ID NO: 5173972 - DNA, 19 bp, Homo sapiens
agactataaagcagtagac

SEQ ID NO: 5173973 - DNA, 15 bp, Homo sapiens
agactatagcccctg

SEQ ID NO: 5173974 - DNA, 17 bp, Homo sapiens
agactatatacatgtgt

SEQ ID NO: 5173975 - DNA, 17 bp, Homo sapiens
agactatattgtacaca

SEQ ID NO: 5173976 - DNA, 20 bp, Homo sapiens
agactatcttactatttcac

SEQ ID NO: 5173977 - DNA, 18 bp, Homo sapiens
agactatggaatgtcagt

SEQ ID NO: 5173978 - DNA, 20 bp, Homo sapiens
agactatggaatgtcagtgt

SEQ ID NO: 5173979 - DNA, 15 bp, Homo sapiens
agactatggagcctg

SEQ ID NO: 5173980 - DNA, 16 bp, Homo sapiens
agactatggagcctgg

SEQ ID NO: 5173981 - DNA, 20 bp, Homo sapiens
agactatggagcctggcaca

SEQ ID NO: 5173982 - DNA, 18 bp, Homo sapiens
agactattatgaaatcat

SEQ ID NO: 5173983 - DNA, 15 bp, Homo sapiens
agactattcaaacag

SEQ ID NO: 5173984 - DNA, 16 bp, Homo sapiens
agactattgacatcag

SEQ ID NO: 5173985 - DNA, 14 bp, Homo sapiens
agactatttcaaaa

SEQ ID NO: 5173986 - DNA, 17 bp, Homo sapiens
agactatttcaaaatgt

SEQ ID NO: 5173987 - DNA, 14 bp, Homo sapiens
agactatttgctta

SEQ ID NO: 5173988 - DNA, 18 bp, Homo sapiens
agactcaaaacctggaga

SEQ ID NO: 5173989 - DNA, 19 bp, Homo sapiens
agactcaaaacctggagat

SEQ ID NO: 5173990 - DNA, 19 bp, Homo sapiens
agactcaaacggaggaagc

SEQ ID NO: 5173991 - DNA, 15 bp, Homo sapiens
agactcaaatgttct

SEQ ID NO: 5173992 - DNA, 14 bp, Homo sapiens
agactcaaattttg

SEQ ID NO: 5173993 - DNA, 21 bp, Homo sapiens
agactcaagagaatttatgtg

SEQ ID NO: 5173994 - DNA, 22 bp, Homo sapiens
agactcaaggaagaataatttt

SEQ ID NO: 5173995 - DNA, 21 bp, Homo sapiens
agactcaaggcctccagccac

SEQ ID NO: 5173996 - DNA, 17 bp, Homo sapiens
agactcaaggggctgga

SEQ ID NO: 5173997 - DNA, 16 bp, Homo sapiens
agactcaagggggtga

SEQ ID NO: 5173998 - DNA, 23 bp, Homo sapiens
agactcaagtacccattctgttt

SEQ ID NO: 5173999 - DNA, 21 bp, Homo sapiens
agactcaagtgatcctcctgt

SEQ ID NO: 5174000 - DNA, 14 bp, Homo sapiens
agactcaatgtgga

SEQ ID NO: 5174001 - DNA, 12 bp, Homo sapiens
agactcacctct

SEQ ID NO: 5174002 - DNA, 19 bp, Homo sapiens
agactcacctctgcctcaa

SEQ ID NO: 5174003 - DNA, 18 bp, Homo sapiens
agactcacggctgcacct

SEQ ID NO: 5174004 - DNA, 22 bp, Homo sapiens
agactcacttgccattgccagg

SEQ ID NO: 5174005 - DNA, 17 bp, Homo sapiens
agactcagaggtccagg

SEQ ID NO: 5174006 - DNA, 20 bp, Homo sapiens
agactcagatgaggacagag

SEQ ID NO: 5174007 - DNA, 18 bp, Homo sapiens
agactcagcctctgctgg

SEQ ID NO: 5174008 - DNA, 13 bp, Homo sapiens
agactcagcctgc

SEQ ID NO: 5174009 - DNA, 17 bp, Homo sapiens
agactcagcctgcagtt

SEQ ID NO: 5174010 - DNA, 22 bp, Homo sapiens
agactcagcgctcctcctgtgt

SEQ ID NO: 5174011 - DNA, 19 bp, Homo sapiens
agactcaggccaagaaacg

SEQ ID NO: 5174012 - DNA, 13 bp, Homo sapiens
agactcaggccca

SEQ ID NO: 5174013 - DNA, 16 bp, Homo sapiens
agactcagggccccag

SEQ ID NO: 5174014 - DNA, 17 bp, Homo sapiens
agactcagggccccagc

SEQ ID NO: 5174015 - DNA, 18 bp, Homo sapiens
agactcagggccccagca

SEQ ID NO: 5174016 - DNA, 16 bp, Homo sapiens
agactcaggttccaga

SEQ ID NO: 5174017 - DNA, 17 bp, Homo sapiens
agactcaggttccagaa

SEQ ID NO: 5174018 - DNA, 16 bp, Homo sapiens
agactcagtgcagatg

SEQ ID NO: 5174019 - DNA, 18 bp, Homo sapiens
agactcagtgcagatgga

SEQ ID NO: 5174020 - DNA, 20 bp, Homo sapiens
agactcatcctgaacagcat

SEQ ID NO: 5174021 - DNA, 15 bp, Homo sapiens
agactcatctacaca

SEQ ID NO: 5174022 - DNA, 15 bp, Homo sapiens
agactcattcttctg

SEQ ID NO: 5174023 - DNA, 14 bp, Homo sapiens
agactccaaagaaa

SEQ ID NO: 5174024 - DNA, 16 bp, Homo sapiens
agactccaaagaaatg

SEQ ID NO: 5174025 - DNA, 23 bp, Homo sapiens
agactccaagattcaaagagact

SEQ ID NO: 5174026 - DNA, 15 bp, Homo sapiens
agactccaaggagct

SEQ ID NO: 5174027 - DNA, 16 bp, Homo sapiens
agactccaaggagcta

SEQ ID NO: 5174028 - DNA, 18 bp, Homo sapiens
agactccaatggggccag

SEQ ID NO: 5174029 - DNA, 19 bp, Homo sapiens
agactccaatggggccagc

SEQ ID NO: 5174030 - DNA, 21 bp, Homo sapiens
agactccaatggggccagcac

SEQ ID NO: 5174031 - DNA, 23 bp, Homo sapiens
agactccaatggggccagcactg

SEQ ID NO: 5174032 - DNA, 22 bp, Homo sapiens
agactccagaaatgtccctttc

SEQ ID NO: 5174033 - DNA, 22 bp, Homo sapiens
agactccagaatctgctgttgc

SEQ ID NO: 5174034 - DNA, 24 bp, Homo sapiens
agactccagaatctgctgttgcca

SEQ ID NO: 5174035 - DNA, 14 bp, Homo sapiens
agactccagacctg

SEQ ID NO: 5174036 - DNA, 16 bp, Homo sapiens
agactccagcccctgg

SEQ ID NO: 5174037 - DNA, 17 bp, Homo sapiens
agactccagcccctgga

SEQ ID NO: 5174038 - DNA, 21 bp, Homo sapiens
agactccagctgggttggaaa

SEQ ID NO: 5174039 - DNA, 15 bp, Homo sapiens
agactccagctgtga

SEQ ID NO: 5174040 - DNA, 11 bp, Homo sapiens
agactccaggc

SEQ ID NO: 5174041 - DNA, 12 bp, Homo sapiens
agactccaggcc

SEQ ID NO: 5174042 - DNA, 22 bp, Homo sapiens
agactccatctctatataaaaa

SEQ ID NO: 5174043 - DNA, 17 bp, Homo sapiens
agactccatctcttctg

SEQ ID NO: 5174044 - DNA, 21 bp, Homo sapiens
agactccatctctttaaaaac

SEQ ID NO: 5174045 - DNA, 17 bp, Homo sapiens
agactcccatgaagcct

SEQ ID NO: 5174046 - DNA, 19 bp, Homo sapiens
agactcccatgaagccttt

SEQ ID NO: 5174047 - DNA, 18 bp, Homo sapiens
agactcccgccccgggct

SEQ ID NO: 5174048 - DNA, 21 bp, Homo sapiens
agactcccgccccgggctggc

SEQ ID NO: 5174049 - DNA, 23 bp, Homo sapiens
agactcccgccccgggctggccc

SEQ ID NO: 5174050 - DNA, 24 bp, Homo sapiens
agactcccgccccgggctggccct

SEQ ID NO: 5174051 - DNA, 17 bp, Homo sapiens
agactcccgcctttgac

SEQ ID NO: 5174052 - DNA, 23 bp, Homo sapiens
agactcccggggtccccgccctc

SEQ ID NO: 5174053 - DNA, 11 bp, Homo sapiens
agactccctga

SEQ ID NO: 5174054 - DNA, 19 bp, Homo sapiens
agactccctgatcccagac

SEQ ID NO: 5174055 - DNA, 20 bp, Homo sapiens
agactccctgatcccagacc

SEQ ID NO: 5174056 - DNA, 16 bp, Homo sapiens
agactccgccctcctc

SEQ ID NO: 5174057 - DNA, 14 bp, Homo sapiens
agactccggcctgt

SEQ ID NO: 5174058 - DNA, 16 bp, Homo sapiens
agactccggccttcac

SEQ ID NO: 5174059 - DNA, 11 bp, Homo sapiens
agactcctagg

SEQ ID NO: 5174060 - DNA, 22 bp, Homo sapiens
agactcctaggcaggacatgct

SEQ ID NO: 5174061 - DNA, 19 bp, Homo sapiens
agactcctcagcacccctc

SEQ ID NO: 5174062 - DNA, 13 bp, Homo sapiens
agactcctcagga

SEQ ID NO: 5174063 - DNA, 17 bp, Homo sapiens
agactcctcagttcttg

SEQ ID NO: 5174064 - DNA, 13 bp, Homo sapiens
agactcctctggg

SEQ ID NO: 5174065 - DNA, 19 bp, Homo sapiens
agactcctctgggcctggg

SEQ ID NO: 5174066 - DNA, 21 bp, Homo sapiens
agactcctcttcccagagtca

SEQ ID NO: 5174067 - DNA, 15 bp, Homo sapiens
agactcctgaggaca

SEQ ID NO: 5174068 - DNA, 23 bp, Homo sapiens
agactcctgcaggcagccaggcc

SEQ ID NO: 5174069 - DNA, 16 bp, Homo sapiens
agactcctgccctgtt

SEQ ID NO: 5174070 - DNA, 22 bp, Homo sapiens
agactcctgctctctatccaaa

SEQ ID NO: 5174071 - DNA, 13 bp, Homo sapiens
agactcctggctt

SEQ ID NO: 5174072 - DNA, 17 bp, Homo sapiens
agactcctggtctgtga

SEQ ID NO: 5174073 - DNA, 21 bp, Homo sapiens
agactccttcaacaattctaa

SEQ ID NO: 5174074 - DNA, 17 bp, Homo sapiens
agactccttctccccaa

SEQ ID NO: 5174075 - DNA, 21 bp, Homo sapiens
agactcctttcctgcatcttt

SEQ ID NO: 5174076 - DNA, 17 bp, Homo sapiens
agactcgactctgtgcc

SEQ ID NO: 5174077 - DNA, 24 bp, Homo sapiens
agactcgagaaccaaccagggaag

SEQ ID NO: 5174078 - DNA, 15 bp, Homo sapiens
agactcgagagggct

SEQ ID NO: 5174079 - DNA, 18 bp, Homo sapiens
agactcgagagggctgag

SEQ ID NO: 5174080 - DNA, 22 bp, Homo sapiens
agactcgatgcaagtgtttctg

SEQ ID NO: 5174081 - DNA, 16 bp, Homo sapiens
agactcgcctatctta

SEQ ID NO: 5174082 - DNA, 17 bp, Homo sapiens
agactcgcctatcttag

SEQ ID NO: 5174083 - DNA, 15 bp, Homo sapiens
agactcgcctgggaa

SEQ ID NO: 5174084 - DNA, 17 bp, Homo sapiens
agactcgcgacaatgca

SEQ ID NO: 5174085 - DNA, 19 bp, Homo sapiens
agactcgcgacaatgcaaa

SEQ ID NO: 5174086 - DNA, 21 bp, Homo sapiens
agactcgcggcaggttctctt

SEQ ID NO: 5174087 - DNA, 16 bp, Homo sapiens
agactcgttctcgtga

SEQ ID NO: 5174088 - DNA, 21 bp, Homo sapiens
agactctaaatatttcatgat

SEQ ID NO: 5174089 - DNA, 12 bp, Homo sapiens
agactctaagaa

SEQ ID NO: 5174090 - DNA, 19 bp, Homo sapiens
agactctacagaggccatg

SEQ ID NO: 5174091 - DNA, 18 bp, Homo sapiens
agaaaatataataaaaga

SEQ ID NO: 5174092 - DNA, 11 bp, Homo sapiens
agaaaatatac

SEQ ID NO: 5174093 - DNA, 16 bp, Homo sapiens
agaaaatatactgtaa

SEQ ID NO: 5174094 - DNA, 17 bp, Homo sapiens
agaaaatatactgtaaa

SEQ ID NO: 5174095 - DNA, 18 bp, Homo sapiens
agaaaatatactgtaaag

SEQ ID NO: 5174096 - DNA, 20 bp, Homo sapiens
agaaaatatactgtaaagaa

SEQ ID NO: 5174097 - DNA, 23 bp, Homo sapiens
agaaaatatactgtaaagaaaga

SEQ ID NO: 5174098 - DNA, 16 bp, Homo sapiens
agaaaatatatgcctg

SEQ ID NO: 5174099 - DNA, 22 bp, Homo sapiens
agaaaatatgtcccagaaatgt

SEQ ID NO: 5174100 - DNA, 10 bp, Homo sapiens
agaaaatatt

SEQ ID NO: 5174101 - DNA, 13 bp, Homo sapiens
agaaaatattact

SEQ ID NO: 5174102 - DNA, 21 bp, Homo sapiens
agaaaatattctaacatttga

SEQ ID NO: 5174103 - DNA, 14 bp, Homo sapiens
agaaaatatttttg

SEQ ID NO: 5174104 - DNA, 15 bp, Homo sapiens
agaaaatatttttgt

SEQ ID NO: 5174105 - DNA, 15 bp, Homo sapiens
agaaaatcagatttt

SEQ ID NO: 5174106 - DNA, 22 bp, Homo sapiens
agaaaatctgcatgtttgatta

SEQ ID NO: 5174107 - DNA, 13 bp, Homo sapiens
agaaaatgaaatc

SEQ ID NO: 5174108 - DNA, 19 bp, Homo sapiens
agaaaatgagaaaggacag

SEQ ID NO: 5174109 - DNA, 16 bp, Homo sapiens
agaaaatgatacagca

SEQ ID NO: 5174110 - DNA, 21 bp, Homo sapiens
agaaaatgatgagtttttatg

SEQ ID NO: 5174111 - DNA, 17 bp, Homo sapiens
agaaaatgcaccaaata

SEQ ID NO: 5174112 - DNA, 22 bp, Homo sapiens
agaaaatgcattatttagtcaa

SEQ ID NO: 5174113 - DNA, 22 bp, Homo sapiens
agaaaatgcctagagatatttc

SEQ ID NO: 5174114 - DNA, 19 bp, Homo sapiens
agaaaatgcgagactctga

SEQ ID NO: 5174115 - DNA, 22 bp, Homo sapiens
agaaaatgcggttataaaaaat

SEQ ID NO: 5174116 - DNA, 19 bp, Homo sapiens
agaaaatgcttgacaaata

SEQ ID NO: 5174117 - DNA, 23 bp, Homo sapiens
agaaaatgcttgacaaatatttt

SEQ ID NO: 5174118 - DNA, 13 bp, Homo sapiens
agaaaatgctttc

SEQ ID NO: 5174119 - DNA, 14 bp, Homo sapiens
agaaaatgctttct

SEQ ID NO: 5174120 - DNA, 15 bp, Homo sapiens
agaaaatgctttctc

SEQ ID NO: 5174121 - DNA, 17 bp, Homo sapiens
agaaaatgctttctcat

SEQ ID NO: 5174122 - DNA, 23 bp, Homo sapiens
agaaaatgctttctcatgcatag

SEQ ID NO: 5174123 - DNA, 13 bp, Homo sapiens
agaaaatggaaaa

SEQ ID NO: 5174124 - DNA, 20 bp, Homo sapiens
agaaaatggaaagaaggaaa

SEQ ID NO: 5174125 - DNA, 16 bp, Homo sapiens
agaaaatggaacatta

SEQ ID NO: 5174126 - DNA, 13 bp, Homo sapiens
agaaaatggaatt

SEQ ID NO: 5174127 - DNA, 22 bp, Homo sapiens
agaaaatggaattactccaaaa

SEQ ID NO: 5174128 - DNA, 15 bp, Homo sapiens
agaaaatggacgtgt

SEQ ID NO: 5174129 - DNA, 22 bp, Homo sapiens
agaaaatggacgtgttatgact

SEQ ID NO: 5174130 - DNA, 23 bp, Homo sapiens
agaaaatggcacttgggggactg

SEQ ID NO: 5174131 - DNA, 21 bp, Homo sapiens
agaaaatggctaataaactgt

SEQ ID NO: 5174132 - DNA, 23 bp, Homo sapiens
agaaaatggctaataaactgtat

SEQ ID NO: 5174133 - DNA, 11 bp, Homo sapiens
agaaaatgtag

SEQ ID NO: 5174134 - DNA, 13 bp, Homo sapiens
agaaaatgtcagt

SEQ ID NO: 5174135 - DNA, 22 bp, Homo sapiens
agaaaatgtctttctcttcctt

SEQ ID NO: 5174136 - DNA, 11 bp, Homo sapiens
agaaaatgtga

SEQ ID NO: 5174137 - DNA, 17 bp, Homo sapiens
agaaaatgtgtaacaga

SEQ ID NO: 5174138 - DNA, 13 bp, Homo sapiens
agaaaatgttatt

SEQ ID NO: 5174139 - DNA, 14 bp, Homo sapiens
agaaaatgttctgt

SEQ ID NO: 5174140 - DNA, 16 bp, Homo sapiens
agaaaatgttgagaat

SEQ ID NO: 5174141 - DNA, 20 bp, Homo sapiens
agaaaattaattatatttct

SEQ ID NO: 5174142 - DNA, 15 bp, Homo sapiens
agaaaattagactgt

SEQ ID NO: 5174143 - DNA, 18 bp, Homo sapiens
agaaaattatattctgtt

SEQ ID NO: 5174144 - DNA, 16 bp, Homo sapiens
agaaaattcagctcct

SEQ ID NO: 5174145 - DNA, 17 bp, Homo sapiens
agaaaattcagctcctt

SEQ ID NO: 5174146 - DNA, 17 bp, Homo sapiens
agaaaattcaggtctgt

SEQ ID NO: 5174147 - DNA, 17 bp, Homo sapiens
agaaaattccctggggt

SEQ ID NO: 5174148 - DNA, 18 bp, Homo sapiens
agaaaattccctggggtc

SEQ ID NO: 5174149 - DNA, 14 bp, Homo sapiens
agaaaattcctata

SEQ ID NO: 5174150 - DNA, 15 bp, Homo sapiens
agaaaattcctataa

SEQ ID NO: 5174151 - DNA, 19 bp, Homo sapiens
agaaaattcctataaggaa

SEQ ID NO: 5174152 - DNA, 18 bp, Homo sapiens
agaaaattcttgagaagt

SEQ ID NO: 5174153 - DNA, 18 bp, Homo sapiens
agaaaattgaatttaaca

SEQ ID NO: 5174154 - DNA, 19 bp, Homo sapiens
agaaaattgaatttaacaa

SEQ ID NO: 5174155 - DNA, 22 bp, Homo sapiens
agaaaattgagttgcacttatt

SEQ ID NO: 5174156 - DNA, 23 bp, Homo sapiens
agaaaattgatatttttatacaa

SEQ ID NO: 5174157 - DNA, 15 bp, Homo sapiens
agaaaattgcactaa

SEQ ID NO: 5174158 - DNA, 13 bp, Homo sapiens
agaaaattgcatg

SEQ ID NO: 5174159 - DNA, 15 bp, Homo sapiens
agaaaattgcatgaa

SEQ ID NO: 5174160 - DNA, 21 bp, Homo sapiens
agaaaattgcatgaaactagg

SEQ ID NO: 5174161 - DNA, 12 bp, Homo sapiens
agaaaattgcca

SEQ ID NO: 5174162 - DNA, 14 bp, Homo sapiens
agaaaattgccaaa

SEQ ID NO: 5174163 - DNA, 20 bp, Homo sapiens
agaaaattgccaaaatatat

SEQ ID NO: 5174164 - DNA, 20 bp, Homo sapiens
agaaaattggactggtgaaa

SEQ ID NO: 5174165 - DNA, 19 bp, Homo sapiens
agaaaattgttgtgcttag

SEQ ID NO: 5174166 - DNA, 23 bp, Homo sapiens
agaaaattgttgtgcttagaatt

SEQ ID NO: 5174167 - DNA, 16 bp, Homo sapiens
agaaaatttaattatt

SEQ ID NO: 5174168 - DNA, 23 bp, Homo sapiens
agaaaatttacaaaatttattct

SEQ ID NO: 5174169 - DNA, 21 bp, Homo sapiens
agaaaatttagccctttaaaa

SEQ ID NO: 5174170 - DNA, 12 bp, Homo sapiens
agaaaattttgc

SEQ ID NO: 5174171 - DNA, 22 bp, Homo sapiens
agaaaattttgtattaatttct

SEQ ID NO: 5174172 - DNA, 16 bp, Homo sapiens
agaaaatttttgtagt

SEQ ID NO: 5174173 - DNA, 20 bp, Homo sapiens
agaaaatttttgtagtagcg

SEQ ID NO: 5174174 - DNA, 22 bp, Homo sapiens
agaaaatttttgtagtagcgtt

SEQ ID NO: 5174175 - DNA, 22 bp, Homo sapiens
agaaaattttttttcaaaaatg

SEQ ID NO: 5174176 - DNA, 16 bp, Homo sapiens
agaaacaaaaagagct

SEQ ID NO: 5174177 - DNA, 16 bp, Homo sapiens
agaaacaaaaagcccc

SEQ ID NO: 5174178 - DNA, 15 bp, Homo sapiens
agaaacaaaatataa

SEQ ID NO: 5174179 - DNA, 14 bp, Homo sapiens
agaaacaaaatgaa

SEQ ID NO: 5174180 - DNA, 15 bp, Homo sapiens
agaaacaaacaaaac

SEQ ID NO: 5174181 - DNA, 13 bp, Homo sapiens
agaaacaaacatc

SEQ ID NO: 5174182 - DNA, 12 bp, Homo sapiens
agaaacaaactt

SEQ ID NO: 5174183 - DNA, 22 bp, Homo sapiens
agaaacaaacttttcaaggctt

SEQ ID NO: 5174184 - DNA, 14 bp, Homo sapiens
agaaacaaagcaaa

SEQ ID NO: 5174185 - DNA, 15 bp, Homo sapiens
agaaacaaagcaaat

SEQ ID NO: 5174186 - DNA, 14 bp, Homo sapiens
agaaacaaagggtt

SEQ ID NO: 5174187 - DNA, 17 bp, Homo sapiens
agaaacaaataaactag

SEQ ID NO: 5174188 - DNA, 16 bp, Homo sapiens
agaaacaaatgacata

SEQ ID NO: 5174189 - DNA, 16 bp, Homo sapiens
agaaacaacaaataag

SEQ ID NO: 5174190 - DNA, 14 bp, Homo sapiens
agaaacaacagaaa

SEQ ID NO: 5174191 - DNA, 13 bp, Homo sapiens
agaaacaactgcc

SEQ ID NO: 5174192 - DNA, 19 bp, Homo sapiens
agaaacaactgccaaataa

SEQ ID NO: 5174193 - DNA, 12 bp, Homo sapiens
agaaacaagaca

SEQ ID NO: 5174194 - DNA, 18 bp, Homo sapiens
agaaacaagacaagctcc

SEQ ID NO: 5174195 - DNA, 14 bp, Homo sapiens
agaaacaagctgtg

SEQ ID NO: 5174196 - DNA, 15 bp, Homo sapiens
agaaacaagctgtgc

SEQ ID NO: 5174197 - DNA, 16 bp, Homo sapiens
agaaacaataaagaga

SEQ ID NO: 5174198 - DNA, 14 bp, Homo sapiens
agaaacaatttctg

SEQ ID NO: 5174199 - DNA, 14 bp, Homo sapiens
agaaacacaatatt

SEQ ID NO: 5174200 - DNA, 15 bp, Homo sapiens
agaaacacacagtca

SEQ ID NO: 5174201 - DNA, 20 bp, Homo sapiens
agaaacacactgaggcaggg

SEQ ID NO: 5174202 - DNA, 14 bp, Homo sapiens
agaaacacagcatg

SEQ ID NO: 5174203 - DNA, 18 bp, Homo sapiens
agaaacacagcatgcatt

SEQ ID NO: 5174204 - DNA, 19 bp, Homo sapiens
agaaacacagcatgcattt

SEQ ID NO: 5174205 - DNA, 24 bp, Homo sapiens
agaaacacagcatgcatttagcat

SEQ ID NO: 5174206 - DNA, 16 bp, Homo sapiens
agaaacacagttttga

SEQ ID NO: 5174207 - DNA, 17 bp, Homo sapiens
agaaacacataaattat

SEQ ID NO: 5174208 - DNA, 20 bp, Homo sapiens
agaaacacatcaaataaact

SEQ ID NO: 5174209 - DNA, 20 bp, Homo sapiens
agaaacaccacccatttcta

SEQ ID NO: 5174210 - DNA, 19 bp, Homo sapiens
agaaacaccacttaatctt

SEQ ID NO: 5174211 - DNA, 16 bp, Homo sapiens
agaaacaccagtgtta

SEQ ID NO: 5174212 - DNA, 15 bp, Homo sapiens
agaaacacccctctg

SEQ ID NO: 5174213 - DNA, 22 bp, Homo sapiens
agaaacacccctctgtctagga

SEQ ID NO: 5174214 - DNA, 23 bp, Homo sapiens
agaaacacgaactttagctgcat

SEQ ID NO: 5174215 - DNA, 23 bp, Homo sapiens
agaaacactaagctctctgggcc

SEQ ID NO: 5174216 - DNA, 14 bp, Homo sapiens
agaaacactcaaca

SEQ ID NO: 5174217 - DNA, 15 bp, Homo sapiens
agaaacactgaaaag

SEQ ID NO: 5174218 - DNA, 11 bp, Homo sapiens
agaaacactgc

SEQ ID NO: 5174219 - DNA, 16 bp, Homo sapiens
agaaacactgcaaatt

SEQ ID NO: 5174220 - DNA, 14 bp, Homo sapiens
agaaacactgttgg

SEQ ID NO: 5174221 - DNA, 14 bp, Homo sapiens
agaaacacttgaac

SEQ ID NO: 5174222 - DNA, 11 bp, Homo sapiens
agaaacacttt

SEQ ID NO: 5174223 - DNA, 24 bp, Homo sapiens
agaaacactttcttgagcaccagg

SEQ ID NO: 5174224 - DNA, 20 bp, Homo sapiens
agaaacagaagaaaaacact

SEQ ID NO: 5174225 - DNA, 16 bp, Homo sapiens
agaaacagaagtagaa

SEQ ID NO: 5174226 - DNA, 12 bp, Homo sapiens
agaaacagacag

SEQ ID NO: 5174227 - DNA, 15 bp, Homo sapiens
agaaacagagagaga

SEQ ID NO: 5174228 - DNA, 18 bp, Homo sapiens
agaaacagagatcataaa

SEQ ID NO: 5174229 - DNA, 17 bp, Homo sapiens
agaaacagagtggcctc

SEQ ID NO: 5174230 - DNA, 18 bp, Homo sapiens
agaaacagagtggcctcc

SEQ ID NO: 5174231 - DNA, 21 bp, Homo sapiens
agaaacagagtggcctccctg

SEQ ID NO: 5174232 - DNA, 16 bp, Homo sapiens
agaaacagataccata

SEQ ID NO: 5174233 - DNA, 15 bp, Homo sapiens
agaaacagccagcaa

SEQ ID NO: 5174234 - DNA, 13 bp, Homo sapiens
agaaacagctgct

SEQ ID NO: 5174235 - DNA, 15 bp, Homo sapiens
agaaacagctttcaa

SEQ ID NO: 5174236 - DNA, 14 bp, Homo sapiens
agaaacaggcccag

SEQ ID NO: 5174237 - DNA, 21 bp, Homo sapiens
agaaacagggacaaagaaatc

SEQ ID NO: 5174238 - DNA, 12 bp, Homo sapiens
agaaacagggca

SEQ ID NO: 5174239 - DNA, 19 bp, Homo sapiens
agaaacaggggatcaaagt

SEQ ID NO: 5174240 - DNA, 21 bp, Homo sapiens
agaaacaggggatcaaagttc

SEQ ID NO: 5174241 - DNA, 13 bp, Homo sapiens
agaaacagttaac

SEQ ID NO: 5174242 - DNA, 19 bp, Homo sapiens
agaaacagttggtaacttt

SEQ ID NO: 5174243 - DNA, 16 bp, Homo sapiens
agaaacagtttaacag

SEQ ID NO: 5174244 - DNA, 17 bp, Homo sapiens
agaaacagtttaacaga

SEQ ID NO: 5174245 - DNA, 13 bp, Homo sapiens
agaaacagtttct

SEQ ID NO: 5174246 - DNA, 15 bp, Homo sapiens
agaaacataaataaa

SEQ ID NO: 5174247 - DNA, 23 bp, Homo sapiens
agaaacataaataaaatgaccag

SEQ ID NO: 5174248 - DNA, 19 bp, Homo sapiens
agaaacataaccgtgaagc

SEQ ID NO: 5174249 - DNA, 14 bp, Homo sapiens
agaaacatacacaa

SEQ ID NO: 5174250 - DNA, 16 bp, Homo sapiens
agaaacatcagttact

SEQ ID NO: 5174251 - DNA, 21 bp, Homo sapiens
agaaacatccatattgcacaa

SEQ ID NO: 5174252 - DNA, 11 bp, Homo sapiens
agaaacatctc

SEQ ID NO: 5174253 - DNA, 18 bp, Homo sapiens
agaaacatgaaatgcttc

SEQ ID NO: 5174254 - DNA, 12 bp, Homo sapiens
agaaacatgaca

SEQ ID NO: 5174255 - DNA, 18 bp, Homo sapiens
agaaacatgacactgacc

SEQ ID NO: 5174256 - DNA, 11 bp, Homo sapiens
agaaacattgt

SEQ ID NO: 5174257 - DNA, 16 bp, Homo sapiens
agaaacattgtaaata

SEQ ID NO: 5174258 - DNA, 15 bp, Homo sapiens
agaaacatttatatt

SEQ ID NO: 5174259 - DNA, 19 bp, Homo sapiens
agaaacatttatattgata

SEQ ID NO: 5174260 - DNA, 20 bp, Homo sapiens
agaaacatttggaaaagaca

SEQ ID NO: 5174261 - DNA, 15 bp, Homo sapiens
agaaacatttggtaa

SEQ ID NO: 5174262 - DNA, 21 bp, Homo sapiens
agaaaccaaactaggagatga

SEQ ID NO: 5174263 - DNA, 11 bp, Homo sapiens
agaaaccaaat

SEQ ID NO: 5174264 - DNA, 16 bp, Homo sapiens
agaaaccaagtgggct

SEQ ID NO: 5174265 - DNA, 19 bp, Homo sapiens
agaaaccacagtcttccca

SEQ ID NO: 5174266 - DNA, 15 bp, Homo sapiens
agaaaccagaaaagc

SEQ ID NO: 5174267 - DNA, 15 bp, Homo sapiens
agaaaccagcttcct

SEQ ID NO: 5174268 - DNA, 16 bp, Homo sapiens
agaaaccagcttcctt

SEQ ID NO: 5174269 - DNA, 22 bp, Homo sapiens
agaaaccagcttccttcagaga

SEQ ID NO: 5174270 - DNA, 17 bp, Homo sapiens
agaaaccagtatggaag

SEQ ID NO: 5174271 - DNA, 21 bp, Homo sapiens
agactctaccagactgtgtat

SEQ ID NO: 5174272 - DNA, 13 bp, Homo sapiens
agactctagaaaa

SEQ ID NO: 5174273 - DNA, 18 bp, Homo sapiens
agactctagacaagatat

SEQ ID NO: 5174274 - DNA, 17 bp, Homo sapiens
agactctagagtccaag

SEQ ID NO: 5174275 - DNA, 21 bp, Homo sapiens
agactctagagtccaaggttt

SEQ ID NO: 5174276 - DNA, 19 bp, Homo sapiens
agactctaggttatacaat

SEQ ID NO: 5174277 - DNA, 21 bp, Homo sapiens
agactctaggttatacaataa

SEQ ID NO: 5174278 - DNA, 15 bp, Homo sapiens
agactctatgctctg

SEQ ID NO: 5174279 - DNA, 16 bp, Homo sapiens
agactctatgctctgg

SEQ ID NO: 5174280 - DNA, 16 bp, Homo sapiens
agactctatttaagat

SEQ ID NO: 5174281 - DNA, 22 bp, Homo sapiens
agactctccactgacctggttg

SEQ ID NO: 5174282 - DNA, 13 bp, Homo sapiens
agactctccctgt

SEQ ID NO: 5174283 - DNA, 18 bp, Homo sapiens
agactctcctgcctcagc

SEQ ID NO: 5174284 - DNA, 19 bp, Homo sapiens
agactctctagttttatct

SEQ ID NO: 5174285 - DNA, 13 bp, Homo sapiens
agactctctctgg

SEQ ID NO: 5174286 - DNA, 11 bp, Homo sapiens
agactctgagc

SEQ ID NO: 5174287 - DNA, 16 bp, Homo sapiens
agactctgagccaagg

SEQ ID NO: 5174288 - DNA, 21 bp, Homo sapiens
agactctgagccaagggaggg

SEQ ID NO: 5174289 - DNA, 17 bp, Homo sapiens
agactctgagctgctca

SEQ ID NO: 5174290 - DNA, 23 bp, Homo sapiens
agactctgcctcctggtttcctt

SEQ ID NO: 5174291 - DNA, 17 bp, Homo sapiens
agactctgctagtgaaa

SEQ ID NO: 5174292 - DNA, 11 bp, Homo sapiens
agactctgctc

SEQ ID NO: 5174293 - DNA, 16 bp, Homo sapiens
agactctggaagcccc

SEQ ID NO: 5174294 - DNA, 12 bp, Homo sapiens
agactctggagc

SEQ ID NO: 5174295 - DNA, 23 bp, Homo sapiens
agactctggagccaaggcagagg

SEQ ID NO: 5174296 - DNA, 20 bp, Homo sapiens
agactctgggtccctcggag

SEQ ID NO: 5174297 - DNA, 21 bp, Homo sapiens
agactctgggtccctcggagc

SEQ ID NO: 5174298 - DNA, 19 bp, Homo sapiens
agactctggtcttctttgg

SEQ ID NO: 5174299 - DNA, 21 bp, Homo sapiens
agactctgtctaaaaaacaaa

SEQ ID NO: 5174300 - DNA, 18 bp, Homo sapiens
agactctgtctcagtcca

SEQ ID NO: 5174301 - DNA, 20 bp, Homo sapiens
agactctgtgagattctaaa

SEQ ID NO: 5174302 - DNA, 12 bp, Homo sapiens
agactctgtgat

SEQ ID NO: 5174303 - DNA, 20 bp, Homo sapiens
agactctgtgtggctgtgca

SEQ ID NO: 5174304 - DNA, 20 bp, Homo sapiens
agactcttcccctccctccc

SEQ ID NO: 5174305 - DNA, 22 bp, Homo sapiens
agactctttaataaattgctta

SEQ ID NO: 5174306 - DNA, 17 bp, Homo sapiens
agactctttagagcagc

SEQ ID NO: 5174307 - DNA, 18 bp, Homo sapiens
agactctttagagcagct

SEQ ID NO: 5174308 - DNA, 16 bp, Homo sapiens
agactctttggacact

SEQ ID NO: 5174309 - DNA, 23 bp, Homo sapiens
agactctttttgtacctggtgac

SEQ ID NO: 5174310 - DNA, 19 bp, Homo sapiens
agactgaaatggcttctat

SEQ ID NO: 5174311 - DNA, 13 bp, Homo sapiens
agactgaaattta

SEQ ID NO: 5174312 - DNA, 15 bp, Homo sapiens
agactgaacagccaa

SEQ ID NO: 5174313 - DNA, 14 bp, Homo sapiens
agactgaacatgtt

SEQ ID NO: 5174314 - DNA, 20 bp, Homo sapiens
agactgaactgcagggttca

SEQ ID NO: 5174315 - DNA, 18 bp, Homo sapiens
agactgaacttaccgtga

SEQ ID NO: 5174316 - DNA, 13 bp, Homo sapiens
agactgaagagac

SEQ ID NO: 5174317 - DNA, 13 bp, Homo sapiens
agactgaagattt

SEQ ID NO: 5174318 - DNA, 16 bp, Homo sapiens
agactgaagatttatt

SEQ ID NO: 5174319 - DNA, 21 bp, Homo sapiens
agactgaatagatatgaaagc

SEQ ID NO: 5174320 - DNA, 17 bp, Homo sapiens
agactgacacctcactg

SEQ ID NO: 5174321 - DNA, 22 bp, Homo sapiens
agactgacagtttacagacgct

SEQ ID NO: 5174322 - DNA, 11 bp, Homo sapiens
agactgaccca

SEQ ID NO: 5174323 - DNA, 14 bp, Homo sapiens
agactgaccccaga

SEQ ID NO: 5174324 - DNA, 23 bp, Homo sapiens
agactgactggcaccaacacttt

SEQ ID NO: 5174325 - DNA, 22 bp, Homo sapiens
agactgactgggcgtggtggct

SEQ ID NO: 5174326 - DNA, 15 bp, Homo sapiens
agactgagaggcaga

SEQ ID NO: 5174327 - DNA, 17 bp, Homo sapiens
agactgagcagccgcca

SEQ ID NO: 5174328 - DNA, 13 bp, Homo sapiens
agactgagctctc

SEQ ID NO: 5174329 - DNA, 16 bp, Homo sapiens
agactgagctctccag

SEQ ID NO: 5174330 - DNA, 21 bp, Homo sapiens
agactgagcttgattctaaag

SEQ ID NO: 5174331 - DNA, 17 bp, Homo sapiens
agactgaggacaaagtg

SEQ ID NO: 5174332 - DNA, 17 bp, Homo sapiens
agactgagggagagact

SEQ ID NO: 5174333 - DNA, 15 bp, Homo sapiens
agactgaggggtcga

SEQ ID NO: 5174334 - DNA, 18 bp, Homo sapiens
agactgaggtataaagac

SEQ ID NO: 5174335 - DNA, 22 bp, Homo sapiens
agactgagtacgttgtgcattt

SEQ ID NO: 5174336 - DNA, 18 bp, Homo sapiens
agactgagtcagatgggt

SEQ ID NO: 5174337 - DNA, 19 bp, Homo sapiens
agactgataacaacctttt

SEQ ID NO: 5174338 - DNA, 14 bp, Homo sapiens
agactgataatttt

SEQ ID NO: 5174339 - DNA, 13 bp, Homo sapiens
agactgatagaca

SEQ ID NO: 5174340 - DNA, 19 bp, Homo sapiens
agactgatcaggacctcca

SEQ ID NO: 5174341 - DNA, 19 bp, Homo sapiens
agactgatcatccaggcct

SEQ ID NO: 5174342 - DNA, 15 bp, Homo sapiens
agactgatgagcaca

SEQ ID NO: 5174343 - DNA, 20 bp, Homo sapiens
agactgatggccaggcaagt

SEQ ID NO: 5174344 - DNA, 16 bp, Homo sapiens
agactgcaagaactgt

SEQ ID NO: 5174345 - DNA, 18 bp, Homo sapiens
agactgcaagaactgttt

SEQ ID NO: 5174346 - DNA, 21 bp, Homo sapiens
agactgcaagtgagcaaacct

SEQ ID NO: 5174347 - DNA, 21 bp, Homo sapiens
agactgcaatgtgatctatgt

SEQ ID NO: 5174348 - DNA, 14 bp, Homo sapiens
agactgcacccagg

SEQ ID NO: 5174349 - DNA, 16 bp, Homo sapiens
agactgcacccaggag

SEQ ID NO: 5174350 - DNA, 19 bp, Homo sapiens
agactgcagaacccccagg

SEQ ID NO: 5174351 - DNA, 12 bp, Homo sapiens
agactgcagctg

SEQ ID NO: 5174352 - DNA, 17 bp, Homo sapiens
agactgcaggtgggctg

SEQ ID NO: 5174353 - DNA, 18 bp, Homo sapiens
agactgcaggtgggctgg

SEQ ID NO: 5174354 - DNA, 20 bp, Homo sapiens
agactgcaggtgggctgggc

SEQ ID NO: 5174355 - DNA, 12 bp, Homo sapiens
agactgcatctc

SEQ ID NO: 5174356 - DNA, 21 bp, Homo sapiens
agactgccacgtgccttagga

SEQ ID NO: 5174357 - DNA, 18 bp, Homo sapiens
agactgccagctcttcct

SEQ ID NO: 5174358 - DNA, 22 bp, Homo sapiens
agactgccagctcttcctagct

SEQ ID NO: 5174359 - DNA, 21 bp, Homo sapiens
agactgccatattaaattttt

SEQ ID NO: 5174360 - DNA, 15 bp, Homo sapiens
agactgcccaccctg

SEQ ID NO: 5174361 - DNA, 20 bp, Homo sapiens
agactgcccaccctgggcct

SEQ ID NO: 5174362 - DNA, 22 bp, Homo sapiens
agactgcccaccctgggcctcc

SEQ ID NO: 5174363 - DNA, 23 bp, Homo sapiens
agactgcccaccctgggcctccc

SEQ ID NO: 5174364 - DNA, 21 bp, Homo sapiens
agactgccccacggagacaga

SEQ ID NO: 5174365 - DNA, 22 bp, Homo sapiens
agactgccccacggagacagag

SEQ ID NO: 5174366 - DNA, 15 bp, Homo sapiens
agactgccccagcca

SEQ ID NO: 5174367 - DNA, 18 bp, Homo sapiens
agactgccccagccaacg

SEQ ID NO: 5174368 - DNA, 12 bp, Homo sapiens
agactgcctccc

SEQ ID NO: 5174369 - DNA, 13 bp, Homo sapiens
agactgcctccct

SEQ ID NO: 5174370 - DNA, 13 bp, Homo sapiens
agactgcctgtct

SEQ ID NO: 5174371 - DNA, 18 bp, Homo sapiens
agactgcctgtctgcttg

SEQ ID NO: 5174372 - DNA, 18 bp, Homo sapiens
agactgccttatattatt

SEQ ID NO: 5174373 - DNA, 19 bp, Homo sapiens
agactgccttatattattt

SEQ ID NO: 5174374 - DNA, 12 bp, Homo sapiens
agactgccttca

SEQ ID NO: 5174375 - DNA, 23 bp, Homo sapiens
agactgcgatttgtcccaggtcc

SEQ ID NO: 5174376 - DNA, 22 bp, Homo sapiens
agactgcgggatggtcctgggg

SEQ ID NO: 5174377 - DNA, 18 bp, Homo sapiens
agactgctagaaccaagc

SEQ ID NO: 5174378 - DNA, 12 bp, Homo sapiens
agactgctagct

SEQ ID NO: 5174379 - DNA, 14 bp, Homo sapiens
agactgctatcagt

SEQ ID NO: 5174380 - DNA, 19 bp, Homo sapiens
agactgctcctgagccccc

SEQ ID NO: 5174381 - DNA, 14 bp, Homo sapiens
agactgctgcaaag

SEQ ID NO: 5174382 - DNA, 22 bp, Homo sapiens
agactgctgggactggccaggt

SEQ ID NO: 5174383 - DNA, 19 bp, Homo sapiens
agactgctgtggccaggag

SEQ ID NO: 5174384 - DNA, 21 bp, Homo sapiens
agactgcttcccatcctaccc

SEQ ID NO: 5174385 - DNA, 16 bp, Homo sapiens
agactgcttggccaga

SEQ ID NO: 5174386 - DNA, 19 bp, Homo sapiens
agactgcttggccagatgc

SEQ ID NO: 5174387 - DNA, 16 bp, Homo sapiens
agactggaaaaaatga

SEQ ID NO: 5174388 - DNA, 15 bp, Homo sapiens
agactggaacactag

SEQ ID NO: 5174389 - DNA, 18 bp, Homo sapiens
agactggaacactagaca

SEQ ID NO: 5174390 - DNA, 17 bp, Homo sapiens
agactggaacttgaact

SEQ ID NO: 5174391 - DNA, 11 bp, Homo sapiens
agactggaaga

SEQ ID NO: 5174392 - DNA, 19 bp, Homo sapiens
agactggaagcacagcttc

SEQ ID NO: 5174393 - DNA, 18 bp, Homo sapiens
agactggaatagtggcat

SEQ ID NO: 5174394 - DNA, 11 bp, Homo sapiens
agactggacag

SEQ ID NO: 5174395 - DNA, 13 bp, Homo sapiens
agactggacagct

SEQ ID NO: 5174396 - DNA, 15 bp, Homo sapiens
agactggacagcttg

SEQ ID NO: 5174397 - DNA, 20 bp, Homo sapiens
agactggacggggaaaccta

SEQ ID NO: 5174398 - DNA, 18 bp, Homo sapiens
agactggagactgtccac

SEQ ID NO: 5174399 - DNA, 20 bp, Homo sapiens
agactggaggcatttctttt

SEQ ID NO: 5174400 - DNA, 16 bp, Homo sapiens
agactggatagtccgt

SEQ ID NO: 5174401 - DNA, 15 bp, Homo sapiens
agactggcaataaac

SEQ ID NO: 5174402 - DNA, 21 bp, Homo sapiens
agactggcacagttttctgag

SEQ ID NO: 5174403 - DNA, 23 bp, Homo sapiens
agactggcacagttttctgagaa

SEQ ID NO: 5174404 - DNA, 18 bp, Homo sapiens
agactggcagccagggag

SEQ ID NO: 5174405 - DNA, 13 bp, Homo sapiens
agactggcaggcg

SEQ ID NO: 5174406 - DNA, 15 bp, Homo sapiens
agactggccagaggc

SEQ ID NO: 5174407 - DNA, 15 bp, Homo sapiens
agactggccatgcaa

SEQ ID NO: 5174408 - DNA, 17 bp, Homo sapiens
agactggccatgcaagt

SEQ ID NO: 5174409 - DNA, 15 bp, Homo sapiens
agactggcccagtgc

SEQ ID NO: 5174410 - DNA, 18 bp, Homo sapiens
agactggcccagtgccag

SEQ ID NO: 5174411 - DNA, 21 bp, Homo sapiens
agactggcccagtgccagcaa

SEQ ID NO: 5174412 - DNA, 13 bp, Homo sapiens
agactggccgggc

SEQ ID NO: 5174413 - DNA, 15 bp, Homo sapiens
agactggccgggcag

SEQ ID NO: 5174414 - DNA, 18 bp, Homo sapiens
agactggccgggcaggcg

SEQ ID NO: 5174415 - DNA, 17 bp, Homo sapiens
agactggcgtgaaccca

SEQ ID NO: 5174416 - DNA, 11 bp, Homo sapiens
agactggctgc

SEQ ID NO: 5174417 - DNA, 20 bp, Homo sapiens
agactggctggctgcagtga

SEQ ID NO: 5174418 - DNA, 18 bp, Homo sapiens
agactggcttttattaat

SEQ ID NO: 5174419 - DNA, 23 bp, Homo sapiens
agactgggaaggcttgggatttg

SEQ ID NO: 5174420 - DNA, 17 bp, Homo sapiens
agactgggagccacttc

SEQ ID NO: 5174421 - DNA, 20 bp, Homo sapiens
agactgggagccacttctcc

SEQ ID NO: 5174422 - DNA, 22 bp, Homo sapiens
agactgggagccacttctcccc

SEQ ID NO: 5174423 - DNA, 16 bp, Homo sapiens
agactgggcacccctg

SEQ ID NO: 5174424 - DNA, 17 bp, Homo sapiens
agactgggcacccctgc

SEQ ID NO: 5174425 - DNA, 22 bp, Homo sapiens
agactgggcacccctgcctcct

SEQ ID NO: 5174426 - DNA, 18 bp, Homo sapiens
agactgggcactggggcc

SEQ ID NO: 5174427 - DNA, 14 bp, Homo sapiens
agactgggcccagg

SEQ ID NO: 5174428 - DNA, 16 bp, Homo sapiens
agactgggcccaggca

SEQ ID NO: 5174429 - DNA, 18 bp, Homo sapiens
agactgggcccaggcagg

SEQ ID NO: 5174430 - DNA, 21 bp, Homo sapiens
agactgggcccaggcaggtct

SEQ ID NO: 5174431 - DNA, 21 bp, Homo sapiens
agactgggcctaggccaggag

SEQ ID NO: 5174432 - DNA, 12 bp, Homo sapiens
agactgggctga

SEQ ID NO: 5174433 - DNA, 14 bp, Homo sapiens
agactgggctgagg

SEQ ID NO: 5174434 - DNA, 16 bp, Homo sapiens
agactgggctggctgc

SEQ ID NO: 5174435 - DNA, 17 bp, Homo sapiens
agactgggctggctgcc

SEQ ID NO: 5174436 - DNA, 15 bp, Homo sapiens
agactggggcctgga

SEQ ID NO: 5174437 - DNA, 16 bp, Homo sapiens
agactggggcctggac

SEQ ID NO: 5174438 - DNA, 18 bp, Homo sapiens
agactggggggcttgaaa

SEQ ID NO: 5174439 - DNA, 18 bp, Homo sapiens
agactgggtaggaaagag

SEQ ID NO: 5174440 - DNA, 22 bp, Homo sapiens
agactgggtaggaaagaggaag

SEQ ID NO: 5174441 - DNA, 15 bp, Homo sapiens
agactgggtttctag

SEQ ID NO: 5174442 - DNA, 16 bp, Homo sapiens
agactggtaggaggag

SEQ ID NO: 5174443 - DNA, 19 bp, Homo sapiens
agactggtaggaggaggca

SEQ ID NO: 5174444 - DNA, 21 bp, Homo sapiens
agactggtaggaggaggcatg

SEQ ID NO: 5174445 - DNA, 18 bp, Homo sapiens
agactggtcctgtgtgca

SEQ ID NO: 5174446 - DNA, 22 bp, Homo sapiens
agactggtctcgaactcctggc

SEQ ID NO: 5174447 - DNA, 14 bp, Homo sapiens
agactggtgactga

SEQ ID NO: 5174448 - DNA, 20 bp, Homo sapiens
agactggttccatggcctct

SEQ ID NO: 5174449 - DNA, 18 bp, Homo sapiens
agaaaccagtatggaagg

SEQ ID NO: 5174450 - DNA, 23 bp, Homo sapiens
agaaaccatcctctcccttctta

SEQ ID NO: 5174451 - DNA, 22 bp, Homo sapiens
agaaacccaccagcctaagaag

SEQ ID NO: 5174452 - DNA, 14 bp, Homo sapiens
agaaacccagagat

SEQ ID NO: 5174453 - DNA, 15 bp, Homo sapiens
agaaacccagagatg

SEQ ID NO: 5174454 - DNA, 13 bp, Homo sapiens
agaaaccccaagc

SEQ ID NO: 5174455 - DNA, 14 bp, Homo sapiens
agaaaccccaagca

SEQ ID NO: 5174456 - DNA, 17 bp, Homo sapiens
agaaaccccaagcagca

SEQ ID NO: 5174457 - DNA, 13 bp, Homo sapiens
agaaaccccaggg

SEQ ID NO: 5174458 - DNA, 13 bp, Homo sapiens
agaaacccccagg

SEQ ID NO: 5174459 - DNA, 14 bp, Homo sapiens
agaaacccctgaca

SEQ ID NO: 5174460 - DNA, 16 bp, Homo sapiens
agaaacccgacagagg

SEQ ID NO: 5174461 - DNA, 21 bp, Homo sapiens
agaaaccctaaaaagagaaga

SEQ ID NO: 5174462 - DNA, 13 bp, Homo sapiens
agaaaccctgcac

SEQ ID NO: 5174463 - DNA, 22 bp, Homo sapiens
agaaaccgatttttaaagttgg

SEQ ID NO: 5174464 - DNA, 23 bp, Homo sapiens
agaaacctactgcccaggcactg

SEQ ID NO: 5174465 - DNA, 17 bp, Homo sapiens
agaaacctatctcaggg

SEQ ID NO: 5174466 - DNA, 21 bp, Homo sapiens
agaaacctatctcagggaggg

SEQ ID NO: 5174467 - DNA, 22 bp, Homo sapiens
agaaacctcattggccagctca

SEQ ID NO: 5174468 - DNA, 23 bp, Homo sapiens
agaaacctgaggatgcaacaaat

SEQ ID NO: 5174469 - DNA, 17 bp, Homo sapiens
agaaacctgccaaggag

SEQ ID NO: 5174470 - DNA, 23 bp, Homo sapiens
agaaacctgccaaggagcatcct

SEQ ID NO: 5174471 - DNA, 19 bp, Homo sapiens
agaaacctggggtgaatac

SEQ ID NO: 5174472 - DNA, 21 bp, Homo sapiens
agaaacctggggtgaatactt

SEQ ID NO: 5174473 - DNA, 20 bp, Homo sapiens
agaaacctgtatctttctat

SEQ ID NO: 5174474 - DNA, 20 bp, Homo sapiens
agaaaccttattgtacctct

SEQ ID NO: 5174475 - DNA, 15 bp, Homo sapiens
agaaaccttccagag

SEQ ID NO: 5174476 - DNA, 16 bp, Homo sapiens
agaaaccttccagaga

SEQ ID NO: 5174477 - DNA, 23 bp, Homo sapiens
agaaaccttgcaaactctataaa

SEQ ID NO: 5174478 - DNA, 14 bp, Homo sapiens
agaaaccttgctct

SEQ ID NO: 5174479 - DNA, 19 bp, Homo sapiens
agaaaccttgtttgtttta

SEQ ID NO: 5174480 - DNA, 21 bp, Homo sapiens
agaaacctttatccctgctta

SEQ ID NO: 5174481 - DNA, 15 bp, Homo sapiens
agaaacgaaaaggac

SEQ ID NO: 5174482 - DNA, 20 bp, Homo sapiens
agaaacgaagccatctttct

SEQ ID NO: 5174483 - DNA, 17 bp, Homo sapiens
agaaacgagatttgcca

SEQ ID NO: 5174484 - DNA, 20 bp, Homo sapiens
agaaacgatcagacagatct

SEQ ID NO: 5174485 - DNA, 18 bp, Homo sapiens
agaaacgcatccagcaag

SEQ ID NO: 5174486 - DNA, 21 bp, Homo sapiens
agaaacgcgctccttggcgga

SEQ ID NO: 5174487 - DNA, 16 bp, Homo sapiens
agaaacgtaaactatg

SEQ ID NO: 5174488 - DNA, 17 bp, Homo sapiens
agaaacgtgtcacactt

SEQ ID NO: 5174489 - DNA, 20 bp, Homo sapiens
agaaacgtttggaacaatct

SEQ ID NO: 5174490 - DNA, 21 bp, Homo sapiens
agaaacgtttggaacaatcta

SEQ ID NO: 5174491 - DNA, 20 bp, Homo sapiens
agaaactaaaaatatagcaa

SEQ ID NO: 5174492 - DNA, 14 bp, Homo sapiens
agaaactaagaatc

SEQ ID NO: 5174493 - DNA, 14 bp, Homo sapiens
agaaactaagattt

SEQ ID NO: 5174494 - DNA, 17 bp, Homo sapiens
agaaactaattgacttt

SEQ ID NO: 5174495 - DNA, 14 bp, Homo sapiens
agaaactacaaata

SEQ ID NO: 5174496 - DNA, 21 bp, Homo sapiens
agaaactagtatctctggcct

SEQ ID NO: 5174497 - DNA, 22 bp, Homo sapiens
agaaactatttttgtgtttgaa

SEQ ID NO: 5174498 - DNA, 21 bp, Homo sapiens
agaaactcaaccatcaatgga

SEQ ID NO: 5174499 - DNA, 23 bp, Homo sapiens
agaaactcacccccaaggggcag

SEQ ID NO: 5174500 - DNA, 16 bp, Homo sapiens
agaaactccaaagtcc

SEQ ID NO: 5174501 - DNA, 19 bp, Homo sapiens
agaaactccgaagaaaaga

SEQ ID NO: 5174502 - DNA, 22 bp, Homo sapiens
agaaactcctggatccctttca

SEQ ID NO: 5174503 - DNA, 18 bp, Homo sapiens
agaaactcgggcttgagt

SEQ ID NO: 5174504 - DNA, 16 bp, Homo sapiens
agaaactctacataat

SEQ ID NO: 5174505 - DNA, 19 bp, Homo sapiens
agaaactctatggtcttat

SEQ ID NO: 5174506 - DNA, 16 bp, Homo sapiens
agaaactgaaaaatat

SEQ ID NO: 5174507 - DNA, 21 bp, Homo sapiens
agaaactgaaaaatatctggt

SEQ ID NO: 5174508 - DNA, 19 bp, Homo sapiens
agaaactgaaaactgtaaa

SEQ ID NO: 5174509 - DNA, 16 bp, Homo sapiens
agaaactgaaagtgtt

SEQ ID NO: 5174510 - DNA, 17 bp, Homo sapiens
agaaactgaaagtgttt

SEQ ID NO: 5174511 - DNA, 19 bp, Homo sapiens
agaaactgaaagtgtttta

SEQ ID NO: 5174512 - DNA, 13 bp, Homo sapiens
agaaactgaacca

SEQ ID NO: 5174513 - DNA, 21 bp, Homo sapiens
agaaactgacatgccctccct

SEQ ID NO: 5174514 - DNA, 16 bp, Homo sapiens
agaaactgaggcccag

SEQ ID NO: 5174515 - DNA, 18 bp, Homo sapiens
agaaactgaggcccagag

SEQ ID NO: 5174516 - DNA, 15 bp, Homo sapiens
agaaactgagtcctg

SEQ ID NO: 5174517 - DNA, 14 bp, Homo sapiens
agaaactgatgcca

SEQ ID NO: 5174518 - DNA, 20 bp, Homo sapiens
agaaactgccacatacacca

SEQ ID NO: 5174519 - DNA, 13 bp, Homo sapiens
agaaactgctgca

SEQ ID NO: 5174520 - DNA, 23 bp, Homo sapiens
agaaactgctgcagattagttct

SEQ ID NO: 5174521 - DNA, 17 bp, Homo sapiens
agaaactggaagctgtt

SEQ ID NO: 5174522 - DNA, 22 bp, Homo sapiens
agaaactggcaaagcagaatgt

SEQ ID NO: 5174523 - DNA, 13 bp, Homo sapiens
agaaacttaaaca

SEQ ID NO: 5174524 - DNA, 21 bp, Homo sapiens
agaaacttaaattttagttct

SEQ ID NO: 5174525 - DNA, 18 bp, Homo sapiens
agaaacttaagcaaaggg

SEQ ID NO: 5174526 - DNA, 17 bp, Homo sapiens
agaaacttagaggaaaa

SEQ ID NO: 5174527 - DNA, 22 bp, Homo sapiens
agaaacttatcttacaaagtgt

SEQ ID NO: 5174528 - DNA, 20 bp, Homo sapiens
agaaacttatttctcatatc

SEQ ID NO: 5174529 - DNA, 21 bp, Homo sapiens
agaaacttatttctcatatca

SEQ ID NO: 5174530 - DNA, 23 bp, Homo sapiens
agaaacttcagcaagctagaact

SEQ ID NO: 5174531 - DNA, 14 bp, Homo sapiens
agaaacttccaaat

SEQ ID NO: 5174532 - DNA, 14 bp, Homo sapiens
agaaacttctcagt

SEQ ID NO: 5174533 - DNA, 18 bp, Homo sapiens
agaaacttgaactccagg

SEQ ID NO: 5174534 - DNA, 19 bp, Homo sapiens
agaaacttgaagctttgta

SEQ ID NO: 5174535 - DNA, 20 bp, Homo sapiens
agaaacttgaagctttgtag

SEQ ID NO: 5174536 - DNA, 18 bp, Homo sapiens
agaaacttggctggaatt

SEQ ID NO: 5174537 - DNA, 13 bp, Homo sapiens
agaaacttgtgaa

SEQ ID NO: 5174538 - DNA, 23 bp, Homo sapiens
agaaacttgttcttccaaagcag

SEQ ID NO: 5174539 - DNA, 16 bp, Homo sapiens
agaaactttatacatt

SEQ ID NO: 5174540 - DNA, 22 bp, Homo sapiens
agaaactttatacattagtaaa

SEQ ID NO: 5174541 - DNA, 12 bp, Homo sapiens
agaaactttatt

SEQ ID NO: 5174542 - DNA, 19 bp, Homo sapiens
agaaactttctataaccta

SEQ ID NO: 5174543 - DNA, 22 bp, Homo sapiens
agaaactttgatctctgcttac

SEQ ID NO: 5174544 - DNA, 14 bp, Homo sapiens
agaaactttggaag

SEQ ID NO: 5174545 - DNA, 18 bp, Homo sapiens
agaaactttggaagcact

SEQ ID NO: 5174546 - DNA, 23 bp, Homo sapiens
agaaactttggaagttttacttg

SEQ ID NO: 5174547 - DNA, 24 bp, Homo sapiens
agaaactttggaagttttacttga

SEQ ID NO: 5174548 - DNA, 14 bp, Homo sapiens
agaaacttttgaaa

SEQ ID NO: 5174549 - DNA, 14 bp, Homo sapiens
agaaactttttaat

SEQ ID NO: 5174550 - DNA, 21 bp, Homo sapiens
agaaactttttaataaagtat

SEQ ID NO: 5174551 - DNA, 15 bp, Homo sapiens
agaaacttttttatt

SEQ ID NO: 5174552 - DNA, 16 bp, Homo sapiens
agaaacttttttattt

SEQ ID NO: 5174553 - DNA, 13 bp, Homo sapiens
agaaagaaaaaag

SEQ ID NO: 5174554 - DNA, 21 bp, Homo sapiens
agaaagaaaagaccctgagac

SEQ ID NO: 5174555 - DNA, 17 bp, Homo sapiens
agaaagaaaaggcaaaa

SEQ ID NO: 5174556 - DNA, 20 bp, Homo sapiens
agaaagaaaaggcaaaagac

SEQ ID NO: 5174557 - DNA, 19 bp, Homo sapiens
agaaagaaaatggaaagaa

SEQ ID NO: 5174558 - DNA, 13 bp, Homo sapiens
agaaagaaacact

SEQ ID NO: 5174559 - DNA, 20 bp, Homo sapiens
agaaagaaacccgacagagg

SEQ ID NO: 5174560 - DNA, 21 bp, Homo sapiens
agaaagaaacttcattcagag

SEQ ID NO: 5174561 - DNA, 12 bp, Homo sapiens
agaaagaaagga

SEQ ID NO: 5174562 - DNA, 16 bp, Homo sapiens
agaaagaaaggaaaga

SEQ ID NO: 5174563 - DNA, 17 bp, Homo sapiens
agaaagaaaggaaagaa

SEQ ID NO: 5174564 - DNA, 19 bp, Homo sapiens
agaaagaaaggaaagaagg

SEQ ID NO: 5174565 - DNA, 15 bp, Homo sapiens
agaaagaaagggaaa

SEQ ID NO: 5174566 - DNA, 23 bp, Homo sapiens
agaaagaaagtacccagcaaatg

SEQ ID NO: 5174567 - DNA, 12 bp, Homo sapiens
agaaagaaagtt

SEQ ID NO: 5174568 - DNA, 14 bp, Homo sapiens
agaaagaaattact

SEQ ID NO: 5174569 - DNA, 13 bp, Homo sapiens
agaaagaaatttg

SEQ ID NO: 5174570 - DNA, 18 bp, Homo sapiens
agaaagaaatttgaaaaa

SEQ ID NO: 5174571 - DNA, 18 bp, Homo sapiens
agaaagaacgttcccttt

SEQ ID NO: 5174572 - DNA, 14 bp, Homo sapiens
agaaagaactatct

SEQ ID NO: 5174573 - DNA, 24 bp, Homo sapiens
agaaagaactttaaagctcaggag

SEQ ID NO: 5174574 - DNA, 10 bp, Homo sapiens
agaaagaagc

SEQ ID NO: 5174575 - DNA, 12 bp, Homo sapiens
agaaagaagccc

SEQ ID NO: 5174576 - DNA, 15 bp, Homo sapiens
agaaagaagtggaga

SEQ ID NO: 5174577 - DNA, 22 bp, Homo sapiens
agaaagaataggggctgaagac

SEQ ID NO: 5174578 - DNA, 15 bp, Homo sapiens
agaaagaattagcca

SEQ ID NO: 5174579 - DNA, 18 bp, Homo sapiens
agaaagacaaaatgtgac

SEQ ID NO: 5174580 - DNA, 18 bp, Homo sapiens
agaaagacagagctggga

SEQ ID NO: 5174581 - DNA, 20 bp, Homo sapiens
agaaagacatctgaggaaaa

SEQ ID NO: 5174582 - DNA, 22 bp, Homo sapiens
agaaagaccatgcatttaaagt

SEQ ID NO: 5174583 - DNA, 22 bp, Homo sapiens
agaaagaccctgatgcaggtca

SEQ ID NO: 5174584 - DNA, 23 bp, Homo sapiens
agaaagaccctgatgcaggtcag

SEQ ID NO: 5174585 - DNA, 16 bp, Homo sapiens
agaaagactattcaaa

SEQ ID NO: 5174586 - DNA, 12 bp, Homo sapiens
agaaagacttgg

SEQ ID NO: 5174587 - DNA, 22 bp, Homo sapiens
agaaagacttggttggtagggt

SEQ ID NO: 5174588 - DNA, 13 bp, Homo sapiens
agaaagagaatga

SEQ ID NO: 5174589 - DNA, 18 bp, Homo sapiens
agaaagagacagagactg

SEQ ID NO: 5174590 - DNA, 13 bp, Homo sapiens
agaaagagagaaa

SEQ ID NO: 5174591 - DNA, 14 bp, Homo sapiens
agaaagagagaaaa

SEQ ID NO: 5174592 - DNA, 16 bp, Homo sapiens
agaaagagagaagcca

SEQ ID NO: 5174593 - DNA, 12 bp, Homo sapiens
agaaagagagag

SEQ ID NO: 5174594 - DNA, 18 bp, Homo sapiens
agaaagagagagatacat

SEQ ID NO: 5174595 - DNA, 11 bp, Homo sapiens
agaaagagagc

SEQ ID NO: 5174596 - DNA, 16 bp, Homo sapiens
agaaagagctgcctgg

SEQ ID NO: 5174597 - DNA, 17 bp, Homo sapiens
agaaagagctgcctgga

SEQ ID NO: 5174598 - DNA, 20 bp, Homo sapiens
agaaagagctgcctggatga

SEQ ID NO: 5174599 - DNA, 14 bp, Homo sapiens
agaaagaggggcct

SEQ ID NO: 5174600 - DNA, 21 bp, Homo sapiens
agaaagagggtcccagggctg

SEQ ID NO: 5174601 - DNA, 19 bp, Homo sapiens
agaaagaggtctccccatc

SEQ ID NO: 5174602 - DNA, 21 bp, Homo sapiens
agaaagaggtgaccccagggc

SEQ ID NO: 5174603 - DNA, 19 bp, Homo sapiens
agaaagagtattgttatgt

SEQ ID NO: 5174604 - DNA, 17 bp, Homo sapiens
agaaagatacagacatt

SEQ ID NO: 5174605 - DNA, 22 bp, Homo sapiens
agaaagatcaaattaaataata

SEQ ID NO: 5174606 - DNA, 18 bp, Homo sapiens
agaaagatcattgaaatt

SEQ ID NO: 5174607 - DNA, 22 bp, Homo sapiens
agaaagatccaccctcaaatgt

SEQ ID NO: 5174608 - DNA, 17 bp, Homo sapiens
agaaagatcgtttaaaa

SEQ ID NO: 5174609 - DNA, 15 bp, Homo sapiens
agaaagatggaaatt

SEQ ID NO: 5174610 - DNA, 19 bp, Homo sapiens
agaaagatggatgtgcttt

SEQ ID NO: 5174611 - DNA, 14 bp, Homo sapiens
agaaagatgtatat

SEQ ID NO: 5174612 - DNA, 12 bp, Homo sapiens
agaaagattaaa

SEQ ID NO: 5174613 - DNA, 16 bp, Homo sapiens
agaaagattaaatata

SEQ ID NO: 5174614 - DNA, 22 bp, Homo sapiens
agaaagattaaatatgatcact

SEQ ID NO: 5174615 - DNA, 19 bp, Homo sapiens
agaaagattgtaaactaaa

SEQ ID NO: 5174616 - DNA, 13 bp, Homo sapiens
agaaagatttaaa

SEQ ID NO: 5174617 - DNA, 16 bp, Homo sapiens
agaaagatttaaagta

SEQ ID NO: 5174618 - DNA, 19 bp, Homo sapiens
agaaagatttgttactgta

SEQ ID NO: 5174619 - DNA, 15 bp, Homo sapiens
agaaagcaaacatgt

SEQ ID NO: 5174620 - DNA, 20 bp, Homo sapiens
agaaagcaaatcagacacaa

SEQ ID NO: 5174621 - DNA, 17 bp, Homo sapiens
agaaagcaaattatttt

SEQ ID NO: 5174622 - DNA, 15 bp, Homo sapiens
agaaagcaaggactg

SEQ ID NO: 5174623 - DNA, 22 bp, Homo sapiens
agaaagcaatacgtttgtgcag

SEQ ID NO: 5174624 - DNA, 17 bp, Homo sapiens
agaaagcacctgttttt

SEQ ID NO: 5174625 - DNA, 16 bp, Homo sapiens
agaaagcactactgca

SEQ ID NO: 5174626 - DNA, 16 bp, Homo sapiens
agactggttttctgcc

SEQ ID NO: 5174627 - DNA, 14 bp, Homo sapiens
agactgtaaattcc

SEQ ID NO: 5174628 - DNA, 19 bp, Homo sapiens
agactgtaaattccaaaga

SEQ ID NO: 5174629 - DNA, 22 bp, Homo sapiens
agactgtaactttttttcagtt

SEQ ID NO: 5174630 - DNA, 23 bp, Homo sapiens
agactgtaactttttttcagttc

SEQ ID NO: 5174631 - DNA, 21 bp, Homo sapiens
agactgtaagatgttgtttta

SEQ ID NO: 5174632 - DNA, 17 bp, Homo sapiens
agactgtaattaagtaa

SEQ ID NO: 5174633 - DNA, 14 bp, Homo sapiens
agactgtacaaagt

SEQ ID NO: 5174634 - DNA, 12 bp, Homo sapiens
agactgtacata

SEQ ID NO: 5174635 - DNA, 18 bp, Homo sapiens
agactgtacataattgca

SEQ ID NO: 5174636 - DNA, 18 bp, Homo sapiens
agactgtacattatgaag

SEQ ID NO: 5174637 - DNA, 18 bp, Homo sapiens
agactgtagcctggatat

SEQ ID NO: 5174638 - DNA, 15 bp, Homo sapiens
agactgtagcttctc

SEQ ID NO: 5174639 - DNA, 16 bp, Homo sapiens
agactgtagcttctct

SEQ ID NO: 5174640 - DNA, 18 bp, Homo sapiens
agactgtaggattcaagt

SEQ ID NO: 5174641 - DNA, 22 bp, Homo sapiens
agactgtattttcaggaaggta

SEQ ID NO: 5174642 - DNA, 16 bp, Homo sapiens
agactgtcaaatgaac

SEQ ID NO: 5174643 - DNA, 20 bp, Homo sapiens
agactgtcaaatgaactttt

SEQ ID NO: 5174644 - DNA, 21 bp, Homo sapiens
agactgtcagcttccaaacat

SEQ ID NO: 5174645 - DNA, 15 bp, Homo sapiens
agactgtcaggaagt

SEQ ID NO: 5174646 - DNA, 17 bp, Homo sapiens
agactgtcattgcccct

SEQ ID NO: 5174647 - DNA, 16 bp, Homo sapiens
agactgtccacttcta

SEQ ID NO: 5174648 - DNA, 13 bp, Homo sapiens
agactgtccaggg

SEQ ID NO: 5174649 - DNA, 19 bp, Homo sapiens
agactgtcccgacacagcg

SEQ ID NO: 5174650 - DNA, 18 bp, Homo sapiens
agactgtctggcccccct

SEQ ID NO: 5174651 - DNA, 19 bp, Homo sapiens
agactgtgaacagcttgct

SEQ ID NO: 5174652 - DNA, 18 bp, Homo sapiens
agactgtgaacttgactg

SEQ ID NO: 5174653 - DNA, 22 bp, Homo sapiens
agactgtgaggcggcagctggg

SEQ ID NO: 5174654 - DNA, 13 bp, Homo sapiens
agactgtgcaata

SEQ ID NO: 5174655 - DNA, 19 bp, Homo sapiens
agactgtgcaatacttaga

SEQ ID NO: 5174656 - DNA, 11 bp, Homo sapiens
agactgtgcca

SEQ ID NO: 5174657 - DNA, 12 bp, Homo sapiens
agactgtgccat

SEQ ID NO: 5174658 - DNA, 21 bp, Homo sapiens
agactgtgccatggtgagaaa

SEQ ID NO: 5174659 - DNA, 17 bp, Homo sapiens
agactgtgctctctgtg

SEQ ID NO: 5174660 - DNA, 15 bp, Homo sapiens
agactgtgcttggga

SEQ ID NO: 5174661 - DNA, 18 bp, Homo sapiens
agactgtggaaatgccaa

SEQ ID NO: 5174662 - DNA, 16 bp, Homo sapiens
agactgtggaaccaaa

SEQ ID NO: 5174663 - DNA, 19 bp, Homo sapiens
agactgtggagactgctcc

SEQ ID NO: 5174664 - DNA, 21 bp, Homo sapiens
agactgtggagctctgggggg

SEQ ID NO: 5174665 - DNA, 23 bp, Homo sapiens
agactgtggccatatatgctgta

SEQ ID NO: 5174666 - DNA, 11 bp, Homo sapiens
agactgtggct

SEQ ID NO: 5174667 - DNA, 14 bp, Homo sapiens
agactgtggggagg

SEQ ID NO: 5174668 - DNA, 16 bp, Homo sapiens
agactgtggggagggt

SEQ ID NO: 5174669 - DNA, 19 bp, Homo sapiens
agactgtgggtggggaggc

SEQ ID NO: 5174670 - DNA, 22 bp, Homo sapiens
agactgtgggtggggaggccct

SEQ ID NO: 5174671 - DNA, 17 bp, Homo sapiens
agactgtggtaggggca

SEQ ID NO: 5174672 - DNA, 23 bp, Homo sapiens
agactgtggtaggggcagggagg

SEQ ID NO: 5174673 - DNA, 22 bp, Homo sapiens
agactgtgtaaaatgtaatgca

SEQ ID NO: 5174674 - DNA, 13 bp, Homo sapiens
agactgtgtatgt

SEQ ID NO: 5174675 - DNA, 14 bp, Homo sapiens
agactgtgtctgta

SEQ ID NO: 5174676 - DNA, 15 bp, Homo sapiens
agactgtgtctgtat

SEQ ID NO: 5174677 - DNA, 19 bp, Homo sapiens
agactgtgtgtgccctctg

SEQ ID NO: 5174678 - DNA, 22 bp, Homo sapiens
agactgtgtgtgccctctgggc

SEQ ID NO: 5174679 - DNA, 21 bp, Homo sapiens
agactgtgtttggtcctgtag

SEQ ID NO: 5174680 - DNA, 18 bp, Homo sapiens
agactgttccctccaagg

SEQ ID NO: 5174681 - DNA, 23 bp, Homo sapiens
agactgttgctcaaatctattca

SEQ ID NO: 5174682 - DNA, 19 bp, Homo sapiens
agactgttgtccctgcact

SEQ ID NO: 5174683 - DNA, 15 bp, Homo sapiens
agactgttgtgatct

SEQ ID NO: 5174684 - DNA, 20 bp, Homo sapiens
agactgttgtgatcttgcat

SEQ ID NO: 5174685 - DNA, 15 bp, Homo sapiens
agactgtttgaatgt

SEQ ID NO: 5174686 - DNA, 20 bp, Homo sapiens
agactgtttgctgatcccca

SEQ ID NO: 5174687 - DNA, 16 bp, Homo sapiens
agactgttttactgtt

SEQ ID NO: 5174688 - DNA, 19 bp, Homo sapiens
agactgttttactgtttta

SEQ ID NO: 5174689 - DNA, 21 bp, Homo sapiens
agactgttttactgttttaat

SEQ ID NO: 5174690 - DNA, 23 bp, Homo sapiens
agactgttttactgttttaattg

SEQ ID NO: 5174691 - DNA, 18 bp, Homo sapiens
agactgtttttaagtaac

SEQ ID NO: 5174692 - DNA, 22 bp, Homo sapiens
agacttaaaaaatacttgcatg

SEQ ID NO: 5174693 - DNA, 13 bp, Homo sapiens
agacttaaaacat

SEQ ID NO: 5174694 - DNA, 14 bp, Homo sapiens
agacttaaaacatg

SEQ ID NO: 5174695 - DNA, 16 bp, Homo sapiens
agacttaaaacatggt

SEQ ID NO: 5174696 - DNA, 22 bp, Homo sapiens
agacttaaaagagctcagacat

SEQ ID NO: 5174697 - DNA, 21 bp, Homo sapiens
agacttaaagggcccaatgaa

SEQ ID NO: 5174698 - DNA, 15 bp, Homo sapiens
agacttaagattaaa

SEQ ID NO: 5174699 - DNA, 18 bp, Homo sapiens
agacttaagcccagtgca

SEQ ID NO: 5174700 - DNA, 14 bp, Homo sapiens
agacttaatcatat

SEQ ID NO: 5174701 - DNA, 16 bp, Homo sapiens
agacttaatctttgct

SEQ ID NO: 5174702 - DNA, 21 bp, Homo sapiens
agacttaatgagactttaaaa

SEQ ID NO: 5174703 - DNA, 13 bp, Homo sapiens
agacttaattctg

SEQ ID NO: 5174704 - DNA, 15 bp, Homo sapiens
agacttaatttcaaa

SEQ ID NO: 5174705 - DNA, 18 bp, Homo sapiens
agacttacagcaaatcct

SEQ ID NO: 5174706 - DNA, 20 bp, Homo sapiens
agacttacagcaaatccttt

SEQ ID NO: 5174707 - DNA, 23 bp, Homo sapiens
agacttacagggataaggcctgt

SEQ ID NO: 5174708 - DNA, 19 bp, Homo sapiens
agacttacctgaataatta

SEQ ID NO: 5174709 - DNA, 15 bp, Homo sapiens
agacttactaataaa

SEQ ID NO: 5174710 - DNA, 17 bp, Homo sapiens
agacttactaataaaat

SEQ ID NO: 5174711 - DNA, 15 bp, Homo sapiens
agacttactctaaga

SEQ ID NO: 5174712 - DNA, 13 bp, Homo sapiens
agacttactgcat

SEQ ID NO: 5174713 - DNA, 18 bp, Homo sapiens
agacttacttattcttcc

SEQ ID NO: 5174714 - DNA, 19 bp, Homo sapiens
agacttactttactcattt

SEQ ID NO: 5174715 - DNA, 21 bp, Homo sapiens
agacttactttactcattttt

SEQ ID NO: 5174716 - DNA, 15 bp, Homo sapiens
agacttagaacctga

SEQ ID NO: 5174717 - DNA, 13 bp, Homo sapiens
agacttagaagca

SEQ ID NO: 5174718 - DNA, 13 bp, Homo sapiens
agacttagaatag

SEQ ID NO: 5174719 - DNA, 18 bp, Homo sapiens
agacttagatctgagccc

SEQ ID NO: 5174720 - DNA, 15 bp, Homo sapiens
agacttagattcatt

SEQ ID NO: 5174721 - DNA, 17 bp, Homo sapiens
agacttaggccagaggt

SEQ ID NO: 5174722 - DNA, 14 bp, Homo sapiens
agacttagttattt

SEQ ID NO: 5174723 - DNA, 21 bp, Homo sapiens
agacttattcttttataataa

SEQ ID NO: 5174724 - DNA, 17 bp, Homo sapiens
agacttattttcacatg

SEQ ID NO: 5174725 - DNA, 20 bp, Homo sapiens
agacttcaaaatattgagca

SEQ ID NO: 5174726 - DNA, 22 bp, Homo sapiens
agacttcaagcatggctatttt

SEQ ID NO: 5174727 - DNA, 17 bp, Homo sapiens
agacttcaatattaaat

SEQ ID NO: 5174728 - DNA, 19 bp, Homo sapiens
agacttcaatattaaatga

SEQ ID NO: 5174729 - DNA, 16 bp, Homo sapiens
agacttcaatcctgat

SEQ ID NO: 5174730 - DNA, 20 bp, Homo sapiens
agacttcacaattcatggaa

SEQ ID NO: 5174731 - DNA, 18 bp, Homo sapiens
agacttcacagcgtctgc

SEQ ID NO: 5174732 - DNA, 19 bp, Homo sapiens
agacttcacagcgtctgct

SEQ ID NO: 5174733 - DNA, 15 bp, Homo sapiens
agacttcagagagaa

SEQ ID NO: 5174734 - DNA, 16 bp, Homo sapiens
agacttcagagagaat

SEQ ID NO: 5174735 - DNA, 14 bp, Homo sapiens
agacttcagatttc

SEQ ID NO: 5174736 - DNA, 17 bp, Homo sapiens
agacttcagatttcaaa

SEQ ID NO: 5174737 - DNA, 21 bp, Homo sapiens
agacttcagatttcaaattaa

SEQ ID NO: 5174738 - DNA, 13 bp, Homo sapiens
agacttcagtatg

SEQ ID NO: 5174739 - DNA, 17 bp, Homo sapiens
agacttcatttttccta

SEQ ID NO: 5174740 - DNA, 18 bp, Homo sapiens
agacttccagctttctct

SEQ ID NO: 5174741 - DNA, 19 bp, Homo sapiens
agacttcccacggctcctc

SEQ ID NO: 5174742 - DNA, 18 bp, Homo sapiens
agacttcccagcttctgc

SEQ ID NO: 5174743 - DNA, 20 bp, Homo sapiens
agacttccccatcccgaagc

SEQ ID NO: 5174744 - DNA, 14 bp, Homo sapiens
agacttcctagact

SEQ ID NO: 5174745 - DNA, 17 bp, Homo sapiens
agacttcctattaattt

SEQ ID NO: 5174746 - DNA, 17 bp, Homo sapiens
agacttcctctggctcc

SEQ ID NO: 5174747 - DNA, 14 bp, Homo sapiens
agacttccttgaga

SEQ ID NO: 5174748 - DNA, 13 bp, Homo sapiens
agacttcctttat

SEQ ID NO: 5174749 - DNA, 17 bp, Homo sapiens
agacttcgaaaacagat

SEQ ID NO: 5174750 - DNA, 20 bp, Homo sapiens
agacttcgctattcccaggc

SEQ ID NO: 5174751 - DNA, 22 bp, Homo sapiens
agacttcgctattcccaggcag

SEQ ID NO: 5174752 - DNA, 22 bp, Homo sapiens
agacttcggggaagatacactg

SEQ ID NO: 5174753 - DNA, 19 bp, Homo sapiens
agacttctaggaggatgct

SEQ ID NO: 5174754 - DNA, 23 bp, Homo sapiens
agacttctattttttaaagactg

SEQ ID NO: 5174755 - DNA, 20 bp, Homo sapiens
agacttctcaaagagaattg

SEQ ID NO: 5174756 - DNA, 21 bp, Homo sapiens
agacttctcaaagagaattgt

SEQ ID NO: 5174757 - DNA, 13 bp, Homo sapiens
agacttctctgta

SEQ ID NO: 5174758 - DNA, 16 bp, Homo sapiens
agacttctctgtgaac

SEQ ID NO: 5174759 - DNA, 15 bp, Homo sapiens
agacttctcttacat

SEQ ID NO: 5174760 - DNA, 15 bp, Homo sapiens
agacttctctttctt

SEQ ID NO: 5174761 - DNA, 20 bp, Homo sapiens
agacttctctttgcctcaaa

SEQ ID NO: 5174762 - DNA, 12 bp, Homo sapiens
agacttctgctt

SEQ ID NO: 5174763 - DNA, 20 bp, Homo sapiens
agacttctggtgctgctggg

SEQ ID NO: 5174764 - DNA, 20 bp, Homo sapiens
agacttctggttgtatttct

SEQ ID NO: 5174765 - DNA, 15 bp, Homo sapiens
agacttgaaaagaga

SEQ ID NO: 5174766 - DNA, 20 bp, Homo sapiens
agacttgaaaagagacaggc

SEQ ID NO: 5174767 - DNA, 22 bp, Homo sapiens
agacttgaaaagagacaggcag

SEQ ID NO: 5174768 - DNA, 17 bp, Homo sapiens
agacttgaaagaaaggg

SEQ ID NO: 5174769 - DNA, 18 bp, Homo sapiens
agacttgacaacatccca

SEQ ID NO: 5174770 - DNA, 19 bp, Homo sapiens
agacttgacaacatcccac

SEQ ID NO: 5174771 - DNA, 20 bp, Homo sapiens
agacttgacaacatcccaca

SEQ ID NO: 5174772 - DNA, 12 bp, Homo sapiens
agacttgacagt

SEQ ID NO: 5174773 - DNA, 13 bp, Homo sapiens
agacttgacagtg

SEQ ID NO: 5174774 - DNA, 21 bp, Homo sapiens
agacttgagaaatttgaaagg

SEQ ID NO: 5174775 - DNA, 15 bp, Homo sapiens
agacttgagaacttg

SEQ ID NO: 5174776 - DNA, 14 bp, Homo sapiens
agacttgatgaata

SEQ ID NO: 5174777 - DNA, 19 bp, Homo sapiens
agacttgatgaataaacac

SEQ ID NO: 5174778 - DNA, 15 bp, Homo sapiens
agacttgatttacaa

SEQ ID NO: 5174779 - DNA, 12 bp, Homo sapiens
agacttgcactg

SEQ ID NO: 5174780 - DNA, 16 bp, Homo sapiens
agacttgcactgaagc

SEQ ID NO: 5174781 - DNA, 14 bp, Homo sapiens
agacttgccaggct

SEQ ID NO: 5174782 - DNA, 15 bp, Homo sapiens
agacttgccatgtga

SEQ ID NO: 5174783 - DNA, 16 bp, Homo sapiens
agacttgccttcctaa

SEQ ID NO: 5174784 - DNA, 22 bp, Homo sapiens
agacttgccttcctaagcctgt

SEQ ID NO: 5174785 - DNA, 17 bp, Homo sapiens
agacttgctccctctcc

SEQ ID NO: 5174786 - DNA, 18 bp, Homo sapiens
agacttgctccctctcca

SEQ ID NO: 5174787 - DNA, 19 bp, Homo sapiens
agacttgctccctctccaa

SEQ ID NO: 5174788 - DNA, 21 bp, Homo sapiens
agacttgctccctctccaaga

SEQ ID NO: 5174789 - DNA, 13 bp, Homo sapiens
agacttgctctct

SEQ ID NO: 5174790 - DNA, 15 bp, Homo sapiens
agacttgcttcctgc

SEQ ID NO: 5174791 - DNA, 16 bp, Homo sapiens
agacttgcttcctgca

SEQ ID NO: 5174792 - DNA, 18 bp, Homo sapiens
agacttggaagaggagga

SEQ ID NO: 5174793 - DNA, 19 bp, Homo sapiens
agacttggacatctctctg

SEQ ID NO: 5174794 - DNA, 21 bp, Homo sapiens
agacttggacatctctctggc

SEQ ID NO: 5174795 - DNA, 22 bp, Homo sapiens
agacttggagaatactgccaaa

SEQ ID NO: 5174796 - DNA, 17 bp, Homo sapiens
agacttggagctgtcct

SEQ ID NO: 5174797 - DNA, 14 bp, Homo sapiens
agacttggatgagg

SEQ ID NO: 5174798 - DNA, 20 bp, Homo sapiens
agacttgggagctttaaaga

SEQ ID NO: 5174799 - DNA, 20 bp, Homo sapiens
agacttgggatggggaggga

SEQ ID NO: 5174800 - DNA, 21 bp, Homo sapiens
agacttgggttgatctcttag

SEQ ID NO: 5174801 - DNA, 19 bp, Homo sapiens
agacttggtggtctgagct

SEQ ID NO: 5174802 - DNA, 21 bp, Homo sapiens
agacttgtatattctatttta

SEQ ID NO: 5174803 - DNA, 22 bp, Homo sapiens
agacttgtcaagcctgtgcaaa

SEQ ID NO: 5174804 - DNA, 19 bp, Homo sapiens
agaaagcacttaaacagaa

SEQ ID NO: 5174805 - DNA, 18 bp, Homo sapiens
agaaagcagaaagttcaa

SEQ ID NO: 5174806 - DNA, 14 bp, Homo sapiens
agaaagcagttctg

SEQ ID NO: 5174807 - DNA, 17 bp, Homo sapiens
agaaagcatatcccacc

SEQ ID NO: 5174808 - DNA, 17 bp, Homo sapiens
agaaagcatccctcacc

SEQ ID NO: 5174809 - DNA, 21 bp, Homo sapiens
agaaagcatctattcccaaag

SEQ ID NO: 5174810 - DNA, 14 bp, Homo sapiens
agaaagcatttgaa

SEQ ID NO: 5174811 - DNA, 15 bp, Homo sapiens
agaaagcatttgaat

SEQ ID NO: 5174812 - DNA, 16 bp, Homo sapiens
agaaagcatttgaatg

SEQ ID NO: 5174813 - DNA, 22 bp, Homo sapiens
agaaagcatttgaatgcatttt

SEQ ID NO: 5174814 - DNA, 17 bp, Homo sapiens
agaaagccaagggcagt

SEQ ID NO: 5174815 - DNA, 13 bp, Homo sapiens
agaaagccacgcc

SEQ ID NO: 5174816 - DNA, 14 bp, Homo sapiens
agaaagccacgccc

SEQ ID NO: 5174817 - DNA, 18 bp, Homo sapiens
agaaagccacgccctccc

SEQ ID NO: 5174818 - DNA, 20 bp, Homo sapiens
agaaagccacgccctccctg

SEQ ID NO: 5174819 - DNA, 23 bp, Homo sapiens
agaaagccacgccctccctgcta

SEQ ID NO: 5174820 - DNA, 14 bp, Homo sapiens
agaaagccagacaa

SEQ ID NO: 5174821 - DNA, 20 bp, Homo sapiens
agaaagccaggagcagccct

SEQ ID NO: 5174822 - DNA, 20 bp, Homo sapiens
agaaagccagtcttaacatt

SEQ ID NO: 5174823 - DNA, 22 bp, Homo sapiens
agaaagccatattccagcagtg

SEQ ID NO: 5174824 - DNA, 17 bp, Homo sapiens
agaaagccatatttttt

SEQ ID NO: 5174825 - DNA, 14 bp, Homo sapiens
agaaagcccacctg

SEQ ID NO: 5174826 - DNA, 20 bp, Homo sapiens
agaaagcccacctgggctgg

SEQ ID NO: 5174827 - DNA, 17 bp, Homo sapiens
agaaagccccacccagg

SEQ ID NO: 5174828 - DNA, 15 bp, Homo sapiens
agaaagccgggggag

SEQ ID NO: 5174829 - DNA, 22 bp, Homo sapiens
agaaagccgggggaggggccct

SEQ ID NO: 5174830 - DNA, 23 bp, Homo sapiens
agaaagccgggggaggggccctc

SEQ ID NO: 5174831 - DNA, 18 bp, Homo sapiens
agaaagccgtactgtcta

SEQ ID NO: 5174832 - DNA, 19 bp, Homo sapiens
agaaagcctcctctggaga

SEQ ID NO: 5174833 - DNA, 16 bp, Homo sapiens
agaaagcctcctgccc

SEQ ID NO: 5174834 - DNA, 23 bp, Homo sapiens
agaaagcctcctgccccctgcca

SEQ ID NO: 5174835 - DNA, 12 bp, Homo sapiens
agaaagcctgag

SEQ ID NO: 5174836 - DNA, 19 bp, Homo sapiens
agaaagcctgggtgacatt

SEQ ID NO: 5174837 - DNA, 20 bp, Homo sapiens
agaaagcctgggtgacattt

SEQ ID NO: 5174838 - DNA, 13 bp, Homo sapiens
agaaagccttctt

SEQ ID NO: 5174839 - DNA, 14 bp, Homo sapiens
agaaagctaaagtg

SEQ ID NO: 5174840 - DNA, 12 bp, Homo sapiens
agaaagctaaat

SEQ ID NO: 5174841 - DNA, 13 bp, Homo sapiens
agaaagctaaatg

SEQ ID NO: 5174842 - DNA, 17 bp, Homo sapiens
agaaagctaaatgaatc

SEQ ID NO: 5174843 - DNA, 16 bp, Homo sapiens
agaaagctaatacaaa

SEQ ID NO: 5174844 - DNA, 22 bp, Homo sapiens
agaaagctaatacaaaactatc

SEQ ID NO: 5174845 - DNA, 19 bp, Homo sapiens
agaaagctaatactaatag

SEQ ID NO: 5174846 - DNA, 19 bp, Homo sapiens
agaaagctagatatgcctt

SEQ ID NO: 5174847 - DNA, 20 bp, Homo sapiens
agaaagctagatatgcctta

SEQ ID NO: 5174848 - DNA, 21 bp, Homo sapiens
agaaagctattccaagactca

SEQ ID NO: 5174849 - DNA, 14 bp, Homo sapiens
agaaagctgacatt

SEQ ID NO: 5174850 - DNA, 16 bp, Homo sapiens
agaaagctgacttggc

SEQ ID NO: 5174851 - DNA, 11 bp, Homo sapiens
agaaagctgcc

SEQ ID NO: 5174852 - DNA, 20 bp, Homo sapiens
agaaagctgccagagccggc

SEQ ID NO: 5174853 - DNA, 16 bp, Homo sapiens
agaaagctggactgac

SEQ ID NO: 5174854 - DNA, 13 bp, Homo sapiens
agaaagctgtgaa

SEQ ID NO: 5174855 - DNA, 14 bp, Homo sapiens
agaaagctgtgaaa

SEQ ID NO: 5174856 - DNA, 16 bp, Homo sapiens
agaaagctgtgaaatt

SEQ ID NO: 5174857 - DNA, 15 bp, Homo sapiens
agaaagcttcatcca

SEQ ID NO: 5174858 - DNA, 17 bp, Homo sapiens
agaaagcttttattcct

SEQ ID NO: 5174859 - DNA, 20 bp, Homo sapiens
agaaaggaaaacctgaagac

SEQ ID NO: 5174860 - DNA, 21 bp, Homo sapiens
agaaaggaaaccttttcttgt

SEQ ID NO: 5174861 - DNA, 22 bp, Homo sapiens
agaaaggaaagccagaaggaaa

SEQ ID NO: 5174862 - DNA, 11 bp, Homo sapiens
agaaaggaaat

SEQ ID NO: 5174863 - DNA, 14 bp, Homo sapiens
agaaaggaacattt

SEQ ID NO: 5174864 - DNA, 15 bp, Homo sapiens
agaaaggaagcattg

SEQ ID NO: 5174865 - DNA, 19 bp, Homo sapiens
agaaaggaagcattgtaaa

SEQ ID NO: 5174866 - DNA, 11 bp, Homo sapiens
agaaaggaagt

SEQ ID NO: 5174867 - DNA, 18 bp, Homo sapiens
agaaaggactaacatctc

SEQ ID NO: 5174868 - DNA, 15 bp, Homo sapiens
agaaaggactctggg

SEQ ID NO: 5174869 - DNA, 13 bp, Homo sapiens
agaaaggagagac

SEQ ID NO: 5174870 - DNA, 18 bp, Homo sapiens
agaaaggagagtcttgca

SEQ ID NO: 5174871 - DNA, 19 bp, Homo sapiens
agaaaggagagtcttgcag

SEQ ID NO: 5174872 - DNA, 12 bp, Homo sapiens
agaaaggagggg

SEQ ID NO: 5174873 - DNA, 20 bp, Homo sapiens
agaaaggaggggatagagag

SEQ ID NO: 5174874 - DNA, 15 bp, Homo sapiens
agaaaggagtagttt

SEQ ID NO: 5174875 - DNA, 21 bp, Homo sapiens
agaaaggatttcctttctttt

SEQ ID NO: 5174876 - DNA, 18 bp, Homo sapiens
agaaaggcaaagtacatt

SEQ ID NO: 5174877 - DNA, 21 bp, Homo sapiens
agaaaggcaaagtacattgta

SEQ ID NO: 5174878 - DNA, 16 bp, Homo sapiens
agaaaggcaaatctga

SEQ ID NO: 5174879 - DNA, 19 bp, Homo sapiens
agaaaggcaagagctcaag

SEQ ID NO: 5174880 - DNA, 14 bp, Homo sapiens
agaaaggcagccct

SEQ ID NO: 5174881 - DNA, 22 bp, Homo sapiens
agaaaggcaggtttcatttctt

SEQ ID NO: 5174882 - DNA, 14 bp, Homo sapiens
agaaaggcctctgt

SEQ ID NO: 5174883 - DNA, 17 bp, Homo sapiens
agaaaggcctgcacaca

SEQ ID NO: 5174884 - DNA, 17 bp, Homo sapiens
agaaaggcctttaaaat

SEQ ID NO: 5174885 - DNA, 15 bp, Homo sapiens
agaaaggctaacaaa

SEQ ID NO: 5174886 - DNA, 22 bp, Homo sapiens
agaaaggctaacaaattttaag

SEQ ID NO: 5174887 - DNA, 23 bp, Homo sapiens
agaaaggctaacaaattttaagt

SEQ ID NO: 5174888 - DNA, 14 bp, Homo sapiens
agaaaggctctgaa

SEQ ID NO: 5174889 - DNA, 11 bp, Homo sapiens
agaaaggctgc

SEQ ID NO: 5174890 - DNA, 15 bp, Homo sapiens
agaaaggctgctgta

SEQ ID NO: 5174891 - DNA, 24 bp, Homo sapiens
agaaaggcttccagatgtctaaaa

SEQ ID NO: 5174892 - DNA, 19 bp, Homo sapiens
agaaagggaaactggctga

SEQ ID NO: 5174893 - DNA, 17 bp, Homo sapiens
agaaagggacccacctg

SEQ ID NO: 5174894 - DNA, 19 bp, Homo sapiens
agaaagggacccacctgct

SEQ ID NO: 5174895 - DNA, 19 bp, Homo sapiens
agaaagggagaaggattct

SEQ ID NO: 5174896 - DNA, 19 bp, Homo sapiens
agaaagggagaggaagaga

SEQ ID NO: 5174897 - DNA, 20 bp, Homo sapiens
agaaagggagaggaagagaa

SEQ ID NO: 5174898 - DNA, 17 bp, Homo sapiens
agaaagggaggcccagc

SEQ ID NO: 5174899 - DNA, 16 bp, Homo sapiens
agaaagggagggctct

SEQ ID NO: 5174900 - DNA, 16 bp, Homo sapiens
agaaagggattgctga

SEQ ID NO: 5174901 - DNA, 19 bp, Homo sapiens
agaaagggattgctgaggc

SEQ ID NO: 5174902 - DNA, 18 bp, Homo sapiens
agaaagggcagaggaaga

SEQ ID NO: 5174903 - DNA, 12 bp, Homo sapiens
agaaagggcagc

SEQ ID NO: 5174904 - DNA, 18 bp, Homo sapiens
agaaagggcagcccctcc

SEQ ID NO: 5174905 - DNA, 21 bp, Homo sapiens
agaaagggcagcccctcccca

SEQ ID NO: 5174906 - DNA, 16 bp, Homo sapiens
agaaagggccctgggc

SEQ ID NO: 5174907 - DNA, 20 bp, Homo sapiens
agaaagggccctgggcctgc

SEQ ID NO: 5174908 - DNA, 15 bp, Homo sapiens
agaaaggggagccca

SEQ ID NO: 5174909 - DNA, 21 bp, Homo sapiens
agaaaggggcaggagctcaga

SEQ ID NO: 5174910 - DNA, 18 bp, Homo sapiens
agaaaggggcattttgta

SEQ ID NO: 5174911 - DNA, 19 bp, Homo sapiens
agaaaggtgattccaggag

SEQ ID NO: 5174912 - DNA, 20 bp, Homo sapiens
agaaaggtgattccaggagg

SEQ ID NO: 5174913 - DNA, 20 bp, Homo sapiens
agaaaggtggactggaaggg

SEQ ID NO: 5174914 - DNA, 18 bp, Homo sapiens
agaaaggttgattctcat

SEQ ID NO: 5174915 - DNA, 20 bp, Homo sapiens
agaaaggttgcgtttaatat

SEQ ID NO: 5174916 - DNA, 22 bp, Homo sapiens
agaaagtaaggtgcttggagtt

SEQ ID NO: 5174917 - DNA, 23 bp, Homo sapiens
agaaagtacccagcaaatgggca

SEQ ID NO: 5174918 - DNA, 15 bp, Homo sapiens
agaaagtagaggcat

SEQ ID NO: 5174919 - DNA, 18 bp, Homo sapiens
agaaagtataatttcagt

SEQ ID NO: 5174920 - DNA, 14 bp, Homo sapiens
agaaagtcaccagg

SEQ ID NO: 5174921 - DNA, 17 bp, Homo sapiens
agaaagtcacctgccca

SEQ ID NO: 5174922 - DNA, 20 bp, Homo sapiens
agaaagtcattccttctttt

SEQ ID NO: 5174923 - DNA, 18 bp, Homo sapiens
agaaagtccattgatgtc

SEQ ID NO: 5174924 - DNA, 20 bp, Homo sapiens
agaaagtcgaattaatagct

SEQ ID NO: 5174925 - DNA, 19 bp, Homo sapiens
agaaagtcttatttattca

SEQ ID NO: 5174926 - DNA, 15 bp, Homo sapiens
agaaagtgaagcaaa

SEQ ID NO: 5174927 - DNA, 16 bp, Homo sapiens
agaaagtgaataaaaa

SEQ ID NO: 5174928 - DNA, 20 bp, Homo sapiens
agaaagtgaataaaaattaa

SEQ ID NO: 5174929 - DNA, 13 bp, Homo sapiens
agaaagtgacatt

SEQ ID NO: 5174930 - DNA, 14 bp, Homo sapiens
agaaagtgacattt

SEQ ID NO: 5174931 - DNA, 17 bp, Homo sapiens
agaaagtgataagtgca

SEQ ID NO: 5174932 - DNA, 15 bp, Homo sapiens
agaaagtgcagcatg

SEQ ID NO: 5174933 - DNA, 19 bp, Homo sapiens
agaaagtgcagcatggagg

SEQ ID NO: 5174934 - DNA, 19 bp, Homo sapiens
agaaagtgcctgacacact

SEQ ID NO: 5174935 - DNA, 17 bp, Homo sapiens
agaaagtgcctttcagg

SEQ ID NO: 5174936 - DNA, 18 bp, Homo sapiens
agaaagtgcctttcagga

SEQ ID NO: 5174937 - DNA, 19 bp, Homo sapiens
agaaagtggaaaacaagga

SEQ ID NO: 5174938 - DNA, 23 bp, Homo sapiens
agaaagtggaaaacaaggaagtc

SEQ ID NO: 5174939 - DNA, 19 bp, Homo sapiens
agaaagtgggacctggtgg

SEQ ID NO: 5174940 - DNA, 19 bp, Homo sapiens
agaaagtgggggtggagga

SEQ ID NO: 5174941 - DNA, 20 bp, Homo sapiens
agaaagtgggggtggaggac

SEQ ID NO: 5174942 - DNA, 13 bp, Homo sapiens
agaaagtgtaaat

SEQ ID NO: 5174943 - DNA, 16 bp, Homo sapiens
agaaagtgtatttgga

SEQ ID NO: 5174944 - DNA, 17 bp, Homo sapiens
agaaagtgtgtgtgttc

SEQ ID NO: 5174945 - DNA, 20 bp, Homo sapiens
agaaagtgtgtgtgttctgt

SEQ ID NO: 5174946 - DNA, 18 bp, Homo sapiens
agaaagtgttaaaactga

SEQ ID NO: 5174947 - DNA, 18 bp, Homo sapiens
agaaagtgttctgttaca

SEQ ID NO: 5174948 - DNA, 20 bp, Homo sapiens
agaaagtgttctgttacaaa

SEQ ID NO: 5174949 - DNA, 15 bp, Homo sapiens
agaaagtgttttatt

SEQ ID NO: 5174950 - DNA, 24 bp, Homo sapiens
agaaagtgttttattttcaaatct

SEQ ID NO: 5174951 - DNA, 22 bp, Homo sapiens
agaaagttagggggttcttatt

SEQ ID NO: 5174952 - DNA, 22 bp, Homo sapiens
agaaagttattgtgttgcctta

SEQ ID NO: 5174953 - DNA, 13 bp, Homo sapiens
agaaagtttagaa

SEQ ID NO: 5174954 - DNA, 21 bp, Homo sapiens
agaaagtttgtaaaaatatac

SEQ ID NO: 5174955 - DNA, 22 bp, Homo sapiens
agaaataaaaatcaacttgtgt

SEQ ID NO: 5174956 - DNA, 14 bp, Homo sapiens
agaaataaaactgt

SEQ ID NO: 5174957 - DNA, 16 bp, Homo sapiens
agaaataaaagtatga

SEQ ID NO: 5174958 - DNA, 22 bp, Homo sapiens
agaaataaaatatctccaaatg

SEQ ID NO: 5174959 - DNA, 14 bp, Homo sapiens
agaaataaacctta

SEQ ID NO: 5174960 - DNA, 16 bp, Homo sapiens
agaaataaaccttaat

SEQ ID NO: 5174961 - DNA, 17 bp, Homo sapiens
agaaataaaccttaata

SEQ ID NO: 5174962 - DNA, 11 bp, Homo sapiens
agaaataaact

SEQ ID NO: 5174963 - DNA, 21 bp, Homo sapiens
agaaataaacttattcctcct

SEQ ID NO: 5174964 - DNA, 22 bp, Homo sapiens
agaaataaatagctatatccat

SEQ ID NO: 5174965 - DNA, 16 bp, Homo sapiens
agaaataaatctatat

SEQ ID NO: 5174966 - DNA, 17 bp, Homo sapiens
agaaataaatgaaactt

SEQ ID NO: 5174967 - DNA, 13 bp, Homo sapiens
agaaataaatgtt

SEQ ID NO: 5174968 - DNA, 11 bp, Homo sapiens
agaaataaatt

SEQ ID NO: 5174969 - DNA, 17 bp, Homo sapiens
agaaataaatttatttc

SEQ ID NO: 5174970 - DNA, 15 bp, Homo sapiens
agaaataagtatcca

SEQ ID NO: 5174971 - DNA, 15 bp, Homo sapiens
agaaataatatgcat

SEQ ID NO: 5174972 - DNA, 19 bp, Homo sapiens
agaaataatccctgtaata

SEQ ID NO: 5174973 - DNA, 20 bp, Homo sapiens
agaaataatgctacaatttt

SEQ ID NO: 5174974 - DNA, 19 bp, Homo sapiens
agaaataatgtcaaaaata

SEQ ID NO: 5174975 - DNA, 13 bp, Homo sapiens
agaaataattgtt

SEQ ID NO: 5174976 - DNA, 18 bp, Homo sapiens
agaaataatttttcttac

SEQ ID NO: 5174977 - DNA, 22 bp, Homo sapiens
agaaatacagaagaaaataata

SEQ ID NO: 5174978 - DNA, 16 bp, Homo sapiens
agaaatacagattttg

SEQ ID NO: 5174979 - DNA, 14 bp, Homo sapiens
agaaatacagctgg

SEQ ID NO: 5174980 - DNA, 16 bp, Homo sapiens
agaaatacagctggct

SEQ ID NO: 5174981 - DNA, 20 bp, Homo sapiens
agaaatacatgttgtaaatg

SEQ ID NO: 5174982 - DNA, 16 bp, Homo sapiens
agacttgtgcatccct

SEQ ID NO: 5174983 - DNA, 17 bp, Homo sapiens
agacttgttctcagagc

SEQ ID NO: 5174984 - DNA, 20 bp, Homo sapiens
agacttgttcttggttcctg

SEQ ID NO: 5174985 - DNA, 16 bp, Homo sapiens
agacttgttggcgtag

SEQ ID NO: 5174986 - DNA, 13 bp, Homo sapiens
agacttgtttcct

SEQ ID NO: 5174987 - DNA, 14 bp, Homo sapiens
agacttgtttcctg

SEQ ID NO: 5174988 - DNA, 17 bp, Homo sapiens
agacttgtttcctgtgc

SEQ ID NO: 5174989 - DNA, 19 bp, Homo sapiens
agacttgtttcctgtgccc

SEQ ID NO: 5174990 - DNA, 18 bp, Homo sapiens
agactttaaaagatgaaa

SEQ ID NO: 5174991 - DNA, 14 bp, Homo sapiens
agactttaaaagca

SEQ ID NO: 5174992 - DNA, 12 bp, Homo sapiens
agactttaacat

SEQ ID NO: 5174993 - DNA, 17 bp, Homo sapiens
agactttaacataagct

SEQ ID NO: 5174994 - DNA, 23 bp, Homo sapiens
agactttaatcccggtttcagaa

SEQ ID NO: 5174995 - DNA, 20 bp, Homo sapiens
agactttacatgacacagct

SEQ ID NO: 5174996 - DNA, 17 bp, Homo sapiens
agactttagaaataaat

SEQ ID NO: 5174997 - DNA, 17 bp, Homo sapiens
agactttagctttctga

SEQ ID NO: 5174998 - DNA, 15 bp, Homo sapiens
agactttagtagttt

SEQ ID NO: 5174999 - DNA, 21 bp, Homo sapiens
agactttagtgccctgccccc

SEQ ID NO: 5175000 - DNA, 16 bp, Homo sapiens
agactttataattcct

SEQ ID NO: 5175001 - DNA, 16 bp, Homo sapiens
agactttatgtagttt

SEQ ID NO: 5175002 - DNA, 15 bp, Homo sapiens
agactttcacaccat

SEQ ID NO: 5175003 - DNA, 18 bp, Homo sapiens
agactttcccaaatgtat

SEQ ID NO: 5175004 - DNA, 18 bp, Homo sapiens
agactttccccatactct

SEQ ID NO: 5175005 - DNA, 16 bp, Homo sapiens
agactttcccctctcg

SEQ ID NO: 5175006 - DNA, 19 bp, Homo sapiens
agactttctacatgcaaat

SEQ ID NO: 5175007 - DNA, 17 bp, Homo sapiens
agactttctattaatat

SEQ ID NO: 5175008 - DNA, 14 bp, Homo sapiens
agactttctcagtg

SEQ ID NO: 5175009 - DNA, 13 bp, Homo sapiens
agactttctcctg

SEQ ID NO: 5175010 - DNA, 17 bp, Homo sapiens
agactttctgaaaacac

SEQ ID NO: 5175011 - DNA, 21 bp, Homo sapiens
agactttctttaaattatgtt

SEQ ID NO: 5175012 - DNA, 16 bp, Homo sapiens
agactttctttttcta

SEQ ID NO: 5175013 - DNA, 18 bp, Homo sapiens
agactttctttttctaca

SEQ ID NO: 5175014 - DNA, 19 bp, Homo sapiens
agactttctttttctacat

SEQ ID NO: 5175015 - DNA, 18 bp, Homo sapiens
agactttgatactaccag

SEQ ID NO: 5175016 - DNA, 17 bp, Homo sapiens
agactttgatccttgga

SEQ ID NO: 5175017 - DNA, 13 bp, Homo sapiens
agactttgatgtc

SEQ ID NO: 5175018 - DNA, 16 bp, Homo sapiens
agactttgctgcattt

SEQ ID NO: 5175019 - DNA, 23 bp, Homo sapiens
agactttgctgcattttacacat

SEQ ID NO: 5175020 - DNA, 14 bp, Homo sapiens
agactttggaaaat

SEQ ID NO: 5175021 - DNA, 21 bp, Homo sapiens
agactttggaaaatgcattgt

SEQ ID NO: 5175022 - DNA, 14 bp, Homo sapiens
agactttggaaaga

SEQ ID NO: 5175023 - DNA, 20 bp, Homo sapiens
agactttggacagtggcctc

SEQ ID NO: 5175024 - DNA, 17 bp, Homo sapiens
agactttggttatttta

SEQ ID NO: 5175025 - DNA, 23 bp, Homo sapiens
agactttggttattttacttttt

SEQ ID NO: 5175026 - DNA, 20 bp, Homo sapiens
agactttgtgactgtcactt

SEQ ID NO: 5175027 - DNA, 19 bp, Homo sapiens
agactttgtttttaaaatg

SEQ ID NO: 5175028 - DNA, 15 bp, Homo sapiens
agacttttatgtgag

SEQ ID NO: 5175029 - DNA, 16 bp, Homo sapiens
agacttttatgtgaga

SEQ ID NO: 5175030 - DNA, 17 bp, Homo sapiens
agacttttatgtgagat

SEQ ID NO: 5175031 - DNA, 18 bp, Homo sapiens
agacttttatgtgagatt

SEQ ID NO: 5175032 - DNA, 23 bp, Homo sapiens
agacttttatgtgagatttcctt

SEQ ID NO: 5175033 - DNA, 19 bp, Homo sapiens
agacttttccaatatgtga

SEQ ID NO: 5175034 - DNA, 21 bp, Homo sapiens
agacttttctttgcgatgtcc

SEQ ID NO: 5175035 - DNA, 23 bp, Homo sapiens
agacttttgcttaccttttccta

SEQ ID NO: 5175036 - DNA, 21 bp, Homo sapiens
agactttttaaattcctgctt

SEQ ID NO: 5175037 - DNA, 12 bp, Homo sapiens
agactttttggt

SEQ ID NO: 5175038 - DNA, 19 bp, Homo sapiens
agactttttggtggatgta

SEQ ID NO: 5175039 - DNA, 15 bp, Homo sapiens
agacttttttctagt

SEQ ID NO: 5175040 - DNA, 18 bp, Homo sapiens
agagaaaaaaaaaatagt

SEQ ID NO: 5175041 - DNA, 16 bp, Homo sapiens
agagaaaaaaaaacac

SEQ ID NO: 5175042 - DNA, 16 bp, Homo sapiens
agagaaaaaaaaatat

SEQ ID NO: 5175043 - DNA, 20 bp, Homo sapiens
agagaaaaaaaaatatgtgt

SEQ ID NO: 5175044 - DNA, 17 bp, Homo sapiens
agagaaaaaagaagtgt

SEQ ID NO: 5175045 - DNA, 10 bp, Homo sapiens
agagaaaaac

SEQ ID NO: 5175046 - DNA, 20 bp, Homo sapiens
agagaaaaagaaagaactgt

SEQ ID NO: 5175047 - DNA, 14 bp, Homo sapiens
agagaaaaagaaat

SEQ ID NO: 5175048 - DNA, 20 bp, Homo sapiens
agagaaaaagaaatgcaaaa

SEQ ID NO: 5175049 - DNA, 14 bp, Homo sapiens
agagaaaaagagag

SEQ ID NO: 5175050 - DNA, 20 bp, Homo sapiens
agagaaaaagcagaggccaa

SEQ ID NO: 5175051 - DNA, 13 bp, Homo sapiens
agagaaaacactt

SEQ ID NO: 5175052 - DNA, 13 bp, Homo sapiens
agagaaaagaaaa

SEQ ID NO: 5175053 - DNA, 19 bp, Homo sapiens
agagaaaagattaaaatta

SEQ ID NO: 5175054 - DNA, 22 bp, Homo sapiens
agagaaaagattaaaattagtg

SEQ ID NO: 5175055 - DNA, 16 bp, Homo sapiens
agagaaaagggaaaaa

SEQ ID NO: 5175056 - DNA, 18 bp, Homo sapiens
agagaaaataaaaagtta

SEQ ID NO: 5175057 - DNA, 17 bp, Homo sapiens
agagaaaataaattcca

SEQ ID NO: 5175058 - DNA, 23 bp, Homo sapiens
agagaaaataaatttaactttaa

SEQ ID NO: 5175059 - DNA, 15 bp, Homo sapiens
agagaaaatatatgt

SEQ ID NO: 5175060 - DNA, 19 bp, Homo sapiens
agagaaaatatatgtattt

SEQ ID NO: 5175061 - DNA, 23 bp, Homo sapiens
agagaaaatatatgtatttttat

SEQ ID NO: 5175062 - DNA, 17 bp, Homo sapiens
agagaaaatattactta

SEQ ID NO: 5175063 - DNA, 18 bp, Homo sapiens
agagaaaatattacttat

SEQ ID NO: 5175064 - DNA, 18 bp, Homo sapiens
agagaaaatgagaaagga

SEQ ID NO: 5175065 - DNA, 16 bp, Homo sapiens
agagaaaatgctgcct

SEQ ID NO: 5175066 - DNA, 16 bp, Homo sapiens
agagaaaatgctttct

SEQ ID NO: 5175067 - DNA, 19 bp, Homo sapiens
agagaaaatgctttctcat

SEQ ID NO: 5175068 - DNA, 20 bp, Homo sapiens
agagaaaatgtaaaggaggg

SEQ ID NO: 5175069 - DNA, 16 bp, Homo sapiens
agagaaaattgaattt

SEQ ID NO: 5175070 - DNA, 21 bp, Homo sapiens
agagaaaattgaatttaacaa

SEQ ID NO: 5175071 - DNA, 14 bp, Homo sapiens
agagaaaattgaga

SEQ ID NO: 5175072 - DNA, 15 bp, Homo sapiens
agagaaacaaacttt

SEQ ID NO: 5175073 - DNA, 13 bp, Homo sapiens
agagaaacagaca

SEQ ID NO: 5175074 - DNA, 18 bp, Homo sapiens
agagaaacatttatggaa

SEQ ID NO: 5175075 - DNA, 21 bp, Homo sapiens
agagaaacatttggaaaagac

SEQ ID NO: 5175076 - DNA, 12 bp, Homo sapiens
agagaaaccagc

SEQ ID NO: 5175077 - DNA, 18 bp, Homo sapiens
agagaaaccagcttcctt

SEQ ID NO: 5175078 - DNA, 21 bp, Homo sapiens
agagaaacctgccaaggagca

SEQ ID NO: 5175079 - DNA, 19 bp, Homo sapiens
agagaaactacccaggtat

SEQ ID NO: 5175080 - DNA, 12 bp, Homo sapiens
agagaaacttta

SEQ ID NO: 5175081 - DNA, 17 bp, Homo sapiens
agagaaagaaaaggcaa

SEQ ID NO: 5175082 - DNA, 15 bp, Homo sapiens
agagaaagaaaatga

SEQ ID NO: 5175083 - DNA, 16 bp, Homo sapiens
agagaaagaagagaca

SEQ ID NO: 5175084 - DNA, 17 bp, Homo sapiens
agagaaagaagagacag

SEQ ID NO: 5175085 - DNA, 18 bp, Homo sapiens
agagaaagaatgagaaag

SEQ ID NO: 5175086 - DNA, 12 bp, Homo sapiens
agagaaagagaa

SEQ ID NO: 5175087 - DNA, 16 bp, Homo sapiens
agagaaagagagaagc

SEQ ID NO: 5175088 - DNA, 20 bp, Homo sapiens
agagaaagagagaagccagc

SEQ ID NO: 5175089 - DNA, 15 bp, Homo sapiens
agagaaagagagaga

SEQ ID NO: 5175090 - DNA, 15 bp, Homo sapiens
agagaaagcacaatt

SEQ ID NO: 5175091 - DNA, 17 bp, Homo sapiens
agagaaagccaggcagg

SEQ ID NO: 5175092 - DNA, 19 bp, Homo sapiens
agagaaagccaggcaggta

SEQ ID NO: 5175093 - DNA, 19 bp, Homo sapiens
agagaaagtgatttctaga

SEQ ID NO: 5175094 - DNA, 18 bp, Homo sapiens
agagaaagtgggacctgg

SEQ ID NO: 5175095 - DNA, 24 bp, Homo sapiens
agagaaagtgggtgagatgctgga

SEQ ID NO: 5175096 - DNA, 23 bp, Homo sapiens
agagaaataagtgccctctccca

SEQ ID NO: 5175097 - DNA, 21 bp, Homo sapiens
agagaaatacagctggctatc

SEQ ID NO: 5175098 - DNA, 18 bp, Homo sapiens
agagaaatattttaattt

SEQ ID NO: 5175099 - DNA, 14 bp, Homo sapiens
agagaaatcacagg

SEQ ID NO: 5175100 - DNA, 19 bp, Homo sapiens
agagaaatcagaaaaatta

SEQ ID NO: 5175101 - DNA, 18 bp, Homo sapiens
agagaaatcagctgctat

SEQ ID NO: 5175102 - DNA, 12 bp, Homo sapiens
agagaaatcctt

SEQ ID NO: 5175103 - DNA, 14 bp, Homo sapiens
agagaaatctgaaa

SEQ ID NO: 5175104 - DNA, 16 bp, Homo sapiens
agagaaatgaagttta

SEQ ID NO: 5175105 - DNA, 16 bp, Homo sapiens
agagaaatgatgtgaa

SEQ ID NO: 5175106 - DNA, 14 bp, Homo sapiens
agagaaatgcccca

SEQ ID NO: 5175107 - DNA, 16 bp, Homo sapiens
agagaaatgccccagt

SEQ ID NO: 5175108 - DNA, 15 bp, Homo sapiens
agagaaatgtgaagg

SEQ ID NO: 5175109 - DNA, 18 bp, Homo sapiens
agagaaattctgttaaaa

SEQ ID NO: 5175110 - DNA, 22 bp, Homo sapiens
agagaaatttttatttttgaac

SEQ ID NO: 5175111 - DNA, 15 bp, Homo sapiens
agagaacaacaggca

SEQ ID NO: 5175112 - DNA, 13 bp, Homo sapiens
agagaacaatcac

SEQ ID NO: 5175113 - DNA, 21 bp, Homo sapiens
agagaacaatcactattctta

SEQ ID NO: 5175114 - DNA, 21 bp, Homo sapiens
agagaacacagggctgcatcc

SEQ ID NO: 5175115 - DNA, 23 bp, Homo sapiens
agagaacactggacaacatttta

SEQ ID NO: 5175116 - DNA, 21 bp, Homo sapiens
agagaacatcccgcttctgaa

SEQ ID NO: 5175117 - DNA, 15 bp, Homo sapiens
agagaacattttact

SEQ ID NO: 5175118 - DNA, 16 bp, Homo sapiens
agagaacattttactg

SEQ ID NO: 5175119 - DNA, 14 bp, Homo sapiens
agagaaccaggagg

SEQ ID NO: 5175120 - DNA, 13 bp, Homo sapiens
agagaaccaggct

SEQ ID NO: 5175121 - DNA, 17 bp, Homo sapiens
agagaaccatgtgctac

SEQ ID NO: 5175122 - DNA, 15 bp, Homo sapiens
agagaacccagccca

SEQ ID NO: 5175123 - DNA, 18 bp, Homo sapiens
agagaacccagcccaccc

SEQ ID NO: 5175124 - DNA, 17 bp, Homo sapiens
agagaaccgagcaaaga

SEQ ID NO: 5175125 - DNA, 20 bp, Homo sapiens
agagaaccgagcaaagatca

SEQ ID NO: 5175126 - DNA, 13 bp, Homo sapiens
agagaacctcaaa

SEQ ID NO: 5175127 - DNA, 15 bp, Homo sapiens
agagaacctcaaact

SEQ ID NO: 5175128 - DNA, 23 bp, Homo sapiens
agagaacctcaaactaggaggaa

SEQ ID NO: 5175129 - DNA, 20 bp, Homo sapiens
agagaacctcacgcacctcc

SEQ ID NO: 5175130 - DNA, 20 bp, Homo sapiens
agagaacctcagattcttca

SEQ ID NO: 5175131 - DNA, 20 bp, Homo sapiens
agagaacctggagttcctga

SEQ ID NO: 5175132 - DNA, 17 bp, Homo sapiens
agagaacctgtgggctg

SEQ ID NO: 5175133 - DNA, 15 bp, Homo sapiens
agagaacgcagccct

SEQ ID NO: 5175134 - DNA, 18 bp, Homo sapiens
agagaactactaaggaaa

SEQ ID NO: 5175135 - DNA, 14 bp, Homo sapiens
agagaactattgtt

SEQ ID NO: 5175136 - DNA, 15 bp, Homo sapiens
agagaactgaaaaga

SEQ ID NO: 5175137 - DNA, 13 bp, Homo sapiens
agagaactgacat

SEQ ID NO: 5175138 - DNA, 13 bp, Homo sapiens
agagaactgagca

SEQ ID NO: 5175139 - DNA, 17 bp, Homo sapiens
agagaactgagcatctc

SEQ ID NO: 5175140 - DNA, 20 bp, Homo sapiens
agagaactggaggaaccaca

SEQ ID NO: 5175141 - DNA, 17 bp, Homo sapiens
agagaactgtcaccctg

SEQ ID NO: 5175142 - DNA, 21 bp, Homo sapiens
agagaactttattttggattg

SEQ ID NO: 5175143 - DNA, 23 bp, Homo sapiens
agagaactttttgttaacagaca

SEQ ID NO: 5175144 - DNA, 12 bp, Homo sapiens
agagaagaaaga

SEQ ID NO: 5175145 - DNA, 13 bp, Homo sapiens
agagaagaaagaa

SEQ ID NO: 5175146 - DNA, 15 bp, Homo sapiens
agagaagaaagtgaa

SEQ ID NO: 5175147 - DNA, 14 bp, Homo sapiens
agagaagaaagtgt

SEQ ID NO: 5175148 - DNA, 19 bp, Homo sapiens
agagaagaaatagcagagc

SEQ ID NO: 5175149 - DNA, 22 bp, Homo sapiens
agagaagaaatgttataaagta

SEQ ID NO: 5175150 - DNA, 11 bp, Homo sapiens
agagaagaaga

SEQ ID NO: 5175151 - DNA, 12 bp, Homo sapiens
agagaagaagaa

SEQ ID NO: 5175152 - DNA, 12 bp, Homo sapiens
agagaagaatga

SEQ ID NO: 5175153 - DNA, 14 bp, Homo sapiens
agagaagacaaaac

SEQ ID NO: 5175154 - DNA, 10 bp, Homo sapiens
agagaagaga

SEQ ID NO: 5175155 - DNA, 17 bp, Homo sapiens
agagaagagaaaggaca

SEQ ID NO: 5175156 - DNA, 13 bp, Homo sapiens
agagaagagcccc

SEQ ID NO: 5175157 - DNA, 16 bp, Homo sapiens
agagaagagccccact

SEQ ID NO: 5175158 - DNA, 23 bp, Homo sapiens
agagaagaggacttttttgatta

SEQ ID NO: 5175159 - DNA, 19 bp, Homo sapiens
agagaagagggcccagccc

SEQ ID NO: 5175160 - DNA, 21 bp, Homo sapiens
agagaagagggcccagcccag

SEQ ID NO: 5175161 - DNA, 20 bp, Homo sapiens
agagaagataattgttgaaa

SEQ ID NO: 5175162 - DNA, 16 bp, Homo sapiens
agaaatacccatgtta

SEQ ID NO: 5175163 - DNA, 23 bp, Homo sapiens
agaaatactactgtgtaagggcc

SEQ ID NO: 5175164 - DNA, 21 bp, Homo sapiens
agaaatactataacatatgta

SEQ ID NO: 5175165 - DNA, 16 bp, Homo sapiens
agaaatactatatata

SEQ ID NO: 5175166 - DNA, 15 bp, Homo sapiens
agaaatactcatgtg

SEQ ID NO: 5175167 - DNA, 18 bp, Homo sapiens
agaaatactgctctgaat

SEQ ID NO: 5175168 - DNA, 23 bp, Homo sapiens
agaaatactgctctgaatatttt

SEQ ID NO: 5175169 - DNA, 16 bp, Homo sapiens
agaaatactgtacaat

SEQ ID NO: 5175170 - DNA, 16 bp, Homo sapiens
agaaatacttgtgatt

SEQ ID NO: 5175171 - DNA, 13 bp, Homo sapiens
agaaatagacaaa

SEQ ID NO: 5175172 - DNA, 17 bp, Homo sapiens
agaaatagacaaaaagt

SEQ ID NO: 5175173 - DNA, 22 bp, Homo sapiens
agaaatagacaaaaagtatatt

SEQ ID NO: 5175174 - DNA, 14 bp, Homo sapiens
agaaatagacagtc

SEQ ID NO: 5175175 - DNA, 17 bp, Homo sapiens
agaaatagacttaataa

SEQ ID NO: 5175176 - DNA, 19 bp, Homo sapiens
agaaatagactttgccttt

SEQ ID NO: 5175177 - DNA, 15 bp, Homo sapiens
agaaatagagccaac

SEQ ID NO: 5175178 - DNA, 11 bp, Homo sapiens
agaaatagcag

SEQ ID NO: 5175179 - DNA, 20 bp, Homo sapiens
agaaatagcctgcgctgttt

SEQ ID NO: 5175180 - DNA, 15 bp, Homo sapiens
agaaatagctatgga

SEQ ID NO: 5175181 - DNA, 20 bp, Homo sapiens
agaaatagcttatgaaaaga

SEQ ID NO: 5175182 - DNA, 20 bp, Homo sapiens
agaaatagggcatggcttgc

SEQ ID NO: 5175183 - DNA, 22 bp, Homo sapiens
agaaatagggcatggcttgccc

SEQ ID NO: 5175184 - DNA, 16 bp, Homo sapiens
agaaataggtatcaaa

SEQ ID NO: 5175185 - DNA, 15 bp, Homo sapiens
agaaatagttgtctg

SEQ ID NO: 5175186 - DNA, 16 bp, Homo sapiens
agaaatagttgtctgt

SEQ ID NO: 5175187 - DNA, 17 bp, Homo sapiens
agaaatagttgtctgtg

SEQ ID NO: 5175188 - DNA, 19 bp, Homo sapiens
agaaatataaacacattaa

SEQ ID NO: 5175189 - DNA, 18 bp, Homo sapiens
agaaatataacacatttt

SEQ ID NO: 5175190 - DNA, 19 bp, Homo sapiens
agaaatataacacattttt

SEQ ID NO: 5175191 - DNA, 18 bp, Homo sapiens
agaaatataataaaatgt

SEQ ID NO: 5175192 - DNA, 20 bp, Homo sapiens
agaaatataataaaatgtgt

SEQ ID NO: 5175193 - DNA, 21 bp, Homo sapiens
agaaatatacagtttgacttt

SEQ ID NO: 5175194 - DNA, 19 bp, Homo sapiens
agaaatatagtgcaatagt

SEQ ID NO: 5175195 - DNA, 15 bp, Homo sapiens
agaaatatatataca

SEQ ID NO: 5175196 - DNA, 20 bp, Homo sapiens
agaaatatatatacatatgt

SEQ ID NO: 5175197 - DNA, 21 bp, Homo sapiens
agaaatatatcctgtgtacct

SEQ ID NO: 5175198 - DNA, 18 bp, Homo sapiens
agaaatatattatgaaaa

SEQ ID NO: 5175199 - DNA, 19 bp, Homo sapiens
agaaatatccctcatttca

SEQ ID NO: 5175200 - DNA, 21 bp, Homo sapiens
agaaatatccctcatttcatt

SEQ ID NO: 5175201 - DNA, 20 bp, Homo sapiens
agaaatatccttttagaagc

SEQ ID NO: 5175202 - DNA, 12 bp, Homo sapiens
agaaatatctgt

SEQ ID NO: 5175203 - DNA, 14 bp, Homo sapiens
agaaatatctgtga

SEQ ID NO: 5175204 - DNA, 15 bp, Homo sapiens
agaaatatctttctc

SEQ ID NO: 5175205 - DNA, 19 bp, Homo sapiens
agaaatatctttctcttac

SEQ ID NO: 5175206 - DNA, 15 bp, Homo sapiens
agaaatatgaaattc

SEQ ID NO: 5175207 - DNA, 20 bp, Homo sapiens
agaaatatgaaattccagca

SEQ ID NO: 5175208 - DNA, 15 bp, Homo sapiens
agaaatatgatttta

SEQ ID NO: 5175209 - DNA, 14 bp, Homo sapiens
agaaatatgcagaa

SEQ ID NO: 5175210 - DNA, 19 bp, Homo sapiens
agaaatattaatatgtact

SEQ ID NO: 5175211 - DNA, 20 bp, Homo sapiens
agaaatattaatatgtactt

SEQ ID NO: 5175212 - DNA, 22 bp, Homo sapiens
agaaatattaatatgtactttt

SEQ ID NO: 5175213 - DNA, 13 bp, Homo sapiens
agaaatatttacc

SEQ ID NO: 5175214 - DNA, 23 bp, Homo sapiens
agaaatattttaatttttaaatg

SEQ ID NO: 5175215 - DNA, 19 bp, Homo sapiens
agaaatcaagcataaatca

SEQ ID NO: 5175216 - DNA, 21 bp, Homo sapiens
agaaatcaagcataaatcact

SEQ ID NO: 5175217 - DNA, 19 bp, Homo sapiens
agaaatcaagtaatgaatc

SEQ ID NO: 5175218 - DNA, 14 bp, Homo sapiens
agaaatcaattttt

SEQ ID NO: 5175219 - DNA, 21 bp, Homo sapiens
agaaatcaattttttaaacca

SEQ ID NO: 5175220 - DNA, 22 bp, Homo sapiens
agaaatcacaggggcggggcag

SEQ ID NO: 5175221 - DNA, 10 bp, Homo sapiens
agaaatcact

SEQ ID NO: 5175222 - DNA, 12 bp, Homo sapiens
agaaatcactgt

SEQ ID NO: 5175223 - DNA, 18 bp, Homo sapiens
agaaatcactgtgaaatt

SEQ ID NO: 5175224 - DNA, 14 bp, Homo sapiens
agaaatcacttaaa

SEQ ID NO: 5175225 - DNA, 24 bp, Homo sapiens
agaaatcaggtgttttaagactga

SEQ ID NO: 5175226 - DNA, 21 bp, Homo sapiens
agaaatcatgttatgataaaa

SEQ ID NO: 5175227 - DNA, 17 bp, Homo sapiens
agaaatcattttgcaat

SEQ ID NO: 5175228 - DNA, 16 bp, Homo sapiens
agaaatcccagttcat

SEQ ID NO: 5175229 - DNA, 20 bp, Homo sapiens
agaaatccccccttcagaac

SEQ ID NO: 5175230 - DNA, 22 bp, Homo sapiens
agaaatccctgtttaatattta

SEQ ID NO: 5175231 - DNA, 20 bp, Homo sapiens
agaaatcctttcataaagca

SEQ ID NO: 5175232 - DNA, 17 bp, Homo sapiens
agaaatcggttgctgtt

SEQ ID NO: 5175233 - DNA, 20 bp, Homo sapiens
agaaatctactgaattggct

SEQ ID NO: 5175234 - DNA, 19 bp, Homo sapiens
agaaatctatagaaagtgt

SEQ ID NO: 5175235 - DNA, 23 bp, Homo sapiens
agaaatctattacacctttatct

SEQ ID NO: 5175236 - DNA, 20 bp, Homo sapiens
agaaatctcccatgtgcata

SEQ ID NO: 5175237 - DNA, 17 bp, Homo sapiens
agaaatctggcccaggg

SEQ ID NO: 5175238 - DNA, 17 bp, Homo sapiens
agaaatctggcttctgg

SEQ ID NO: 5175239 - DNA, 20 bp, Homo sapiens
agaaatcttaagtcataatg

SEQ ID NO: 5175240 - DNA, 19 bp, Homo sapiens
agaaatcttgtcttaccac

SEQ ID NO: 5175241 - DNA, 15 bp, Homo sapiens
agaaatctttccagt

SEQ ID NO: 5175242 - DNA, 13 bp, Homo sapiens
agaaatgaaaaaa

SEQ ID NO: 5175243 - DNA, 16 bp, Homo sapiens
agaaatgaaaacagtg

SEQ ID NO: 5175244 - DNA, 13 bp, Homo sapiens
agaaatgaaatag

SEQ ID NO: 5175245 - DNA, 18 bp, Homo sapiens
agaaatgaaattgacaag

SEQ ID NO: 5175246 - DNA, 13 bp, Homo sapiens
agaaatgaaattt

SEQ ID NO: 5175247 - DNA, 18 bp, Homo sapiens
agaaatgaaattttacca

SEQ ID NO: 5175248 - DNA, 20 bp, Homo sapiens
agaaatgaaattttaccaag

SEQ ID NO: 5175249 - DNA, 13 bp, Homo sapiens
agaaatgaacaaa

SEQ ID NO: 5175250 - DNA, 17 bp, Homo sapiens
agaaatgaacaaaagat

SEQ ID NO: 5175251 - DNA, 16 bp, Homo sapiens
agaaatgaacaaggca

SEQ ID NO: 5175252 - DNA, 19 bp, Homo sapiens
agaaatgaagtttatatta

SEQ ID NO: 5175253 - DNA, 13 bp, Homo sapiens
agaaatgaatgct

SEQ ID NO: 5175254 - DNA, 17 bp, Homo sapiens
agaaatgagatcaggct

SEQ ID NO: 5175255 - DNA, 14 bp, Homo sapiens
agaaatgaggaaga

SEQ ID NO: 5175256 - DNA, 16 bp, Homo sapiens
agaaatgaggaagaat

SEQ ID NO: 5175257 - DNA, 17 bp, Homo sapiens
agaaatgagtgataaat

SEQ ID NO: 5175258 - DNA, 17 bp, Homo sapiens
agaaatgatgtgaaaga

SEQ ID NO: 5175259 - DNA, 18 bp, Homo sapiens
agaaatgattcaccaggt

SEQ ID NO: 5175260 - DNA, 14 bp, Homo sapiens
agaaatgcaaaaat

SEQ ID NO: 5175261 - DNA, 17 bp, Homo sapiens
agaaatgcaaaagaagt

SEQ ID NO: 5175262 - DNA, 18 bp, Homo sapiens
agaaatgcaaattctcaa

SEQ ID NO: 5175263 - DNA, 15 bp, Homo sapiens
agaaatgcaataact

SEQ ID NO: 5175264 - DNA, 13 bp, Homo sapiens
agaaatgcacaat

SEQ ID NO: 5175265 - DNA, 12 bp, Homo sapiens
agaaatgcagaa

SEQ ID NO: 5175266 - DNA, 23 bp, Homo sapiens
agaaatgcatatgtcactagaat

SEQ ID NO: 5175267 - DNA, 15 bp, Homo sapiens
agaaatgcatattgt

SEQ ID NO: 5175268 - DNA, 16 bp, Homo sapiens
agaaatgcatattgta

SEQ ID NO: 5175269 - DNA, 15 bp, Homo sapiens
agaaatgcatatttg

SEQ ID NO: 5175270 - DNA, 22 bp, Homo sapiens
agaaatgcatatttgccacaaa

SEQ ID NO: 5175271 - DNA, 22 bp, Homo sapiens
agaaatgcatccattcctcagg

SEQ ID NO: 5175272 - DNA, 22 bp, Homo sapiens
agaaatgccaagcacttctttt

SEQ ID NO: 5175273 - DNA, 18 bp, Homo sapiens
agaaatgccagaaacagt

SEQ ID NO: 5175274 - DNA, 20 bp, Homo sapiens
agaaatgccagtggtggagg

SEQ ID NO: 5175275 - DNA, 16 bp, Homo sapiens
agaaatgccccagtgt

SEQ ID NO: 5175276 - DNA, 22 bp, Homo sapiens
agaaatgcccttcactttctcc

SEQ ID NO: 5175277 - DNA, 12 bp, Homo sapiens
agaaatgctaat

SEQ ID NO: 5175278 - DNA, 21 bp, Homo sapiens
agaaatgctaatgtaatcatt

SEQ ID NO: 5175279 - DNA, 12 bp, Homo sapiens
agaaatgctctg

SEQ ID NO: 5175280 - DNA, 13 bp, Homo sapiens
agaaatgctgcct

SEQ ID NO: 5175281 - DNA, 14 bp, Homo sapiens
agaaatgctgcctg

SEQ ID NO: 5175282 - DNA, 22 bp, Homo sapiens
agaaatgctgcctgcctgtctg

SEQ ID NO: 5175283 - DNA, 23 bp, Homo sapiens
agaaatgctgcctgcctgtctgt

SEQ ID NO: 5175284 - DNA, 16 bp, Homo sapiens
agaaatggacaaagaa

SEQ ID NO: 5175285 - DNA, 17 bp, Homo sapiens
agaaatggattcagtat

SEQ ID NO: 5175286 - DNA, 16 bp, Homo sapiens
agaaatggcgtctgct

SEQ ID NO: 5175287 - DNA, 20 bp, Homo sapiens
agaaatggcgtctgctctgg

SEQ ID NO: 5175288 - DNA, 21 bp, Homo sapiens
agaaatgggaaatgcctaaga

SEQ ID NO: 5175289 - DNA, 16 bp, Homo sapiens
agaaatgggactctga

SEQ ID NO: 5175290 - DNA, 14 bp, Homo sapiens
agaaatgggcctgc

SEQ ID NO: 5175291 - DNA, 16 bp, Homo sapiens
agaaatggggaattct

SEQ ID NO: 5175292 - DNA, 22 bp, Homo sapiens
agaaatggtccgctttcctgga

SEQ ID NO: 5175293 - DNA, 23 bp, Homo sapiens
agaaatggtccgctttcctggag

SEQ ID NO: 5175294 - DNA, 19 bp, Homo sapiens
agaaatggtgagattgttt

SEQ ID NO: 5175295 - DNA, 15 bp, Homo sapiens
agaaatggttgtatt

SEQ ID NO: 5175296 - DNA, 16 bp, Homo sapiens
agaaatggttgtatta

SEQ ID NO: 5175297 - DNA, 21 bp, Homo sapiens
agaaatggttgtattagatgt

SEQ ID NO: 5175298 - DNA, 18 bp, Homo sapiens
agaaatggtttcctctgg

SEQ ID NO: 5175299 - DNA, 19 bp, Homo sapiens
agaaatggtttcctctgga

SEQ ID NO: 5175300 - DNA, 16 bp, Homo sapiens
agaaatgtaaactgcc

SEQ ID NO: 5175301 - DNA, 17 bp, Homo sapiens
agaaatgtaaactgcca

SEQ ID NO: 5175302 - DNA, 18 bp, Homo sapiens
agaaatgtaaactgccat

SEQ ID NO: 5175303 - DNA, 18 bp, Homo sapiens
agaaatgtaaatgttatt

SEQ ID NO: 5175304 - DNA, 23 bp, Homo sapiens
agaaatgtaaatgttattattct

SEQ ID NO: 5175305 - DNA, 22 bp, Homo sapiens
agaaatgtaatgcgattttatt

SEQ ID NO: 5175306 - DNA, 15 bp, Homo sapiens
agaaatgtacagcaa

SEQ ID NO: 5175307 - DNA, 16 bp, Homo sapiens
agaaatgtacagcaag

SEQ ID NO: 5175308 - DNA, 17 bp, Homo sapiens
agaaatgtagcagcagc

SEQ ID NO: 5175309 - DNA, 14 bp, Homo sapiens
agaaatgtcataaa

SEQ ID NO: 5175310 - DNA, 17 bp, Homo sapiens
agaaatgtcataaatta

SEQ ID NO: 5175311 - DNA, 16 bp, Homo sapiens
agaaatgtctctgctc

SEQ ID NO: 5175312 - DNA, 18 bp, Homo sapiens
agaaatgtgaagggtggg

SEQ ID NO: 5175313 - DNA, 16 bp, Homo sapiens
agaaatgtgctgcaaa

SEQ ID NO: 5175314 - DNA, 22 bp, Homo sapiens
agaaatgttgagtctgtactaa

SEQ ID NO: 5175315 - DNA, 22 bp, Homo sapiens
agaaatgtttatacaataattt

SEQ ID NO: 5175316 - DNA, 18 bp, Homo sapiens
agaaatgtttatggaaat

SEQ ID NO: 5175317 - DNA, 16 bp, Homo sapiens
agaaatgtttcataca

SEQ ID NO: 5175318 - DNA, 12 bp, Homo sapiens
agaaatgtttct

SEQ ID NO: 5175319 - DNA, 20 bp, Homo sapiens
agaaatgtttttaacactat

SEQ ID NO: 5175320 - DNA, 14 bp, Homo sapiens
agaaattaaaatat

SEQ ID NO: 5175321 - DNA, 16 bp, Homo sapiens
agaaattaaaatatta

SEQ ID NO: 5175322 - DNA, 14 bp, Homo sapiens
agaaattaaatctg

SEQ ID NO: 5175323 - DNA, 12 bp, Homo sapiens
agaaattaactt

SEQ ID NO: 5175324 - DNA, 17 bp, Homo sapiens
agaaattacaggttcct

SEQ ID NO: 5175325 - DNA, 20 bp, Homo sapiens
agaaattacctgtggatatt

SEQ ID NO: 5175326 - DNA, 20 bp, Homo sapiens
agaaattactaattttactt

SEQ ID NO: 5175327 - DNA, 11 bp, Homo sapiens
agaaattagaa

SEQ ID NO: 5175328 - DNA, 17 bp, Homo sapiens
agaaattagaaacctta

SEQ ID NO: 5175329 - DNA, 18 bp, Homo sapiens
agaaattagatttgtgca

SEQ ID NO: 5175330 - DNA, 15 bp, Homo sapiens
agaaattagctgtgt

SEQ ID NO: 5175331 - DNA, 13 bp, Homo sapiens
agaaattagggct

SEQ ID NO: 5175332 - DNA, 21 bp, Homo sapiens
agaaattagggctctaatttc

SEQ ID NO: 5175333 - DNA, 18 bp, Homo sapiens
agaaattataattttagt

SEQ ID NO: 5175334 - DNA, 22 bp, Homo sapiens
agaaattatctttagttgaatt

SEQ ID NO: 5175335 - DNA, 21 bp, Homo sapiens
agaaattatgatcctctattt

SEQ ID NO: 5175336 - DNA, 12 bp, Homo sapiens
agaaattatgtg

SEQ ID NO: 5175337 - DNA, 22 bp, Homo sapiens
agaaattatgtgccagatttat

SEQ ID NO: 5175338 - DNA, 16 bp, Homo sapiens
agaaattatttaataa

SEQ ID NO: 5175339 - DNA, 14 bp, Homo sapiens
agaaattattttct

SEQ ID NO: 5175340 - DNA, 23 bp, Homo sapiens
agagaagcattctcattggaaat

SEQ ID NO: 5175341 - DNA, 20 bp, Homo sapiens
agagaagccacgctgtcctc

SEQ ID NO: 5175342 - DNA, 12 bp, Homo sapiens
agagaagccagc

SEQ ID NO: 5175343 - DNA, 16 bp, Homo sapiens
agagaagccagccaca

SEQ ID NO: 5175344 - DNA, 13 bp, Homo sapiens
agagaagccagct

SEQ ID NO: 5175345 - DNA, 13 bp, Homo sapiens
agagaagccatca

SEQ ID NO: 5175346 - DNA, 13 bp, Homo sapiens
agagaagccccgc

SEQ ID NO: 5175347 - DNA, 13 bp, Homo sapiens
agagaagcccctt

SEQ ID NO: 5175348 - DNA, 17 bp, Homo sapiens
agagaagccccttcccc

SEQ ID NO: 5175349 - DNA, 23 bp, Homo sapiens
agagaagcctatttttatatttt

SEQ ID NO: 5175350 - DNA, 22 bp, Homo sapiens
agagaagccttcaagctctgag

SEQ ID NO: 5175351 - DNA, 18 bp, Homo sapiens
agagaagcggatttccag

SEQ ID NO: 5175352 - DNA, 20 bp, Homo sapiens
agagaagctaaaacctgagc

SEQ ID NO: 5175353 - DNA, 12 bp, Homo sapiens
agagaagctcct

SEQ ID NO: 5175354 - DNA, 14 bp, Homo sapiens
agagaagctgagaa

SEQ ID NO: 5175355 - DNA, 12 bp, Homo sapiens
agagaagctggg

SEQ ID NO: 5175356 - DNA, 21 bp, Homo sapiens
agagaagctttcaggggaagg

SEQ ID NO: 5175357 - DNA, 23 bp, Homo sapiens
agagaaggaaaagactgaatcta

SEQ ID NO: 5175358 - DNA, 16 bp, Homo sapiens
agagaaggaatgtctt

SEQ ID NO: 5175359 - DNA, 17 bp, Homo sapiens
agagaaggacggtgcca

SEQ ID NO: 5175360 - DNA, 15 bp, Homo sapiens
agagaaggagatcag

SEQ ID NO: 5175361 - DNA, 14 bp, Homo sapiens
agagaaggagatgt

SEQ ID NO: 5175362 - DNA, 14 bp, Homo sapiens
agagaaggcagcag

SEQ ID NO: 5175363 - DNA, 20 bp, Homo sapiens
agagaaggcaggaatgtgtg

SEQ ID NO: 5175364 - DNA, 23 bp, Homo sapiens
agagaaggcccataccttctggt

SEQ ID NO: 5175365 - DNA, 14 bp, Homo sapiens
agagaaggcttcct

SEQ ID NO: 5175366 - DNA, 20 bp, Homo sapiens
agagaagggaagcctcttca

SEQ ID NO: 5175367 - DNA, 22 bp, Homo sapiens
agagaaggggaagcactcgtgt

SEQ ID NO: 5175368 - DNA, 12 bp, Homo sapiens
agagaaggggag

SEQ ID NO: 5175369 - DNA, 22 bp, Homo sapiens
agagaagggggattggagggaa

SEQ ID NO: 5175370 - DNA, 16 bp, Homo sapiens
agagaagtagaaatca

SEQ ID NO: 5175371 - DNA, 18 bp, Homo sapiens
agagaagtatacataagt

SEQ ID NO: 5175372 - DNA, 16 bp, Homo sapiens
agagaagtattataaa

SEQ ID NO: 5175373 - DNA, 20 bp, Homo sapiens
agagaagtcacagggcagta

SEQ ID NO: 5175374 - DNA, 14 bp, Homo sapiens
agagaagtctcatt

SEQ ID NO: 5175375 - DNA, 17 bp, Homo sapiens
agagaagtctggtcaga

SEQ ID NO: 5175376 - DNA, 17 bp, Homo sapiens
agagaagtgacagggaa

SEQ ID NO: 5175377 - DNA, 18 bp, Homo sapiens
agagaagtgacggttcct

SEQ ID NO: 5175378 - DNA, 19 bp, Homo sapiens
agagaagtgacggttccta

SEQ ID NO: 5175379 - DNA, 14 bp, Homo sapiens
agagaagtgcccct

SEQ ID NO: 5175380 - DNA, 18 bp, Homo sapiens
agagaagtgcccctgctg

SEQ ID NO: 5175381 - DNA, 14 bp, Homo sapiens
agagaagttctcaa

SEQ ID NO: 5175382 - DNA, 18 bp, Homo sapiens
agagaagttctcaaagtt

SEQ ID NO: 5175383 - DNA, 12 bp, Homo sapiens
agagaataaatt

SEQ ID NO: 5175384 - DNA, 22 bp, Homo sapiens
agagaataaattggattatttt

SEQ ID NO: 5175385 - DNA, 13 bp, Homo sapiens
agagaatacacat

SEQ ID NO: 5175386 - DNA, 22 bp, Homo sapiens
agagaatacacatataaaaaca

SEQ ID NO: 5175387 - DNA, 13 bp, Homo sapiens
agagaatataaca

SEQ ID NO: 5175388 - DNA, 21 bp, Homo sapiens
agagaatatttcaaatgaaca

SEQ ID NO: 5175389 - DNA, 23 bp, Homo sapiens
agagaatatttcaaatgaacacg

SEQ ID NO: 5175390 - DNA, 22 bp, Homo sapiens
agagaatatttttggcattcct

SEQ ID NO: 5175391 - DNA, 12 bp, Homo sapiens
agagaatcaaca

SEQ ID NO: 5175392 - DNA, 19 bp, Homo sapiens
agagaatcacacaagtttg

SEQ ID NO: 5175393 - DNA, 15 bp, Homo sapiens
agagaatcagggcag

SEQ ID NO: 5175394 - DNA, 15 bp, Homo sapiens
agagaatcatactta

SEQ ID NO: 5175395 - DNA, 17 bp, Homo sapiens
agagaatccacataaaa

SEQ ID NO: 5175396 - DNA, 23 bp, Homo sapiens
agagaatccctagtcttcaagca

SEQ ID NO: 5175397 - DNA, 18 bp, Homo sapiens
agagaatcttaaggtcta

SEQ ID NO: 5175398 - DNA, 19 bp, Homo sapiens
agagaatcttaaggtctaa

SEQ ID NO: 5175399 - DNA, 19 bp, Homo sapiens
agagaatgaactgtggaat

SEQ ID NO: 5175400 - DNA, 10 bp, Homo sapiens
agagaatgag

SEQ ID NO: 5175401 - DNA, 12 bp, Homo sapiens
agagaatgagag

SEQ ID NO: 5175402 - DNA, 15 bp, Homo sapiens
agagaatgagagagt

SEQ ID NO: 5175403 - DNA, 14 bp, Homo sapiens
agagaatgaggaag

SEQ ID NO: 5175404 - DNA, 14 bp, Homo sapiens
agagaatgcacaga

SEQ ID NO: 5175405 - DNA, 19 bp, Homo sapiens
agagaatgcacagatatac

SEQ ID NO: 5175406 - DNA, 20 bp, Homo sapiens
agagaatgcacagatatact

SEQ ID NO: 5175407 - DNA, 14 bp, Homo sapiens
agagaatgccctca

SEQ ID NO: 5175408 - DNA, 21 bp, Homo sapiens
agagaatgcccttctccttat

SEQ ID NO: 5175409 - DNA, 15 bp, Homo sapiens
agagaatggaaaaca

SEQ ID NO: 5175410 - DNA, 14 bp, Homo sapiens
agagaatggagaca

SEQ ID NO: 5175411 - DNA, 17 bp, Homo sapiens
agagaatggctgggtca

SEQ ID NO: 5175412 - DNA, 20 bp, Homo sapiens
agagaatggctgggtcaggg

SEQ ID NO: 5175413 - DNA, 20 bp, Homo sapiens
agagaatgggtttactctca

SEQ ID NO: 5175414 - DNA, 22 bp, Homo sapiens
agagaatgtatttccttttcta

SEQ ID NO: 5175415 - DNA, 14 bp, Homo sapiens
agagaatgtcactg

SEQ ID NO: 5175416 - DNA, 12 bp, Homo sapiens
agagaatgtgtg

SEQ ID NO: 5175417 - DNA, 21 bp, Homo sapiens
agagaatgttcctactcacac

SEQ ID NO: 5175418 - DNA, 22 bp, Homo sapiens
agagaattactatttactttat

SEQ ID NO: 5175419 - DNA, 19 bp, Homo sapiens
agagaattacttatattca

SEQ ID NO: 5175420 - DNA, 16 bp, Homo sapiens
agagaattatatattt

SEQ ID NO: 5175421 - DNA, 16 bp, Homo sapiens
agagaattatctcaag

SEQ ID NO: 5175422 - DNA, 14 bp, Homo sapiens
agagaattcagtat

SEQ ID NO: 5175423 - DNA, 20 bp, Homo sapiens
agagaattctaagattgtac

SEQ ID NO: 5175424 - DNA, 19 bp, Homo sapiens
agagaatttctaaagtaaa

SEQ ID NO: 5175425 - DNA, 22 bp, Homo sapiens
agagaatttctaaagtaaaatt

SEQ ID NO: 5175426 - DNA, 23 bp, Homo sapiens
agagaatttgctttatctgttgt

SEQ ID NO: 5175427 - DNA, 20 bp, Homo sapiens
agagacaaactgtaaaaaat

SEQ ID NO: 5175428 - DNA, 13 bp, Homo sapiens
agagacaaagatt

SEQ ID NO: 5175429 - DNA, 15 bp, Homo sapiens
agagacaaagatttc

SEQ ID NO: 5175430 - DNA, 18 bp, Homo sapiens
agagacaaagtgggtgtg

SEQ ID NO: 5175431 - DNA, 17 bp, Homo sapiens
agagacaaagtttggaa

SEQ ID NO: 5175432 - DNA, 13 bp, Homo sapiens
agagacaaatagt

SEQ ID NO: 5175433 - DNA, 18 bp, Homo sapiens
agagacaaatagtaggct

SEQ ID NO: 5175434 - DNA, 19 bp, Homo sapiens
agagacaacttgctccttt

SEQ ID NO: 5175435 - DNA, 22 bp, Homo sapiens
agagacaagaaaggcagacaca

SEQ ID NO: 5175436 - DNA, 15 bp, Homo sapiens
agagacaagtaattt

SEQ ID NO: 5175437 - DNA, 20 bp, Homo sapiens
agagacaagtaatttcagtg

SEQ ID NO: 5175438 - DNA, 19 bp, Homo sapiens
agagacacaagccttcggc

SEQ ID NO: 5175439 - DNA, 19 bp, Homo sapiens
agagacacaagtggcctta

SEQ ID NO: 5175440 - DNA, 16 bp, Homo sapiens
agagacacactgaaga

SEQ ID NO: 5175441 - DNA, 17 bp, Homo sapiens
agagacacactgaagaa

SEQ ID NO: 5175442 - DNA, 13 bp, Homo sapiens
agagacacctgca

SEQ ID NO: 5175443 - DNA, 20 bp, Homo sapiens
agagacacctgcacctcccc

SEQ ID NO: 5175444 - DNA, 21 bp, Homo sapiens
agagacacctgcacctccccc

SEQ ID NO: 5175445 - DNA, 22 bp, Homo sapiens
agagacacctgcacctcccccc

SEQ ID NO: 5175446 - DNA, 16 bp, Homo sapiens
agagacactcccccct

SEQ ID NO: 5175447 - DNA, 20 bp, Homo sapiens
agagacactgttgataaaaa

SEQ ID NO: 5175448 - DNA, 22 bp, Homo sapiens
agagacactgttgataaaaact

SEQ ID NO: 5175449 - DNA, 23 bp, Homo sapiens
agagacagaagcaggctggaggt

SEQ ID NO: 5175450 - DNA, 21 bp, Homo sapiens
agagacagaccccttggcttt

SEQ ID NO: 5175451 - DNA, 19 bp, Homo sapiens
agagacagacttgagaact

SEQ ID NO: 5175452 - DNA, 15 bp, Homo sapiens
agagacagagagaga

SEQ ID NO: 5175453 - DNA, 14 bp, Homo sapiens
agagacagcccagg

SEQ ID NO: 5175454 - DNA, 13 bp, Homo sapiens
agagacaggaaaa

SEQ ID NO: 5175455 - DNA, 14 bp, Homo sapiens
agagacaggagggc

SEQ ID NO: 5175456 - DNA, 15 bp, Homo sapiens
agagacaggagggca

SEQ ID NO: 5175457 - DNA, 13 bp, Homo sapiens
agagacaggcagg

SEQ ID NO: 5175458 - DNA, 20 bp, Homo sapiens
agagacaggcccaagagatg

SEQ ID NO: 5175459 - DNA, 11 bp, Homo sapiens
agagacaggga

SEQ ID NO: 5175460 - DNA, 12 bp, Homo sapiens
agagacagggcc

SEQ ID NO: 5175461 - DNA, 23 bp, Homo sapiens
agagacagggcccgggcccaggc

SEQ ID NO: 5175462 - DNA, 13 bp, Homo sapiens
agagacagggtct

SEQ ID NO: 5175463 - DNA, 20 bp, Homo sapiens
agagacagggtttcaccatg

SEQ ID NO: 5175464 - DNA, 13 bp, Homo sapiens
agagacagtgttt

SEQ ID NO: 5175465 - DNA, 22 bp, Homo sapiens
agagacagttatttatagtcat

SEQ ID NO: 5175466 - DNA, 15 bp, Homo sapiens
agagacagttctctg

SEQ ID NO: 5175467 - DNA, 22 bp, Homo sapiens
agagacagttgggtgagaacaa

SEQ ID NO: 5175468 - DNA, 17 bp, Homo sapiens
agagacatacttgaagg

SEQ ID NO: 5175469 - DNA, 23 bp, Homo sapiens
agagacatacttgaagggccaga

SEQ ID NO: 5175470 - DNA, 13 bp, Homo sapiens
agagacatcagcc

SEQ ID NO: 5175471 - DNA, 15 bp, Homo sapiens
agagacatgcagaga

SEQ ID NO: 5175472 - DNA, 23 bp, Homo sapiens
agagacatggtattgactcaaca

SEQ ID NO: 5175473 - DNA, 22 bp, Homo sapiens
agagacattaactcattagact

SEQ ID NO: 5175474 - DNA, 14 bp, Homo sapiens
agagaccacacatt

SEQ ID NO: 5175475 - DNA, 20 bp, Homo sapiens
agagaccacacattttatga

SEQ ID NO: 5175476 - DNA, 20 bp, Homo sapiens
agagaccacagccgggtgtg

SEQ ID NO: 5175477 - DNA, 15 bp, Homo sapiens
agagaccacatgggg

SEQ ID NO: 5175478 - DNA, 19 bp, Homo sapiens
agagaccaccgcgcccctc

SEQ ID NO: 5175479 - DNA, 20 bp, Homo sapiens
agagaccaccgcgcccctct

SEQ ID NO: 5175480 - DNA, 21 bp, Homo sapiens
agagaccaccgcgcccctctg

SEQ ID NO: 5175481 - DNA, 14 bp, Homo sapiens
agagaccacttcct

SEQ ID NO: 5175482 - DNA, 12 bp, Homo sapiens
agagaccagcac

SEQ ID NO: 5175483 - DNA, 15 bp, Homo sapiens
agagaccagcactca

SEQ ID NO: 5175484 - DNA, 17 bp, Homo sapiens
agagaccagcctttctt

SEQ ID NO: 5175485 - DNA, 13 bp, Homo sapiens
agagaccaggagg

SEQ ID NO: 5175486 - DNA, 20 bp, Homo sapiens
agagaccataagagaaacct

SEQ ID NO: 5175487 - DNA, 13 bp, Homo sapiens
agagaccatccct

SEQ ID NO: 5175488 - DNA, 18 bp, Homo sapiens
agagaccatccctgaagg

SEQ ID NO: 5175489 - DNA, 21 bp, Homo sapiens
agagaccatccctgaaggccc

SEQ ID NO: 5175490 - DNA, 14 bp, Homo sapiens
agagaccatctcct

SEQ ID NO: 5175491 - DNA, 12 bp, Homo sapiens
agagacccaagg

SEQ ID NO: 5175492 - DNA, 14 bp, Homo sapiens
agagaccccagtca

SEQ ID NO: 5175493 - DNA, 21 bp, Homo sapiens
agagacccccggaacaagcct

SEQ ID NO: 5175494 - DNA, 14 bp, Homo sapiens
agagacccccgtgc

SEQ ID NO: 5175495 - DNA, 15 bp, Homo sapiens
agagaccctacagac

SEQ ID NO: 5175496 - DNA, 22 bp, Homo sapiens
agagaccctcactgctggggag

SEQ ID NO: 5175497 - DNA, 17 bp, Homo sapiens
agagacccttgtttgat

SEQ ID NO: 5175498 - DNA, 13 bp, Homo sapiens
agagaccgaggag

SEQ ID NO: 5175499 - DNA, 20 bp, Homo sapiens
agagaccgtcgggggctgag

SEQ ID NO: 5175500 - DNA, 21 bp, Homo sapiens
agagaccgtcgggggctgagg

SEQ ID NO: 5175501 - DNA, 16 bp, Homo sapiens
agagacctacctcagg

SEQ ID NO: 5175502 - DNA, 18 bp, Homo sapiens
agagacctacctcaggtt

SEQ ID NO: 5175503 - DNA, 20 bp, Homo sapiens
agagacctacctcaggttgc

SEQ ID NO: 5175504 - DNA, 16 bp, Homo sapiens
agagacctcatcagcc

SEQ ID NO: 5175505 - DNA, 19 bp, Homo sapiens
agagacctcatcagccttg

SEQ ID NO: 5175506 - DNA, 19 bp, Homo sapiens
agagacctcatcaggatga

SEQ ID NO: 5175507 - DNA, 15 bp, Homo sapiens
agagacctctgccta

SEQ ID NO: 5175508 - DNA, 16 bp, Homo sapiens
agagacctgaagtgtg

SEQ ID NO: 5175509 - DNA, 14 bp, Homo sapiens
agagacctgaggca

SEQ ID NO: 5175510 - DNA, 18 bp, Homo sapiens
agagacctgccctctctg

SEQ ID NO: 5175511 - DNA, 15 bp, Homo sapiens
agagacctgctccag

SEQ ID NO: 5175512 - DNA, 16 bp, Homo sapiens
agagacctgctccaga

SEQ ID NO: 5175513 - DNA, 17 bp, Homo sapiens
agagacctgtgtgaact

SEQ ID NO: 5175514 - DNA, 17 bp, Homo sapiens
agagaccttcaaatgcg

SEQ ID NO: 5175515 - DNA, 15 bp, Homo sapiens
agagaccttctctta

SEQ ID NO: 5175516 - DNA, 14 bp, Homo sapiens
agagacctttgccc

SEQ ID NO: 5175517 - DNA, 17 bp, Homo sapiens
agagacctttgcccaca

SEQ ID NO: 5175518 - DNA, 22 bp, Homo sapiens
agagacgaggtgtcttccttcc

SEQ ID NO: 5175519 - DNA, 22 bp, Homo sapiens
agaaattcaagaagtatttttt

SEQ ID NO: 5175520 - DNA, 22 bp, Homo sapiens
agaaattcaatttggatttaaa

SEQ ID NO: 5175521 - DNA, 19 bp, Homo sapiens
agaaattcattaaagaaaa

SEQ ID NO: 5175522 - DNA, 23 bp, Homo sapiens
agaaattccatacttctctcaga

SEQ ID NO: 5175523 - DNA, 18 bp, Homo sapiens
agaaattccctggaccag

SEQ ID NO: 5175524 - DNA, 22 bp, Homo sapiens
agaaattccctggaccagatgc

SEQ ID NO: 5175525 - DNA, 23 bp, Homo sapiens
agaaattcctgtagcatcttctg

SEQ ID NO: 5175526 - DNA, 19 bp, Homo sapiens
agaaattcgcatgtttaat

SEQ ID NO: 5175527 - DNA, 21 bp, Homo sapiens
agaaattcgccccattttctt

SEQ ID NO: 5175528 - DNA, 20 bp, Homo sapiens
agaaattcgtgtgttttttt

SEQ ID NO: 5175529 - DNA, 13 bp, Homo sapiens
agaaattctaact

SEQ ID NO: 5175530 - DNA, 12 bp, Homo sapiens
agaaattctata

SEQ ID NO: 5175531 - DNA, 13 bp, Homo sapiens
agaaattctataa

SEQ ID NO: 5175532 - DNA, 20 bp, Homo sapiens
agaaattctcaaaatacgtg

SEQ ID NO: 5175533 - DNA, 16 bp, Homo sapiens
agaaattctgctgtta

SEQ ID NO: 5175534 - DNA, 11 bp, Homo sapiens
agaaattctgt

SEQ ID NO: 5175535 - DNA, 21 bp, Homo sapiens
agaaattctgtcatagaaagt

SEQ ID NO: 5175536 - DNA, 19 bp, Homo sapiens
agaaattctgttaaaatct

SEQ ID NO: 5175537 - DNA, 20 bp, Homo sapiens
agaaattctgttaaaatcta

SEQ ID NO: 5175538 - DNA, 21 bp, Homo sapiens
agaaattctgttaaaatctat

SEQ ID NO: 5175539 - DNA, 19 bp, Homo sapiens
agaaattcttcaatttgaa

SEQ ID NO: 5175540 - DNA, 12 bp, Homo sapiens
agaaattcttgt

SEQ ID NO: 5175541 - DNA, 18 bp, Homo sapiens
agaaattcttgttatggt

SEQ ID NO: 5175542 - DNA, 14 bp, Homo sapiens
agaaattgaaagca

SEQ ID NO: 5175543 - DNA, 17 bp, Homo sapiens
agaaattgcctccagtc

SEQ ID NO: 5175544 - DNA, 22 bp, Homo sapiens
agaaattggaacagaatgtttt

SEQ ID NO: 5175545 - DNA, 14 bp, Homo sapiens
agaaattggtacct

SEQ ID NO: 5175546 - DNA, 16 bp, Homo sapiens
agaaattggtaccttg

SEQ ID NO: 5175547 - DNA, 23 bp, Homo sapiens
agaaattggtaccttgcacacat

SEQ ID NO: 5175548 - DNA, 16 bp, Homo sapiens
agaaattgtatattgt

SEQ ID NO: 5175549 - DNA, 20 bp, Homo sapiens
agaaattgtatattgtaatt

SEQ ID NO: 5175550 - DNA, 13 bp, Homo sapiens
agaaattgtcctt

SEQ ID NO: 5175551 - DNA, 14 bp, Homo sapiens
agaaattgtccttg

SEQ ID NO: 5175552 - DNA, 22 bp, Homo sapiens
agaaattgtccttgaagcttgt

SEQ ID NO: 5175553 - DNA, 15 bp, Homo sapiens
agaaattgtgccaaa

SEQ ID NO: 5175554 - DNA, 19 bp, Homo sapiens
agaaattgttcctgatgtg

SEQ ID NO: 5175555 - DNA, 16 bp, Homo sapiens
agaaattgtttttctg

SEQ ID NO: 5175556 - DNA, 12 bp, Homo sapiens
agaaatttaaca

SEQ ID NO: 5175557 - DNA, 19 bp, Homo sapiens
agaaatttaatcagtgtga

SEQ ID NO: 5175558 - DNA, 17 bp, Homo sapiens
agaaatttaattcagaa

SEQ ID NO: 5175559 - DNA, 18 bp, Homo sapiens
agaaatttactatgtaaa

SEQ ID NO: 5175560 - DNA, 17 bp, Homo sapiens
agaaatttataaacttt

SEQ ID NO: 5175561 - DNA, 23 bp, Homo sapiens
agaaatttatatgtcagagctgt

SEQ ID NO: 5175562 - DNA, 19 bp, Homo sapiens
agaaatttatgaagcagat

SEQ ID NO: 5175563 - DNA, 22 bp, Homo sapiens
agaaatttatgaagcagattta

SEQ ID NO: 5175564 - DNA, 23 bp, Homo sapiens
agaaatttatttcctagttctgt

SEQ ID NO: 5175565 - DNA, 16 bp, Homo sapiens
agaaatttccactcag

SEQ ID NO: 5175566 - DNA, 13 bp, Homo sapiens
agaaatttctagt

SEQ ID NO: 5175567 - DNA, 17 bp, Homo sapiens
agaaatttgaaaaaact

SEQ ID NO: 5175568 - DNA, 15 bp, Homo sapiens
agaaatttgatttct

SEQ ID NO: 5175569 - DNA, 18 bp, Homo sapiens
agaaatttgcccctggca

SEQ ID NO: 5175570 - DNA, 15 bp, Homo sapiens
agaaatttggtaccc

SEQ ID NO: 5175571 - DNA, 20 bp, Homo sapiens
agaaattttactgacagaaa

SEQ ID NO: 5175572 - DNA, 12 bp, Homo sapiens
agaaattttatt

SEQ ID NO: 5175573 - DNA, 20 bp, Homo sapiens
agaaattttattagacattc

SEQ ID NO: 5175574 - DNA, 13 bp, Homo sapiens
agaaattttcaac

SEQ ID NO: 5175575 - DNA, 15 bp, Homo sapiens
agaaattttctacag

SEQ ID NO: 5175576 - DNA, 13 bp, Homo sapiens
agaaattttgtaa

SEQ ID NO: 5175577 - DNA, 21 bp, Homo sapiens
agaaattttgtaagaaggcaa

SEQ ID NO: 5175578 - DNA, 15 bp, Homo sapiens
agaaatttttatcag

SEQ ID NO: 5175579 - DNA, 13 bp, Homo sapiens
agaaatttttatt

SEQ ID NO: 5175580 - DNA, 18 bp, Homo sapiens
agaaatttttatttttga

SEQ ID NO: 5175581 - DNA, 17 bp, Homo sapiens
agaaatttttcagatgc

SEQ ID NO: 5175582 - DNA, 22 bp, Homo sapiens
agaaatttttcagatgcttctg

SEQ ID NO: 5175583 - DNA, 16 bp, Homo sapiens
agaaatttttttccag

SEQ ID NO: 5175584 - DNA, 22 bp, Homo sapiens
agaaatttttttccagaattga

SEQ ID NO: 5175585 - DNA, 20 bp, Homo sapiens
agaacaaaaaaatctgcaga

SEQ ID NO: 5175586 - DNA, 23 bp, Homo sapiens
agaacaaaaaaatctgcagaagg

SEQ ID NO: 5175587 - DNA, 12 bp, Homo sapiens
agaacaaaaact

SEQ ID NO: 5175588 - DNA, 20 bp, Homo sapiens
agaacaaaaagaaatcttgt

SEQ ID NO: 5175589 - DNA, 14 bp, Homo sapiens
agaacaaaacagtc

SEQ ID NO: 5175590 - DNA, 19 bp, Homo sapiens
agaacaaaacctcttctgt

SEQ ID NO: 5175591 - DNA, 15 bp, Homo sapiens
agaacaaaacttcta

SEQ ID NO: 5175592 - DNA, 12 bp, Homo sapiens
agaacaaacaaa

SEQ ID NO: 5175593 - DNA, 18 bp, Homo sapiens
agaacaaacaaaacttaa

SEQ ID NO: 5175594 - DNA, 15 bp, Homo sapiens
agaacaaagagtgaa

SEQ ID NO: 5175595 - DNA, 17 bp, Homo sapiens
agaacaaagagtgaaat

SEQ ID NO: 5175596 - DNA, 23 bp, Homo sapiens
agaacaaagagtgaaatattgta

SEQ ID NO: 5175597 - DNA, 15 bp, Homo sapiens
agaacaaagctgtta

SEQ ID NO: 5175598 - DNA, 20 bp, Homo sapiens
agaacaaagctgttaaactg

SEQ ID NO: 5175599 - DNA, 22 bp, Homo sapiens
agaacaaagggccaaatagagt

SEQ ID NO: 5175600 - DNA, 16 bp, Homo sapiens
agaacaaagtgagaca

SEQ ID NO: 5175601 - DNA, 20 bp, Homo sapiens
agaacaaagtgagacagtcc

SEQ ID NO: 5175602 - DNA, 22 bp, Homo sapiens
agaacaaatatgattctcctct

SEQ ID NO: 5175603 - DNA, 14 bp, Homo sapiens
agaacaaatattca

SEQ ID NO: 5175604 - DNA, 13 bp, Homo sapiens
agaacaaatgtgt

SEQ ID NO: 5175605 - DNA, 16 bp, Homo sapiens
agaacaacaaagacat

SEQ ID NO: 5175606 - DNA, 13 bp, Homo sapiens
agaacaacaacaa

SEQ ID NO: 5175607 - DNA, 22 bp, Homo sapiens
agaacaacaacaaagcatgctc

SEQ ID NO: 5175608 - DNA, 21 bp, Homo sapiens
agaacaacaacaacaataaca

SEQ ID NO: 5175609 - DNA, 14 bp, Homo sapiens
agaacaacacttgt

SEQ ID NO: 5175610 - DNA, 18 bp, Homo sapiens
agaacaacatatacaaca

SEQ ID NO: 5175611 - DNA, 18 bp, Homo sapiens
agaacaactttagcatca

SEQ ID NO: 5175612 - DNA, 23 bp, Homo sapiens
agaacaagcaaatataaacagca

SEQ ID NO: 5175613 - DNA, 15 bp, Homo sapiens
agaacaagccagagc

SEQ ID NO: 5175614 - DNA, 22 bp, Homo sapiens
agaacaagcccaaatttaattt

SEQ ID NO: 5175615 - DNA, 10 bp, Homo sapiens
agaacaaggc

SEQ ID NO: 5175616 - DNA, 20 bp, Homo sapiens
agaacaagtcacagctgcag

SEQ ID NO: 5175617 - DNA, 22 bp, Homo sapiens
agaacaagtcacagctgcagct

SEQ ID NO: 5175618 - DNA, 23 bp, Homo sapiens
agaacaagtcacagctgcagctg

SEQ ID NO: 5175619 - DNA, 19 bp, Homo sapiens
agaacaagtgcctcctgga

SEQ ID NO: 5175620 - DNA, 23 bp, Homo sapiens
agaacaagttttggcagccatga

SEQ ID NO: 5175621 - DNA, 20 bp, Homo sapiens
agaacaatattgactttgtc

SEQ ID NO: 5175622 - DNA, 14 bp, Homo sapiens
agaacaatcactat

SEQ ID NO: 5175623 - DNA, 17 bp, Homo sapiens
agaacaatgtcagaaac

SEQ ID NO: 5175624 - DNA, 22 bp, Homo sapiens
agaacaattacatgtaaacaaa

SEQ ID NO: 5175625 - DNA, 15 bp, Homo sapiens
agaacaattttcttg

SEQ ID NO: 5175626 - DNA, 22 bp, Homo sapiens
agaacacaaagcggggggaggg

SEQ ID NO: 5175627 - DNA, 16 bp, Homo sapiens
agaacacaaatgtcta

SEQ ID NO: 5175628 - DNA, 22 bp, Homo sapiens
agaacacaagccacgcctgcga

SEQ ID NO: 5175629 - DNA, 23 bp, Homo sapiens
agaacacaagggatataaaatga

SEQ ID NO: 5175630 - DNA, 16 bp, Homo sapiens
agaacacaaggtcatt

SEQ ID NO: 5175631 - DNA, 15 bp, Homo sapiens
agaacacatggctgg

SEQ ID NO: 5175632 - DNA, 13 bp, Homo sapiens
agaacaccaagta

SEQ ID NO: 5175633 - DNA, 15 bp, Homo sapiens
agaacaccaagtaaa

SEQ ID NO: 5175634 - DNA, 17 bp, Homo sapiens
agaacacccactggcca

SEQ ID NO: 5175635 - DNA, 15 bp, Homo sapiens
agaacaccctctaaa

SEQ ID NO: 5175636 - DNA, 21 bp, Homo sapiens
agaacacctgccttctaccct

SEQ ID NO: 5175637 - DNA, 18 bp, Homo sapiens
agaacacctggccgggtc

SEQ ID NO: 5175638 - DNA, 14 bp, Homo sapiens
agaacacgcgtatt

SEQ ID NO: 5175639 - DNA, 13 bp, Homo sapiens
agaacactaacct

SEQ ID NO: 5175640 - DNA, 18 bp, Homo sapiens
agaacactaactcaccag

SEQ ID NO: 5175641 - DNA, 20 bp, Homo sapiens
agaacactaactcaccagcc

SEQ ID NO: 5175642 - DNA, 14 bp, Homo sapiens
agaacactaattca

SEQ ID NO: 5175643 - DNA, 17 bp, Homo sapiens
agaacactattttcaga

SEQ ID NO: 5175644 - DNA, 22 bp, Homo sapiens
agaacactattttcagaatctg

SEQ ID NO: 5175645 - DNA, 14 bp, Homo sapiens
agaacactgtgaaa

SEQ ID NO: 5175646 - DNA, 17 bp, Homo sapiens
agaacacttcagacaca

SEQ ID NO: 5175647 - DNA, 20 bp, Homo sapiens
agaacagaaaacaacaaaaa

SEQ ID NO: 5175648 - DNA, 21 bp, Homo sapiens
agaacagaaaacaacaaaaaa

SEQ ID NO: 5175649 - DNA, 18 bp, Homo sapiens
agaacagaggcatttaaa

SEQ ID NO: 5175650 - DNA, 16 bp, Homo sapiens
agaacagataaagatt

SEQ ID NO: 5175651 - DNA, 18 bp, Homo sapiens
agaacagatgctgagcca

SEQ ID NO: 5175652 - DNA, 16 bp, Homo sapiens
agaacagatggctgtg

SEQ ID NO: 5175653 - DNA, 18 bp, Homo sapiens
agaacagatggctgtgaa

SEQ ID NO: 5175654 - DNA, 20 bp, Homo sapiens
agaacagatggctgtgaaaa

SEQ ID NO: 5175655 - DNA, 13 bp, Homo sapiens
agaacagcaggcc

SEQ ID NO: 5175656 - DNA, 22 bp, Homo sapiens
agaacagcatcatgtcataaac

SEQ ID NO: 5175657 - DNA, 14 bp, Homo sapiens
agaacagcatggcc

SEQ ID NO: 5175658 - DNA, 18 bp, Homo sapiens
agaacagccctcggcctc

SEQ ID NO: 5175659 - DNA, 13 bp, Homo sapiens
agaacagccgcct

SEQ ID NO: 5175660 - DNA, 22 bp, Homo sapiens
agaacagccgctcctgtctgcc

SEQ ID NO: 5175661 - DNA, 18 bp, Homo sapiens
agaacagctaacaataaa

SEQ ID NO: 5175662 - DNA, 19 bp, Homo sapiens
agaacagctaacaataaag

SEQ ID NO: 5175663 - DNA, 12 bp, Homo sapiens
agaacagctgtt

SEQ ID NO: 5175664 - DNA, 13 bp, Homo sapiens
agaacagcttcag

SEQ ID NO: 5175665 - DNA, 16 bp, Homo sapiens
agaacagcttcaggtt

SEQ ID NO: 5175666 - DNA, 22 bp, Homo sapiens
agaacaggaggtgtgaatgcac

SEQ ID NO: 5175667 - DNA, 23 bp, Homo sapiens
agaacaggaggtgtgaatgcacg

SEQ ID NO: 5175668 - DNA, 17 bp, Homo sapiens
agaacagggtttctcag

SEQ ID NO: 5175669 - DNA, 17 bp, Homo sapiens
agaacaggtgggctgta

SEQ ID NO: 5175670 - DNA, 13 bp, Homo sapiens
agaacagtacatt

SEQ ID NO: 5175671 - DNA, 16 bp, Homo sapiens
agaacagtacattttt

SEQ ID NO: 5175672 - DNA, 18 bp, Homo sapiens
agaacagtaggattgctg

SEQ ID NO: 5175673 - DNA, 15 bp, Homo sapiens
agaacagtcatgtat

SEQ ID NO: 5175674 - DNA, 23 bp, Homo sapiens
agaacagtgagaaagggcataca

SEQ ID NO: 5175675 - DNA, 14 bp, Homo sapiens
agaacagtgatttt

SEQ ID NO: 5175676 - DNA, 21 bp, Homo sapiens
agaacagtgcttgccacagag

SEQ ID NO: 5175677 - DNA, 18 bp, Homo sapiens
agaacagtggttgcctgg

SEQ ID NO: 5175678 - DNA, 19 bp, Homo sapiens
agaacagtggttgcctggg

SEQ ID NO: 5175679 - DNA, 20 bp, Homo sapiens
agaacagtggttgcctgggg

SEQ ID NO: 5175680 - DNA, 14 bp, Homo sapiens
agaacagtgttgaa

SEQ ID NO: 5175681 - DNA, 20 bp, Homo sapiens
agaacagtgtttgattttta

SEQ ID NO: 5175682 - DNA, 21 bp, Homo sapiens
agaacagttaagcagccgcca

SEQ ID NO: 5175683 - DNA, 19 bp, Homo sapiens
agaacagtttcatcaggac

SEQ ID NO: 5175684 - DNA, 15 bp, Homo sapiens
agaacagtttgtaca

SEQ ID NO: 5175685 - DNA, 17 bp, Homo sapiens
agaacagtttgtacaga

SEQ ID NO: 5175686 - DNA, 20 bp, Homo sapiens
agaacataaaggtaaaacaa

SEQ ID NO: 5175687 - DNA, 22 bp, Homo sapiens
agaacatacaaggacattcact

SEQ ID NO: 5175688 - DNA, 14 bp, Homo sapiens
agaacatactgttc

SEQ ID NO: 5175689 - DNA, 11 bp, Homo sapiens
agaacatagaa

SEQ ID NO: 5175690 - DNA, 22 bp, Homo sapiens
agaacatagtttaagttgatta

SEQ ID NO: 5175691 - DNA, 16 bp, Homo sapiens
agaacatcattagaac

SEQ ID NO: 5175692 - DNA, 15 bp, Homo sapiens
agaacatccaaggag

SEQ ID NO: 5175693 - DNA, 18 bp, Homo sapiens
agaacatccaaggagaaa

SEQ ID NO: 5175694 - DNA, 13 bp, Homo sapiens
agaacatccctcc

SEQ ID NO: 5175695 - DNA, 17 bp, Homo sapiens
agaacatccctgccagc

SEQ ID NO: 5175696 - DNA, 15 bp, Homo sapiens
agaacatccctgggc

SEQ ID NO: 5175697 - DNA, 16 bp, Homo sapiens
agagacgcaagggaga

SEQ ID NO: 5175698 - DNA, 15 bp, Homo sapiens
agagacgcagccctg

SEQ ID NO: 5175699 - DNA, 18 bp, Homo sapiens
agagacgccctatttcta

SEQ ID NO: 5175700 - DNA, 14 bp, Homo sapiens
agagacggcagaaa

SEQ ID NO: 5175701 - DNA, 22 bp, Homo sapiens
agagacggcagaaaacagagcc

SEQ ID NO: 5175702 - DNA, 14 bp, Homo sapiens
agagacggcagccc

SEQ ID NO: 5175703 - DNA, 15 bp, Homo sapiens
agagacggcagcccc

SEQ ID NO: 5175704 - DNA, 16 bp, Homo sapiens
agagacggtgtcttgt

SEQ ID NO: 5175705 - DNA, 21 bp, Homo sapiens
agagacggtgtcttgttctgt

SEQ ID NO: 5175706 - DNA, 18 bp, Homo sapiens
agagactaaggggcagct

SEQ ID NO: 5175707 - DNA, 17 bp, Homo sapiens
agagactaatgttggac

SEQ ID NO: 5175708 - DNA, 18 bp, Homo sapiens
agagactactctgcctga

SEQ ID NO: 5175709 - DNA, 14 bp, Homo sapiens
agagactagacaaa

SEQ ID NO: 5175710 - DNA, 19 bp, Homo sapiens
agagactcaaagagactcc

SEQ ID NO: 5175711 - DNA, 15 bp, Homo sapiens
agagactcagatgag

SEQ ID NO: 5175712 - DNA, 13 bp, Homo sapiens
agagactcagcct

SEQ ID NO: 5175713 - DNA, 14 bp, Homo sapiens
agagactcagcctg

SEQ ID NO: 5175714 - DNA, 20 bp, Homo sapiens
agagactcagcgctcctcct

SEQ ID NO: 5175715 - DNA, 20 bp, Homo sapiens
agagactcagggccccagca

SEQ ID NO: 5175716 - DNA, 21 bp, Homo sapiens
agagactcatttcacagcctt

SEQ ID NO: 5175717 - DNA, 16 bp, Homo sapiens
agagactccagctggg

SEQ ID NO: 5175718 - DNA, 16 bp, Homo sapiens
agagactcccatgaag

SEQ ID NO: 5175719 - DNA, 17 bp, Homo sapiens
agagactcccatgaagc

SEQ ID NO: 5175720 - DNA, 21 bp, Homo sapiens
agagactcccatgaagccttt

SEQ ID NO: 5175721 - DNA, 23 bp, Homo sapiens
agagactcctgaaggtctgggtc

SEQ ID NO: 5175722 - DNA, 14 bp, Homo sapiens
agagactcctgcag

SEQ ID NO: 5175723 - DNA, 20 bp, Homo sapiens
agagactcctgcaggcagcc

SEQ ID NO: 5175724 - DNA, 22 bp, Homo sapiens
agagactcctgcaggcagccag

SEQ ID NO: 5175725 - DNA, 23 bp, Homo sapiens
agagactcctgcaggcagccagg

SEQ ID NO: 5175726 - DNA, 22 bp, Homo sapiens
agagactccttgagagaccagg

SEQ ID NO: 5175727 - DNA, 12 bp, Homo sapiens
agagactctatt

SEQ ID NO: 5175728 - DNA, 15 bp, Homo sapiens
agagactctatttta

SEQ ID NO: 5175729 - DNA, 18 bp, Homo sapiens
agagactctattttaatg

SEQ ID NO: 5175730 - DNA, 20 bp, Homo sapiens
agagactctattttaatgta

SEQ ID NO: 5175731 - DNA, 17 bp, Homo sapiens
agagactctcctgcctc

SEQ ID NO: 5175732 - DNA, 19 bp, Homo sapiens
agagactctcttagggaaa

SEQ ID NO: 5175733 - DNA, 16 bp, Homo sapiens
agagactctgtgatct

SEQ ID NO: 5175734 - DNA, 17 bp, Homo sapiens
agagactctgtgatcta

SEQ ID NO: 5175735 - DNA, 18 bp, Homo sapiens
agagactctgtgatctaa

SEQ ID NO: 5175736 - DNA, 24 bp, Homo sapiens
agagactctttatttttctctttc

SEQ ID NO: 5175737 - DNA, 13 bp, Homo sapiens
agagactgaaagc

SEQ ID NO: 5175738 - DNA, 23 bp, Homo sapiens
agagactgaaagcagcagctagg

SEQ ID NO: 5175739 - DNA, 20 bp, Homo sapiens
agagactgagcagccgccag

SEQ ID NO: 5175740 - DNA, 20 bp, Homo sapiens
agagactgagggagagactc

SEQ ID NO: 5175741 - DNA, 19 bp, Homo sapiens
agagactgatcatccaggc

SEQ ID NO: 5175742 - DNA, 17 bp, Homo sapiens
agagactgcaagctgct

SEQ ID NO: 5175743 - DNA, 13 bp, Homo sapiens
agagactgcccac

SEQ ID NO: 5175744 - DNA, 19 bp, Homo sapiens
agagactgcccaccctggg

SEQ ID NO: 5175745 - DNA, 20 bp, Homo sapiens
agagactgcccaccctgggc

SEQ ID NO: 5175746 - DNA, 21 bp, Homo sapiens
agagactgcccaccctgggcc

SEQ ID NO: 5175747 - DNA, 13 bp, Homo sapiens
agagactgccctt

SEQ ID NO: 5175748 - DNA, 17 bp, Homo sapiens
agagactgcccttctca

SEQ ID NO: 5175749 - DNA, 15 bp, Homo sapiens
agagactgcgttctg

SEQ ID NO: 5175750 - DNA, 22 bp, Homo sapiens
agagactgcgttctgcaagcat

SEQ ID NO: 5175751 - DNA, 17 bp, Homo sapiens
agagactggagcatctg

SEQ ID NO: 5175752 - DNA, 13 bp, Homo sapiens
agagactggcagc

SEQ ID NO: 5175753 - DNA, 14 bp, Homo sapiens
agagactggcagcc

SEQ ID NO: 5175754 - DNA, 17 bp, Homo sapiens
agagactggcagccagg

SEQ ID NO: 5175755 - DNA, 22 bp, Homo sapiens
agagactgggagccacttctcc

SEQ ID NO: 5175756 - DNA, 22 bp, Homo sapiens
agagactgggcctaggccagga

SEQ ID NO: 5175757 - DNA, 22 bp, Homo sapiens
agagactggttagtgatgcagt

SEQ ID NO: 5175758 - DNA, 19 bp, Homo sapiens
agagactggttttttccag

SEQ ID NO: 5175759 - DNA, 13 bp, Homo sapiens
agagactgtagat

SEQ ID NO: 5175760 - DNA, 22 bp, Homo sapiens
agagactgtagattgcttctgt

SEQ ID NO: 5175761 - DNA, 14 bp, Homo sapiens
agagactgtgccat

SEQ ID NO: 5175762 - DNA, 19 bp, Homo sapiens
agagactgtgcttgggagc

SEQ ID NO: 5175763 - DNA, 15 bp, Homo sapiens
agagactgtggggag

SEQ ID NO: 5175764 - DNA, 19 bp, Homo sapiens
agagacttaaaggacagga

SEQ ID NO: 5175765 - DNA, 15 bp, Homo sapiens
agagacttagaagca

SEQ ID NO: 5175766 - DNA, 16 bp, Homo sapiens
agagacttagaagcat

SEQ ID NO: 5175767 - DNA, 20 bp, Homo sapiens
agagacttctaggaggatgc

SEQ ID NO: 5175768 - DNA, 22 bp, Homo sapiens
agagacttctaggaggatgctg

SEQ ID NO: 5175769 - DNA, 18 bp, Homo sapiens
agagacttctctgtaagt

SEQ ID NO: 5175770 - DNA, 18 bp, Homo sapiens
agagacttgcagttagac

SEQ ID NO: 5175771 - DNA, 21 bp, Homo sapiens
agagacttggaagaggaggag

SEQ ID NO: 5175772 - DNA, 18 bp, Homo sapiens
agagacttggatgaggag

SEQ ID NO: 5175773 - DNA, 18 bp, Homo sapiens
agagacttgttttggatg

SEQ ID NO: 5175774 - DNA, 12 bp, Homo sapiens
agagagaaaaag

SEQ ID NO: 5175775 - DNA, 19 bp, Homo sapiens
agagagaaaaagagagagc

SEQ ID NO: 5175776 - DNA, 20 bp, Homo sapiens
agagagaaaaagagagagca

SEQ ID NO: 5175777 - DNA, 14 bp, Homo sapiens
agagagaaaaagat

SEQ ID NO: 5175778 - DNA, 21 bp, Homo sapiens
agagagaaaacttatttgagt

SEQ ID NO: 5175779 - DNA, 11 bp, Homo sapiens
agagagaaaat

SEQ ID NO: 5175780 - DNA, 15 bp, Homo sapiens
agagagaaaataaaa

SEQ ID NO: 5175781 - DNA, 21 bp, Homo sapiens
agagagaaagaagtaggcatg

SEQ ID NO: 5175782 - DNA, 15 bp, Homo sapiens
agagagaaagccagg

SEQ ID NO: 5175783 - DNA, 18 bp, Homo sapiens
agagagaaatcaggcctg

SEQ ID NO: 5175784 - DNA, 13 bp, Homo sapiens
agagagaaattct

SEQ ID NO: 5175785 - DNA, 14 bp, Homo sapiens
agagagaaattctg

SEQ ID NO: 5175786 - DNA, 21 bp, Homo sapiens
agagagaaattctgttaaaat

SEQ ID NO: 5175787 - DNA, 23 bp, Homo sapiens
agagagaaccaggagggtaacag

SEQ ID NO: 5175788 - DNA, 18 bp, Homo sapiens
agagagaacctaactgta

SEQ ID NO: 5175789 - DNA, 22 bp, Homo sapiens
agagagaacctaactgtatctt

SEQ ID NO: 5175790 - DNA, 9 bp, Homo sapiens
agagagaag

SEQ ID NO: 5175791 - DNA, 18 bp, Homo sapiens
agagagaagacccttctc

SEQ ID NO: 5175792 - DNA, 16 bp, Homo sapiens
agagagaagagcccca

SEQ ID NO: 5175793 - DNA, 18 bp, Homo sapiens
agagagaagagtccagga

SEQ ID NO: 5175794 - DNA, 17 bp, Homo sapiens
agagagaagccagccac

SEQ ID NO: 5175795 - DNA, 12 bp, Homo sapiens
agagagaataaa

SEQ ID NO: 5175796 - DNA, 17 bp, Homo sapiens
agagagaatagagctgc

SEQ ID NO: 5175797 - DNA, 21 bp, Homo sapiens
agagagaatagagctgccact

SEQ ID NO: 5175798 - DNA, 22 bp, Homo sapiens
agagagaatagagctgccactg

SEQ ID NO: 5175799 - DNA, 19 bp, Homo sapiens
agagagaatcagacctggg

SEQ ID NO: 5175800 - DNA, 21 bp, Homo sapiens
agagagaatctcaagattcta

SEQ ID NO: 5175801 - DNA, 14 bp, Homo sapiens
agagagaatgagag

SEQ ID NO: 5175802 - DNA, 23 bp, Homo sapiens
agagagaatgagagcgacacaga

SEQ ID NO: 5175803 - DNA, 13 bp, Homo sapiens
agagagacaaaat

SEQ ID NO: 5175804 - DNA, 21 bp, Homo sapiens
agagagacaacttgctccttt

SEQ ID NO: 5175805 - DNA, 20 bp, Homo sapiens
agagagacagagacagagag

SEQ ID NO: 5175806 - DNA, 21 bp, Homo sapiens
agagagacagagacagagaga

SEQ ID NO: 5175807 - DNA, 17 bp, Homo sapiens
agagagacagcacaggc

SEQ ID NO: 5175808 - DNA, 15 bp, Homo sapiens
agagagacaggcagc

SEQ ID NO: 5175809 - DNA, 16 bp, Homo sapiens
agagagacatggaaaa

SEQ ID NO: 5175810 - DNA, 22 bp, Homo sapiens
agagagaccccgcacccggctc

SEQ ID NO: 5175811 - DNA, 15 bp, Homo sapiens
agagagaccctgcca

SEQ ID NO: 5175812 - DNA, 18 bp, Homo sapiens
agagagactcaaagagac

SEQ ID NO: 5175813 - DNA, 13 bp, Homo sapiens
agagagactgatg

SEQ ID NO: 5175814 - DNA, 12 bp, Homo sapiens
agagagagaaaa

SEQ ID NO: 5175815 - DNA, 14 bp, Homo sapiens
agagagagaaagag

SEQ ID NO: 5175816 - DNA, 10 bp, Homo sapiens
agagagagag

SEQ ID NO: 5175817 - DNA, 13 bp, Homo sapiens
agagagagagaaa

SEQ ID NO: 5175818 - DNA, 14 bp, Homo sapiens
agagagagagaaaa

SEQ ID NO: 5175819 - DNA, 14 bp, Homo sapiens
agagagagagaaat

SEQ ID NO: 5175820 - DNA, 17 bp, Homo sapiens
agagagagagacagaga

SEQ ID NO: 5175821 - DNA, 12 bp, Homo sapiens
agagagagagag

SEQ ID NO: 5175822 - DNA, 15 bp, Homo sapiens
agagagagagagaaa

SEQ ID NO: 5175823 - DNA, 15 bp, Homo sapiens
agagagagagagaga

SEQ ID NO: 5175824 - DNA, 14 bp, Homo sapiens
agagagagaggaca

SEQ ID NO: 5175825 - DNA, 16 bp, Homo sapiens
agagagagaggacaga

SEQ ID NO: 5175826 - DNA, 21 bp, Homo sapiens
agagagagccatgaagcatta

SEQ ID NO: 5175827 - DNA, 22 bp, Homo sapiens
agagagaggaggcagccccctc

SEQ ID NO: 5175828 - DNA, 15 bp, Homo sapiens
agagagaggcaatgg

SEQ ID NO: 5175829 - DNA, 14 bp, Homo sapiens
agagagaggcagaa

SEQ ID NO: 5175830 - DNA, 15 bp, Homo sapiens
agagagaggctgcct

SEQ ID NO: 5175831 - DNA, 12 bp, Homo sapiens
agagagagggcg

SEQ ID NO: 5175832 - DNA, 13 bp, Homo sapiens
agagagaggggag

SEQ ID NO: 5175833 - DNA, 15 bp, Homo sapiens
agagagagtgagagc

SEQ ID NO: 5175834 - DNA, 16 bp, Homo sapiens
agagagagtgagagca

SEQ ID NO: 5175835 - DNA, 22 bp, Homo sapiens
agagagagtgagagcacaaaga

SEQ ID NO: 5175836 - DNA, 17 bp, Homo sapiens
agagagatgagaagcca

SEQ ID NO: 5175837 - DNA, 16 bp, Homo sapiens
agagagatgctgctcc

SEQ ID NO: 5175838 - DNA, 17 bp, Homo sapiens
agagagatgggagctcc

SEQ ID NO: 5175839 - DNA, 17 bp, Homo sapiens
agagagattggccagca

SEQ ID NO: 5175840 - DNA, 24 bp, Homo sapiens
agagagattgggactgagtgctga

SEQ ID NO: 5175841 - DNA, 15 bp, Homo sapiens
agagagcaaacatag

SEQ ID NO: 5175842 - DNA, 15 bp, Homo sapiens
agagagcagaaataa

SEQ ID NO: 5175843 - DNA, 16 bp, Homo sapiens
agagagcagcgcccag

SEQ ID NO: 5175844 - DNA, 17 bp, Homo sapiens
agagagcagcgcccagg

SEQ ID NO: 5175845 - DNA, 23 bp, Homo sapiens
agagagcagcttctgccacttcc

SEQ ID NO: 5175846 - DNA, 14 bp, Homo sapiens
agagagcaggcagg

SEQ ID NO: 5175847 - DNA, 13 bp, Homo sapiens
agagagcagggga

SEQ ID NO: 5175848 - DNA, 15 bp, Homo sapiens
agagagcagtgcttt

SEQ ID NO: 5175849 - DNA, 17 bp, Homo sapiens
agagagcagtgcttttg

SEQ ID NO: 5175850 - DNA, 15 bp, Homo sapiens
agagagcagtggcag

SEQ ID NO: 5175851 - DNA, 23 bp, Homo sapiens
agagagcatcttttcctcccatt

SEQ ID NO: 5175852 - DNA, 16 bp, Homo sapiens
agagagccaaatctga

SEQ ID NO: 5175853 - DNA, 12 bp, Homo sapiens
agagagccaaga

SEQ ID NO: 5175854 - DNA, 17 bp, Homo sapiens
agagagccaagacggag

SEQ ID NO: 5175855 - DNA, 15 bp, Homo sapiens
agagagccattttgt

SEQ ID NO: 5175856 - DNA, 13 bp, Homo sapiens
agagagcccgagg

SEQ ID NO: 5175857 - DNA, 18 bp, Homo sapiens
agagagcccttcccaggg

SEQ ID NO: 5175858 - DNA, 13 bp, Homo sapiens
agagagcctccct

SEQ ID NO: 5175859 - DNA, 15 bp, Homo sapiens
agagagcctgcagga

SEQ ID NO: 5175860 - DNA, 18 bp, Homo sapiens
agagagcctgcaggatct

SEQ ID NO: 5175861 - DNA, 13 bp, Homo sapiens
agagagccttaac

SEQ ID NO: 5175862 - DNA, 14 bp, Homo sapiens
agagagccttaact

SEQ ID NO: 5175863 - DNA, 18 bp, Homo sapiens
agagagccttaatggatg

SEQ ID NO: 5175864 - DNA, 15 bp, Homo sapiens
agagagcgcgggaga

SEQ ID NO: 5175865 - DNA, 21 bp, Homo sapiens
agagagcgcgggagagagtga

SEQ ID NO: 5175866 - DNA, 21 bp, Homo sapiens
agagagctcatcatcagtctt

SEQ ID NO: 5175867 - DNA, 22 bp, Homo sapiens
agagagctcgctcttgggagtc

SEQ ID NO: 5175868 - DNA, 19 bp, Homo sapiens
agagagctctggccccgct

SEQ ID NO: 5175869 - DNA, 21 bp, Homo sapiens
agagagctgagacccttattt

SEQ ID NO: 5175870 - DNA, 19 bp, Homo sapiens
agagagctgagtgagctga

SEQ ID NO: 5175871 - DNA, 17 bp, Homo sapiens
agagagctgttcccaaa

SEQ ID NO: 5175872 - DNA, 18 bp, Homo sapiens
agagagcttaatgataat

SEQ ID NO: 5175873 - DNA, 14 bp, Homo sapiens
agagaggaaaagct

SEQ ID NO: 5175874 - DNA, 20 bp, Homo sapiens
agagaggaagtggtctgtct

SEQ ID NO: 5175875 - DNA, 17 bp, Homo sapiens
agagaggaatcagactt

SEQ ID NO: 5175876 - DNA, 13 bp, Homo sapiens
agagaggacagct

SEQ ID NO: 5175877 - DNA, 16 bp, Homo sapiens
agaacatccctgggca

SEQ ID NO: 5175878 - DNA, 17 bp, Homo sapiens
agaacatccctgggcaa

SEQ ID NO: 5175879 - DNA, 19 bp, Homo sapiens
agaacatccctgggcaagt

SEQ ID NO: 5175880 - DNA, 21 bp, Homo sapiens
agaacatccctgtcttaactg

SEQ ID NO: 5175881 - DNA, 21 bp, Homo sapiens
agaacatccttaaatgtctaa

SEQ ID NO: 5175882 - DNA, 14 bp, Homo sapiens
agaacatgaatcaa

SEQ ID NO: 5175883 - DNA, 17 bp, Homo sapiens
agaacatgaatcaaaag

SEQ ID NO: 5175884 - DNA, 16 bp, Homo sapiens
agaacatgagtgctga

SEQ ID NO: 5175885 - DNA, 16 bp, Homo sapiens
agaacatgatgggcct

SEQ ID NO: 5175886 - DNA, 13 bp, Homo sapiens
agaacatgcacat

SEQ ID NO: 5175887 - DNA, 14 bp, Homo sapiens
agaacatgcagttt

SEQ ID NO: 5175888 - DNA, 20 bp, Homo sapiens
agaacatgcagtttgaaatt

SEQ ID NO: 5175889 - DNA, 21 bp, Homo sapiens
agaacatgcagtttgaaattc

SEQ ID NO: 5175890 - DNA, 22 bp, Homo sapiens
agaacatggattccactgaaat

SEQ ID NO: 5175891 - DNA, 18 bp, Homo sapiens
agaacatggcctaagggc

SEQ ID NO: 5175892 - DNA, 21 bp, Homo sapiens
agaacatggtgtgtgtctctg

SEQ ID NO: 5175893 - DNA, 22 bp, Homo sapiens
agaacatggtgtgtgtctctga

SEQ ID NO: 5175894 - DNA, 18 bp, Homo sapiens
agaacatgtagaaaacaa

SEQ ID NO: 5175895 - DNA, 19 bp, Homo sapiens
agaacatgttacgtgtgca

SEQ ID NO: 5175896 - DNA, 19 bp, Homo sapiens
agaacatgttggtatttat

SEQ ID NO: 5175897 - DNA, 14 bp, Homo sapiens
agaacatgttttat

SEQ ID NO: 5175898 - DNA, 16 bp, Homo sapiens
agaacattaattatat

SEQ ID NO: 5175899 - DNA, 15 bp, Homo sapiens
agaacattaggcccc

SEQ ID NO: 5175900 - DNA, 18 bp, Homo sapiens
agaacattaggccccagc

SEQ ID NO: 5175901 - DNA, 18 bp, Homo sapiens
agaacattcaatcttgcc

SEQ ID NO: 5175902 - DNA, 22 bp, Homo sapiens
agaacattcacttttgttaaca

SEQ ID NO: 5175903 - DNA, 19 bp, Homo sapiens
agaacattcagctctggag

SEQ ID NO: 5175904 - DNA, 22 bp, Homo sapiens
agaacattcagctctggagaac

SEQ ID NO: 5175905 - DNA, 15 bp, Homo sapiens
agaacattctctcat

SEQ ID NO: 5175906 - DNA, 14 bp, Homo sapiens
agaacattgatctg

SEQ ID NO: 5175907 - DNA, 18 bp, Homo sapiens
agaacattgatctgtttt

SEQ ID NO: 5175908 - DNA, 11 bp, Homo sapiens
agaacattgta

SEQ ID NO: 5175909 - DNA, 16 bp, Homo sapiens
agaacattttaattca

SEQ ID NO: 5175910 - DNA, 19 bp, Homo sapiens
agaacattttactgttgta

SEQ ID NO: 5175911 - DNA, 21 bp, Homo sapiens
agaacattttactgttgtaca

SEQ ID NO: 5175912 - DNA, 17 bp, Homo sapiens
agaacattttataaaac

SEQ ID NO: 5175913 - DNA, 23 bp, Homo sapiens
agaaccaaaaaaaaaaaaggaaa

SEQ ID NO: 5175914 - DNA, 17 bp, Homo sapiens
agaaccaaaaagaggct

SEQ ID NO: 5175915 - DNA, 19 bp, Homo sapiens
agaaccaaaaatcccacct

SEQ ID NO: 5175916 - DNA, 18 bp, Homo sapiens
agaaccaaaagttttcct

SEQ ID NO: 5175917 - DNA, 16 bp, Homo sapiens
agaaccaaagaagaaa

SEQ ID NO: 5175918 - DNA, 17 bp, Homo sapiens
agaaccaaagctcaaat

SEQ ID NO: 5175919 - DNA, 15 bp, Homo sapiens
agaaccaagcttcag

SEQ ID NO: 5175920 - DNA, 16 bp, Homo sapiens
agaaccaagcttcaga

SEQ ID NO: 5175921 - DNA, 21 bp, Homo sapiens
agaaccaagcttcagagccta

SEQ ID NO: 5175922 - DNA, 23 bp, Homo sapiens
agaaccaagcttgtctttaaagt

SEQ ID NO: 5175923 - DNA, 21 bp, Homo sapiens
agaaccacacttgaaaccttt

SEQ ID NO: 5175924 - DNA, 13 bp, Homo sapiens
agaaccacagcag

SEQ ID NO: 5175925 - DNA, 15 bp, Homo sapiens
agaaccacagcagac

SEQ ID NO: 5175926 - DNA, 18 bp, Homo sapiens
agaaccacagcagacacc

SEQ ID NO: 5175927 - DNA, 16 bp, Homo sapiens
agaaccaccactgcct

SEQ ID NO: 5175928 - DNA, 22 bp, Homo sapiens
agaaccacgatgaccacagact

SEQ ID NO: 5175929 - DNA, 18 bp, Homo sapiens
agaaccactccttcatgt

SEQ ID NO: 5175930 - DNA, 15 bp, Homo sapiens
agaaccacttggctg

SEQ ID NO: 5175931 - DNA, 16 bp, Homo sapiens
agaaccagagggcatg

SEQ ID NO: 5175932 - DNA, 21 bp, Homo sapiens
agaaccagatcgtacttgaaa

SEQ ID NO: 5175933 - DNA, 17 bp, Homo sapiens
agaaccagcactcccag

SEQ ID NO: 5175934 - DNA, 19 bp, Homo sapiens
agaaccagcactcccaggg

SEQ ID NO: 5175935 - DNA, 22 bp, Homo sapiens
agaaccagcactcccagggccc

SEQ ID NO: 5175936 - DNA, 15 bp, Homo sapiens
agaaccagcccagcc

SEQ ID NO: 5175937 - DNA, 17 bp, Homo sapiens
agaaccagcccagcctg

SEQ ID NO: 5175938 - DNA, 17 bp, Homo sapiens
agaaccagccgtatttt

SEQ ID NO: 5175939 - DNA, 19 bp, Homo sapiens
agaaccagccgtattttac

SEQ ID NO: 5175940 - DNA, 22 bp, Homo sapiens
agaaccagccgtattttacatg

SEQ ID NO: 5175941 - DNA, 17 bp, Homo sapiens
agaaccaggcaacttgg

SEQ ID NO: 5175942 - DNA, 19 bp, Homo sapiens
agaaccaggcatggaaaga

SEQ ID NO: 5175943 - DNA, 20 bp, Homo sapiens
agaaccagtccccccaccct

SEQ ID NO: 5175944 - DNA, 16 bp, Homo sapiens
agaaccagtccctctg

SEQ ID NO: 5175945 - DNA, 14 bp, Homo sapiens
agaaccagtctcct

SEQ ID NO: 5175946 - DNA, 17 bp, Homo sapiens
agaaccagtctttcaac

SEQ ID NO: 5175947 - DNA, 22 bp, Homo sapiens
agaaccagtctttcaactcatt

SEQ ID NO: 5175948 - DNA, 21 bp, Homo sapiens
agaaccagttgttttgtcttg

SEQ ID NO: 5175949 - DNA, 22 bp, Homo sapiens
agaaccatccctattttgtatt

SEQ ID NO: 5175950 - DNA, 10 bp, Homo sapiens
agaaccatct

SEQ ID NO: 5175951 - DNA, 23 bp, Homo sapiens
agaaccattcactggcaaatgga

SEQ ID NO: 5175952 - DNA, 14 bp, Homo sapiens
agaaccatttgcaa

SEQ ID NO: 5175953 - DNA, 14 bp, Homo sapiens
agaacccacagtga

SEQ ID NO: 5175954 - DNA, 23 bp, Homo sapiens
agaacccacataaaagccccagc

SEQ ID NO: 5175955 - DNA, 20 bp, Homo sapiens
agaacccagggctctgcccc

SEQ ID NO: 5175956 - DNA, 21 bp, Homo sapiens
agaacccagggctctgcccca

SEQ ID NO: 5175957 - DNA, 21 bp, Homo sapiens
agaaccccccgcaatgtgctt

SEQ ID NO: 5175958 - DNA, 14 bp, Homo sapiens
agaacccccctccc

SEQ ID NO: 5175959 - DNA, 15 bp, Homo sapiens
agaacccccctcccc

SEQ ID NO: 5175960 - DNA, 17 bp, Homo sapiens
agaacccctacatgaaa

SEQ ID NO: 5175961 - DNA, 22 bp, Homo sapiens
agaacccctggctccaggccag

SEQ ID NO: 5175962 - DNA, 15 bp, Homo sapiens
agaaccctccacccc

SEQ ID NO: 5175963 - DNA, 17 bp, Homo sapiens
agaaccctctgtcccac

SEQ ID NO: 5175964 - DNA, 20 bp, Homo sapiens
agaaccctggtgaggaagct

SEQ ID NO: 5175965 - DNA, 15 bp, Homo sapiens
agaaccgagcaaaga

SEQ ID NO: 5175966 - DNA, 16 bp, Homo sapiens
agaaccgagcaaagat

SEQ ID NO: 5175967 - DNA, 20 bp, Homo sapiens
agaaccgagcaaagatcaaa

SEQ ID NO: 5175968 - DNA, 21 bp, Homo sapiens
agaaccgagcaaagatcaaaa

SEQ ID NO: 5175969 - DNA, 23 bp, Homo sapiens
agaaccgcggccgaagcccacca

SEQ ID NO: 5175970 - DNA, 17 bp, Homo sapiens
agaaccggtcccagcct

SEQ ID NO: 5175971 - DNA, 19 bp, Homo sapiens
agaaccggtcccagcctgg

SEQ ID NO: 5175972 - DNA, 22 bp, Homo sapiens
agaaccggtcccagcctgggct

SEQ ID NO: 5175973 - DNA, 23 bp, Homo sapiens
agaaccggtcccagcctgggctc

SEQ ID NO: 5175974 - DNA, 13 bp, Homo sapiens
agaacctaacatg

SEQ ID NO: 5175975 - DNA, 16 bp, Homo sapiens
agaacctaatgcactc

SEQ ID NO: 5175976 - DNA, 21 bp, Homo sapiens
agaacctacaaaagcttgtgt

SEQ ID NO: 5175977 - DNA, 22 bp, Homo sapiens
agaacctacaaaagcttgtgta

SEQ ID NO: 5175978 - DNA, 22 bp, Homo sapiens
agaacctactgttcctttcaga

SEQ ID NO: 5175979 - DNA, 23 bp, Homo sapiens
agaacctcaggtacggagaagaa

SEQ ID NO: 5175980 - DNA, 22 bp, Homo sapiens
agaacctctaagtgctgctgtg

SEQ ID NO: 5175981 - DNA, 21 bp, Homo sapiens
agaacctgcacacaggacagc

SEQ ID NO: 5175982 - DNA, 21 bp, Homo sapiens
agaacctgcgcaccccgttcc

SEQ ID NO: 5175983 - DNA, 23 bp, Homo sapiens
agaacctggaaaaattccagaag

SEQ ID NO: 5175984 - DNA, 12 bp, Homo sapiens
agaacctggaga

SEQ ID NO: 5175985 - DNA, 14 bp, Homo sapiens
agaacctgggctgt

SEQ ID NO: 5175986 - DNA, 20 bp, Homo sapiens
agaacctgtagaagatgacc

SEQ ID NO: 5175987 - DNA, 14 bp, Homo sapiens
agaacctgtccttg

SEQ ID NO: 5175988 - DNA, 20 bp, Homo sapiens
agaacctgtctcctactttg

SEQ ID NO: 5175989 - DNA, 22 bp, Homo sapiens
agaacctgtctcctactttgaa

SEQ ID NO: 5175990 - DNA, 20 bp, Homo sapiens
agaaccttaatgacaacact

SEQ ID NO: 5175991 - DNA, 18 bp, Homo sapiens
agaaccttactggcactg

SEQ ID NO: 5175992 - DNA, 23 bp, Homo sapiens
agaaccttactggcactgtggca

SEQ ID NO: 5175993 - DNA, 22 bp, Homo sapiens
agaaccttctagaacctgggct

SEQ ID NO: 5175994 - DNA, 12 bp, Homo sapiens
agaaccttctct

SEQ ID NO: 5175995 - DNA, 14 bp, Homo sapiens
agaaccttctctat

SEQ ID NO: 5175996 - DNA, 14 bp, Homo sapiens
agaaccttgcctga

SEQ ID NO: 5175997 - DNA, 14 bp, Homo sapiens
agaaccttggacca

SEQ ID NO: 5175998 - DNA, 15 bp, Homo sapiens
agaaccttgtcccag

SEQ ID NO: 5175999 - DNA, 20 bp, Homo sapiens
agaaccttgtcccagccagt

SEQ ID NO: 5176000 - DNA, 22 bp, Homo sapiens
agaaccttgtgcctggctcaga

SEQ ID NO: 5176001 - DNA, 14 bp, Homo sapiens
agaacctttctgtg

SEQ ID NO: 5176002 - DNA, 21 bp, Homo sapiens
agaacctttggacaagaggaa

SEQ ID NO: 5176003 - DNA, 13 bp, Homo sapiens
agaacctttgtca

SEQ ID NO: 5176004 - DNA, 13 bp, Homo sapiens
agaacgcagccct

SEQ ID NO: 5176005 - DNA, 23 bp, Homo sapiens
agaacgcagccctagagcctgcc

SEQ ID NO: 5176006 - DNA, 22 bp, Homo sapiens
agaacgccagggaccccagaat

SEQ ID NO: 5176007 - DNA, 14 bp, Homo sapiens
agaacgccctgtgt

SEQ ID NO: 5176008 - DNA, 18 bp, Homo sapiens
agaacgcggtgtgtaaca

SEQ ID NO: 5176009 - DNA, 24 bp, Homo sapiens
agaacgcttcgggaaaatattcat

SEQ ID NO: 5176010 - DNA, 20 bp, Homo sapiens
agaacgctttcagggaaaaa

SEQ ID NO: 5176011 - DNA, 18 bp, Homo sapiens
agaacggaggaggctgca

SEQ ID NO: 5176012 - DNA, 14 bp, Homo sapiens
agaacggcttgctt

SEQ ID NO: 5176013 - DNA, 17 bp, Homo sapiens
agaacgggcctccccgg

SEQ ID NO: 5176014 - DNA, 23 bp, Homo sapiens
agaacgggcgtcaggggtgcaca

SEQ ID NO: 5176015 - DNA, 19 bp, Homo sapiens
agaacggggctcttctcat

SEQ ID NO: 5176016 - DNA, 21 bp, Homo sapiens
agaacgggttctcccatgggg

SEQ ID NO: 5176017 - DNA, 20 bp, Homo sapiens
agaacggtgaccgcctcctg

SEQ ID NO: 5176018 - DNA, 18 bp, Homo sapiens
agaacgtactttctgtta

SEQ ID NO: 5176019 - DNA, 22 bp, Homo sapiens
agaacgtattggtccagcttgc

SEQ ID NO: 5176020 - DNA, 22 bp, Homo sapiens
agaacgtatttagccattaccc

SEQ ID NO: 5176021 - DNA, 21 bp, Homo sapiens
agaacgtgtttaattaaattt

SEQ ID NO: 5176022 - DNA, 20 bp, Homo sapiens
agaacgttccctttggggat

SEQ ID NO: 5176023 - DNA, 17 bp, Homo sapiens
agaactaaaatgttcta

SEQ ID NO: 5176024 - DNA, 16 bp, Homo sapiens
agaactaaactcattt

SEQ ID NO: 5176025 - DNA, 14 bp, Homo sapiens
agaactaaatagat

SEQ ID NO: 5176026 - DNA, 18 bp, Homo sapiens
agaactaaatataaattt

SEQ ID NO: 5176027 - DNA, 16 bp, Homo sapiens
agaactaaatgttcta

SEQ ID NO: 5176028 - DNA, 18 bp, Homo sapiens
agaactaaatttttcata

SEQ ID NO: 5176029 - DNA, 20 bp, Homo sapiens
agaactaaatttttcataga

SEQ ID NO: 5176030 - DNA, 22 bp, Homo sapiens
agaactaacactattttatgca

SEQ ID NO: 5176031 - DNA, 22 bp, Homo sapiens
agaactaagaggcccagccctc

SEQ ID NO: 5176032 - DNA, 18 bp, Homo sapiens
agaactaagtaagaaaca

SEQ ID NO: 5176033 - DNA, 19 bp, Homo sapiens
agaactaagtaagaaacac

SEQ ID NO: 5176034 - DNA, 14 bp, Homo sapiens
agaactactgataa

SEQ ID NO: 5176035 - DNA, 20 bp, Homo sapiens
agaactactttgaaaacaat

SEQ ID NO: 5176036 - DNA, 17 bp, Homo sapiens
agaactagaacctggag

SEQ ID NO: 5176037 - DNA, 18 bp, Homo sapiens
agaactagaacctggagg

SEQ ID NO: 5176038 - DNA, 18 bp, Homo sapiens
agaactagccttatttct

SEQ ID NO: 5176039 - DNA, 20 bp, Homo sapiens
agaactaggagtcttcactg

SEQ ID NO: 5176040 - DNA, 15 bp, Homo sapiens
agaactataacattc

SEQ ID NO: 5176041 - DNA, 22 bp, Homo sapiens
agaactataacattcaatttgc

SEQ ID NO: 5176042 - DNA, 16 bp, Homo sapiens
agaactatatgtgaat

SEQ ID NO: 5176043 - DNA, 19 bp, Homo sapiens
agaactatatgtgaatcct

SEQ ID NO: 5176044 - DNA, 14 bp, Homo sapiens
agaactatcatttt

SEQ ID NO: 5176045 - DNA, 17 bp, Homo sapiens
agaactatctgcattat

SEQ ID NO: 5176046 - DNA, 17 bp, Homo sapiens
agaactatgctaatttt

SEQ ID NO: 5176047 - DNA, 17 bp, Homo sapiens
agaactatgtttttgtt

SEQ ID NO: 5176048 - DNA, 17 bp, Homo sapiens
agaactattgtgttttt

SEQ ID NO: 5176049 - DNA, 18 bp, Homo sapiens
agaactatttaaaataaa

SEQ ID NO: 5176050 - DNA, 14 bp, Homo sapiens
agaactcactgggg

SEQ ID NO: 5176051 - DNA, 18 bp, Homo sapiens
agaactcagtgccacacc

SEQ ID NO: 5176052 - DNA, 18 bp, Homo sapiens
agagaggaccccactgga

SEQ ID NO: 5176053 - DNA, 16 bp, Homo sapiens
agagaggacctccatg

SEQ ID NO: 5176054 - DNA, 14 bp, Homo sapiens
agagaggagaaaca

SEQ ID NO: 5176055 - DNA, 17 bp, Homo sapiens
agagaggagaggagaga

SEQ ID NO: 5176056 - DNA, 13 bp, Homo sapiens
agagaggagcacc

SEQ ID NO: 5176057 - DNA, 15 bp, Homo sapiens
agagaggaggagaga

SEQ ID NO: 5176058 - DNA, 13 bp, Homo sapiens
agagaggaggcag

SEQ ID NO: 5176059 - DNA, 20 bp, Homo sapiens
agagaggagtcagagagaat

SEQ ID NO: 5176060 - DNA, 14 bp, Homo sapiens
agagaggagttcaa

SEQ ID NO: 5176061 - DNA, 18 bp, Homo sapiens
agagaggatacatttaat

SEQ ID NO: 5176062 - DNA, 19 bp, Homo sapiens
agagaggatgtgcaagcga

SEQ ID NO: 5176063 - DNA, 17 bp, Homo sapiens
agagaggcacctgctgg

SEQ ID NO: 5176064 - DNA, 16 bp, Homo sapiens
agagaggcagagagcg

SEQ ID NO: 5176065 - DNA, 11 bp, Homo sapiens
agagaggcctg

SEQ ID NO: 5176066 - DNA, 13 bp, Homo sapiens
agagaggcctgct

SEQ ID NO: 5176067 - DNA, 24 bp, Homo sapiens
agagaggcctgggtgtgacctgac

SEQ ID NO: 5176068 - DNA, 18 bp, Homo sapiens
agagaggctaaaatgttt

SEQ ID NO: 5176069 - DNA, 19 bp, Homo sapiens
agagaggctaaaatgtttt

SEQ ID NO: 5176070 - DNA, 19 bp, Homo sapiens
agagaggctcaacaaggaa

SEQ ID NO: 5176071 - DNA, 17 bp, Homo sapiens
agagaggcttgaaggcc

SEQ ID NO: 5176072 - DNA, 20 bp, Homo sapiens
agagagggaagctgaggccc

SEQ ID NO: 5176073 - DNA, 19 bp, Homo sapiens
agagagggacacatgcccc

SEQ ID NO: 5176074 - DNA, 22 bp, Homo sapiens
agagagggagaaacaagtggac

SEQ ID NO: 5176075 - DNA, 23 bp, Homo sapiens
agagagggagaaaggaggagaca

SEQ ID NO: 5176076 - DNA, 15 bp, Homo sapiens
agagagggagaagaa

SEQ ID NO: 5176077 - DNA, 17 bp, Homo sapiens
agagagggaggcaagcc

SEQ ID NO: 5176078 - DNA, 16 bp, Homo sapiens
agagagggatgggttc

SEQ ID NO: 5176079 - DNA, 20 bp, Homo sapiens
agagagggcacatctccaga

SEQ ID NO: 5176080 - DNA, 15 bp, Homo sapiens
agagagggcaggcat

SEQ ID NO: 5176081 - DNA, 15 bp, Homo sapiens
agagagggcccagct

SEQ ID NO: 5176082 - DNA, 14 bp, Homo sapiens
agagagggcgccca

SEQ ID NO: 5176083 - DNA, 20 bp, Homo sapiens
agagagggcgcccagcccag

SEQ ID NO: 5176084 - DNA, 13 bp, Homo sapiens
agagaggggaaga

SEQ ID NO: 5176085 - DNA, 17 bp, Homo sapiens
agagaggggaagaattt

SEQ ID NO: 5176086 - DNA, 19 bp, Homo sapiens
agagaggggaagaatttaa

SEQ ID NO: 5176087 - DNA, 20 bp, Homo sapiens
agagaggggaagaatttaat

SEQ ID NO: 5176088 - DNA, 22 bp, Homo sapiens
agagaggggaataatagaagaa

SEQ ID NO: 5176089 - DNA, 19 bp, Homo sapiens
agagaggggacatttccct

SEQ ID NO: 5176090 - DNA, 21 bp, Homo sapiens
agagaggggcaaatagagagt

SEQ ID NO: 5176091 - DNA, 22 bp, Homo sapiens
agagaggggcaaatagagagtc

SEQ ID NO: 5176092 - DNA, 19 bp, Homo sapiens
agagaggggcagggaagga

SEQ ID NO: 5176093 - DNA, 20 bp, Homo sapiens
agagaggggctgctctccag

SEQ ID NO: 5176094 - DNA, 19 bp, Homo sapiens
agagagggggcactgtggt

SEQ ID NO: 5176095 - DNA, 16 bp, Homo sapiens
agagagggggccacct

SEQ ID NO: 5176096 - DNA, 19 bp, Homo sapiens
agagagggggccacctccc

SEQ ID NO: 5176097 - DNA, 12 bp, Homo sapiens
agagagggggct

SEQ ID NO: 5176098 - DNA, 20 bp, Homo sapiens
agagagggtggtgacctctg

SEQ ID NO: 5176099 - DNA, 19 bp, Homo sapiens
agagaggtagcactctcag

SEQ ID NO: 5176100 - DNA, 16 bp, Homo sapiens
agagaggtagcgagct

SEQ ID NO: 5176101 - DNA, 17 bp, Homo sapiens
agagaggtagcgagctg

SEQ ID NO: 5176102 - DNA, 16 bp, Homo sapiens
agagaggtatttaact

SEQ ID NO: 5176103 - DNA, 17 bp, Homo sapiens
agagaggtggagaactg

SEQ ID NO: 5176104 - DNA, 15 bp, Homo sapiens
agagaggtgggcagc

SEQ ID NO: 5176105 - DNA, 20 bp, Homo sapiens
agagaggttatagagtagaa

SEQ ID NO: 5176106 - DNA, 18 bp, Homo sapiens
agagaggttctggggagg

SEQ ID NO: 5176107 - DNA, 14 bp, Homo sapiens
agagaggtttcgat

SEQ ID NO: 5176108 - DNA, 22 bp, Homo sapiens
agagaggtttgcagtcccaagc

SEQ ID NO: 5176109 - DNA, 18 bp, Homo sapiens
agagagtagctgcagcct

SEQ ID NO: 5176110 - DNA, 22 bp, Homo sapiens
agagagtatggtgctgggtcct

SEQ ID NO: 5176111 - DNA, 15 bp, Homo sapiens
agagagtattctaaa

SEQ ID NO: 5176112 - DNA, 15 bp, Homo sapiens
agagagtcccactgc

SEQ ID NO: 5176113 - DNA, 15 bp, Homo sapiens
agagagtcctctgga

SEQ ID NO: 5176114 - DNA, 22 bp, Homo sapiens
agagagtcctctggatggcacc

SEQ ID NO: 5176115 - DNA, 22 bp, Homo sapiens
agagagtcttttaactttagaa

SEQ ID NO: 5176116 - DNA, 18 bp, Homo sapiens
agagagtgagagagagtg

SEQ ID NO: 5176117 - DNA, 20 bp, Homo sapiens
agagagtgagagagagtgag

SEQ ID NO: 5176118 - DNA, 13 bp, Homo sapiens
agagagtgagagc

SEQ ID NO: 5176119 - DNA, 18 bp, Homo sapiens
agagagtgagagcacaaa

SEQ ID NO: 5176120 - DNA, 13 bp, Homo sapiens
agagagtggagag

SEQ ID NO: 5176121 - DNA, 12 bp, Homo sapiens
agagagtggcaa

SEQ ID NO: 5176122 - DNA, 13 bp, Homo sapiens
agagagtggctgg

SEQ ID NO: 5176123 - DNA, 16 bp, Homo sapiens
agagagtggggcctgc

SEQ ID NO: 5176124 - DNA, 22 bp, Homo sapiens
agagagtggtaaaaaagaaatg

SEQ ID NO: 5176125 - DNA, 16 bp, Homo sapiens
agagagtgttgaaacg

SEQ ID NO: 5176126 - DNA, 21 bp, Homo sapiens
agagagttaataggagtattt

SEQ ID NO: 5176127 - DNA, 23 bp, Homo sapiens
agagagttgtctgtccaggccct

SEQ ID NO: 5176128 - DNA, 18 bp, Homo sapiens
agagagttgttgtgtaca

SEQ ID NO: 5176129 - DNA, 15 bp, Homo sapiens
agagagtttcaaaag

SEQ ID NO: 5176130 - DNA, 15 bp, Homo sapiens
agagagtttgccact

SEQ ID NO: 5176131 - DNA, 20 bp, Homo sapiens
agagataaaaatcatataga

SEQ ID NO: 5176132 - DNA, 15 bp, Homo sapiens
agagataaaacagaa

SEQ ID NO: 5176133 - DNA, 13 bp, Homo sapiens
agagataaatatt

SEQ ID NO: 5176134 - DNA, 15 bp, Homo sapiens
agagataataagatt

SEQ ID NO: 5176135 - DNA, 22 bp, Homo sapiens
agagataatgaggcaactcagc

SEQ ID NO: 5176136 - DNA, 17 bp, Homo sapiens
agagataattcttaaaa

SEQ ID NO: 5176137 - DNA, 13 bp, Homo sapiens
agagatacagagg

SEQ ID NO: 5176138 - DNA, 21 bp, Homo sapiens
agagatacatcttataaactg

SEQ ID NO: 5176139 - DNA, 21 bp, Homo sapiens
agagatacattccctatcaaa

SEQ ID NO: 5176140 - DNA, 22 bp, Homo sapiens
agagataccaagatgccatctg

SEQ ID NO: 5176141 - DNA, 20 bp, Homo sapiens
agagatacccacagagtgtg

SEQ ID NO: 5176142 - DNA, 14 bp, Homo sapiens
agagataccctctg

SEQ ID NO: 5176143 - DNA, 14 bp, Homo sapiens
agagatactctggg

SEQ ID NO: 5176144 - DNA, 21 bp, Homo sapiens
agagatagccgggctccaggg

SEQ ID NO: 5176145 - DNA, 14 bp, Homo sapiens
agagatagcctgtg

SEQ ID NO: 5176146 - DNA, 17 bp, Homo sapiens
agagatagcctgtggcc

SEQ ID NO: 5176147 - DNA, 15 bp, Homo sapiens
agagatagcttctct

SEQ ID NO: 5176148 - DNA, 22 bp, Homo sapiens
agagataggaaggtcatttcca

SEQ ID NO: 5176149 - DNA, 17 bp, Homo sapiens
agagatataaatgaagt

SEQ ID NO: 5176150 - DNA, 13 bp, Homo sapiens
agagatataataa

SEQ ID NO: 5176151 - DNA, 15 bp, Homo sapiens
agagatatatctgaa

SEQ ID NO: 5176152 - DNA, 23 bp, Homo sapiens
agagatatatctgaaaactggaa

SEQ ID NO: 5176153 - DNA, 21 bp, Homo sapiens
agagatatttaggaaaatgct

SEQ ID NO: 5176154 - DNA, 14 bp, Homo sapiens
agagatattttggg

SEQ ID NO: 5176155 - DNA, 15 bp, Homo sapiens
agagatattttgtaa

SEQ ID NO: 5176156 - DNA, 22 bp, Homo sapiens
agagatcaaccccttcgctcct

SEQ ID NO: 5176157 - DNA, 20 bp, Homo sapiens
agagatcacccactcctatg

SEQ ID NO: 5176158 - DNA, 12 bp, Homo sapiens
agagatcagcag

SEQ ID NO: 5176159 - DNA, 15 bp, Homo sapiens
agagatcagcagtgg

SEQ ID NO: 5176160 - DNA, 19 bp, Homo sapiens
agagatcaggaagagaagg

SEQ ID NO: 5176161 - DNA, 15 bp, Homo sapiens
agagatcataaagag

SEQ ID NO: 5176162 - DNA, 17 bp, Homo sapiens
agagatcatatcctcag

SEQ ID NO: 5176163 - DNA, 13 bp, Homo sapiens
agagatcatggaa

SEQ ID NO: 5176164 - DNA, 18 bp, Homo sapiens
agagatccaaaagaagcc

SEQ ID NO: 5176165 - DNA, 15 bp, Homo sapiens
agagatccaaagact

SEQ ID NO: 5176166 - DNA, 21 bp, Homo sapiens
agagatccattgccatcagtg

SEQ ID NO: 5176167 - DNA, 22 bp, Homo sapiens
agagatccattgccatcagtga

SEQ ID NO: 5176168 - DNA, 16 bp, Homo sapiens
agagatcccaggaggt

SEQ ID NO: 5176169 - DNA, 20 bp, Homo sapiens
agagatcccaggaggtgcag

SEQ ID NO: 5176170 - DNA, 15 bp, Homo sapiens
agagatccctgcaga

SEQ ID NO: 5176171 - DNA, 20 bp, Homo sapiens
agagatccctgcagaaccca

SEQ ID NO: 5176172 - DNA, 23 bp, Homo sapiens
agagatcctacttctctgagtca

SEQ ID NO: 5176173 - DNA, 23 bp, Homo sapiens
agagatcgagaccatcctggcca

SEQ ID NO: 5176174 - DNA, 14 bp, Homo sapiens
agagatctacacat

SEQ ID NO: 5176175 - DNA, 13 bp, Homo sapiens
agagatctagaaa

SEQ ID NO: 5176176 - DNA, 18 bp, Homo sapiens
agagatctagaaagtggg

SEQ ID NO: 5176177 - DNA, 19 bp, Homo sapiens
agagatctagaaagtgggt

SEQ ID NO: 5176178 - DNA, 14 bp, Homo sapiens
agagatctcccttc

SEQ ID NO: 5176179 - DNA, 13 bp, Homo sapiens
agagatctgctgt

SEQ ID NO: 5176180 - DNA, 14 bp, Homo sapiens
agagatctgtgtgg

SEQ ID NO: 5176181 - DNA, 16 bp, Homo sapiens
agagatctgtgtggct

SEQ ID NO: 5176182 - DNA, 17 bp, Homo sapiens
agagatctgtgtggctc

SEQ ID NO: 5176183 - DNA, 19 bp, Homo sapiens
agagatctgtgtggctcct

SEQ ID NO: 5176184 - DNA, 22 bp, Homo sapiens
agagatctgtgtggctcctggg

SEQ ID NO: 5176185 - DNA, 23 bp, Homo sapiens
agagatcttcccataataaagca

SEQ ID NO: 5176186 - DNA, 16 bp, Homo sapiens
agagatgaaataattt

SEQ ID NO: 5176187 - DNA, 19 bp, Homo sapiens
agagatgaacatctgggga

SEQ ID NO: 5176188 - DNA, 19 bp, Homo sapiens
agagatgaagagtgagagg

SEQ ID NO: 5176189 - DNA, 17 bp, Homo sapiens
agagatgactgagtcct

SEQ ID NO: 5176190 - DNA, 15 bp, Homo sapiens
agagatgagaaagct

SEQ ID NO: 5176191 - DNA, 15 bp, Homo sapiens
agagatgagaagcca

SEQ ID NO: 5176192 - DNA, 14 bp, Homo sapiens
agagatgagctttc

SEQ ID NO: 5176193 - DNA, 15 bp, Homo sapiens
agagatgagctttct

SEQ ID NO: 5176194 - DNA, 23 bp, Homo sapiens
agagatgatcgtgcctataaata

SEQ ID NO: 5176195 - DNA, 20 bp, Homo sapiens
agagatgcactatatgttta

SEQ ID NO: 5176196 - DNA, 13 bp, Homo sapiens
agagatgcattca

SEQ ID NO: 5176197 - DNA, 16 bp, Homo sapiens
agagatgccagccctt

SEQ ID NO: 5176198 - DNA, 17 bp, Homo sapiens
agagatgcctccaccgc

SEQ ID NO: 5176199 - DNA, 13 bp, Homo sapiens
agagatgcctccc

SEQ ID NO: 5176200 - DNA, 16 bp, Homo sapiens
agagatgcctccctga

SEQ ID NO: 5176201 - DNA, 14 bp, Homo sapiens
agagatgctactgt

SEQ ID NO: 5176202 - DNA, 14 bp, Homo sapiens
agagatggaaaaaa

SEQ ID NO: 5176203 - DNA, 15 bp, Homo sapiens
agagatggacagaga

SEQ ID NO: 5176204 - DNA, 18 bp, Homo sapiens
agagatggacagagaact

SEQ ID NO: 5176205 - DNA, 19 bp, Homo sapiens
agagatggacagagaactt

SEQ ID NO: 5176206 - DNA, 15 bp, Homo sapiens
agagatggagaaata

SEQ ID NO: 5176207 - DNA, 22 bp, Homo sapiens
agagatggcacaccagatgctt

SEQ ID NO: 5176208 - DNA, 16 bp, Homo sapiens
agagatggcagagcca

SEQ ID NO: 5176209 - DNA, 20 bp, Homo sapiens
agagatggcctgagaagaga

SEQ ID NO: 5176210 - DNA, 20 bp, Homo sapiens
agagatggcttacaaaaaga

SEQ ID NO: 5176211 - DNA, 23 bp, Homo sapiens
agagatgggactgggagggccca

SEQ ID NO: 5176212 - DNA, 17 bp, Homo sapiens
agagatgggagctcctc

SEQ ID NO: 5176213 - DNA, 19 bp, Homo sapiens
agagatgggagctcctctc

SEQ ID NO: 5176214 - DNA, 20 bp, Homo sapiens
agagatgggagctcctctcc

SEQ ID NO: 5176215 - DNA, 21 bp, Homo sapiens
agagatgggagctcctctcct

SEQ ID NO: 5176216 - DNA, 24 bp, Homo sapiens
agagatgggagctcctctcctgga

SEQ ID NO: 5176217 - DNA, 17 bp, Homo sapiens
agagatgggatttcatc

SEQ ID NO: 5176218 - DNA, 13 bp, Homo sapiens
agagatgtaccaa

SEQ ID NO: 5176219 - DNA, 20 bp, Homo sapiens
agagatgtaccatgttaaag

SEQ ID NO: 5176220 - DNA, 15 bp, Homo sapiens
agagatgtgcaccca

SEQ ID NO: 5176221 - DNA, 19 bp, Homo sapiens
agagatgtggcaaagtgct

SEQ ID NO: 5176222 - DNA, 13 bp, Homo sapiens
agagatgtgtaat

SEQ ID NO: 5176223 - DNA, 18 bp, Homo sapiens
agagatgtgtaatttttc

SEQ ID NO: 5176224 - DNA, 14 bp, Homo sapiens
agagatgtgtgttg

SEQ ID NO: 5176225 - DNA, 23 bp, Homo sapiens
agagatgtgtgttgatactgttg

SEQ ID NO: 5176226 - DNA, 24 bp, Homo sapiens
agagatgtgtgttgatactgttgc

SEQ ID NO: 5176227 - DNA, 13 bp, Homo sapiens
agagattaaaaaa

SEQ ID NO: 5176228 - DNA, 17 bp, Homo sapiens
agagattaatttgtgta

SEQ ID NO: 5176229 - DNA, 12 bp, Homo sapiens
agagattattaa

SEQ ID NO: 5176230 - DNA, 19 bp, Homo sapiens
agaactcatcactgtggct

SEQ ID NO: 5176231 - DNA, 23 bp, Homo sapiens
agaactcatcactgtggctgtct

SEQ ID NO: 5176232 - DNA, 17 bp, Homo sapiens
agaactcattcatagga

SEQ ID NO: 5176233 - DNA, 13 bp, Homo sapiens
agaactcatttca

SEQ ID NO: 5176234 - DNA, 16 bp, Homo sapiens
agaactcatttcaagt

SEQ ID NO: 5176235 - DNA, 13 bp, Homo sapiens
agaactcatttga

SEQ ID NO: 5176236 - DNA, 14 bp, Homo sapiens
agaactcatttgaa

SEQ ID NO: 5176237 - DNA, 15 bp, Homo sapiens
agaactccaggccct

SEQ ID NO: 5176238 - DNA, 14 bp, Homo sapiens
agaactcccttctc

SEQ ID NO: 5176239 - DNA, 17 bp, Homo sapiens
agaactccctttcaaca

SEQ ID NO: 5176240 - DNA, 20 bp, Homo sapiens
agaactcctacctgaaggca

SEQ ID NO: 5176241 - DNA, 14 bp, Homo sapiens
agaactcctgactg

SEQ ID NO: 5176242 - DNA, 20 bp, Homo sapiens
agaactcctgtcttctttct

SEQ ID NO: 5176243 - DNA, 18 bp, Homo sapiens
agaactccttattttgta

SEQ ID NO: 5176244 - DNA, 21 bp, Homo sapiens
agaactccttattttgtatta

SEQ ID NO: 5176245 - DNA, 22 bp, Homo sapiens
agaactcgcaatccgagccagc

SEQ ID NO: 5176246 - DNA, 17 bp, Homo sapiens
agaactcgttaaagcaa

SEQ ID NO: 5176247 - DNA, 17 bp, Homo sapiens
agaactctaaccagtgt

SEQ ID NO: 5176248 - DNA, 14 bp, Homo sapiens
agaactctcagact

SEQ ID NO: 5176249 - DNA, 21 bp, Homo sapiens
agaactctcctatctgaacct

SEQ ID NO: 5176250 - DNA, 20 bp, Homo sapiens
agaactctctccctggtctc

SEQ ID NO: 5176251 - DNA, 13 bp, Homo sapiens
agaactctctgga

SEQ ID NO: 5176252 - DNA, 16 bp, Homo sapiens
agaactctctggaagc

SEQ ID NO: 5176253 - DNA, 20 bp, Homo sapiens
agaactctctgtcttctctc

SEQ ID NO: 5176254 - DNA, 22 bp, Homo sapiens
agaactctgcttactaatgtat

SEQ ID NO: 5176255 - DNA, 20 bp, Homo sapiens
agaactctgggctgctaccc

SEQ ID NO: 5176256 - DNA, 13 bp, Homo sapiens
agaactcttcctc

SEQ ID NO: 5176257 - DNA, 22 bp, Homo sapiens
agaactcttcctccaaggacag

SEQ ID NO: 5176258 - DNA, 10 bp, Homo sapiens
agaactgaaa

SEQ ID NO: 5176259 - DNA, 16 bp, Homo sapiens
agaactgaaaacataa

SEQ ID NO: 5176260 - DNA, 12 bp, Homo sapiens
agaactgaaaag

SEQ ID NO: 5176261 - DNA, 21 bp, Homo sapiens
agaactgaaataaaaaattat

SEQ ID NO: 5176262 - DNA, 22 bp, Homo sapiens
agaactgaagccacttggccca

SEQ ID NO: 5176263 - DNA, 23 bp, Homo sapiens
agaactgaagccacttggcccag

SEQ ID NO: 5176264 - DNA, 20 bp, Homo sapiens
agaactgaagtgtgctgtga

SEQ ID NO: 5176265 - DNA, 13 bp, Homo sapiens
agaactgaatcca

SEQ ID NO: 5176266 - DNA, 21 bp, Homo sapiens
agaactgaatccatatttcaa

SEQ ID NO: 5176267 - DNA, 15 bp, Homo sapiens
agaactgaatgagaa

SEQ ID NO: 5176268 - DNA, 19 bp, Homo sapiens
agaactgaattttgggact

SEQ ID NO: 5176269 - DNA, 21 bp, Homo sapiens
agaactgaattttgtctttat

SEQ ID NO: 5176270 - DNA, 12 bp, Homo sapiens
agaactgacaaa

SEQ ID NO: 5176271 - DNA, 22 bp, Homo sapiens
agaactgacaaaggagccttga

SEQ ID NO: 5176272 - DNA, 15 bp, Homo sapiens
agaactgactttctc

SEQ ID NO: 5176273 - DNA, 16 bp, Homo sapiens
agaactgagcatctcc

SEQ ID NO: 5176274 - DNA, 22 bp, Homo sapiens
agaactgaggtcactgggttct

SEQ ID NO: 5176275 - DNA, 17 bp, Homo sapiens
agaactgatgacactga

SEQ ID NO: 5176276 - DNA, 12 bp, Homo sapiens
agaactgatttt

SEQ ID NO: 5176277 - DNA, 17 bp, Homo sapiens
agaactgcacatgaaga

SEQ ID NO: 5176278 - DNA, 20 bp, Homo sapiens
agaactgcacatgaagaaat

SEQ ID NO: 5176279 - DNA, 15 bp, Homo sapiens
agaactgcacttttt

SEQ ID NO: 5176280 - DNA, 19 bp, Homo sapiens
agaactgcagacctcactg

SEQ ID NO: 5176281 - DNA, 20 bp, Homo sapiens
agaactgcagatagcccagg

SEQ ID NO: 5176282 - DNA, 15 bp, Homo sapiens
agaactgcagggcct

SEQ ID NO: 5176283 - DNA, 20 bp, Homo sapiens
agaactgcatatgtttcgct

SEQ ID NO: 5176284 - DNA, 17 bp, Homo sapiens
agaactgcatggaccta

SEQ ID NO: 5176285 - DNA, 19 bp, Homo sapiens
agaactgcatgtggcttct

SEQ ID NO: 5176286 - DNA, 21 bp, Homo sapiens
agaactgccccatctcctccc

SEQ ID NO: 5176287 - DNA, 18 bp, Homo sapiens
agaactgcccttgctgcc

SEQ ID NO: 5176288 - DNA, 14 bp, Homo sapiens
agaactgctggggc

SEQ ID NO: 5176289 - DNA, 13 bp, Homo sapiens
agaactgctgttt

SEQ ID NO: 5176290 - DNA, 19 bp, Homo sapiens
agaactgcttcatgtgaac

SEQ ID NO: 5176291 - DNA, 20 bp, Homo sapiens
agaactgcttcatgtgaaca

SEQ ID NO: 5176292 - DNA, 21 bp, Homo sapiens
agaactgcttctaagatgcca

SEQ ID NO: 5176293 - DNA, 20 bp, Homo sapiens
agaactgcttgcatttcttt

SEQ ID NO: 5176294 - DNA, 18 bp, Homo sapiens
agaactggacgcccagct

SEQ ID NO: 5176295 - DNA, 16 bp, Homo sapiens
agaactggactcagga

SEQ ID NO: 5176296 - DNA, 17 bp, Homo sapiens
agaactggactcaggat

SEQ ID NO: 5176297 - DNA, 20 bp, Homo sapiens
agaactggactcaggatgcc

SEQ ID NO: 5176298 - DNA, 15 bp, Homo sapiens
agaactggcaggagc

SEQ ID NO: 5176299 - DNA, 16 bp, Homo sapiens
agaactggcaggagcc

SEQ ID NO: 5176300 - DNA, 17 bp, Homo sapiens
agaactggggtgatgtt

SEQ ID NO: 5176301 - DNA, 22 bp, Homo sapiens
agaactggggttcaagcccagg

SEQ ID NO: 5176302 - DNA, 19 bp, Homo sapiens
agaactggttcttgccttc

SEQ ID NO: 5176303 - DNA, 13 bp, Homo sapiens
agaactgtacatt

SEQ ID NO: 5176304 - DNA, 19 bp, Homo sapiens
agaactgtactgttttctg

SEQ ID NO: 5176305 - DNA, 22 bp, Homo sapiens
agaactgtccacatctgcctcc

SEQ ID NO: 5176306 - DNA, 23 bp, Homo sapiens
agaactgtcccatccccaggtcc

SEQ ID NO: 5176307 - DNA, 19 bp, Homo sapiens
agaactgtcggaggaaaga

SEQ ID NO: 5176308 - DNA, 14 bp, Homo sapiens
agaactgtctttca

SEQ ID NO: 5176309 - DNA, 20 bp, Homo sapiens
agaactgtgaaatttacaaa

SEQ ID NO: 5176310 - DNA, 12 bp, Homo sapiens
agaactgtgaat

SEQ ID NO: 5176311 - DNA, 13 bp, Homo sapiens
agaactgtgaata

SEQ ID NO: 5176312 - DNA, 18 bp, Homo sapiens
agaactgtgaatatgtgt

SEQ ID NO: 5176313 - DNA, 13 bp, Homo sapiens
agaactgtgccac

SEQ ID NO: 5176314 - DNA, 12 bp, Homo sapiens
agaactgtgctc

SEQ ID NO: 5176315 - DNA, 21 bp, Homo sapiens
agaactgtgtttcaagttcaa

SEQ ID NO: 5176316 - DNA, 21 bp, Homo sapiens
agaacttactgattattttct

SEQ ID NO: 5176317 - DNA, 15 bp, Homo sapiens
agaacttcaaaatgt

SEQ ID NO: 5176318 - DNA, 18 bp, Homo sapiens
agaacttcagaaagactt

SEQ ID NO: 5176319 - DNA, 15 bp, Homo sapiens
agaacttcatctgcc

SEQ ID NO: 5176320 - DNA, 14 bp, Homo sapiens
agaacttcatggat

SEQ ID NO: 5176321 - DNA, 16 bp, Homo sapiens
agaacttcatttttaa

SEQ ID NO: 5176322 - DNA, 21 bp, Homo sapiens
agaacttccaacaagcctcaa

SEQ ID NO: 5176323 - DNA, 22 bp, Homo sapiens
agaacttctcgtagatgctgcc

SEQ ID NO: 5176324 - DNA, 22 bp, Homo sapiens
agaacttgaagcctgctccttc

SEQ ID NO: 5176325 - DNA, 17 bp, Homo sapiens
agaacttgaatttctgg

SEQ ID NO: 5176326 - DNA, 13 bp, Homo sapiens
agaacttgctgct

SEQ ID NO: 5176327 - DNA, 21 bp, Homo sapiens
agaacttgttaacctttctaa

SEQ ID NO: 5176328 - DNA, 17 bp, Homo sapiens
agaacttgttgctgatt

SEQ ID NO: 5176329 - DNA, 19 bp, Homo sapiens
agaacttgttgctgatttt

SEQ ID NO: 5176330 - DNA, 12 bp, Homo sapiens
agaacttgttta

SEQ ID NO: 5176331 - DNA, 17 bp, Homo sapiens
agaactttaaagctcag

SEQ ID NO: 5176332 - DNA, 22 bp, Homo sapiens
agaactttaaagctcaggaggg

SEQ ID NO: 5176333 - DNA, 23 bp, Homo sapiens
agaactttaaagctcaggagggt

SEQ ID NO: 5176334 - DNA, 14 bp, Homo sapiens
agaactttattttg

SEQ ID NO: 5176335 - DNA, 23 bp, Homo sapiens
agaactttattttggattgtgga

SEQ ID NO: 5176336 - DNA, 16 bp, Homo sapiens
agaactttcatttttt

SEQ ID NO: 5176337 - DNA, 18 bp, Homo sapiens
agaactttcatttttttc

SEQ ID NO: 5176338 - DNA, 19 bp, Homo sapiens
agaactttccatctgcttg

SEQ ID NO: 5176339 - DNA, 21 bp, Homo sapiens
agaactttcggagcctgcctc

SEQ ID NO: 5176340 - DNA, 13 bp, Homo sapiens
agaactttctgtc

SEQ ID NO: 5176341 - DNA, 16 bp, Homo sapiens
agaactttgaaggaca

SEQ ID NO: 5176342 - DNA, 20 bp, Homo sapiens
agaactttgagctactgccg

SEQ ID NO: 5176343 - DNA, 21 bp, Homo sapiens
agaactttgccttaagtttcc

SEQ ID NO: 5176344 - DNA, 22 bp, Homo sapiens
agaactttgtacagtggagaaa

SEQ ID NO: 5176345 - DNA, 15 bp, Homo sapiens
agaactttgtatagt

SEQ ID NO: 5176346 - DNA, 19 bp, Homo sapiens
agaactttgtgccagcgct

SEQ ID NO: 5176347 - DNA, 13 bp, Homo sapiens
agaacttttcata

SEQ ID NO: 5176348 - DNA, 21 bp, Homo sapiens
agaacttttctgtcttacaag

SEQ ID NO: 5176349 - DNA, 14 bp, Homo sapiens
agaactttttcctc

SEQ ID NO: 5176350 - DNA, 19 bp, Homo sapiens
agaacttttttaaataaac

SEQ ID NO: 5176351 - DNA, 20 bp, Homo sapiens
agaacttttttaaataaact

SEQ ID NO: 5176352 - DNA, 11 bp, Homo sapiens
agaagaaaaaa

SEQ ID NO: 5176353 - DNA, 14 bp, Homo sapiens
agaagaaaaaaacg

SEQ ID NO: 5176354 - DNA, 22 bp, Homo sapiens
agaagaaaaaactgaaggtact

SEQ ID NO: 5176355 - DNA, 17 bp, Homo sapiens
agaagaaaaagaagctg

SEQ ID NO: 5176356 - DNA, 18 bp, Homo sapiens
agaagaaaaatggaaaaa

SEQ ID NO: 5176357 - DNA, 18 bp, Homo sapiens
agaagaaaacaaagttct

SEQ ID NO: 5176358 - DNA, 23 bp, Homo sapiens
agaagaaaacatctattctctcc

SEQ ID NO: 5176359 - DNA, 13 bp, Homo sapiens
agaagaaaacatt

SEQ ID NO: 5176360 - DNA, 11 bp, Homo sapiens
agaagaaaagc

SEQ ID NO: 5176361 - DNA, 19 bp, Homo sapiens
agaagaaaatggaaccagg

SEQ ID NO: 5176362 - DNA, 23 bp, Homo sapiens
agaagaaaatggatgacaaagaa

SEQ ID NO: 5176363 - DNA, 12 bp, Homo sapiens
agaagaaaattc

SEQ ID NO: 5176364 - DNA, 16 bp, Homo sapiens
agaagaaaattctcct

SEQ ID NO: 5176365 - DNA, 16 bp, Homo sapiens
agaagaaaattgctgt

SEQ ID NO: 5176366 - DNA, 15 bp, Homo sapiens
agaagaaaatttaat

SEQ ID NO: 5176367 - DNA, 19 bp, Homo sapiens
agaagaaactcctggatcc

SEQ ID NO: 5176368 - DNA, 13 bp, Homo sapiens
agaagaaactgct

SEQ ID NO: 5176369 - DNA, 20 bp, Homo sapiens
agaagaaacttgtaaatatc

SEQ ID NO: 5176370 - DNA, 23 bp, Homo sapiens
agaagaaactttgcctcaagact

SEQ ID NO: 5176371 - DNA, 13 bp, Homo sapiens
agaagaaagcaaa

SEQ ID NO: 5176372 - DNA, 23 bp, Homo sapiens
agaagaaagcaaaagcaagggac

SEQ ID NO: 5176373 - DNA, 14 bp, Homo sapiens
agaagaaaggactg

SEQ ID NO: 5176374 - DNA, 13 bp, Homo sapiens
agaagaaaggcat

SEQ ID NO: 5176375 - DNA, 20 bp, Homo sapiens
agaagaaaggccaaggtgct

SEQ ID NO: 5176376 - DNA, 20 bp, Homo sapiens
agaagaaagtaaaaagaaca

SEQ ID NO: 5176377 - DNA, 19 bp, Homo sapiens
agaagaaatagcagagcct

SEQ ID NO: 5176378 - DNA, 14 bp, Homo sapiens
agaagaaatgaaat

SEQ ID NO: 5176379 - DNA, 14 bp, Homo sapiens
agaagaaatgaata

SEQ ID NO: 5176380 - DNA, 18 bp, Homo sapiens
agaagaaattaaggaaca

SEQ ID NO: 5176381 - DNA, 19 bp, Homo sapiens
agaagaaattaaggaacat

SEQ ID NO: 5176382 - DNA, 16 bp, Homo sapiens
agaagaaattaatata

SEQ ID NO: 5176383 - DNA, 18 bp, Homo sapiens
agaagaaattctgtcata

SEQ ID NO: 5176384 - DNA, 12 bp, Homo sapiens
agaagaacagta

SEQ ID NO: 5176385 - DNA, 23 bp, Homo sapiens
agaagaaccaaatacctcaattt

SEQ ID NO: 5176386 - DNA, 15 bp, Homo sapiens
agaagaaccagccca

SEQ ID NO: 5176387 - DNA, 13 bp, Homo sapiens
agaagaaccattt

SEQ ID NO: 5176388 - DNA, 17 bp, Homo sapiens
agaagaaccgacccacc

SEQ ID NO: 5176389 - DNA, 10 bp, Homo sapiens
agaagaagaa

SEQ ID NO: 5176390 - DNA, 13 bp, Homo sapiens
agaagaagaaaaa

SEQ ID NO: 5176391 - DNA, 13 bp, Homo sapiens
agaagaagaattt

SEQ ID NO: 5176392 - DNA, 14 bp, Homo sapiens
agaagaagaggaag

SEQ ID NO: 5176393 - DNA, 15 bp, Homo sapiens
agaagaagaggaaga

SEQ ID NO: 5176394 - DNA, 15 bp, Homo sapiens
agaagaagaggaagt

SEQ ID NO: 5176395 - DNA, 13 bp, Homo sapiens
agaagaagctcct

SEQ ID NO: 5176396 - DNA, 21 bp, Homo sapiens
agaagaaggaaatgaatttct

SEQ ID NO: 5176397 - DNA, 12 bp, Homo sapiens
agaagaaggaga

SEQ ID NO: 5176398 - DNA, 19 bp, Homo sapiens
agaagaaggagagcaagaa

SEQ ID NO: 5176399 - DNA, 16 bp, Homo sapiens
agaagaaggccagaga

SEQ ID NO: 5176400 - DNA, 18 bp, Homo sapiens
agaagaaggccagagagg

SEQ ID NO: 5176401 - DNA, 16 bp, Homo sapiens
agaagaagtcagagag

SEQ ID NO: 5176402 - DNA, 18 bp, Homo sapiens
agaagaagtgaacactta

SEQ ID NO: 5176403 - DNA, 19 bp, Homo sapiens
agaagaagtggatctaaat

SEQ ID NO: 5176404 - DNA, 13 bp, Homo sapiens
agaagaatataaa

SEQ ID NO: 5176405 - DNA, 16 bp, Homo sapiens
agaagaatatcaaata

SEQ ID NO: 5176406 - DNA, 21 bp, Homo sapiens
agaagaatatcaaataataaa

SEQ ID NO: 5176407 - DNA, 14 bp, Homo sapiens
agaagaatattgta

SEQ ID NO: 5176408 - DNA, 14 bp, Homo sapiens
agaagaatattgtt

SEQ ID NO: 5176409 - DNA, 15 bp, Homo sapiens
agagattattaaatc

SEQ ID NO: 5176410 - DNA, 13 bp, Homo sapiens
agagattattcaa

SEQ ID NO: 5176411 - DNA, 13 bp, Homo sapiens
agagattcatttt

SEQ ID NO: 5176412 - DNA, 16 bp, Homo sapiens
agagattcattttcta

SEQ ID NO: 5176413 - DNA, 20 bp, Homo sapiens
agagattcccctggaccaca

SEQ ID NO: 5176414 - DNA, 23 bp, Homo sapiens
agagattctgaactaaagtgctg

SEQ ID NO: 5176415 - DNA, 21 bp, Homo sapiens
agagattctggatctcctgct

SEQ ID NO: 5176416 - DNA, 19 bp, Homo sapiens
agagattcttagctcttgg

SEQ ID NO: 5176417 - DNA, 23 bp, Homo sapiens
agagattgaactttgaggaggaa

SEQ ID NO: 5176418 - DNA, 19 bp, Homo sapiens
agagattgccccagagccc

SEQ ID NO: 5176419 - DNA, 13 bp, Homo sapiens
agagattgctaat

SEQ ID NO: 5176420 - DNA, 15 bp, Homo sapiens
agagattgcttctca

SEQ ID NO: 5176421 - DNA, 21 bp, Homo sapiens
agagattggatcaagtattac

SEQ ID NO: 5176422 - DNA, 18 bp, Homo sapiens
agagattgggactgagtg

SEQ ID NO: 5176423 - DNA, 14 bp, Homo sapiens
agagattgggagaa

SEQ ID NO: 5176424 - DNA, 14 bp, Homo sapiens
agagattgtacatt

SEQ ID NO: 5176425 - DNA, 16 bp, Homo sapiens
agagatttaattaatc

SEQ ID NO: 5176426 - DNA, 18 bp, Homo sapiens
agagatttatataaatgt

SEQ ID NO: 5176427 - DNA, 16 bp, Homo sapiens
agagatttcaacatat

SEQ ID NO: 5176428 - DNA, 12 bp, Homo sapiens
agagatttcaag

SEQ ID NO: 5176429 - DNA, 14 bp, Homo sapiens
agagatttgtctaa

SEQ ID NO: 5176430 - DNA, 14 bp, Homo sapiens
agagattttacaaa

SEQ ID NO: 5176431 - DNA, 22 bp, Homo sapiens
agagattttcattttagtgtat

SEQ ID NO: 5176432 - DNA, 13 bp, Homo sapiens
agagattttctct

SEQ ID NO: 5176433 - DNA, 17 bp, Homo sapiens
agagatttttttttaaa

SEQ ID NO: 5176434 - DNA, 20 bp, Homo sapiens
agagcaaaagcctcagaaag

SEQ ID NO: 5176435 - DNA, 18 bp, Homo sapiens
agagcaaaataattttaa

SEQ ID NO: 5176436 - DNA, 22 bp, Homo sapiens
agagcaaaatgctcttgtccct

SEQ ID NO: 5176437 - DNA, 14 bp, Homo sapiens
agagcaaaattgat

SEQ ID NO: 5176438 - DNA, 15 bp, Homo sapiens
agagcaaacagaaaa

SEQ ID NO: 5176439 - DNA, 18 bp, Homo sapiens
agagcaaagatggcttcc

SEQ ID NO: 5176440 - DNA, 20 bp, Homo sapiens
agagcaaagatggcttccgt

SEQ ID NO: 5176441 - DNA, 15 bp, Homo sapiens
agagcaaagcgccca

SEQ ID NO: 5176442 - DNA, 21 bp, Homo sapiens
agagcaaagcgcccacccagg

SEQ ID NO: 5176443 - DNA, 21 bp, Homo sapiens
agagcaaaggagacaaagcag

SEQ ID NO: 5176444 - DNA, 14 bp, Homo sapiens
agagcaaaggccca

SEQ ID NO: 5176445 - DNA, 16 bp, Homo sapiens
agagcaaaggcccatg

SEQ ID NO: 5176446 - DNA, 18 bp, Homo sapiens
agagcaaagggaaatcaa

SEQ ID NO: 5176447 - DNA, 16 bp, Homo sapiens
agagcaaagggccagg

SEQ ID NO: 5176448 - DNA, 19 bp, Homo sapiens
agagcaaagggccaggaag

SEQ ID NO: 5176449 - DNA, 16 bp, Homo sapiens
agagcaaatgagggag

SEQ ID NO: 5176450 - DNA, 18 bp, Homo sapiens
agagcaaatgagggaggg

SEQ ID NO: 5176451 - DNA, 23 bp, Homo sapiens
agagcaaatttcatctttccaaa

SEQ ID NO: 5176452 - DNA, 21 bp, Homo sapiens
agagcaacccctgtacccagc

SEQ ID NO: 5176453 - DNA, 22 bp, Homo sapiens
agagcaacccctgtacccagct

SEQ ID NO: 5176454 - DNA, 18 bp, Homo sapiens
agagcaagactccgtctc

SEQ ID NO: 5176455 - DNA, 16 bp, Homo sapiens
agagcaagagagcagc

SEQ ID NO: 5176456 - DNA, 20 bp, Homo sapiens
agagcaagagataagtcttt

SEQ ID NO: 5176457 - DNA, 13 bp, Homo sapiens
agagcaagccttt

SEQ ID NO: 5176458 - DNA, 13 bp, Homo sapiens
agagcaaggaagc

SEQ ID NO: 5176459 - DNA, 23 bp, Homo sapiens
agagcaaggaaggtaaaaagtta

SEQ ID NO: 5176460 - DNA, 22 bp, Homo sapiens
agagcaaggtttcgtggcagca

SEQ ID NO: 5176461 - DNA, 19 bp, Homo sapiens
agagcaagtcctcactctt

SEQ ID NO: 5176462 - DNA, 11 bp, Homo sapiens
agagcaataac

SEQ ID NO: 5176463 - DNA, 14 bp, Homo sapiens
agagcaataacact

SEQ ID NO: 5176464 - DNA, 20 bp, Homo sapiens
agagcaatcttgctgtgaaa

SEQ ID NO: 5176465 - DNA, 21 bp, Homo sapiens
agagcaatgcccgtaatgctt

SEQ ID NO: 5176466 - DNA, 17 bp, Homo sapiens
agagcaatggttgtatt

SEQ ID NO: 5176467 - DNA, 21 bp, Homo sapiens
agagcaattccaggctgagcc

SEQ ID NO: 5176468 - DNA, 22 bp, Homo sapiens
agagcaattccaggctgagcca

SEQ ID NO: 5176469 - DNA, 15 bp, Homo sapiens
agagcaattgcagca

SEQ ID NO: 5176470 - DNA, 15 bp, Homo sapiens
agagcacaaacattt

SEQ ID NO: 5176471 - DNA, 16 bp, Homo sapiens
agagcacaaacatttt

SEQ ID NO: 5176472 - DNA, 19 bp, Homo sapiens
agagcacaagaaggccagc

SEQ ID NO: 5176473 - DNA, 21 bp, Homo sapiens
agagcacaagaaggccagccc

SEQ ID NO: 5176474 - DNA, 15 bp, Homo sapiens
agagcacaatattaa

SEQ ID NO: 5176475 - DNA, 23 bp, Homo sapiens
agagcacacttatttatgaattg

SEQ ID NO: 5176476 - DNA, 22 bp, Homo sapiens
agagcacagagccctgaggggc

SEQ ID NO: 5176477 - DNA, 14 bp, Homo sapiens
agagcacagattca

SEQ ID NO: 5176478 - DNA, 11 bp, Homo sapiens
agagcacagcc

SEQ ID NO: 5176479 - DNA, 13 bp, Homo sapiens
agagcacagccca

SEQ ID NO: 5176480 - DNA, 17 bp, Homo sapiens
agagcacagcccacggg

SEQ ID NO: 5176481 - DNA, 13 bp, Homo sapiens
agagcacaggttc

SEQ ID NO: 5176482 - DNA, 14 bp, Homo sapiens
agagcacccacagc

SEQ ID NO: 5176483 - DNA, 12 bp, Homo sapiens
agagcacccact

SEQ ID NO: 5176484 - DNA, 23 bp, Homo sapiens
agagcacccccaagcctgggctt

SEQ ID NO: 5176485 - DNA, 17 bp, Homo sapiens
agagcacccctctctgc

SEQ ID NO: 5176486 - DNA, 12 bp, Homo sapiens
agagcacctcag

SEQ ID NO: 5176487 - DNA, 15 bp, Homo sapiens
agagcacctgtagct

SEQ ID NO: 5176488 - DNA, 22 bp, Homo sapiens
agagcaccttagacagtccctg

SEQ ID NO: 5176489 - DNA, 14 bp, Homo sapiens
agagcacgcctgcc

SEQ ID NO: 5176490 - DNA, 21 bp, Homo sapiens
agagcacggtcccccaggagg

SEQ ID NO: 5176491 - DNA, 22 bp, Homo sapiens
agagcacggtcccccaggaggc

SEQ ID NO: 5176492 - DNA, 15 bp, Homo sapiens
agagcactagaagtg

SEQ ID NO: 5176493 - DNA, 17 bp, Homo sapiens
agagcactctcacccca

SEQ ID NO: 5176494 - DNA, 17 bp, Homo sapiens
agagcactgtatacccc

SEQ ID NO: 5176495 - DNA, 21 bp, Homo sapiens
agagcacttaagagaatattt

SEQ ID NO: 5176496 - DNA, 17 bp, Homo sapiens
agagcacttcacacaga

SEQ ID NO: 5176497 - DNA, 20 bp, Homo sapiens
agagcacttgagctgtctga

SEQ ID NO: 5176498 - DNA, 22 bp, Homo sapiens
agagcactttaaaaacaggcca

SEQ ID NO: 5176499 - DNA, 15 bp, Homo sapiens
agagcagaaattctg

SEQ ID NO: 5176500 - DNA, 17 bp, Homo sapiens
agagcagaaattctgtt

SEQ ID NO: 5176501 - DNA, 20 bp, Homo sapiens
agagcagaaattctgttttt

SEQ ID NO: 5176502 - DNA, 15 bp, Homo sapiens
agagcagacaggcta

SEQ ID NO: 5176503 - DNA, 12 bp, Homo sapiens
agagcagagaag

SEQ ID NO: 5176504 - DNA, 12 bp, Homo sapiens
agagcagagacc

SEQ ID NO: 5176505 - DNA, 17 bp, Homo sapiens
agagcagagaccatccc

SEQ ID NO: 5176506 - DNA, 18 bp, Homo sapiens
agagcagagaccatccct

SEQ ID NO: 5176507 - DNA, 20 bp, Homo sapiens
agagcagagaccatccctga

SEQ ID NO: 5176508 - DNA, 15 bp, Homo sapiens
agagcagagccccca

SEQ ID NO: 5176509 - DNA, 14 bp, Homo sapiens
agagcagaggcagc

SEQ ID NO: 5176510 - DNA, 12 bp, Homo sapiens
agagcagaggtc

SEQ ID NO: 5176511 - DNA, 14 bp, Homo sapiens
agagcagagtctgg

SEQ ID NO: 5176512 - DNA, 18 bp, Homo sapiens
agagcagagtctgggcct

SEQ ID NO: 5176513 - DNA, 14 bp, Homo sapiens
agagcagatgcaga

SEQ ID NO: 5176514 - DNA, 19 bp, Homo sapiens
agagcagcaaggtcttgct

SEQ ID NO: 5176515 - DNA, 12 bp, Homo sapiens
agagcagcacct

SEQ ID NO: 5176516 - DNA, 22 bp, Homo sapiens
agagcagcacctcctcagcctg

SEQ ID NO: 5176517 - DNA, 13 bp, Homo sapiens
agagcagcactcc

SEQ ID NO: 5176518 - DNA, 14 bp, Homo sapiens
agagcagcagcacc

SEQ ID NO: 5176519 - DNA, 15 bp, Homo sapiens
agagcagcagcacca

SEQ ID NO: 5176520 - DNA, 16 bp, Homo sapiens
agagcagcaggtgctg

SEQ ID NO: 5176521 - DNA, 16 bp, Homo sapiens
agagcagcctcttgaa

SEQ ID NO: 5176522 - DNA, 13 bp, Homo sapiens
agagcagcctgat

SEQ ID NO: 5176523 - DNA, 18 bp, Homo sapiens
agagcagcctgatggcca

SEQ ID NO: 5176524 - DNA, 21 bp, Homo sapiens
agagcagcctgatggccaagg

SEQ ID NO: 5176525 - DNA, 18 bp, Homo sapiens
agagcagctccccaggag

SEQ ID NO: 5176526 - DNA, 20 bp, Homo sapiens
agagcagctccccaggagct

SEQ ID NO: 5176527 - DNA, 18 bp, Homo sapiens
agagcagctggctctcca

SEQ ID NO: 5176528 - DNA, 12 bp, Homo sapiens
agagcagctggt

SEQ ID NO: 5176529 - DNA, 18 bp, Homo sapiens
agagcagctttaaactca

SEQ ID NO: 5176530 - DNA, 11 bp, Homo sapiens
agagcaggaaa

SEQ ID NO: 5176531 - DNA, 18 bp, Homo sapiens
agagcaggaagcattcag

SEQ ID NO: 5176532 - DNA, 20 bp, Homo sapiens
agagcaggaagcattcagag

SEQ ID NO: 5176533 - DNA, 22 bp, Homo sapiens
agagcaggaaggacaggaagct

SEQ ID NO: 5176534 - DNA, 15 bp, Homo sapiens
agagcaggactccag

SEQ ID NO: 5176535 - DNA, 21 bp, Homo sapiens
agagcaggactccaggcccaa

SEQ ID NO: 5176536 - DNA, 22 bp, Homo sapiens
agagcaggactgatgtctccta

SEQ ID NO: 5176537 - DNA, 12 bp, Homo sapiens
agagcaggaggc

SEQ ID NO: 5176538 - DNA, 18 bp, Homo sapiens
agagcaggaggtgcctga

SEQ ID NO: 5176539 - DNA, 15 bp, Homo sapiens
agagcaggatagctc

SEQ ID NO: 5176540 - DNA, 12 bp, Homo sapiens
agagcaggcaca

SEQ ID NO: 5176541 - DNA, 19 bp, Homo sapiens
agagcaggcacatggagga

SEQ ID NO: 5176542 - DNA, 20 bp, Homo sapiens
agagcaggcacatggaggag

SEQ ID NO: 5176543 - DNA, 23 bp, Homo sapiens
agagcaggccagcccggacctct

SEQ ID NO: 5176544 - DNA, 13 bp, Homo sapiens
agagcaggctggc

SEQ ID NO: 5176545 - DNA, 22 bp, Homo sapiens
agagcaggctggcagctctcca

SEQ ID NO: 5176546 - DNA, 13 bp, Homo sapiens
agagcaggctttg

SEQ ID NO: 5176547 - DNA, 24 bp, Homo sapiens
agagcagggattaacctctgcact

SEQ ID NO: 5176548 - DNA, 22 bp, Homo sapiens
agagcaggggagcttgggactc

SEQ ID NO: 5176549 - DNA, 16 bp, Homo sapiens
agagcaggggctccag

SEQ ID NO: 5176550 - DNA, 18 bp, Homo sapiens
agagcaggggctgctggg

SEQ ID NO: 5176551 - DNA, 23 bp, Homo sapiens
agagcaggggctgctgggggctc

SEQ ID NO: 5176552 - DNA, 17 bp, Homo sapiens
agagcagggggacctag

SEQ ID NO: 5176553 - DNA, 23 bp, Homo sapiens
agagcagggggacctaggctcct

SEQ ID NO: 5176554 - DNA, 22 bp, Homo sapiens
agagcaggggtccttggtgtga

SEQ ID NO: 5176555 - DNA, 16 bp, Homo sapiens
agagcaggtctgcagg

SEQ ID NO: 5176556 - DNA, 17 bp, Homo sapiens
agagcaggtctgcaggc

SEQ ID NO: 5176557 - DNA, 21 bp, Homo sapiens
agagcaggttactaaggaagg

SEQ ID NO: 5176558 - DNA, 19 bp, Homo sapiens
agagcagtcagagtccagt

SEQ ID NO: 5176559 - DNA, 20 bp, Homo sapiens
agagcagtgaagactagaaa

SEQ ID NO: 5176560 - DNA, 16 bp, Homo sapiens
agagcagtgattctct

SEQ ID NO: 5176561 - DNA, 15 bp, Homo sapiens
agagcagtgcacatc

SEQ ID NO: 5176562 - DNA, 13 bp, Homo sapiens
agagcagtgggca

SEQ ID NO: 5176563 - DNA, 20 bp, Homo sapiens
agagcagttaacatctgaag

SEQ ID NO: 5176564 - DNA, 16 bp, Homo sapiens
agagcagtttcatctg

SEQ ID NO: 5176565 - DNA, 21 bp, Homo sapiens
agagcataatttaaaaatata

SEQ ID NO: 5176566 - DNA, 13 bp, Homo sapiens
agagcatagggtc

SEQ ID NO: 5176567 - DNA, 12 bp, Homo sapiens
agagcatatttg

SEQ ID NO: 5176568 - DNA, 19 bp, Homo sapiens
agagcatcaggcctagagg

SEQ ID NO: 5176569 - DNA, 14 bp, Homo sapiens
agagcatcatgcct

SEQ ID NO: 5176570 - DNA, 16 bp, Homo sapiens
agagcatcatgcctct

SEQ ID NO: 5176571 - DNA, 22 bp, Homo sapiens
agagcatcatgcctctgaggcc

SEQ ID NO: 5176572 - DNA, 21 bp, Homo sapiens
agagcatccggccaaatgcaa

SEQ ID NO: 5176573 - DNA, 13 bp, Homo sapiens
agagcatcctgat

SEQ ID NO: 5176574 - DNA, 20 bp, Homo sapiens
agagcatcgtgacccttcag

SEQ ID NO: 5176575 - DNA, 21 bp, Homo sapiens
agagcatcgtgacccttcagg

SEQ ID NO: 5176576 - DNA, 22 bp, Homo sapiens
agagcatcgtgacccttcaggg

SEQ ID NO: 5176577 - DNA, 19 bp, Homo sapiens
agagcatctcaggaggggc

SEQ ID NO: 5176578 - DNA, 14 bp, Homo sapiens
agagcatctgcccc

SEQ ID NO: 5176579 - DNA, 15 bp, Homo sapiens
agagcatctgcccca

SEQ ID NO: 5176580 - DNA, 18 bp, Homo sapiens
agagcatctgccccaggt

SEQ ID NO: 5176581 - DNA, 19 bp, Homo sapiens
agagcatctgccccaggta

SEQ ID NO: 5176582 - DNA, 20 bp, Homo sapiens
agagcatctgctctgagacg

SEQ ID NO: 5176583 - DNA, 12 bp, Homo sapiens
agagcatgaaat

SEQ ID NO: 5176584 - DNA, 16 bp, Homo sapiens
agagcatgatgggagg

SEQ ID NO: 5176585 - DNA, 14 bp, Homo sapiens
agagcatgctgcct

SEQ ID NO: 5176586 - DNA, 15 bp, Homo sapiens
agagcatggatgcat

SEQ ID NO: 5176587 - DNA, 18 bp, Homo sapiens
agagcatggatgcatttc

SEQ ID NO: 5176588 - DNA, 22 bp, Homo sapiens
agaagaatattgttcctaagtt

SEQ ID NO: 5176589 - DNA, 17 bp, Homo sapiens
agaagaatccacaagga

SEQ ID NO: 5176590 - DNA, 15 bp, Homo sapiens
agaagaatcttcctg

SEQ ID NO: 5176591 - DNA, 19 bp, Homo sapiens
agaagaatcttcctggcac

SEQ ID NO: 5176592 - DNA, 15 bp, Homo sapiens
agaagaatctttctt

SEQ ID NO: 5176593 - DNA, 13 bp, Homo sapiens
agaagaatggctt

SEQ ID NO: 5176594 - DNA, 14 bp, Homo sapiens
agaagaatggcttt

SEQ ID NO: 5176595 - DNA, 18 bp, Homo sapiens
agaagaatggctttcaat

SEQ ID NO: 5176596 - DNA, 23 bp, Homo sapiens
agaagaatggctttcaataccct

SEQ ID NO: 5176597 - DNA, 19 bp, Homo sapiens
agaagaatgtgtttcaaac

SEQ ID NO: 5176598 - DNA, 22 bp, Homo sapiens
agaagaatttgaagacttcaaa

SEQ ID NO: 5176599 - DNA, 22 bp, Homo sapiens
agaagaattttcagaccccagc

SEQ ID NO: 5176600 - DNA, 22 bp, Homo sapiens
agaagacaaactccggcactgg

SEQ ID NO: 5176601 - DNA, 15 bp, Homo sapiens
agaagacaaactttg

SEQ ID NO: 5176602 - DNA, 14 bp, Homo sapiens
agaagacaacagaa

SEQ ID NO: 5176603 - DNA, 23 bp, Homo sapiens
agaagacacaaggtgatttcaga

SEQ ID NO: 5176604 - DNA, 13 bp, Homo sapiens
agaagacacacag

SEQ ID NO: 5176605 - DNA, 14 bp, Homo sapiens
agaagacacacagc

SEQ ID NO: 5176606 - DNA, 16 bp, Homo sapiens
agaagacaccagagca

SEQ ID NO: 5176607 - DNA, 19 bp, Homo sapiens
agaagacaccagagcagat

SEQ ID NO: 5176608 - DNA, 11 bp, Homo sapiens
agaagacacta

SEQ ID NO: 5176609 - DNA, 12 bp, Homo sapiens
agaagacactaa

SEQ ID NO: 5176610 - DNA, 21 bp, Homo sapiens
agaagacactgatgggcaacc

SEQ ID NO: 5176611 - DNA, 12 bp, Homo sapiens
agaagacactgc

SEQ ID NO: 5176612 - DNA, 18 bp, Homo sapiens
agaagacaggctggaaga

SEQ ID NO: 5176613 - DNA, 18 bp, Homo sapiens
agaagacatactgcttga

SEQ ID NO: 5176614 - DNA, 14 bp, Homo sapiens
agaagacatggaga

SEQ ID NO: 5176615 - DNA, 20 bp, Homo sapiens
agaagacatggagactcctg

SEQ ID NO: 5176616 - DNA, 22 bp, Homo sapiens
agaagacatggagactcctgcc

SEQ ID NO: 5176617 - DNA, 14 bp, Homo sapiens
agaagacatgtttt

SEQ ID NO: 5176618 - DNA, 16 bp, Homo sapiens
agaagacatgttttag

SEQ ID NO: 5176619 - DNA, 17 bp, Homo sapiens
agaagacatgttttaga

SEQ ID NO: 5176620 - DNA, 19 bp, Homo sapiens
agaagacccctgcccaagt

SEQ ID NO: 5176621 - DNA, 21 bp, Homo sapiens
agaagaccctttgttgaaaaa

SEQ ID NO: 5176622 - DNA, 22 bp, Homo sapiens
agaagaccctttgttgaaaaat

SEQ ID NO: 5176623 - DNA, 23 bp, Homo sapiens
agaagaccctttgttgaaaaatg

SEQ ID NO: 5176624 - DNA, 18 bp, Homo sapiens
agaagacctagctatgtt

SEQ ID NO: 5176625 - DNA, 20 bp, Homo sapiens
agaagacgggaggggaggca

SEQ ID NO: 5176626 - DNA, 21 bp, Homo sapiens
agaagacgggaggggaggcat

SEQ ID NO: 5176627 - DNA, 16 bp, Homo sapiens
agaagactatttacca

SEQ ID NO: 5176628 - DNA, 18 bp, Homo sapiens
agaagactctccactgac

SEQ ID NO: 5176629 - DNA, 18 bp, Homo sapiens
agaagactgcattatatt

SEQ ID NO: 5176630 - DNA, 21 bp, Homo sapiens
agaagactgcattatatttat

SEQ ID NO: 5176631 - DNA, 21 bp, Homo sapiens
agaagactgtgcggcacagga

SEQ ID NO: 5176632 - DNA, 15 bp, Homo sapiens
agaagactttaatta

SEQ ID NO: 5176633 - DNA, 11 bp, Homo sapiens
agaagagaaag

SEQ ID NO: 5176634 - DNA, 13 bp, Homo sapiens
agaagagaagctg

SEQ ID NO: 5176635 - DNA, 13 bp, Homo sapiens
agaagagaattca

SEQ ID NO: 5176636 - DNA, 16 bp, Homo sapiens
agaagagaattcagta

SEQ ID NO: 5176637 - DNA, 22 bp, Homo sapiens
agaagagaattcagtatttttt

SEQ ID NO: 5176638 - DNA, 17 bp, Homo sapiens
agaagagacaaactcct

SEQ ID NO: 5176639 - DNA, 21 bp, Homo sapiens
agaagagaccaagcttgtttc

SEQ ID NO: 5176640 - DNA, 15 bp, Homo sapiens
agaagagaggagagg

SEQ ID NO: 5176641 - DNA, 15 bp, Homo sapiens
agaagagaggggaag

SEQ ID NO: 5176642 - DNA, 18 bp, Homo sapiens
agaagagaggggaagaat

SEQ ID NO: 5176643 - DNA, 21 bp, Homo sapiens
agaagagagtagctcgtcctc

SEQ ID NO: 5176644 - DNA, 20 bp, Homo sapiens
agaagagatgcactatatgt

SEQ ID NO: 5176645 - DNA, 24 bp, Homo sapiens
agaagagatgggatttcatcatgt

SEQ ID NO: 5176646 - DNA, 20 bp, Homo sapiens
agaagagatgggcttgtttt

SEQ ID NO: 5176647 - DNA, 22 bp, Homo sapiens
agaagagatgtggcaaagtgct

SEQ ID NO: 5176648 - DNA, 20 bp, Homo sapiens
agaagagcatccggcatgag

SEQ ID NO: 5176649 - DNA, 11 bp, Homo sapiens
agaagagccac

SEQ ID NO: 5176650 - DNA, 21 bp, Homo sapiens
agaagagccatcttggcaggg

SEQ ID NO: 5176651 - DNA, 14 bp, Homo sapiens
agaagagccccact

SEQ ID NO: 5176652 - DNA, 23 bp, Homo sapiens
agaagagcgcagtgttttgcaag

SEQ ID NO: 5176653 - DNA, 13 bp, Homo sapiens
agaagagctgttc

SEQ ID NO: 5176654 - DNA, 14 bp, Homo sapiens
agaagaggagaaaa

SEQ ID NO: 5176655 - DNA, 20 bp, Homo sapiens
agaagaggagaaaaagaaga

SEQ ID NO: 5176656 - DNA, 14 bp, Homo sapiens
agaagaggaggaag

SEQ ID NO: 5176657 - DNA, 13 bp, Homo sapiens
agaagaggaggag

SEQ ID NO: 5176658 - DNA, 15 bp, Homo sapiens
agaagaggaggaggt

SEQ ID NO: 5176659 - DNA, 20 bp, Homo sapiens
agaagaggcatcctgcctgg

SEQ ID NO: 5176660 - DNA, 16 bp, Homo sapiens
agaagagggcctgtgg

SEQ ID NO: 5176661 - DNA, 13 bp, Homo sapiens
agaagagggggag

SEQ ID NO: 5176662 - DNA, 20 bp, Homo sapiens
agaagagggggaggggaagc

SEQ ID NO: 5176663 - DNA, 15 bp, Homo sapiens
agaagagtcaaagta

SEQ ID NO: 5176664 - DNA, 17 bp, Homo sapiens
agaagagtcaacattga

SEQ ID NO: 5176665 - DNA, 15 bp, Homo sapiens
agaagagtccaggaa

SEQ ID NO: 5176666 - DNA, 22 bp, Homo sapiens
agaagagtcccggagctcaagg

SEQ ID NO: 5176667 - DNA, 19 bp, Homo sapiens
agaagagtgccctgctttg

SEQ ID NO: 5176668 - DNA, 23 bp, Homo sapiens
agaagagtgccctgctttgcaaa

SEQ ID NO: 5176669 - DNA, 16 bp, Homo sapiens
agaagagtggtgagat

SEQ ID NO: 5176670 - DNA, 23 bp, Homo sapiens
agaagagtttaaaagcatgaaac

SEQ ID NO: 5176671 - DNA, 15 bp, Homo sapiens
agaagagtttcttaa

SEQ ID NO: 5176672 - DNA, 21 bp, Homo sapiens
agaagagtttgtgactattct

SEQ ID NO: 5176673 - DNA, 12 bp, Homo sapiens
agaagagttttc

SEQ ID NO: 5176674 - DNA, 17 bp, Homo sapiens
agaagagttttctcaga

SEQ ID NO: 5176675 - DNA, 14 bp, Homo sapiens
agaagataaatgag

SEQ ID NO: 5176676 - DNA, 14 bp, Homo sapiens
agaagataacattt

SEQ ID NO: 5176677 - DNA, 19 bp, Homo sapiens
agaagataacattttcaat

SEQ ID NO: 5176678 - DNA, 12 bp, Homo sapiens
agaagataataa

SEQ ID NO: 5176679 - DNA, 20 bp, Homo sapiens
agaagataatcattgcttat

SEQ ID NO: 5176680 - DNA, 15 bp, Homo sapiens
agaagataatgttct

SEQ ID NO: 5176681 - DNA, 17 bp, Homo sapiens
agaagataattgttgaa

SEQ ID NO: 5176682 - DNA, 14 bp, Homo sapiens
agaagatagtgaga

SEQ ID NO: 5176683 - DNA, 22 bp, Homo sapiens
agaagatattagtcttggggca

SEQ ID NO: 5176684 - DNA, 19 bp, Homo sapiens
agaagatcacgctccccgc

SEQ ID NO: 5176685 - DNA, 14 bp, Homo sapiens
agaagatcccctca

SEQ ID NO: 5176686 - DNA, 16 bp, Homo sapiens
agaagatcctacccca

SEQ ID NO: 5176687 - DNA, 14 bp, Homo sapiens
agaagatcctgtca

SEQ ID NO: 5176688 - DNA, 22 bp, Homo sapiens
agaagatctaccccagggagaa

SEQ ID NO: 5176689 - DNA, 13 bp, Homo sapiens
agaagatctttct

SEQ ID NO: 5176690 - DNA, 15 bp, Homo sapiens
agaagatctttgggc

SEQ ID NO: 5176691 - DNA, 20 bp, Homo sapiens
agaagatgaaagattcagtg

SEQ ID NO: 5176692 - DNA, 16 bp, Homo sapiens
agaagatgatcagacc

SEQ ID NO: 5176693 - DNA, 16 bp, Homo sapiens
agaagatgccagcttc

SEQ ID NO: 5176694 - DNA, 22 bp, Homo sapiens
agaagatgccagcttctctctc

SEQ ID NO: 5176695 - DNA, 22 bp, Homo sapiens
agaagatgccctccaatccttt

SEQ ID NO: 5176696 - DNA, 14 bp, Homo sapiens
agaagatgctccag

SEQ ID NO: 5176697 - DNA, 19 bp, Homo sapiens
agaagatggactctgaaaa

SEQ ID NO: 5176698 - DNA, 14 bp, Homo sapiens
agaagatggcactg

SEQ ID NO: 5176699 - DNA, 20 bp, Homo sapiens
agaagatggcactgtccagg

SEQ ID NO: 5176700 - DNA, 23 bp, Homo sapiens
agaagatggcactgtccagggcc

SEQ ID NO: 5176701 - DNA, 17 bp, Homo sapiens
agaagatggtgaagaca

SEQ ID NO: 5176702 - DNA, 14 bp, Homo sapiens
agaagatgtgtaaa

SEQ ID NO: 5176703 - DNA, 14 bp, Homo sapiens
agaagatgtttaac

SEQ ID NO: 5176704 - DNA, 21 bp, Homo sapiens
agaagattctcgccccttccc

SEQ ID NO: 5176705 - DNA, 21 bp, Homo sapiens
agaagattcttaccaagagtg

SEQ ID NO: 5176706 - DNA, 22 bp, Homo sapiens
agaagattgttggtgaattttc

SEQ ID NO: 5176707 - DNA, 19 bp, Homo sapiens
agaagatttcagagctgag

SEQ ID NO: 5176708 - DNA, 17 bp, Homo sapiens
agaagattttataagaa

SEQ ID NO: 5176709 - DNA, 14 bp, Homo sapiens
agaagcaaagttca

SEQ ID NO: 5176710 - DNA, 20 bp, Homo sapiens
agaagcaaagttcaacttat

SEQ ID NO: 5176711 - DNA, 15 bp, Homo sapiens
agaagcaagaaagaa

SEQ ID NO: 5176712 - DNA, 12 bp, Homo sapiens
agaagcaagaca

SEQ ID NO: 5176713 - DNA, 22 bp, Homo sapiens
agaagcaagacacgtggcctcg

SEQ ID NO: 5176714 - DNA, 16 bp, Homo sapiens
agaagcaagggcaaga

SEQ ID NO: 5176715 - DNA, 22 bp, Homo sapiens
agaagcaatctttgaaataaaa

SEQ ID NO: 5176716 - DNA, 22 bp, Homo sapiens
agaagcaattatttaaagaaag

SEQ ID NO: 5176717 - DNA, 16 bp, Homo sapiens
agaagcacagaatatt

SEQ ID NO: 5176718 - DNA, 19 bp, Homo sapiens
agaagcacagaatattttt

SEQ ID NO: 5176719 - DNA, 21 bp, Homo sapiens
agaagcacagaatatttttat

SEQ ID NO: 5176720 - DNA, 19 bp, Homo sapiens
agaagcacagctcctgcca

SEQ ID NO: 5176721 - DNA, 20 bp, Homo sapiens
agaagcacagctcctgccag

SEQ ID NO: 5176722 - DNA, 10 bp, Homo sapiens
agaagcagaa

SEQ ID NO: 5176723 - DNA, 20 bp, Homo sapiens
agaagcagcagctagaaaga

SEQ ID NO: 5176724 - DNA, 23 bp, Homo sapiens
agaagcagcagctagaaagagaa

SEQ ID NO: 5176725 - DNA, 13 bp, Homo sapiens
agaagcagcccct

SEQ ID NO: 5176726 - DNA, 22 bp, Homo sapiens
agaagcagcccctcgaggccta

SEQ ID NO: 5176727 - DNA, 24 bp, Homo sapiens
agaagcagcccctcgaggcctaca

SEQ ID NO: 5176728 - DNA, 10 bp, Homo sapiens
agaagcagcg

SEQ ID NO: 5176729 - DNA, 12 bp, Homo sapiens
agaagcagctct

SEQ ID NO: 5176730 - DNA, 12 bp, Homo sapiens
agaagcagcttc

SEQ ID NO: 5176731 - DNA, 12 bp, Homo sapiens
agaagcaggcag

SEQ ID NO: 5176732 - DNA, 13 bp, Homo sapiens
agaagcaggcagg

SEQ ID NO: 5176733 - DNA, 16 bp, Homo sapiens
agaagcaggcagggca

SEQ ID NO: 5176734 - DNA, 13 bp, Homo sapiens
agaagcaggttct

SEQ ID NO: 5176735 - DNA, 13 bp, Homo sapiens
agaagcagtgagc

SEQ ID NO: 5176736 - DNA, 23 bp, Homo sapiens
agaagcagtgagccgcatcttct

SEQ ID NO: 5176737 - DNA, 15 bp, Homo sapiens
agaagcatacaactt

SEQ ID NO: 5176738 - DNA, 19 bp, Homo sapiens
agaagcatcctccacatcc

SEQ ID NO: 5176739 - DNA, 13 bp, Homo sapiens
agaagcatgaaaa

SEQ ID NO: 5176740 - DNA, 18 bp, Homo sapiens
agaagcattaacttctct

SEQ ID NO: 5176741 - DNA, 19 bp, Homo sapiens
agaagcattccttctttga

SEQ ID NO: 5176742 - DNA, 23 bp, Homo sapiens
agaagcattccttctttgataat

SEQ ID NO: 5176743 - DNA, 24 bp, Homo sapiens
agaagcattccttctttgataatg

SEQ ID NO: 5176744 - DNA, 16 bp, Homo sapiens
agaagcattgcctgga

SEQ ID NO: 5176745 - DNA, 17 bp, Homo sapiens
agaagcattgcctggac

SEQ ID NO: 5176746 - DNA, 19 bp, Homo sapiens
agaagcattgcctggactg

SEQ ID NO: 5176747 - DNA, 21 bp, Homo sapiens
agaagcatttgatattatcta

SEQ ID NO: 5176748 - DNA, 15 bp, Homo sapiens
agaagcatttgtatt

SEQ ID NO: 5176749 - DNA, 19 bp, Homo sapiens
agaagcattttgtaagttg

SEQ ID NO: 5176750 - DNA, 14 bp, Homo sapiens
agaagccaaatttt

SEQ ID NO: 5176751 - DNA, 15 bp, Homo sapiens
agaagccaaattttt

SEQ ID NO: 5176752 - DNA, 23 bp, Homo sapiens
agaagccaactatgattattaac

SEQ ID NO: 5176753 - DNA, 18 bp, Homo sapiens
agaagccaagacagtggc

SEQ ID NO: 5176754 - DNA, 19 bp, Homo sapiens
agaagccaagacagtggca

SEQ ID NO: 5176755 - DNA, 14 bp, Homo sapiens
agaagccaagcctg

SEQ ID NO: 5176756 - DNA, 23 bp, Homo sapiens
agaagccaagctccctggagccc

SEQ ID NO: 5176757 - DNA, 16 bp, Homo sapiens
agaagccaagggaaag

SEQ ID NO: 5176758 - DNA, 19 bp, Homo sapiens
agaagccaagggaaagggg

SEQ ID NO: 5176759 - DNA, 15 bp, Homo sapiens
agaagccaagggaca

SEQ ID NO: 5176760 - DNA, 19 bp, Homo sapiens
agaagccaagggacacagg

SEQ ID NO: 5176761 - DNA, 12 bp, Homo sapiens
agaagccacaga

SEQ ID NO: 5176762 - DNA, 13 bp, Homo sapiens
agaagccacagaa

SEQ ID NO: 5176763 - DNA, 19 bp, Homo sapiens
agaagccacatcgttgaga

SEQ ID NO: 5176764 - DNA, 16 bp, Homo sapiens
agaagccaccttccca

SEQ ID NO: 5176765 - DNA, 14 bp, Homo sapiens
agaagccagaaggt

SEQ ID NO: 5176766 - DNA, 16 bp, Homo sapiens
agaagccagaatcaca

SEQ ID NO: 5176767 - DNA, 14 bp, Homo sapiens
agagcatgtgaggg

SEQ ID NO: 5176768 - DNA, 18 bp, Homo sapiens
agagcatgtgggggaagg

SEQ ID NO: 5176769 - DNA, 21 bp, Homo sapiens
agagcattacgtgagccaggt

SEQ ID NO: 5176770 - DNA, 16 bp, Homo sapiens
agagcattagctggcg

SEQ ID NO: 5176771 - DNA, 17 bp, Homo sapiens
agagcattagctggcgc

SEQ ID NO: 5176772 - DNA, 16 bp, Homo sapiens
agagcattccagtcag

SEQ ID NO: 5176773 - DNA, 21 bp, Homo sapiens
agagcattccagtcaggctct

SEQ ID NO: 5176774 - DNA, 17 bp, Homo sapiens
agagcattgcatggaca

SEQ ID NO: 5176775 - DNA, 12 bp, Homo sapiens
agagcattgtca

SEQ ID NO: 5176776 - DNA, 22 bp, Homo sapiens
agagcatttggtacacacttga

SEQ ID NO: 5176777 - DNA, 18 bp, Homo sapiens
agagccaaacagagccca

SEQ ID NO: 5176778 - DNA, 14 bp, Homo sapiens
agagccaacctgga

SEQ ID NO: 5176779 - DNA, 15 bp, Homo sapiens
agagccaacctggac

SEQ ID NO: 5176780 - DNA, 13 bp, Homo sapiens
agagccaagacgg

SEQ ID NO: 5176781 - DNA, 14 bp, Homo sapiens
agagccaagcactg

SEQ ID NO: 5176782 - DNA, 20 bp, Homo sapiens
agagccaagcactgctcacg

SEQ ID NO: 5176783 - DNA, 21 bp, Homo sapiens
agagccaagcactgctcacgt

SEQ ID NO: 5176784 - DNA, 12 bp, Homo sapiens
agagccaaggcc

SEQ ID NO: 5176785 - DNA, 16 bp, Homo sapiens
agagccaagggggcag

SEQ ID NO: 5176786 - DNA, 16 bp, Homo sapiens
agagccaagttccaaa

SEQ ID NO: 5176787 - DNA, 23 bp, Homo sapiens
agagccaatggagtagacccctg

SEQ ID NO: 5176788 - DNA, 17 bp, Homo sapiens
agagccaattagacttg

SEQ ID NO: 5176789 - DNA, 23 bp, Homo sapiens
agagccacaggccccttttgtgg

SEQ ID NO: 5176790 - DNA, 16 bp, Homo sapiens
agagccacagggtctg

SEQ ID NO: 5176791 - DNA, 21 bp, Homo sapiens
agagccacagggtctgcctcc

SEQ ID NO: 5176792 - DNA, 22 bp, Homo sapiens
agagccacagggtctgcctcca

SEQ ID NO: 5176793 - DNA, 11 bp, Homo sapiens
agagccacagt

SEQ ID NO: 5176794 - DNA, 12 bp, Homo sapiens
agagccacctgc

SEQ ID NO: 5176795 - DNA, 20 bp, Homo sapiens
agagccacctgcaagatgga

SEQ ID NO: 5176796 - DNA, 13 bp, Homo sapiens
agagccacctgga

SEQ ID NO: 5176797 - DNA, 14 bp, Homo sapiens
agagccacgctggc

SEQ ID NO: 5176798 - DNA, 16 bp, Homo sapiens
agagccactacctttg

SEQ ID NO: 5176799 - DNA, 23 bp, Homo sapiens
agagccactttcaagctgcactg

SEQ ID NO: 5176800 - DNA, 10 bp, Homo sapiens
agagccagag

SEQ ID NO: 5176801 - DNA, 13 bp, Homo sapiens
agagccagagaag

SEQ ID NO: 5176802 - DNA, 18 bp, Homo sapiens
agagccagagaagtgaca

SEQ ID NO: 5176803 - DNA, 14 bp, Homo sapiens
agagccagccctcc

SEQ ID NO: 5176804 - DNA, 11 bp, Homo sapiens
agagccagccg

SEQ ID NO: 5176805 - DNA, 12 bp, Homo sapiens
agagccagcctg

SEQ ID NO: 5176806 - DNA, 13 bp, Homo sapiens
agagccagcctgg

SEQ ID NO: 5176807 - DNA, 14 bp, Homo sapiens
agagccagcctggg

SEQ ID NO: 5176808 - DNA, 18 bp, Homo sapiens
agagccagcggctccaac

SEQ ID NO: 5176809 - DNA, 12 bp, Homo sapiens
agagccagctct

SEQ ID NO: 5176810 - DNA, 14 bp, Homo sapiens
agagccagctctct

SEQ ID NO: 5176811 - DNA, 18 bp, Homo sapiens
agagccagctctctctac

SEQ ID NO: 5176812 - DNA, 12 bp, Homo sapiens
agagccagcttg

SEQ ID NO: 5176813 - DNA, 12 bp, Homo sapiens
agagccaggaga

SEQ ID NO: 5176814 - DNA, 15 bp, Homo sapiens
agagccaggagaagc

SEQ ID NO: 5176815 - DNA, 15 bp, Homo sapiens
agagccaggatgccc

SEQ ID NO: 5176816 - DNA, 13 bp, Homo sapiens
agagccaggcaca

SEQ ID NO: 5176817 - DNA, 19 bp, Homo sapiens
agagccaggcacacactgt

SEQ ID NO: 5176818 - DNA, 14 bp, Homo sapiens
agagccaggctctg

SEQ ID NO: 5176819 - DNA, 17 bp, Homo sapiens
agagccaggctctgcct

SEQ ID NO: 5176820 - DNA, 18 bp, Homo sapiens
agagccaggctctgcctg

SEQ ID NO: 5176821 - DNA, 10 bp, Homo sapiens
agagccaggg

SEQ ID NO: 5176822 - DNA, 17 bp, Homo sapiens
agagccagggctgtcct

SEQ ID NO: 5176823 - DNA, 18 bp, Homo sapiens
agagccaggggtgtccca

SEQ ID NO: 5176824 - DNA, 13 bp, Homo sapiens
agagccagggtct

SEQ ID NO: 5176825 - DNA, 16 bp, Homo sapiens
agagccatacataaaa

SEQ ID NO: 5176826 - DNA, 19 bp, Homo sapiens
agagccatataagtttgaa

SEQ ID NO: 5176827 - DNA, 13 bp, Homo sapiens
agagccatccacc

SEQ ID NO: 5176828 - DNA, 17 bp, Homo sapiens
agagccatccaccctga

SEQ ID NO: 5176829 - DNA, 21 bp, Homo sapiens
agagccatccaccctgaggag

SEQ ID NO: 5176830 - DNA, 19 bp, Homo sapiens
agagccatggactctacac

SEQ ID NO: 5176831 - DNA, 14 bp, Homo sapiens
agagccatgggcct

SEQ ID NO: 5176832 - DNA, 19 bp, Homo sapiens
agagccatgggcctgggcc

SEQ ID NO: 5176833 - DNA, 23 bp, Homo sapiens
agagccatgggcctgggcctgct

SEQ ID NO: 5176834 - DNA, 18 bp, Homo sapiens
agagcccaagtgccatcc

SEQ ID NO: 5176835 - DNA, 16 bp, Homo sapiens
agagcccaccagccag

SEQ ID NO: 5176836 - DNA, 20 bp, Homo sapiens
agagcccaccagccagccct

SEQ ID NO: 5176837 - DNA, 22 bp, Homo sapiens
agagcccaccagccagccctgg

SEQ ID NO: 5176838 - DNA, 23 bp, Homo sapiens
agagcccaccagccagccctggc

SEQ ID NO: 5176839 - DNA, 19 bp, Homo sapiens
agagcccaccttggctcaa

SEQ ID NO: 5176840 - DNA, 17 bp, Homo sapiens
agagcccacgcccccac

SEQ ID NO: 5176841 - DNA, 16 bp, Homo sapiens
agagcccagaggtaac

SEQ ID NO: 5176842 - DNA, 15 bp, Homo sapiens
agagcccagagtccc

SEQ ID NO: 5176843 - DNA, 13 bp, Homo sapiens
agagcccagccca

SEQ ID NO: 5176844 - DNA, 11 bp, Homo sapiens
agagcccagct

SEQ ID NO: 5176845 - DNA, 12 bp, Homo sapiens
agagcccagctc

SEQ ID NO: 5176846 - DNA, 14 bp, Homo sapiens
agagcccagctcca

SEQ ID NO: 5176847 - DNA, 13 bp, Homo sapiens
agagcccagctct

SEQ ID NO: 5176848 - DNA, 18 bp, Homo sapiens
agagcccagctcttgctc

SEQ ID NO: 5176849 - DNA, 20 bp, Homo sapiens
agagcccagctcttgctctc

SEQ ID NO: 5176850 - DNA, 19 bp, Homo sapiens
agagcccaggagctcccct

SEQ ID NO: 5176851 - DNA, 14 bp, Homo sapiens
agagcccaggcctc

SEQ ID NO: 5176852 - DNA, 14 bp, Homo sapiens
agagcccatgctca

SEQ ID NO: 5176853 - DNA, 14 bp, Homo sapiens
agagccccacacgg

SEQ ID NO: 5176854 - DNA, 13 bp, Homo sapiens
agagccccactcc

SEQ ID NO: 5176855 - DNA, 14 bp, Homo sapiens
agagccccactccc

SEQ ID NO: 5176856 - DNA, 13 bp, Homo sapiens
agagccccagctg

SEQ ID NO: 5176857 - DNA, 14 bp, Homo sapiens
agagccccatggtg

SEQ ID NO: 5176858 - DNA, 15 bp, Homo sapiens
agagcccccaagcct

SEQ ID NO: 5176859 - DNA, 21 bp, Homo sapiens
agagcccccaagcctctgccc

SEQ ID NO: 5176860 - DNA, 19 bp, Homo sapiens
agagcccccaccagcagca

SEQ ID NO: 5176861 - DNA, 14 bp, Homo sapiens
agagcccccagccc

SEQ ID NO: 5176862 - DNA, 22 bp, Homo sapiens
agagccccccgtgtggcttaca

SEQ ID NO: 5176863 - DNA, 18 bp, Homo sapiens
agagccccgccccacccc

SEQ ID NO: 5176864 - DNA, 19 bp, Homo sapiens
agagccccgccccaccccg

SEQ ID NO: 5176865 - DNA, 16 bp, Homo sapiens
agagccccggagcacc

SEQ ID NO: 5176866 - DNA, 22 bp, Homo sapiens
agagcccctcctaacccagcag

SEQ ID NO: 5176867 - DNA, 15 bp, Homo sapiens
agagcccctcctcca

SEQ ID NO: 5176868 - DNA, 20 bp, Homo sapiens
agagcccctcctccagcccc

SEQ ID NO: 5176869 - DNA, 16 bp, Homo sapiens
agagcccgcccacctg

SEQ ID NO: 5176870 - DNA, 18 bp, Homo sapiens
agagcccgcccacctggg

SEQ ID NO: 5176871 - DNA, 18 bp, Homo sapiens
agagcccgccgtctgcag

SEQ ID NO: 5176872 - DNA, 24 bp, Homo sapiens
agagcccgccgtctgcaggggcct

SEQ ID NO: 5176873 - DNA, 17 bp, Homo sapiens
agagcccgcgtgctgga

SEQ ID NO: 5176874 - DNA, 19 bp, Homo sapiens
agagcccgcgtgctggaga

SEQ ID NO: 5176875 - DNA, 14 bp, Homo sapiens
agagcccgggagag

SEQ ID NO: 5176876 - DNA, 18 bp, Homo sapiens
agagcccgggagagactc

SEQ ID NO: 5176877 - DNA, 17 bp, Homo sapiens
agagcccgggagctgct

SEQ ID NO: 5176878 - DNA, 12 bp, Homo sapiens
agagccctccac

SEQ ID NO: 5176879 - DNA, 18 bp, Homo sapiens
agagccctccaggcctgc

SEQ ID NO: 5176880 - DNA, 19 bp, Homo sapiens
agagccctccaggcctgca

SEQ ID NO: 5176881 - DNA, 21 bp, Homo sapiens
agagccctccaggcctgcagg

SEQ ID NO: 5176882 - DNA, 19 bp, Homo sapiens
agagccctctgagccgcca

SEQ ID NO: 5176883 - DNA, 22 bp, Homo sapiens
agagccctctgctgctttccaa

SEQ ID NO: 5176884 - DNA, 19 bp, Homo sapiens
agagccctgagctcaggct

SEQ ID NO: 5176885 - DNA, 18 bp, Homo sapiens
agagccctgaggcctaga

SEQ ID NO: 5176886 - DNA, 13 bp, Homo sapiens
agagccctgctcc

SEQ ID NO: 5176887 - DNA, 14 bp, Homo sapiens
agagccctgctgtg

SEQ ID NO: 5176888 - DNA, 18 bp, Homo sapiens
agagccctggacacccct

SEQ ID NO: 5176889 - DNA, 19 bp, Homo sapiens
agagccctggacacccctg

SEQ ID NO: 5176890 - DNA, 23 bp, Homo sapiens
agagccctggacacccctgctct

SEQ ID NO: 5176891 - DNA, 16 bp, Homo sapiens
agagccctggctgggt

SEQ ID NO: 5176892 - DNA, 13 bp, Homo sapiens
agagccctgggac

SEQ ID NO: 5176893 - DNA, 15 bp, Homo sapiens
agagccctgggaccg

SEQ ID NO: 5176894 - DNA, 20 bp, Homo sapiens
agagccctgtggccgactct

SEQ ID NO: 5176895 - DNA, 18 bp, Homo sapiens
agagcccttcccagggca

SEQ ID NO: 5176896 - DNA, 20 bp, Homo sapiens
agagcccttgactgtacaga

SEQ ID NO: 5176897 - DNA, 18 bp, Homo sapiens
agagccgacaatgccctg

SEQ ID NO: 5176898 - DNA, 17 bp, Homo sapiens
agagccgcaccctggct

SEQ ID NO: 5176899 - DNA, 19 bp, Homo sapiens
agagccgcaccctggctgg

SEQ ID NO: 5176900 - DNA, 20 bp, Homo sapiens
agagccgcaccctggctgga

SEQ ID NO: 5176901 - DNA, 23 bp, Homo sapiens
agagccgccccgtgtccccccag

SEQ ID NO: 5176902 - DNA, 16 bp, Homo sapiens
agagccgggaagcgat

SEQ ID NO: 5176903 - DNA, 20 bp, Homo sapiens
agagccggggcactttcaga

SEQ ID NO: 5176904 - DNA, 18 bp, Homo sapiens
agagccgggtgtccccaa

SEQ ID NO: 5176905 - DNA, 19 bp, Homo sapiens
agagccggtggtgcccgtg

SEQ ID NO: 5176906 - DNA, 17 bp, Homo sapiens
agagccgtaaaaactga

SEQ ID NO: 5176907 - DNA, 16 bp, Homo sapiens
agagccgtggtccctg

SEQ ID NO: 5176908 - DNA, 16 bp, Homo sapiens
agagccgttcctggga

SEQ ID NO: 5176909 - DNA, 15 bp, Homo sapiens
agagcctaagaaaat

SEQ ID NO: 5176910 - DNA, 18 bp, Homo sapiens
agagcctaagaaaatcat

SEQ ID NO: 5176911 - DNA, 16 bp, Homo sapiens
agagcctaccttcacc

SEQ ID NO: 5176912 - DNA, 14 bp, Homo sapiens
agagcctagccacc

SEQ ID NO: 5176913 - DNA, 20 bp, Homo sapiens
agagcctagccacctcccac

SEQ ID NO: 5176914 - DNA, 20 bp, Homo sapiens
agagcctatggaaagggtgt

SEQ ID NO: 5176915 - DNA, 14 bp, Homo sapiens
agagcctcaaatga

SEQ ID NO: 5176916 - DNA, 17 bp, Homo sapiens
agagcctcaaatgagaa

SEQ ID NO: 5176917 - DNA, 22 bp, Homo sapiens
agagcctcccaaggagaacaaa

SEQ ID NO: 5176918 - DNA, 23 bp, Homo sapiens
agagcctcccaaggagaacaaat

SEQ ID NO: 5176919 - DNA, 23 bp, Homo sapiens
agagcctcccaccagagccggga

SEQ ID NO: 5176920 - DNA, 14 bp, Homo sapiens
agagcctccctcag

SEQ ID NO: 5176921 - DNA, 20 bp, Homo sapiens
agagcctccctcagccacgc

SEQ ID NO: 5176922 - DNA, 23 bp, Homo sapiens
agagcctccctcagccacgcctc

SEQ ID NO: 5176923 - DNA, 22 bp, Homo sapiens
agagcctcctgggaacacatct

SEQ ID NO: 5176924 - DNA, 23 bp, Homo sapiens
agagcctctgttttgtaaactaa

SEQ ID NO: 5176925 - DNA, 13 bp, Homo sapiens
agagcctcttagt

SEQ ID NO: 5176926 - DNA, 18 bp, Homo sapiens
agagcctctttgctggag

SEQ ID NO: 5176927 - DNA, 19 bp, Homo sapiens
agagcctgaagctggcctg

SEQ ID NO: 5176928 - DNA, 16 bp, Homo sapiens
agagcctgaatttgta

SEQ ID NO: 5176929 - DNA, 17 bp, Homo sapiens
agagcctgacctgagag

SEQ ID NO: 5176930 - DNA, 13 bp, Homo sapiens
agagcctgaggga

SEQ ID NO: 5176931 - DNA, 16 bp, Homo sapiens
agagcctgatctcttc

SEQ ID NO: 5176932 - DNA, 18 bp, Homo sapiens
agagcctgatctcttcct

SEQ ID NO: 5176933 - DNA, 14 bp, Homo sapiens
agagcctgcaggat

SEQ ID NO: 5176934 - DNA, 18 bp, Homo sapiens
agagcctgcaggtgctgc

SEQ ID NO: 5176935 - DNA, 10 bp, Homo sapiens
agagcctgcc

SEQ ID NO: 5176936 - DNA, 13 bp, Homo sapiens
agagcctgcccca

SEQ ID NO: 5176937 - DNA, 18 bp, Homo sapiens
agagcctgcctaaccagg

SEQ ID NO: 5176938 - DNA, 16 bp, Homo sapiens
agagcctgctccccca

SEQ ID NO: 5176939 - DNA, 18 bp, Homo sapiens
agagcctgctcccccacc

SEQ ID NO: 5176940 - DNA, 20 bp, Homo sapiens
agagcctgctcccccacccc

SEQ ID NO: 5176941 - DNA, 12 bp, Homo sapiens
agagcctgctgg

SEQ ID NO: 5176942 - DNA, 13 bp, Homo sapiens
agagcctggagaa

SEQ ID NO: 5176943 - DNA, 17 bp, Homo sapiens
agagcctggagaagctg

SEQ ID NO: 5176944 - DNA, 10 bp, Homo sapiens
agagcctggc

SEQ ID NO: 5176945 - DNA, 11 bp, Homo sapiens
agagcctggca

SEQ ID NO: 5176946 - DNA, 17 bp, Homo sapiens
agagcctggccccaggc

SEQ ID NO: 5176947 - DNA, 18 bp, Homo sapiens
agagcctggccccaggcc

SEQ ID NO: 5176948 - DNA, 10 bp, Homo sapiens
agaagccagc

SEQ ID NO: 5176949 - DNA, 14 bp, Homo sapiens
agaagccagcttgt

SEQ ID NO: 5176950 - DNA, 20 bp, Homo sapiens
agaagccagcttgtttacat

SEQ ID NO: 5176951 - DNA, 12 bp, Homo sapiens
agaagccaggag

SEQ ID NO: 5176952 - DNA, 14 bp, Homo sapiens
agaagccaggagca

SEQ ID NO: 5176953 - DNA, 12 bp, Homo sapiens
agaagccagtct

SEQ ID NO: 5176954 - DNA, 22 bp, Homo sapiens
agaagccatatatgaccagaag

SEQ ID NO: 5176955 - DNA, 21 bp, Homo sapiens
agaagccatgggacctcctcc

SEQ ID NO: 5176956 - DNA, 20 bp, Homo sapiens
agaagccatgtactcaagta

SEQ ID NO: 5176957 - DNA, 10 bp, Homo sapiens
agaagccatt

SEQ ID NO: 5176958 - DNA, 14 bp, Homo sapiens
agaagccattgtct

SEQ ID NO: 5176959 - DNA, 15 bp, Homo sapiens
agaagccattgtctt

SEQ ID NO: 5176960 - DNA, 18 bp, Homo sapiens
agaagcccaatattataa

SEQ ID NO: 5176961 - DNA, 12 bp, Homo sapiens
agaagcccagaa

SEQ ID NO: 5176962 - DNA, 12 bp, Homo sapiens
agaagcccagga

SEQ ID NO: 5176963 - DNA, 14 bp, Homo sapiens
agaagcccatggag

SEQ ID NO: 5176964 - DNA, 21 bp, Homo sapiens
agaagcccatgtcttctgctg

SEQ ID NO: 5176965 - DNA, 24 bp, Homo sapiens
agaagcccccagctaagaacctgg

SEQ ID NO: 5176966 - DNA, 19 bp, Homo sapiens
agaagccccgcacgggctg

SEQ ID NO: 5176967 - DNA, 13 bp, Homo sapiens
agaagcccggctc

SEQ ID NO: 5176968 - DNA, 17 bp, Homo sapiens
agaagcccggctcctgg

SEQ ID NO: 5176969 - DNA, 20 bp, Homo sapiens
agaagcccggctcctggtca

SEQ ID NO: 5176970 - DNA, 18 bp, Homo sapiens
agaagccctgcagagcac

SEQ ID NO: 5176971 - DNA, 14 bp, Homo sapiens
agaagccctgttct

SEQ ID NO: 5176972 - DNA, 19 bp, Homo sapiens
agaagccggcggagctctg

SEQ ID NO: 5176973 - DNA, 18 bp, Homo sapiens
agaagccgggaacagaca

SEQ ID NO: 5176974 - DNA, 22 bp, Homo sapiens
agaagccgggaacagacaacag

SEQ ID NO: 5176975 - DNA, 14 bp, Homo sapiens
agaagccgtgggtg

SEQ ID NO: 5176976 - DNA, 21 bp, Homo sapiens
agaagcctaattgtcacatca

SEQ ID NO: 5176977 - DNA, 14 bp, Homo sapiens
agaagcctccttac

SEQ ID NO: 5176978 - DNA, 17 bp, Homo sapiens
agaagcctgaggctggg

SEQ ID NO: 5176979 - DNA, 22 bp, Homo sapiens
agaagcctggactctgccccac

SEQ ID NO: 5176980 - DNA, 11 bp, Homo sapiens
agaagcctggg

SEQ ID NO: 5176981 - DNA, 18 bp, Homo sapiens
agaagcctgtaacactcc

SEQ ID NO: 5176982 - DNA, 22 bp, Homo sapiens
agaagcctgtctgtacttcatt

SEQ ID NO: 5176983 - DNA, 20 bp, Homo sapiens
agaagccttaatttgcacag

SEQ ID NO: 5176984 - DNA, 19 bp, Homo sapiens
agaagccttatgaaaatta

SEQ ID NO: 5176985 - DNA, 11 bp, Homo sapiens
agaagccttca

SEQ ID NO: 5176986 - DNA, 15 bp, Homo sapiens
agaagccttcaagct

SEQ ID NO: 5176987 - DNA, 18 bp, Homo sapiens
agaagccttcaagctctg

SEQ ID NO: 5176988 - DNA, 19 bp, Homo sapiens
agaagccttcagctccagg

SEQ ID NO: 5176989 - DNA, 13 bp, Homo sapiens
agaagccttcttg

SEQ ID NO: 5176990 - DNA, 21 bp, Homo sapiens
agaagccttcttgctgcccac

SEQ ID NO: 5176991 - DNA, 24 bp, Homo sapiens
agaagccttggaaccagccccatc

SEQ ID NO: 5176992 - DNA, 15 bp, Homo sapiens
agaagcgaacaaaaa

SEQ ID NO: 5176993 - DNA, 14 bp, Homo sapiens
agaagcgagcactg

SEQ ID NO: 5176994 - DNA, 22 bp, Homo sapiens
agaagcgattatgaaagcaaca

SEQ ID NO: 5176995 - DNA, 19 bp, Homo sapiens
agaagcgatttaagttaca

SEQ ID NO: 5176996 - DNA, 15 bp, Homo sapiens
agaagcgctgccctg

SEQ ID NO: 5176997 - DNA, 22 bp, Homo sapiens
agaagcggtttccaggccaccg

SEQ ID NO: 5176998 - DNA, 22 bp, Homo sapiens
agaagcgtctcccttggccacg

SEQ ID NO: 5176999 - DNA, 15 bp, Homo sapiens
agaagcgtttttaac

SEQ ID NO: 5177000 - DNA, 18 bp, Homo sapiens
agaagcgtttttaacctg

SEQ ID NO: 5177001 - DNA, 14 bp, Homo sapiens
agaagctaatgtag

SEQ ID NO: 5177002 - DNA, 20 bp, Homo sapiens
agaagctataaattcctctt

SEQ ID NO: 5177003 - DNA, 16 bp, Homo sapiens
agaagctataagagaa

SEQ ID NO: 5177004 - DNA, 22 bp, Homo sapiens
agaagctatggaaccagcagtt

SEQ ID NO: 5177005 - DNA, 16 bp, Homo sapiens
agaagctatgttttta

SEQ ID NO: 5177006 - DNA, 20 bp, Homo sapiens
agaagctatgtttttaaagt

SEQ ID NO: 5177007 - DNA, 13 bp, Homo sapiens
agaagctattttt

SEQ ID NO: 5177008 - DNA, 13 bp, Homo sapiens
agaagctcagcta

SEQ ID NO: 5177009 - DNA, 12 bp, Homo sapiens
agaagctcaggt

SEQ ID NO: 5177010 - DNA, 23 bp, Homo sapiens
agaagctcaggttccctgccaca

SEQ ID NO: 5177011 - DNA, 13 bp, Homo sapiens
agaagctcattta

SEQ ID NO: 5177012 - DNA, 14 bp, Homo sapiens
agaagctccaggta

SEQ ID NO: 5177013 - DNA, 15 bp, Homo sapiens
agaagctcccaggaa

SEQ ID NO: 5177014 - DNA, 18 bp, Homo sapiens
agaagctcccaggaacaa

SEQ ID NO: 5177015 - DNA, 13 bp, Homo sapiens
agaagctccgggt

SEQ ID NO: 5177016 - DNA, 17 bp, Homo sapiens
agaagctcctctcccca

SEQ ID NO: 5177017 - DNA, 22 bp, Homo sapiens
agaagctcctctccccagccca

SEQ ID NO: 5177018 - DNA, 23 bp, Homo sapiens
agaagctcctctccccagcccag

SEQ ID NO: 5177019 - DNA, 16 bp, Homo sapiens
agaagctcctgaatcc

SEQ ID NO: 5177020 - DNA, 19 bp, Homo sapiens
agaagctcctgctacttcc

SEQ ID NO: 5177021 - DNA, 14 bp, Homo sapiens
agaagctcgcccca

SEQ ID NO: 5177022 - DNA, 15 bp, Homo sapiens
agaagctcgccccac

SEQ ID NO: 5177023 - DNA, 19 bp, Homo sapiens
agaagctcgccccacctcc

SEQ ID NO: 5177024 - DNA, 18 bp, Homo sapiens
agaagctctcgagggaag

SEQ ID NO: 5177025 - DNA, 13 bp, Homo sapiens
agaagctgaagcc

SEQ ID NO: 5177026 - DNA, 13 bp, Homo sapiens
agaagctgaggat

SEQ ID NO: 5177027 - DNA, 21 bp, Homo sapiens
agaagctgaggatcctcacag

SEQ ID NO: 5177028 - DNA, 22 bp, Homo sapiens
agaagctgaggctagttccaga

SEQ ID NO: 5177029 - DNA, 16 bp, Homo sapiens
agaagctgatccagtt

SEQ ID NO: 5177030 - DNA, 16 bp, Homo sapiens
agaagctgatctgatt

SEQ ID NO: 5177031 - DNA, 22 bp, Homo sapiens
agaagctgattttcatgaaaat

SEQ ID NO: 5177032 - DNA, 11 bp, Homo sapiens
agaagctgcag

SEQ ID NO: 5177033 - DNA, 14 bp, Homo sapiens
agaagctgcagctg

SEQ ID NO: 5177034 - DNA, 12 bp, Homo sapiens
agaagctgcagg

SEQ ID NO: 5177035 - DNA, 15 bp, Homo sapiens
agaagctgcaggctt

SEQ ID NO: 5177036 - DNA, 21 bp, Homo sapiens
agaagctgccaggtgagaaac

SEQ ID NO: 5177037 - DNA, 18 bp, Homo sapiens
agaagctgctccaggcct

SEQ ID NO: 5177038 - DNA, 23 bp, Homo sapiens
agaagctgctccaggcctgcagc

SEQ ID NO: 5177039 - DNA, 18 bp, Homo sapiens
agaagctgggagggaggg

SEQ ID NO: 5177040 - DNA, 17 bp, Homo sapiens
agaagctgtctaggtcc

SEQ ID NO: 5177041 - DNA, 13 bp, Homo sapiens
agaagctgtgtct

SEQ ID NO: 5177042 - DNA, 17 bp, Homo sapiens
agaagctgttgggagaa

SEQ ID NO: 5177043 - DNA, 18 bp, Homo sapiens
agaagctgttgtacattt

SEQ ID NO: 5177044 - DNA, 22 bp, Homo sapiens
agaagctgttgtacatttatga

SEQ ID NO: 5177045 - DNA, 23 bp, Homo sapiens
agaagctgttgtacatttatgat

SEQ ID NO: 5177046 - DNA, 16 bp, Homo sapiens
agaagcttaggcaggg

SEQ ID NO: 5177047 - DNA, 18 bp, Homo sapiens
agaagcttccacaaaatt

SEQ ID NO: 5177048 - DNA, 18 bp, Homo sapiens
agaagcttccattccaag

SEQ ID NO: 5177049 - DNA, 15 bp, Homo sapiens
agaagcttggaggag

SEQ ID NO: 5177050 - DNA, 19 bp, Homo sapiens
agaagcttgtattatcagt

SEQ ID NO: 5177051 - DNA, 21 bp, Homo sapiens
agaagcttgtggtgttcctga

SEQ ID NO: 5177052 - DNA, 15 bp, Homo sapiens
agaagctttatttct

SEQ ID NO: 5177053 - DNA, 24 bp, Homo sapiens
agaaggaaaaaaggaggatagaaa

SEQ ID NO: 5177054 - DNA, 16 bp, Homo sapiens
agaaggaaaaatgtgt

SEQ ID NO: 5177055 - DNA, 18 bp, Homo sapiens
agaaggaaaaatgtgtaa

SEQ ID NO: 5177056 - DNA, 19 bp, Homo sapiens
agaaggaaaacatgctgct

SEQ ID NO: 5177057 - DNA, 12 bp, Homo sapiens
agaaggaaaaga

SEQ ID NO: 5177058 - DNA, 14 bp, Homo sapiens
agaaggaaaagagt

SEQ ID NO: 5177059 - DNA, 18 bp, Homo sapiens
agaaggaaacggaagctg

SEQ ID NO: 5177060 - DNA, 13 bp, Homo sapiens
agaaggaaagaag

SEQ ID NO: 5177061 - DNA, 18 bp, Homo sapiens
agaaggaacattgcagag

SEQ ID NO: 5177062 - DNA, 20 bp, Homo sapiens
agaaggaacccggtcccagg

SEQ ID NO: 5177063 - DNA, 9 bp, Homo sapiens
agaaggaag

SEQ ID NO: 5177064 - DNA, 16 bp, Homo sapiens
agaaggaagccatagt

SEQ ID NO: 5177065 - DNA, 12 bp, Homo sapiens
agaaggaagccc

SEQ ID NO: 5177066 - DNA, 22 bp, Homo sapiens
agaaggaaggagactcacctct

SEQ ID NO: 5177067 - DNA, 19 bp, Homo sapiens
agaaggaaggaggcagact

SEQ ID NO: 5177068 - DNA, 18 bp, Homo sapiens
agaaggaaggatgccact

SEQ ID NO: 5177069 - DNA, 17 bp, Homo sapiens
agaaggaaggcagggag

SEQ ID NO: 5177070 - DNA, 17 bp, Homo sapiens
agaaggaaggcctgagc

SEQ ID NO: 5177071 - DNA, 14 bp, Homo sapiens
agaaggaagggcag

SEQ ID NO: 5177072 - DNA, 20 bp, Homo sapiens
agaaggaatggtgcgtggct

SEQ ID NO: 5177073 - DNA, 14 bp, Homo sapiens
agaaggaatttgta

SEQ ID NO: 5177074 - DNA, 17 bp, Homo sapiens
agaaggaatttgtactt

SEQ ID NO: 5177075 - DNA, 23 bp, Homo sapiens
agaaggacatgagatcagggcct

SEQ ID NO: 5177076 - DNA, 15 bp, Homo sapiens
agaaggacggtgcca

SEQ ID NO: 5177077 - DNA, 16 bp, Homo sapiens
agaaggactgaagaaa

SEQ ID NO: 5177078 - DNA, 13 bp, Homo sapiens
agaaggactgcag

SEQ ID NO: 5177079 - DNA, 22 bp, Homo sapiens
agaaggactgcagccactgatt

SEQ ID NO: 5177080 - DNA, 14 bp, Homo sapiens
agaaggactggtgc

SEQ ID NO: 5177081 - DNA, 16 bp, Homo sapiens
agaaggagaaggctgg

SEQ ID NO: 5177082 - DNA, 14 bp, Homo sapiens
agaaggagacagag

SEQ ID NO: 5177083 - DNA, 17 bp, Homo sapiens
agaaggagacagagctg

SEQ ID NO: 5177084 - DNA, 20 bp, Homo sapiens
agaaggagagcccaggcctg

SEQ ID NO: 5177085 - DNA, 22 bp, Homo sapiens
agaaggagaggcccggtgcagc

SEQ ID NO: 5177086 - DNA, 13 bp, Homo sapiens
agaaggagaggct

SEQ ID NO: 5177087 - DNA, 23 bp, Homo sapiens
agaaggagatgtaatgacagaga

SEQ ID NO: 5177088 - DNA, 16 bp, Homo sapiens
agaaggagcaagagaa

SEQ ID NO: 5177089 - DNA, 13 bp, Homo sapiens
agaaggagcaggc

SEQ ID NO: 5177090 - DNA, 14 bp, Homo sapiens
agaaggagccttgt

SEQ ID NO: 5177091 - DNA, 22 bp, Homo sapiens
agaaggaggaatgctggactgg

SEQ ID NO: 5177092 - DNA, 23 bp, Homo sapiens
agaaggaggagagggaaaatgtt

SEQ ID NO: 5177093 - DNA, 12 bp, Homo sapiens
agaaggaggggg

SEQ ID NO: 5177094 - DNA, 15 bp, Homo sapiens
agaaggatagcctca

SEQ ID NO: 5177095 - DNA, 17 bp, Homo sapiens
agaaggatagcctcagc

SEQ ID NO: 5177096 - DNA, 18 bp, Homo sapiens
agaaggatagcctcagcc

SEQ ID NO: 5177097 - DNA, 21 bp, Homo sapiens
agaaggatgaatgaggtccca

SEQ ID NO: 5177098 - DNA, 16 bp, Homo sapiens
agaaggatgtacattt

SEQ ID NO: 5177099 - DNA, 11 bp, Homo sapiens
agaaggcaaaa

SEQ ID NO: 5177100 - DNA, 14 bp, Homo sapiens
agaaggcaaagttt

SEQ ID NO: 5177101 - DNA, 14 bp, Homo sapiens
agaaggcaaatgac

SEQ ID NO: 5177102 - DNA, 19 bp, Homo sapiens
agaaggcaacttgaagaaa

SEQ ID NO: 5177103 - DNA, 14 bp, Homo sapiens
agaaggcaatatta

SEQ ID NO: 5177104 - DNA, 11 bp, Homo sapiens
agaaggcactg

SEQ ID NO: 5177105 - DNA, 17 bp, Homo sapiens
agaaggcagagaaaaca

SEQ ID NO: 5177106 - DNA, 19 bp, Homo sapiens
agaaggcagagaaaacaca

SEQ ID NO: 5177107 - DNA, 19 bp, Homo sapiens
agaaggcagcaaagagggg

SEQ ID NO: 5177108 - DNA, 15 bp, Homo sapiens
agaaggcaggcctcc

SEQ ID NO: 5177109 - DNA, 15 bp, Homo sapiens
agaaggcagggaaag

SEQ ID NO: 5177110 - DNA, 18 bp, Homo sapiens
agaaggcagtagttttca

SEQ ID NO: 5177111 - DNA, 20 bp, Homo sapiens
agaaggcagtagttttcaaa

SEQ ID NO: 5177112 - DNA, 22 bp, Homo sapiens
agaaggcatatcagtctctgag

SEQ ID NO: 5177113 - DNA, 15 bp, Homo sapiens
agaaggcatgagaaa

SEQ ID NO: 5177114 - DNA, 20 bp, Homo sapiens
agaaggccagaaaaggcagc

SEQ ID NO: 5177115 - DNA, 14 bp, Homo sapiens
agaaggccagagag

SEQ ID NO: 5177116 - DNA, 19 bp, Homo sapiens
agaaggccagagagggaaa

SEQ ID NO: 5177117 - DNA, 15 bp, Homo sapiens
agaaggccagcccac

SEQ ID NO: 5177118 - DNA, 17 bp, Homo sapiens
agaaggccagcccactg

SEQ ID NO: 5177119 - DNA, 22 bp, Homo sapiens
agaaggccagcccactgggccc

SEQ ID NO: 5177120 - DNA, 12 bp, Homo sapiens
agaaggccaggc

SEQ ID NO: 5177121 - DNA, 13 bp, Homo sapiens
agaaggccaggcc

SEQ ID NO: 5177122 - DNA, 17 bp, Homo sapiens
agaaggccccagagaga

SEQ ID NO: 5177123 - DNA, 19 bp, Homo sapiens
agaaggccccagagagacc

SEQ ID NO: 5177124 - DNA, 13 bp, Homo sapiens
agaaggcccggga

SEQ ID NO: 5177125 - DNA, 16 bp, Homo sapiens
agaaggcccgggagga

SEQ ID NO: 5177126 - DNA, 11 bp, Homo sapiens
agaaggcctcc

SEQ ID NO: 5177127 - DNA, 12 bp, Homo sapiens
agaaggcctccc

SEQ ID NO: 5177128 - DNA, 15 bp, Homo sapiens
agaaggcctgccccc

SEQ ID NO: 5177129 - DNA, 12 bp, Homo sapiens
agagcctggctt

SEQ ID NO: 5177130 - DNA, 22 bp, Homo sapiens
agagcctggctttggtccccag

SEQ ID NO: 5177131 - DNA, 11 bp, Homo sapiens
agagcctgggc

SEQ ID NO: 5177132 - DNA, 16 bp, Homo sapiens
agagcctgggcgcaag

SEQ ID NO: 5177133 - DNA, 16 bp, Homo sapiens
agagcctggggcatcc

SEQ ID NO: 5177134 - DNA, 12 bp, Homo sapiens
agagcctggggg

SEQ ID NO: 5177135 - DNA, 18 bp, Homo sapiens
agagcctgggggtggggg

SEQ ID NO: 5177136 - DNA, 13 bp, Homo sapiens
agagcctgtcacc

SEQ ID NO: 5177137 - DNA, 16 bp, Homo sapiens
agagcctgtcaccaga

SEQ ID NO: 5177138 - DNA, 18 bp, Homo sapiens
agagcctgtcaccagagc

SEQ ID NO: 5177139 - DNA, 22 bp, Homo sapiens
agagcctgtcaccagagcttct

SEQ ID NO: 5177140 - DNA, 12 bp, Homo sapiens
agagcctgtccc

SEQ ID NO: 5177141 - DNA, 17 bp, Homo sapiens
agagcctgtccccgcct

SEQ ID NO: 5177142 - DNA, 18 bp, Homo sapiens
agagcctgtccccgcctt

SEQ ID NO: 5177143 - DNA, 19 bp, Homo sapiens
agagcctgtccccgccttc

SEQ ID NO: 5177144 - DNA, 17 bp, Homo sapiens
agagcctgttttaaaaa

SEQ ID NO: 5177145 - DNA, 15 bp, Homo sapiens
agagccttaaaacat

SEQ ID NO: 5177146 - DNA, 17 bp, Homo sapiens
agagccttaatggatgc

SEQ ID NO: 5177147 - DNA, 13 bp, Homo sapiens
agagccttagcag

SEQ ID NO: 5177148 - DNA, 20 bp, Homo sapiens
agagccttagcagccctgga

SEQ ID NO: 5177149 - DNA, 17 bp, Homo sapiens
agagccttcaagtgcca

SEQ ID NO: 5177150 - DNA, 20 bp, Homo sapiens
agagccttcaagtgccaaac

SEQ ID NO: 5177151 - DNA, 14 bp, Homo sapiens
agagccttcagaat

SEQ ID NO: 5177152 - DNA, 23 bp, Homo sapiens
agagccttcagaatgctcctgag

SEQ ID NO: 5177153 - DNA, 20 bp, Homo sapiens
agagccttccacccaggggc

SEQ ID NO: 5177154 - DNA, 15 bp, Homo sapiens
agagccttccagggg

SEQ ID NO: 5177155 - DNA, 17 bp, Homo sapiens
agagccttccaggggtg

SEQ ID NO: 5177156 - DNA, 22 bp, Homo sapiens
agagccttccaggggtgggaca

SEQ ID NO: 5177157 - DNA, 22 bp, Homo sapiens
agagccttccatgacctcccct

SEQ ID NO: 5177158 - DNA, 23 bp, Homo sapiens
agagccttccatgacctcccctc

SEQ ID NO: 5177159 - DNA, 13 bp, Homo sapiens
agagccttctcag

SEQ ID NO: 5177160 - DNA, 20 bp, Homo sapiens
agagccttctcctgcctaca

SEQ ID NO: 5177161 - DNA, 21 bp, Homo sapiens
agagccttctcctgcctacat

SEQ ID NO: 5177162 - DNA, 21 bp, Homo sapiens
agagccttctgatgtctctaa

SEQ ID NO: 5177163 - DNA, 21 bp, Homo sapiens
agagccttgggagccactgcc

SEQ ID NO: 5177164 - DNA, 20 bp, Homo sapiens
agagccttggtgtccacctg

SEQ ID NO: 5177165 - DNA, 22 bp, Homo sapiens
agagccttggtgtccacctggc

SEQ ID NO: 5177166 - DNA, 19 bp, Homo sapiens
agagcctttcctcaaaact

SEQ ID NO: 5177167 - DNA, 18 bp, Homo sapiens
agagcctttctccagccc

SEQ ID NO: 5177168 - DNA, 21 bp, Homo sapiens
agagcctttggatgaccagaa

SEQ ID NO: 5177169 - DNA, 21 bp, Homo sapiens
agagccttttatctgcagaac

SEQ ID NO: 5177170 - DNA, 15 bp, Homo sapiens
agagcgaccagcagg

SEQ ID NO: 5177171 - DNA, 19 bp, Homo sapiens
agagcgagaccctgtctca

SEQ ID NO: 5177172 - DNA, 19 bp, Homo sapiens
agagcgagagatcaaagat

SEQ ID NO: 5177173 - DNA, 17 bp, Homo sapiens
agagcgagattccgtct

SEQ ID NO: 5177174 - DNA, 16 bp, Homo sapiens
agagcgaggaaaggat

SEQ ID NO: 5177175 - DNA, 21 bp, Homo sapiens
agagcgaggaaaggattttac

SEQ ID NO: 5177176 - DNA, 20 bp, Homo sapiens
agagcgaggaggcgcggcct

SEQ ID NO: 5177177 - DNA, 23 bp, Homo sapiens
agagcgaggctgagcctacagat

SEQ ID NO: 5177178 - DNA, 19 bp, Homo sapiens
agagcgccacccgcccgcc

SEQ ID NO: 5177179 - DNA, 13 bp, Homo sapiens
agagcgccaggaa

SEQ ID NO: 5177180 - DNA, 18 bp, Homo sapiens
agagcgccaggaagccag

SEQ ID NO: 5177181 - DNA, 19 bp, Homo sapiens
agagcgccaggaagccaga

SEQ ID NO: 5177182 - DNA, 18 bp, Homo sapiens
agagcgcctcttcctctg

SEQ ID NO: 5177183 - DNA, 14 bp, Homo sapiens
agagcgcctgcccc

SEQ ID NO: 5177184 - DNA, 15 bp, Homo sapiens
agagcgcctgcccct

SEQ ID NO: 5177185 - DNA, 15 bp, Homo sapiens
agagcgcggctggct

SEQ ID NO: 5177186 - DNA, 18 bp, Homo sapiens
agagcgcggctggctctg

SEQ ID NO: 5177187 - DNA, 21 bp, Homo sapiens
agagcgcgggagagagtgaga

SEQ ID NO: 5177188 - DNA, 13 bp, Homo sapiens
agagcgcgtctgg

SEQ ID NO: 5177189 - DNA, 19 bp, Homo sapiens
agagcgctcctctgccttg

SEQ ID NO: 5177190 - DNA, 14 bp, Homo sapiens
agagcggctggaga

SEQ ID NO: 5177191 - DNA, 15 bp, Homo sapiens
agagcggctggagaa

SEQ ID NO: 5177192 - DNA, 19 bp, Homo sapiens
agagcggctggagaaagat

SEQ ID NO: 5177193 - DNA, 18 bp, Homo sapiens
agagcgggcctcttccct

SEQ ID NO: 5177194 - DNA, 21 bp, Homo sapiens
agagcgggcctcttccctcag

SEQ ID NO: 5177195 - DNA, 18 bp, Homo sapiens
agagcggggtcccctctg

SEQ ID NO: 5177196 - DNA, 21 bp, Homo sapiens
agagcggggtcccctctgtgc

SEQ ID NO: 5177197 - DNA, 17 bp, Homo sapiens
agagcgggtaaagtgca

SEQ ID NO: 5177198 - DNA, 23 bp, Homo sapiens
agagcggtctcaggctggtggga

SEQ ID NO: 5177199 - DNA, 20 bp, Homo sapiens
agagcgtgagctgagcaggc

SEQ ID NO: 5177200 - DNA, 16 bp, Homo sapiens
agagcgttactgtaga

SEQ ID NO: 5177201 - DNA, 19 bp, Homo sapiens
agagctaaactccttcctg

SEQ ID NO: 5177202 - DNA, 21 bp, Homo sapiens
agagctaacccttatctgtaa

SEQ ID NO: 5177203 - DNA, 12 bp, Homo sapiens
agagctaaggcc

SEQ ID NO: 5177204 - DNA, 14 bp, Homo sapiens
agagctaataaatc

SEQ ID NO: 5177205 - DNA, 14 bp, Homo sapiens
agagctaatttaag

SEQ ID NO: 5177206 - DNA, 11 bp, Homo sapiens
agagctacata

SEQ ID NO: 5177207 - DNA, 20 bp, Homo sapiens
agagctagaaaaataaaatg

SEQ ID NO: 5177208 - DNA, 13 bp, Homo sapiens
agagctagaaagt

SEQ ID NO: 5177209 - DNA, 18 bp, Homo sapiens
agagctagaacctggaga

SEQ ID NO: 5177210 - DNA, 22 bp, Homo sapiens
agagctagaacctggagggcta

SEQ ID NO: 5177211 - DNA, 14 bp, Homo sapiens
agagctagagaaat

SEQ ID NO: 5177212 - DNA, 14 bp, Homo sapiens
agagctagaggcca

SEQ ID NO: 5177213 - DNA, 13 bp, Homo sapiens
agagctagcgctg

SEQ ID NO: 5177214 - DNA, 21 bp, Homo sapiens
agagctagctgccactttcac

SEQ ID NO: 5177215 - DNA, 19 bp, Homo sapiens
agagctaggagcaaagcct

SEQ ID NO: 5177216 - DNA, 20 bp, Homo sapiens
agagctaggagcaaagcctg

SEQ ID NO: 5177217 - DNA, 14 bp, Homo sapiens
agagctaggcaggg

SEQ ID NO: 5177218 - DNA, 15 bp, Homo sapiens
agagctaggctgtgg

SEQ ID NO: 5177219 - DNA, 15 bp, Homo sapiens
agagctagggctgct

SEQ ID NO: 5177220 - DNA, 21 bp, Homo sapiens
agagctagggctgctgcttct

SEQ ID NO: 5177221 - DNA, 23 bp, Homo sapiens
agagctatatatatatatatatg

SEQ ID NO: 5177222 - DNA, 14 bp, Homo sapiens
agagctatgcacac

SEQ ID NO: 5177223 - DNA, 20 bp, Homo sapiens
agagctatgcacaccaaatt

SEQ ID NO: 5177224 - DNA, 22 bp, Homo sapiens
agagctatgcacaccaaattgc

SEQ ID NO: 5177225 - DNA, 15 bp, Homo sapiens
agagctatggtgagg

SEQ ID NO: 5177226 - DNA, 18 bp, Homo sapiens
agagctattttagaaagc

SEQ ID NO: 5177227 - DNA, 19 bp, Homo sapiens
agagctattttagaaagct

SEQ ID NO: 5177228 - DNA, 17 bp, Homo sapiens
agagctcaagggacaag

SEQ ID NO: 5177229 - DNA, 21 bp, Homo sapiens
agagctcaagggacaaggaca

SEQ ID NO: 5177230 - DNA, 13 bp, Homo sapiens
agagctcaccatg

SEQ ID NO: 5177231 - DNA, 17 bp, Homo sapiens
agagctcaccatggaat

SEQ ID NO: 5177232 - DNA, 16 bp, Homo sapiens
agagctcagcacagcc

SEQ ID NO: 5177233 - DNA, 18 bp, Homo sapiens
agagctcagcacagcctc

SEQ ID NO: 5177234 - DNA, 22 bp, Homo sapiens
agagctcagcacagcctcaccc

SEQ ID NO: 5177235 - DNA, 16 bp, Homo sapiens
agagctcaggagaagg

SEQ ID NO: 5177236 - DNA, 17 bp, Homo sapiens
agagctcaggagaaggc

SEQ ID NO: 5177237 - DNA, 16 bp, Homo sapiens
agagctcagtacaggg

SEQ ID NO: 5177238 - DNA, 19 bp, Homo sapiens
agagctcagtacagggcag

SEQ ID NO: 5177239 - DNA, 20 bp, Homo sapiens
agagctcagtacagggcagg

SEQ ID NO: 5177240 - DNA, 20 bp, Homo sapiens
agagctcatcccccctgctg

SEQ ID NO: 5177241 - DNA, 21 bp, Homo sapiens
agagctcatcccccctgctgc

SEQ ID NO: 5177242 - DNA, 15 bp, Homo sapiens
agagctccacagaag

SEQ ID NO: 5177243 - DNA, 11 bp, Homo sapiens
agagctcccag

SEQ ID NO: 5177244 - DNA, 15 bp, Homo sapiens
agagctcccaggacg

SEQ ID NO: 5177245 - DNA, 22 bp, Homo sapiens
agagctcccctccacagctgca

SEQ ID NO: 5177246 - DNA, 20 bp, Homo sapiens
agagctcccggcgtggtgga

SEQ ID NO: 5177247 - DNA, 17 bp, Homo sapiens
agagctcctgtccctac

SEQ ID NO: 5177248 - DNA, 20 bp, Homo sapiens
agagctcctgtccctaccca

SEQ ID NO: 5177249 - DNA, 15 bp, Homo sapiens
agagctccttgatga

SEQ ID NO: 5177250 - DNA, 15 bp, Homo sapiens
agagctctacaggcc

SEQ ID NO: 5177251 - DNA, 16 bp, Homo sapiens
agagctctacaggcct

SEQ ID NO: 5177252 - DNA, 20 bp, Homo sapiens
agagctctacaggcctgcag

SEQ ID NO: 5177253 - DNA, 16 bp, Homo sapiens
agagctctccagctcc

SEQ ID NO: 5177254 - DNA, 22 bp, Homo sapiens
agagctctccttagcattcata

SEQ ID NO: 5177255 - DNA, 15 bp, Homo sapiens
agagctctgacccac

SEQ ID NO: 5177256 - DNA, 23 bp, Homo sapiens
agagctctgacccacagcctcca

SEQ ID NO: 5177257 - DNA, 14 bp, Homo sapiens
agagctctgcacgt

SEQ ID NO: 5177258 - DNA, 20 bp, Homo sapiens
agagctctggagccacctgt

SEQ ID NO: 5177259 - DNA, 22 bp, Homo sapiens
agagctctggtgataaggacat

SEQ ID NO: 5177260 - DNA, 22 bp, Homo sapiens
agagctcttcggtttctgagca

SEQ ID NO: 5177261 - DNA, 16 bp, Homo sapiens
agagctcttgtgttca

SEQ ID NO: 5177262 - DNA, 18 bp, Homo sapiens
agagctcttgtgttcaga

SEQ ID NO: 5177263 - DNA, 19 bp, Homo sapiens
agagctcttgtgttcagaa

SEQ ID NO: 5177264 - DNA, 20 bp, Homo sapiens
agagctctttgtctcaccag

SEQ ID NO: 5177265 - DNA, 21 bp, Homo sapiens
agagctctttgtctcaccagc

SEQ ID NO: 5177266 - DNA, 23 bp, Homo sapiens
agagctcttttttagctctctta

SEQ ID NO: 5177267 - DNA, 15 bp, Homo sapiens
agagctgaagtactg

SEQ ID NO: 5177268 - DNA, 20 bp, Homo sapiens
agagctgacacaaacctgcc

SEQ ID NO: 5177269 - DNA, 23 bp, Homo sapiens
agagctgacacaaacctgcctgg

SEQ ID NO: 5177270 - DNA, 23 bp, Homo sapiens
agagctgacacaggatgaaggca

SEQ ID NO: 5177271 - DNA, 23 bp, Homo sapiens
agagctgacccagagtggagtct

SEQ ID NO: 5177272 - DNA, 17 bp, Homo sapiens
agagctgagccagttgt

SEQ ID NO: 5177273 - DNA, 18 bp, Homo sapiens
agagctgagccagttgtc

SEQ ID NO: 5177274 - DNA, 17 bp, Homo sapiens
agagctgagggccctgt

SEQ ID NO: 5177275 - DNA, 13 bp, Homo sapiens
agagctgatccag

SEQ ID NO: 5177276 - DNA, 17 bp, Homo sapiens
agagctgatccagagca

SEQ ID NO: 5177277 - DNA, 19 bp, Homo sapiens
agagctgatccagagcaca

SEQ ID NO: 5177278 - DNA, 23 bp, Homo sapiens
agagctgatgtgagtgtgtgtga

SEQ ID NO: 5177279 - DNA, 23 bp, Homo sapiens
agagctgattgcagaaaggagag

SEQ ID NO: 5177280 - DNA, 21 bp, Homo sapiens
agagctgcagccagtcaggca

SEQ ID NO: 5177281 - DNA, 14 bp, Homo sapiens
agagctgccacctg

SEQ ID NO: 5177282 - DNA, 14 bp, Homo sapiens
agagctgccactgg

SEQ ID NO: 5177283 - DNA, 15 bp, Homo sapiens
agagctgccctctcc

SEQ ID NO: 5177284 - DNA, 18 bp, Homo sapiens
agagctgccctctcctgg

SEQ ID NO: 5177285 - DNA, 18 bp, Homo sapiens
agagctgcctaagaggca

SEQ ID NO: 5177286 - DNA, 21 bp, Homo sapiens
agagctgcctccccaatccat

SEQ ID NO: 5177287 - DNA, 14 bp, Homo sapiens
agagctgcctcctg

SEQ ID NO: 5177288 - DNA, 11 bp, Homo sapiens
agagctgcctg

SEQ ID NO: 5177289 - DNA, 13 bp, Homo sapiens
agagctgcctgga

SEQ ID NO: 5177290 - DNA, 14 bp, Homo sapiens
agagctgcgggctg

SEQ ID NO: 5177291 - DNA, 16 bp, Homo sapiens
agagctgcgggctgag

SEQ ID NO: 5177292 - DNA, 20 bp, Homo sapiens
agagctgcgggctgagggca

SEQ ID NO: 5177293 - DNA, 22 bp, Homo sapiens
agagctgcgggctgagggcatc

SEQ ID NO: 5177294 - DNA, 23 bp, Homo sapiens
agagctgcgggctgagggcatct

SEQ ID NO: 5177295 - DNA, 14 bp, Homo sapiens
agagctgctccttt

SEQ ID NO: 5177296 - DNA, 16 bp, Homo sapiens
agagctgctcctttgg

SEQ ID NO: 5177297 - DNA, 16 bp, Homo sapiens
agagctgctctggaaa

SEQ ID NO: 5177298 - DNA, 22 bp, Homo sapiens
agagctgctctggaaaatgtga

SEQ ID NO: 5177299 - DNA, 15 bp, Homo sapiens
agagctgctgagcag

SEQ ID NO: 5177300 - DNA, 19 bp, Homo sapiens
agagctgctgagggacctt

SEQ ID NO: 5177301 - DNA, 13 bp, Homo sapiens
agagctgctgggc

SEQ ID NO: 5177302 - DNA, 12 bp, Homo sapiens
agagctgctgta

SEQ ID NO: 5177303 - DNA, 15 bp, Homo sapiens
agagctgctgtcctt

SEQ ID NO: 5177304 - DNA, 22 bp, Homo sapiens
agagctgctgtccttttaggaa

SEQ ID NO: 5177305 - DNA, 16 bp, Homo sapiens
agagctggaacacaat

SEQ ID NO: 5177306 - DNA, 11 bp, Homo sapiens
agaaggcctgg

SEQ ID NO: 5177307 - DNA, 12 bp, Homo sapiens
agaaggcctggt

SEQ ID NO: 5177308 - DNA, 18 bp, Homo sapiens
agaaggcctggtcagcag

SEQ ID NO: 5177309 - DNA, 21 bp, Homo sapiens
agaaggcctggtcagcagagc

SEQ ID NO: 5177310 - DNA, 15 bp, Homo sapiens
agaaggcgaggagag

SEQ ID NO: 5177311 - DNA, 17 bp, Homo sapiens
agaaggcgaggagagtg

SEQ ID NO: 5177312 - DNA, 18 bp, Homo sapiens
agaaggcgcttcccaact

SEQ ID NO: 5177313 - DNA, 18 bp, Homo sapiens
agaaggctcagccttgga

SEQ ID NO: 5177314 - DNA, 19 bp, Homo sapiens
agaaggctctatctgctgg

SEQ ID NO: 5177315 - DNA, 12 bp, Homo sapiens
agaaggctcttc

SEQ ID NO: 5177316 - DNA, 18 bp, Homo sapiens
agaaggctcttctgacta

SEQ ID NO: 5177317 - DNA, 19 bp, Homo sapiens
agaaggctgcctaaggagg

SEQ ID NO: 5177318 - DNA, 20 bp, Homo sapiens
agaaggctgggtccagggga

SEQ ID NO: 5177319 - DNA, 18 bp, Homo sapiens
agaaggcttctctccaca

SEQ ID NO: 5177320 - DNA, 12 bp, Homo sapiens
agaagggaaaca

SEQ ID NO: 5177321 - DNA, 14 bp, Homo sapiens
agaagggaaacagt

SEQ ID NO: 5177322 - DNA, 15 bp, Homo sapiens
agaagggaaacagtc

SEQ ID NO: 5177323 - DNA, 16 bp, Homo sapiens
agaagggaaacagtca

SEQ ID NO: 5177324 - DNA, 12 bp, Homo sapiens
agaagggaaagc

SEQ ID NO: 5177325 - DNA, 15 bp, Homo sapiens
agaagggaaatctta

SEQ ID NO: 5177326 - DNA, 12 bp, Homo sapiens
agaagggaaatt

SEQ ID NO: 5177327 - DNA, 14 bp, Homo sapiens
agaagggaaattca

SEQ ID NO: 5177328 - DNA, 13 bp, Homo sapiens
agaagggaagcct

SEQ ID NO: 5177329 - DNA, 14 bp, Homo sapiens
agaagggagaagaa

SEQ ID NO: 5177330 - DNA, 16 bp, Homo sapiens
agaagggagaagaaag

SEQ ID NO: 5177331 - DNA, 14 bp, Homo sapiens
agaagggagaagga

SEQ ID NO: 5177332 - DNA, 15 bp, Homo sapiens
agaagggagggcaga

SEQ ID NO: 5177333 - DNA, 16 bp, Homo sapiens
agaagggagggcagag

SEQ ID NO: 5177334 - DNA, 22 bp, Homo sapiens
agaagggagggcagagctggtg

SEQ ID NO: 5177335 - DNA, 12 bp, Homo sapiens
agaagggagggt

SEQ ID NO: 5177336 - DNA, 14 bp, Homo sapiens
agaagggagggtgg

SEQ ID NO: 5177337 - DNA, 21 bp, Homo sapiens
agaagggatggattccaaccc

SEQ ID NO: 5177338 - DNA, 19 bp, Homo sapiens
agaagggcataaaacagct

SEQ ID NO: 5177339 - DNA, 20 bp, Homo sapiens
agaagggccaccctgagcag

SEQ ID NO: 5177340 - DNA, 13 bp, Homo sapiens
agaagggccagcc

SEQ ID NO: 5177341 - DNA, 21 bp, Homo sapiens
agaagggctagaacctggagg

SEQ ID NO: 5177342 - DNA, 22 bp, Homo sapiens
agaagggctgaaccctcagcct

SEQ ID NO: 5177343 - DNA, 16 bp, Homo sapiens
agaagggctgcatgat

SEQ ID NO: 5177344 - DNA, 21 bp, Homo sapiens
agaagggcttcaaagatatag

SEQ ID NO: 5177345 - DNA, 17 bp, Homo sapiens
agaaggggaaaaatggg

SEQ ID NO: 5177346 - DNA, 22 bp, Homo sapiens
agaaggggaatgtgtcctcctg

SEQ ID NO: 5177347 - DNA, 12 bp, Homo sapiens
agaaggggagct

SEQ ID NO: 5177348 - DNA, 13 bp, Homo sapiens
agaaggggagctt

SEQ ID NO: 5177349 - DNA, 17 bp, Homo sapiens
agaaggggatgggaaat

SEQ ID NO: 5177350 - DNA, 22 bp, Homo sapiens
agaaggggatgggaaataaaga

SEQ ID NO: 5177351 - DNA, 23 bp, Homo sapiens
agaaggggatggtgttgtcacaa

SEQ ID NO: 5177352 - DNA, 12 bp, Homo sapiens
agaaggggccat

SEQ ID NO: 5177353 - DNA, 13 bp, Homo sapiens
agaaggggcgagg

SEQ ID NO: 5177354 - DNA, 14 bp, Homo sapiens
agaaggggcgaggc

SEQ ID NO: 5177355 - DNA, 19 bp, Homo sapiens
agaaggggctttgtgacca

SEQ ID NO: 5177356 - DNA, 21 bp, Homo sapiens
agaagggggacgtttctggaa

SEQ ID NO: 5177357 - DNA, 21 bp, Homo sapiens
agaagggggagtgaaacagag

SEQ ID NO: 5177358 - DNA, 23 bp, Homo sapiens
agaagggggattggagggaagac

SEQ ID NO: 5177359 - DNA, 14 bp, Homo sapiens
agaagggggccctg

SEQ ID NO: 5177360 - DNA, 15 bp, Homo sapiens
agaagggggccctgc

SEQ ID NO: 5177361 - DNA, 16 bp, Homo sapiens
agaagggggccctgct

SEQ ID NO: 5177362 - DNA, 19 bp, Homo sapiens
agaagggggctctgcccca

SEQ ID NO: 5177363 - DNA, 18 bp, Homo sapiens
agaagggggtcaaagcaa

SEQ ID NO: 5177364 - DNA, 19 bp, Homo sapiens
agaagggggtcaaagcaag

SEQ ID NO: 5177365 - DNA, 24 bp, Homo sapiens
agaagggggtggggcgggtctatg

SEQ ID NO: 5177366 - DNA, 16 bp, Homo sapiens
agaagggggtgggggg

SEQ ID NO: 5177367 - DNA, 17 bp, Homo sapiens
agaagggggtgggggga

SEQ ID NO: 5177368 - DNA, 20 bp, Homo sapiens
agaagggggtggtgtctcca

SEQ ID NO: 5177369 - DNA, 17 bp, Homo sapiens
agaagggggttgtggca

SEQ ID NO: 5177370 - DNA, 23 bp, Homo sapiens
agaagggtccttccctctcccca

SEQ ID NO: 5177371 - DNA, 22 bp, Homo sapiens
agaagggtggatgacagggcag

SEQ ID NO: 5177372 - DNA, 20 bp, Homo sapiens
agaagggttacttgctgctc

SEQ ID NO: 5177373 - DNA, 21 bp, Homo sapiens
agaagggttacttgctgctca

SEQ ID NO: 5177374 - DNA, 22 bp, Homo sapiens
agaagggttacttgctgctcac

SEQ ID NO: 5177375 - DNA, 22 bp, Homo sapiens
agaagggttagacaagcctgga

SEQ ID NO: 5177376 - DNA, 17 bp, Homo sapiens
agaagggttcaggactt

SEQ ID NO: 5177377 - DNA, 17 bp, Homo sapiens
agaagggttctgccctg

SEQ ID NO: 5177378 - DNA, 22 bp, Homo sapiens
agaagggttctgccctgcctga

SEQ ID NO: 5177379 - DNA, 23 bp, Homo sapiens
agaagggttttccaccctggaat

SEQ ID NO: 5177380 - DNA, 20 bp, Homo sapiens
agaaggtaaggtgtgaacct

SEQ ID NO: 5177381 - DNA, 17 bp, Homo sapiens
agaaggtaataggaaga

SEQ ID NO: 5177382 - DNA, 20 bp, Homo sapiens
agaaggtaataggaagaaca

SEQ ID NO: 5177383 - DNA, 15 bp, Homo sapiens
agaaggtatcagtta

SEQ ID NO: 5177384 - DNA, 14 bp, Homo sapiens
agaaggtctccaag

SEQ ID NO: 5177385 - DNA, 12 bp, Homo sapiens
agaaggtgaaat

SEQ ID NO: 5177386 - DNA, 13 bp, Homo sapiens
agaaggtgcctgc

SEQ ID NO: 5177387 - DNA, 17 bp, Homo sapiens
agaaggtgcctgccata

SEQ ID NO: 5177388 - DNA, 20 bp, Homo sapiens
agaaggtgcctgccatagcc

SEQ ID NO: 5177389 - DNA, 19 bp, Homo sapiens
agaaggtggacctggcagt

SEQ ID NO: 5177390 - DNA, 15 bp, Homo sapiens
agaaggtggaccttt

SEQ ID NO: 5177391 - DNA, 22 bp, Homo sapiens
agaaggtggaccttttaaagtg

SEQ ID NO: 5177392 - DNA, 19 bp, Homo sapiens
agaaggtgggggttggctg

SEQ ID NO: 5177393 - DNA, 20 bp, Homo sapiens
agaaggtgggggttggctgg

SEQ ID NO: 5177394 - DNA, 23 bp, Homo sapiens
agaaggtgggggttggctgggta

SEQ ID NO: 5177395 - DNA, 22 bp, Homo sapiens
agaaggtgggttttcatcaaga

SEQ ID NO: 5177396 - DNA, 19 bp, Homo sapiens
agaaggttggcgtgccctg

SEQ ID NO: 5177397 - DNA, 14 bp, Homo sapiens
agaaggttggtggg

SEQ ID NO: 5177398 - DNA, 23 bp, Homo sapiens
agaaggttggtggggggtccagt

SEQ ID NO: 5177399 - DNA, 21 bp, Homo sapiens
agaaggtttactttttggtgt

SEQ ID NO: 5177400 - DNA, 18 bp, Homo sapiens
agaaggtttcagaaagaa

SEQ ID NO: 5177401 - DNA, 15 bp, Homo sapiens
agaagtaaaagcaaa

SEQ ID NO: 5177402 - DNA, 22 bp, Homo sapiens
agaagtaaaagcaaaaaagaaa

SEQ ID NO: 5177403 - DNA, 16 bp, Homo sapiens
agaagtaaaagctaat

SEQ ID NO: 5177404 - DNA, 21 bp, Homo sapiens
agaagtaaactggatactgta

SEQ ID NO: 5177405 - DNA, 20 bp, Homo sapiens
agaagtaacaagagtgattc

SEQ ID NO: 5177406 - DNA, 21 bp, Homo sapiens
agaagtaacaagagtgattct

SEQ ID NO: 5177407 - DNA, 15 bp, Homo sapiens
agaagtaacttattt

SEQ ID NO: 5177408 - DNA, 18 bp, Homo sapiens
agaagtaacttattttgt

SEQ ID NO: 5177409 - DNA, 15 bp, Homo sapiens
agaagtaagaagagg

SEQ ID NO: 5177410 - DNA, 16 bp, Homo sapiens
agaagtaagaagagga

SEQ ID NO: 5177411 - DNA, 22 bp, Homo sapiens
agaagtaagaagaggagcctca

SEQ ID NO: 5177412 - DNA, 15 bp, Homo sapiens
agaagtaatcagtat

SEQ ID NO: 5177413 - DNA, 14 bp, Homo sapiens
agaagtacctttgt

SEQ ID NO: 5177414 - DNA, 17 bp, Homo sapiens
agaagtacctttgttac

SEQ ID NO: 5177415 - DNA, 21 bp, Homo sapiens
agaagtactgcccttttgtgt

SEQ ID NO: 5177416 - DNA, 14 bp, Homo sapiens
agaagtacttttct

SEQ ID NO: 5177417 - DNA, 17 bp, Homo sapiens
agaagtagaaatcatag

SEQ ID NO: 5177418 - DNA, 15 bp, Homo sapiens
agaagtagaatcctt

SEQ ID NO: 5177419 - DNA, 20 bp, Homo sapiens
agaagtaggaaggaaaaaat

SEQ ID NO: 5177420 - DNA, 21 bp, Homo sapiens
agaagtaggaaggaaaaaata

SEQ ID NO: 5177421 - DNA, 23 bp, Homo sapiens
agaagtagtgtctggatcagtaa

SEQ ID NO: 5177422 - DNA, 13 bp, Homo sapiens
agaagtagtttta

SEQ ID NO: 5177423 - DNA, 13 bp, Homo sapiens
agaagtatacata

SEQ ID NO: 5177424 - DNA, 13 bp, Homo sapiens
agaagtatatttt

SEQ ID NO: 5177425 - DNA, 14 bp, Homo sapiens
agaagtatccaatt

SEQ ID NO: 5177426 - DNA, 16 bp, Homo sapiens
agaagtatccaattat

SEQ ID NO: 5177427 - DNA, 17 bp, Homo sapiens
agaagtatccaattatg

SEQ ID NO: 5177428 - DNA, 23 bp, Homo sapiens
agaagtatccaattatgtgacaa

SEQ ID NO: 5177429 - DNA, 14 bp, Homo sapiens
agaagtatggaatt

SEQ ID NO: 5177430 - DNA, 14 bp, Homo sapiens
agaagtattataaa

SEQ ID NO: 5177431 - DNA, 23 bp, Homo sapiens
agaagtattcttttcaattatat

SEQ ID NO: 5177432 - DNA, 19 bp, Homo sapiens
agaagtattgtttacatta

SEQ ID NO: 5177433 - DNA, 21 bp, Homo sapiens
agaagtatttaaactttcaat

SEQ ID NO: 5177434 - DNA, 19 bp, Homo sapiens
agaagtatttttttaattt

SEQ ID NO: 5177435 - DNA, 20 bp, Homo sapiens
agaagtatttttttaatttc

SEQ ID NO: 5177436 - DNA, 21 bp, Homo sapiens
agaagtatttttttaatttct

SEQ ID NO: 5177437 - DNA, 16 bp, Homo sapiens
agaagtcacagggcag

SEQ ID NO: 5177438 - DNA, 18 bp, Homo sapiens
agaagtcacagggcagta

SEQ ID NO: 5177439 - DNA, 19 bp, Homo sapiens
agaagtcacagggcagtac

SEQ ID NO: 5177440 - DNA, 22 bp, Homo sapiens
agaagtcacattcctgaacagg

SEQ ID NO: 5177441 - DNA, 20 bp, Homo sapiens
agaagtcactcacactggcc

SEQ ID NO: 5177442 - DNA, 18 bp, Homo sapiens
agaagtcactgaacaaaa

SEQ ID NO: 5177443 - DNA, 21 bp, Homo sapiens
agaagtcagagaaaacacttt

SEQ ID NO: 5177444 - DNA, 17 bp, Homo sapiens
agaagtcagcctacata

SEQ ID NO: 5177445 - DNA, 20 bp, Homo sapiens
agaagtcagttggagaaaat

SEQ ID NO: 5177446 - DNA, 22 bp, Homo sapiens
agaagtcatcttgctaccagta

SEQ ID NO: 5177447 - DNA, 13 bp, Homo sapiens
agaagtcatgaag

SEQ ID NO: 5177448 - DNA, 20 bp, Homo sapiens
agaagtcatgaagcccaagt

SEQ ID NO: 5177449 - DNA, 20 bp, Homo sapiens
agaagtcatggcccaaatcc

SEQ ID NO: 5177450 - DNA, 13 bp, Homo sapiens
agaagtccagagt

SEQ ID NO: 5177451 - DNA, 22 bp, Homo sapiens
agaagtccatgagttgagtggg

SEQ ID NO: 5177452 - DNA, 22 bp, Homo sapiens
agaagtcctccctcctgcaggc

SEQ ID NO: 5177453 - DNA, 17 bp, Homo sapiens
agaagtccttatgttaa

SEQ ID NO: 5177454 - DNA, 13 bp, Homo sapiens
agaagtctcagct

SEQ ID NO: 5177455 - DNA, 16 bp, Homo sapiens
agaagtctccctgcac

SEQ ID NO: 5177456 - DNA, 20 bp, Homo sapiens
agaagtctggaaaaaaacaa

SEQ ID NO: 5177457 - DNA, 21 bp, Homo sapiens
agaagtctggccattttggaa

SEQ ID NO: 5177458 - DNA, 19 bp, Homo sapiens
agaagtctggtcagagcca

SEQ ID NO: 5177459 - DNA, 20 bp, Homo sapiens
agaagtctgtccaaatttaa

SEQ ID NO: 5177460 - DNA, 21 bp, Homo sapiens
agaagtcttaattgtgtttat

SEQ ID NO: 5177461 - DNA, 22 bp, Homo sapiens
agaagtcttaattgtgtttatt

SEQ ID NO: 5177462 - DNA, 15 bp, Homo sapiens
agaagtcttagactt

SEQ ID NO: 5177463 - DNA, 21 bp, Homo sapiens
agaagtcttctatttatttat

SEQ ID NO: 5177464 - DNA, 22 bp, Homo sapiens
agaagtctttcagtggaattgt

SEQ ID NO: 5177465 - DNA, 15 bp, Homo sapiens
agaagtgaagaatgc

SEQ ID NO: 5177466 - DNA, 16 bp, Homo sapiens
agaagtgaatgctggg

SEQ ID NO: 5177467 - DNA, 14 bp, Homo sapiens
agaagtgacaggga

SEQ ID NO: 5177468 - DNA, 17 bp, Homo sapiens
agaagtgacagggaagc

SEQ ID NO: 5177469 - DNA, 19 bp, Homo sapiens
agaagtgacagggaagcta

SEQ ID NO: 5177470 - DNA, 22 bp, Homo sapiens
agaagtgacagggaagctacag

SEQ ID NO: 5177471 - DNA, 17 bp, Homo sapiens
agaagtgacggttccta

SEQ ID NO: 5177472 - DNA, 23 bp, Homo sapiens
agaagtgacggttcctacacagg

SEQ ID NO: 5177473 - DNA, 19 bp, Homo sapiens
agaagtgagagctttgctt

SEQ ID NO: 5177474 - DNA, 20 bp, Homo sapiens
agaagtgaggatgagaccca

SEQ ID NO: 5177475 - DNA, 18 bp, Homo sapiens
agaagtgagggctgggca

SEQ ID NO: 5177476 - DNA, 21 bp, Homo sapiens
agaagtgagggctgggcagct

SEQ ID NO: 5177477 - DNA, 21 bp, Homo sapiens
agaagtgatatggtgaaggga

SEQ ID NO: 5177478 - DNA, 22 bp, Homo sapiens
agaagtgatatggtgaagggaa

SEQ ID NO: 5177479 - DNA, 19 bp, Homo sapiens
agaagtgcatgaaaaacca

SEQ ID NO: 5177480 - DNA, 19 bp, Homo sapiens
agaagtgcatttctgaata

SEQ ID NO: 5177481 - DNA, 11 bp, Homo sapiens
agaagtgccat

SEQ ID NO: 5177482 - DNA, 14 bp, Homo sapiens
agagctggaaggca

SEQ ID NO: 5177483 - DNA, 17 bp, Homo sapiens
agagctggaaggcaggg

SEQ ID NO: 5177484 - DNA, 20 bp, Homo sapiens
agagctggaaggcagggcag

SEQ ID NO: 5177485 - DNA, 15 bp, Homo sapiens
agagctggagccccc

SEQ ID NO: 5177486 - DNA, 22 bp, Homo sapiens
agagctggagcccccagcagag

SEQ ID NO: 5177487 - DNA, 23 bp, Homo sapiens
agagctggagcccccagcagagg

SEQ ID NO: 5177488 - DNA, 13 bp, Homo sapiens
agagctggcagtg

SEQ ID NO: 5177489 - DNA, 13 bp, Homo sapiens
agagctggcctcc

SEQ ID NO: 5177490 - DNA, 13 bp, Homo sapiens
agagctggctctg

SEQ ID NO: 5177491 - DNA, 15 bp, Homo sapiens
agagctggctctgag

SEQ ID NO: 5177492 - DNA, 17 bp, Homo sapiens
agagctggctgtcttcc

SEQ ID NO: 5177493 - DNA, 15 bp, Homo sapiens
agagctgggaaacag

SEQ ID NO: 5177494 - DNA, 16 bp, Homo sapiens
agagctgggaaacagg

SEQ ID NO: 5177495 - DNA, 18 bp, Homo sapiens
agagctgggaaattcatg

SEQ ID NO: 5177496 - DNA, 12 bp, Homo sapiens
agagctgggagg

SEQ ID NO: 5177497 - DNA, 23 bp, Homo sapiens
agagctgggaggcatggccctgg

SEQ ID NO: 5177498 - DNA, 13 bp, Homo sapiens
agagctgggaggg

SEQ ID NO: 5177499 - DNA, 19 bp, Homo sapiens
agagctgggatcccacagc

SEQ ID NO: 5177500 - DNA, 18 bp, Homo sapiens
agagctggggctgaggga

SEQ ID NO: 5177501 - DNA, 21 bp, Homo sapiens
agagctggggctgagggatgg

SEQ ID NO: 5177502 - DNA, 20 bp, Homo sapiens
agagctgggtaccaggccac

SEQ ID NO: 5177503 - DNA, 21 bp, Homo sapiens
agagctgggtaccaggccacc

SEQ ID NO: 5177504 - DNA, 16 bp, Homo sapiens
agagctgggtggcctg

SEQ ID NO: 5177505 - DNA, 16 bp, Homo sapiens
agagctggtgcccgga

SEQ ID NO: 5177506 - DNA, 17 bp, Homo sapiens
agagctggtgcggctgg

SEQ ID NO: 5177507 - DNA, 21 bp, Homo sapiens
agagctggtgcggctggccat

SEQ ID NO: 5177508 - DNA, 22 bp, Homo sapiens
agagctggtgcggctggccatg

SEQ ID NO: 5177509 - DNA, 11 bp, Homo sapiens
agagctggtgt

SEQ ID NO: 5177510 - DNA, 15 bp, Homo sapiens
agagctggtgtctga

SEQ ID NO: 5177511 - DNA, 22 bp, Homo sapiens
agagctggttgggaagacatgg

SEQ ID NO: 5177512 - DNA, 18 bp, Homo sapiens
agagctgtattaagtgac

SEQ ID NO: 5177513 - DNA, 19 bp, Homo sapiens
agagctgtattaagtgact

SEQ ID NO: 5177514 - DNA, 17 bp, Homo sapiens
agagctgtcctcctggc

SEQ ID NO: 5177515 - DNA, 20 bp, Homo sapiens
agagctgtctatgcagcctg

SEQ ID NO: 5177516 - DNA, 14 bp, Homo sapiens
agagctgtctggtg

SEQ ID NO: 5177517 - DNA, 16 bp, Homo sapiens
agagctgtcttcccct

SEQ ID NO: 5177518 - DNA, 13 bp, Homo sapiens
agagctgtgccag

SEQ ID NO: 5177519 - DNA, 16 bp, Homo sapiens
agagctgtggagaggg

SEQ ID NO: 5177520 - DNA, 20 bp, Homo sapiens
agagctgtggcacagacccc

SEQ ID NO: 5177521 - DNA, 15 bp, Homo sapiens
agagctgtggctggg

SEQ ID NO: 5177522 - DNA, 20 bp, Homo sapiens
agagctgttatgctgtttcc

SEQ ID NO: 5177523 - DNA, 21 bp, Homo sapiens
agagctgttatgctgtttcct

SEQ ID NO: 5177524 - DNA, 22 bp, Homo sapiens
agagctgttcaacatcactgaa

SEQ ID NO: 5177525 - DNA, 18 bp, Homo sapiens
agagctgttcacagccag

SEQ ID NO: 5177526 - DNA, 18 bp, Homo sapiens
agagctgttgatgggatg

SEQ ID NO: 5177527 - DNA, 23 bp, Homo sapiens
agagctgtttggatacagctgct

SEQ ID NO: 5177528 - DNA, 22 bp, Homo sapiens
agagctgttttggatgaatgca

SEQ ID NO: 5177529 - DNA, 21 bp, Homo sapiens
agagcttaatgataatattgt

SEQ ID NO: 5177530 - DNA, 12 bp, Homo sapiens
agagcttagaaa

SEQ ID NO: 5177531 - DNA, 13 bp, Homo sapiens
agagcttagaaac

SEQ ID NO: 5177532 - DNA, 15 bp, Homo sapiens
agagcttagatttcc

SEQ ID NO: 5177533 - DNA, 17 bp, Homo sapiens
agagcttattggccact

SEQ ID NO: 5177534 - DNA, 19 bp, Homo sapiens
agagcttcagaggtggccc

SEQ ID NO: 5177535 - DNA, 16 bp, Homo sapiens
agagcttcaggcccca

SEQ ID NO: 5177536 - DNA, 13 bp, Homo sapiens
agagcttcatgtg

SEQ ID NO: 5177537 - DNA, 13 bp, Homo sapiens
agagcttccaaat

SEQ ID NO: 5177538 - DNA, 22 bp, Homo sapiens
agagcttccactgtcagccctc

SEQ ID NO: 5177539 - DNA, 16 bp, Homo sapiens
agagcttcccccaagg

SEQ ID NO: 5177540 - DNA, 20 bp, Homo sapiens
agagcttcccccaaggctga

SEQ ID NO: 5177541 - DNA, 22 bp, Homo sapiens
agagcttcccctaacctgggtt

SEQ ID NO: 5177542 - DNA, 13 bp, Homo sapiens
agagcttccctga

SEQ ID NO: 5177543 - DNA, 17 bp, Homo sapiens
agagcttccctgactca

SEQ ID NO: 5177544 - DNA, 14 bp, Homo sapiens
agagcttcctgggg

SEQ ID NO: 5177545 - DNA, 22 bp, Homo sapiens
agagcttcctggggaccaagat

SEQ ID NO: 5177546 - DNA, 16 bp, Homo sapiens
agagcttcctgtttct

SEQ ID NO: 5177547 - DNA, 15 bp, Homo sapiens
agagcttctcctgac

SEQ ID NO: 5177548 - DNA, 21 bp, Homo sapiens
agagcttctcctgaccagggc

SEQ ID NO: 5177549 - DNA, 16 bp, Homo sapiens
agagcttctctgggct

SEQ ID NO: 5177550 - DNA, 21 bp, Homo sapiens
agagcttctgtattttcaaag

SEQ ID NO: 5177551 - DNA, 15 bp, Homo sapiens
agagcttcttccagg

SEQ ID NO: 5177552 - DNA, 23 bp, Homo sapiens
agagcttcttccaggtgcccagc

SEQ ID NO: 5177553 - DNA, 18 bp, Homo sapiens
agagcttgaagcctccac

SEQ ID NO: 5177554 - DNA, 17 bp, Homo sapiens
agagcttgatgccagta

SEQ ID NO: 5177555 - DNA, 22 bp, Homo sapiens
agagcttgctccagattctgat

SEQ ID NO: 5177556 - DNA, 21 bp, Homo sapiens
agagcttggacagtctgagct

SEQ ID NO: 5177557 - DNA, 23 bp, Homo sapiens
agagcttgggggtggggagaaaa

SEQ ID NO: 5177558 - DNA, 14 bp, Homo sapiens
agagcttggtggct

SEQ ID NO: 5177559 - DNA, 16 bp, Homo sapiens
agagcttgtagccctg

SEQ ID NO: 5177560 - DNA, 18 bp, Homo sapiens
agagcttgtagccctgga

SEQ ID NO: 5177561 - DNA, 18 bp, Homo sapiens
agagcttgtggtggggca

SEQ ID NO: 5177562 - DNA, 22 bp, Homo sapiens
agagctttaaaagtatctttaa

SEQ ID NO: 5177563 - DNA, 16 bp, Homo sapiens
agagctttacaaaaag

SEQ ID NO: 5177564 - DNA, 14 bp, Homo sapiens
agagctttattgct

SEQ ID NO: 5177565 - DNA, 20 bp, Homo sapiens
agagctttattgctgcattt

SEQ ID NO: 5177566 - DNA, 11 bp, Homo sapiens
agagctttccg

SEQ ID NO: 5177567 - DNA, 22 bp, Homo sapiens
agagctttcttcccgaacccca

SEQ ID NO: 5177568 - DNA, 21 bp, Homo sapiens
agagctttgtcacttgccaca

SEQ ID NO: 5177569 - DNA, 15 bp, Homo sapiens
agagcttttaaaaat

SEQ ID NO: 5177570 - DNA, 16 bp, Homo sapiens
agagcttttaaaaatg

SEQ ID NO: 5177571 - DNA, 18 bp, Homo sapiens
agagcttttcagaacatc

SEQ ID NO: 5177572 - DNA, 13 bp, Homo sapiens
agaggaaaaaaat

SEQ ID NO: 5177573 - DNA, 17 bp, Homo sapiens
agaggaaaaaaatgact

SEQ ID NO: 5177574 - DNA, 18 bp, Homo sapiens
agaggaaaaaaattacaa

SEQ ID NO: 5177575 - DNA, 18 bp, Homo sapiens
agaggaaaaacagggaaa

SEQ ID NO: 5177576 - DNA, 20 bp, Homo sapiens
agaggaaaaacagggaaaaa

SEQ ID NO: 5177577 - DNA, 13 bp, Homo sapiens
agaggaaaaagaa

SEQ ID NO: 5177578 - DNA, 13 bp, Homo sapiens
agaggaaaaatat

SEQ ID NO: 5177579 - DNA, 16 bp, Homo sapiens
agaggaaaaatgggag

SEQ ID NO: 5177580 - DNA, 18 bp, Homo sapiens
agaggaaaaccctcaagg

SEQ ID NO: 5177581 - DNA, 12 bp, Homo sapiens
agaggaaaagaa

SEQ ID NO: 5177582 - DNA, 14 bp, Homo sapiens
agaggaaaagaaat

SEQ ID NO: 5177583 - DNA, 19 bp, Homo sapiens
agaggaaaagactcctcct

SEQ ID NO: 5177584 - DNA, 20 bp, Homo sapiens
agaggaaaagactcctcctg

SEQ ID NO: 5177585 - DNA, 13 bp, Homo sapiens
agaggaaaagcca

SEQ ID NO: 5177586 - DNA, 15 bp, Homo sapiens
agaggaaaagccagt

SEQ ID NO: 5177587 - DNA, 21 bp, Homo sapiens
agaggaaaagtaaggtgcagt

SEQ ID NO: 5177588 - DNA, 11 bp, Homo sapiens
agaggaaaatc

SEQ ID NO: 5177589 - DNA, 17 bp, Homo sapiens
agaggaaaatgaataat

SEQ ID NO: 5177590 - DNA, 20 bp, Homo sapiens
agaggaaaatgaataataca

SEQ ID NO: 5177591 - DNA, 22 bp, Homo sapiens
agaggaaactggcgatctccca

SEQ ID NO: 5177592 - DNA, 16 bp, Homo sapiens
agaggaaagcaaagga

SEQ ID NO: 5177593 - DNA, 19 bp, Homo sapiens
agaggaaagcaaaggagat

SEQ ID NO: 5177594 - DNA, 16 bp, Homo sapiens
agaggaaaggcgcccc

SEQ ID NO: 5177595 - DNA, 22 bp, Homo sapiens
agaggaaaggcgcccccgcccc

SEQ ID NO: 5177596 - DNA, 17 bp, Homo sapiens
agaggaaataacagaga

SEQ ID NO: 5177597 - DNA, 17 bp, Homo sapiens
agaggaaattaaataat

SEQ ID NO: 5177598 - DNA, 16 bp, Homo sapiens
agaggaacccccacca

SEQ ID NO: 5177599 - DNA, 19 bp, Homo sapiens
agaggaactccttggccta

SEQ ID NO: 5177600 - DNA, 18 bp, Homo sapiens
agaggaactgtccagaga

SEQ ID NO: 5177601 - DNA, 19 bp, Homo sapiens
agaggaactgtccagagag

SEQ ID NO: 5177602 - DNA, 21 bp, Homo sapiens
agaggaactgtccagagagca

SEQ ID NO: 5177603 - DNA, 17 bp, Homo sapiens
agaggaagatgaagaga

SEQ ID NO: 5177604 - DNA, 23 bp, Homo sapiens
agaggaagatgaagagaagctga

SEQ ID NO: 5177605 - DNA, 20 bp, Homo sapiens
agaggaagcacaagaagtgg

SEQ ID NO: 5177606 - DNA, 22 bp, Homo sapiens
agaggaagccacgtgctggaga

SEQ ID NO: 5177607 - DNA, 18 bp, Homo sapiens
agaggaagccttcttaga

SEQ ID NO: 5177608 - DNA, 14 bp, Homo sapiens
agaggaagctgttg

SEQ ID NO: 5177609 - DNA, 14 bp, Homo sapiens
agaggaaggaaaca

SEQ ID NO: 5177610 - DNA, 16 bp, Homo sapiens
agaggaaggacccctc

SEQ ID NO: 5177611 - DNA, 17 bp, Homo sapiens
agaggaagggaggcctg

SEQ ID NO: 5177612 - DNA, 21 bp, Homo sapiens
agaggaagggaggcctgaggg

SEQ ID NO: 5177613 - DNA, 15 bp, Homo sapiens
agaggaaggggccag

SEQ ID NO: 5177614 - DNA, 18 bp, Homo sapiens
agaggaaggggccagagg

SEQ ID NO: 5177615 - DNA, 20 bp, Homo sapiens
agaggaaggggccagaggct

SEQ ID NO: 5177616 - DNA, 16 bp, Homo sapiens
agaggaagttcagatc

SEQ ID NO: 5177617 - DNA, 19 bp, Homo sapiens
agaggaataaagctgtgag

SEQ ID NO: 5177618 - DNA, 17 bp, Homo sapiens
agaggaatattatgact

SEQ ID NO: 5177619 - DNA, 15 bp, Homo sapiens
agaggaatcctggca

SEQ ID NO: 5177620 - DNA, 17 bp, Homo sapiens
agaggaatcctggcagc

SEQ ID NO: 5177621 - DNA, 17 bp, Homo sapiens
agaggaatctgtttctc

SEQ ID NO: 5177622 - DNA, 13 bp, Homo sapiens
agaggaatgaaaa

SEQ ID NO: 5177623 - DNA, 17 bp, Homo sapiens
agaggaatgaaaaaagc

SEQ ID NO: 5177624 - DNA, 18 bp, Homo sapiens
agaggaatgaaaaaagct

SEQ ID NO: 5177625 - DNA, 13 bp, Homo sapiens
agaggaatgaagt

SEQ ID NO: 5177626 - DNA, 18 bp, Homo sapiens
agaggaatgtgggctatg

SEQ ID NO: 5177627 - DNA, 20 bp, Homo sapiens
agaggaatttaaagaggaaa

SEQ ID NO: 5177628 - DNA, 17 bp, Homo sapiens
agaggacaaaataaagt

SEQ ID NO: 5177629 - DNA, 18 bp, Homo sapiens
agaggacaaaataaagtg

SEQ ID NO: 5177630 - DNA, 23 bp, Homo sapiens
agaggacaaaataaagtgtgtgt

SEQ ID NO: 5177631 - DNA, 16 bp, Homo sapiens
agaggacaagggaaat

SEQ ID NO: 5177632 - DNA, 16 bp, Homo sapiens
agaggacactaggaga

SEQ ID NO: 5177633 - DNA, 22 bp, Homo sapiens
agaggacacttcaaactgcgga

SEQ ID NO: 5177634 - DNA, 23 bp, Homo sapiens
agaggacagataactgctttgca

SEQ ID NO: 5177635 - DNA, 13 bp, Homo sapiens
agaggacagctct

SEQ ID NO: 5177636 - DNA, 16 bp, Homo sapiens
agaggacagctctggg

SEQ ID NO: 5177637 - DNA, 23 bp, Homo sapiens
agaggacagcttccccatcgcct

SEQ ID NO: 5177638 - DNA, 20 bp, Homo sapiens
agaggacagtatttgtgggg

SEQ ID NO: 5177639 - DNA, 20 bp, Homo sapiens
agaggacagtctggagaagg

SEQ ID NO: 5177640 - DNA, 13 bp, Homo sapiens
agaggacagtgct

SEQ ID NO: 5177641 - DNA, 16 bp, Homo sapiens
agaggacagtgctgac

SEQ ID NO: 5177642 - DNA, 17 bp, Homo sapiens
agaggacagtgctgacc

SEQ ID NO: 5177643 - DNA, 19 bp, Homo sapiens
agaggacagtggattgttt

SEQ ID NO: 5177644 - DNA, 20 bp, Homo sapiens
agaggaccaatgcttgcatg

SEQ ID NO: 5177645 - DNA, 23 bp, Homo sapiens
agaggaccaatgcttgcatggag

SEQ ID NO: 5177646 - DNA, 14 bp, Homo sapiens
agaggaccacagtg

SEQ ID NO: 5177647 - DNA, 19 bp, Homo sapiens
agaggaccacagtgggtgg

SEQ ID NO: 5177648 - DNA, 14 bp, Homo sapiens
agaggaccagagga

SEQ ID NO: 5177649 - DNA, 15 bp, Homo sapiens
agaggaccaggactt

SEQ ID NO: 5177650 - DNA, 14 bp, Homo sapiens
agaggaccagggcc

SEQ ID NO: 5177651 - DNA, 16 bp, Homo sapiens
agaggaccccagggtg

SEQ ID NO: 5177652 - DNA, 21 bp, Homo sapiens
agaggacctatcccaaatgtg

SEQ ID NO: 5177653 - DNA, 15 bp, Homo sapiens
agaggacctccatgc

SEQ ID NO: 5177654 - DNA, 17 bp, Homo sapiens
agaggacctccatgccc

SEQ ID NO: 5177655 - DNA, 22 bp, Homo sapiens
agaggacctgagtttgggagag

SEQ ID NO: 5177656 - DNA, 19 bp, Homo sapiens
agaggacctgtatttaagc

SEQ ID NO: 5177657 - DNA, 21 bp, Homo sapiens
agaggacgcacgctcgctgcc

SEQ ID NO: 5177658 - DNA, 17 bp, Homo sapiens
agaggacggccctgcct

SEQ ID NO: 5177659 - DNA, 21 bp, Homo sapiens
agaggacggccctgcctgcct

SEQ ID NO: 5177660 - DNA, 13 bp, Homo sapiens
agaagtgcccctg

SEQ ID NO: 5177661 - DNA, 12 bp, Homo sapiens
agaagtgccttc

SEQ ID NO: 5177662 - DNA, 13 bp, Homo sapiens
agaagtgccttct

SEQ ID NO: 5177663 - DNA, 14 bp, Homo sapiens
agaagtgccttctc

SEQ ID NO: 5177664 - DNA, 22 bp, Homo sapiens
agaagtgccttctccttcccca

SEQ ID NO: 5177665 - DNA, 15 bp, Homo sapiens
agaagtgctcccctc

SEQ ID NO: 5177666 - DNA, 13 bp, Homo sapiens
agaagtgctccct

SEQ ID NO: 5177667 - DNA, 14 bp, Homo sapiens
agaagtgctccctg

SEQ ID NO: 5177668 - DNA, 15 bp, Homo sapiens
agaagtgctccctgg

SEQ ID NO: 5177669 - DNA, 19 bp, Homo sapiens
agaagtgctccctggaggc

SEQ ID NO: 5177670 - DNA, 24 bp, Homo sapiens
agaagtgctccctggaggcacgca

SEQ ID NO: 5177671 - DNA, 14 bp, Homo sapiens
agaagtgctcttgg

SEQ ID NO: 5177672 - DNA, 21 bp, Homo sapiens
agaagtgctcttggctgaccc

SEQ ID NO: 5177673 - DNA, 21 bp, Homo sapiens
agaagtgcttaacgttttctt

SEQ ID NO: 5177674 - DNA, 23 bp, Homo sapiens
agaagtgcttaacgttttcttaa

SEQ ID NO: 5177675 - DNA, 19 bp, Homo sapiens
agaagtggaccaggacagg

SEQ ID NO: 5177676 - DNA, 17 bp, Homo sapiens
agaagtggactggagga

SEQ ID NO: 5177677 - DNA, 22 bp, Homo sapiens
agaagtggcatctgaaaacaat

SEQ ID NO: 5177678 - DNA, 12 bp, Homo sapiens
agaagtggcccc

SEQ ID NO: 5177679 - DNA, 13 bp, Homo sapiens
agaagtggcccct

SEQ ID NO: 5177680 - DNA, 14 bp, Homo sapiens
agaagtggctgcca

SEQ ID NO: 5177681 - DNA, 15 bp, Homo sapiens
agaagtgggagcagc

SEQ ID NO: 5177682 - DNA, 22 bp, Homo sapiens
agaagtgggagtgggagaggaa

SEQ ID NO: 5177683 - DNA, 17 bp, Homo sapiens
agaagtgggattcagga

SEQ ID NO: 5177684 - DNA, 19 bp, Homo sapiens
agaagtgggccaggacagg

SEQ ID NO: 5177685 - DNA, 23 bp, Homo sapiens
agaagtgggccaggacaggcccg

SEQ ID NO: 5177686 - DNA, 20 bp, Homo sapiens
agaagtggggacagagcaga

SEQ ID NO: 5177687 - DNA, 22 bp, Homo sapiens
agaagtggggaccccacccctc

SEQ ID NO: 5177688 - DNA, 20 bp, Homo sapiens
agaagtgggtggggacagac

SEQ ID NO: 5177689 - DNA, 15 bp, Homo sapiens
agaagtggtgttttt

SEQ ID NO: 5177690 - DNA, 20 bp, Homo sapiens
agaagtggtgttttttttcc

SEQ ID NO: 5177691 - DNA, 12 bp, Homo sapiens
agaagtggtttc

SEQ ID NO: 5177692 - DNA, 16 bp, Homo sapiens
agaagtgtagtatgct

SEQ ID NO: 5177693 - DNA, 14 bp, Homo sapiens
agaagtgtcatgtt

SEQ ID NO: 5177694 - DNA, 17 bp, Homo sapiens
agaagtgtcgttttcat

SEQ ID NO: 5177695 - DNA, 12 bp, Homo sapiens
agaagtgtgatt

SEQ ID NO: 5177696 - DNA, 23 bp, Homo sapiens
agaagtgtgattgggaataaata

SEQ ID NO: 5177697 - DNA, 14 bp, Homo sapiens
agaagtgtgttctg

SEQ ID NO: 5177698 - DNA, 15 bp, Homo sapiens
agaagtgtgttctga

SEQ ID NO: 5177699 - DNA, 16 bp, Homo sapiens
agaagtgttgattgcc

SEQ ID NO: 5177700 - DNA, 23 bp, Homo sapiens
agaagtgtttcagattttttaaa

SEQ ID NO: 5177701 - DNA, 12 bp, Homo sapiens
agaagtgtttta

SEQ ID NO: 5177702 - DNA, 16 bp, Homo sapiens
agaagttaaaaaacag

SEQ ID NO: 5177703 - DNA, 19 bp, Homo sapiens
agaagttaaaggttactgt

SEQ ID NO: 5177704 - DNA, 20 bp, Homo sapiens
agaagttaaaggttactgtt

SEQ ID NO: 5177705 - DNA, 15 bp, Homo sapiens
agaagttaagcaaca

SEQ ID NO: 5177706 - DNA, 20 bp, Homo sapiens
agaagttaattcttaaaact

SEQ ID NO: 5177707 - DNA, 17 bp, Homo sapiens
agaagttactttgtaat

SEQ ID NO: 5177708 - DNA, 20 bp, Homo sapiens
agaagttactttgtaatttt

SEQ ID NO: 5177709 - DNA, 16 bp, Homo sapiens
agaagttagtttgtat

SEQ ID NO: 5177710 - DNA, 21 bp, Homo sapiens
agaagttcagtttttactgag

SEQ ID NO: 5177711 - DNA, 19 bp, Homo sapiens
agaagttcatgggcacctc

SEQ ID NO: 5177712 - DNA, 17 bp, Homo sapiens
agaagttctagtgtttt

SEQ ID NO: 5177713 - DNA, 23 bp, Homo sapiens
agaagttctcagaataactacct

SEQ ID NO: 5177714 - DNA, 14 bp, Homo sapiens
agaagttctgggtg

SEQ ID NO: 5177715 - DNA, 21 bp, Homo sapiens
agaagttgaactatgactgga

SEQ ID NO: 5177716 - DNA, 19 bp, Homo sapiens
agaagttgaatgggcacag

SEQ ID NO: 5177717 - DNA, 13 bp, Homo sapiens
agaagttgatatg

SEQ ID NO: 5177718 - DNA, 13 bp, Homo sapiens
agaagttgctaag

SEQ ID NO: 5177719 - DNA, 14 bp, Homo sapiens
agaagttgtgaaac

SEQ ID NO: 5177720 - DNA, 20 bp, Homo sapiens
agaagttgtggatttcagtt

SEQ ID NO: 5177721 - DNA, 12 bp, Homo sapiens
agaagtttaaat

SEQ ID NO: 5177722 - DNA, 21 bp, Homo sapiens
agaagtttaaatctttgttaa

SEQ ID NO: 5177723 - DNA, 22 bp, Homo sapiens
agaagtttaaatctttgttaaa

SEQ ID NO: 5177724 - DNA, 13 bp, Homo sapiens
agaagtttaacaa

SEQ ID NO: 5177725 - DNA, 15 bp, Homo sapiens
agaagtttagatttt

SEQ ID NO: 5177726 - DNA, 19 bp, Homo sapiens
agaagtttcatcatttttt

SEQ ID NO: 5177727 - DNA, 21 bp, Homo sapiens
agaagtttcatcattttttac

SEQ ID NO: 5177728 - DNA, 14 bp, Homo sapiens
agaagtttcccttc

SEQ ID NO: 5177729 - DNA, 19 bp, Homo sapiens
agaagtttctacattctct

SEQ ID NO: 5177730 - DNA, 23 bp, Homo sapiens
agaagtttctggagcaagagaga

SEQ ID NO: 5177731 - DNA, 13 bp, Homo sapiens
agaagtttgcact

SEQ ID NO: 5177732 - DNA, 16 bp, Homo sapiens
agaagtttgtagccag

SEQ ID NO: 5177733 - DNA, 15 bp, Homo sapiens
agaagtttgtcaagt

SEQ ID NO: 5177734 - DNA, 13 bp, Homo sapiens
agaagtttgtcca

SEQ ID NO: 5177735 - DNA, 13 bp, Homo sapiens
agaagtttgtggt

SEQ ID NO: 5177736 - DNA, 16 bp, Homo sapiens
agaagttttaaatttt

SEQ ID NO: 5177737 - DNA, 16 bp, Homo sapiens
agaagttttaactatg

SEQ ID NO: 5177738 - DNA, 23 bp, Homo sapiens
agaagttttaacttccagtggct

SEQ ID NO: 5177739 - DNA, 23 bp, Homo sapiens
agaagtttttgtttttgttttgt

SEQ ID NO: 5177740 - DNA, 20 bp, Homo sapiens
agaataaaaacttttgagga

SEQ ID NO: 5177741 - DNA, 16 bp, Homo sapiens
agaataaaagctgtgg

SEQ ID NO: 5177742 - DNA, 20 bp, Homo sapiens
agaataaaaggaccacgtgc

SEQ ID NO: 5177743 - DNA, 13 bp, Homo sapiens
agaataaaagttc

SEQ ID NO: 5177744 - DNA, 18 bp, Homo sapiens
agaataaaagttcctctc

SEQ ID NO: 5177745 - DNA, 16 bp, Homo sapiens
agaataaaatgttgaa

SEQ ID NO: 5177746 - DNA, 20 bp, Homo sapiens
agaataaaatgttgaaaagt

SEQ ID NO: 5177747 - DNA, 19 bp, Homo sapiens
agaataaaattcctatctc

SEQ ID NO: 5177748 - DNA, 13 bp, Homo sapiens
agaataaaattgt

SEQ ID NO: 5177749 - DNA, 14 bp, Homo sapiens
agaataaaattgta

SEQ ID NO: 5177750 - DNA, 16 bp, Homo sapiens
agaataaacatttgtt

SEQ ID NO: 5177751 - DNA, 15 bp, Homo sapiens
agaataaagaaaaac

SEQ ID NO: 5177752 - DNA, 12 bp, Homo sapiens
agaataaagaac

SEQ ID NO: 5177753 - DNA, 11 bp, Homo sapiens
agaataaagca

SEQ ID NO: 5177754 - DNA, 16 bp, Homo sapiens
agaataaagcaatttt

SEQ ID NO: 5177755 - DNA, 23 bp, Homo sapiens
agaataaagccttgtgatcactt

SEQ ID NO: 5177756 - DNA, 13 bp, Homo sapiens
agaataaaggcag

SEQ ID NO: 5177757 - DNA, 15 bp, Homo sapiens
agaataaaggcagct

SEQ ID NO: 5177758 - DNA, 15 bp, Homo sapiens
agaataaaggcagtt

SEQ ID NO: 5177759 - DNA, 17 bp, Homo sapiens
agaataaagtccaaagt

SEQ ID NO: 5177760 - DNA, 17 bp, Homo sapiens
agaataaagttctgagt

SEQ ID NO: 5177761 - DNA, 21 bp, Homo sapiens
agaataaagttctgagtgttt

SEQ ID NO: 5177762 - DNA, 15 bp, Homo sapiens
agaataaatacaata

SEQ ID NO: 5177763 - DNA, 22 bp, Homo sapiens
agaataaatacaatattgcatt

SEQ ID NO: 5177764 - DNA, 14 bp, Homo sapiens
agaataaatgaaga

SEQ ID NO: 5177765 - DNA, 14 bp, Homo sapiens
agaataaatgaatc

SEQ ID NO: 5177766 - DNA, 17 bp, Homo sapiens
agaataaatgagcattt

SEQ ID NO: 5177767 - DNA, 20 bp, Homo sapiens
agaataaatggtttctcatt

SEQ ID NO: 5177768 - DNA, 17 bp, Homo sapiens
agaataaatgttttaca

SEQ ID NO: 5177769 - DNA, 19 bp, Homo sapiens
agaataaatgttttacaac

SEQ ID NO: 5177770 - DNA, 20 bp, Homo sapiens
agaataaattaatattgtat

SEQ ID NO: 5177771 - DNA, 13 bp, Homo sapiens
agaataaattcta

SEQ ID NO: 5177772 - DNA, 21 bp, Homo sapiens
agaataaattctacctccttg

SEQ ID NO: 5177773 - DNA, 18 bp, Homo sapiens
agaataaattggattatt

SEQ ID NO: 5177774 - DNA, 19 bp, Homo sapiens
agaataaattggattattt

SEQ ID NO: 5177775 - DNA, 21 bp, Homo sapiens
agaataaattggattattttc

SEQ ID NO: 5177776 - DNA, 18 bp, Homo sapiens
agaataacaagaagccca

SEQ ID NO: 5177777 - DNA, 16 bp, Homo sapiens
agaataacctttcaga

SEQ ID NO: 5177778 - DNA, 19 bp, Homo sapiens
agaataactacctcctcac

SEQ ID NO: 5177779 - DNA, 14 bp, Homo sapiens
agaataagagaaag

SEQ ID NO: 5177780 - DNA, 14 bp, Homo sapiens
agaataaggaggag

SEQ ID NO: 5177781 - DNA, 15 bp, Homo sapiens
agaataaggaggagg

SEQ ID NO: 5177782 - DNA, 17 bp, Homo sapiens
agaataaggaggaggag

SEQ ID NO: 5177783 - DNA, 17 bp, Homo sapiens
agaataaggcacaaaat

SEQ ID NO: 5177784 - DNA, 15 bp, Homo sapiens
agaataaggcaggca

SEQ ID NO: 5177785 - DNA, 21 bp, Homo sapiens
agaataagtcatgttccttca

SEQ ID NO: 5177786 - DNA, 14 bp, Homo sapiens
agaataagtgctgt

SEQ ID NO: 5177787 - DNA, 20 bp, Homo sapiens
agaataagtgctgtttgaga

SEQ ID NO: 5177788 - DNA, 19 bp, Homo sapiens
agaataagttattgcagtt

SEQ ID NO: 5177789 - DNA, 21 bp, Homo sapiens
agaataagttattgcagttta

SEQ ID NO: 5177790 - DNA, 16 bp, Homo sapiens
agaataagttcataca

SEQ ID NO: 5177791 - DNA, 20 bp, Homo sapiens
agaataatcacgctttcctg

SEQ ID NO: 5177792 - DNA, 20 bp, Homo sapiens
agaataatccagtattgctg

SEQ ID NO: 5177793 - DNA, 22 bp, Homo sapiens
agaataatccagtattgctgat

SEQ ID NO: 5177794 - DNA, 19 bp, Homo sapiens
agaataatctcatcccccc

SEQ ID NO: 5177795 - DNA, 22 bp, Homo sapiens
agaataatctcatccccccacc

SEQ ID NO: 5177796 - DNA, 13 bp, Homo sapiens
agaataatctttg

SEQ ID NO: 5177797 - DNA, 18 bp, Homo sapiens
agaataatgaagatcttt

SEQ ID NO: 5177798 - DNA, 15 bp, Homo sapiens
agaataatgaatgga

SEQ ID NO: 5177799 - DNA, 21 bp, Homo sapiens
agaataatgtgggaagaaaca

SEQ ID NO: 5177800 - DNA, 22 bp, Homo sapiens
agaataatgtgggaagaaacaa

SEQ ID NO: 5177801 - DNA, 14 bp, Homo sapiens
agaataattgtgta

SEQ ID NO: 5177802 - DNA, 16 bp, Homo sapiens
agaataattgtgtaca

SEQ ID NO: 5177803 - DNA, 17 bp, Homo sapiens
agaataattgtgtacaa

SEQ ID NO: 5177804 - DNA, 13 bp, Homo sapiens
agaataatttata

SEQ ID NO: 5177805 - DNA, 22 bp, Homo sapiens
agaataatttatagtaatgagt

SEQ ID NO: 5177806 - DNA, 23 bp, Homo sapiens
agaataatttctcctcatttaat

SEQ ID NO: 5177807 - DNA, 15 bp, Homo sapiens
agaataatttggtat

SEQ ID NO: 5177808 - DNA, 23 bp, Homo sapiens
agaataattttaacagacatgta

SEQ ID NO: 5177809 - DNA, 15 bp, Homo sapiens
agaatacaaacatat

SEQ ID NO: 5177810 - DNA, 16 bp, Homo sapiens
agaatacaaacatatt

SEQ ID NO: 5177811 - DNA, 20 bp, Homo sapiens
agaatacacatataaaaaca

SEQ ID NO: 5177812 - DNA, 12 bp, Homo sapiens
agaatacagaaa

SEQ ID NO: 5177813 - DNA, 21 bp, Homo sapiens
agaatacagaaagatggatgt

SEQ ID NO: 5177814 - DNA, 14 bp, Homo sapiens
agaatacagctttc

SEQ ID NO: 5177815 - DNA, 22 bp, Homo sapiens
agaatacagtaagctgctctat

SEQ ID NO: 5177816 - DNA, 16 bp, Homo sapiens
agaatacataaacaac

SEQ ID NO: 5177817 - DNA, 22 bp, Homo sapiens
agaatacatcagaaaataaaat

SEQ ID NO: 5177818 - DNA, 15 bp, Homo sapiens
agaatacatgtaagt

SEQ ID NO: 5177819 - DNA, 16 bp, Homo sapiens
agaatacccaggaaga

SEQ ID NO: 5177820 - DNA, 21 bp, Homo sapiens
agaatacccaggaagactttg

SEQ ID NO: 5177821 - DNA, 16 bp, Homo sapiens
agaatacggaagagca

SEQ ID NO: 5177822 - DNA, 21 bp, Homo sapiens
agaatacggaagagcaggtga

SEQ ID NO: 5177823 - DNA, 23 bp, Homo sapiens
agaatacgggtccctctaaccca

SEQ ID NO: 5177824 - DNA, 20 bp, Homo sapiens
agaatactgggttcttagtt

SEQ ID NO: 5177825 - DNA, 13 bp, Homo sapiens
agaatactggtct

SEQ ID NO: 5177826 - DNA, 15 bp, Homo sapiens
agaatactggtctca

SEQ ID NO: 5177827 - DNA, 17 bp, Homo sapiens
agaatactggtctcagg

SEQ ID NO: 5177828 - DNA, 19 bp, Homo sapiens
agaatacttctcatttttt

SEQ ID NO: 5177829 - DNA, 12 bp, Homo sapiens
agaatacttgaa

SEQ ID NO: 5177830 - DNA, 18 bp, Homo sapiens
agaatactttgcttcata

SEQ ID NO: 5177831 - DNA, 12 bp, Homo sapiens
agaatacttttt

SEQ ID NO: 5177832 - DNA, 12 bp, Homo sapiens
agaatagaaaca

SEQ ID NO: 5177833 - DNA, 12 bp, Homo sapiens
agaatagaagga

SEQ ID NO: 5177834 - DNA, 13 bp, Homo sapiens
agaatagaaggaa

SEQ ID NO: 5177835 - DNA, 15 bp, Homo sapiens
agaatagaaggaaac

SEQ ID NO: 5177836 - DNA, 20 bp, Homo sapiens
agaatagatctgatggtgag

SEQ ID NO: 5177837 - DNA, 18 bp, Homo sapiens
agaatagcacagccagac

SEQ ID NO: 5177838 - DNA, 19 bp, Homo sapiens
agaatagcacagccagact

SEQ ID NO: 5177839 - DNA, 20 bp, Homo sapiens
agaggactctgcttaaacaa

SEQ ID NO: 5177840 - DNA, 19 bp, Homo sapiens
agaggactggttctgaggc

SEQ ID NO: 5177841 - DNA, 14 bp, Homo sapiens
agaggactgtgtga

SEQ ID NO: 5177842 - DNA, 18 bp, Homo sapiens
agaggagaaaaaaaaagt

SEQ ID NO: 5177843 - DNA, 20 bp, Homo sapiens
agaggagaaaaagaagaaaa

SEQ ID NO: 5177844 - DNA, 21 bp, Homo sapiens
agaggagaaaaagaagaaaag

SEQ ID NO: 5177845 - DNA, 15 bp, Homo sapiens
agaggagaaacacat

SEQ ID NO: 5177846 - DNA, 19 bp, Homo sapiens
agaggagaaatgcaataac

SEQ ID NO: 5177847 - DNA, 12 bp, Homo sapiens
agaggagaacag

SEQ ID NO: 5177848 - DNA, 15 bp, Homo sapiens
agaggagaagagaca

SEQ ID NO: 5177849 - DNA, 12 bp, Homo sapiens
agaggagacaga

SEQ ID NO: 5177850 - DNA, 15 bp, Homo sapiens
agaggagacagacac

SEQ ID NO: 5177851 - DNA, 16 bp, Homo sapiens
agaggagaccctggaa

SEQ ID NO: 5177852 - DNA, 12 bp, Homo sapiens
agaggagagagg

SEQ ID NO: 5177853 - DNA, 16 bp, Homo sapiens
agaggagagcatctgc

SEQ ID NO: 5177854 - DNA, 20 bp, Homo sapiens
agaggagagcatctgctctg

SEQ ID NO: 5177855 - DNA, 23 bp, Homo sapiens
agaggagagcatctgctctgaga

SEQ ID NO: 5177856 - DNA, 16 bp, Homo sapiens
agaggagagccagaga

SEQ ID NO: 5177857 - DNA, 21 bp, Homo sapiens
agaggagagccagagaagtga

SEQ ID NO: 5177858 - DNA, 12 bp, Homo sapiens
agaggagaggag

SEQ ID NO: 5177859 - DNA, 15 bp, Homo sapiens
agaggagaggagaca

SEQ ID NO: 5177860 - DNA, 15 bp, Homo sapiens
agaggagaggagaga

SEQ ID NO: 5177861 - DNA, 13 bp, Homo sapiens
agaggagaggggc

SEQ ID NO: 5177862 - DNA, 21 bp, Homo sapiens
agaggagagtacccccctgag

SEQ ID NO: 5177863 - DNA, 13 bp, Homo sapiens
agaggagagtggc

SEQ ID NO: 5177864 - DNA, 19 bp, Homo sapiens
agaggagagtggcctgggt

SEQ ID NO: 5177865 - DNA, 17 bp, Homo sapiens
agaggagataaggtggc

SEQ ID NO: 5177866 - DNA, 19 bp, Homo sapiens
agaggagataaggtggctt

SEQ ID NO: 5177867 - DNA, 15 bp, Homo sapiens
agaggagatcagggc

SEQ ID NO: 5177868 - DNA, 19 bp, Homo sapiens
agaggagatgtgatcaggc

SEQ ID NO: 5177869 - DNA, 23 bp, Homo sapiens
agaggagatgtgatcaggcccca

SEQ ID NO: 5177870 - DNA, 14 bp, Homo sapiens
agaggagcaaacag

SEQ ID NO: 5177871 - DNA, 14 bp, Homo sapiens
agaggagcacctga

SEQ ID NO: 5177872 - DNA, 16 bp, Homo sapiens
agaggagcacctgaac

SEQ ID NO: 5177873 - DNA, 18 bp, Homo sapiens
agaggagcagaccagcac

SEQ ID NO: 5177874 - DNA, 20 bp, Homo sapiens
agaggagcagagggcagggg

SEQ ID NO: 5177875 - DNA, 20 bp, Homo sapiens
agaggagcaggaagcaaggc

SEQ ID NO: 5177876 - DNA, 19 bp, Homo sapiens
agaggagccagaagtaaag

SEQ ID NO: 5177877 - DNA, 19 bp, Homo sapiens
agaggagcccagtgggctg

SEQ ID NO: 5177878 - DNA, 15 bp, Homo sapiens
agaggagccctcatc

SEQ ID NO: 5177879 - DNA, 13 bp, Homo sapiens
agaggagccctgc

SEQ ID NO: 5177880 - DNA, 16 bp, Homo sapiens
agaggagcctcagaag

SEQ ID NO: 5177881 - DNA, 19 bp, Homo sapiens
agaggagcctcagaagaaa

SEQ ID NO: 5177882 - DNA, 13 bp, Homo sapiens
agaggagcctgga

SEQ ID NO: 5177883 - DNA, 15 bp, Homo sapiens
agaggagcctggagt

SEQ ID NO: 5177884 - DNA, 11 bp, Homo sapiens
agaggagcctt

SEQ ID NO: 5177885 - DNA, 14 bp, Homo sapiens
agaggagccttttt

SEQ ID NO: 5177886 - DNA, 17 bp, Homo sapiens
agaggagcgcaggcagc

SEQ ID NO: 5177887 - DNA, 19 bp, Homo sapiens
agaggagcgggacctgtgg

SEQ ID NO: 5177888 - DNA, 21 bp, Homo sapiens
agaggagctctaccctgctcc

SEQ ID NO: 5177889 - DNA, 17 bp, Homo sapiens
agaggagctgagttggc

SEQ ID NO: 5177890 - DNA, 21 bp, Homo sapiens
agaggaggaaaaaggctggtg

SEQ ID NO: 5177891 - DNA, 22 bp, Homo sapiens
agaggaggaaaaaggctggtgg

SEQ ID NO: 5177892 - DNA, 21 bp, Homo sapiens
agaggaggaaaagtcttccta

SEQ ID NO: 5177893 - DNA, 19 bp, Homo sapiens
agaggaggacccctgcctt

SEQ ID NO: 5177894 - DNA, 13 bp, Homo sapiens
agaggaggagaaa

SEQ ID NO: 5177895 - DNA, 23 bp, Homo sapiens
agaggaggagagaagtggccagg

SEQ ID NO: 5177896 - DNA, 12 bp, Homo sapiens
agaggaggatgg

SEQ ID NO: 5177897 - DNA, 23 bp, Homo sapiens
agaggaggcaaatggcactgcag

SEQ ID NO: 5177898 - DNA, 16 bp, Homo sapiens
agaggaggcagaaaga

SEQ ID NO: 5177899 - DNA, 12 bp, Homo sapiens
agaggaggcagc

SEQ ID NO: 5177900 - DNA, 12 bp, Homo sapiens
agaggaggcctc

SEQ ID NO: 5177901 - DNA, 15 bp, Homo sapiens
agaggaggcctggac

SEQ ID NO: 5177902 - DNA, 17 bp, Homo sapiens
agaggagggatgctgcc

SEQ ID NO: 5177903 - DNA, 18 bp, Homo sapiens
agaggagggcagagggag

SEQ ID NO: 5177904 - DNA, 14 bp, Homo sapiens
agaggaggggccgc

SEQ ID NO: 5177905 - DNA, 22 bp, Homo sapiens
agaggaggggccgctgccaccc

SEQ ID NO: 5177906 - DNA, 20 bp, Homo sapiens
agaggaggggtaaatatatg

SEQ ID NO: 5177907 - DNA, 13 bp, Homo sapiens
agaggaggtgaga

SEQ ID NO: 5177908 - DNA, 13 bp, Homo sapiens
agaggaggtgccc

SEQ ID NO: 5177909 - DNA, 21 bp, Homo sapiens
agaggaggtgtggagtggagg

SEQ ID NO: 5177910 - DNA, 21 bp, Homo sapiens
agaggagtaaataattggaaa

SEQ ID NO: 5177911 - DNA, 20 bp, Homo sapiens
agaggagtacaggtgaagca

SEQ ID NO: 5177912 - DNA, 19 bp, Homo sapiens
agaggagtgattgaaccag

SEQ ID NO: 5177913 - DNA, 22 bp, Homo sapiens
agaggagtgattgaaccagctc

SEQ ID NO: 5177914 - DNA, 22 bp, Homo sapiens
agaggagtgcgtggcccaccag

SEQ ID NO: 5177915 - DNA, 18 bp, Homo sapiens
agaggagtgttattgcat

SEQ ID NO: 5177916 - DNA, 12 bp, Homo sapiens
agaggagttcaa

SEQ ID NO: 5177917 - DNA, 14 bp, Homo sapiens
agaggagttcaatg

SEQ ID NO: 5177918 - DNA, 18 bp, Homo sapiens
agaggagttcaatgatct

SEQ ID NO: 5177919 - DNA, 19 bp, Homo sapiens
agaggagttcaatgatcta

SEQ ID NO: 5177920 - DNA, 23 bp, Homo sapiens
agaggagttcaatgatctaggtt

SEQ ID NO: 5177921 - DNA, 20 bp, Homo sapiens
agaggagttctaacacattt

SEQ ID NO: 5177922 - DNA, 21 bp, Homo sapiens
agaggagttctaacacatttc

SEQ ID NO: 5177923 - DNA, 16 bp, Homo sapiens
agaggagttgccaggg

SEQ ID NO: 5177924 - DNA, 14 bp, Homo sapiens
agaggagtttctta

SEQ ID NO: 5177925 - DNA, 17 bp, Homo sapiens
agaggagtttcttaatg

SEQ ID NO: 5177926 - DNA, 17 bp, Homo sapiens
agaggataaataataaa

SEQ ID NO: 5177927 - DNA, 14 bp, Homo sapiens
agaggatacattta

SEQ ID NO: 5177928 - DNA, 15 bp, Homo sapiens
agaggatacatttaa

SEQ ID NO: 5177929 - DNA, 20 bp, Homo sapiens
agaggatacatttaataaaa

SEQ ID NO: 5177930 - DNA, 17 bp, Homo sapiens
agaggatgaaggaaggg

SEQ ID NO: 5177931 - DNA, 20 bp, Homo sapiens
agaggatgaatgtatgtgca

SEQ ID NO: 5177932 - DNA, 21 bp, Homo sapiens
agaggatgaatgtatgtgcac

SEQ ID NO: 5177933 - DNA, 22 bp, Homo sapiens
agaggatgaatgtatgtgcact

SEQ ID NO: 5177934 - DNA, 17 bp, Homo sapiens
agaggatgagagcccag

SEQ ID NO: 5177935 - DNA, 22 bp, Homo sapiens
agaggatgagagcccagaggta

SEQ ID NO: 5177936 - DNA, 14 bp, Homo sapiens
agaggatgagcaga

SEQ ID NO: 5177937 - DNA, 16 bp, Homo sapiens
agaggatgagcagagg

SEQ ID NO: 5177938 - DNA, 13 bp, Homo sapiens
agaggatgatttc

SEQ ID NO: 5177939 - DNA, 12 bp, Homo sapiens
agaggatgcctt

SEQ ID NO: 5177940 - DNA, 13 bp, Homo sapiens
agaggatgccttt

SEQ ID NO: 5177941 - DNA, 18 bp, Homo sapiens
agaggatgctctttccca

SEQ ID NO: 5177942 - DNA, 18 bp, Homo sapiens
agaggatggatgaatctg

SEQ ID NO: 5177943 - DNA, 15 bp, Homo sapiens
agaggatggccagtg

SEQ ID NO: 5177944 - DNA, 19 bp, Homo sapiens
agaggatgtctcaaacttc

SEQ ID NO: 5177945 - DNA, 21 bp, Homo sapiens
agaggatgtggaaagcacttt

SEQ ID NO: 5177946 - DNA, 14 bp, Homo sapiens
agaggatgttctgg

SEQ ID NO: 5177947 - DNA, 22 bp, Homo sapiens
agaggattagtagaaaatacat

SEQ ID NO: 5177948 - DNA, 15 bp, Homo sapiens
agaggattctgtctt

SEQ ID NO: 5177949 - DNA, 20 bp, Homo sapiens
agaggattgcttgagcccag

SEQ ID NO: 5177950 - DNA, 22 bp, Homo sapiens
agaggattggctcccatctttt

SEQ ID NO: 5177951 - DNA, 19 bp, Homo sapiens
agaggatttcttcaaatct

SEQ ID NO: 5177952 - DNA, 23 bp, Homo sapiens
agaggattttagctaggatttga

SEQ ID NO: 5177953 - DNA, 19 bp, Homo sapiens
agaggatttttttctgagc

SEQ ID NO: 5177954 - DNA, 21 bp, Homo sapiens
agaggatttttttctgagcga

SEQ ID NO: 5177955 - DNA, 16 bp, Homo sapiens
agaggcaaagaatcaa

SEQ ID NO: 5177956 - DNA, 22 bp, Homo sapiens
agaggcaagctgaaattttaga

SEQ ID NO: 5177957 - DNA, 15 bp, Homo sapiens
agaggcaaggatggt

SEQ ID NO: 5177958 - DNA, 23 bp, Homo sapiens
agaggcaaggatggtggggcccc

SEQ ID NO: 5177959 - DNA, 22 bp, Homo sapiens
agaggcaataaataaatgtttt

SEQ ID NO: 5177960 - DNA, 11 bp, Homo sapiens
agaggcaccag

SEQ ID NO: 5177961 - DNA, 13 bp, Homo sapiens
agaggcaccagga

SEQ ID NO: 5177962 - DNA, 23 bp, Homo sapiens
agaggcacctaaacttgggtaca

SEQ ID NO: 5177963 - DNA, 23 bp, Homo sapiens
agaggcactcagtgagcctcctg

SEQ ID NO: 5177964 - DNA, 13 bp, Homo sapiens
agaggcagaagaa

SEQ ID NO: 5177965 - DNA, 13 bp, Homo sapiens
agaggcagagacc

SEQ ID NO: 5177966 - DNA, 13 bp, Homo sapiens
agaggcagagcct

SEQ ID NO: 5177967 - DNA, 14 bp, Homo sapiens
agaggcagagtgcc

SEQ ID NO: 5177968 - DNA, 22 bp, Homo sapiens
agaggcagagtgccccacctgc

SEQ ID NO: 5177969 - DNA, 12 bp, Homo sapiens
agaggcagcagg

SEQ ID NO: 5177970 - DNA, 14 bp, Homo sapiens
agaggcagcccagg

SEQ ID NO: 5177971 - DNA, 21 bp, Homo sapiens
agaggcagccccattctgcct

SEQ ID NO: 5177972 - DNA, 23 bp, Homo sapiens
agaggcagccccattctgcctgc

SEQ ID NO: 5177973 - DNA, 22 bp, Homo sapiens
agaggcagcttcaagtgccttt

SEQ ID NO: 5177974 - DNA, 18 bp, Homo sapiens
agaggcaggaatgggggt

SEQ ID NO: 5177975 - DNA, 22 bp, Homo sapiens
agaggcaggaccagaaggcaat

SEQ ID NO: 5177976 - DNA, 13 bp, Homo sapiens
agaggcagggagg

SEQ ID NO: 5177977 - DNA, 14 bp, Homo sapiens
agaggcagggccct

SEQ ID NO: 5177978 - DNA, 22 bp, Homo sapiens
agaggcaggggcttgctttgca

SEQ ID NO: 5177979 - DNA, 18 bp, Homo sapiens
agaggcaggtctgggcca

SEQ ID NO: 5177980 - DNA, 17 bp, Homo sapiens
agaggcagtggcagcaa

SEQ ID NO: 5177981 - DNA, 14 bp, Homo sapiens
agaggcagtggcca

SEQ ID NO: 5177982 - DNA, 14 bp, Homo sapiens
agaggcatcccaag

SEQ ID NO: 5177983 - DNA, 15 bp, Homo sapiens
agaggcatcccaaga

SEQ ID NO: 5177984 - DNA, 22 bp, Homo sapiens
agaggcatcccaagacctcatc

SEQ ID NO: 5177985 - DNA, 14 bp, Homo sapiens
agaggcatcctgcc

SEQ ID NO: 5177986 - DNA, 15 bp, Homo sapiens
agaggcatgacagct

SEQ ID NO: 5177987 - DNA, 18 bp, Homo sapiens
agaggcatgtgatgtgca

SEQ ID NO: 5177988 - DNA, 14 bp, Homo sapiens
agaggcatttcccc

SEQ ID NO: 5177989 - DNA, 18 bp, Homo sapiens
agaggcatttgagcagct

SEQ ID NO: 5177990 - DNA, 19 bp, Homo sapiens
agaggcatttgagcagctg

SEQ ID NO: 5177991 - DNA, 20 bp, Homo sapiens
agaggcatttgagcagctga

SEQ ID NO: 5177992 - DNA, 19 bp, Homo sapiens
agaggcatttgtcttagag

SEQ ID NO: 5177993 - DNA, 23 bp, Homo sapiens
agaggcatttgtcttagagagag

SEQ ID NO: 5177994 - DNA, 16 bp, Homo sapiens
agaggccaaacaggcc

SEQ ID NO: 5177995 - DNA, 19 bp, Homo sapiens
agaggccaaattaatcttt

SEQ ID NO: 5177996 - DNA, 21 bp, Homo sapiens
agaggccaagtctaatgaaga

SEQ ID NO: 5177997 - DNA, 18 bp, Homo sapiens
agaggccacattactaga

SEQ ID NO: 5177998 - DNA, 12 bp, Homo sapiens
agaggccaccta

SEQ ID NO: 5177999 - DNA, 22 bp, Homo sapiens
agaggccactgtgggtgaagcg

SEQ ID NO: 5178000 - DNA, 18 bp, Homo sapiens
agaggccagacatggtgt

SEQ ID NO: 5178001 - DNA, 21 bp, Homo sapiens
agaggccagccccacccagga

SEQ ID NO: 5178002 - DNA, 14 bp, Homo sapiens
agaggccagcctgg

SEQ ID NO: 5178003 - DNA, 14 bp, Homo sapiens
agaggccaggatgc

SEQ ID NO: 5178004 - DNA, 20 bp, Homo sapiens
agaggccagttgatctgctc

SEQ ID NO: 5178005 - DNA, 22 bp, Homo sapiens
agaggccagttgatctgctctg

SEQ ID NO: 5178006 - DNA, 19 bp, Homo sapiens
agaggccatgggcctcctg

SEQ ID NO: 5178007 - DNA, 21 bp, Homo sapiens
agaggcccactagagggccca

SEQ ID NO: 5178008 - DNA, 21 bp, Homo sapiens
agaggcccaggcaccaccagg

SEQ ID NO: 5178009 - DNA, 15 bp, Homo sapiens
agaggcccaggctgc

SEQ ID NO: 5178010 - DNA, 16 bp, Homo sapiens
agaggcccaggctgcc

SEQ ID NO: 5178011 - DNA, 19 bp, Homo sapiens
agaggcccaggctgccgtc

SEQ ID NO: 5178012 - DNA, 15 bp, Homo sapiens
agaggcccagggagc

SEQ ID NO: 5178013 - DNA, 16 bp, Homo sapiens
agaggcccagggagca

SEQ ID NO: 5178014 - DNA, 12 bp, Homo sapiens
agaggccccacc

SEQ ID NO: 5178015 - DNA, 13 bp, Homo sapiens
agaggccccagcc

SEQ ID NO: 5178016 - DNA, 14 bp, Homo sapiens
agaggccccagcct

SEQ ID NO: 5178017 - DNA, 14 bp, Homo sapiens
agaggcccccaccc

SEQ ID NO: 5178018 - DNA, 13 bp, Homo sapiens
agaatagcagaga

SEQ ID NO: 5178019 - DNA, 19 bp, Homo sapiens
agaatagcagagagccaaa

SEQ ID NO: 5178020 - DNA, 19 bp, Homo sapiens
agaatagcatctgtacaaa

SEQ ID NO: 5178021 - DNA, 23 bp, Homo sapiens
agaatagcctattgtctttcatt

SEQ ID NO: 5178022 - DNA, 21 bp, Homo sapiens
agaatagctgttttgtgtata

SEQ ID NO: 5178023 - DNA, 15 bp, Homo sapiens
agaatagcttccaat

SEQ ID NO: 5178024 - DNA, 12 bp, Homo sapiens
agaatagctttt

SEQ ID NO: 5178025 - DNA, 14 bp, Homo sapiens
agaataggaaaaca

SEQ ID NO: 5178026 - DNA, 21 bp, Homo sapiens
agaataggacttgtttttgtt

SEQ ID NO: 5178027 - DNA, 13 bp, Homo sapiens
agaataggattaa

SEQ ID NO: 5178028 - DNA, 16 bp, Homo sapiens
agaataggattaatga

SEQ ID NO: 5178029 - DNA, 17 bp, Homo sapiens
agaataggcactttaaa

SEQ ID NO: 5178030 - DNA, 19 bp, Homo sapiens
agaataggcattaacacaa

SEQ ID NO: 5178031 - DNA, 18 bp, Homo sapiens
agaataggggagccaagg

SEQ ID NO: 5178032 - DNA, 15 bp, Homo sapiens
agaataggtcatttt

SEQ ID NO: 5178033 - DNA, 21 bp, Homo sapiens
agaataggtcattttctattc

SEQ ID NO: 5178034 - DNA, 18 bp, Homo sapiens
agaataggtgcaaacaaa

SEQ ID NO: 5178035 - DNA, 20 bp, Homo sapiens
agaataggtgcaaacaaaca

SEQ ID NO: 5178036 - DNA, 22 bp, Homo sapiens
agaatagtgcctaaagtgctgc

SEQ ID NO: 5178037 - DNA, 13 bp, Homo sapiens
agaatagtgcctc

SEQ ID NO: 5178038 - DNA, 20 bp, Homo sapiens
agaatagttattctctaaga

SEQ ID NO: 5178039 - DNA, 23 bp, Homo sapiens
agaatagttgaacctatttctct

SEQ ID NO: 5178040 - DNA, 15 bp, Homo sapiens
agaatagtttacaca

SEQ ID NO: 5178041 - DNA, 18 bp, Homo sapiens
agaatataaacatataca

SEQ ID NO: 5178042 - DNA, 14 bp, Homo sapiens
agaatataacatgt

SEQ ID NO: 5178043 - DNA, 14 bp, Homo sapiens
agaatataattatc

SEQ ID NO: 5178044 - DNA, 15 bp, Homo sapiens
agaatatacacattt

SEQ ID NO: 5178045 - DNA, 16 bp, Homo sapiens
agaatatacacatttt

SEQ ID NO: 5178046 - DNA, 22 bp, Homo sapiens
agaatatacacattttgtaaat

SEQ ID NO: 5178047 - DNA, 11 bp, Homo sapiens
agaatatacct

SEQ ID NO: 5178048 - DNA, 13 bp, Homo sapiens
agaatatacctta

SEQ ID NO: 5178049 - DNA, 17 bp, Homo sapiens
agaatatactgtcttgt

SEQ ID NO: 5178050 - DNA, 16 bp, Homo sapiens
agaatatagcatcttt

SEQ ID NO: 5178051 - DNA, 19 bp, Homo sapiens
agaatatagcatctttcat

SEQ ID NO: 5178052 - DNA, 19 bp, Homo sapiens
agaatataggataagaaat

SEQ ID NO: 5178053 - DNA, 13 bp, Homo sapiens
agaatatatacat

SEQ ID NO: 5178054 - DNA, 12 bp, Homo sapiens
agaatatatata

SEQ ID NO: 5178055 - DNA, 20 bp, Homo sapiens
agaatatattgccaaatatt

SEQ ID NO: 5178056 - DNA, 15 bp, Homo sapiens
agaatatcatctttt

SEQ ID NO: 5178057 - DNA, 19 bp, Homo sapiens
agaatatcgatataaattg

SEQ ID NO: 5178058 - DNA, 14 bp, Homo sapiens
agaatatgaatgag

SEQ ID NO: 5178059 - DNA, 13 bp, Homo sapiens
agaatatgacaat

SEQ ID NO: 5178060 - DNA, 16 bp, Homo sapiens
agaatatgacttttta

SEQ ID NO: 5178061 - DNA, 19 bp, Homo sapiens
agaatatgatcatgtaaat

SEQ ID NO: 5178062 - DNA, 22 bp, Homo sapiens
agaatatggacttaaatgttaa

SEQ ID NO: 5178063 - DNA, 19 bp, Homo sapiens
agaatatgtaatacttaaa

SEQ ID NO: 5178064 - DNA, 20 bp, Homo sapiens
agaatatgtatgtacctgag

SEQ ID NO: 5178065 - DNA, 18 bp, Homo sapiens
agaatatgtttcaaactt

SEQ ID NO: 5178066 - DNA, 19 bp, Homo sapiens
agaatatgtttcaaacttt

SEQ ID NO: 5178067 - DNA, 18 bp, Homo sapiens
agaatatgtttccttgtt

SEQ ID NO: 5178068 - DNA, 15 bp, Homo sapiens
agaatattaaaaatt

SEQ ID NO: 5178069 - DNA, 18 bp, Homo sapiens
agaatattaaatattata

SEQ ID NO: 5178070 - DNA, 23 bp, Homo sapiens
agaatattcagacaaaatggata

SEQ ID NO: 5178071 - DNA, 13 bp, Homo sapiens
agaatattcagga

SEQ ID NO: 5178072 - DNA, 16 bp, Homo sapiens
agaatattgcaaaata

SEQ ID NO: 5178073 - DNA, 13 bp, Homo sapiens
agaatattgtatt

SEQ ID NO: 5178074 - DNA, 15 bp, Homo sapiens
agaatattgtattgt

SEQ ID NO: 5178075 - DNA, 15 bp, Homo sapiens
agaatattgttccta

SEQ ID NO: 5178076 - DNA, 16 bp, Homo sapiens
agaatattgttcctaa

SEQ ID NO: 5178077 - DNA, 20 bp, Homo sapiens
agaatattgttcctaagttc

SEQ ID NO: 5178078 - DNA, 22 bp, Homo sapiens
agaatatttaagaaaagcactt

SEQ ID NO: 5178079 - DNA, 24 bp, Homo sapiens
agaatatttaagaaaagcactttt

SEQ ID NO: 5178080 - DNA, 13 bp, Homo sapiens
agaatatttacta

SEQ ID NO: 5178081 - DNA, 21 bp, Homo sapiens
agaatatttactaactaaata

SEQ ID NO: 5178082 - DNA, 13 bp, Homo sapiens
agaatatttagaa

SEQ ID NO: 5178083 - DNA, 16 bp, Homo sapiens
agaatatttattacct

SEQ ID NO: 5178084 - DNA, 21 bp, Homo sapiens
agaatatttcaaatgaacacg

SEQ ID NO: 5178085 - DNA, 22 bp, Homo sapiens
agaatatttttatatttccttt

SEQ ID NO: 5178086 - DNA, 14 bp, Homo sapiens
agaatcaaacattt

SEQ ID NO: 5178087 - DNA, 13 bp, Homo sapiens
agaatcaaagcaa

SEQ ID NO: 5178088 - DNA, 15 bp, Homo sapiens
agaatcaaatactca

SEQ ID NO: 5178089 - DNA, 16 bp, Homo sapiens
agaatcaagtctgtga

SEQ ID NO: 5178090 - DNA, 13 bp, Homo sapiens
agaatcacaatag

SEQ ID NO: 5178091 - DNA, 13 bp, Homo sapiens
agaatcacaggct

SEQ ID NO: 5178092 - DNA, 18 bp, Homo sapiens
agaatcaccgcatttcag

SEQ ID NO: 5178093 - DNA, 22 bp, Homo sapiens
agaatcacctaattaatttcag

SEQ ID NO: 5178094 - DNA, 15 bp, Homo sapiens
agaatcactgcagcc

SEQ ID NO: 5178095 - DNA, 19 bp, Homo sapiens
agaatcactgcagcccagg

SEQ ID NO: 5178096 - DNA, 14 bp, Homo sapiens
agaatcacttgaac

SEQ ID NO: 5178097 - DNA, 17 bp, Homo sapiens
agaatcacttgaacccg

SEQ ID NO: 5178098 - DNA, 16 bp, Homo sapiens
agaatcacttttctag

SEQ ID NO: 5178099 - DNA, 17 bp, Homo sapiens
agaatcagaagatagtc

SEQ ID NO: 5178100 - DNA, 12 bp, Homo sapiens
agaatcagaata

SEQ ID NO: 5178101 - DNA, 13 bp, Homo sapiens
agaatcagacagc

SEQ ID NO: 5178102 - DNA, 20 bp, Homo sapiens
agaatcagatacaaaactat

SEQ ID NO: 5178103 - DNA, 17 bp, Homo sapiens
agaatcagatcatttca

SEQ ID NO: 5178104 - DNA, 17 bp, Homo sapiens
agaatcagggcaggctt

SEQ ID NO: 5178105 - DNA, 19 bp, Homo sapiens
agaatcagggcaggcttgc

SEQ ID NO: 5178106 - DNA, 22 bp, Homo sapiens
agaatcagggcaggcttgccac

SEQ ID NO: 5178107 - DNA, 18 bp, Homo sapiens
agaatcagggtggagaag

SEQ ID NO: 5178108 - DNA, 16 bp, Homo sapiens
agaatcaggttgcaaa

SEQ ID NO: 5178109 - DNA, 21 bp, Homo sapiens
agaatcagtaggaccaggcca

SEQ ID NO: 5178110 - DNA, 22 bp, Homo sapiens
agaatcagtaggaccaggccac

SEQ ID NO: 5178111 - DNA, 19 bp, Homo sapiens
agaatcagtctatccacag

SEQ ID NO: 5178112 - DNA, 17 bp, Homo sapiens
agaatcagtgtgttact

SEQ ID NO: 5178113 - DNA, 18 bp, Homo sapiens
agaatcagtgttaaattc

SEQ ID NO: 5178114 - DNA, 19 bp, Homo sapiens
agaatcagtgttaaattca

SEQ ID NO: 5178115 - DNA, 21 bp, Homo sapiens
agaatcagtgttaaattcatt

SEQ ID NO: 5178116 - DNA, 17 bp, Homo sapiens
agaatcataattttcaa

SEQ ID NO: 5178117 - DNA, 17 bp, Homo sapiens
agaatcatacttaacat

SEQ ID NO: 5178118 - DNA, 17 bp, Homo sapiens
agaatcatagtgccata

SEQ ID NO: 5178119 - DNA, 17 bp, Homo sapiens
agaatcatatgattctg

SEQ ID NO: 5178120 - DNA, 13 bp, Homo sapiens
agaatcatcagga

SEQ ID NO: 5178121 - DNA, 19 bp, Homo sapiens
agaatcatgctgttgcatt

SEQ ID NO: 5178122 - DNA, 13 bp, Homo sapiens
agaatcatggatt

SEQ ID NO: 5178123 - DNA, 14 bp, Homo sapiens
agaatcatgtattt

SEQ ID NO: 5178124 - DNA, 17 bp, Homo sapiens
agaatcatgtattttgt

SEQ ID NO: 5178125 - DNA, 18 bp, Homo sapiens
agaatcatgtattttgta

SEQ ID NO: 5178126 - DNA, 20 bp, Homo sapiens
agaatcatgtcgatcctggg

SEQ ID NO: 5178127 - DNA, 18 bp, Homo sapiens
agaatcatgtgaacccgg

SEQ ID NO: 5178128 - DNA, 21 bp, Homo sapiens
agaatcatgtgaacccgggac

SEQ ID NO: 5178129 - DNA, 20 bp, Homo sapiens
agaatcattatttattaaat

SEQ ID NO: 5178130 - DNA, 22 bp, Homo sapiens
agaatcattatttattaaattt

SEQ ID NO: 5178131 - DNA, 13 bp, Homo sapiens
agaatcattgtaa

SEQ ID NO: 5178132 - DNA, 12 bp, Homo sapiens
agaatccaaact

SEQ ID NO: 5178133 - DNA, 21 bp, Homo sapiens
agaatccaaacttggattttt

SEQ ID NO: 5178134 - DNA, 14 bp, Homo sapiens
agaatccacataaa

SEQ ID NO: 5178135 - DNA, 16 bp, Homo sapiens
agaatccacatttcta

SEQ ID NO: 5178136 - DNA, 18 bp, Homo sapiens
agaatccacatttctaaa

SEQ ID NO: 5178137 - DNA, 19 bp, Homo sapiens
agaatccacatttctaaaa

SEQ ID NO: 5178138 - DNA, 22 bp, Homo sapiens
agaatccacatttctaaaatct

SEQ ID NO: 5178139 - DNA, 18 bp, Homo sapiens
agaatcccaaatttgatt

SEQ ID NO: 5178140 - DNA, 23 bp, Homo sapiens
agaatcccacccccacttcatgc

SEQ ID NO: 5178141 - DNA, 16 bp, Homo sapiens
agaatcccagcagcag

SEQ ID NO: 5178142 - DNA, 21 bp, Homo sapiens
agaatcccagccccctgacca

SEQ ID NO: 5178143 - DNA, 18 bp, Homo sapiens
agaatccccgtgctcaca

SEQ ID NO: 5178144 - DNA, 16 bp, Homo sapiens
agaatccctagacttt

SEQ ID NO: 5178145 - DNA, 12 bp, Homo sapiens
agaatccctgca

SEQ ID NO: 5178146 - DNA, 14 bp, Homo sapiens
agaatccctgcagc

SEQ ID NO: 5178147 - DNA, 16 bp, Homo sapiens
agaatccctgcagcct

SEQ ID NO: 5178148 - DNA, 15 bp, Homo sapiens
agaatccctgtgtta

SEQ ID NO: 5178149 - DNA, 18 bp, Homo sapiens
agaatccctgtgttaatt

SEQ ID NO: 5178150 - DNA, 19 bp, Homo sapiens
agaatccctgtgttaattt

SEQ ID NO: 5178151 - DNA, 20 bp, Homo sapiens
agaatcccttaacagttgta

SEQ ID NO: 5178152 - DNA, 23 bp, Homo sapiens
agaatccctttgcacctgagacc

SEQ ID NO: 5178153 - DNA, 22 bp, Homo sapiens
agaatccgtattgaatttgtgt

SEQ ID NO: 5178154 - DNA, 21 bp, Homo sapiens
agaatcctaggctccacccca

SEQ ID NO: 5178155 - DNA, 21 bp, Homo sapiens
agaatcctcagttggaatcat

SEQ ID NO: 5178156 - DNA, 19 bp, Homo sapiens
agaatcctcccttcccagg

SEQ ID NO: 5178157 - DNA, 20 bp, Homo sapiens
agaatcctcccttcccagga

SEQ ID NO: 5178158 - DNA, 12 bp, Homo sapiens
agaatcctgcct

SEQ ID NO: 5178159 - DNA, 14 bp, Homo sapiens
agaatcctgcttta

SEQ ID NO: 5178160 - DNA, 20 bp, Homo sapiens
agaatcctggccctctgtgt

SEQ ID NO: 5178161 - DNA, 17 bp, Homo sapiens
agaatccttatctataa

SEQ ID NO: 5178162 - DNA, 19 bp, Homo sapiens
agaatccttatctataaaa

SEQ ID NO: 5178163 - DNA, 21 bp, Homo sapiens
agaatcctttacattcaactt

SEQ ID NO: 5178164 - DNA, 22 bp, Homo sapiens
agaatccttttgtagaatgaac

SEQ ID NO: 5178165 - DNA, 17 bp, Homo sapiens
agaatcgacctcactgt

SEQ ID NO: 5178166 - DNA, 20 bp, Homo sapiens
agaatcgacctcactgtcag

SEQ ID NO: 5178167 - DNA, 21 bp, Homo sapiens
agaatcgatgggggatgcttc

SEQ ID NO: 5178168 - DNA, 13 bp, Homo sapiens
agaatcgcttgaa

SEQ ID NO: 5178169 - DNA, 21 bp, Homo sapiens
agaatcgcttgaacccaggag

SEQ ID NO: 5178170 - DNA, 15 bp, Homo sapiens
agaatcgctttcctt

SEQ ID NO: 5178171 - DNA, 20 bp, Homo sapiens
agaatcgctttccttcctcc

SEQ ID NO: 5178172 - DNA, 17 bp, Homo sapiens
agaatcggcagtatttt

SEQ ID NO: 5178173 - DNA, 20 bp, Homo sapiens
agaatcggcagtattttctg

SEQ ID NO: 5178174 - DNA, 21 bp, Homo sapiens
agaatcggcagtattttctgt

SEQ ID NO: 5178175 - DNA, 19 bp, Homo sapiens
agaatcggccagtgggcct

SEQ ID NO: 5178176 - DNA, 18 bp, Homo sapiens
agaatcgttttgtactgt

SEQ ID NO: 5178177 - DNA, 20 bp, Homo sapiens
agaatctaaaccttacatgt

SEQ ID NO: 5178178 - DNA, 18 bp, Homo sapiens
agaatctaattctgttga

SEQ ID NO: 5178179 - DNA, 14 bp, Homo sapiens
agaatctagaaatg

SEQ ID NO: 5178180 - DNA, 15 bp, Homo sapiens
agaatctagaaatgt

SEQ ID NO: 5178181 - DNA, 14 bp, Homo sapiens
agaatctagaagat

SEQ ID NO: 5178182 - DNA, 18 bp, Homo sapiens
agaatctagaagatgtgt

SEQ ID NO: 5178183 - DNA, 21 bp, Homo sapiens
agaatctaggccaccccaacc

SEQ ID NO: 5178184 - DNA, 22 bp, Homo sapiens
agaatctaggccaccccaacct

SEQ ID NO: 5178185 - DNA, 21 bp, Homo sapiens
agaatctattttctatgtact

SEQ ID NO: 5178186 - DNA, 18 bp, Homo sapiens
agaatctcagcactttgt

SEQ ID NO: 5178187 - DNA, 13 bp, Homo sapiens
agaatctccattt

SEQ ID NO: 5178188 - DNA, 22 bp, Homo sapiens
agaatctctctactcagatgac

SEQ ID NO: 5178189 - DNA, 13 bp, Homo sapiens
agaatctctgagc

SEQ ID NO: 5178190 - DNA, 16 bp, Homo sapiens
agaatctgaagctatt

SEQ ID NO: 5178191 - DNA, 18 bp, Homo sapiens
agaatctgaatgtaattt

SEQ ID NO: 5178192 - DNA, 12 bp, Homo sapiens
agaatctgcccc

SEQ ID NO: 5178193 - DNA, 12 bp, Homo sapiens
agaatctgcctg

SEQ ID NO: 5178194 - DNA, 17 bp, Homo sapiens
agaatctggctcctgtt

SEQ ID NO: 5178195 - DNA, 21 bp, Homo sapiens
agaatcttaaggtctaactgt

SEQ ID NO: 5178196 - DNA, 16 bp, Homo sapiens
agaggcccccagccca

SEQ ID NO: 5178197 - DNA, 20 bp, Homo sapiens
agaggcccccagcccagggc

SEQ ID NO: 5178198 - DNA, 21 bp, Homo sapiens
agaggcccccagtggggacag

SEQ ID NO: 5178199 - DNA, 19 bp, Homo sapiens
agaggccccggctgggtga

SEQ ID NO: 5178200 - DNA, 20 bp, Homo sapiens
agaggccccttgctgctggc

SEQ ID NO: 5178201 - DNA, 23 bp, Homo sapiens
agaggccccttgctgctggctcc

SEQ ID NO: 5178202 - DNA, 19 bp, Homo sapiens
agaggcccgaggcaccgga

SEQ ID NO: 5178203 - DNA, 20 bp, Homo sapiens
agaggccctaggcgggatgg

SEQ ID NO: 5178204 - DNA, 14 bp, Homo sapiens
agaggccctcaagt

SEQ ID NO: 5178205 - DNA, 14 bp, Homo sapiens
agaggccctcgctg

SEQ ID NO: 5178206 - DNA, 23 bp, Homo sapiens
agaggccctctggagtggccact

SEQ ID NO: 5178207 - DNA, 13 bp, Homo sapiens
agaggccctggag

SEQ ID NO: 5178208 - DNA, 19 bp, Homo sapiens
agaggccctggagggaagg

SEQ ID NO: 5178209 - DNA, 23 bp, Homo sapiens
agaggccctggagggaaggacag

SEQ ID NO: 5178210 - DNA, 21 bp, Homo sapiens
agaggccctggatcagcgtgg

SEQ ID NO: 5178211 - DNA, 22 bp, Homo sapiens
agaggccctggatcagcgtggc

SEQ ID NO: 5178212 - DNA, 24 bp, Homo sapiens
agaggccctggatcagcgtggcct

SEQ ID NO: 5178213 - DNA, 23 bp, Homo sapiens
agaggccgaaggtgcctcagact

SEQ ID NO: 5178214 - DNA, 21 bp, Homo sapiens
agaggccgagcggtggccccg

SEQ ID NO: 5178215 - DNA, 13 bp, Homo sapiens
agaggccgctgcc

SEQ ID NO: 5178216 - DNA, 16 bp, Homo sapiens
agaggccggggtccag

SEQ ID NO: 5178217 - DNA, 21 bp, Homo sapiens
agaggccggggtccaggcccg

SEQ ID NO: 5178218 - DNA, 22 bp, Homo sapiens
agaggccgtggctgctgtggga

SEQ ID NO: 5178219 - DNA, 17 bp, Homo sapiens
agaggcctcatgcctgc

SEQ ID NO: 5178220 - DNA, 18 bp, Homo sapiens
agaggcctcggctgtctc

SEQ ID NO: 5178221 - DNA, 22 bp, Homo sapiens
agaggcctcggctgtctcctgt

SEQ ID NO: 5178222 - DNA, 20 bp, Homo sapiens
agaggcctcttttcctgaag

SEQ ID NO: 5178223 - DNA, 19 bp, Homo sapiens
agaggcctgaaatcctggt

SEQ ID NO: 5178224 - DNA, 13 bp, Homo sapiens
agaggcctgagga

SEQ ID NO: 5178225 - DNA, 15 bp, Homo sapiens
agaggcctgcagggc

SEQ ID NO: 5178226 - DNA, 16 bp, Homo sapiens
agaggcctggagccca

SEQ ID NO: 5178227 - DNA, 22 bp, Homo sapiens
agaggcctggcatcttctggag

SEQ ID NO: 5178228 - DNA, 19 bp, Homo sapiens
agaggcctgggctgggaaa

SEQ ID NO: 5178229 - DNA, 23 bp, Homo sapiens
agaggcctggggccggtagaggc

SEQ ID NO: 5178230 - DNA, 19 bp, Homo sapiens
agaggcctggggtgggaca

SEQ ID NO: 5178231 - DNA, 20 bp, Homo sapiens
agaggcctggggtgggacag

SEQ ID NO: 5178232 - DNA, 13 bp, Homo sapiens
agaggcctggtgc

SEQ ID NO: 5178233 - DNA, 18 bp, Homo sapiens
agaggcctggtgccctgg

SEQ ID NO: 5178234 - DNA, 12 bp, Homo sapiens
agaggccttccc

SEQ ID NO: 5178235 - DNA, 18 bp, Homo sapiens
agaggccttgggggtctg

SEQ ID NO: 5178236 - DNA, 13 bp, Homo sapiens
agaggcctttcta

SEQ ID NO: 5178237 - DNA, 14 bp, Homo sapiens
agaggcgagccagg

SEQ ID NO: 5178238 - DNA, 16 bp, Homo sapiens
agaggcgagccaggca

SEQ ID NO: 5178239 - DNA, 21 bp, Homo sapiens
agaggcgcatgaatttgtgaa

SEQ ID NO: 5178240 - DNA, 15 bp, Homo sapiens
agaggcggaaacctt

SEQ ID NO: 5178241 - DNA, 17 bp, Homo sapiens
agaggcggaaaccttgc

SEQ ID NO: 5178242 - DNA, 18 bp, Homo sapiens
agaggcggaaaccttgca

SEQ ID NO: 5178243 - DNA, 16 bp, Homo sapiens
agaggcggcctcgtgc

SEQ ID NO: 5178244 - DNA, 18 bp, Homo sapiens
agaggcgggagaactgaa

SEQ ID NO: 5178245 - DNA, 20 bp, Homo sapiens
agaggcgggccagccaggcg

SEQ ID NO: 5178246 - DNA, 19 bp, Homo sapiens
agaggcgtactacccagct

SEQ ID NO: 5178247 - DNA, 17 bp, Homo sapiens
agaggcgtcttgtattt

SEQ ID NO: 5178248 - DNA, 14 bp, Homo sapiens
agaggctaaaatgt

SEQ ID NO: 5178249 - DNA, 16 bp, Homo sapiens
agaggctaaaatgttt

SEQ ID NO: 5178250 - DNA, 17 bp, Homo sapiens
agaggctaaaatgtttt

SEQ ID NO: 5178251 - DNA, 21 bp, Homo sapiens
agaggctaaattactcaggaa

SEQ ID NO: 5178252 - DNA, 21 bp, Homo sapiens
agaggctaattcagtgtcaca

SEQ ID NO: 5178253 - DNA, 16 bp, Homo sapiens
agaggctacagggcca

SEQ ID NO: 5178254 - DNA, 15 bp, Homo sapiens
agaggctactcttga

SEQ ID NO: 5178255 - DNA, 20 bp, Homo sapiens
agaggctagccccagggtga

SEQ ID NO: 5178256 - DNA, 17 bp, Homo sapiens
agaggctagcttctgct

SEQ ID NO: 5178257 - DNA, 13 bp, Homo sapiens
agaggctcagaga

SEQ ID NO: 5178258 - DNA, 17 bp, Homo sapiens
agaggctcatggccctg

SEQ ID NO: 5178259 - DNA, 20 bp, Homo sapiens
agaggctccagctctggcac

SEQ ID NO: 5178260 - DNA, 22 bp, Homo sapiens
agaggctccagctctggcacag

SEQ ID NO: 5178261 - DNA, 16 bp, Homo sapiens
agaggctccccagggc

SEQ ID NO: 5178262 - DNA, 17 bp, Homo sapiens
agaggctccccagggct

SEQ ID NO: 5178263 - DNA, 18 bp, Homo sapiens
agaggctccccagggctc

SEQ ID NO: 5178264 - DNA, 20 bp, Homo sapiens
agaggctccccctaaacaca

SEQ ID NO: 5178265 - DNA, 12 bp, Homo sapiens
agaggctctgga

SEQ ID NO: 5178266 - DNA, 15 bp, Homo sapiens
agaggctctggacag

SEQ ID NO: 5178267 - DNA, 16 bp, Homo sapiens
agaggctctggacagc

SEQ ID NO: 5178268 - DNA, 16 bp, Homo sapiens
agaggctctggggcag

SEQ ID NO: 5178269 - DNA, 19 bp, Homo sapiens
agaggctgaaagaggccaa

SEQ ID NO: 5178270 - DNA, 16 bp, Homo sapiens
agaggctgacttttcc

SEQ ID NO: 5178271 - DNA, 15 bp, Homo sapiens
agaggctgagcagga

SEQ ID NO: 5178272 - DNA, 12 bp, Homo sapiens
agaggctgagcc

SEQ ID NO: 5178273 - DNA, 23 bp, Homo sapiens
agaggctgagccctgtacccacc

SEQ ID NO: 5178274 - DNA, 18 bp, Homo sapiens
agaggctgaggcctggac

SEQ ID NO: 5178275 - DNA, 19 bp, Homo sapiens
agaggctgaggcctggact

SEQ ID NO: 5178276 - DNA, 16 bp, Homo sapiens
agaggctgaggctggc

SEQ ID NO: 5178277 - DNA, 19 bp, Homo sapiens
agaggctgaggctggcaca

SEQ ID NO: 5178278 - DNA, 16 bp, Homo sapiens
agaggctgcagccagg

SEQ ID NO: 5178279 - DNA, 13 bp, Homo sapiens
agaggctgcattg

SEQ ID NO: 5178280 - DNA, 12 bp, Homo sapiens
agaggctgcctc

SEQ ID NO: 5178281 - DNA, 13 bp, Homo sapiens
agaggctgcctca

SEQ ID NO: 5178282 - DNA, 17 bp, Homo sapiens
agaggctgcctcagcca

SEQ ID NO: 5178283 - DNA, 20 bp, Homo sapiens
agaggctgcctccgcacctg

SEQ ID NO: 5178284 - DNA, 21 bp, Homo sapiens
agaggctgcctccgcacctga

SEQ ID NO: 5178285 - DNA, 13 bp, Homo sapiens
agaggctggcaag

SEQ ID NO: 5178286 - DNA, 13 bp, Homo sapiens
agaggctgggagc

SEQ ID NO: 5178287 - DNA, 17 bp, Homo sapiens
agaggctgggagcatag

SEQ ID NO: 5178288 - DNA, 21 bp, Homo sapiens
agaggctgggaggagcccctg

SEQ ID NO: 5178289 - DNA, 23 bp, Homo sapiens
agaggctgggaggagcccctgga

SEQ ID NO: 5178290 - DNA, 16 bp, Homo sapiens
agaggctgggaggttg

SEQ ID NO: 5178291 - DNA, 21 bp, Homo sapiens
agaggctggtgctgtggccag

SEQ ID NO: 5178292 - DNA, 18 bp, Homo sapiens
agaggctggttttggcat

SEQ ID NO: 5178293 - DNA, 15 bp, Homo sapiens
agaggctgtggtcag

SEQ ID NO: 5178294 - DNA, 17 bp, Homo sapiens
agaggctgtggtggctg

SEQ ID NO: 5178295 - DNA, 17 bp, Homo sapiens
agaggctgtgtccctgc

SEQ ID NO: 5178296 - DNA, 23 bp, Homo sapiens
agaggctgtgtccctgctggggt

SEQ ID NO: 5178297 - DNA, 16 bp, Homo sapiens
agaggctgtgtggcca

SEQ ID NO: 5178298 - DNA, 22 bp, Homo sapiens
agaggctgttcccaccaggctg

SEQ ID NO: 5178299 - DNA, 22 bp, Homo sapiens
agaggcttccctacacagggcc

SEQ ID NO: 5178300 - DNA, 12 bp, Homo sapiens
agaggcttctcc

SEQ ID NO: 5178301 - DNA, 21 bp, Homo sapiens
agaggcttctccgccagcctc

SEQ ID NO: 5178302 - DNA, 14 bp, Homo sapiens
agaggcttctcctg

SEQ ID NO: 5178303 - DNA, 23 bp, Homo sapiens
agaggcttctcctgttttatata

SEQ ID NO: 5178304 - DNA, 14 bp, Homo sapiens
agaggcttgtttac

SEQ ID NO: 5178305 - DNA, 17 bp, Homo sapiens
agaggctttggggtcct

SEQ ID NO: 5178306 - DNA, 19 bp, Homo sapiens
agaggcttttccagtgtgt

SEQ ID NO: 5178307 - DNA, 17 bp, Homo sapiens
agagggaaaacagaaaa

SEQ ID NO: 5178308 - DNA, 16 bp, Homo sapiens
agagggaaaatcttca

SEQ ID NO: 5178309 - DNA, 20 bp, Homo sapiens
agagggaaacgtgccctctg

SEQ ID NO: 5178310 - DNA, 15 bp, Homo sapiens
agagggaacaaaact

SEQ ID NO: 5178311 - DNA, 17 bp, Homo sapiens
agagggaagatgacctg

SEQ ID NO: 5178312 - DNA, 12 bp, Homo sapiens
agagggaagcca

SEQ ID NO: 5178313 - DNA, 17 bp, Homo sapiens
agagggaagctgaggcc

SEQ ID NO: 5178314 - DNA, 18 bp, Homo sapiens
agagggaagctgaggccc

SEQ ID NO: 5178315 - DNA, 14 bp, Homo sapiens
agagggaagctggc

SEQ ID NO: 5178316 - DNA, 15 bp, Homo sapiens
agagggaagctggct

SEQ ID NO: 5178317 - DNA, 17 bp, Homo sapiens
agagggaatggatgggg

SEQ ID NO: 5178318 - DNA, 19 bp, Homo sapiens
agagggaatgttccctgca

SEQ ID NO: 5178319 - DNA, 20 bp, Homo sapiens
agagggacaaccagaaggcc

SEQ ID NO: 5178320 - DNA, 20 bp, Homo sapiens
agagggacacatgcccctcc

SEQ ID NO: 5178321 - DNA, 21 bp, Homo sapiens
agagggacacatgcccctccc

SEQ ID NO: 5178322 - DNA, 15 bp, Homo sapiens
agagggacaggctga

SEQ ID NO: 5178323 - DNA, 16 bp, Homo sapiens
agagggacagtgggct

SEQ ID NO: 5178324 - DNA, 18 bp, Homo sapiens
agagggaccagctggggg

SEQ ID NO: 5178325 - DNA, 17 bp, Homo sapiens
agagggaccagggtggg

SEQ ID NO: 5178326 - DNA, 16 bp, Homo sapiens
agagggacctctccca

SEQ ID NO: 5178327 - DNA, 16 bp, Homo sapiens
agagggacgcacagca

SEQ ID NO: 5178328 - DNA, 19 bp, Homo sapiens
agagggactcaagggaaag

SEQ ID NO: 5178329 - DNA, 11 bp, Homo sapiens
agagggactgg

SEQ ID NO: 5178330 - DNA, 15 bp, Homo sapiens
agagggactggacag

SEQ ID NO: 5178331 - DNA, 18 bp, Homo sapiens
agagggactggacagcca

SEQ ID NO: 5178332 - DNA, 13 bp, Homo sapiens
agagggacttgag

SEQ ID NO: 5178333 - DNA, 15 bp, Homo sapiens
agagggagaaggaga

SEQ ID NO: 5178334 - DNA, 17 bp, Homo sapiens
agagggagaaggagagg

SEQ ID NO: 5178335 - DNA, 12 bp, Homo sapiens
agagggagagga

SEQ ID NO: 5178336 - DNA, 16 bp, Homo sapiens
agagggagaggaagca

SEQ ID NO: 5178337 - DNA, 17 bp, Homo sapiens
agagggagaggaagcac

SEQ ID NO: 5178338 - DNA, 16 bp, Homo sapiens
agagggagctggaacc

SEQ ID NO: 5178339 - DNA, 19 bp, Homo sapiens
agagggaggagtttttctt

SEQ ID NO: 5178340 - DNA, 22 bp, Homo sapiens
agagggaggggacagaggccct

SEQ ID NO: 5178341 - DNA, 14 bp, Homo sapiens
agagggaggggcct

SEQ ID NO: 5178342 - DNA, 20 bp, Homo sapiens
agagggaggggcctaggcct

SEQ ID NO: 5178343 - DNA, 20 bp, Homo sapiens
agagggaggtcactggaaag

SEQ ID NO: 5178344 - DNA, 22 bp, Homo sapiens
agagggaggtcactggaaaggg

SEQ ID NO: 5178345 - DNA, 22 bp, Homo sapiens
agagggagtacaaagacaggga

SEQ ID NO: 5178346 - DNA, 20 bp, Homo sapiens
agagggagtgacagaggcag

SEQ ID NO: 5178347 - DNA, 23 bp, Homo sapiens
agagggagtttaatacaggaaat

SEQ ID NO: 5178348 - DNA, 16 bp, Homo sapiens
agagggataaggcagt

SEQ ID NO: 5178349 - DNA, 18 bp, Homo sapiens
agagggatacaagagagg

SEQ ID NO: 5178350 - DNA, 23 bp, Homo sapiens
agagggatccaccgccacactgg

SEQ ID NO: 5178351 - DNA, 17 bp, Homo sapiens
agagggatgaaatgcca

SEQ ID NO: 5178352 - DNA, 21 bp, Homo sapiens
agagggcaaacccaaaacctc

SEQ ID NO: 5178353 - DNA, 14 bp, Homo sapiens
agagggcaaggaag

SEQ ID NO: 5178354 - DNA, 16 bp, Homo sapiens
agagggcacacactgt

SEQ ID NO: 5178355 - DNA, 12 bp, Homo sapiens
agagggcacaga

SEQ ID NO: 5178356 - DNA, 18 bp, Homo sapiens
agagggcagactgtgaac

SEQ ID NO: 5178357 - DNA, 18 bp, Homo sapiens
agagggcagtacctggga

SEQ ID NO: 5178358 - DNA, 11 bp, Homo sapiens
agagggcagtc

SEQ ID NO: 5178359 - DNA, 19 bp, Homo sapiens
agagggccaagagagacat

SEQ ID NO: 5178360 - DNA, 12 bp, Homo sapiens
agagggccacac

SEQ ID NO: 5178361 - DNA, 17 bp, Homo sapiens
agagggccagagctagg

SEQ ID NO: 5178362 - DNA, 22 bp, Homo sapiens
agagggccagagctagggctgc

SEQ ID NO: 5178363 - DNA, 14 bp, Homo sapiens
agagggccagcagg

SEQ ID NO: 5178364 - DNA, 19 bp, Homo sapiens
agagggccagcaggctcct

SEQ ID NO: 5178365 - DNA, 13 bp, Homo sapiens
agagggcccagcc

SEQ ID NO: 5178366 - DNA, 14 bp, Homo sapiens
agagggcccagccc

SEQ ID NO: 5178367 - DNA, 15 bp, Homo sapiens
agagggcccagccca

SEQ ID NO: 5178368 - DNA, 16 bp, Homo sapiens
agagggcccagctgta

SEQ ID NO: 5178369 - DNA, 14 bp, Homo sapiens
agagggcccaggca

SEQ ID NO: 5178370 - DNA, 21 bp, Homo sapiens
agagggcccaggcaggccacc

SEQ ID NO: 5178371 - DNA, 16 bp, Homo sapiens
agagggcccaggtccc

SEQ ID NO: 5178372 - DNA, 15 bp, Homo sapiens
agagggcccatcagg

SEQ ID NO: 5178373 - DNA, 18 bp, Homo sapiens
agagggccctggtgtttc

SEQ ID NO: 5178374 - DNA, 18 bp, Homo sapiens
agaatcttgactttctga

SEQ ID NO: 5178375 - DNA, 14 bp, Homo sapiens
agaatctttagaga

SEQ ID NO: 5178376 - DNA, 22 bp, Homo sapiens
agaatctttattcaaactttta

SEQ ID NO: 5178377 - DNA, 16 bp, Homo sapiens
agaatctttattgaga

SEQ ID NO: 5178378 - DNA, 24 bp, Homo sapiens
agaatctttattgagaaagagcac

SEQ ID NO: 5178379 - DNA, 12 bp, Homo sapiens
agaatctttcct

SEQ ID NO: 5178380 - DNA, 14 bp, Homo sapiens
agaatgaaaaatga

SEQ ID NO: 5178381 - DNA, 12 bp, Homo sapiens
agaatgaaaaca

SEQ ID NO: 5178382 - DNA, 17 bp, Homo sapiens
agaatgaaaacaatatg

SEQ ID NO: 5178383 - DNA, 19 bp, Homo sapiens
agaatgaaaacaatatgtt

SEQ ID NO: 5178384 - DNA, 21 bp, Homo sapiens
agaatgaaaactgtaaatatt

SEQ ID NO: 5178385 - DNA, 21 bp, Homo sapiens
agaatgaaagagtaaaggaaa

SEQ ID NO: 5178386 - DNA, 21 bp, Homo sapiens
agaatgaaagctgttccttgg

SEQ ID NO: 5178387 - DNA, 18 bp, Homo sapiens
agaatgaaagggcccaga

SEQ ID NO: 5178388 - DNA, 12 bp, Homo sapiens
agaatgaaagta

SEQ ID NO: 5178389 - DNA, 13 bp, Homo sapiens
agaatgaaagtag

SEQ ID NO: 5178390 - DNA, 19 bp, Homo sapiens
agaatgaaatactgtttga

SEQ ID NO: 5178391 - DNA, 12 bp, Homo sapiens
agaatgaaatga

SEQ ID NO: 5178392 - DNA, 15 bp, Homo sapiens
agaatgaacaaattg

SEQ ID NO: 5178393 - DNA, 21 bp, Homo sapiens
agaatgaacccatagggagct

SEQ ID NO: 5178394 - DNA, 18 bp, Homo sapiens
agaatgaaccctcctcct

SEQ ID NO: 5178395 - DNA, 19 bp, Homo sapiens
agaatgaactgtggaattt

SEQ ID NO: 5178396 - DNA, 16 bp, Homo sapiens
agaatgaagacctaaa

SEQ ID NO: 5178397 - DNA, 22 bp, Homo sapiens
agaatgaaggtttttgtaaaga

SEQ ID NO: 5178398 - DNA, 22 bp, Homo sapiens
agaatgaatgagtaggaaagga

SEQ ID NO: 5178399 - DNA, 19 bp, Homo sapiens
agaatgaatttatctttac

SEQ ID NO: 5178400 - DNA, 16 bp, Homo sapiens
agaatgaccctgtcaa

SEQ ID NO: 5178401 - DNA, 18 bp, Homo sapiens
agaatgaccctgtcaagc

SEQ ID NO: 5178402 - DNA, 16 bp, Homo sapiens
agaatgacctgccctg

SEQ ID NO: 5178403 - DNA, 14 bp, Homo sapiens
agaatgacctggcc

SEQ ID NO: 5178404 - DNA, 15 bp, Homo sapiens
agaatgaccttgagt

SEQ ID NO: 5178405 - DNA, 16 bp, Homo sapiens
agaatgaccttgagtt

SEQ ID NO: 5178406 - DNA, 13 bp, Homo sapiens
agaatgaccttgt

SEQ ID NO: 5178407 - DNA, 14 bp, Homo sapiens
agaatgaccttgta

SEQ ID NO: 5178408 - DNA, 22 bp, Homo sapiens
agaatgaccttgtaatgtaact

SEQ ID NO: 5178409 - DNA, 15 bp, Homo sapiens
agaatgactgatgtt

SEQ ID NO: 5178410 - DNA, 14 bp, Homo sapiens
agaatgagaaacat

SEQ ID NO: 5178411 - DNA, 13 bp, Homo sapiens
agaatgagaaaga

SEQ ID NO: 5178412 - DNA, 14 bp, Homo sapiens
agaatgagaaagaa

SEQ ID NO: 5178413 - DNA, 16 bp, Homo sapiens
agaatgagaaagaaaa

SEQ ID NO: 5178414 - DNA, 14 bp, Homo sapiens
agaatgagaaatca

SEQ ID NO: 5178415 - DNA, 18 bp, Homo sapiens
agaatgagaaatcatgtt

SEQ ID NO: 5178416 - DNA, 18 bp, Homo sapiens
agaatgagaagggaaggc

SEQ ID NO: 5178417 - DNA, 14 bp, Homo sapiens
agaatgagacatcc

SEQ ID NO: 5178418 - DNA, 15 bp, Homo sapiens
agaatgagagagaaa

SEQ ID NO: 5178419 - DNA, 16 bp, Homo sapiens
agaatgagagagtgtg

SEQ ID NO: 5178420 - DNA, 17 bp, Homo sapiens
agaatgagagcgacaca

SEQ ID NO: 5178421 - DNA, 18 bp, Homo sapiens
agaatgagagcgacacag

SEQ ID NO: 5178422 - DNA, 21 bp, Homo sapiens
agaatgagagcgacacagacg

SEQ ID NO: 5178423 - DNA, 18 bp, Homo sapiens
agaatgagatgatttaat

SEQ ID NO: 5178424 - DNA, 22 bp, Homo sapiens
agaatgagatgatttaattctt

SEQ ID NO: 5178425 - DNA, 13 bp, Homo sapiens
agaatgagcctgt

SEQ ID NO: 5178426 - DNA, 18 bp, Homo sapiens
agaatgaggaagcaaaga

SEQ ID NO: 5178427 - DNA, 19 bp, Homo sapiens
agaatgaggcacatgacag

SEQ ID NO: 5178428 - DNA, 16 bp, Homo sapiens
agaatgagggccaaga

SEQ ID NO: 5178429 - DNA, 21 bp, Homo sapiens
agaatgagggcgtgaaacaca

SEQ ID NO: 5178430 - DNA, 22 bp, Homo sapiens
agaatgagggcgtgaaacacaa

SEQ ID NO: 5178431 - DNA, 20 bp, Homo sapiens
agaatgagtccttgatttca

SEQ ID NO: 5178432 - DNA, 22 bp, Homo sapiens
agaatgagtgaagtattgctga

SEQ ID NO: 5178433 - DNA, 15 bp, Homo sapiens
agaatgagtgcaggt

SEQ ID NO: 5178434 - DNA, 14 bp, Homo sapiens
agaatgagtgggaa

SEQ ID NO: 5178435 - DNA, 15 bp, Homo sapiens
agaatgagtgggaat

SEQ ID NO: 5178436 - DNA, 20 bp, Homo sapiens
agaatgatcaaggatctgga

SEQ ID NO: 5178437 - DNA, 15 bp, Homo sapiens
agaatgatctattgc

SEQ ID NO: 5178438 - DNA, 16 bp, Homo sapiens
agaatgatgcacactg

SEQ ID NO: 5178439 - DNA, 13 bp, Homo sapiens
agaatgatggttt

SEQ ID NO: 5178440 - DNA, 16 bp, Homo sapiens
agaatgatgttttaaa

SEQ ID NO: 5178441 - DNA, 18 bp, Homo sapiens
agaatgatgttttaaaaa

SEQ ID NO: 5178442 - DNA, 22 bp, Homo sapiens
agaatgatttccacctttatgt

SEQ ID NO: 5178443 - DNA, 12 bp, Homo sapiens
agaatgatttgt

SEQ ID NO: 5178444 - DNA, 18 bp, Homo sapiens
agaatgatttgtaaatag

SEQ ID NO: 5178445 - DNA, 16 bp, Homo sapiens
agaatgatttttagat

SEQ ID NO: 5178446 - DNA, 19 bp, Homo sapiens
agaatgatttttgctattt

SEQ ID NO: 5178447 - DNA, 16 bp, Homo sapiens
agaatgcaaaagtcta

SEQ ID NO: 5178448 - DNA, 13 bp, Homo sapiens
agaatgcaagcag

SEQ ID NO: 5178449 - DNA, 16 bp, Homo sapiens
agaatgcacaagaatg

SEQ ID NO: 5178450 - DNA, 17 bp, Homo sapiens
agaatgcacagatatac

SEQ ID NO: 5178451 - DNA, 23 bp, Homo sapiens
agaatgcacagtgggtggagcca

SEQ ID NO: 5178452 - DNA, 19 bp, Homo sapiens
agaatgcacttgattcagg

SEQ ID NO: 5178453 - DNA, 12 bp, Homo sapiens
agaatgcagaga

SEQ ID NO: 5178454 - DNA, 13 bp, Homo sapiens
agaatgcagagat

SEQ ID NO: 5178455 - DNA, 23 bp, Homo sapiens
agaatgcagagatgtgcccccac

SEQ ID NO: 5178456 - DNA, 16 bp, Homo sapiens
agaatgcagcccacca

SEQ ID NO: 5178457 - DNA, 20 bp, Homo sapiens
agaatgcagcccaccaggag

SEQ ID NO: 5178458 - DNA, 17 bp, Homo sapiens
agaatgcaggccccgcc

SEQ ID NO: 5178459 - DNA, 22 bp, Homo sapiens
agaatgcaggccccgccccctc

SEQ ID NO: 5178460 - DNA, 23 bp, Homo sapiens
agaatgcatgctttccatatttt

SEQ ID NO: 5178461 - DNA, 13 bp, Homo sapiens
agaatgcattaaa

SEQ ID NO: 5178462 - DNA, 14 bp, Homo sapiens
agaatgcattaaaa

SEQ ID NO: 5178463 - DNA, 13 bp, Homo sapiens
agaatgccagccc

SEQ ID NO: 5178464 - DNA, 15 bp, Homo sapiens
agaatgccagcccaa

SEQ ID NO: 5178465 - DNA, 14 bp, Homo sapiens
agaatgccatttct

SEQ ID NO: 5178466 - DNA, 18 bp, Homo sapiens
agaatgccgaggagttgt

SEQ ID NO: 5178467 - DNA, 17 bp, Homo sapiens
agaatgcctaggccagc

SEQ ID NO: 5178468 - DNA, 20 bp, Homo sapiens
agaatgcctaggccagctcc

SEQ ID NO: 5178469 - DNA, 11 bp, Homo sapiens
agaatgctcct

SEQ ID NO: 5178470 - DNA, 11 bp, Homo sapiens
agaatgctgaa

SEQ ID NO: 5178471 - DNA, 22 bp, Homo sapiens
agaatgctgcaggacttgagaa

SEQ ID NO: 5178472 - DNA, 17 bp, Homo sapiens
agaatgctggcaaaggc

SEQ ID NO: 5178473 - DNA, 14 bp, Homo sapiens
agaatgcttaaaaa

SEQ ID NO: 5178474 - DNA, 14 bp, Homo sapiens
agaatgcttaatca

SEQ ID NO: 5178475 - DNA, 20 bp, Homo sapiens
agaatgcttaatcagataga

SEQ ID NO: 5178476 - DNA, 16 bp, Homo sapiens
agaatgcttcaagttt

SEQ ID NO: 5178477 - DNA, 16 bp, Homo sapiens
agaatgcttctcttta

SEQ ID NO: 5178478 - DNA, 14 bp, Homo sapiens
agaatggaaaaaaa

SEQ ID NO: 5178479 - DNA, 15 bp, Homo sapiens
agaatggaagcctcc

SEQ ID NO: 5178480 - DNA, 23 bp, Homo sapiens
agaatggaagcctccacctgcag

SEQ ID NO: 5178481 - DNA, 13 bp, Homo sapiens
agaatggagaaag

SEQ ID NO: 5178482 - DNA, 14 bp, Homo sapiens
agaatggagaaagt

SEQ ID NO: 5178483 - DNA, 15 bp, Homo sapiens
agaatggagaaagta

SEQ ID NO: 5178484 - DNA, 17 bp, Homo sapiens
agaatggagaaagtaag

SEQ ID NO: 5178485 - DNA, 19 bp, Homo sapiens
agaatggagaaagtaagtc

SEQ ID NO: 5178486 - DNA, 14 bp, Homo sapiens
agaatggagaggaa

SEQ ID NO: 5178487 - DNA, 15 bp, Homo sapiens
agaatggaggcaggg

SEQ ID NO: 5178488 - DNA, 18 bp, Homo sapiens
agaatggataaaataatg

SEQ ID NO: 5178489 - DNA, 23 bp, Homo sapiens
agaatggataaaataatgctgca

SEQ ID NO: 5178490 - DNA, 19 bp, Homo sapiens
agaatggcagtcctggagg

SEQ ID NO: 5178491 - DNA, 17 bp, Homo sapiens
agaatggcatggcagga

SEQ ID NO: 5178492 - DNA, 18 bp, Homo sapiens
agaatggcatggcaggag

SEQ ID NO: 5178493 - DNA, 21 bp, Homo sapiens
agaatggcatggcaggagtct

SEQ ID NO: 5178494 - DNA, 20 bp, Homo sapiens
agaatggcatggtaggctac

SEQ ID NO: 5178495 - DNA, 14 bp, Homo sapiens
agaatggcatttgc

SEQ ID NO: 5178496 - DNA, 18 bp, Homo sapiens
agaatggcatttgcaata

SEQ ID NO: 5178497 - DNA, 18 bp, Homo sapiens
agaatggcctctttgtag

SEQ ID NO: 5178498 - DNA, 15 bp, Homo sapiens
agaatggcctgagac

SEQ ID NO: 5178499 - DNA, 21 bp, Homo sapiens
agaatggcgccaccagctctg

SEQ ID NO: 5178500 - DNA, 21 bp, Homo sapiens
agaatggctatcaaaagaaat

SEQ ID NO: 5178501 - DNA, 16 bp, Homo sapiens
agaatggcttctctgt

SEQ ID NO: 5178502 - DNA, 16 bp, Homo sapiens
agaatggctttcaata

SEQ ID NO: 5178503 - DNA, 18 bp, Homo sapiens
agaatgggaaagagaaag

SEQ ID NO: 5178504 - DNA, 17 bp, Homo sapiens
agaatgggaatatttta

SEQ ID NO: 5178505 - DNA, 16 bp, Homo sapiens
agaatgggagaaaatt

SEQ ID NO: 5178506 - DNA, 16 bp, Homo sapiens
agaatgggcagttaca

SEQ ID NO: 5178507 - DNA, 17 bp, Homo sapiens
agaatgggcagttacat

SEQ ID NO: 5178508 - DNA, 18 bp, Homo sapiens
agaatggggatcacagag

SEQ ID NO: 5178509 - DNA, 19 bp, Homo sapiens
agaatggggttcctgctgt

SEQ ID NO: 5178510 - DNA, 20 bp, Homo sapiens
agaatgggtaattcaagagg

SEQ ID NO: 5178511 - DNA, 19 bp, Homo sapiens
agaatgggtttactctcaa

SEQ ID NO: 5178512 - DNA, 21 bp, Homo sapiens
agaatggtccgtgctaaggac

SEQ ID NO: 5178513 - DNA, 16 bp, Homo sapiens
agaatggtctcagtgt

SEQ ID NO: 5178514 - DNA, 17 bp, Homo sapiens
agaatggtctcagtgtt

SEQ ID NO: 5178515 - DNA, 16 bp, Homo sapiens
agaatggtgattttaa

SEQ ID NO: 5178516 - DNA, 17 bp, Homo sapiens
agaatggtggcttcttt

SEQ ID NO: 5178517 - DNA, 13 bp, Homo sapiens
agaatggtgggct

SEQ ID NO: 5178518 - DNA, 20 bp, Homo sapiens
agaatggtgggctccagagt

SEQ ID NO: 5178519 - DNA, 21 bp, Homo sapiens
agaatggtgggctccagagta

SEQ ID NO: 5178520 - DNA, 19 bp, Homo sapiens
agaatggtgtgaacccggg

SEQ ID NO: 5178521 - DNA, 21 bp, Homo sapiens
agaatggttgccttaaagaaa

SEQ ID NO: 5178522 - DNA, 23 bp, Homo sapiens
agaatggttgccttaaagaaagt

SEQ ID NO: 5178523 - DNA, 16 bp, Homo sapiens
agaatgtaaaagaact

SEQ ID NO: 5178524 - DNA, 15 bp, Homo sapiens
agaatgtaaagcaac

SEQ ID NO: 5178525 - DNA, 16 bp, Homo sapiens
agaatgtaaagcttgt

SEQ ID NO: 5178526 - DNA, 17 bp, Homo sapiens
agaatgtaaagcttgtc

SEQ ID NO: 5178527 - DNA, 12 bp, Homo sapiens
agaatgtaaagt

SEQ ID NO: 5178528 - DNA, 14 bp, Homo sapiens
agaatgtaaatgtc

SEQ ID NO: 5178529 - DNA, 19 bp, Homo sapiens
agaatgtaactccagatag

SEQ ID NO: 5178530 - DNA, 15 bp, Homo sapiens
agaatgtaagaaaac

SEQ ID NO: 5178531 - DNA, 16 bp, Homo sapiens
agaatgtaagaactac

SEQ ID NO: 5178532 - DNA, 23 bp, Homo sapiens
agaatgtaaggtatatcattcta

SEQ ID NO: 5178533 - DNA, 11 bp, Homo sapiens
agaatgtacag

SEQ ID NO: 5178534 - DNA, 14 bp, Homo sapiens
agaatgtacagaaa

SEQ ID NO: 5178535 - DNA, 22 bp, Homo sapiens
agaatgtacagaaaatagcttt

SEQ ID NO: 5178536 - DNA, 22 bp, Homo sapiens
agaatgtacagttgagctcagg

SEQ ID NO: 5178537 - DNA, 21 bp, Homo sapiens
agaatgtagccctctccaaat

SEQ ID NO: 5178538 - DNA, 19 bp, Homo sapiens
agaatgtagtcagactgac

SEQ ID NO: 5178539 - DNA, 21 bp, Homo sapiens
agaatgtatcagccagccttc

SEQ ID NO: 5178540 - DNA, 21 bp, Homo sapiens
agaatgtatccccaaaagcgt

SEQ ID NO: 5178541 - DNA, 22 bp, Homo sapiens
agaatgtatctgtgaagtagtt

SEQ ID NO: 5178542 - DNA, 13 bp, Homo sapiens
agaatgtattgta

SEQ ID NO: 5178543 - DNA, 15 bp, Homo sapiens
agaatgtattgtacc

SEQ ID NO: 5178544 - DNA, 22 bp, Homo sapiens
agaatgtattgtaccttttaac

SEQ ID NO: 5178545 - DNA, 23 bp, Homo sapiens
agaatgtattgtaccttttaaca

SEQ ID NO: 5178546 - DNA, 14 bp, Homo sapiens
agaatgtcaataaa

SEQ ID NO: 5178547 - DNA, 15 bp, Homo sapiens
agaatgtcaataaat

SEQ ID NO: 5178548 - DNA, 17 bp, Homo sapiens
agaatgtcaatatttga

SEQ ID NO: 5178549 - DNA, 19 bp, Homo sapiens
agaatgtcagattcctttc

SEQ ID NO: 5178550 - DNA, 21 bp, Homo sapiens
agaatgtcagattcctttccc

SEQ ID NO: 5178551 - DNA, 17 bp, Homo sapiens
agaatgtcagatttctg

SEQ ID NO: 5178552 - DNA, 19 bp, Homo sapiens
agaatgtcagatttctggt

SEQ ID NO: 5178553 - DNA, 17 bp, Homo sapiens
agagggccgggcagagg

SEQ ID NO: 5178554 - DNA, 15 bp, Homo sapiens
agagggcctctgcct

SEQ ID NO: 5178555 - DNA, 18 bp, Homo sapiens
agagggcctctgcctggg

SEQ ID NO: 5178556 - DNA, 20 bp, Homo sapiens
agagggcctctgcctgggac

SEQ ID NO: 5178557 - DNA, 13 bp, Homo sapiens
agagggcctgcaa

SEQ ID NO: 5178558 - DNA, 15 bp, Homo sapiens
agagggcctgtggga

SEQ ID NO: 5178559 - DNA, 19 bp, Homo sapiens
agagggcctgtgggagcct

SEQ ID NO: 5178560 - DNA, 17 bp, Homo sapiens
agagggccttgcttctc

SEQ ID NO: 5178561 - DNA, 15 bp, Homo sapiens
agagggcgagggatg

SEQ ID NO: 5178562 - DNA, 14 bp, Homo sapiens
agagggcgcaggcc

SEQ ID NO: 5178563 - DNA, 16 bp, Homo sapiens
agagggcgcaggccgt

SEQ ID NO: 5178564 - DNA, 20 bp, Homo sapiens
agagggcgcccagcccaggc

SEQ ID NO: 5178565 - DNA, 23 bp, Homo sapiens
agagggcgcccagcccaggcctg

SEQ ID NO: 5178566 - DNA, 16 bp, Homo sapiens
agagggctagccctga

SEQ ID NO: 5178567 - DNA, 17 bp, Homo sapiens
agagggctctgtgctga

SEQ ID NO: 5178568 - DNA, 14 bp, Homo sapiens
agagggctgagccc

SEQ ID NO: 5178569 - DNA, 17 bp, Homo sapiens
agagggctgagcccctc

SEQ ID NO: 5178570 - DNA, 20 bp, Homo sapiens
agagggctgagcccctcctc

SEQ ID NO: 5178571 - DNA, 11 bp, Homo sapiens
agagggctgga

SEQ ID NO: 5178572 - DNA, 17 bp, Homo sapiens
agagggctggaggccca

SEQ ID NO: 5178573 - DNA, 18 bp, Homo sapiens
agagggctggaggcccag

SEQ ID NO: 5178574 - DNA, 19 bp, Homo sapiens
agagggctggaggcccagg

SEQ ID NO: 5178575 - DNA, 14 bp, Homo sapiens
agagggctgtggct

SEQ ID NO: 5178576 - DNA, 13 bp, Homo sapiens
agagggcttcctc

SEQ ID NO: 5178577 - DNA, 22 bp, Homo sapiens
agagggctttcagcgcccccag

SEQ ID NO: 5178578 - DNA, 15 bp, Homo sapiens
agagggctttttaaa

SEQ ID NO: 5178579 - DNA, 19 bp, Homo sapiens
agagggctttttaaatttg

SEQ ID NO: 5178580 - DNA, 19 bp, Homo sapiens
agaggggaaaagctgaaca

SEQ ID NO: 5178581 - DNA, 22 bp, Homo sapiens
agaggggaaaccagtgtagcct

SEQ ID NO: 5178582 - DNA, 17 bp, Homo sapiens
agaggggaagggcaggg

SEQ ID NO: 5178583 - DNA, 20 bp, Homo sapiens
agaggggaagtctcttcctg

SEQ ID NO: 5178584 - DNA, 20 bp, Homo sapiens
agaggggaataatagaagaa

SEQ ID NO: 5178585 - DNA, 14 bp, Homo sapiens
agaggggactctgg

SEQ ID NO: 5178586 - DNA, 18 bp, Homo sapiens
agaggggagagctgaaca

SEQ ID NO: 5178587 - DNA, 13 bp, Homo sapiens
agaggggagagga

SEQ ID NO: 5178588 - DNA, 14 bp, Homo sapiens
agaggggagggagg

SEQ ID NO: 5178589 - DNA, 19 bp, Homo sapiens
agaggggagggctcctggg

SEQ ID NO: 5178590 - DNA, 15 bp, Homo sapiens
agaggggaggggcct

SEQ ID NO: 5178591 - DNA, 20 bp, Homo sapiens
agaggggaggggcctaggga

SEQ ID NO: 5178592 - DNA, 18 bp, Homo sapiens
agaggggcagatggaaag

SEQ ID NO: 5178593 - DNA, 12 bp, Homo sapiens
agaggggcagcc

SEQ ID NO: 5178594 - DNA, 20 bp, Homo sapiens
agaggggcagccgctaggag

SEQ ID NO: 5178595 - DNA, 15 bp, Homo sapiens
agaggggcaggccct

SEQ ID NO: 5178596 - DNA, 12 bp, Homo sapiens
agaggggcaggg

SEQ ID NO: 5178597 - DNA, 20 bp, Homo sapiens
agaggggccagcggccctcc

SEQ ID NO: 5178598 - DNA, 18 bp, Homo sapiens
agaggggccagctaaccc

SEQ ID NO: 5178599 - DNA, 14 bp, Homo sapiens
agaggggccaggcc

SEQ ID NO: 5178600 - DNA, 15 bp, Homo sapiens
agaggggccaggccc

SEQ ID NO: 5178601 - DNA, 17 bp, Homo sapiens
agaggggccaggcccag

SEQ ID NO: 5178602 - DNA, 20 bp, Homo sapiens
agaggggccaggcccaggca

SEQ ID NO: 5178603 - DNA, 21 bp, Homo sapiens
agaggggccaggcccaggcag

SEQ ID NO: 5178604 - DNA, 20 bp, Homo sapiens
agaggggccgatgcccagag

SEQ ID NO: 5178605 - DNA, 19 bp, Homo sapiens
agaggggcctctggctgcc

SEQ ID NO: 5178606 - DNA, 13 bp, Homo sapiens
agaggggcctgcc

SEQ ID NO: 5178607 - DNA, 17 bp, Homo sapiens
agaggggcctgccacct

SEQ ID NO: 5178608 - DNA, 21 bp, Homo sapiens
agaggggcctgccacctggac

SEQ ID NO: 5178609 - DNA, 22 bp, Homo sapiens
agaggggcctgccacctggacc

SEQ ID NO: 5178610 - DNA, 23 bp, Homo sapiens
agaggggcctgccacctggaccc

SEQ ID NO: 5178611 - DNA, 22 bp, Homo sapiens
agaggggcctgggaaaggaaaa

SEQ ID NO: 5178612 - DNA, 19 bp, Homo sapiens
agaggggcgccttttcagc

SEQ ID NO: 5178613 - DNA, 17 bp, Homo sapiens
agaggggcgggctcaga

SEQ ID NO: 5178614 - DNA, 20 bp, Homo sapiens
agaggggcgggctcagagct

SEQ ID NO: 5178615 - DNA, 16 bp, Homo sapiens
agaggggcggggccag

SEQ ID NO: 5178616 - DNA, 22 bp, Homo sapiens
agaggggctaggggctggtcct

SEQ ID NO: 5178617 - DNA, 21 bp, Homo sapiens
agaggggctgaatagcagaag

SEQ ID NO: 5178618 - DNA, 12 bp, Homo sapiens
agaggggctggg

SEQ ID NO: 5178619 - DNA, 13 bp, Homo sapiens
agagggggacctg

SEQ ID NO: 5178620 - DNA, 22 bp, Homo sapiens
agagggggactgctgctgcctg

SEQ ID NO: 5178621 - DNA, 16 bp, Homo sapiens
agagggggagtagcca

SEQ ID NO: 5178622 - DNA, 19 bp, Homo sapiens
agagggggagtagccaagc

SEQ ID NO: 5178623 - DNA, 20 bp, Homo sapiens
agagggggatgcccctggcc

SEQ ID NO: 5178624 - DNA, 22 bp, Homo sapiens
agagggggatgcccctggccct

SEQ ID NO: 5178625 - DNA, 22 bp, Homo sapiens
agagggggcactgtggtcaggc

SEQ ID NO: 5178626 - DNA, 14 bp, Homo sapiens
agagggggctctcc

SEQ ID NO: 5178627 - DNA, 16 bp, Homo sapiens
agagggggctggtggg

SEQ ID NO: 5178628 - DNA, 22 bp, Homo sapiens
agaggggggaagatcaggtcat

SEQ ID NO: 5178629 - DNA, 14 bp, Homo sapiens
agaggggggctgcc

SEQ ID NO: 5178630 - DNA, 19 bp, Homo sapiens
agagggggtggcctcccaa

SEQ ID NO: 5178631 - DNA, 23 bp, Homo sapiens
agagggggtggcctcccaactca

SEQ ID NO: 5178632 - DNA, 17 bp, Homo sapiens
agaggggtataggacaa

SEQ ID NO: 5178633 - DNA, 21 bp, Homo sapiens
agaggggtgagacagtggggg

SEQ ID NO: 5178634 - DNA, 23 bp, Homo sapiens
agaggggtgcacccactcaccag

SEQ ID NO: 5178635 - DNA, 18 bp, Homo sapiens
agaggggtgcagaggctg

SEQ ID NO: 5178636 - DNA, 23 bp, Homo sapiens
agaggggtgcagaggctgtggct

SEQ ID NO: 5178637 - DNA, 22 bp, Homo sapiens
agaggggtgctgctcctaaacc

SEQ ID NO: 5178638 - DNA, 15 bp, Homo sapiens
agaggggtggaggct

SEQ ID NO: 5178639 - DNA, 22 bp, Homo sapiens
agaggggttttagatttttaaa

SEQ ID NO: 5178640 - DNA, 15 bp, Homo sapiens
agagggtagggcaca

SEQ ID NO: 5178641 - DNA, 16 bp, Homo sapiens
agagggtatttttgta

SEQ ID NO: 5178642 - DNA, 16 bp, Homo sapiens
agagggtcccagggct

SEQ ID NO: 5178643 - DNA, 15 bp, Homo sapiens
agagggtccctaggt

SEQ ID NO: 5178644 - DNA, 18 bp, Homo sapiens
agagggtctggagaagca

SEQ ID NO: 5178645 - DNA, 16 bp, Homo sapiens
agagggtgagggcctt

SEQ ID NO: 5178646 - DNA, 17 bp, Homo sapiens
agagggtgagggccttc

SEQ ID NO: 5178647 - DNA, 21 bp, Homo sapiens
agagggtgatggaacaagaga

SEQ ID NO: 5178648 - DNA, 14 bp, Homo sapiens
agagggtgctgccc

SEQ ID NO: 5178649 - DNA, 23 bp, Homo sapiens
agagggtggagatgtcagtctgt

SEQ ID NO: 5178650 - DNA, 19 bp, Homo sapiens
agagggtggtgacctctgc

SEQ ID NO: 5178651 - DNA, 18 bp, Homo sapiens
agagggtgtcgtcctgca

SEQ ID NO: 5178652 - DNA, 19 bp, Homo sapiens
agagggtgtcgtcctgcag

SEQ ID NO: 5178653 - DNA, 22 bp, Homo sapiens
agagggtgtggctttccaggca

SEQ ID NO: 5178654 - DNA, 19 bp, Homo sapiens
agagggtgtgggtgccctg

SEQ ID NO: 5178655 - DNA, 19 bp, Homo sapiens
agagggttcacacagccca

SEQ ID NO: 5178656 - DNA, 14 bp, Homo sapiens
agagggttgctggt

SEQ ID NO: 5178657 - DNA, 16 bp, Homo sapiens
agagggttgctggtcc

SEQ ID NO: 5178658 - DNA, 16 bp, Homo sapiens
agaggtaaaagtgtga

SEQ ID NO: 5178659 - DNA, 20 bp, Homo sapiens
agaggtaaaagtgtgagcag

SEQ ID NO: 5178660 - DNA, 17 bp, Homo sapiens
agaggtaaaatttgcac

SEQ ID NO: 5178661 - DNA, 14 bp, Homo sapiens
agaggtaaagggtg

SEQ ID NO: 5178662 - DNA, 21 bp, Homo sapiens
agaggtaaccgttaggcggga

SEQ ID NO: 5178663 - DNA, 16 bp, Homo sapiens
agaggtaatttttcac

SEQ ID NO: 5178664 - DNA, 16 bp, Homo sapiens
agaggtacacttgtga

SEQ ID NO: 5178665 - DNA, 18 bp, Homo sapiens
agaggtacacttgtgaat

SEQ ID NO: 5178666 - DNA, 17 bp, Homo sapiens
agaggtacagggttttt

SEQ ID NO: 5178667 - DNA, 14 bp, Homo sapiens
agaggtagagaaac

SEQ ID NO: 5178668 - DNA, 16 bp, Homo sapiens
agaggtagcactctca

SEQ ID NO: 5178669 - DNA, 15 bp, Homo sapiens
agaggtagcgagctg

SEQ ID NO: 5178670 - DNA, 22 bp, Homo sapiens
agaggtatcctctttttgctcc

SEQ ID NO: 5178671 - DNA, 20 bp, Homo sapiens
agaggtatgtgcccctcctg

SEQ ID NO: 5178672 - DNA, 15 bp, Homo sapiens
agaggtatttaactg

SEQ ID NO: 5178673 - DNA, 14 bp, Homo sapiens
agaggtcagactaa

SEQ ID NO: 5178674 - DNA, 15 bp, Homo sapiens
agaggtcagcacaca

SEQ ID NO: 5178675 - DNA, 20 bp, Homo sapiens
agaggtcaggacggctcctc

SEQ ID NO: 5178676 - DNA, 19 bp, Homo sapiens
agaggtccacaacacacag

SEQ ID NO: 5178677 - DNA, 14 bp, Homo sapiens
agaggtccagccca

SEQ ID NO: 5178678 - DNA, 16 bp, Homo sapiens
agaggtccagcccatc

SEQ ID NO: 5178679 - DNA, 12 bp, Homo sapiens
agaggtccaggc

SEQ ID NO: 5178680 - DNA, 20 bp, Homo sapiens
agaggtccaggtcccagccc

SEQ ID NO: 5178681 - DNA, 22 bp, Homo sapiens
agaggtccaggtcccagcccct

SEQ ID NO: 5178682 - DNA, 14 bp, Homo sapiens
agaggtcccagccc

SEQ ID NO: 5178683 - DNA, 22 bp, Homo sapiens
agaggtcccagccccaggcctg

SEQ ID NO: 5178684 - DNA, 15 bp, Homo sapiens
agaggtccctgctta

SEQ ID NO: 5178685 - DNA, 18 bp, Homo sapiens
agaggtcgcagctaccct

SEQ ID NO: 5178686 - DNA, 23 bp, Homo sapiens
agaggtcgcagctaccctcagcc

SEQ ID NO: 5178687 - DNA, 23 bp, Homo sapiens
agaggtctccaaactgattaaat

SEQ ID NO: 5178688 - DNA, 17 bp, Homo sapiens
agaggtctccccatccc

SEQ ID NO: 5178689 - DNA, 23 bp, Homo sapiens
agaggtctccctataccgagacc

SEQ ID NO: 5178690 - DNA, 14 bp, Homo sapiens
agaggtctgagccc

SEQ ID NO: 5178691 - DNA, 20 bp, Homo sapiens
agaggtctgattggctgctt

SEQ ID NO: 5178692 - DNA, 13 bp, Homo sapiens
agaggtctgtaaa

SEQ ID NO: 5178693 - DNA, 18 bp, Homo sapiens
agaggtgaaaatgaagaa

SEQ ID NO: 5178694 - DNA, 16 bp, Homo sapiens
agaggtgaaagcataa

SEQ ID NO: 5178695 - DNA, 21 bp, Homo sapiens
agaggtgaaattccagatgag

SEQ ID NO: 5178696 - DNA, 22 bp, Homo sapiens
agaggtgacccaatgctcctgg

SEQ ID NO: 5178697 - DNA, 16 bp, Homo sapiens
agaggtgaccccaggg

SEQ ID NO: 5178698 - DNA, 16 bp, Homo sapiens
agaggtgagaaattta

SEQ ID NO: 5178699 - DNA, 23 bp, Homo sapiens
agaggtgagaccaaaggatccag

SEQ ID NO: 5178700 - DNA, 19 bp, Homo sapiens
agaggtgaggtgacttgcc

SEQ ID NO: 5178701 - DNA, 18 bp, Homo sapiens
agaggtgattctcagggc

SEQ ID NO: 5178702 - DNA, 22 bp, Homo sapiens
agaggtgcctgggaggagtggc

SEQ ID NO: 5178703 - DNA, 22 bp, Homo sapiens
agaggtgctaaattgtctgcca

SEQ ID NO: 5178704 - DNA, 18 bp, Homo sapiens
agaggtgctgctttgctt

SEQ ID NO: 5178705 - DNA, 16 bp, Homo sapiens
agaggtgcttcaccct

SEQ ID NO: 5178706 - DNA, 17 bp, Homo sapiens
agaggtggaaaatgatc

SEQ ID NO: 5178707 - DNA, 15 bp, Homo sapiens
agaggtggatactgg

SEQ ID NO: 5178708 - DNA, 18 bp, Homo sapiens
agaggtggccagagctgg

SEQ ID NO: 5178709 - DNA, 19 bp, Homo sapiens
agaggtggccctcccaggc

SEQ ID NO: 5178710 - DNA, 20 bp, Homo sapiens
agaggtggccctcccaggct

SEQ ID NO: 5178711 - DNA, 22 bp, Homo sapiens
agaggtggccctcccaggctgg

SEQ ID NO: 5178712 - DNA, 13 bp, Homo sapiens
agaggtggccctt

SEQ ID NO: 5178713 - DNA, 17 bp, Homo sapiens
agaggtgggagactcgc

SEQ ID NO: 5178714 - DNA, 17 bp, Homo sapiens
agaggtgggagggccct

SEQ ID NO: 5178715 - DNA, 13 bp, Homo sapiens
agaggtgggcagc

SEQ ID NO: 5178716 - DNA, 19 bp, Homo sapiens
agaggtgggcagcagctca

SEQ ID NO: 5178717 - DNA, 17 bp, Homo sapiens
agaggtgggcagctggg

SEQ ID NO: 5178718 - DNA, 18 bp, Homo sapiens
agaggtgggcagctgggc

SEQ ID NO: 5178719 - DNA, 13 bp, Homo sapiens
agaggtgggccag

SEQ ID NO: 5178720 - DNA, 20 bp, Homo sapiens
agaggtggggaagagagcct

SEQ ID NO: 5178721 - DNA, 22 bp, Homo sapiens
agaggtggggaagagagcctgc

SEQ ID NO: 5178722 - DNA, 21 bp, Homo sapiens
agaggtggggagggagacaga

SEQ ID NO: 5178723 - DNA, 23 bp, Homo sapiens
agaggtggggagggagacagaga

SEQ ID NO: 5178724 - DNA, 18 bp, Homo sapiens
agaggtgggggatgctga

SEQ ID NO: 5178725 - DNA, 17 bp, Homo sapiens
agaggtggggtgaagct

SEQ ID NO: 5178726 - DNA, 18 bp, Homo sapiens
agaggtggggtgaagctg

SEQ ID NO: 5178727 - DNA, 18 bp, Homo sapiens
agaggtggggtgctgggg

SEQ ID NO: 5178728 - DNA, 17 bp, Homo sapiens
agaggtggtgggggcag

SEQ ID NO: 5178729 - DNA, 16 bp, Homo sapiens
agaggtgtcatgcttt

SEQ ID NO: 5178730 - DNA, 20 bp, Homo sapiens
agaatgtcaggaatttaaga

SEQ ID NO: 5178731 - DNA, 16 bp, Homo sapiens
agaatgtcagtatgtg

SEQ ID NO: 5178732 - DNA, 17 bp, Homo sapiens
agaatgtcagtatgtgg

SEQ ID NO: 5178733 - DNA, 19 bp, Homo sapiens
agaatgtcagtatgtggaa

SEQ ID NO: 5178734 - DNA, 15 bp, Homo sapiens
agaatgtcatttgct

SEQ ID NO: 5178735 - DNA, 21 bp, Homo sapiens
agaatgtcatttgctaatgaa

SEQ ID NO: 5178736 - DNA, 23 bp, Homo sapiens
agaatgtcatttgctaatgaatt

SEQ ID NO: 5178737 - DNA, 16 bp, Homo sapiens
agaatgtcattttggt

SEQ ID NO: 5178738 - DNA, 23 bp, Homo sapiens
agaatgtcattttggtactttgg

SEQ ID NO: 5178739 - DNA, 22 bp, Homo sapiens
agaatgtctgaagtacaaacat

SEQ ID NO: 5178740 - DNA, 14 bp, Homo sapiens
agaatgtcttggtg

SEQ ID NO: 5178741 - DNA, 18 bp, Homo sapiens
agaatgtgccatgtataa

SEQ ID NO: 5178742 - DNA, 15 bp, Homo sapiens
agaatgtgctgcctt

SEQ ID NO: 5178743 - DNA, 20 bp, Homo sapiens
agaatgtggaaatagatgtg

SEQ ID NO: 5178744 - DNA, 18 bp, Homo sapiens
agaatgtggccacttatt

SEQ ID NO: 5178745 - DNA, 16 bp, Homo sapiens
agaatgtgtctcagga

SEQ ID NO: 5178746 - DNA, 19 bp, Homo sapiens
agaatgtgtctcaggaaaa

SEQ ID NO: 5178747 - DNA, 17 bp, Homo sapiens
agaatgtgtcttgcgag

SEQ ID NO: 5178748 - DNA, 17 bp, Homo sapiens
agaatgtgttcttttct

SEQ ID NO: 5178749 - DNA, 22 bp, Homo sapiens
agaatgtgttcttttctccttt

SEQ ID NO: 5178750 - DNA, 21 bp, Homo sapiens
agaatgtgtttaaacttggtt

SEQ ID NO: 5178751 - DNA, 16 bp, Homo sapiens
agaatgtgtttcaaac

SEQ ID NO: 5178752 - DNA, 18 bp, Homo sapiens
agaatgtgtttcaaactg

SEQ ID NO: 5178753 - DNA, 17 bp, Homo sapiens
agaatgtgttttctgaa

SEQ ID NO: 5178754 - DNA, 18 bp, Homo sapiens
agaatgtgttttctgaat

SEQ ID NO: 5178755 - DNA, 14 bp, Homo sapiens
agaatgttaccaga

SEQ ID NO: 5178756 - DNA, 16 bp, Homo sapiens
agaatgttaccagact

SEQ ID NO: 5178757 - DNA, 17 bp, Homo sapiens
agaatgttaccagactt

SEQ ID NO: 5178758 - DNA, 22 bp, Homo sapiens
agaatgttaccagacttcaaga

SEQ ID NO: 5178759 - DNA, 16 bp, Homo sapiens
agaatgttagagtaat

SEQ ID NO: 5178760 - DNA, 17 bp, Homo sapiens
agaatgttattgtgtat

SEQ ID NO: 5178761 - DNA, 19 bp, Homo sapiens
agaatgttccagacattct

SEQ ID NO: 5178762 - DNA, 20 bp, Homo sapiens
agaatgttggtttactttca

SEQ ID NO: 5178763 - DNA, 23 bp, Homo sapiens
agaatgttggtttactttcaaat

SEQ ID NO: 5178764 - DNA, 16 bp, Homo sapiens
agaatgttgtacttga

SEQ ID NO: 5178765 - DNA, 18 bp, Homo sapiens
agaatgttgtattcagtg

SEQ ID NO: 5178766 - DNA, 12 bp, Homo sapiens
agaatgtttcct

SEQ ID NO: 5178767 - DNA, 15 bp, Homo sapiens
agaatgtttcctgtg

SEQ ID NO: 5178768 - DNA, 18 bp, Homo sapiens
agaatgtttcctgtggaa

SEQ ID NO: 5178769 - DNA, 18 bp, Homo sapiens
agaatgtttctatttcca

SEQ ID NO: 5178770 - DNA, 23 bp, Homo sapiens
agaatgtttggcactctctaacg

SEQ ID NO: 5178771 - DNA, 16 bp, Homo sapiens
agaatgttttgcactg

SEQ ID NO: 5178772 - DNA, 18 bp, Homo sapiens
agaatgttttggcaagag

SEQ ID NO: 5178773 - DNA, 14 bp, Homo sapiens
agaattaaaaactt

SEQ ID NO: 5178774 - DNA, 15 bp, Homo sapiens
agaattaaaaacttt

SEQ ID NO: 5178775 - DNA, 17 bp, Homo sapiens
agaattaaaaatgaaat

SEQ ID NO: 5178776 - DNA, 24 bp, Homo sapiens
agaattaaaactttgtagacattt

SEQ ID NO: 5178777 - DNA, 15 bp, Homo sapiens
agaattaaaataaca

SEQ ID NO: 5178778 - DNA, 15 bp, Homo sapiens
agaattaaactttta

SEQ ID NO: 5178779 - DNA, 18 bp, Homo sapiens
agaattaaacttttaatt

SEQ ID NO: 5178780 - DNA, 22 bp, Homo sapiens
agaattaactataacaatcact

SEQ ID NO: 5178781 - DNA, 22 bp, Homo sapiens
agaattaagggggttctgtttt

SEQ ID NO: 5178782 - DNA, 19 bp, Homo sapiens
agaattaatcttaattttg

SEQ ID NO: 5178783 - DNA, 17 bp, Homo sapiens
agaattacagaaaattt

SEQ ID NO: 5178784 - DNA, 18 bp, Homo sapiens
agaattacagaaaatttg

SEQ ID NO: 5178785 - DNA, 19 bp, Homo sapiens
agaattacagaaaatttgc

SEQ ID NO: 5178786 - DNA, 15 bp, Homo sapiens
agaattacagactct

SEQ ID NO: 5178787 - DNA, 16 bp, Homo sapiens
agaattaccattaatt

SEQ ID NO: 5178788 - DNA, 15 bp, Homo sapiens
agaattacccttcct

SEQ ID NO: 5178789 - DNA, 16 bp, Homo sapiens
agaattacccttcctc

SEQ ID NO: 5178790 - DNA, 12 bp, Homo sapiens
agaattactgtt

SEQ ID NO: 5178791 - DNA, 17 bp, Homo sapiens
agaattactttgtgttg

SEQ ID NO: 5178792 - DNA, 13 bp, Homo sapiens
agaattagacatc

SEQ ID NO: 5178793 - DNA, 20 bp, Homo sapiens
agaattagatttctatagga

SEQ ID NO: 5178794 - DNA, 13 bp, Homo sapiens
agaattaggaagg

SEQ ID NO: 5178795 - DNA, 19 bp, Homo sapiens
agaattaggtaatggatat

SEQ ID NO: 5178796 - DNA, 17 bp, Homo sapiens
agaattaggtttctttg

SEQ ID NO: 5178797 - DNA, 22 bp, Homo sapiens
agaattaggtttctttgaagaa

SEQ ID NO: 5178798 - DNA, 22 bp, Homo sapiens
agaattagtatgtctgtttttg

SEQ ID NO: 5178799 - DNA, 18 bp, Homo sapiens
agaattataacagcaagg

SEQ ID NO: 5178800 - DNA, 13 bp, Homo sapiens
agaattatatagg

SEQ ID NO: 5178801 - DNA, 22 bp, Homo sapiens
agaattatataggttgtgcaaa

SEQ ID NO: 5178802 - DNA, 15 bp, Homo sapiens
agaattatatctaat

SEQ ID NO: 5178803 - DNA, 16 bp, Homo sapiens
agaattatatctaatt

SEQ ID NO: 5178804 - DNA, 18 bp, Homo sapiens
agaattatatctaattta

SEQ ID NO: 5178805 - DNA, 22 bp, Homo sapiens
agaattatatctaatttataca

SEQ ID NO: 5178806 - DNA, 23 bp, Homo sapiens
agaattatatctaatttatacaa

SEQ ID NO: 5178807 - DNA, 22 bp, Homo sapiens
agaattatccattacgtgcatt

SEQ ID NO: 5178808 - DNA, 15 bp, Homo sapiens
agaattatctaattt

SEQ ID NO: 5178809 - DNA, 17 bp, Homo sapiens
agaattatctaatttat

SEQ ID NO: 5178810 - DNA, 20 bp, Homo sapiens
agaattatctaatttataaa

SEQ ID NO: 5178811 - DNA, 15 bp, Homo sapiens
agaattatctcaagt

SEQ ID NO: 5178812 - DNA, 16 bp, Homo sapiens
agaattatctcaagta

SEQ ID NO: 5178813 - DNA, 17 bp, Homo sapiens
agaattatctcaagtaa

SEQ ID NO: 5178814 - DNA, 15 bp, Homo sapiens
agaattatgtaatat

SEQ ID NO: 5178815 - DNA, 23 bp, Homo sapiens
agaattattcagtgaatttgtcc

SEQ ID NO: 5178816 - DNA, 19 bp, Homo sapiens
agaattatttttaaaaaga

SEQ ID NO: 5178817 - DNA, 22 bp, Homo sapiens
agaattatttttgagcaggagc

SEQ ID NO: 5178818 - DNA, 17 bp, Homo sapiens
agaattatttttgtgtt

SEQ ID NO: 5178819 - DNA, 21 bp, Homo sapiens
agaattcaaaagtgattatct

SEQ ID NO: 5178820 - DNA, 20 bp, Homo sapiens
agaattcacacaactacttt

SEQ ID NO: 5178821 - DNA, 18 bp, Homo sapiens
agaattcagaagacccct

SEQ ID NO: 5178822 - DNA, 17 bp, Homo sapiens
agaattcagctgccccc

SEQ ID NO: 5178823 - DNA, 18 bp, Homo sapiens
agaattcattcatactta

SEQ ID NO: 5178824 - DNA, 13 bp, Homo sapiens
agaattccaagga

SEQ ID NO: 5178825 - DNA, 24 bp, Homo sapiens
agaattcccaagagggctttatta

SEQ ID NO: 5178826 - DNA, 22 bp, Homo sapiens
agaattccctctctctgactct

SEQ ID NO: 5178827 - DNA, 15 bp, Homo sapiens
agaattcccttgaat

SEQ ID NO: 5178828 - DNA, 19 bp, Homo sapiens
agaattcctgaagccagat

SEQ ID NO: 5178829 - DNA, 12 bp, Homo sapiens
agaattccttcg

SEQ ID NO: 5178830 - DNA, 20 bp, Homo sapiens
agaattccttcgaaaggcct

SEQ ID NO: 5178831 - DNA, 21 bp, Homo sapiens
agaattccttttataagattt

SEQ ID NO: 5178832 - DNA, 23 bp, Homo sapiens
agaattccttttataagatttaa

SEQ ID NO: 5178833 - DNA, 21 bp, Homo sapiens
agaattctaagattgtacata

SEQ ID NO: 5178834 - DNA, 16 bp, Homo sapiens
agaattctaattgtca

SEQ ID NO: 5178835 - DNA, 14 bp, Homo sapiens
agaattctagcttt

SEQ ID NO: 5178836 - DNA, 23 bp, Homo sapiens
agaattctagtgctgctgaagat

SEQ ID NO: 5178837 - DNA, 16 bp, Homo sapiens
agaattctattttgct

SEQ ID NO: 5178838 - DNA, 22 bp, Homo sapiens
agaattctattttgctggagac

SEQ ID NO: 5178839 - DNA, 20 bp, Homo sapiens
agaattctcagaatctcaaa

SEQ ID NO: 5178840 - DNA, 18 bp, Homo sapiens
agaattctctagtttgat

SEQ ID NO: 5178841 - DNA, 17 bp, Homo sapiens
agaattctcttatccaa

SEQ ID NO: 5178842 - DNA, 22 bp, Homo sapiens
agaattctcttgttctttggca

SEQ ID NO: 5178843 - DNA, 15 bp, Homo sapiens
agaattctgattgat

SEQ ID NO: 5178844 - DNA, 18 bp, Homo sapiens
agaattctgtattggata

SEQ ID NO: 5178845 - DNA, 14 bp, Homo sapiens
agaattctgttcta

SEQ ID NO: 5178846 - DNA, 21 bp, Homo sapiens
agaattcttagcatacattca

SEQ ID NO: 5178847 - DNA, 17 bp, Homo sapiens
agaattgaaaagttttt

SEQ ID NO: 5178848 - DNA, 14 bp, Homo sapiens
agaattgaaaatgc

SEQ ID NO: 5178849 - DNA, 16 bp, Homo sapiens
agaattgaaaatgcat

SEQ ID NO: 5178850 - DNA, 14 bp, Homo sapiens
agaattgaaacact

SEQ ID NO: 5178851 - DNA, 16 bp, Homo sapiens
agaattgaacccagga

SEQ ID NO: 5178852 - DNA, 19 bp, Homo sapiens
agaattgaaggagaaaatg

SEQ ID NO: 5178853 - DNA, 16 bp, Homo sapiens
agaattgaaggttttt

SEQ ID NO: 5178854 - DNA, 18 bp, Homo sapiens
agaattgaaggtttttga

SEQ ID NO: 5178855 - DNA, 20 bp, Homo sapiens
agaattgaaggtttttgata

SEQ ID NO: 5178856 - DNA, 19 bp, Homo sapiens
agaattgaattctggaaac

SEQ ID NO: 5178857 - DNA, 15 bp, Homo sapiens
agaattgaattggaa

SEQ ID NO: 5178858 - DNA, 21 bp, Homo sapiens
agaattgaattggaaagactt

SEQ ID NO: 5178859 - DNA, 18 bp, Homo sapiens
agaattgacattgaaatc

SEQ ID NO: 5178860 - DNA, 21 bp, Homo sapiens
agaattgaccatctgctttta

SEQ ID NO: 5178861 - DNA, 15 bp, Homo sapiens
agaattgactgaagc

SEQ ID NO: 5178862 - DNA, 20 bp, Homo sapiens
agaattgactgaagcacagc

SEQ ID NO: 5178863 - DNA, 15 bp, Homo sapiens
agaattgactgattt

SEQ ID NO: 5178864 - DNA, 17 bp, Homo sapiens
agaattgactgcagttg

SEQ ID NO: 5178865 - DNA, 19 bp, Homo sapiens
agaattgactgcagttgaa

SEQ ID NO: 5178866 - DNA, 14 bp, Homo sapiens
agaattgagcagtt

SEQ ID NO: 5178867 - DNA, 23 bp, Homo sapiens
agaattgagcagttctgttgcat

SEQ ID NO: 5178868 - DNA, 14 bp, Homo sapiens
agaattgagtgttt

SEQ ID NO: 5178869 - DNA, 21 bp, Homo sapiens
agaattgatcattttcccccc

SEQ ID NO: 5178870 - DNA, 22 bp, Homo sapiens
agaattgatcattttcccccca

SEQ ID NO: 5178871 - DNA, 23 bp, Homo sapiens
agaattgattgggcacatcattt

SEQ ID NO: 5178872 - DNA, 15 bp, Homo sapiens
agaattgcaatctat

SEQ ID NO: 5178873 - DNA, 20 bp, Homo sapiens
agaattgcaattttaacaca

SEQ ID NO: 5178874 - DNA, 16 bp, Homo sapiens
agaattgcacatctaa

SEQ ID NO: 5178875 - DNA, 13 bp, Homo sapiens
agaattggccaga

SEQ ID NO: 5178876 - DNA, 13 bp, Homo sapiens
agaattggctcaa

SEQ ID NO: 5178877 - DNA, 20 bp, Homo sapiens
agaattgtagataatactgt

SEQ ID NO: 5178878 - DNA, 14 bp, Homo sapiens
agaattgtctctgg

SEQ ID NO: 5178879 - DNA, 13 bp, Homo sapiens
agaattgtcttgc

SEQ ID NO: 5178880 - DNA, 18 bp, Homo sapiens
agaattgtgcaaatggaa

SEQ ID NO: 5178881 - DNA, 21 bp, Homo sapiens
agaattgtgcgacttcacaaa

SEQ ID NO: 5178882 - DNA, 13 bp, Homo sapiens
agaattgtggttc

SEQ ID NO: 5178883 - DNA, 22 bp, Homo sapiens
agaattgtggtttatatattta

SEQ ID NO: 5178884 - DNA, 15 bp, Homo sapiens
agaattgtgtctgca

SEQ ID NO: 5178885 - DNA, 17 bp, Homo sapiens
agaattgtgtctgcagg

SEQ ID NO: 5178886 - DNA, 17 bp, Homo sapiens
agaattgttagatggca

SEQ ID NO: 5178887 - DNA, 11 bp, Homo sapiens
agaattgttat

SEQ ID NO: 5178888 - DNA, 18 bp, Homo sapiens
agaattgtttttgaattt

SEQ ID NO: 5178889 - DNA, 21 bp, Homo sapiens
agaatttaaagaaaaaaatgt

SEQ ID NO: 5178890 - DNA, 20 bp, Homo sapiens
agaatttaaattctttttca

SEQ ID NO: 5178891 - DNA, 15 bp, Homo sapiens
agaatttaatggact

SEQ ID NO: 5178892 - DNA, 18 bp, Homo sapiens
agaatttaatttttaaaa

SEQ ID NO: 5178893 - DNA, 18 bp, Homo sapiens
agaatttaccagaaatat

SEQ ID NO: 5178894 - DNA, 19 bp, Homo sapiens
agaatttaccatcatctct

SEQ ID NO: 5178895 - DNA, 20 bp, Homo sapiens
agaatttagaggataaataa

SEQ ID NO: 5178896 - DNA, 21 bp, Homo sapiens
agaatttagaggataaataat

SEQ ID NO: 5178897 - DNA, 13 bp, Homo sapiens
agaatttagatct

SEQ ID NO: 5178898 - DNA, 22 bp, Homo sapiens
agaatttagtttgtactcagtg

SEQ ID NO: 5178899 - DNA, 20 bp, Homo sapiens
agaatttatcctttatttta

SEQ ID NO: 5178900 - DNA, 16 bp, Homo sapiens
agaatttatctccctt

SEQ ID NO: 5178901 - DNA, 13 bp, Homo sapiens
agaatttattcaa

SEQ ID NO: 5178902 - DNA, 14 bp, Homo sapiens
agaatttattcaat

SEQ ID NO: 5178903 - DNA, 21 bp, Homo sapiens
agaatttattcaattcctctg

SEQ ID NO: 5178904 - DNA, 17 bp, Homo sapiens
agaatttcaaggcaggg

SEQ ID NO: 5178905 - DNA, 16 bp, Homo sapiens
agaatttccactgtaa

SEQ ID NO: 5178906 - DNA, 18 bp, Homo sapiens
agaatttccactgtaatt

SEQ ID NO: 5178907 - DNA, 17 bp, Homo sapiens
agaggtgtcatgctttg

SEQ ID NO: 5178908 - DNA, 20 bp, Homo sapiens
agaggtgtgagtaattgagg

SEQ ID NO: 5178909 - DNA, 13 bp, Homo sapiens
agaggtgtgtgcc

SEQ ID NO: 5178910 - DNA, 22 bp, Homo sapiens
agaggtgtttttataatatcca

SEQ ID NO: 5178911 - DNA, 15 bp, Homo sapiens
agaggttaaagcaaa

SEQ ID NO: 5178912 - DNA, 16 bp, Homo sapiens
agaggttaaggtgcaa

SEQ ID NO: 5178913 - DNA, 15 bp, Homo sapiens
agaggttaaggtggg

SEQ ID NO: 5178914 - DNA, 20 bp, Homo sapiens
agaggttaaggtgggtccag

SEQ ID NO: 5178915 - DNA, 18 bp, Homo sapiens
agaggttatctgcctggc

SEQ ID NO: 5178916 - DNA, 19 bp, Homo sapiens
agaggttatctgcctggcc

SEQ ID NO: 5178917 - DNA, 21 bp, Homo sapiens
agaggttatctgcctggcctg

SEQ ID NO: 5178918 - DNA, 20 bp, Homo sapiens
agaggttatctgtcccaggt

SEQ ID NO: 5178919 - DNA, 20 bp, Homo sapiens
agaggttcaaagatattttg

SEQ ID NO: 5178920 - DNA, 15 bp, Homo sapiens
agaggttctgcctct

SEQ ID NO: 5178921 - DNA, 17 bp, Homo sapiens
agaggttctggggagga

SEQ ID NO: 5178922 - DNA, 21 bp, Homo sapiens
agaggttctggggaggaaggg

SEQ ID NO: 5178923 - DNA, 21 bp, Homo sapiens
agaggttgctaatgcctttca

SEQ ID NO: 5178924 - DNA, 20 bp, Homo sapiens
agaggttgtagtgagcccag

SEQ ID NO: 5178925 - DNA, 14 bp, Homo sapiens
agaggttgtctgtg

SEQ ID NO: 5178926 - DNA, 21 bp, Homo sapiens
agaggtttatttgggtacatg

SEQ ID NO: 5178927 - DNA, 15 bp, Homo sapiens
agaggtttcagcatt

SEQ ID NO: 5178928 - DNA, 13 bp, Homo sapiens
agaggtttcagtg

SEQ ID NO: 5178929 - DNA, 21 bp, Homo sapiens
agaggtttgaaggagaatggc

SEQ ID NO: 5178930 - DNA, 22 bp, Homo sapiens
agaggtttgactagatgatgga

SEQ ID NO: 5178931 - DNA, 13 bp, Homo sapiens
agaggtttgctga

SEQ ID NO: 5178932 - DNA, 18 bp, Homo sapiens
agaggtttggctcctgcc

SEQ ID NO: 5178933 - DNA, 20 bp, Homo sapiens
agaggtttggctcctgccca

SEQ ID NO: 5178934 - DNA, 12 bp, Homo sapiens
agaggtttgtca

SEQ ID NO: 5178935 - DNA, 14 bp, Homo sapiens
agaggtttgtcaac

SEQ ID NO: 5178936 - DNA, 18 bp, Homo sapiens
agaggtttgtcaacacaa

SEQ ID NO: 5178937 - DNA, 21 bp, Homo sapiens
agaggtttgtcaacacaaaga

SEQ ID NO: 5178938 - DNA, 12 bp, Homo sapiens
agaggttttaaa

SEQ ID NO: 5178939 - DNA, 23 bp, Homo sapiens
agaggttttaggaaacctggcat

SEQ ID NO: 5178940 - DNA, 18 bp, Homo sapiens
agaggttttcacaaatgt

SEQ ID NO: 5178941 - DNA, 14 bp, Homo sapiens
agaggttttgtatt

SEQ ID NO: 5178942 - DNA, 22 bp, Homo sapiens
agaggtttttcttaaataataa

SEQ ID NO: 5178943 - DNA, 16 bp, Homo sapiens
agaggtttttcttggg

SEQ ID NO: 5178944 - DNA, 17 bp, Homo sapiens
agaggtttttcttggga

SEQ ID NO: 5178945 - DNA, 22 bp, Homo sapiens
agagtaaaagtcccagttaagt

SEQ ID NO: 5178946 - DNA, 18 bp, Homo sapiens
agagtaaataaactgttt

SEQ ID NO: 5178947 - DNA, 20 bp, Homo sapiens
agagtaaataaactgtttat

SEQ ID NO: 5178948 - DNA, 13 bp, Homo sapiens
agagtaagacatt

SEQ ID NO: 5178949 - DNA, 14 bp, Homo sapiens
agagtaagacattg

SEQ ID NO: 5178950 - DNA, 15 bp, Homo sapiens
agagtaagcagtgtt

SEQ ID NO: 5178951 - DNA, 15 bp, Homo sapiens
agagtaagctgcttt

SEQ ID NO: 5178952 - DNA, 14 bp, Homo sapiens
agagtaatgggttt

SEQ ID NO: 5178953 - DNA, 14 bp, Homo sapiens
agagtacactgtgt

SEQ ID NO: 5178954 - DNA, 20 bp, Homo sapiens
agagtacactgtgtctctat

SEQ ID NO: 5178955 - DNA, 17 bp, Homo sapiens
agagtacagatcctctg

SEQ ID NO: 5178956 - DNA, 19 bp, Homo sapiens
agagtacagtgagccaaga

SEQ ID NO: 5178957 - DNA, 23 bp, Homo sapiens
agagtacagtgtaacagtactct

SEQ ID NO: 5178958 - DNA, 17 bp, Homo sapiens
agagtacgtcctgcctg

SEQ ID NO: 5178959 - DNA, 20 bp, Homo sapiens
agagtacgtcctgcctggca

SEQ ID NO: 5178960 - DNA, 14 bp, Homo sapiens
agagtacttaatat

SEQ ID NO: 5178961 - DNA, 17 bp, Homo sapiens
agagtacttaatatact

SEQ ID NO: 5178962 - DNA, 19 bp, Homo sapiens
agagtactttggtttctga

SEQ ID NO: 5178963 - DNA, 13 bp, Homo sapiens
agagtagaaagct

SEQ ID NO: 5178964 - DNA, 14 bp, Homo sapiens
agagtagaaataaa

SEQ ID NO: 5178965 - DNA, 21 bp, Homo sapiens
agagtagaataacctttcaga

SEQ ID NO: 5178966 - DNA, 17 bp, Homo sapiens
agagtagaattgcattg

SEQ ID NO: 5178967 - DNA, 18 bp, Homo sapiens
agagtagaattgcattga

SEQ ID NO: 5178968 - DNA, 15 bp, Homo sapiens
agagtagacatcccc

SEQ ID NO: 5178969 - DNA, 22 bp, Homo sapiens
agagtagccatgaggaggcaga

SEQ ID NO: 5178970 - DNA, 19 bp, Homo sapiens
agagtagccgagagcctgc

SEQ ID NO: 5178971 - DNA, 16 bp, Homo sapiens
agagtagctgcagcct

SEQ ID NO: 5178972 - DNA, 21 bp, Homo sapiens
agagtaggctattcctgagag

SEQ ID NO: 5178973 - DNA, 18 bp, Homo sapiens
agagtagggtagaaggaa

SEQ ID NO: 5178974 - DNA, 17 bp, Homo sapiens
agagtaggtactccata

SEQ ID NO: 5178975 - DNA, 20 bp, Homo sapiens
agagtaggtgggtaggagcc

SEQ ID NO: 5178976 - DNA, 12 bp, Homo sapiens
agagtataaata

SEQ ID NO: 5178977 - DNA, 19 bp, Homo sapiens
agagtataattttggttgt

SEQ ID NO: 5178978 - DNA, 14 bp, Homo sapiens
agagtataggatgg

SEQ ID NO: 5178979 - DNA, 16 bp, Homo sapiens
agagtatattgaaaag

SEQ ID NO: 5178980 - DNA, 18 bp, Homo sapiens
agagtatcaaaggcagaa

SEQ ID NO: 5178981 - DNA, 21 bp, Homo sapiens
agagtatcaaaggcagaaagg

SEQ ID NO: 5178982 - DNA, 17 bp, Homo sapiens
agagtatcagttgcagg

SEQ ID NO: 5178983 - DNA, 19 bp, Homo sapiens
agagtatcagttgcaggtg

SEQ ID NO: 5178984 - DNA, 21 bp, Homo sapiens
agagtatcagttgcaggtgcc

SEQ ID NO: 5178985 - DNA, 18 bp, Homo sapiens
agagtatctgaagggaat

SEQ ID NO: 5178986 - DNA, 22 bp, Homo sapiens
agagtatctgaagggaattgtt

SEQ ID NO: 5178987 - DNA, 21 bp, Homo sapiens
agagtatctttaaaagtgcct

SEQ ID NO: 5178988 - DNA, 13 bp, Homo sapiens
agagtatctttac

SEQ ID NO: 5178989 - DNA, 18 bp, Homo sapiens
agagtatgagaaatacag

SEQ ID NO: 5178990 - DNA, 22 bp, Homo sapiens
agagtatgagtcttctgtaatt

SEQ ID NO: 5178991 - DNA, 14 bp, Homo sapiens
agagtatggagctc

SEQ ID NO: 5178992 - DNA, 21 bp, Homo sapiens
agagtatggagctcagagagg

SEQ ID NO: 5178993 - DNA, 22 bp, Homo sapiens
agagtatggttgattcccagca

SEQ ID NO: 5178994 - DNA, 14 bp, Homo sapiens
agagtatgtacgta

SEQ ID NO: 5178995 - DNA, 18 bp, Homo sapiens
agagtatgtagtggcttc

SEQ ID NO: 5178996 - DNA, 19 bp, Homo sapiens
agagtatgtggcaaaacat

SEQ ID NO: 5178997 - DNA, 11 bp, Homo sapiens
agagtatgtgt

SEQ ID NO: 5178998 - DNA, 16 bp, Homo sapiens
agagtatgtgtatgta

SEQ ID NO: 5178999 - DNA, 17 bp, Homo sapiens
agagtatgtgtatgtac

SEQ ID NO: 5179000 - DNA, 18 bp, Homo sapiens
agagtatgttcttgaaga

SEQ ID NO: 5179001 - DNA, 14 bp, Homo sapiens
agagtattcagtga

SEQ ID NO: 5179002 - DNA, 12 bp, Homo sapiens
agagtatttccc

SEQ ID NO: 5179003 - DNA, 20 bp, Homo sapiens
agagtatttcccttccaaag

SEQ ID NO: 5179004 - DNA, 13 bp, Homo sapiens
agagtatttctgg

SEQ ID NO: 5179005 - DNA, 13 bp, Homo sapiens
agagtatttttaa

SEQ ID NO: 5179006 - DNA, 17 bp, Homo sapiens
agagtatttttgacaga

SEQ ID NO: 5179007 - DNA, 17 bp, Homo sapiens
agagtcaatttgctgaa

SEQ ID NO: 5179008 - DNA, 20 bp, Homo sapiens
agagtcacaagtagcctctg

SEQ ID NO: 5179009 - DNA, 20 bp, Homo sapiens
agagtcacagctttcccagg

SEQ ID NO: 5179010 - DNA, 16 bp, Homo sapiens
agagtcacccccccag

SEQ ID NO: 5179011 - DNA, 19 bp, Homo sapiens
agagtcacccccccaggcc

SEQ ID NO: 5179012 - DNA, 21 bp, Homo sapiens
agagtcacccccccaggcctc

SEQ ID NO: 5179013 - DNA, 23 bp, Homo sapiens
agagtcacccccccaggcctcca

SEQ ID NO: 5179014 - DNA, 17 bp, Homo sapiens
agagtcacttgtagtcc

SEQ ID NO: 5179015 - DNA, 21 bp, Homo sapiens
agagtcagaactaactttggt

SEQ ID NO: 5179016 - DNA, 16 bp, Homo sapiens
agagtcagaggagaag

SEQ ID NO: 5179017 - DNA, 18 bp, Homo sapiens
agagtcagctctctgccc

SEQ ID NO: 5179018 - DNA, 18 bp, Homo sapiens
agagtcaggaagagattt

SEQ ID NO: 5179019 - DNA, 14 bp, Homo sapiens
agagtcaggagaaa

SEQ ID NO: 5179020 - DNA, 12 bp, Homo sapiens
agagtcaggagt

SEQ ID NO: 5179021 - DNA, 16 bp, Homo sapiens
agagtcatatacatta

SEQ ID NO: 5179022 - DNA, 13 bp, Homo sapiens
agagtcatatttt

SEQ ID NO: 5179023 - DNA, 15 bp, Homo sapiens
agagtcatattttga

SEQ ID NO: 5179024 - DNA, 14 bp, Homo sapiens
agagtcatctccat

SEQ ID NO: 5179025 - DNA, 18 bp, Homo sapiens
agagtcatctccatcagc

SEQ ID NO: 5179026 - DNA, 16 bp, Homo sapiens
agagtcatgtgagcct

SEQ ID NO: 5179027 - DNA, 13 bp, Homo sapiens
agagtcattcata

SEQ ID NO: 5179028 - DNA, 22 bp, Homo sapiens
agagtcattgtaatgttgtgaa

SEQ ID NO: 5179029 - DNA, 23 bp, Homo sapiens
agagtcattgtaatgttgtgaat

SEQ ID NO: 5179030 - DNA, 17 bp, Homo sapiens
agagtcatttatgagca

SEQ ID NO: 5179031 - DNA, 13 bp, Homo sapiens
agagtccaggaag

SEQ ID NO: 5179032 - DNA, 14 bp, Homo sapiens
agagtccaggcccc

SEQ ID NO: 5179033 - DNA, 16 bp, Homo sapiens
agagtccaggcctggg

SEQ ID NO: 5179034 - DNA, 19 bp, Homo sapiens
agagtccaggcctgggtca

SEQ ID NO: 5179035 - DNA, 20 bp, Homo sapiens
agagtccatgtggactgtgc

SEQ ID NO: 5179036 - DNA, 19 bp, Homo sapiens
agagtcccactgcctcagg

SEQ ID NO: 5179037 - DNA, 20 bp, Homo sapiens
agagtcccactgcctcaggt

SEQ ID NO: 5179038 - DNA, 12 bp, Homo sapiens
agagtcccaggc

SEQ ID NO: 5179039 - DNA, 22 bp, Homo sapiens
agagtcccccctcccacctcca

SEQ ID NO: 5179040 - DNA, 14 bp, Homo sapiens
agagtccctgcctg

SEQ ID NO: 5179041 - DNA, 16 bp, Homo sapiens
agagtccgtggttgcc

SEQ ID NO: 5179042 - DNA, 13 bp, Homo sapiens
agagtcctcactc

SEQ ID NO: 5179043 - DNA, 18 bp, Homo sapiens
agagtcctccttcccagc

SEQ ID NO: 5179044 - DNA, 19 bp, Homo sapiens
agagtcctccttcccagct

SEQ ID NO: 5179045 - DNA, 20 bp, Homo sapiens
agagtcctgaggcagaacct

SEQ ID NO: 5179046 - DNA, 23 bp, Homo sapiens
agagtccttagcctgggcctcct

SEQ ID NO: 5179047 - DNA, 12 bp, Homo sapiens
agagtcctttgg

SEQ ID NO: 5179048 - DNA, 16 bp, Homo sapiens
agagtcgatgctcaat

SEQ ID NO: 5179049 - DNA, 14 bp, Homo sapiens
agagtcgctgtgcc

SEQ ID NO: 5179050 - DNA, 12 bp, Homo sapiens
agagtctaaaga

SEQ ID NO: 5179051 - DNA, 13 bp, Homo sapiens
agagtctaaagat

SEQ ID NO: 5179052 - DNA, 17 bp, Homo sapiens
agagtctaaagatggag

SEQ ID NO: 5179053 - DNA, 15 bp, Homo sapiens
agagtctagattctc

SEQ ID NO: 5179054 - DNA, 17 bp, Homo sapiens
agagtctagcactcatt

SEQ ID NO: 5179055 - DNA, 15 bp, Homo sapiens
agagtctagggcaca

SEQ ID NO: 5179056 - DNA, 18 bp, Homo sapiens
agagtctcactcccctcc

SEQ ID NO: 5179057 - DNA, 21 bp, Homo sapiens
agagtctcagaaactcccctg

SEQ ID NO: 5179058 - DNA, 17 bp, Homo sapiens
agagtctccaagagaac

SEQ ID NO: 5179059 - DNA, 17 bp, Homo sapiens
agagtctccagttactg

SEQ ID NO: 5179060 - DNA, 17 bp, Homo sapiens
agagtctcccagggagc

SEQ ID NO: 5179061 - DNA, 16 bp, Homo sapiens
agagtctccttctctt

SEQ ID NO: 5179062 - DNA, 19 bp, Homo sapiens
agagtctccttctcttctc

SEQ ID NO: 5179063 - DNA, 18 bp, Homo sapiens
agagtctcgctcttgtca

SEQ ID NO: 5179064 - DNA, 21 bp, Homo sapiens
agagtctctacccctttctgt

SEQ ID NO: 5179065 - DNA, 16 bp, Homo sapiens
agagtctctccagcct

SEQ ID NO: 5179066 - DNA, 14 bp, Homo sapiens
agagtctctggctc

SEQ ID NO: 5179067 - DNA, 17 bp, Homo sapiens
agagtctctggctcagc

SEQ ID NO: 5179068 - DNA, 17 bp, Homo sapiens
agagtctgaaagacaga

SEQ ID NO: 5179069 - DNA, 12 bp, Homo sapiens
agagtctgaaca

SEQ ID NO: 5179070 - DNA, 16 bp, Homo sapiens
agagtctgaacagctg

SEQ ID NO: 5179071 - DNA, 17 bp, Homo sapiens
agagtctgaacagctgt

SEQ ID NO: 5179072 - DNA, 14 bp, Homo sapiens
agagtctgacagga

SEQ ID NO: 5179073 - DNA, 15 bp, Homo sapiens
agagtctgacaggaa

SEQ ID NO: 5179074 - DNA, 23 bp, Homo sapiens
agagtctgagggcttgtagttct

SEQ ID NO: 5179075 - DNA, 16 bp, Homo sapiens
agagtctggcctgcca

SEQ ID NO: 5179076 - DNA, 13 bp, Homo sapiens
agagtctgggacc

SEQ ID NO: 5179077 - DNA, 18 bp, Homo sapiens
agagtctgggcctctgac

SEQ ID NO: 5179078 - DNA, 23 bp, Homo sapiens
agagtctggtgaagctcacttct

SEQ ID NO: 5179079 - DNA, 12 bp, Homo sapiens
agagtctgtctc

SEQ ID NO: 5179080 - DNA, 13 bp, Homo sapiens
agagtctgtctct

SEQ ID NO: 5179081 - DNA, 14 bp, Homo sapiens
agagtctgtctctt

SEQ ID NO: 5179082 - DNA, 13 bp, Homo sapiens
agagtcttaattt

SEQ ID NO: 5179083 - DNA, 23 bp, Homo sapiens
agagtcttacaatcaaatctcct

SEQ ID NO: 5179084 - DNA, 19 bp, Homo sapiens
agagtcttccaaggccaga

SEQ ID NO: 5179085 - DNA, 21 bp, Homo sapiens
agagtcttccacttcaatgca

SEQ ID NO: 5179086 - DNA, 17 bp, Homo sapiens
agaatttcccaaagcag

SEQ ID NO: 5179087 - DNA, 18 bp, Homo sapiens
agaatttcccaaagcagt

SEQ ID NO: 5179088 - DNA, 12 bp, Homo sapiens
agaatttcctgt

SEQ ID NO: 5179089 - DNA, 20 bp, Homo sapiens
agaatttcctgtaatatatt

SEQ ID NO: 5179090 - DNA, 15 bp, Homo sapiens
agaatttcgaagatg

SEQ ID NO: 5179091 - DNA, 19 bp, Homo sapiens
agaatttctaaagtaaaat

SEQ ID NO: 5179092 - DNA, 13 bp, Homo sapiens
agaatttctaaga

SEQ ID NO: 5179093 - DNA, 21 bp, Homo sapiens
agaatttctaccatttcagag

SEQ ID NO: 5179094 - DNA, 16 bp, Homo sapiens
agaatttctgctaaat

SEQ ID NO: 5179095 - DNA, 16 bp, Homo sapiens
agaatttctggaagaa

SEQ ID NO: 5179096 - DNA, 19 bp, Homo sapiens
agaatttctggaagaaagg

SEQ ID NO: 5179097 - DNA, 12 bp, Homo sapiens
agaatttctgta

SEQ ID NO: 5179098 - DNA, 21 bp, Homo sapiens
agaatttcttggtaagaagcc

SEQ ID NO: 5179099 - DNA, 20 bp, Homo sapiens
agaatttgagaaccttggac

SEQ ID NO: 5179100 - DNA, 20 bp, Homo sapiens
agaatttgatatgtgaacag

SEQ ID NO: 5179101 - DNA, 22 bp, Homo sapiens
agaatttgatatgtgaacagtt

SEQ ID NO: 5179102 - DNA, 12 bp, Homo sapiens
agaatttgcata

SEQ ID NO: 5179103 - DNA, 17 bp, Homo sapiens
agaatttgcatacttac

SEQ ID NO: 5179104 - DNA, 17 bp, Homo sapiens
agaatttgctttatctg

SEQ ID NO: 5179105 - DNA, 16 bp, Homo sapiens
agaatttggaaatcct

SEQ ID NO: 5179106 - DNA, 16 bp, Homo sapiens
agaatttggcccagag

SEQ ID NO: 5179107 - DNA, 16 bp, Homo sapiens
agaatttggggcagga

SEQ ID NO: 5179108 - DNA, 23 bp, Homo sapiens
agaatttgtgttgaaggaacttg

SEQ ID NO: 5179109 - DNA, 13 bp, Homo sapiens
agaatttgttctt

SEQ ID NO: 5179110 - DNA, 16 bp, Homo sapiens
agaatttgtttaaatt

SEQ ID NO: 5179111 - DNA, 15 bp, Homo sapiens
agaatttgtttcatc

SEQ ID NO: 5179112 - DNA, 20 bp, Homo sapiens
agaatttgtttcatctattt

SEQ ID NO: 5179113 - DNA, 12 bp, Homo sapiens
agaattttaaaa

SEQ ID NO: 5179114 - DNA, 21 bp, Homo sapiens
agaattttaaaaatgaatcct

SEQ ID NO: 5179115 - DNA, 17 bp, Homo sapiens
agaattttaaatatttt

SEQ ID NO: 5179116 - DNA, 18 bp, Homo sapiens
agaattttaaattataac

SEQ ID NO: 5179117 - DNA, 16 bp, Homo sapiens
agaattttaagccttt

SEQ ID NO: 5179118 - DNA, 22 bp, Homo sapiens
agaattttaagcctttgttgaa

SEQ ID NO: 5179119 - DNA, 13 bp, Homo sapiens
agaattttaatgt

SEQ ID NO: 5179120 - DNA, 16 bp, Homo sapiens
agaattttaatgtgaa

SEQ ID NO: 5179121 - DNA, 17 bp, Homo sapiens
agaattttaatgtgaag

SEQ ID NO: 5179122 - DNA, 17 bp, Homo sapiens
agaattttaccaaaatt

SEQ ID NO: 5179123 - DNA, 16 bp, Homo sapiens
agaattttacttccat

SEQ ID NO: 5179124 - DNA, 17 bp, Homo sapiens
agaattttacttccatt

SEQ ID NO: 5179125 - DNA, 18 bp, Homo sapiens
agaattttacttccatta

SEQ ID NO: 5179126 - DNA, 13 bp, Homo sapiens
agaattttagtcc

SEQ ID NO: 5179127 - DNA, 20 bp, Homo sapiens
agaattttatactttcccta

SEQ ID NO: 5179128 - DNA, 20 bp, Homo sapiens
agaattttatatcattggat

SEQ ID NO: 5179129 - DNA, 22 bp, Homo sapiens
agaattttcctgagacaaattt

SEQ ID NO: 5179130 - DNA, 22 bp, Homo sapiens
agaattttctggcctttcatgg

SEQ ID NO: 5179131 - DNA, 23 bp, Homo sapiens
agaattttggaaaaatgtcactg

SEQ ID NO: 5179132 - DNA, 14 bp, Homo sapiens
agaattttgtgaaa

SEQ ID NO: 5179133 - DNA, 20 bp, Homo sapiens
agaattttgttggtctgaat

SEQ ID NO: 5179134 - DNA, 13 bp, Homo sapiens
agaatttttaaca

SEQ ID NO: 5179135 - DNA, 15 bp, Homo sapiens
agaatttttaactgt

SEQ ID NO: 5179136 - DNA, 17 bp, Homo sapiens
agaatttttaatgactt

SEQ ID NO: 5179137 - DNA, 14 bp, Homo sapiens
agaatttttaatgt

SEQ ID NO: 5179138 - DNA, 21 bp, Homo sapiens
agaatttttgcccatatctgg

SEQ ID NO: 5179139 - DNA, 22 bp, Homo sapiens
agaatttttgtttggactgttt

SEQ ID NO: 5179140 - DNA, 14 bp, Homo sapiens
agaattttttattt

SEQ ID NO: 5179141 - DNA, 14 bp, Homo sapiens
agaatttttttaat

SEQ ID NO: 5179142 - DNA, 20 bp, Homo sapiens
agaatttttttgtctttcaa

SEQ ID NO: 5179143 - DNA, 23 bp, Homo sapiens
agaattttttttttaagatatgt

SEQ ID NO: 5179144 - DNA, 20 bp, Homo sapiens
agacaaaaaaatttaaaatt

SEQ ID NO: 5179145 - DNA, 22 bp, Homo sapiens
agacaaaaacagcctcacagaa

SEQ ID NO: 5179146 - DNA, 15 bp, Homo sapiens
agacaaaaagaacaa

SEQ ID NO: 5179147 - DNA, 18 bp, Homo sapiens
agacaaaaagacaaacat

SEQ ID NO: 5179148 - DNA, 16 bp, Homo sapiens
agacaaaaaggaaaca

SEQ ID NO: 5179149 - DNA, 12 bp, Homo sapiens
agacaaaaataa

SEQ ID NO: 5179150 - DNA, 17 bp, Homo sapiens
agacaaaaatactctaa

SEQ ID NO: 5179151 - DNA, 22 bp, Homo sapiens
agacaaaaatactctaattcta

SEQ ID NO: 5179152 - DNA, 14 bp, Homo sapiens
agacaaaaattatc

SEQ ID NO: 5179153 - DNA, 21 bp, Homo sapiens
agacaaaacttataatttcca

SEQ ID NO: 5179154 - DNA, 22 bp, Homo sapiens
agacaaaagtctgtctttcctg

SEQ ID NO: 5179155 - DNA, 13 bp, Homo sapiens
agacaaaagtttc

SEQ ID NO: 5179156 - DNA, 22 bp, Homo sapiens
agacaaaatattttcctgccac

SEQ ID NO: 5179157 - DNA, 20 bp, Homo sapiens
agacaaaattgtaagccaga

SEQ ID NO: 5179158 - DNA, 23 bp, Homo sapiens
agacaaaattgtaagccagagtc

SEQ ID NO: 5179159 - DNA, 13 bp, Homo sapiens
agacaaaatttta

SEQ ID NO: 5179160 - DNA, 18 bp, Homo sapiens
agacaaacaagggagaag

SEQ ID NO: 5179161 - DNA, 19 bp, Homo sapiens
agacaaacacctcccagga

SEQ ID NO: 5179162 - DNA, 15 bp, Homo sapiens
agacaaacactgcca

SEQ ID NO: 5179163 - DNA, 18 bp, Homo sapiens
agacaaacagcccttcct

SEQ ID NO: 5179164 - DNA, 19 bp, Homo sapiens
agacaaaccactgtacata

SEQ ID NO: 5179165 - DNA, 17 bp, Homo sapiens
agacaaaccagaagcaa

SEQ ID NO: 5179166 - DNA, 14 bp, Homo sapiens
agacaaactaaact

SEQ ID NO: 5179167 - DNA, 16 bp, Homo sapiens
agacaaactaaacttt

SEQ ID NO: 5179168 - DNA, 21 bp, Homo sapiens
agacaaactgtaaaaaatgtg

SEQ ID NO: 5179169 - DNA, 14 bp, Homo sapiens
agacaaagaaggaa

SEQ ID NO: 5179170 - DNA, 15 bp, Homo sapiens
agacaaagaaggaaa

SEQ ID NO: 5179171 - DNA, 14 bp, Homo sapiens
agacaaagatttct

SEQ ID NO: 5179172 - DNA, 16 bp, Homo sapiens
agacaaagatttcttc

SEQ ID NO: 5179173 - DNA, 18 bp, Homo sapiens
agacaaagccctgtcctt

SEQ ID NO: 5179174 - DNA, 13 bp, Homo sapiens
agacaaaggccca

SEQ ID NO: 5179175 - DNA, 17 bp, Homo sapiens
agacaaaggcccagaaa

SEQ ID NO: 5179176 - DNA, 21 bp, Homo sapiens
agacaaaggcccagaaatcat

SEQ ID NO: 5179177 - DNA, 12 bp, Homo sapiens
agacaaaggcct

SEQ ID NO: 5179178 - DNA, 21 bp, Homo sapiens
agacaaagtttggaagtacat

SEQ ID NO: 5179179 - DNA, 13 bp, Homo sapiens
agacaaatacaca

SEQ ID NO: 5179180 - DNA, 15 bp, Homo sapiens
agacaaatacacata

SEQ ID NO: 5179181 - DNA, 13 bp, Homo sapiens
agacaaatactca

SEQ ID NO: 5179182 - DNA, 12 bp, Homo sapiens
agacaaatagta

SEQ ID NO: 5179183 - DNA, 13 bp, Homo sapiens
agacaaatatgta

SEQ ID NO: 5179184 - DNA, 12 bp, Homo sapiens
agacaaatattc

SEQ ID NO: 5179185 - DNA, 15 bp, Homo sapiens
agacaaatatttgga

SEQ ID NO: 5179186 - DNA, 18 bp, Homo sapiens
agacaaatcaacagaagc

SEQ ID NO: 5179187 - DNA, 22 bp, Homo sapiens
agacaaatcctaggctcctggg

SEQ ID NO: 5179188 - DNA, 20 bp, Homo sapiens
agacaaatcctttctgcccc

SEQ ID NO: 5179189 - DNA, 18 bp, Homo sapiens
agacaaatctttaagaat

SEQ ID NO: 5179190 - DNA, 16 bp, Homo sapiens
agacaaatgaaataat

SEQ ID NO: 5179191 - DNA, 20 bp, Homo sapiens
agacaaatgcagtgtattta

SEQ ID NO: 5179192 - DNA, 15 bp, Homo sapiens
agacaaatgggactg

SEQ ID NO: 5179193 - DNA, 22 bp, Homo sapiens
agacaaattcaccttcacttag

SEQ ID NO: 5179194 - DNA, 18 bp, Homo sapiens
agacaaattcatattctt

SEQ ID NO: 5179195 - DNA, 18 bp, Homo sapiens
agacaaattctgtttctt

SEQ ID NO: 5179196 - DNA, 20 bp, Homo sapiens
agacaacagaaagagggaca

SEQ ID NO: 5179197 - DNA, 19 bp, Homo sapiens
agacaacagcacacaggca

SEQ ID NO: 5179198 - DNA, 17 bp, Homo sapiens
agacaacagcccaggca

SEQ ID NO: 5179199 - DNA, 19 bp, Homo sapiens
agacaacaggtaaaacagg

SEQ ID NO: 5179200 - DNA, 14 bp, Homo sapiens
agacaacattatga

SEQ ID NO: 5179201 - DNA, 12 bp, Homo sapiens
agacaaccaaaa

SEQ ID NO: 5179202 - DNA, 14 bp, Homo sapiens
agacaaccaaaaca

SEQ ID NO: 5179203 - DNA, 22 bp, Homo sapiens
agacaaccctgaggtatctgtg

SEQ ID NO: 5179204 - DNA, 22 bp, Homo sapiens
agacaacctaccttctttccag

SEQ ID NO: 5179205 - DNA, 18 bp, Homo sapiens
agacaacgatgaatttct

SEQ ID NO: 5179206 - DNA, 21 bp, Homo sapiens
agacaacgggcccatggcctt

SEQ ID NO: 5179207 - DNA, 19 bp, Homo sapiens
agacaacgtgctctttgtt

SEQ ID NO: 5179208 - DNA, 20 bp, Homo sapiens
agacaacgtgctctttgttt

SEQ ID NO: 5179209 - DNA, 21 bp, Homo sapiens
agacaactatcaattcttgag

SEQ ID NO: 5179210 - DNA, 14 bp, Homo sapiens
agacaactggacaa

SEQ ID NO: 5179211 - DNA, 15 bp, Homo sapiens
agacaacttgctcct

SEQ ID NO: 5179212 - DNA, 18 bp, Homo sapiens
agacaacttgctcctttc

SEQ ID NO: 5179213 - DNA, 20 bp, Homo sapiens
agacaacttgctcctttcca

SEQ ID NO: 5179214 - DNA, 20 bp, Homo sapiens
agacaagaaaggcagacaca

SEQ ID NO: 5179215 - DNA, 18 bp, Homo sapiens
agacaagaaatccctgtt

SEQ ID NO: 5179216 - DNA, 17 bp, Homo sapiens
agacaagaacagccgcc

SEQ ID NO: 5179217 - DNA, 15 bp, Homo sapiens
agacaagaacattct

SEQ ID NO: 5179218 - DNA, 15 bp, Homo sapiens
agacaagaagcaaat

SEQ ID NO: 5179219 - DNA, 22 bp, Homo sapiens
agacaagagatctacacatgtt

SEQ ID NO: 5179220 - DNA, 17 bp, Homo sapiens
agacaagagctgctgtc

SEQ ID NO: 5179221 - DNA, 14 bp, Homo sapiens
agacaagagctgtt

SEQ ID NO: 5179222 - DNA, 21 bp, Homo sapiens
agacaagagctgttatgctgt

SEQ ID NO: 5179223 - DNA, 22 bp, Homo sapiens
agacaagagctgttatgctgtt

SEQ ID NO: 5179224 - DNA, 18 bp, Homo sapiens
agacaagagggcaagcct

SEQ ID NO: 5179225 - DNA, 22 bp, Homo sapiens
agacaagatattgtacataaaa

SEQ ID NO: 5179226 - DNA, 12 bp, Homo sapiens
agacaagatggc

SEQ ID NO: 5179227 - DNA, 20 bp, Homo sapiens
agacaagatggctggaagga

SEQ ID NO: 5179228 - DNA, 23 bp, Homo sapiens
agacaagattttttaattgttta

SEQ ID NO: 5179229 - DNA, 15 bp, Homo sapiens
agacaagcaacccaa

SEQ ID NO: 5179230 - DNA, 17 bp, Homo sapiens
agacaagcaacccaaac

SEQ ID NO: 5179231 - DNA, 18 bp, Homo sapiens
agacaagcactattttat

SEQ ID NO: 5179232 - DNA, 18 bp, Homo sapiens
agacaagcagcccttgct

SEQ ID NO: 5179233 - DNA, 19 bp, Homo sapiens
agacaagcagcccttgctt

SEQ ID NO: 5179234 - DNA, 15 bp, Homo sapiens
agacaagcatggaaa

SEQ ID NO: 5179235 - DNA, 15 bp, Homo sapiens
agacaagccagaact

SEQ ID NO: 5179236 - DNA, 17 bp, Homo sapiens
agacaagccagaacttg

SEQ ID NO: 5179237 - DNA, 14 bp, Homo sapiens
agacaagccctggc

SEQ ID NO: 5179238 - DNA, 18 bp, Homo sapiens
agacaagccctggcaaca

SEQ ID NO: 5179239 - DNA, 15 bp, Homo sapiens
agacaagcctggagg

SEQ ID NO: 5179240 - DNA, 15 bp, Homo sapiens
agacaagctcctccc

SEQ ID NO: 5179241 - DNA, 16 bp, Homo sapiens
agacaagctcctccct

SEQ ID NO: 5179242 - DNA, 16 bp, Homo sapiens
agacaaggcaggcctg

SEQ ID NO: 5179243 - DNA, 13 bp, Homo sapiens
agacaaggtgcta

SEQ ID NO: 5179244 - DNA, 15 bp, Homo sapiens
agacaagtaatttca

SEQ ID NO: 5179245 - DNA, 21 bp, Homo sapiens
agacaagtctagtggaaccaa

SEQ ID NO: 5179246 - DNA, 15 bp, Homo sapiens
agacaagtctgtggc

SEQ ID NO: 5179247 - DNA, 23 bp, Homo sapiens
agacaagtgactgtatctgtgta

SEQ ID NO: 5179248 - DNA, 23 bp, Homo sapiens
agacaagtgatgctaaaacctga

SEQ ID NO: 5179249 - DNA, 22 bp, Homo sapiens
agacaagttccatgggatacaa

SEQ ID NO: 5179250 - DNA, 18 bp, Homo sapiens
agacaagttggaaaaaca

SEQ ID NO: 5179251 - DNA, 19 bp, Homo sapiens
agacaagttggaaaaacaa

SEQ ID NO: 5179252 - DNA, 15 bp, Homo sapiens
agacaagttttgttt

SEQ ID NO: 5179253 - DNA, 17 bp, Homo sapiens
agacaataaaccctcag

SEQ ID NO: 5179254 - DNA, 14 bp, Homo sapiens
agacaatagtattt

SEQ ID NO: 5179255 - DNA, 16 bp, Homo sapiens
agacaatagtatttct

SEQ ID NO: 5179256 - DNA, 15 bp, Homo sapiens
agacaatatacaagc

SEQ ID NO: 5179257 - DNA, 13 bp, Homo sapiens
agacaatatatca

SEQ ID NO: 5179258 - DNA, 20 bp, Homo sapiens
agacaatatatcataactta

SEQ ID NO: 5179259 - DNA, 23 bp, Homo sapiens
agacaatcacgggcggtcctgca

SEQ ID NO: 5179260 - DNA, 18 bp, Homo sapiens
agacaatcactgaaacaa

SEQ ID NO: 5179261 - DNA, 19 bp, Homo sapiens
agacaatcactgaaacaaa

SEQ ID NO: 5179262 - DNA, 20 bp, Homo sapiens
agacaatcactgccaacccc

SEQ ID NO: 5179263 - DNA, 16 bp, Homo sapiens
agacaatcattgtttt

SEQ ID NO: 5179264 - DNA, 14 bp, Homo sapiens
agacaatccactct

SEQ ID NO: 5179265 - DNA, 18 bp, Homo sapiens
agagtcttgggcctggcc

SEQ ID NO: 5179266 - DNA, 19 bp, Homo sapiens
agagtcttgggcctggccc

SEQ ID NO: 5179267 - DNA, 15 bp, Homo sapiens
agagtcttttaactt

SEQ ID NO: 5179268 - DNA, 17 bp, Homo sapiens
agagtcttttaacttta

SEQ ID NO: 5179269 - DNA, 20 bp, Homo sapiens
agagtcttttaactttagaa

SEQ ID NO: 5179270 - DNA, 17 bp, Homo sapiens
agagtgaaagggctatg

SEQ ID NO: 5179271 - DNA, 22 bp, Homo sapiens
agagtgaacaaatttacagaga

SEQ ID NO: 5179272 - DNA, 12 bp, Homo sapiens
agagtgaagagt

SEQ ID NO: 5179273 - DNA, 15 bp, Homo sapiens
agagtgaagagtgaa

SEQ ID NO: 5179274 - DNA, 17 bp, Homo sapiens
agagtgaatacactgga

SEQ ID NO: 5179275 - DNA, 15 bp, Homo sapiens
agagtgaattatatt

SEQ ID NO: 5179276 - DNA, 17 bp, Homo sapiens
agagtgaattccctcac

SEQ ID NO: 5179277 - DNA, 15 bp, Homo sapiens
agagtgaatttcagt

SEQ ID NO: 5179278 - DNA, 23 bp, Homo sapiens
agagtgaatttcagtataaagat

SEQ ID NO: 5179279 - DNA, 22 bp, Homo sapiens
agagtgacacccaagagggctg

SEQ ID NO: 5179280 - DNA, 13 bp, Homo sapiens
agagtgacaggca

SEQ ID NO: 5179281 - DNA, 18 bp, Homo sapiens
agagtgaccagcacactg

SEQ ID NO: 5179282 - DNA, 22 bp, Homo sapiens
agagtgacctcggacagagccc

SEQ ID NO: 5179283 - DNA, 21 bp, Homo sapiens
agagtgacctggcatcttgga

SEQ ID NO: 5179284 - DNA, 19 bp, Homo sapiens
agagtgactagtacaaatt

SEQ ID NO: 5179285 - DNA, 18 bp, Homo sapiens
agagtgactccaagaaca

SEQ ID NO: 5179286 - DNA, 16 bp, Homo sapiens
agagtgactctccagg

SEQ ID NO: 5179287 - DNA, 19 bp, Homo sapiens
agagtgagactcgtctcaa

SEQ ID NO: 5179288 - DNA, 12 bp, Homo sapiens
agagtgagagag

SEQ ID NO: 5179289 - DNA, 14 bp, Homo sapiens
agagtgagagggca

SEQ ID NO: 5179290 - DNA, 21 bp, Homo sapiens
agagtgagagggcatgcgcac

SEQ ID NO: 5179291 - DNA, 16 bp, Homo sapiens
agagtgagctacagag

SEQ ID NO: 5179292 - DNA, 18 bp, Homo sapiens
agagtgagctctggtgga

SEQ ID NO: 5179293 - DNA, 17 bp, Homo sapiens
agagtgataatacaagt

SEQ ID NO: 5179294 - DNA, 19 bp, Homo sapiens
agagtgattctagttggga

SEQ ID NO: 5179295 - DNA, 13 bp, Homo sapiens
agagtgcaacagt

SEQ ID NO: 5179296 - DNA, 16 bp, Homo sapiens
agagtgcaatggtgca

SEQ ID NO: 5179297 - DNA, 15 bp, Homo sapiens
agagtgcacagctgt

SEQ ID NO: 5179298 - DNA, 22 bp, Homo sapiens
agagtgcagggattacaggcgt

SEQ ID NO: 5179299 - DNA, 13 bp, Homo sapiens
agagtgcaggtgc

SEQ ID NO: 5179300 - DNA, 20 bp, Homo sapiens
agagtgccaacttctttcat

SEQ ID NO: 5179301 - DNA, 18 bp, Homo sapiens
agagtgccatccctgaga

SEQ ID NO: 5179302 - DNA, 12 bp, Homo sapiens
agagtgcccagc

SEQ ID NO: 5179303 - DNA, 13 bp, Homo sapiens
agagtgcccagca

SEQ ID NO: 5179304 - DNA, 14 bp, Homo sapiens
agagtgcccagcag

SEQ ID NO: 5179305 - DNA, 13 bp, Homo sapiens
agagtgccccacc

SEQ ID NO: 5179306 - DNA, 16 bp, Homo sapiens
agagtgccccacctgc

SEQ ID NO: 5179307 - DNA, 18 bp, Homo sapiens
agagtgccctgctttgca

SEQ ID NO: 5179308 - DNA, 20 bp, Homo sapiens
agagtgccctgctttgcaaa

SEQ ID NO: 5179309 - DNA, 21 bp, Homo sapiens
agagtgcccttaaaataatga

SEQ ID NO: 5179310 - DNA, 22 bp, Homo sapiens
agagtgccttatttcctttcca

SEQ ID NO: 5179311 - DNA, 17 bp, Homo sapiens
agagtgctctgaccctg

SEQ ID NO: 5179312 - DNA, 13 bp, Homo sapiens
agagtgctgtcgg

SEQ ID NO: 5179313 - DNA, 23 bp, Homo sapiens
agagtgctgtcgggaccacatct

SEQ ID NO: 5179314 - DNA, 17 bp, Homo sapiens
agagtgctgtgagatga

SEQ ID NO: 5179315 - DNA, 15 bp, Homo sapiens
agagtggaaggactg

SEQ ID NO: 5179316 - DNA, 21 bp, Homo sapiens
agagtggaaggactgtggctg

SEQ ID NO: 5179317 - DNA, 20 bp, Homo sapiens
agagtggactgaatgtgcct

SEQ ID NO: 5179318 - DNA, 16 bp, Homo sapiens
agagtggagcccaggg

SEQ ID NO: 5179319 - DNA, 17 bp, Homo sapiens
agagtggagcccagggt

SEQ ID NO: 5179320 - DNA, 15 bp, Homo sapiens
agagtggaggcgggc

SEQ ID NO: 5179321 - DNA, 14 bp, Homo sapiens
agagtggagttgaa

SEQ ID NO: 5179322 - DNA, 24 bp, Homo sapiens
agagtggcagccaagagccatctg

SEQ ID NO: 5179323 - DNA, 24 bp, Homo sapiens
agagtggcccctcacctgggcctt

SEQ ID NO: 5179324 - DNA, 16 bp, Homo sapiens
agagtggcctagagca

SEQ ID NO: 5179325 - DNA, 18 bp, Homo sapiens
agagtggcctagagcact

SEQ ID NO: 5179326 - DNA, 19 bp, Homo sapiens
agagtggcctagagcactc

SEQ ID NO: 5179327 - DNA, 12 bp, Homo sapiens
agagtggcctcc

SEQ ID NO: 5179328 - DNA, 14 bp, Homo sapiens
agagtggcctccct

SEQ ID NO: 5179329 - DNA, 11 bp, Homo sapiens
agagtggcctg

SEQ ID NO: 5179330 - DNA, 12 bp, Homo sapiens
agagtggcctgg

SEQ ID NO: 5179331 - DNA, 14 bp, Homo sapiens
agagtggcctggcc

SEQ ID NO: 5179332 - DNA, 15 bp, Homo sapiens
agagtggcctggcca

SEQ ID NO: 5179333 - DNA, 16 bp, Homo sapiens
agagtggcctggccag

SEQ ID NO: 5179334 - DNA, 17 bp, Homo sapiens
agagtggcctggccagg

SEQ ID NO: 5179335 - DNA, 24 bp, Homo sapiens
agagtggcctgggtcccagggctg

SEQ ID NO: 5179336 - DNA, 15 bp, Homo sapiens
agagtggcctgtgag

SEQ ID NO: 5179337 - DNA, 16 bp, Homo sapiens
agagtggcctgtgagc

SEQ ID NO: 5179338 - DNA, 15 bp, Homo sapiens
agagtggcgtgagct

SEQ ID NO: 5179339 - DNA, 15 bp, Homo sapiens
agagtggctcactgg

SEQ ID NO: 5179340 - DNA, 21 bp, Homo sapiens
agagtggctcactggctggga

SEQ ID NO: 5179341 - DNA, 13 bp, Homo sapiens
agagtggctcctc

SEQ ID NO: 5179342 - DNA, 23 bp, Homo sapiens
agagtggctcctcccggtgccca

SEQ ID NO: 5179343 - DNA, 13 bp, Homo sapiens
agagtggctgggg

SEQ ID NO: 5179344 - DNA, 20 bp, Homo sapiens
agagtgggacagttcctgag

SEQ ID NO: 5179345 - DNA, 19 bp, Homo sapiens
agagtgggagaggctggga

SEQ ID NO: 5179346 - DNA, 22 bp, Homo sapiens
agagtgggagaggctgggaggt

SEQ ID NO: 5179347 - DNA, 14 bp, Homo sapiens
agagtgggccccgg

SEQ ID NO: 5179348 - DNA, 18 bp, Homo sapiens
agagtgggccccgggctg

SEQ ID NO: 5179349 - DNA, 22 bp, Homo sapiens
agagtgggccccgggctggaga

SEQ ID NO: 5179350 - DNA, 23 bp, Homo sapiens
agagtgggccccgggctggagaa

SEQ ID NO: 5179351 - DNA, 18 bp, Homo sapiens
agagtgggctgcatctgg

SEQ ID NO: 5179352 - DNA, 16 bp, Homo sapiens
agagtgggctgcctgg

SEQ ID NO: 5179353 - DNA, 23 bp, Homo sapiens
agagtgggctttgtggaaacagc

SEQ ID NO: 5179354 - DNA, 20 bp, Homo sapiens
agagtggggctagactgggc

SEQ ID NO: 5179355 - DNA, 21 bp, Homo sapiens
agagtggggctagactgggct

SEQ ID NO: 5179356 - DNA, 22 bp, Homo sapiens
agagtggggctagactgggctg

SEQ ID NO: 5179357 - DNA, 14 bp, Homo sapiens
agagtgggggtggg

SEQ ID NO: 5179358 - DNA, 17 bp, Homo sapiens
agagtggggttttcttg

SEQ ID NO: 5179359 - DNA, 16 bp, Homo sapiens
agagtgggtttcacaa

SEQ ID NO: 5179360 - DNA, 15 bp, Homo sapiens
agagtggtaaaaaag

SEQ ID NO: 5179361 - DNA, 21 bp, Homo sapiens
agagtggtaaaaaagaaatga

SEQ ID NO: 5179362 - DNA, 22 bp, Homo sapiens
agagtggtaaaaaagaaatgaa

SEQ ID NO: 5179363 - DNA, 23 bp, Homo sapiens
agagtggtaaaaaagaaatgaaa

SEQ ID NO: 5179364 - DNA, 15 bp, Homo sapiens
agagtggtatttgca

SEQ ID NO: 5179365 - DNA, 18 bp, Homo sapiens
agagtggtgagtggaagg

SEQ ID NO: 5179366 - DNA, 15 bp, Homo sapiens
agagtggtggcctat

SEQ ID NO: 5179367 - DNA, 18 bp, Homo sapiens
agagtggttattcattat

SEQ ID NO: 5179368 - DNA, 19 bp, Homo sapiens
agagtggttgttgccaact

SEQ ID NO: 5179369 - DNA, 23 bp, Homo sapiens
agagtggtttctgcgtgtgtata

SEQ ID NO: 5179370 - DNA, 11 bp, Homo sapiens
agagtgtaaaa

SEQ ID NO: 5179371 - DNA, 14 bp, Homo sapiens
agagtgtagaagca

SEQ ID NO: 5179372 - DNA, 15 bp, Homo sapiens
agagtgtagaagcat

SEQ ID NO: 5179373 - DNA, 22 bp, Homo sapiens
agagtgtagaagcattccttct

SEQ ID NO: 5179374 - DNA, 23 bp, Homo sapiens
agagtgtagcctaaagggcaggg

SEQ ID NO: 5179375 - DNA, 16 bp, Homo sapiens
agagtgtagctgtaag

SEQ ID NO: 5179376 - DNA, 19 bp, Homo sapiens
agagtgtagctgtaagggc

SEQ ID NO: 5179377 - DNA, 21 bp, Homo sapiens
agagtgtagctgtaagggcag

SEQ ID NO: 5179378 - DNA, 22 bp, Homo sapiens
agagtgtagctgtaagggcagt

SEQ ID NO: 5179379 - DNA, 16 bp, Homo sapiens
agagtgtagggggcct

SEQ ID NO: 5179380 - DNA, 20 bp, Homo sapiens
agagtgtaggtgaaatgaat

SEQ ID NO: 5179381 - DNA, 20 bp, Homo sapiens
agagtgtagtttacagaaaa

SEQ ID NO: 5179382 - DNA, 22 bp, Homo sapiens
agagtgtccttcctctgtcctc

SEQ ID NO: 5179383 - DNA, 21 bp, Homo sapiens
agagtgtgaccaaaagttaca

SEQ ID NO: 5179384 - DNA, 18 bp, Homo sapiens
agagtgtgagagagactg

SEQ ID NO: 5179385 - DNA, 15 bp, Homo sapiens
agagtgtgcagactg

SEQ ID NO: 5179386 - DNA, 15 bp, Homo sapiens
agagtgtggaggctg

SEQ ID NO: 5179387 - DNA, 19 bp, Homo sapiens
agagtgtgggaagggagag

SEQ ID NO: 5179388 - DNA, 20 bp, Homo sapiens
agagtgtgggggaggcgcac

SEQ ID NO: 5179389 - DNA, 18 bp, Homo sapiens
agagtgtgtgggcagggt

SEQ ID NO: 5179390 - DNA, 11 bp, Homo sapiens
agagtgtgtgt

SEQ ID NO: 5179391 - DNA, 18 bp, Homo sapiens
agagtgttggtgttggct

SEQ ID NO: 5179392 - DNA, 21 bp, Homo sapiens
agagtgttgttgctgaccagc

SEQ ID NO: 5179393 - DNA, 22 bp, Homo sapiens
agagtgttgttgctgaccagct

SEQ ID NO: 5179394 - DNA, 21 bp, Homo sapiens
agagtgtttgtgagctttttg

SEQ ID NO: 5179395 - DNA, 13 bp, Homo sapiens
agagttaaaagca

SEQ ID NO: 5179396 - DNA, 15 bp, Homo sapiens
agagttaaaatgttt

SEQ ID NO: 5179397 - DNA, 23 bp, Homo sapiens
agagttaaatagagtatatgcac

SEQ ID NO: 5179398 - DNA, 22 bp, Homo sapiens
agagttaacaatgatatatgga

SEQ ID NO: 5179399 - DNA, 19 bp, Homo sapiens
agagttaagaactatgacg

SEQ ID NO: 5179400 - DNA, 13 bp, Homo sapiens
agagttaagaagc

SEQ ID NO: 5179401 - DNA, 14 bp, Homo sapiens
agagttaagaagct

SEQ ID NO: 5179402 - DNA, 18 bp, Homo sapiens
agagttaagaagctgttg

SEQ ID NO: 5179403 - DNA, 20 bp, Homo sapiens
agagttaagaagctgttgta

SEQ ID NO: 5179404 - DNA, 14 bp, Homo sapiens
agagttaagaatgt

SEQ ID NO: 5179405 - DNA, 23 bp, Homo sapiens
agagttaataggagtatttttgg

SEQ ID NO: 5179406 - DNA, 20 bp, Homo sapiens
agagttaatatatagaaggg

SEQ ID NO: 5179407 - DNA, 16 bp, Homo sapiens
agagttacagttctgt

SEQ ID NO: 5179408 - DNA, 13 bp, Homo sapiens
agagttacttgat

SEQ ID NO: 5179409 - DNA, 16 bp, Homo sapiens
agagttagatatgtgc

SEQ ID NO: 5179410 - DNA, 20 bp, Homo sapiens
agagttaggtttaacataaa

SEQ ID NO: 5179411 - DNA, 21 bp, Homo sapiens
agagttaggtttaacataaag

SEQ ID NO: 5179412 - DNA, 21 bp, Homo sapiens
agagttagtcgccctacagaa

SEQ ID NO: 5179413 - DNA, 16 bp, Homo sapiens
agagttatcttcttta

SEQ ID NO: 5179414 - DNA, 18 bp, Homo sapiens
agagttcaatggctgctg

SEQ ID NO: 5179415 - DNA, 18 bp, Homo sapiens
agagttcacaggaggcca

SEQ ID NO: 5179416 - DNA, 20 bp, Homo sapiens
agagttcagggaggggctga

SEQ ID NO: 5179417 - DNA, 13 bp, Homo sapiens
agagttcagtaag

SEQ ID NO: 5179418 - DNA, 15 bp, Homo sapiens
agagttccctgcaac

SEQ ID NO: 5179419 - DNA, 20 bp, Homo sapiens
agagttcccttgaaactttg

SEQ ID NO: 5179420 - DNA, 16 bp, Homo sapiens
agagttcctgcggagt

SEQ ID NO: 5179421 - DNA, 17 bp, Homo sapiens
agagttccttctcactt

SEQ ID NO: 5179422 - DNA, 14 bp, Homo sapiens
agagttcgtgaaga

SEQ ID NO: 5179423 - DNA, 19 bp, Homo sapiens
agagttcgtgaagagggaa

SEQ ID NO: 5179424 - DNA, 20 bp, Homo sapiens
agagttctatactgtaaagc

SEQ ID NO: 5179425 - DNA, 21 bp, Homo sapiens
agagttctcctggaggcaggg

SEQ ID NO: 5179426 - DNA, 15 bp, Homo sapiens
agagttctggtgaga

SEQ ID NO: 5179427 - DNA, 15 bp, Homo sapiens
agagttctgtgaaga

SEQ ID NO: 5179428 - DNA, 17 bp, Homo sapiens
agagttcttctttcttt

SEQ ID NO: 5179429 - DNA, 15 bp, Homo sapiens
agagttctttgctgc

SEQ ID NO: 5179430 - DNA, 22 bp, Homo sapiens
agagttctttgctgcccctgtc

SEQ ID NO: 5179431 - DNA, 23 bp, Homo sapiens
agagttctttgctgcccctgtct

SEQ ID NO: 5179432 - DNA, 18 bp, Homo sapiens
agagttcttttggatcat

SEQ ID NO: 5179433 - DNA, 21 bp, Homo sapiens
agagttctttttgaagtattt

SEQ ID NO: 5179434 - DNA, 13 bp, Homo sapiens
agagttgaaccta

SEQ ID NO: 5179435 - DNA, 20 bp, Homo sapiens
agagttgacccctcctgaac

SEQ ID NO: 5179436 - DNA, 15 bp, Homo sapiens
agagttgagcacagg

SEQ ID NO: 5179437 - DNA, 22 bp, Homo sapiens
agagttgaggttgttaaaacag

SEQ ID NO: 5179438 - DNA, 17 bp, Homo sapiens
agagttgatactacagt

SEQ ID NO: 5179439 - DNA, 16 bp, Homo sapiens
agagttgctcctcagg

SEQ ID NO: 5179440 - DNA, 21 bp, Homo sapiens
agagttgctgagagggctcga

SEQ ID NO: 5179441 - DNA, 13 bp, Homo sapiens
agagttggccata

SEQ ID NO: 5179442 - DNA, 17 bp, Homo sapiens
agacaatctaaaaaata

SEQ ID NO: 5179443 - DNA, 19 bp, Homo sapiens
agacaatgacactggaagg

SEQ ID NO: 5179444 - DNA, 13 bp, Homo sapiens
agacaatgactta

SEQ ID NO: 5179445 - DNA, 17 bp, Homo sapiens
agacaatgacttactgt

SEQ ID NO: 5179446 - DNA, 22 bp, Homo sapiens
agacaatgacttactgtacatg

SEQ ID NO: 5179447 - DNA, 16 bp, Homo sapiens
agacaatgcagatgcc

SEQ ID NO: 5179448 - DNA, 17 bp, Homo sapiens
agacaatgcagatgcca

SEQ ID NO: 5179449 - DNA, 18 bp, Homo sapiens
agacaatggctatattaa

SEQ ID NO: 5179450 - DNA, 20 bp, Homo sapiens
agacaatgtgaaaagaaaaa

SEQ ID NO: 5179451 - DNA, 12 bp, Homo sapiens
agacaatgttgt

SEQ ID NO: 5179452 - DNA, 12 bp, Homo sapiens
agacaattagca

SEQ ID NO: 5179453 - DNA, 20 bp, Homo sapiens
agacaattcctccagagaca

SEQ ID NO: 5179454 - DNA, 22 bp, Homo sapiens
agacaattcctccagagacact

SEQ ID NO: 5179455 - DNA, 20 bp, Homo sapiens
agacaattctaatggtaact

SEQ ID NO: 5179456 - DNA, 12 bp, Homo sapiens
agacaattctcc

SEQ ID NO: 5179457 - DNA, 14 bp, Homo sapiens
agacaattctttat

SEQ ID NO: 5179458 - DNA, 18 bp, Homo sapiens
agacaattctttatacaa

SEQ ID NO: 5179459 - DNA, 19 bp, Homo sapiens
agacaattgacaacagtta

SEQ ID NO: 5179460 - DNA, 23 bp, Homo sapiens
agacaattgaggtaagttttttg

SEQ ID NO: 5179461 - DNA, 13 bp, Homo sapiens
agacaattgcatt

SEQ ID NO: 5179462 - DNA, 20 bp, Homo sapiens
agacaatttcttctaataaa

SEQ ID NO: 5179463 - DNA, 17 bp, Homo sapiens
agacaatttgatacata

SEQ ID NO: 5179464 - DNA, 18 bp, Homo sapiens
agacaattttttttcaaa

SEQ ID NO: 5179465 - DNA, 15 bp, Homo sapiens
agacacaaaagatgg

SEQ ID NO: 5179466 - DNA, 12 bp, Homo sapiens
agacacaaatgc

SEQ ID NO: 5179467 - DNA, 19 bp, Homo sapiens
agacacaacaactcctagg

SEQ ID NO: 5179468 - DNA, 13 bp, Homo sapiens
agacacaagcctt

SEQ ID NO: 5179469 - DNA, 22 bp, Homo sapiens
agacacaagtggccttaagtct

SEQ ID NO: 5179470 - DNA, 16 bp, Homo sapiens
agacacaatatgtatg

SEQ ID NO: 5179471 - DNA, 16 bp, Homo sapiens
agacacaattagagaa

SEQ ID NO: 5179472 - DNA, 20 bp, Homo sapiens
agacacaatttcatttccag

SEQ ID NO: 5179473 - DNA, 14 bp, Homo sapiens
agacacacaaagca

SEQ ID NO: 5179474 - DNA, 20 bp, Homo sapiens
agacacacaacatcaagaaa

SEQ ID NO: 5179475 - DNA, 15 bp, Homo sapiens
agacacacacacagc

SEQ ID NO: 5179476 - DNA, 23 bp, Homo sapiens
agacacacacacgcacgcacaca

SEQ ID NO: 5179477 - DNA, 20 bp, Homo sapiens
agacacacagcctcacgccc

SEQ ID NO: 5179478 - DNA, 14 bp, Homo sapiens
agacacacagcctt

SEQ ID NO: 5179479 - DNA, 18 bp, Homo sapiens
agacacacatgggcagcc

SEQ ID NO: 5179480 - DNA, 18 bp, Homo sapiens
agacacaccgcggccagg

SEQ ID NO: 5179481 - DNA, 22 bp, Homo sapiens
agacacaccgcggccaggcacc

SEQ ID NO: 5179482 - DNA, 13 bp, Homo sapiens
agacacacctgag

SEQ ID NO: 5179483 - DNA, 13 bp, Homo sapiens
agacacacttgtc

SEQ ID NO: 5179484 - DNA, 14 bp, Homo sapiens
agacacagaacaca

SEQ ID NO: 5179485 - DNA, 18 bp, Homo sapiens
agacacagaagaggctgg

SEQ ID NO: 5179486 - DNA, 16 bp, Homo sapiens
agacacagagacatgg

SEQ ID NO: 5179487 - DNA, 19 bp, Homo sapiens
agacacagagtggagccct

SEQ ID NO: 5179488 - DNA, 21 bp, Homo sapiens
agacacagagtggagccctca

SEQ ID NO: 5179489 - DNA, 14 bp, Homo sapiens
agacacagataata

SEQ ID NO: 5179490 - DNA, 15 bp, Homo sapiens
agacacagatacatg

SEQ ID NO: 5179491 - DNA, 17 bp, Homo sapiens
agacacagcccagacaa

SEQ ID NO: 5179492 - DNA, 22 bp, Homo sapiens
agacacagcccaggtccctccg

SEQ ID NO: 5179493 - DNA, 18 bp, Homo sapiens
agacacagcgtccctagc

SEQ ID NO: 5179494 - DNA, 13 bp, Homo sapiens
agacacagctctt

SEQ ID NO: 5179495 - DNA, 12 bp, Homo sapiens
agacacaggaag

SEQ ID NO: 5179496 - DNA, 17 bp, Homo sapiens
agacacaggcccggctc

SEQ ID NO: 5179497 - DNA, 23 bp, Homo sapiens
agacacaggcccggctccaggct

SEQ ID NO: 5179498 - DNA, 16 bp, Homo sapiens
agacacagggacttga

SEQ ID NO: 5179499 - DNA, 21 bp, Homo sapiens
agacacagggatgattcccac

SEQ ID NO: 5179500 - DNA, 21 bp, Homo sapiens
agacacagggcatccaactga

SEQ ID NO: 5179501 - DNA, 23 bp, Homo sapiens
agacacaggtgcctcacgcctgt

SEQ ID NO: 5179502 - DNA, 21 bp, Homo sapiens
agacacagtcatactgtcact

SEQ ID NO: 5179503 - DNA, 17 bp, Homo sapiens
agacacatcaaatgccc

SEQ ID NO: 5179504 - DNA, 18 bp, Homo sapiens
agacacatcaaatgcccc

SEQ ID NO: 5179505 - DNA, 14 bp, Homo sapiens
agacacatgccagg

SEQ ID NO: 5179506 - DNA, 18 bp, Homo sapiens
agacacatgctgaggttt

SEQ ID NO: 5179507 - DNA, 21 bp, Homo sapiens
agacacatgctgaggttttga

SEQ ID NO: 5179508 - DNA, 20 bp, Homo sapiens
agacacatgctgttggcctc

SEQ ID NO: 5179509 - DNA, 22 bp, Homo sapiens
agacacatgtccaagaagccca

SEQ ID NO: 5179510 - DNA, 18 bp, Homo sapiens
agacacattctcctgtgc

SEQ ID NO: 5179511 - DNA, 20 bp, Homo sapiens
agacacattctcctgtgccc

SEQ ID NO: 5179512 - DNA, 13 bp, Homo sapiens
agacacatttaag

SEQ ID NO: 5179513 - DNA, 14 bp, Homo sapiens
agacacatttaagg

SEQ ID NO: 5179514 - DNA, 15 bp, Homo sapiens
agacaccaaagttct

SEQ ID NO: 5179515 - DNA, 17 bp, Homo sapiens
agacaccaaagttctaa

SEQ ID NO: 5179516 - DNA, 19 bp, Homo sapiens
agacaccaagctcaccctt

SEQ ID NO: 5179517 - DNA, 22 bp, Homo sapiens
agacaccacagacgccacctgg

SEQ ID NO: 5179518 - DNA, 17 bp, Homo sapiens
agacaccacagcctccc

SEQ ID NO: 5179519 - DNA, 13 bp, Homo sapiens
agacaccaccacc

SEQ ID NO: 5179520 - DNA, 15 bp, Homo sapiens
agacaccagagcaga

SEQ ID NO: 5179521 - DNA, 13 bp, Homo sapiens
agacaccatcctg

SEQ ID NO: 5179522 - DNA, 21 bp, Homo sapiens
agacaccatcttttgtgagat

SEQ ID NO: 5179523 - DNA, 12 bp, Homo sapiens
agacacccagga

SEQ ID NO: 5179524 - DNA, 20 bp, Homo sapiens
agacacccgattcctgccca

SEQ ID NO: 5179525 - DNA, 15 bp, Homo sapiens
agacaccctctgggg

SEQ ID NO: 5179526 - DNA, 17 bp, Homo sapiens
agacaccctctgggggt

SEQ ID NO: 5179527 - DNA, 14 bp, Homo sapiens
agacaccctggcag

SEQ ID NO: 5179528 - DNA, 19 bp, Homo sapiens
agacaccggagtatgtgca

SEQ ID NO: 5179529 - DNA, 20 bp, Homo sapiens
agacaccggagtatgtgcag

SEQ ID NO: 5179530 - DNA, 17 bp, Homo sapiens
agacaccgttcattcag

SEQ ID NO: 5179531 - DNA, 16 bp, Homo sapiens
agacacctaaccccag

SEQ ID NO: 5179532 - DNA, 19 bp, Homo sapiens
agacacctatcagagaagc

SEQ ID NO: 5179533 - DNA, 17 bp, Homo sapiens
agacacctccccctacc

SEQ ID NO: 5179534 - DNA, 16 bp, Homo sapiens
agacacctgcacctcc

SEQ ID NO: 5179535 - DNA, 21 bp, Homo sapiens
agacacctgcacctcccccca

SEQ ID NO: 5179536 - DNA, 15 bp, Homo sapiens
agacacctggactga

SEQ ID NO: 5179537 - DNA, 19 bp, Homo sapiens
agacacctgttcacagaaa

SEQ ID NO: 5179538 - DNA, 12 bp, Homo sapiens
agacaccttcat

SEQ ID NO: 5179539 - DNA, 16 bp, Homo sapiens
agacaccttcccagct

SEQ ID NO: 5179540 - DNA, 13 bp, Homo sapiens
agacaccttctgt

SEQ ID NO: 5179541 - DNA, 16 bp, Homo sapiens
agacaccttctgtgct

SEQ ID NO: 5179542 - DNA, 19 bp, Homo sapiens
agacaccttctgtgctcat

SEQ ID NO: 5179543 - DNA, 17 bp, Homo sapiens
agacaccttgacagggc

SEQ ID NO: 5179544 - DNA, 15 bp, Homo sapiens
agacacgacagcaca

SEQ ID NO: 5179545 - DNA, 13 bp, Homo sapiens
agacacgcacggc

SEQ ID NO: 5179546 - DNA, 21 bp, Homo sapiens
agacacgcacggcagccacag

SEQ ID NO: 5179547 - DNA, 21 bp, Homo sapiens
agacacgctggcgacacactc

SEQ ID NO: 5179548 - DNA, 21 bp, Homo sapiens
agacacggagcccagccctcc

SEQ ID NO: 5179549 - DNA, 21 bp, Homo sapiens
agacacggatctgagaatctt

SEQ ID NO: 5179550 - DNA, 19 bp, Homo sapiens
agacacggggcaggacctt

SEQ ID NO: 5179551 - DNA, 15 bp, Homo sapiens
agacacgtgtttttg

SEQ ID NO: 5179552 - DNA, 14 bp, Homo sapiens
agacactaactttg

SEQ ID NO: 5179553 - DNA, 21 bp, Homo sapiens
agacactaattccttaaatga

SEQ ID NO: 5179554 - DNA, 14 bp, Homo sapiens
agacactagtagag

SEQ ID NO: 5179555 - DNA, 18 bp, Homo sapiens
agacactagtagagcaaa

SEQ ID NO: 5179556 - DNA, 22 bp, Homo sapiens
agacactagttcagaggaagca

SEQ ID NO: 5179557 - DNA, 23 bp, Homo sapiens
agacactagttcagaggaagcac

SEQ ID NO: 5179558 - DNA, 17 bp, Homo sapiens
agacactccagtttgcc

SEQ ID NO: 5179559 - DNA, 18 bp, Homo sapiens
agacactcccccctccat

SEQ ID NO: 5179560 - DNA, 20 bp, Homo sapiens
agacactccccgaagtcttt

SEQ ID NO: 5179561 - DNA, 22 bp, Homo sapiens
agacactccccgaagtcttttg

SEQ ID NO: 5179562 - DNA, 23 bp, Homo sapiens
agacactccccgaagtcttttgt

SEQ ID NO: 5179563 - DNA, 13 bp, Homo sapiens
agacactcctggg

SEQ ID NO: 5179564 - DNA, 14 bp, Homo sapiens
agacactcctgggg

SEQ ID NO: 5179565 - DNA, 13 bp, Homo sapiens
agacactctgaca

SEQ ID NO: 5179566 - DNA, 15 bp, Homo sapiens
agacactctgctctg

SEQ ID NO: 5179567 - DNA, 16 bp, Homo sapiens
agacactctgctctgc

SEQ ID NO: 5179568 - DNA, 17 bp, Homo sapiens
agacactctgctctgcc

SEQ ID NO: 5179569 - DNA, 13 bp, Homo sapiens
agacactctggct

SEQ ID NO: 5179570 - DNA, 16 bp, Homo sapiens
agacactctggctggt

SEQ ID NO: 5179571 - DNA, 21 bp, Homo sapiens
agacactgaaatatacacaca

SEQ ID NO: 5179572 - DNA, 14 bp, Homo sapiens
agacactgaaggca

SEQ ID NO: 5179573 - DNA, 16 bp, Homo sapiens
agacactgagccagtc

SEQ ID NO: 5179574 - DNA, 17 bp, Homo sapiens
agacactgagccagtct

SEQ ID NO: 5179575 - DNA, 20 bp, Homo sapiens
agacactgcagtgaccactt

SEQ ID NO: 5179576 - DNA, 20 bp, Homo sapiens
agacactgccacacagggtc

SEQ ID NO: 5179577 - DNA, 19 bp, Homo sapiens
agacactgccgacatcagc

SEQ ID NO: 5179578 - DNA, 11 bp, Homo sapiens
agacactgcct

SEQ ID NO: 5179579 - DNA, 12 bp, Homo sapiens
agacactgcctg

SEQ ID NO: 5179580 - DNA, 10 bp, Homo sapiens
agacactgga

SEQ ID NO: 5179581 - DNA, 11 bp, Homo sapiens
agacactggac

SEQ ID NO: 5179582 - DNA, 12 bp, Homo sapiens
agacactggaca

SEQ ID NO: 5179583 - DNA, 13 bp, Homo sapiens
agacactggacat

SEQ ID NO: 5179584 - DNA, 14 bp, Homo sapiens
agacactggacatg

SEQ ID NO: 5179585 - DNA, 14 bp, Homo sapiens
agacactgggagaa

SEQ ID NO: 5179586 - DNA, 18 bp, Homo sapiens
agacactgggagaagaga

SEQ ID NO: 5179587 - DNA, 17 bp, Homo sapiens
agacactggtctcagag

SEQ ID NO: 5179588 - DNA, 12 bp, Homo sapiens
agacactggtgt

SEQ ID NO: 5179589 - DNA, 17 bp, Homo sapiens
agacactggtgtatctc

SEQ ID NO: 5179590 - DNA, 21 bp, Homo sapiens
agacactggtgtatctcagaa

SEQ ID NO: 5179591 - DNA, 18 bp, Homo sapiens
agacactggtttacactt

SEQ ID NO: 5179592 - DNA, 12 bp, Homo sapiens
agacactgtcaa

SEQ ID NO: 5179593 - DNA, 11 bp, Homo sapiens
agacactgtga

SEQ ID NO: 5179594 - DNA, 21 bp, Homo sapiens
agacactgtgagagttgtctc

SEQ ID NO: 5179595 - DNA, 15 bp, Homo sapiens
agacactgtgcaggc

SEQ ID NO: 5179596 - DNA, 14 bp, Homo sapiens
agacactgttgata

SEQ ID NO: 5179597 - DNA, 13 bp, Homo sapiens
agacactgttgca

SEQ ID NO: 5179598 - DNA, 15 bp, Homo sapiens
agacactgttgcaaa

SEQ ID NO: 5179599 - DNA, 19 bp, Homo sapiens
agacactgtttacaagaaa

SEQ ID NO: 5179600 - DNA, 16 bp, Homo sapiens
agacacttatattttg

SEQ ID NO: 5179601 - DNA, 15 bp, Homo sapiens
agacacttatttatt

SEQ ID NO: 5179602 - DNA, 21 bp, Homo sapiens
agacacttcatggaccaagaa

SEQ ID NO: 5179603 - DNA, 13 bp, Homo sapiens
agacacttcccct

SEQ ID NO: 5179604 - DNA, 22 bp, Homo sapiens
agacacttccccttgtctccct

SEQ ID NO: 5179605 - DNA, 20 bp, Homo sapiens
agacacttctaaatgaagtg

SEQ ID NO: 5179606 - DNA, 15 bp, Homo sapiens
agacacttgatactt

SEQ ID NO: 5179607 - DNA, 13 bp, Homo sapiens
agacacttgcctt

SEQ ID NO: 5179608 - DNA, 13 bp, Homo sapiens
agacacttgctga

SEQ ID NO: 5179609 - DNA, 14 bp, Homo sapiens
agacacttgctgag

SEQ ID NO: 5179610 - DNA, 17 bp, Homo sapiens
agacacttgctgagtga

SEQ ID NO: 5179611 - DNA, 13 bp, Homo sapiens
agacactttggaa

SEQ ID NO: 5179612 - DNA, 15 bp, Homo sapiens
agacactttggaagt

SEQ ID NO: 5179613 - DNA, 23 bp, Homo sapiens
agacactttggaagtttgtgttc

SEQ ID NO: 5179614 - DNA, 22 bp, Homo sapiens
agacactttttctttacaaaca

SEQ ID NO: 5179615 - DNA, 12 bp, Homo sapiens
agacagaaaaaa

SEQ ID NO: 5179616 - DNA, 15 bp, Homo sapiens
agacagaaaagtgcc

SEQ ID NO: 5179617 - DNA, 21 bp, Homo sapiens
agacagaaaagtgcctgagct

SEQ ID NO: 5179618 - DNA, 17 bp, Homo sapiens
agacagaaacagagaga

SEQ ID NO: 5179619 - DNA, 12 bp, Homo sapiens
agacagaaaccc

SEQ ID NO: 5179620 - DNA, 11 bp, Homo sapiens
agacagaaact

SEQ ID NO: 5179621 - DNA, 14 bp, Homo sapiens
agacagaaactgga

SEQ ID NO: 5179622 - DNA, 15 bp, Homo sapiens
agacagaaactggat

SEQ ID NO: 5179623 - DNA, 18 bp, Homo sapiens
agagttggctcaggcaga

SEQ ID NO: 5179624 - DNA, 19 bp, Homo sapiens
agagttgggacaattgctt

SEQ ID NO: 5179625 - DNA, 23 bp, Homo sapiens
agagttgggggctaggggagggg

SEQ ID NO: 5179626 - DNA, 22 bp, Homo sapiens
agagttgggtgtctccttaagc

SEQ ID NO: 5179627 - DNA, 15 bp, Homo sapiens
agagttgtaaatata

SEQ ID NO: 5179628 - DNA, 16 bp, Homo sapiens
agagttgtaaatatat

SEQ ID NO: 5179629 - DNA, 20 bp, Homo sapiens
agagttgtaaatatataaat

SEQ ID NO: 5179630 - DNA, 16 bp, Homo sapiens
agagttgtctctgttg

SEQ ID NO: 5179631 - DNA, 19 bp, Homo sapiens
agagttgtgatggagggga

SEQ ID NO: 5179632 - DNA, 16 bp, Homo sapiens
agagttgtgcacgcag

SEQ ID NO: 5179633 - DNA, 18 bp, Homo sapiens
agagttgtgttgttcttt

SEQ ID NO: 5179634 - DNA, 19 bp, Homo sapiens
agagttgttacatttttaa

SEQ ID NO: 5179635 - DNA, 20 bp, Homo sapiens
agagttgttgtttgccaagc

SEQ ID NO: 5179636 - DNA, 21 bp, Homo sapiens
agagttgtttataatgtcaaa

SEQ ID NO: 5179637 - DNA, 14 bp, Homo sapiens
agagtttaaaatca

SEQ ID NO: 5179638 - DNA, 21 bp, Homo sapiens
agagtttaaacaaaaaaccca

SEQ ID NO: 5179639 - DNA, 14 bp, Homo sapiens
agagtttaacacaa

SEQ ID NO: 5179640 - DNA, 15 bp, Homo sapiens
agagtttaacacaag

SEQ ID NO: 5179641 - DNA, 22 bp, Homo sapiens
agagtttacaagaaataaatct

SEQ ID NO: 5179642 - DNA, 17 bp, Homo sapiens
agagtttagctggaaaa

SEQ ID NO: 5179643 - DNA, 15 bp, Homo sapiens
agagtttcaaaagca

SEQ ID NO: 5179644 - DNA, 16 bp, Homo sapiens
agagtttcaaaagcaa

SEQ ID NO: 5179645 - DNA, 23 bp, Homo sapiens
agagtttcttaacttacttttgt

SEQ ID NO: 5179646 - DNA, 20 bp, Homo sapiens
agagtttcttgtaagccatc

SEQ ID NO: 5179647 - DNA, 22 bp, Homo sapiens
agagtttgatatgggctttctc

SEQ ID NO: 5179648 - DNA, 21 bp, Homo sapiens
agagtttgcctccctgcactt

SEQ ID NO: 5179649 - DNA, 23 bp, Homo sapiens
agagtttggaattattgtagaca

SEQ ID NO: 5179650 - DNA, 23 bp, Homo sapiens
agagtttggggccgaaaatgttt

SEQ ID NO: 5179651 - DNA, 20 bp, Homo sapiens
agagtttggtgatactgtca

SEQ ID NO: 5179652 - DNA, 20 bp, Homo sapiens
agagtttggttaatcagtgt

SEQ ID NO: 5179653 - DNA, 16 bp, Homo sapiens
agagtttggtttggtc

SEQ ID NO: 5179654 - DNA, 17 bp, Homo sapiens
agagtttgtaaatgact

SEQ ID NO: 5179655 - DNA, 14 bp, Homo sapiens
agagtttgtgtgta

SEQ ID NO: 5179656 - DNA, 22 bp, Homo sapiens
agagtttgttctgttctggggg

SEQ ID NO: 5179657 - DNA, 16 bp, Homo sapiens
agagttttatcaactt

SEQ ID NO: 5179658 - DNA, 19 bp, Homo sapiens
agagttttattcctttcct

SEQ ID NO: 5179659 - DNA, 12 bp, Homo sapiens
agagttttggtt

SEQ ID NO: 5179660 - DNA, 18 bp, Homo sapiens
agagtttttaaagccttc

SEQ ID NO: 5179661 - DNA, 19 bp, Homo sapiens
agagtttttaaagccttct

SEQ ID NO: 5179662 - DNA, 17 bp, Homo sapiens
agagtttttatgccttt

SEQ ID NO: 5179663 - DNA, 23 bp, Homo sapiens
agataaaaaaactgttaccagat

SEQ ID NO: 5179664 - DNA, 21 bp, Homo sapiens
agataaaaacctgaactttca

SEQ ID NO: 5179665 - DNA, 21 bp, Homo sapiens
agataaaaagatggcctttgc

SEQ ID NO: 5179666 - DNA, 16 bp, Homo sapiens
agataaaaagtggaat

SEQ ID NO: 5179667 - DNA, 20 bp, Homo sapiens
agataaaacagaatcttctg

SEQ ID NO: 5179668 - DNA, 22 bp, Homo sapiens
agataaaagcaattctgactgt

SEQ ID NO: 5179669 - DNA, 20 bp, Homo sapiens
agataaaatctactccaaat

SEQ ID NO: 5179670 - DNA, 15 bp, Homo sapiens
agataaaatgatgtt

SEQ ID NO: 5179671 - DNA, 21 bp, Homo sapiens
agataaaattatagatgggaa

SEQ ID NO: 5179672 - DNA, 15 bp, Homo sapiens
agataaacacaagat

SEQ ID NO: 5179673 - DNA, 20 bp, Homo sapiens
agataaacaccaacccagga

SEQ ID NO: 5179674 - DNA, 23 bp, Homo sapiens
agataaacagtttagcccatctc

SEQ ID NO: 5179675 - DNA, 14 bp, Homo sapiens
agataaactgaaat

SEQ ID NO: 5179676 - DNA, 17 bp, Homo sapiens
agataaactgaaatttg

SEQ ID NO: 5179677 - DNA, 20 bp, Homo sapiens
agataaagacagctgacaga

SEQ ID NO: 5179678 - DNA, 18 bp, Homo sapiens
agataaagaccagaaatt

SEQ ID NO: 5179679 - DNA, 19 bp, Homo sapiens
agataaagaccagaaattc

SEQ ID NO: 5179680 - DNA, 14 bp, Homo sapiens
agataaagagatac

SEQ ID NO: 5179681 - DNA, 15 bp, Homo sapiens
agataaagatgatct

SEQ ID NO: 5179682 - DNA, 16 bp, Homo sapiens
agataaagattgtgtg

SEQ ID NO: 5179683 - DNA, 18 bp, Homo sapiens
agataaagcttaggtcaa

SEQ ID NO: 5179684 - DNA, 13 bp, Homo sapiens
agataaaggaaac

SEQ ID NO: 5179685 - DNA, 13 bp, Homo sapiens
agataaaggacag

SEQ ID NO: 5179686 - DNA, 21 bp, Homo sapiens
agataaagtcaaatgccaaac

SEQ ID NO: 5179687 - DNA, 14 bp, Homo sapiens
agataaataaaaat

SEQ ID NO: 5179688 - DNA, 20 bp, Homo sapiens
agataaataaaagatagcaa

SEQ ID NO: 5179689 - DNA, 17 bp, Homo sapiens
agataaatagaactatc

SEQ ID NO: 5179690 - DNA, 15 bp, Homo sapiens
agataaatatcatta

SEQ ID NO: 5179691 - DNA, 16 bp, Homo sapiens
agataaatatcattat

SEQ ID NO: 5179692 - DNA, 13 bp, Homo sapiens
agataaatattta

SEQ ID NO: 5179693 - DNA, 13 bp, Homo sapiens
agataaatcatgg

SEQ ID NO: 5179694 - DNA, 17 bp, Homo sapiens
agataaatcatgggcat

SEQ ID NO: 5179695 - DNA, 18 bp, Homo sapiens
agataaatccaactctga

SEQ ID NO: 5179696 - DNA, 18 bp, Homo sapiens
agataaatccaatagtct

SEQ ID NO: 5179697 - DNA, 12 bp, Homo sapiens
agataaatgaaa

SEQ ID NO: 5179698 - DNA, 13 bp, Homo sapiens
agataaatgaaat

SEQ ID NO: 5179699 - DNA, 15 bp, Homo sapiens
agataaatgctttaa

SEQ ID NO: 5179700 - DNA, 21 bp, Homo sapiens
agataaatgctttaaatagtt

SEQ ID NO: 5179701 - DNA, 18 bp, Homo sapiens
agataaatttgttgaata

SEQ ID NO: 5179702 - DNA, 22 bp, Homo sapiens
agataacacactttttattaga

SEQ ID NO: 5179703 - DNA, 18 bp, Homo sapiens
agataacagcctcttgcc

SEQ ID NO: 5179704 - DNA, 16 bp, Homo sapiens
agataaccatattcac

SEQ ID NO: 5179705 - DNA, 23 bp, Homo sapiens
agataacctaataattgtatcta

SEQ ID NO: 5179706 - DNA, 14 bp, Homo sapiens
agataacgcaggag

SEQ ID NO: 5179707 - DNA, 17 bp, Homo sapiens
agataacgcaggagaga

SEQ ID NO: 5179708 - DNA, 18 bp, Homo sapiens
agataacgcaggagagag

SEQ ID NO: 5179709 - DNA, 19 bp, Homo sapiens
agataacgcaggagagaga

SEQ ID NO: 5179710 - DNA, 13 bp, Homo sapiens
agataactaggaa

SEQ ID NO: 5179711 - DNA, 17 bp, Homo sapiens
agataactctctttcct

SEQ ID NO: 5179712 - DNA, 20 bp, Homo sapiens
agataactctctttccttga

SEQ ID NO: 5179713 - DNA, 15 bp, Homo sapiens
agataactctttgga

SEQ ID NO: 5179714 - DNA, 15 bp, Homo sapiens
agataactgaaaatt

SEQ ID NO: 5179715 - DNA, 21 bp, Homo sapiens
agataactgctcttttactaa

SEQ ID NO: 5179716 - DNA, 19 bp, Homo sapiens
agataactgttatttataa

SEQ ID NO: 5179717 - DNA, 19 bp, Homo sapiens
agataacttaaataattta

SEQ ID NO: 5179718 - DNA, 12 bp, Homo sapiens
agataacttact

SEQ ID NO: 5179719 - DNA, 19 bp, Homo sapiens
agataacttactgtatatg

SEQ ID NO: 5179720 - DNA, 20 bp, Homo sapiens
agataacttactgtatatgt

SEQ ID NO: 5179721 - DNA, 22 bp, Homo sapiens
agataacttactgtatatgtat

SEQ ID NO: 5179722 - DNA, 23 bp, Homo sapiens
agataacttactgtatatgtatt

SEQ ID NO: 5179723 - DNA, 14 bp, Homo sapiens
agataacttccttc

SEQ ID NO: 5179724 - DNA, 16 bp, Homo sapiens
agataacttcttgaaa

SEQ ID NO: 5179725 - DNA, 19 bp, Homo sapiens
agataactttgactttctt

SEQ ID NO: 5179726 - DNA, 15 bp, Homo sapiens
agataagataaatga

SEQ ID NO: 5179727 - DNA, 17 bp, Homo sapiens
agataagatttctgtct

SEQ ID NO: 5179728 - DNA, 17 bp, Homo sapiens
agataagcaagagagat

SEQ ID NO: 5179729 - DNA, 16 bp, Homo sapiens
agataagcctgagcct

SEQ ID NO: 5179730 - DNA, 23 bp, Homo sapiens
agataagcttttggtaatattca

SEQ ID NO: 5179731 - DNA, 12 bp, Homo sapiens
agataaggagaa

SEQ ID NO: 5179732 - DNA, 16 bp, Homo sapiens
agataaggccgagccc

SEQ ID NO: 5179733 - DNA, 17 bp, Homo sapiens
agataagggtatctggt

SEQ ID NO: 5179734 - DNA, 16 bp, Homo sapiens
agataaggtggcttct

SEQ ID NO: 5179735 - DNA, 17 bp, Homo sapiens
agataaggtggcttctc

SEQ ID NO: 5179736 - DNA, 12 bp, Homo sapiens
agataaggtttt

SEQ ID NO: 5179737 - DNA, 15 bp, Homo sapiens
agataaggttttaag

SEQ ID NO: 5179738 - DNA, 18 bp, Homo sapiens
agataagtaatttacctg

SEQ ID NO: 5179739 - DNA, 12 bp, Homo sapiens
agataagtgctc

SEQ ID NO: 5179740 - DNA, 18 bp, Homo sapiens
agataagtgctcagtatt

SEQ ID NO: 5179741 - DNA, 12 bp, Homo sapiens
agataagtgtaa

SEQ ID NO: 5179742 - DNA, 16 bp, Homo sapiens
agataagtgtaaatag

SEQ ID NO: 5179743 - DNA, 18 bp, Homo sapiens
agataagtgtatttttca

SEQ ID NO: 5179744 - DNA, 14 bp, Homo sapiens
agataagttggaaa

SEQ ID NO: 5179745 - DNA, 15 bp, Homo sapiens
agataagttggaaac

SEQ ID NO: 5179746 - DNA, 16 bp, Homo sapiens
agataagttggaaaca

SEQ ID NO: 5179747 - DNA, 19 bp, Homo sapiens
agataagttggaaacacta

SEQ ID NO: 5179748 - DNA, 22 bp, Homo sapiens
agataagttggaaacactaaat

SEQ ID NO: 5179749 - DNA, 17 bp, Homo sapiens
agataagttggagcagg

SEQ ID NO: 5179750 - DNA, 20 bp, Homo sapiens
agataagttggagcaggggt

SEQ ID NO: 5179751 - DNA, 12 bp, Homo sapiens
agataataagat

SEQ ID NO: 5179752 - DNA, 15 bp, Homo sapiens
agataataagattag

SEQ ID NO: 5179753 - DNA, 18 bp, Homo sapiens
agataatacaccactaca

SEQ ID NO: 5179754 - DNA, 20 bp, Homo sapiens
agataatagggttttcagat

SEQ ID NO: 5179755 - DNA, 15 bp, Homo sapiens
agataatatctgtga

SEQ ID NO: 5179756 - DNA, 17 bp, Homo sapiens
agataatatctgtgagg

SEQ ID NO: 5179757 - DNA, 18 bp, Homo sapiens
agataatatctgtgaggt

SEQ ID NO: 5179758 - DNA, 15 bp, Homo sapiens
agataatatgagaat

SEQ ID NO: 5179759 - DNA, 16 bp, Homo sapiens
agataatattactgtt

SEQ ID NO: 5179760 - DNA, 21 bp, Homo sapiens
agataatatttttgtatttct

SEQ ID NO: 5179761 - DNA, 17 bp, Homo sapiens
agataatcagcctctta

SEQ ID NO: 5179762 - DNA, 14 bp, Homo sapiens
agataatcattgct

SEQ ID NO: 5179763 - DNA, 15 bp, Homo sapiens
agataatcattgctt

SEQ ID NO: 5179764 - DNA, 13 bp, Homo sapiens
agataatccctgt

SEQ ID NO: 5179765 - DNA, 19 bp, Homo sapiens
agataatctcagtgctttc

SEQ ID NO: 5179766 - DNA, 15 bp, Homo sapiens
agataatctctcagc

SEQ ID NO: 5179767 - DNA, 17 bp, Homo sapiens
agataatcttttacatt

SEQ ID NO: 5179768 - DNA, 18 bp, Homo sapiens
agataatcttttacattg

SEQ ID NO: 5179769 - DNA, 17 bp, Homo sapiens
agataatgaggcaactc

SEQ ID NO: 5179770 - DNA, 21 bp, Homo sapiens
agataatgaggcaactcagca

SEQ ID NO: 5179771 - DNA, 19 bp, Homo sapiens
agataatgatggaacagta

SEQ ID NO: 5179772 - DNA, 18 bp, Homo sapiens
agataatgcatatttttg

SEQ ID NO: 5179773 - DNA, 19 bp, Homo sapiens
agataatggataatcttcg

SEQ ID NO: 5179774 - DNA, 13 bp, Homo sapiens
agataatggtaat

SEQ ID NO: 5179775 - DNA, 16 bp, Homo sapiens
agataatgtatataaa

SEQ ID NO: 5179776 - DNA, 23 bp, Homo sapiens
agataatgtccttgctttacaaa

SEQ ID NO: 5179777 - DNA, 18 bp, Homo sapiens
agataatgtgaaaatggt

SEQ ID NO: 5179778 - DNA, 22 bp, Homo sapiens
agataatgtgaactagctggaa

SEQ ID NO: 5179779 - DNA, 21 bp, Homo sapiens
agataatgttagaggttttaa

SEQ ID NO: 5179780 - DNA, 20 bp, Homo sapiens
agataatgttctttaatgtt

SEQ ID NO: 5179781 - DNA, 18 bp, Homo sapiens
agataattaaatgaaata

SEQ ID NO: 5179782 - DNA, 19 bp, Homo sapiens
agataattacctactctgg

SEQ ID NO: 5179783 - DNA, 19 bp, Homo sapiens
agataattatcagtcatga

SEQ ID NO: 5179784 - DNA, 20 bp, Homo sapiens
agataattatccaggatgtg

SEQ ID NO: 5179785 - DNA, 14 bp, Homo sapiens
agataattcactgt

SEQ ID NO: 5179786 - DNA, 12 bp, Homo sapiens
agataattcatt

SEQ ID NO: 5179787 - DNA, 15 bp, Homo sapiens
agataattcatttgt

SEQ ID NO: 5179788 - DNA, 13 bp, Homo sapiens
agataattcttaa

SEQ ID NO: 5179789 - DNA, 14 bp, Homo sapiens
agataattgctatt

SEQ ID NO: 5179790 - DNA, 18 bp, Homo sapiens
agataattgctatttatt

SEQ ID NO: 5179791 - DNA, 20 bp, Homo sapiens
agataattgtactttgaaaa

SEQ ID NO: 5179792 - DNA, 12 bp, Homo sapiens
agataatttatg

SEQ ID NO: 5179793 - DNA, 16 bp, Homo sapiens
agataatttcagggtg

SEQ ID NO: 5179794 - DNA, 13 bp, Homo sapiens
agataatttgaaa

SEQ ID NO: 5179795 - DNA, 23 bp, Homo sapiens
agataatttgcatattctattgt

SEQ ID NO: 5179796 - DNA, 11 bp, Homo sapiens
agataatttta

SEQ ID NO: 5179797 - DNA, 15 bp, Homo sapiens
agataattttatgtg

SEQ ID NO: 5179798 - DNA, 22 bp, Homo sapiens
agatacaaaaccttgtgtaaga

SEQ ID NO: 5179799 - DNA, 13 bp, Homo sapiens
agatacaaaatgt

SEQ ID NO: 5179800 - DNA, 21 bp, Homo sapiens
agatacaaataaggacacaaa

SEQ ID NO: 5179801 - DNA, 18 bp, Homo sapiens
agatacaaggcccagaag

SEQ ID NO: 5179802 - DNA, 17 bp, Homo sapiens
agacagaaagagacaca

SEQ ID NO: 5179803 - DNA, 23 bp, Homo sapiens
agacagaaagcctccgctgggct

SEQ ID NO: 5179804 - DNA, 15 bp, Homo sapiens
agacagaaccacagg

SEQ ID NO: 5179805 - DNA, 17 bp, Homo sapiens
agacagaacttgaatgt

SEQ ID NO: 5179806 - DNA, 16 bp, Homo sapiens
agacagaagaaacaag

SEQ ID NO: 5179807 - DNA, 16 bp, Homo sapiens
agacagaagcaggctg

SEQ ID NO: 5179808 - DNA, 20 bp, Homo sapiens
agacagaatataaaaactcc

SEQ ID NO: 5179809 - DNA, 20 bp, Homo sapiens
agacagaatctcagtctgtc

SEQ ID NO: 5179810 - DNA, 18 bp, Homo sapiens
agacagaatctcgctctg

SEQ ID NO: 5179811 - DNA, 17 bp, Homo sapiens
agacagaatgtatctgt

SEQ ID NO: 5179812 - DNA, 21 bp, Homo sapiens
agacagaatgtatctgtgaag

SEQ ID NO: 5179813 - DNA, 20 bp, Homo sapiens
agacagaattaatggtcatt

SEQ ID NO: 5179814 - DNA, 14 bp, Homo sapiens
agacagacacacac

SEQ ID NO: 5179815 - DNA, 15 bp, Homo sapiens
agacagacacacaca

SEQ ID NO: 5179816 - DNA, 22 bp, Homo sapiens
agacagacaccacagcctcccc

SEQ ID NO: 5179817 - DNA, 15 bp, Homo sapiens
agacagacatacata

SEQ ID NO: 5179818 - DNA, 15 bp, Homo sapiens
agacagacattcacc

SEQ ID NO: 5179819 - DNA, 19 bp, Homo sapiens
agacagacccagtgagtga

SEQ ID NO: 5179820 - DNA, 14 bp, Homo sapiens
agacagaccctctg

SEQ ID NO: 5179821 - DNA, 15 bp, Homo sapiens
agacagaccctctgc

SEQ ID NO: 5179822 - DNA, 17 bp, Homo sapiens
agacagaccctgaaaag

SEQ ID NO: 5179823 - DNA, 14 bp, Homo sapiens
agacagacctccag

SEQ ID NO: 5179824 - DNA, 23 bp, Homo sapiens
agacagacgcctgcttttgcaaa

SEQ ID NO: 5179825 - DNA, 15 bp, Homo sapiens
agacagacttgagaa

SEQ ID NO: 5179826 - DNA, 19 bp, Homo sapiens
agacagagaaaacttgcct

SEQ ID NO: 5179827 - DNA, 18 bp, Homo sapiens
agacagagaatatgtctg

SEQ ID NO: 5179828 - DNA, 19 bp, Homo sapiens
agacagagaatatgtctgc

SEQ ID NO: 5179829 - DNA, 21 bp, Homo sapiens
agacagagaatatgtctgctc

SEQ ID NO: 5179830 - DNA, 23 bp, Homo sapiens
agacagagaatatgtctgctcct

SEQ ID NO: 5179831 - DNA, 17 bp, Homo sapiens
agacagagacaagtaat

SEQ ID NO: 5179832 - DNA, 19 bp, Homo sapiens
agacagagaccctctgcca

SEQ ID NO: 5179833 - DNA, 16 bp, Homo sapiens
agacagagacctcctg

SEQ ID NO: 5179834 - DNA, 13 bp, Homo sapiens
agacagagacctg

SEQ ID NO: 5179835 - DNA, 15 bp, Homo sapiens
agacagagaggactg

SEQ ID NO: 5179836 - DNA, 20 bp, Homo sapiens
agacagagatggcagagcca

SEQ ID NO: 5179837 - DNA, 17 bp, Homo sapiens
agacagagcaggctttg

SEQ ID NO: 5179838 - DNA, 10 bp, Homo sapiens
agacagagcc

SEQ ID NO: 5179839 - DNA, 13 bp, Homo sapiens
agacagagccaag

SEQ ID NO: 5179840 - DNA, 14 bp, Homo sapiens
agacagagccagga

SEQ ID NO: 5179841 - DNA, 16 bp, Homo sapiens
agacagagccaggaga

SEQ ID NO: 5179842 - DNA, 19 bp, Homo sapiens
agacagagccaggagaagc

SEQ ID NO: 5179843 - DNA, 24 bp, Homo sapiens
agacagagccccaccctcagatgc

SEQ ID NO: 5179844 - DNA, 19 bp, Homo sapiens
agacagagcccccaagcct

SEQ ID NO: 5179845 - DNA, 16 bp, Homo sapiens
agacagagcctccact

SEQ ID NO: 5179846 - DNA, 16 bp, Homo sapiens
agacagagcctcgctc

SEQ ID NO: 5179847 - DNA, 15 bp, Homo sapiens
agacagagctacaca

SEQ ID NO: 5179848 - DNA, 12 bp, Homo sapiens
agacagagctgg

SEQ ID NO: 5179849 - DNA, 21 bp, Homo sapiens
agacagaggaaagggctggct

SEQ ID NO: 5179850 - DNA, 23 bp, Homo sapiens
agacagaggaaagggctggctcc

SEQ ID NO: 5179851 - DNA, 16 bp, Homo sapiens
agacagaggcagagat

SEQ ID NO: 5179852 - DNA, 18 bp, Homo sapiens
agacagaggcagagattg

SEQ ID NO: 5179853 - DNA, 14 bp, Homo sapiens
agacagaggggagc

SEQ ID NO: 5179854 - DNA, 21 bp, Homo sapiens
agacagaggtttcattttcat

SEQ ID NO: 5179855 - DNA, 12 bp, Homo sapiens
agacagagtgga

SEQ ID NO: 5179856 - DNA, 14 bp, Homo sapiens
agacagagtggatc

SEQ ID NO: 5179857 - DNA, 20 bp, Homo sapiens
agacagagtggatctggagt

SEQ ID NO: 5179858 - DNA, 21 bp, Homo sapiens
agacagatatttcaaacatca

SEQ ID NO: 5179859 - DNA, 14 bp, Homo sapiens
agacagatcactcc

SEQ ID NO: 5179860 - DNA, 16 bp, Homo sapiens
agacagatcactcctg

SEQ ID NO: 5179861 - DNA, 19 bp, Homo sapiens
agacagatcactcctggag

SEQ ID NO: 5179862 - DNA, 20 bp, Homo sapiens
agacagatcactcctggagg

SEQ ID NO: 5179863 - DNA, 15 bp, Homo sapiens
agacagatgtggaca

SEQ ID NO: 5179864 - DNA, 23 bp, Homo sapiens
agacagatgtggacatgcacccg

SEQ ID NO: 5179865 - DNA, 11 bp, Homo sapiens
agacagcaagg

SEQ ID NO: 5179866 - DNA, 17 bp, Homo sapiens
agacagcacaaggtggc

SEQ ID NO: 5179867 - DNA, 22 bp, Homo sapiens
agacagcacaaggtggcagcaa

SEQ ID NO: 5179868 - DNA, 16 bp, Homo sapiens
agacagcacaggcagc

SEQ ID NO: 5179869 - DNA, 14 bp, Homo sapiens
agacagcaccactg

SEQ ID NO: 5179870 - DNA, 17 bp, Homo sapiens
agacagcacttggctcc

SEQ ID NO: 5179871 - DNA, 17 bp, Homo sapiens
agacagcagagccatct

SEQ ID NO: 5179872 - DNA, 19 bp, Homo sapiens
agacagcagcagcctgcac

SEQ ID NO: 5179873 - DNA, 12 bp, Homo sapiens
agacagcagctc

SEQ ID NO: 5179874 - DNA, 16 bp, Homo sapiens
agacagcatgtgttaa

SEQ ID NO: 5179875 - DNA, 18 bp, Homo sapiens
agacagccaaaggctggc

SEQ ID NO: 5179876 - DNA, 22 bp, Homo sapiens
agacagccaggtagttggaact

SEQ ID NO: 5179877 - DNA, 19 bp, Homo sapiens
agacagccccagagcaggg

SEQ ID NO: 5179878 - DNA, 14 bp, Homo sapiens
agacagccccctgc

SEQ ID NO: 5179879 - DNA, 15 bp, Homo sapiens
agacagcccgggctc

SEQ ID NO: 5179880 - DNA, 20 bp, Homo sapiens
agacagcccgggctctgcct

SEQ ID NO: 5179881 - DNA, 22 bp, Homo sapiens
agacagcccgggctctgcctcc

SEQ ID NO: 5179882 - DNA, 11 bp, Homo sapiens
agacagcctct

SEQ ID NO: 5179883 - DNA, 19 bp, Homo sapiens
agacagcctgtttctatcc

SEQ ID NO: 5179884 - DNA, 15 bp, Homo sapiens
agacagcggtcccag

SEQ ID NO: 5179885 - DNA, 17 bp, Homo sapiens
agacagctccaccctgg

SEQ ID NO: 5179886 - DNA, 13 bp, Homo sapiens
agacagctgcctg

SEQ ID NO: 5179887 - DNA, 16 bp, Homo sapiens
agacagctgcctggga

SEQ ID NO: 5179888 - DNA, 18 bp, Homo sapiens
agacagctgctcagagcc

SEQ ID NO: 5179889 - DNA, 11 bp, Homo sapiens
agacagctgga

SEQ ID NO: 5179890 - DNA, 14 bp, Homo sapiens
agacagctggaccc

SEQ ID NO: 5179891 - DNA, 20 bp, Homo sapiens
agacaggaaaatcctctggc

SEQ ID NO: 5179892 - DNA, 16 bp, Homo sapiens
agacaggaaagccagg

SEQ ID NO: 5179893 - DNA, 21 bp, Homo sapiens
agacaggaagaccaaggcctc

SEQ ID NO: 5179894 - DNA, 12 bp, Homo sapiens
agacaggaagat

SEQ ID NO: 5179895 - DNA, 21 bp, Homo sapiens
agacaggaatttagaaaaagt

SEQ ID NO: 5179896 - DNA, 16 bp, Homo sapiens
agacaggacagaatgt

SEQ ID NO: 5179897 - DNA, 21 bp, Homo sapiens
agacaggacagtgcttcagcc

SEQ ID NO: 5179898 - DNA, 16 bp, Homo sapiens
agacaggaccagggat

SEQ ID NO: 5179899 - DNA, 15 bp, Homo sapiens
agacaggacccctgc

SEQ ID NO: 5179900 - DNA, 18 bp, Homo sapiens
agacaggacctgactatt

SEQ ID NO: 5179901 - DNA, 15 bp, Homo sapiens
agacaggagacaaaa

SEQ ID NO: 5179902 - DNA, 14 bp, Homo sapiens
agacaggagggcaa

SEQ ID NO: 5179903 - DNA, 19 bp, Homo sapiens
agacaggagggcaagggcc

SEQ ID NO: 5179904 - DNA, 21 bp, Homo sapiens
agacaggattctgacagagca

SEQ ID NO: 5179905 - DNA, 12 bp, Homo sapiens
agacaggcacaa

SEQ ID NO: 5179906 - DNA, 19 bp, Homo sapiens
agacaggcacaaaatgtga

SEQ ID NO: 5179907 - DNA, 18 bp, Homo sapiens
agacaggcagcccagcag

SEQ ID NO: 5179908 - DNA, 20 bp, Homo sapiens
agacaggccatgtgagccac

SEQ ID NO: 5179909 - DNA, 22 bp, Homo sapiens
agacaggccatgtgagccaccg

SEQ ID NO: 5179910 - DNA, 15 bp, Homo sapiens
agacaggcccaagag

SEQ ID NO: 5179911 - DNA, 14 bp, Homo sapiens
agacaggccctccc

SEQ ID NO: 5179912 - DNA, 18 bp, Homo sapiens
agacaggcctttccctgc

SEQ ID NO: 5179913 - DNA, 21 bp, Homo sapiens
agacaggcgctggacagaggg

SEQ ID NO: 5179914 - DNA, 16 bp, Homo sapiens
agacaggcggggccca

SEQ ID NO: 5179915 - DNA, 21 bp, Homo sapiens
agacaggctacaaagcagaga

SEQ ID NO: 5179916 - DNA, 15 bp, Homo sapiens
agacaggctggaaga

SEQ ID NO: 5179917 - DNA, 15 bp, Homo sapiens
agacaggctgggtcc

SEQ ID NO: 5179918 - DNA, 19 bp, Homo sapiens
agacagggcaatcttgtcc

SEQ ID NO: 5179919 - DNA, 22 bp, Homo sapiens
agacagggcaatcttgtccaca

SEQ ID NO: 5179920 - DNA, 22 bp, Homo sapiens
agacagggcccgggcccaggca

SEQ ID NO: 5179921 - DNA, 23 bp, Homo sapiens
agacagggcccgggcccaggcag

SEQ ID NO: 5179922 - DNA, 16 bp, Homo sapiens
agacagggcgtcctct

SEQ ID NO: 5179923 - DNA, 18 bp, Homo sapiens
agacagggcgtcctctcg

SEQ ID NO: 5179924 - DNA, 19 bp, Homo sapiens
agacagggctccagcctgt

SEQ ID NO: 5179925 - DNA, 19 bp, Homo sapiens
agacagggtcaaagtgttt

SEQ ID NO: 5179926 - DNA, 21 bp, Homo sapiens
agacagggtctcactctgtca

SEQ ID NO: 5179927 - DNA, 22 bp, Homo sapiens
agacagggtctcactctgtcgc

SEQ ID NO: 5179928 - DNA, 17 bp, Homo sapiens
agacagggtctcactgt

SEQ ID NO: 5179929 - DNA, 18 bp, Homo sapiens
agacagggtcttgctctg

SEQ ID NO: 5179930 - DNA, 23 bp, Homo sapiens
agacagggtcttgctctgtcccc

SEQ ID NO: 5179931 - DNA, 20 bp, Homo sapiens
agacagggtgggcttcctgc

SEQ ID NO: 5179932 - DNA, 19 bp, Homo sapiens
agacagggtggggcttaga

SEQ ID NO: 5179933 - DNA, 21 bp, Homo sapiens
agacagggtttggctgtgtct

SEQ ID NO: 5179934 - DNA, 15 bp, Homo sapiens
agacaggtcctgatt

SEQ ID NO: 5179935 - DNA, 11 bp, Homo sapiens
agacaggtgag

SEQ ID NO: 5179936 - DNA, 17 bp, Homo sapiens
agacaggttaaatatat

SEQ ID NO: 5179937 - DNA, 19 bp, Homo sapiens
agacaggttaaatatataa

SEQ ID NO: 5179938 - DNA, 20 bp, Homo sapiens
agacaggttaaatatataaa

SEQ ID NO: 5179939 - DNA, 23 bp, Homo sapiens
agacaggttaaatatataaacaa

SEQ ID NO: 5179940 - DNA, 18 bp, Homo sapiens
agacagtaagagtttaca

SEQ ID NO: 5179941 - DNA, 20 bp, Homo sapiens
agacagtaagagtttacaag

SEQ ID NO: 5179942 - DNA, 17 bp, Homo sapiens
agacagtatatttatag

SEQ ID NO: 5179943 - DNA, 18 bp, Homo sapiens
agacagtattgccacctc

SEQ ID NO: 5179944 - DNA, 17 bp, Homo sapiens
agacagtatttgcagtg

SEQ ID NO: 5179945 - DNA, 17 bp, Homo sapiens
agacagtcaccccagga

SEQ ID NO: 5179946 - DNA, 15 bp, Homo sapiens
agacagtcaggaagc

SEQ ID NO: 5179947 - DNA, 19 bp, Homo sapiens
agacagtccctgccaatgg

SEQ ID NO: 5179948 - DNA, 18 bp, Homo sapiens
agacagtcctaacaatat

SEQ ID NO: 5179949 - DNA, 15 bp, Homo sapiens
agacagtcctttccc

SEQ ID NO: 5179950 - DNA, 14 bp, Homo sapiens
agacagtctggaaa

SEQ ID NO: 5179951 - DNA, 22 bp, Homo sapiens
agacagtctgttatgcactgtg

SEQ ID NO: 5179952 - DNA, 13 bp, Homo sapiens
agacagtgatatt

SEQ ID NO: 5179953 - DNA, 19 bp, Homo sapiens
agacagtgatattggaact

SEQ ID NO: 5179954 - DNA, 12 bp, Homo sapiens
agacagtgatct

SEQ ID NO: 5179955 - DNA, 18 bp, Homo sapiens
agacagtgatctccatat

SEQ ID NO: 5179956 - DNA, 15 bp, Homo sapiens
agacagtgcacatga

SEQ ID NO: 5179957 - DNA, 16 bp, Homo sapiens
agacagtgccctgaga

SEQ ID NO: 5179958 - DNA, 16 bp, Homo sapiens
agacagtgctgccctg

SEQ ID NO: 5179959 - DNA, 18 bp, Homo sapiens
agacagtggatcatgaaa

SEQ ID NO: 5179960 - DNA, 16 bp, Homo sapiens
agacagtggcactaaa

SEQ ID NO: 5179961 - DNA, 15 bp, Homo sapiens
agacagtggcagcaa

SEQ ID NO: 5179962 - DNA, 23 bp, Homo sapiens
agacagtgggcactaagggtgga

SEQ ID NO: 5179963 - DNA, 20 bp, Homo sapiens
agacagtgggggtgcctggt

SEQ ID NO: 5179964 - DNA, 20 bp, Homo sapiens
agacagtgtttcgtcatgtt

SEQ ID NO: 5179965 - DNA, 22 bp, Homo sapiens
agacagtgtttcgtcatgttgg

SEQ ID NO: 5179966 - DNA, 14 bp, Homo sapiens
agacagttcaagaa

SEQ ID NO: 5179967 - DNA, 14 bp, Homo sapiens
agacagttctctgt

SEQ ID NO: 5179968 - DNA, 17 bp, Homo sapiens
agacagttcttttctac

SEQ ID NO: 5179969 - DNA, 18 bp, Homo sapiens
agacagttgggatccaaa

SEQ ID NO: 5179970 - DNA, 20 bp, Homo sapiens
agacagttgggtgagaacaa

SEQ ID NO: 5179971 - DNA, 15 bp, Homo sapiens
agacagtttcttagc

SEQ ID NO: 5179972 - DNA, 18 bp, Homo sapiens
agacagtttcttagcttt

SEQ ID NO: 5179973 - DNA, 19 bp, Homo sapiens
agacagtttgtaaatgtta

SEQ ID NO: 5179974 - DNA, 20 bp, Homo sapiens
agacataaaactttaaaagg

SEQ ID NO: 5179975 - DNA, 17 bp, Homo sapiens
agacataaacaaagaca

SEQ ID NO: 5179976 - DNA, 19 bp, Homo sapiens
agacataaagaagaaactt

SEQ ID NO: 5179977 - DNA, 11 bp, Homo sapiens
agacataaagc

SEQ ID NO: 5179978 - DNA, 15 bp, Homo sapiens
agacataaagccttt

SEQ ID NO: 5179979 - DNA, 16 bp, Homo sapiens
agacataaaggaaaag

SEQ ID NO: 5179980 - DNA, 23 bp, Homo sapiens
agacataaaggaaaagacacatt

SEQ ID NO: 5179981 - DNA, 19 bp, Homo sapiens
agatacaaggcccagaagc

SEQ ID NO: 5179982 - DNA, 17 bp, Homo sapiens
agatacaagtttcagac

SEQ ID NO: 5179983 - DNA, 13 bp, Homo sapiens
agatacaataaaa

SEQ ID NO: 5179984 - DNA, 15 bp, Homo sapiens
agatacaatgtattt

SEQ ID NO: 5179985 - DNA, 13 bp, Homo sapiens
agatacacaaaat

SEQ ID NO: 5179986 - DNA, 12 bp, Homo sapiens
agatacacagct

SEQ ID NO: 5179987 - DNA, 13 bp, Homo sapiens
agatacactcctg

SEQ ID NO: 5179988 - DNA, 19 bp, Homo sapiens
agatacactgcactttgtt

SEQ ID NO: 5179989 - DNA, 23 bp, Homo sapiens
agatacagaagcccatgtcttct

SEQ ID NO: 5179990 - DNA, 24 bp, Homo sapiens
agatacagaagcccatgtcttctg

SEQ ID NO: 5179991 - DNA, 21 bp, Homo sapiens
agatacagatggagcaaatgt

SEQ ID NO: 5179992 - DNA, 19 bp, Homo sapiens
agatacagccccaaaccag

SEQ ID NO: 5179993 - DNA, 18 bp, Homo sapiens
agatacagtgaaatcttt

SEQ ID NO: 5179994 - DNA, 20 bp, Homo sapiens
agatacagtgaaatctttta

SEQ ID NO: 5179995 - DNA, 18 bp, Homo sapiens
agatacagtggagacatc

SEQ ID NO: 5179996 - DNA, 14 bp, Homo sapiens
agatacatacagaa

SEQ ID NO: 5179997 - DNA, 16 bp, Homo sapiens
agatacatcactgctt

SEQ ID NO: 5179998 - DNA, 14 bp, Homo sapiens
agatacatttgatc

SEQ ID NO: 5179999 - DNA, 14 bp, Homo sapiens
agataccagcgagg

SEQ ID NO: 5180000 - DNA, 21 bp, Homo sapiens
agataccagcgaggaggctcc

SEQ ID NO: 5180001 - DNA, 23 bp, Homo sapiens
agataccagcgaggaggctccag

SEQ ID NO: 5180002 - DNA, 22 bp, Homo sapiens
agataccagctttttctctcag

SEQ ID NO: 5180003 - DNA, 19 bp, Homo sapiens
agataccatactcatttct

SEQ ID NO: 5180004 - DNA, 20 bp, Homo sapiens
agataccatcagcaaagaat

SEQ ID NO: 5180005 - DNA, 15 bp, Homo sapiens
agataccattttgaa

SEQ ID NO: 5180006 - DNA, 18 bp, Homo sapiens
agataccattttgaaata

SEQ ID NO: 5180007 - DNA, 16 bp, Homo sapiens
agatacccagagagaa

SEQ ID NO: 5180008 - DNA, 23 bp, Homo sapiens
agatacccagagagaaaaagaga

SEQ ID NO: 5180009 - DNA, 15 bp, Homo sapiens
agatacccagtggaa

SEQ ID NO: 5180010 - DNA, 22 bp, Homo sapiens
agataccctacgctgtccagaa

SEQ ID NO: 5180011 - DNA, 17 bp, Homo sapiens
agataccctctgagaca

SEQ ID NO: 5180012 - DNA, 22 bp, Homo sapiens
agataccctctgagacagagag

SEQ ID NO: 5180013 - DNA, 16 bp, Homo sapiens
agataccctgtttctg

SEQ ID NO: 5180014 - DNA, 23 bp, Homo sapiens
agataccggtgcttctggaaact

SEQ ID NO: 5180015 - DNA, 14 bp, Homo sapiens
agatacctaaaaca

SEQ ID NO: 5180016 - DNA, 19 bp, Homo sapiens
agatacctaaaagagattt

SEQ ID NO: 5180017 - DNA, 17 bp, Homo sapiens
agatacctgtgaggact

SEQ ID NO: 5180018 - DNA, 18 bp, Homo sapiens
agataccttaaaatttga

SEQ ID NO: 5180019 - DNA, 22 bp, Homo sapiens
agataccttaaaatttgaaaca

SEQ ID NO: 5180020 - DNA, 19 bp, Homo sapiens
agataccttatcttacaat

SEQ ID NO: 5180021 - DNA, 19 bp, Homo sapiens
agataccttgaaaggaaga

SEQ ID NO: 5180022 - DNA, 19 bp, Homo sapiens
agataccttgcaaagcaac

SEQ ID NO: 5180023 - DNA, 16 bp, Homo sapiens
agatacgactttattt

SEQ ID NO: 5180024 - DNA, 19 bp, Homo sapiens
agatacgactttattttct

SEQ ID NO: 5180025 - DNA, 20 bp, Homo sapiens
agatacgactttattttctg

SEQ ID NO: 5180026 - DNA, 22 bp, Homo sapiens
agatacgggggctgtgactctg

SEQ ID NO: 5180027 - DNA, 15 bp, Homo sapiens
agatacgtctgtgac

SEQ ID NO: 5180028 - DNA, 23 bp, Homo sapiens
agatactatttagataacaagaa

SEQ ID NO: 5180029 - DNA, 18 bp, Homo sapiens
agatactattttcatttt

SEQ ID NO: 5180030 - DNA, 12 bp, Homo sapiens
agatactctcag

SEQ ID NO: 5180031 - DNA, 18 bp, Homo sapiens
agatactctcttcttctc

SEQ ID NO: 5180032 - DNA, 12 bp, Homo sapiens
agatactctggg

SEQ ID NO: 5180033 - DNA, 14 bp, Homo sapiens
agatactgaaacat

SEQ ID NO: 5180034 - DNA, 15 bp, Homo sapiens
agatactgaaacatt

SEQ ID NO: 5180035 - DNA, 12 bp, Homo sapiens
agatactgaaat

SEQ ID NO: 5180036 - DNA, 13 bp, Homo sapiens
agatactgaaata

SEQ ID NO: 5180037 - DNA, 15 bp, Homo sapiens
agatactgaaataaa

SEQ ID NO: 5180038 - DNA, 19 bp, Homo sapiens
agatactgcatgtttgctg

SEQ ID NO: 5180039 - DNA, 14 bp, Homo sapiens
agatactgctgtgt

SEQ ID NO: 5180040 - DNA, 13 bp, Homo sapiens
agatactggaaac

SEQ ID NO: 5180041 - DNA, 21 bp, Homo sapiens
agatactggaagttttgcatt

SEQ ID NO: 5180042 - DNA, 11 bp, Homo sapiens
agatactgtat

SEQ ID NO: 5180043 - DNA, 13 bp, Homo sapiens
agatactgtatat

SEQ ID NO: 5180044 - DNA, 21 bp, Homo sapiens
agatactgtctttgtgctgaa

SEQ ID NO: 5180045 - DNA, 16 bp, Homo sapiens
agatacttacatgttc

SEQ ID NO: 5180046 - DNA, 19 bp, Homo sapiens
agatacttacatttccatt

SEQ ID NO: 5180047 - DNA, 20 bp, Homo sapiens
agatacttacatttccattt

SEQ ID NO: 5180048 - DNA, 20 bp, Homo sapiens
agatacttcagctttgtgta

SEQ ID NO: 5180049 - DNA, 23 bp, Homo sapiens
agatacttctgaaataaatgttc

SEQ ID NO: 5180050 - DNA, 21 bp, Homo sapiens
agatacttggaccgagtagag

SEQ ID NO: 5180051 - DNA, 22 bp, Homo sapiens
agatacttggtcacagccaggc

SEQ ID NO: 5180052 - DNA, 20 bp, Homo sapiens
agatacttgtgaacatgcct

SEQ ID NO: 5180053 - DNA, 14 bp, Homo sapiens
agatactttgaagt

SEQ ID NO: 5180054 - DNA, 14 bp, Homo sapiens
agatactttgcatt

SEQ ID NO: 5180055 - DNA, 23 bp, Homo sapiens
agatacttttaaagttttgtcag

SEQ ID NO: 5180056 - DNA, 19 bp, Homo sapiens
agatactttttcttttgta

SEQ ID NO: 5180057 - DNA, 22 bp, Homo sapiens
agatactttttcttttgtaagt

SEQ ID NO: 5180058 - DNA, 23 bp, Homo sapiens
agatactttttcttttgtaagtg

SEQ ID NO: 5180059 - DNA, 18 bp, Homo sapiens
agatagaaagcaataaaa

SEQ ID NO: 5180060 - DNA, 15 bp, Homo sapiens
agatagaaagcatta

SEQ ID NO: 5180061 - DNA, 22 bp, Homo sapiens
agatagaaagctggactgacca

SEQ ID NO: 5180062 - DNA, 15 bp, Homo sapiens
agatagaaataaata

SEQ ID NO: 5180063 - DNA, 21 bp, Homo sapiens
agatagaagaaaaaagaatgt

SEQ ID NO: 5180064 - DNA, 15 bp, Homo sapiens
agatagaagaactgc

SEQ ID NO: 5180065 - DNA, 15 bp, Homo sapiens
agatagaatgacagt

SEQ ID NO: 5180066 - DNA, 12 bp, Homo sapiens
agatagaatgtc

SEQ ID NO: 5180067 - DNA, 13 bp, Homo sapiens
agatagaatttcc

SEQ ID NO: 5180068 - DNA, 16 bp, Homo sapiens
agatagaatttccaat

SEQ ID NO: 5180069 - DNA, 19 bp, Homo sapiens
agatagaatttggcccaga

SEQ ID NO: 5180070 - DNA, 20 bp, Homo sapiens
agatagaatttggcccagag

SEQ ID NO: 5180071 - DNA, 15 bp, Homo sapiens
agatagacctgtgac

SEQ ID NO: 5180072 - DNA, 22 bp, Homo sapiens
agatagacgggttgaaagacat

SEQ ID NO: 5180073 - DNA, 16 bp, Homo sapiens
agatagacttattctt

SEQ ID NO: 5180074 - DNA, 15 bp, Homo sapiens
agatagagaaatagt

SEQ ID NO: 5180075 - DNA, 22 bp, Homo sapiens
agatagagagttgttgtgtaca

SEQ ID NO: 5180076 - DNA, 20 bp, Homo sapiens
agatagataggtcagtgcaa

SEQ ID NO: 5180077 - DNA, 22 bp, Homo sapiens
agatagatgtcgtggactccag

SEQ ID NO: 5180078 - DNA, 17 bp, Homo sapiens
agatagatttggaatag

SEQ ID NO: 5180079 - DNA, 14 bp, Homo sapiens
agatagcaggagga

SEQ ID NO: 5180080 - DNA, 13 bp, Homo sapiens
agatagcatggga

SEQ ID NO: 5180081 - DNA, 16 bp, Homo sapiens
agatagcattgtgaac

SEQ ID NO: 5180082 - DNA, 18 bp, Homo sapiens
agatagcattgtgaactg

SEQ ID NO: 5180083 - DNA, 19 bp, Homo sapiens
agatagcattgtgaactga

SEQ ID NO: 5180084 - DNA, 13 bp, Homo sapiens
agatagccaaggc

SEQ ID NO: 5180085 - DNA, 22 bp, Homo sapiens
agatagcccatcttcctgagct

SEQ ID NO: 5180086 - DNA, 23 bp, Homo sapiens
agatagcccatcttcctgagcta

SEQ ID NO: 5180087 - DNA, 17 bp, Homo sapiens
agatagccctgtcctgg

SEQ ID NO: 5180088 - DNA, 20 bp, Homo sapiens
agatagccgggctccaggga

SEQ ID NO: 5180089 - DNA, 14 bp, Homo sapiens
agatagcgcatata

SEQ ID NO: 5180090 - DNA, 21 bp, Homo sapiens
agatagctcaatactctctga

SEQ ID NO: 5180091 - DNA, 21 bp, Homo sapiens
agatagctgactcattctttt

SEQ ID NO: 5180092 - DNA, 13 bp, Homo sapiens
agatagctgcatg

SEQ ID NO: 5180093 - DNA, 14 bp, Homo sapiens
agatagctggggct

SEQ ID NO: 5180094 - DNA, 14 bp, Homo sapiens
agatagctgtgact

SEQ ID NO: 5180095 - DNA, 14 bp, Homo sapiens
agatagcttcccca

SEQ ID NO: 5180096 - DNA, 16 bp, Homo sapiens
agataggaaactgaag

SEQ ID NO: 5180097 - DNA, 20 bp, Homo sapiens
agataggaaggtcatttcca

SEQ ID NO: 5180098 - DNA, 21 bp, Homo sapiens
agataggaaggtcatttccat

SEQ ID NO: 5180099 - DNA, 17 bp, Homo sapiens
agataggaccttgggcc

SEQ ID NO: 5180100 - DNA, 17 bp, Homo sapiens
agataggagttctctga

SEQ ID NO: 5180101 - DNA, 16 bp, Homo sapiens
agataggcacatgcat

SEQ ID NO: 5180102 - DNA, 12 bp, Homo sapiens
agataggcctgt

SEQ ID NO: 5180103 - DNA, 18 bp, Homo sapiens
agataggccttcttgtga

SEQ ID NO: 5180104 - DNA, 22 bp, Homo sapiens
agataggctctgcacagatgga

SEQ ID NO: 5180105 - DNA, 15 bp, Homo sapiens
agatagggaaaaggg

SEQ ID NO: 5180106 - DNA, 23 bp, Homo sapiens
agatagggaagagagaaacattt

SEQ ID NO: 5180107 - DNA, 22 bp, Homo sapiens
agatagggctgggcaaggaaaa

SEQ ID NO: 5180108 - DNA, 23 bp, Homo sapiens
agatagggctgggcaaggaaaaa

SEQ ID NO: 5180109 - DNA, 13 bp, Homo sapiens
agataggggcaca

SEQ ID NO: 5180110 - DNA, 21 bp, Homo sapiens
agatagggtggcacatctgtc

SEQ ID NO: 5180111 - DNA, 15 bp, Homo sapiens
agataggtaaatacc

SEQ ID NO: 5180112 - DNA, 21 bp, Homo sapiens
agatagtatgcactatataca

SEQ ID NO: 5180113 - DNA, 14 bp, Homo sapiens
agatagtcatgctg

SEQ ID NO: 5180114 - DNA, 20 bp, Homo sapiens
agatagtccataatgttctg

SEQ ID NO: 5180115 - DNA, 21 bp, Homo sapiens
agatagtccataatgttctgc

SEQ ID NO: 5180116 - DNA, 23 bp, Homo sapiens
agatagtccataatgttctgcta

SEQ ID NO: 5180117 - DNA, 14 bp, Homo sapiens
agatagtcccagca

SEQ ID NO: 5180118 - DNA, 14 bp, Homo sapiens
agatagtgcctctg

SEQ ID NO: 5180119 - DNA, 15 bp, Homo sapiens
agatagtgcctctgc

SEQ ID NO: 5180120 - DNA, 19 bp, Homo sapiens
agatagtgctttattttgt

SEQ ID NO: 5180121 - DNA, 14 bp, Homo sapiens
agatagttaaaaga

SEQ ID NO: 5180122 - DNA, 21 bp, Homo sapiens
agatagttaaaagactgcagc

SEQ ID NO: 5180123 - DNA, 20 bp, Homo sapiens
agatagttacaaaatacaaa

SEQ ID NO: 5180124 - DNA, 18 bp, Homo sapiens
agatagttggttctttta

SEQ ID NO: 5180125 - DNA, 17 bp, Homo sapiens
agatagttgtaaagata

SEQ ID NO: 5180126 - DNA, 23 bp, Homo sapiens
agatagttttgccagaacagttt

SEQ ID NO: 5180127 - DNA, 12 bp, Homo sapiens
agatataaaata

SEQ ID NO: 5180128 - DNA, 16 bp, Homo sapiens
agatataaagccattt

SEQ ID NO: 5180129 - DNA, 15 bp, Homo sapiens
agatataaatataaa

SEQ ID NO: 5180130 - DNA, 15 bp, Homo sapiens
agatataaattttta

SEQ ID NO: 5180131 - DNA, 17 bp, Homo sapiens
agatataacattcagtt

SEQ ID NO: 5180132 - DNA, 20 bp, Homo sapiens
agatataactattgcccagg

SEQ ID NO: 5180133 - DNA, 17 bp, Homo sapiens
agatataactgtcttgt

SEQ ID NO: 5180134 - DNA, 18 bp, Homo sapiens
agatataactgtcttgtt

SEQ ID NO: 5180135 - DNA, 22 bp, Homo sapiens
agatataactgtcttgtttcag

SEQ ID NO: 5180136 - DNA, 16 bp, Homo sapiens
agatataagtgctgta

SEQ ID NO: 5180137 - DNA, 17 bp, Homo sapiens
agatataatgttcacta

SEQ ID NO: 5180138 - DNA, 14 bp, Homo sapiens
agatatacaaatat

SEQ ID NO: 5180139 - DNA, 17 bp, Homo sapiens
agatatactttgtggac

SEQ ID NO: 5180140 - DNA, 23 bp, Homo sapiens
agatatactttgtggaccaatta

SEQ ID NO: 5180141 - DNA, 16 bp, Homo sapiens
agatatatacaaggtg

SEQ ID NO: 5180142 - DNA, 13 bp, Homo sapiens
agatatatatcat

SEQ ID NO: 5180143 - DNA, 22 bp, Homo sapiens
agatatatatttactaaaagaa

SEQ ID NO: 5180144 - DNA, 20 bp, Homo sapiens
agatatatatttccaaatat

SEQ ID NO: 5180145 - DNA, 21 bp, Homo sapiens
agatatatatttccaaatatt

SEQ ID NO: 5180146 - DNA, 19 bp, Homo sapiens
agatatatcagtgttgtct

SEQ ID NO: 5180147 - DNA, 17 bp, Homo sapiens
agatatatctgaaaact

SEQ ID NO: 5180148 - DNA, 18 bp, Homo sapiens
agatatatctgaaaactg

SEQ ID NO: 5180149 - DNA, 20 bp, Homo sapiens
agatatatctgaaaactgga

SEQ ID NO: 5180150 - DNA, 19 bp, Homo sapiens
agatatatgctctgcatgt

SEQ ID NO: 5180151 - DNA, 18 bp, Homo sapiens
agatatatgtgtatacat

SEQ ID NO: 5180152 - DNA, 15 bp, Homo sapiens
agatatattaaatgt

SEQ ID NO: 5180153 - DNA, 19 bp, Homo sapiens
agatatatttaagccttat

SEQ ID NO: 5180154 - DNA, 16 bp, Homo sapiens
agatatatttcacttt

SEQ ID NO: 5180155 - DNA, 17 bp, Homo sapiens
agatatattttctttct

SEQ ID NO: 5180156 - DNA, 23 bp, Homo sapiens
agatatatttttaagataataat

SEQ ID NO: 5180157 - DNA, 21 bp, Homo sapiens
agatatcaaaattctagctgt

SEQ ID NO: 5180158 - DNA, 17 bp, Homo sapiens
agacataaattgtaatt

SEQ ID NO: 5180159 - DNA, 14 bp, Homo sapiens
agacataacgtttt

SEQ ID NO: 5180160 - DNA, 20 bp, Homo sapiens
agacataacgtttttccttt

SEQ ID NO: 5180161 - DNA, 13 bp, Homo sapiens
agacataatgcac

SEQ ID NO: 5180162 - DNA, 14 bp, Homo sapiens
agacataatgcact

SEQ ID NO: 5180163 - DNA, 21 bp, Homo sapiens
agacataatttaaaataaata

SEQ ID NO: 5180164 - DNA, 11 bp, Homo sapiens
agacatacata

SEQ ID NO: 5180165 - DNA, 22 bp, Homo sapiens
agacatacatagacatttcaaa

SEQ ID NO: 5180166 - DNA, 21 bp, Homo sapiens
agacatacttgaagggccaga

SEQ ID NO: 5180167 - DNA, 14 bp, Homo sapiens
agacatagactgca

SEQ ID NO: 5180168 - DNA, 16 bp, Homo sapiens
agacatagcatccaag

SEQ ID NO: 5180169 - DNA, 22 bp, Homo sapiens
agacatagcatccaagtggcat

SEQ ID NO: 5180170 - DNA, 21 bp, Homo sapiens
agacatagccgattctctgcc

SEQ ID NO: 5180171 - DNA, 20 bp, Homo sapiens
agacatatattatatataga

SEQ ID NO: 5180172 - DNA, 22 bp, Homo sapiens
agacatatatttatgaatgtgc

SEQ ID NO: 5180173 - DNA, 19 bp, Homo sapiens
agacatatcactgctgctg

SEQ ID NO: 5180174 - DNA, 20 bp, Homo sapiens
agacatatccaaagggaata

SEQ ID NO: 5180175 - DNA, 15 bp, Homo sapiens
agacatatttaactg

SEQ ID NO: 5180176 - DNA, 21 bp, Homo sapiens
agacatatttcagtgattttt

SEQ ID NO: 5180177 - DNA, 17 bp, Homo sapiens
agacatcaacagataaa

SEQ ID NO: 5180178 - DNA, 13 bp, Homo sapiens
agacatcaatgaa

SEQ ID NO: 5180179 - DNA, 21 bp, Homo sapiens
agacatcaccctttgccttag

SEQ ID NO: 5180180 - DNA, 18 bp, Homo sapiens
agacatcacttgccaatg

SEQ ID NO: 5180181 - DNA, 14 bp, Homo sapiens
agacatcagccctt

SEQ ID NO: 5180182 - DNA, 16 bp, Homo sapiens
agacatcagcccttgg

SEQ ID NO: 5180183 - DNA, 15 bp, Homo sapiens
agacatcaggaaggt

SEQ ID NO: 5180184 - DNA, 14 bp, Homo sapiens
agacatcagtctcc

SEQ ID NO: 5180185 - DNA, 14 bp, Homo sapiens
agacatcattgtca

SEQ ID NO: 5180186 - DNA, 17 bp, Homo sapiens
agacatcattgtcagcc

SEQ ID NO: 5180187 - DNA, 20 bp, Homo sapiens
agacatccaaactaaaagga

SEQ ID NO: 5180188 - DNA, 22 bp, Homo sapiens
agacatccaaatttttttttaa

SEQ ID NO: 5180189 - DNA, 19 bp, Homo sapiens
agacatccataaagaagca

SEQ ID NO: 5180190 - DNA, 21 bp, Homo sapiens
agacatccatgtttgtaaaac

SEQ ID NO: 5180191 - DNA, 19 bp, Homo sapiens
agacatccccctccttgcc

SEQ ID NO: 5180192 - DNA, 17 bp, Homo sapiens
agacatccttgcagttt

SEQ ID NO: 5180193 - DNA, 20 bp, Homo sapiens
agacatctccagtgtgccag

SEQ ID NO: 5180194 - DNA, 12 bp, Homo sapiens
agacatctcctc

SEQ ID NO: 5180195 - DNA, 18 bp, Homo sapiens
agacatctctggagccag

SEQ ID NO: 5180196 - DNA, 22 bp, Homo sapiens
agacatctctggagccagagag

SEQ ID NO: 5180197 - DNA, 13 bp, Homo sapiens
agacatctgcctg

SEQ ID NO: 5180198 - DNA, 20 bp, Homo sapiens
agacatctgctgttatcacc

SEQ ID NO: 5180199 - DNA, 13 bp, Homo sapiens
agacatgaatact

SEQ ID NO: 5180200 - DNA, 18 bp, Homo sapiens
agacatgaatactatcca

SEQ ID NO: 5180201 - DNA, 17 bp, Homo sapiens
agacatgaatgcacact

SEQ ID NO: 5180202 - DNA, 20 bp, Homo sapiens
agacatgaattttaaataat

SEQ ID NO: 5180203 - DNA, 15 bp, Homo sapiens
agacatgcagagatt

SEQ ID NO: 5180204 - DNA, 21 bp, Homo sapiens
agacatgccttggtgccggtc

SEQ ID NO: 5180205 - DNA, 19 bp, Homo sapiens
agacatgcttactttttaa

SEQ ID NO: 5180206 - DNA, 22 bp, Homo sapiens
agacatggaaggttagaggttt

SEQ ID NO: 5180207 - DNA, 20 bp, Homo sapiens
agacatggaaggttaggttt

SEQ ID NO: 5180208 - DNA, 19 bp, Homo sapiens
agacatggacaaggagctg

SEQ ID NO: 5180209 - DNA, 17 bp, Homo sapiens
agacatggacctccagg

SEQ ID NO: 5180210 - DNA, 20 bp, Homo sapiens
agacatggacctccaggctc

SEQ ID NO: 5180211 - DNA, 19 bp, Homo sapiens
agacatggagactcctgcc

SEQ ID NO: 5180212 - DNA, 22 bp, Homo sapiens
agacatggagactcctgccctg

SEQ ID NO: 5180213 - DNA, 16 bp, Homo sapiens
agacatggaggttcta

SEQ ID NO: 5180214 - DNA, 20 bp, Homo sapiens
agacatggaggttctaaggc

SEQ ID NO: 5180215 - DNA, 18 bp, Homo sapiens
agacatggatgcgaggac

SEQ ID NO: 5180216 - DNA, 21 bp, Homo sapiens
agacatgggatccaattttaa

SEQ ID NO: 5180217 - DNA, 18 bp, Homo sapiens
agacatgggcctcccact

SEQ ID NO: 5180218 - DNA, 12 bp, Homo sapiens
agacatggggag

SEQ ID NO: 5180219 - DNA, 18 bp, Homo sapiens
agacatggtggggtctcc

SEQ ID NO: 5180220 - DNA, 17 bp, Homo sapiens
agacatgtaatttgtgt

SEQ ID NO: 5180221 - DNA, 18 bp, Homo sapiens
agacatgtaatttgtgta

SEQ ID NO: 5180222 - DNA, 18 bp, Homo sapiens
agacatgtctgttctaca

SEQ ID NO: 5180223 - DNA, 12 bp, Homo sapiens
agacatgtgaca

SEQ ID NO: 5180224 - DNA, 14 bp, Homo sapiens
agacatgtgacatt

SEQ ID NO: 5180225 - DNA, 19 bp, Homo sapiens
agacatgtgaggaggaaaa

SEQ ID NO: 5180226 - DNA, 17 bp, Homo sapiens
agacatgttgtaaatta

SEQ ID NO: 5180227 - DNA, 18 bp, Homo sapiens
agacatgttttccgtgaa

SEQ ID NO: 5180228 - DNA, 14 bp, Homo sapiens
agacattaaataat

SEQ ID NO: 5180229 - DNA, 17 bp, Homo sapiens
agacattaagcagcctt

SEQ ID NO: 5180230 - DNA, 21 bp, Homo sapiens
agacattaattttttttttaa

SEQ ID NO: 5180231 - DNA, 14 bp, Homo sapiens
agacattagaaaaa

SEQ ID NO: 5180232 - DNA, 15 bp, Homo sapiens
agacattagaaaaaa

SEQ ID NO: 5180233 - DNA, 19 bp, Homo sapiens
agacattagaaaaaaatga

SEQ ID NO: 5180234 - DNA, 12 bp, Homo sapiens
agacattagaga

SEQ ID NO: 5180235 - DNA, 15 bp, Homo sapiens
agacattagagaaaa

SEQ ID NO: 5180236 - DNA, 17 bp, Homo sapiens
agacattagagaaaacc

SEQ ID NO: 5180237 - DNA, 18 bp, Homo sapiens
agacattagagaaaacct

SEQ ID NO: 5180238 - DNA, 20 bp, Homo sapiens
agacattagagaaaacctta

SEQ ID NO: 5180239 - DNA, 21 bp, Homo sapiens
agacattagagaaaaccttaa

SEQ ID NO: 5180240 - DNA, 17 bp, Homo sapiens
agacattccttctacat

SEQ ID NO: 5180241 - DNA, 21 bp, Homo sapiens
agacattccttctacatgtaa

SEQ ID NO: 5180242 - DNA, 15 bp, Homo sapiens
agacattctcacata

SEQ ID NO: 5180243 - DNA, 22 bp, Homo sapiens
agacattctggtgaccagactt

SEQ ID NO: 5180244 - DNA, 14 bp, Homo sapiens
agacattcttttaa

SEQ ID NO: 5180245 - DNA, 15 bp, Homo sapiens
agacattgacagcaa

SEQ ID NO: 5180246 - DNA, 17 bp, Homo sapiens
agacattgacagcaatt

SEQ ID NO: 5180247 - DNA, 23 bp, Homo sapiens
agacattgcaattttgcatagct

SEQ ID NO: 5180248 - DNA, 22 bp, Homo sapiens
agacattgggaggggcttctga

SEQ ID NO: 5180249 - DNA, 17 bp, Homo sapiens
agacattgtcagcaaat

SEQ ID NO: 5180250 - DNA, 21 bp, Homo sapiens
agacattgtttggatttcctt

SEQ ID NO: 5180251 - DNA, 22 bp, Homo sapiens
agacattgtttggatttccttt

SEQ ID NO: 5180252 - DNA, 19 bp, Homo sapiens
agacattgttttgccaaca

SEQ ID NO: 5180253 - DNA, 22 bp, Homo sapiens
agacattgttttgccaacattg

SEQ ID NO: 5180254 - DNA, 14 bp, Homo sapiens
agacatttaaagac

SEQ ID NO: 5180255 - DNA, 15 bp, Homo sapiens
agacatttatactct

SEQ ID NO: 5180256 - DNA, 12 bp, Homo sapiens
agacatttcaaa

SEQ ID NO: 5180257 - DNA, 20 bp, Homo sapiens
agacatttcaaaattaatag

SEQ ID NO: 5180258 - DNA, 10 bp, Homo sapiens
agacatttct

SEQ ID NO: 5180259 - DNA, 21 bp, Homo sapiens
agacatttctgctctcagctc

SEQ ID NO: 5180260 - DNA, 18 bp, Homo sapiens
agacatttctttctgttt

SEQ ID NO: 5180261 - DNA, 16 bp, Homo sapiens
agacatttcttttctt

SEQ ID NO: 5180262 - DNA, 20 bp, Homo sapiens
agacatttcttttcttttta

SEQ ID NO: 5180263 - DNA, 21 bp, Homo sapiens
agacatttcttttctttttac

SEQ ID NO: 5180264 - DNA, 19 bp, Homo sapiens
agacatttgctgaactcag

SEQ ID NO: 5180265 - DNA, 12 bp, Homo sapiens
agacatttgtat

SEQ ID NO: 5180266 - DNA, 17 bp, Homo sapiens
agacatttgtatattgt

SEQ ID NO: 5180267 - DNA, 21 bp, Homo sapiens
agacatttgtgtggaaatcat

SEQ ID NO: 5180268 - DNA, 20 bp, Homo sapiens
agacattttaaaaaatggtc

SEQ ID NO: 5180269 - DNA, 17 bp, Homo sapiens
agacattttaacaagaa

SEQ ID NO: 5180270 - DNA, 14 bp, Homo sapiens
agacattttaagca

SEQ ID NO: 5180271 - DNA, 22 bp, Homo sapiens
agacattttaagcattttctac

SEQ ID NO: 5180272 - DNA, 15 bp, Homo sapiens
agacattttaagttt

SEQ ID NO: 5180273 - DNA, 11 bp, Homo sapiens
agacattttca

SEQ ID NO: 5180274 - DNA, 23 bp, Homo sapiens
agacattttccgcccactcctgg

SEQ ID NO: 5180275 - DNA, 16 bp, Homo sapiens
agacattttcctcaca

SEQ ID NO: 5180276 - DNA, 19 bp, Homo sapiens
agacattttcctcacaccc

SEQ ID NO: 5180277 - DNA, 14 bp, Homo sapiens
agacattttgaaat

SEQ ID NO: 5180278 - DNA, 21 bp, Homo sapiens
agacattttgaaataaaaatg

SEQ ID NO: 5180279 - DNA, 13 bp, Homo sapiens
agacattttgtta

SEQ ID NO: 5180280 - DNA, 14 bp, Homo sapiens
agacatttttcatt

SEQ ID NO: 5180281 - DNA, 21 bp, Homo sapiens
agacatttttcattcatgaat

SEQ ID NO: 5180282 - DNA, 14 bp, Homo sapiens
agacatttttgtgc

SEQ ID NO: 5180283 - DNA, 17 bp, Homo sapiens
agacatttttgtgccat

SEQ ID NO: 5180284 - DNA, 15 bp, Homo sapiens
agacattttttaaaa

SEQ ID NO: 5180285 - DNA, 15 bp, Homo sapiens
agacattttttgcta

SEQ ID NO: 5180286 - DNA, 17 bp, Homo sapiens
agacattttttgctata

SEQ ID NO: 5180287 - DNA, 18 bp, Homo sapiens
agacattttttgctataa

SEQ ID NO: 5180288 - DNA, 23 bp, Homo sapiens
agacattttttgctataatcatt

SEQ ID NO: 5180289 - DNA, 12 bp, Homo sapiens
agaccaaaattt

SEQ ID NO: 5180290 - DNA, 18 bp, Homo sapiens
agaccaaacagtgctgtt

SEQ ID NO: 5180291 - DNA, 22 bp, Homo sapiens
agaccaaagacttgttaaatgt

SEQ ID NO: 5180292 - DNA, 20 bp, Homo sapiens
agaccaaaggaaggaacgct

SEQ ID NO: 5180293 - DNA, 23 bp, Homo sapiens
agaccaaattttgaggtctttta

SEQ ID NO: 5180294 - DNA, 21 bp, Homo sapiens
agaccaacgttactcagggct

SEQ ID NO: 5180295 - DNA, 20 bp, Homo sapiens
agaccaagcttagtcctggg

SEQ ID NO: 5180296 - DNA, 12 bp, Homo sapiens
agaccaaggaac

SEQ ID NO: 5180297 - DNA, 16 bp, Homo sapiens
agaccaaggaacaaga

SEQ ID NO: 5180298 - DNA, 18 bp, Homo sapiens
agaccaaggaacaagacc

SEQ ID NO: 5180299 - DNA, 14 bp, Homo sapiens
agaccaaggcggga

SEQ ID NO: 5180300 - DNA, 17 bp, Homo sapiens
agaccaagtcctcaaag

SEQ ID NO: 5180301 - DNA, 16 bp, Homo sapiens
agaccaagtctctcta

SEQ ID NO: 5180302 - DNA, 13 bp, Homo sapiens
agaccaataaact

SEQ ID NO: 5180303 - DNA, 22 bp, Homo sapiens
agaccaataggtgcaaaaataa

SEQ ID NO: 5180304 - DNA, 16 bp, Homo sapiens
agaccacaaaaattga

SEQ ID NO: 5180305 - DNA, 21 bp, Homo sapiens
agaccacaaatagtgctcgct

SEQ ID NO: 5180306 - DNA, 17 bp, Homo sapiens
agaccacagagctgtca

SEQ ID NO: 5180307 - DNA, 20 bp, Homo sapiens
agaccacagggttcaaaatg

SEQ ID NO: 5180308 - DNA, 23 bp, Homo sapiens
agaccacatctttatctgttctt

SEQ ID NO: 5180309 - DNA, 21 bp, Homo sapiens
agaccaccagccgccccagcc

SEQ ID NO: 5180310 - DNA, 23 bp, Homo sapiens
agaccaccagccgccccagcccc

SEQ ID NO: 5180311 - DNA, 19 bp, Homo sapiens
agaccaccagggtcccagg

SEQ ID NO: 5180312 - DNA, 20 bp, Homo sapiens
agaccaccagggtcccagga

SEQ ID NO: 5180313 - DNA, 19 bp, Homo sapiens
agaccacccatatcatgca

SEQ ID NO: 5180314 - DNA, 22 bp, Homo sapiens
agaccacccccgagcttgcctc

SEQ ID NO: 5180315 - DNA, 16 bp, Homo sapiens
agaccaccccgcctgc

SEQ ID NO: 5180316 - DNA, 18 bp, Homo sapiens
agaccaccgcgcccctct

SEQ ID NO: 5180317 - DNA, 22 bp, Homo sapiens
agaccaccgcgcccctctgcgc

SEQ ID NO: 5180318 - DNA, 21 bp, Homo sapiens
agaccacctgccagccatcac

SEQ ID NO: 5180319 - DNA, 23 bp, Homo sapiens
agaccacctgccagccatcacaa

SEQ ID NO: 5180320 - DNA, 17 bp, Homo sapiens
agaccacctgcttctga

SEQ ID NO: 5180321 - DNA, 21 bp, Homo sapiens
agaccaccttcccttcctcag

SEQ ID NO: 5180322 - DNA, 14 bp, Homo sapiens
agaccacgcccctg

SEQ ID NO: 5180323 - DNA, 20 bp, Homo sapiens
agaccacgcccgtcctgcct

SEQ ID NO: 5180324 - DNA, 21 bp, Homo sapiens
agaccacgcccgtcctgcctg

SEQ ID NO: 5180325 - DNA, 16 bp, Homo sapiens
agaccactgagtacca

SEQ ID NO: 5180326 - DNA, 12 bp, Homo sapiens
agaccactgtct

SEQ ID NO: 5180327 - DNA, 19 bp, Homo sapiens
agaccacttccttaacagc

SEQ ID NO: 5180328 - DNA, 21 bp, Homo sapiens
agaccagaagtgaatgggaaa

SEQ ID NO: 5180329 - DNA, 22 bp, Homo sapiens
agaccagactgtggagaaataa

SEQ ID NO: 5180330 - DNA, 15 bp, Homo sapiens
agaccagagctctgg

SEQ ID NO: 5180331 - DNA, 20 bp, Homo sapiens
agaccagagctctggagcca

SEQ ID NO: 5180332 - DNA, 18 bp, Homo sapiens
agaccagattaaacttca

SEQ ID NO: 5180333 - DNA, 15 bp, Homo sapiens
agaccagcactcagc

SEQ ID NO: 5180334 - DNA, 16 bp, Homo sapiens
agaccagcagacagag

SEQ ID NO: 5180335 - DNA, 20 bp, Homo sapiens
agatatcaatactaagtgac

SEQ ID NO: 5180336 - DNA, 23 bp, Homo sapiens
agatatcatactgatttttaagt

SEQ ID NO: 5180337 - DNA, 23 bp, Homo sapiens
agatatcatctacctagatttaa

SEQ ID NO: 5180338 - DNA, 17 bp, Homo sapiens
agatatcatgaaagaat

SEQ ID NO: 5180339 - DNA, 12 bp, Homo sapiens
agatatccaaac

SEQ ID NO: 5180340 - DNA, 15 bp, Homo sapiens
agatatccaaacaag

SEQ ID NO: 5180341 - DNA, 16 bp, Homo sapiens
agatatccaaacaaga

SEQ ID NO: 5180342 - DNA, 18 bp, Homo sapiens
agatatccaaacaagact

SEQ ID NO: 5180343 - DNA, 22 bp, Homo sapiens
agatatccaaacaagactgctc

SEQ ID NO: 5180344 - DNA, 15 bp, Homo sapiens
agatatccatctttt

SEQ ID NO: 5180345 - DNA, 22 bp, Homo sapiens
agatatcccagctttaaaaaga

SEQ ID NO: 5180346 - DNA, 19 bp, Homo sapiens
agatatcctctgcttaaaa

SEQ ID NO: 5180347 - DNA, 13 bp, Homo sapiens
agatatctatgac

SEQ ID NO: 5180348 - DNA, 16 bp, Homo sapiens
agatatctatgactgt

SEQ ID NO: 5180349 - DNA, 23 bp, Homo sapiens
agatatctatgactgtgtttaat

SEQ ID NO: 5180350 - DNA, 14 bp, Homo sapiens
agatatctatggca

SEQ ID NO: 5180351 - DNA, 15 bp, Homo sapiens
agatatctcaatgaa

SEQ ID NO: 5180352 - DNA, 21 bp, Homo sapiens
agatatctgagggaggaggcc

SEQ ID NO: 5180353 - DNA, 18 bp, Homo sapiens
agatatctgcatgtgtca

SEQ ID NO: 5180354 - DNA, 17 bp, Homo sapiens
agatatcttgaaatgaa

SEQ ID NO: 5180355 - DNA, 19 bp, Homo sapiens
agatatcttggacaaatca

SEQ ID NO: 5180356 - DNA, 18 bp, Homo sapiens
agatatctttttattgat

SEQ ID NO: 5180357 - DNA, 24 bp, Homo sapiens
agatatctttttattgatgtgcaa

SEQ ID NO: 5180358 - DNA, 14 bp, Homo sapiens
agatatgaatatat

SEQ ID NO: 5180359 - DNA, 23 bp, Homo sapiens
agatatgagaaatataaaaataa

SEQ ID NO: 5180360 - DNA, 16 bp, Homo sapiens
agatatgatatgtaaa

SEQ ID NO: 5180361 - DNA, 15 bp, Homo sapiens
agatatgattcaaat

SEQ ID NO: 5180362 - DNA, 14 bp, Homo sapiens
agatatgcattcaa

SEQ ID NO: 5180363 - DNA, 12 bp, Homo sapiens
agatatggaaac

SEQ ID NO: 5180364 - DNA, 18 bp, Homo sapiens
agatatggaaacagaaga

SEQ ID NO: 5180365 - DNA, 23 bp, Homo sapiens
agatatggaagaacgaggtttat

SEQ ID NO: 5180366 - DNA, 22 bp, Homo sapiens
agatatggagtgagtcacctgc

SEQ ID NO: 5180367 - DNA, 17 bp, Homo sapiens
agatatgggacattttt

SEQ ID NO: 5180368 - DNA, 13 bp, Homo sapiens
agatatgtatatt

SEQ ID NO: 5180369 - DNA, 16 bp, Homo sapiens
agatatgtgagaactt

SEQ ID NO: 5180370 - DNA, 14 bp, Homo sapiens
agatattaaattct

SEQ ID NO: 5180371 - DNA, 21 bp, Homo sapiens
agatattaaattctcaaagtt

SEQ ID NO: 5180372 - DNA, 18 bp, Homo sapiens
agatattaatgcccagac

SEQ ID NO: 5180373 - DNA, 14 bp, Homo sapiens
agatattactttat

SEQ ID NO: 5180374 - DNA, 16 bp, Homo sapiens
agatattactttatca

SEQ ID NO: 5180375 - DNA, 14 bp, Homo sapiens
agatattatgtata

SEQ ID NO: 5180376 - DNA, 16 bp, Homo sapiens
agatattatgtataaa

SEQ ID NO: 5180377 - DNA, 22 bp, Homo sapiens
agatattatgtataaaatgtaa

SEQ ID NO: 5180378 - DNA, 19 bp, Homo sapiens
agatattatgtatagaaaa

SEQ ID NO: 5180379 - DNA, 12 bp, Homo sapiens
agatattattca

SEQ ID NO: 5180380 - DNA, 22 bp, Homo sapiens
agatattatttatcgaaagtaa

SEQ ID NO: 5180381 - DNA, 14 bp, Homo sapiens
agatattattttaa

SEQ ID NO: 5180382 - DNA, 19 bp, Homo sapiens
agatattattttaaatttc

SEQ ID NO: 5180383 - DNA, 21 bp, Homo sapiens
agatattcattaataggaaag

SEQ ID NO: 5180384 - DNA, 20 bp, Homo sapiens
agatattcattggcagctca

SEQ ID NO: 5180385 - DNA, 18 bp, Homo sapiens
agatattcctattgtgca

SEQ ID NO: 5180386 - DNA, 20 bp, Homo sapiens
agatattctctagtcatttg

SEQ ID NO: 5180387 - DNA, 13 bp, Homo sapiens
agatattcttatt

SEQ ID NO: 5180388 - DNA, 12 bp, Homo sapiens
agatattcttta

SEQ ID NO: 5180389 - DNA, 15 bp, Homo sapiens
agatattctttacaa

SEQ ID NO: 5180390 - DNA, 14 bp, Homo sapiens
agatattgctacta

SEQ ID NO: 5180391 - DNA, 14 bp, Homo sapiens
agatattggacaaa

SEQ ID NO: 5180392 - DNA, 22 bp, Homo sapiens
agatattgggacacacatcaaa

SEQ ID NO: 5180393 - DNA, 15 bp, Homo sapiens
agatattgtacataa

SEQ ID NO: 5180394 - DNA, 19 bp, Homo sapiens
agatattgtacataaaaga

SEQ ID NO: 5180395 - DNA, 20 bp, Homo sapiens
agatattgtatctcctttaa

SEQ ID NO: 5180396 - DNA, 14 bp, Homo sapiens
agatattgtattat

SEQ ID NO: 5180397 - DNA, 15 bp, Homo sapiens
agatattgtattatc

SEQ ID NO: 5180398 - DNA, 16 bp, Homo sapiens
agatattgtattatca

SEQ ID NO: 5180399 - DNA, 23 bp, Homo sapiens
agatattgtattatcatatatgc

SEQ ID NO: 5180400 - DNA, 22 bp, Homo sapiens
agatattgtcagagttctgctc

SEQ ID NO: 5180401 - DNA, 19 bp, Homo sapiens
agatattgtgaagtacata

SEQ ID NO: 5180402 - DNA, 17 bp, Homo sapiens
agatattgttttctgta

SEQ ID NO: 5180403 - DNA, 16 bp, Homo sapiens
agatatttaaaagaca

SEQ ID NO: 5180404 - DNA, 12 bp, Homo sapiens
agatatttaaat

SEQ ID NO: 5180405 - DNA, 13 bp, Homo sapiens
agatatttaaatt

SEQ ID NO: 5180406 - DNA, 15 bp, Homo sapiens
agatatttaaattta

SEQ ID NO: 5180407 - DNA, 14 bp, Homo sapiens
agatatttatatat

SEQ ID NO: 5180408 - DNA, 23 bp, Homo sapiens
agatatttcaagctcatgtcatt

SEQ ID NO: 5180409 - DNA, 20 bp, Homo sapiens
agatatttccatttcttcct

SEQ ID NO: 5180410 - DNA, 13 bp, Homo sapiens
agatatttcttat

SEQ ID NO: 5180411 - DNA, 12 bp, Homo sapiens
agatatttgaaa

SEQ ID NO: 5180412 - DNA, 18 bp, Homo sapiens
agatatttgatgtagttt

SEQ ID NO: 5180413 - DNA, 12 bp, Homo sapiens
agatatttggct

SEQ ID NO: 5180414 - DNA, 15 bp, Homo sapiens
agatattttatatgt

SEQ ID NO: 5180415 - DNA, 16 bp, Homo sapiens
agatattttatatgta

SEQ ID NO: 5180416 - DNA, 13 bp, Homo sapiens
agatattttattt

SEQ ID NO: 5180417 - DNA, 14 bp, Homo sapiens
agatattttccata

SEQ ID NO: 5180418 - DNA, 20 bp, Homo sapiens
agatattttgctttgtgatt

SEQ ID NO: 5180419 - DNA, 21 bp, Homo sapiens
agatattttgctttgtgattt

SEQ ID NO: 5180420 - DNA, 17 bp, Homo sapiens
agatattttgggcatgt

SEQ ID NO: 5180421 - DNA, 19 bp, Homo sapiens
agatattttgggcatgtgg

SEQ ID NO: 5180422 - DNA, 21 bp, Homo sapiens
agatattttgtaaaatgtatt

SEQ ID NO: 5180423 - DNA, 22 bp, Homo sapiens
agatatttttaacttaatggca

SEQ ID NO: 5180424 - DNA, 17 bp, Homo sapiens
agatatttttatcttta

SEQ ID NO: 5180425 - DNA, 21 bp, Homo sapiens
agatatttttatctttatatg

SEQ ID NO: 5180426 - DNA, 22 bp, Homo sapiens
agatatttttattcaaactacc

SEQ ID NO: 5180427 - DNA, 16 bp, Homo sapiens
agatatttttcatgat

SEQ ID NO: 5180428 - DNA, 17 bp, Homo sapiens
agatatttttgtacgtt

SEQ ID NO: 5180429 - DNA, 19 bp, Homo sapiens
agatattttttcagaaata

SEQ ID NO: 5180430 - DNA, 13 bp, Homo sapiens
agatattttttct

SEQ ID NO: 5180431 - DNA, 17 bp, Homo sapiens
agatcaaagtatgtatg

SEQ ID NO: 5180432 - DNA, 17 bp, Homo sapiens
agatcaacaataaaaaa

SEQ ID NO: 5180433 - DNA, 18 bp, Homo sapiens
agatcaacattccagggt

SEQ ID NO: 5180434 - DNA, 16 bp, Homo sapiens
agatcaacgcctcact

SEQ ID NO: 5180435 - DNA, 22 bp, Homo sapiens
agatcaagaatcttttgtgaaa

SEQ ID NO: 5180436 - DNA, 15 bp, Homo sapiens
agatcaagagatcaa

SEQ ID NO: 5180437 - DNA, 12 bp, Homo sapiens
agatcaagctgt

SEQ ID NO: 5180438 - DNA, 16 bp, Homo sapiens
agatcaaggagaggag

SEQ ID NO: 5180439 - DNA, 18 bp, Homo sapiens
agatcaaggagcccagaa

SEQ ID NO: 5180440 - DNA, 16 bp, Homo sapiens
agatcaaggcaaaaat

SEQ ID NO: 5180441 - DNA, 14 bp, Homo sapiens
agatcaataaatgt

SEQ ID NO: 5180442 - DNA, 13 bp, Homo sapiens
agatcaatgtgac

SEQ ID NO: 5180443 - DNA, 15 bp, Homo sapiens
agatcaattccctct

SEQ ID NO: 5180444 - DNA, 16 bp, Homo sapiens
agatcaattccctctc

SEQ ID NO: 5180445 - DNA, 21 bp, Homo sapiens
agatcaatttgtaattgctta

SEQ ID NO: 5180446 - DNA, 15 bp, Homo sapiens
agatcacaactgaag

SEQ ID NO: 5180447 - DNA, 20 bp, Homo sapiens
agatcacaactgaagataac

SEQ ID NO: 5180448 - DNA, 15 bp, Homo sapiens
agatcacagccccac

SEQ ID NO: 5180449 - DNA, 15 bp, Homo sapiens
agatcacagcctcca

SEQ ID NO: 5180450 - DNA, 20 bp, Homo sapiens
agatcacagcctccagggcc

SEQ ID NO: 5180451 - DNA, 15 bp, Homo sapiens
agatcacagtggcca

SEQ ID NO: 5180452 - DNA, 18 bp, Homo sapiens
agatcacataacagaatg

SEQ ID NO: 5180453 - DNA, 15 bp, Homo sapiens
agatcacatgcccct

SEQ ID NO: 5180454 - DNA, 15 bp, Homo sapiens
agatcaccagaataa

SEQ ID NO: 5180455 - DNA, 14 bp, Homo sapiens
agatcaccttgtat

SEQ ID NO: 5180456 - DNA, 17 bp, Homo sapiens
agatcaccttgtattct

SEQ ID NO: 5180457 - DNA, 18 bp, Homo sapiens
agatcacgccactgcact

SEQ ID NO: 5180458 - DNA, 22 bp, Homo sapiens
agatcacgccactgcactccag

SEQ ID NO: 5180459 - DNA, 22 bp, Homo sapiens
agatcacgccattgtactccag

SEQ ID NO: 5180460 - DNA, 23 bp, Homo sapiens
agatcacgctccccgcctgttcc

SEQ ID NO: 5180461 - DNA, 14 bp, Homo sapiens
agatcactactgca

SEQ ID NO: 5180462 - DNA, 12 bp, Homo sapiens
agatcactcctg

SEQ ID NO: 5180463 - DNA, 17 bp, Homo sapiens
agatcactcctggaggc

SEQ ID NO: 5180464 - DNA, 14 bp, Homo sapiens
agatcactgccaca

SEQ ID NO: 5180465 - DNA, 15 bp, Homo sapiens
agatcactgtttaga

SEQ ID NO: 5180466 - DNA, 16 bp, Homo sapiens
agatcacttgatgcca

SEQ ID NO: 5180467 - DNA, 21 bp, Homo sapiens
agatcacttgtcctcttgcca

SEQ ID NO: 5180468 - DNA, 19 bp, Homo sapiens
agatcactttctcagtttt

SEQ ID NO: 5180469 - DNA, 23 bp, Homo sapiens
agatcactttctcagttttcata

SEQ ID NO: 5180470 - DNA, 20 bp, Homo sapiens
agatcagaaaaatggagcaa

SEQ ID NO: 5180471 - DNA, 18 bp, Homo sapiens
agatcagaaagtgacatt

SEQ ID NO: 5180472 - DNA, 15 bp, Homo sapiens
agatcagaacatgaa

SEQ ID NO: 5180473 - DNA, 14 bp, Homo sapiens
agatcagaacattc

SEQ ID NO: 5180474 - DNA, 21 bp, Homo sapiens
agatcagattaaaaacaccat

SEQ ID NO: 5180475 - DNA, 16 bp, Homo sapiens
agatcagcattcaaaa

SEQ ID NO: 5180476 - DNA, 17 bp, Homo sapiens
agatcagcattcaaaat

SEQ ID NO: 5180477 - DNA, 24 bp, Homo sapiens
agatcagcattcaaaatagttcta

SEQ ID NO: 5180478 - DNA, 14 bp, Homo sapiens
agatcagccagaag

SEQ ID NO: 5180479 - DNA, 13 bp, Homo sapiens
agatcagccatta

SEQ ID NO: 5180480 - DNA, 23 bp, Homo sapiens
agatcagccattaaaataaaaca

SEQ ID NO: 5180481 - DNA, 21 bp, Homo sapiens
agatcagctattcccttctga

SEQ ID NO: 5180482 - DNA, 14 bp, Homo sapiens
agatcaggaaccag

SEQ ID NO: 5180483 - DNA, 18 bp, Homo sapiens
agatcaggaaccagggcc

SEQ ID NO: 5180484 - DNA, 20 bp, Homo sapiens
agatcaggaaccagggcctc

SEQ ID NO: 5180485 - DNA, 21 bp, Homo sapiens
agatcaggaaccagggcctcc

SEQ ID NO: 5180486 - DNA, 13 bp, Homo sapiens
agatcaggaagag

SEQ ID NO: 5180487 - DNA, 21 bp, Homo sapiens
agatcaggaattctaaataaa

SEQ ID NO: 5180488 - DNA, 16 bp, Homo sapiens
agatcaggatcagctt

SEQ ID NO: 5180489 - DNA, 18 bp, Homo sapiens
agatcaggcagtgtttaa

SEQ ID NO: 5180490 - DNA, 21 bp, Homo sapiens
agatcagggatagcgctgttg

SEQ ID NO: 5180491 - DNA, 18 bp, Homo sapiens
agatcagggcctgccccc

SEQ ID NO: 5180492 - DNA, 20 bp, Homo sapiens
agatcaggtcagagcccagg

SEQ ID NO: 5180493 - DNA, 12 bp, Homo sapiens
agatcaggtttg

SEQ ID NO: 5180494 - DNA, 18 bp, Homo sapiens
agatcataggaagtggct

SEQ ID NO: 5180495 - DNA, 19 bp, Homo sapiens
agatcataggaagtggctg

SEQ ID NO: 5180496 - DNA, 18 bp, Homo sapiens
agatcatatacgtgaaaa

SEQ ID NO: 5180497 - DNA, 15 bp, Homo sapiens
agatcatccccgagg

SEQ ID NO: 5180498 - DNA, 14 bp, Homo sapiens
agatcatccgtctg

SEQ ID NO: 5180499 - DNA, 13 bp, Homo sapiens
agatcatcttgaa

SEQ ID NO: 5180500 - DNA, 24 bp, Homo sapiens
agatcatggacctggtgcccctgc

SEQ ID NO: 5180501 - DNA, 14 bp, Homo sapiens
agatcatggcatcc

SEQ ID NO: 5180502 - DNA, 19 bp, Homo sapiens
agatcattctccttgtaaa

SEQ ID NO: 5180503 - DNA, 19 bp, Homo sapiens
agatcattggagtttagga

SEQ ID NO: 5180504 - DNA, 12 bp, Homo sapiens
agatcattgtga

SEQ ID NO: 5180505 - DNA, 20 bp, Homo sapiens
agatcatttataatactgtt

SEQ ID NO: 5180506 - DNA, 21 bp, Homo sapiens
agatcatttataatactgttt

SEQ ID NO: 5180507 - DNA, 16 bp, Homo sapiens
agatcattttttgtct

SEQ ID NO: 5180508 - DNA, 21 bp, Homo sapiens
agatcattttttgtctatttt

SEQ ID NO: 5180509 - DNA, 23 bp, Homo sapiens
agatccaaaagaagcccccagct

SEQ ID NO: 5180510 - DNA, 12 bp, Homo sapiens
agatccaaagac

SEQ ID NO: 5180511 - DNA, 15 bp, Homo sapiens
agatccaaatgtaaa

SEQ ID NO: 5180512 - DNA, 21 bp, Homo sapiens
agatccaagatgtttggacac

SEQ ID NO: 5180513 - DNA, 21 bp, Homo sapiens
agatccaagctcctattagaa

SEQ ID NO: 5180514 - DNA, 12 bp, Homo sapiens
agaccagccctt

SEQ ID NO: 5180515 - DNA, 21 bp, Homo sapiens
agaccagcccttccccatcct

SEQ ID NO: 5180516 - DNA, 14 bp, Homo sapiens
agaccagcctcgcc

SEQ ID NO: 5180517 - DNA, 18 bp, Homo sapiens
agaccagcctgccaggcc

SEQ ID NO: 5180518 - DNA, 17 bp, Homo sapiens
agaccagcctgggcaac

SEQ ID NO: 5180519 - DNA, 18 bp, Homo sapiens
agaccagcctgggcaaca

SEQ ID NO: 5180520 - DNA, 14 bp, Homo sapiens
agaccagcctttct

SEQ ID NO: 5180521 - DNA, 11 bp, Homo sapiens
agaccagctca

SEQ ID NO: 5180522 - DNA, 14 bp, Homo sapiens
agaccagctcagag

SEQ ID NO: 5180523 - DNA, 15 bp, Homo sapiens
agaccagctcagagg

SEQ ID NO: 5180524 - DNA, 13 bp, Homo sapiens
agaccaggaaagg

SEQ ID NO: 5180525 - DNA, 22 bp, Homo sapiens
agaccaggactctgccttccag

SEQ ID NO: 5180526 - DNA, 16 bp, Homo sapiens
agaccaggcaaagcaa

SEQ ID NO: 5180527 - DNA, 13 bp, Homo sapiens
agaccaggccctg

SEQ ID NO: 5180528 - DNA, 16 bp, Homo sapiens
agaccaggctgcagcc

SEQ ID NO: 5180529 - DNA, 22 bp, Homo sapiens
agaccaggctgcagcctccact

SEQ ID NO: 5180530 - DNA, 12 bp, Homo sapiens
agaccagggctc

SEQ ID NO: 5180531 - DNA, 18 bp, Homo sapiens
agaccagggctccagccc

SEQ ID NO: 5180532 - DNA, 21 bp, Homo sapiens
agaccagggctgctctttcca

SEQ ID NO: 5180533 - DNA, 18 bp, Homo sapiens
agaccagggcttttccca

SEQ ID NO: 5180534 - DNA, 20 bp, Homo sapiens
agaccaggggaccagaggga

SEQ ID NO: 5180535 - DNA, 23 bp, Homo sapiens
agaccaggggaccagagggatgg

SEQ ID NO: 5180536 - DNA, 19 bp, Homo sapiens
agaccagggtggccacaca

SEQ ID NO: 5180537 - DNA, 22 bp, Homo sapiens
agaccagggtggccacacaggc

SEQ ID NO: 5180538 - DNA, 22 bp, Homo sapiens
agaccaggtgctcagcccaggc

SEQ ID NO: 5180539 - DNA, 15 bp, Homo sapiens
agaccaggtggaatt

SEQ ID NO: 5180540 - DNA, 13 bp, Homo sapiens
agaccagtactgg

SEQ ID NO: 5180541 - DNA, 22 bp, Homo sapiens
agaccagtcacagccatttcaa

SEQ ID NO: 5180542 - DNA, 13 bp, Homo sapiens
agaccagtgaccc

SEQ ID NO: 5180543 - DNA, 21 bp, Homo sapiens
agaccagtggtctggaaacag

SEQ ID NO: 5180544 - DNA, 22 bp, Homo sapiens
agaccagtggtctggaaacagc

SEQ ID NO: 5180545 - DNA, 21 bp, Homo sapiens
agaccagttgggagcactgga

SEQ ID NO: 5180546 - DNA, 14 bp, Homo sapiens
agaccataagagaa

SEQ ID NO: 5180547 - DNA, 21 bp, Homo sapiens
agaccataagagaaacctgcc

SEQ ID NO: 5180548 - DNA, 15 bp, Homo sapiens
agaccatagtgacca

SEQ ID NO: 5180549 - DNA, 20 bp, Homo sapiens
agaccatataactgtgatga

SEQ ID NO: 5180550 - DNA, 19 bp, Homo sapiens
agaccatattacctggatt

SEQ ID NO: 5180551 - DNA, 17 bp, Homo sapiens
agaccatccaccaggcc

SEQ ID NO: 5180552 - DNA, 14 bp, Homo sapiens
agaccatccctgaa

SEQ ID NO: 5180553 - DNA, 16 bp, Homo sapiens
agaccatccctgaaga

SEQ ID NO: 5180554 - DNA, 18 bp, Homo sapiens
agaccatccctgaaggcc

SEQ ID NO: 5180555 - DNA, 23 bp, Homo sapiens
agaccatccctgaaggccccgcc

SEQ ID NO: 5180556 - DNA, 16 bp, Homo sapiens
agaccatcctggcccc

SEQ ID NO: 5180557 - DNA, 17 bp, Homo sapiens
agaccatcctggcccct

SEQ ID NO: 5180558 - DNA, 18 bp, Homo sapiens
agaccatcctggcccctc

SEQ ID NO: 5180559 - DNA, 15 bp, Homo sapiens
agaccatcctggcta

SEQ ID NO: 5180560 - DNA, 18 bp, Homo sapiens
agaccatctcctatcttt

SEQ ID NO: 5180561 - DNA, 23 bp, Homo sapiens
agaccatctctccctcctggtga

SEQ ID NO: 5180562 - DNA, 22 bp, Homo sapiens
agaccatgaagtaaattatgta

SEQ ID NO: 5180563 - DNA, 16 bp, Homo sapiens
agaccatgcagagcgc

SEQ ID NO: 5180564 - DNA, 16 bp, Homo sapiens
agaccatgcattcaga

SEQ ID NO: 5180565 - DNA, 18 bp, Homo sapiens
agaccatgcattcagatc

SEQ ID NO: 5180566 - DNA, 12 bp, Homo sapiens
agaccatggaca

SEQ ID NO: 5180567 - DNA, 21 bp, Homo sapiens
agaccatggacactacaccca

SEQ ID NO: 5180568 - DNA, 17 bp, Homo sapiens
agaccatgtcttatctt

SEQ ID NO: 5180569 - DNA, 20 bp, Homo sapiens
agaccatgtggtttgctgtt

SEQ ID NO: 5180570 - DNA, 17 bp, Homo sapiens
agaccattaactagttt

SEQ ID NO: 5180571 - DNA, 15 bp, Homo sapiens
agaccattctgtgac

SEQ ID NO: 5180572 - DNA, 18 bp, Homo sapiens
agaccattggggctccca

SEQ ID NO: 5180573 - DNA, 20 bp, Homo sapiens
agaccattggggctcccagc

SEQ ID NO: 5180574 - DNA, 16 bp, Homo sapiens
agaccattgtcttcca

SEQ ID NO: 5180575 - DNA, 18 bp, Homo sapiens
agaccattgtcttccaac

SEQ ID NO: 5180576 - DNA, 20 bp, Homo sapiens
agaccattgtcttccaaccc

SEQ ID NO: 5180577 - DNA, 22 bp, Homo sapiens
agaccattgtcttccaacccca

SEQ ID NO: 5180578 - DNA, 23 bp, Homo sapiens
agaccattgtcttccaaccccag

SEQ ID NO: 5180579 - DNA, 21 bp, Homo sapiens
agaccatttagtcctcacctt

SEQ ID NO: 5180580 - DNA, 16 bp, Homo sapiens
agaccatttttaaatg

SEQ ID NO: 5180581 - DNA, 16 bp, Homo sapiens
agacccaaaacagctt

SEQ ID NO: 5180582 - DNA, 17 bp, Homo sapiens
agacccaaaacagcttt

SEQ ID NO: 5180583 - DNA, 17 bp, Homo sapiens
agacccaaaaggcagaa

SEQ ID NO: 5180584 - DNA, 22 bp, Homo sapiens
agacccaaattataagggccct

SEQ ID NO: 5180585 - DNA, 14 bp, Homo sapiens
agacccaacaatga

SEQ ID NO: 5180586 - DNA, 14 bp, Homo sapiens
agacccaataaaga

SEQ ID NO: 5180587 - DNA, 23 bp, Homo sapiens
agacccaataaagaatgcaatcc

SEQ ID NO: 5180588 - DNA, 14 bp, Homo sapiens
agacccacacatgt

SEQ ID NO: 5180589 - DNA, 16 bp, Homo sapiens
agacccacagccctga

SEQ ID NO: 5180590 - DNA, 14 bp, Homo sapiens
agacccaccatcct

SEQ ID NO: 5180591 - DNA, 21 bp, Homo sapiens
agacccaccatccttccatcc

SEQ ID NO: 5180592 - DNA, 17 bp, Homo sapiens
agacccaccccacctgc

SEQ ID NO: 5180593 - DNA, 15 bp, Homo sapiens
agacccacccccagc

SEQ ID NO: 5180594 - DNA, 20 bp, Homo sapiens
agacccacctgaggctcagc

SEQ ID NO: 5180595 - DNA, 22 bp, Homo sapiens
agacccagagccctctgagccg

SEQ ID NO: 5180596 - DNA, 20 bp, Homo sapiens
agacccagaggccctgaagc

SEQ ID NO: 5180597 - DNA, 16 bp, Homo sapiens
agacccagaggtccag

SEQ ID NO: 5180598 - DNA, 14 bp, Homo sapiens
agacccagatgtga

SEQ ID NO: 5180599 - DNA, 21 bp, Homo sapiens
agacccagcccgcggcctgga

SEQ ID NO: 5180600 - DNA, 22 bp, Homo sapiens
agacccagcccgcggcctggac

SEQ ID NO: 5180601 - DNA, 19 bp, Homo sapiens
agacccagccctcatcccg

SEQ ID NO: 5180602 - DNA, 15 bp, Homo sapiens
agacccagccgccgc

SEQ ID NO: 5180603 - DNA, 19 bp, Homo sapiens
agacccagctgcagaccat

SEQ ID NO: 5180604 - DNA, 13 bp, Homo sapiens
agacccaggactc

SEQ ID NO: 5180605 - DNA, 14 bp, Homo sapiens
agacccaggactcc

SEQ ID NO: 5180606 - DNA, 15 bp, Homo sapiens
agacccaggagtcca

SEQ ID NO: 5180607 - DNA, 16 bp, Homo sapiens
agacccaggagtccag

SEQ ID NO: 5180608 - DNA, 19 bp, Homo sapiens
agacccaggagtccagacc

SEQ ID NO: 5180609 - DNA, 17 bp, Homo sapiens
agacccaggagtccagc

SEQ ID NO: 5180610 - DNA, 16 bp, Homo sapiens
agacccaggcctgtgg

SEQ ID NO: 5180611 - DNA, 19 bp, Homo sapiens
agacccaggggtccaggcc

SEQ ID NO: 5180612 - DNA, 18 bp, Homo sapiens
agacccaggtcttccaga

SEQ ID NO: 5180613 - DNA, 23 bp, Homo sapiens
agacccaggtcttccagacctgc

SEQ ID NO: 5180614 - DNA, 21 bp, Homo sapiens
agacccaggtggagggcacag

SEQ ID NO: 5180615 - DNA, 16 bp, Homo sapiens
agacccagtgcactcc

SEQ ID NO: 5180616 - DNA, 23 bp, Homo sapiens
agacccagtgtaaagaataaatg

SEQ ID NO: 5180617 - DNA, 18 bp, Homo sapiens
agacccatacctttccag

SEQ ID NO: 5180618 - DNA, 15 bp, Homo sapiens
agacccatctggagg

SEQ ID NO: 5180619 - DNA, 11 bp, Homo sapiens
agacccatgct

SEQ ID NO: 5180620 - DNA, 19 bp, Homo sapiens
agacccatgtgctgggaaa

SEQ ID NO: 5180621 - DNA, 15 bp, Homo sapiens
agacccattcctatt

SEQ ID NO: 5180622 - DNA, 16 bp, Homo sapiens
agacccattcctattt

SEQ ID NO: 5180623 - DNA, 21 bp, Homo sapiens
agacccattccttagctattt

SEQ ID NO: 5180624 - DNA, 19 bp, Homo sapiens
agaccccaagaggaagttc

SEQ ID NO: 5180625 - DNA, 14 bp, Homo sapiens
agaccccaagcatt

SEQ ID NO: 5180626 - DNA, 16 bp, Homo sapiens
agaccccacccaagct

SEQ ID NO: 5180627 - DNA, 17 bp, Homo sapiens
agaccccacgctgacca

SEQ ID NO: 5180628 - DNA, 17 bp, Homo sapiens
agaccccagttctaggg

SEQ ID NO: 5180629 - DNA, 18 bp, Homo sapiens
agaccccatggtccatcc

SEQ ID NO: 5180630 - DNA, 13 bp, Homo sapiens
agacccccacacc

SEQ ID NO: 5180631 - DNA, 11 bp, Homo sapiens
agacccccacc

SEQ ID NO: 5180632 - DNA, 20 bp, Homo sapiens
agacccccaccccttcccca

SEQ ID NO: 5180633 - DNA, 12 bp, Homo sapiens
agacccccactc

SEQ ID NO: 5180634 - DNA, 20 bp, Homo sapiens
agacccccagcaaccctcct

SEQ ID NO: 5180635 - DNA, 14 bp, Homo sapiens
agacccccaggcct

SEQ ID NO: 5180636 - DNA, 14 bp, Homo sapiens
agacccccatccag

SEQ ID NO: 5180637 - DNA, 15 bp, Homo sapiens
agacccccatccagc

SEQ ID NO: 5180638 - DNA, 17 bp, Homo sapiens
agacccccatccagcct

SEQ ID NO: 5180639 - DNA, 18 bp, Homo sapiens
agacccccatccagcctc

SEQ ID NO: 5180640 - DNA, 20 bp, Homo sapiens
agacccccatccagcctcca

SEQ ID NO: 5180641 - DNA, 22 bp, Homo sapiens
agacccccatccagcctccagg

SEQ ID NO: 5180642 - DNA, 23 bp, Homo sapiens
agacccccatccagcctccaggg

SEQ ID NO: 5180643 - DNA, 17 bp, Homo sapiens
agacccccatttgtccc

SEQ ID NO: 5180644 - DNA, 19 bp, Homo sapiens
agacccccatttgtcccag

SEQ ID NO: 5180645 - DNA, 21 bp, Homo sapiens
agaccccccagcccctcctcc

SEQ ID NO: 5180646 - DNA, 22 bp, Homo sapiens
agaccccccagcccctcctccc

SEQ ID NO: 5180647 - DNA, 22 bp, Homo sapiens
agacccccccatttcccgcaca

SEQ ID NO: 5180648 - DNA, 14 bp, Homo sapiens
agaccccctggaga

SEQ ID NO: 5180649 - DNA, 15 bp, Homo sapiens
agaccccctgtcctg

SEQ ID NO: 5180650 - DNA, 17 bp, Homo sapiens
agaccccgcacccggct

SEQ ID NO: 5180651 - DNA, 14 bp, Homo sapiens
agaccccgcactgc

SEQ ID NO: 5180652 - DNA, 15 bp, Homo sapiens
agaccccgcactgca

SEQ ID NO: 5180653 - DNA, 16 bp, Homo sapiens
agaccccggtggcagt

SEQ ID NO: 5180654 - DNA, 16 bp, Homo sapiens
agaccccgtggctctg

SEQ ID NO: 5180655 - DNA, 18 bp, Homo sapiens
agaccccgtggctctggg

SEQ ID NO: 5180656 - DNA, 19 bp, Homo sapiens
agaccccgtggctctggga

SEQ ID NO: 5180657 - DNA, 24 bp, Homo sapiens
agacccctaaccctttgtgtgctc

SEQ ID NO: 5180658 - DNA, 17 bp, Homo sapiens
agacccctaccctttcc

SEQ ID NO: 5180659 - DNA, 17 bp, Homo sapiens
agacccctcagccccag

SEQ ID NO: 5180660 - DNA, 13 bp, Homo sapiens
agacccctcccct

SEQ ID NO: 5180661 - DNA, 18 bp, Homo sapiens
agacccctctcaacaccc

SEQ ID NO: 5180662 - DNA, 17 bp, Homo sapiens
agacccctctggccagg

SEQ ID NO: 5180663 - DNA, 22 bp, Homo sapiens
agacccctctggccaggatgga

SEQ ID NO: 5180664 - DNA, 13 bp, Homo sapiens
agacccctggcct

SEQ ID NO: 5180665 - DNA, 13 bp, Homo sapiens
agacccctggctg

SEQ ID NO: 5180666 - DNA, 14 bp, Homo sapiens
agacccctggcttt

SEQ ID NO: 5180667 - DNA, 13 bp, Homo sapiens
agacccctgggag

SEQ ID NO: 5180668 - DNA, 12 bp, Homo sapiens
agacccctgggg

SEQ ID NO: 5180669 - DNA, 17 bp, Homo sapiens
agacccctgggtgggcc

SEQ ID NO: 5180670 - DNA, 23 bp, Homo sapiens
agacccctgggtgggccctgccg

SEQ ID NO: 5180671 - DNA, 14 bp, Homo sapiens
agacccctgtctcc

SEQ ID NO: 5180672 - DNA, 23 bp, Homo sapiens
agacccctgtctttgctgagagc

SEQ ID NO: 5180673 - DNA, 15 bp, Homo sapiens
agaccccttcctttc

SEQ ID NO: 5180674 - DNA, 18 bp, Homo sapiens
agaccccttcctttcctc

SEQ ID NO: 5180675 - DNA, 14 bp, Homo sapiens
agacccgggaagga

SEQ ID NO: 5180676 - DNA, 17 bp, Homo sapiens
agaccctaaatctgagg

SEQ ID NO: 5180677 - DNA, 22 bp, Homo sapiens
agaccctactgaagtggctggt

SEQ ID NO: 5180678 - DNA, 15 bp, Homo sapiens
agaccctaggtgctc

SEQ ID NO: 5180679 - DNA, 17 bp, Homo sapiens
agaccctcccctgcctc

SEQ ID NO: 5180680 - DNA, 15 bp, Homo sapiens
agaccctccttcccc

SEQ ID NO: 5180681 - DNA, 17 bp, Homo sapiens
agaccctccttccccac

SEQ ID NO: 5180682 - DNA, 22 bp, Homo sapiens
agaccctccttccccaccccat

SEQ ID NO: 5180683 - DNA, 17 bp, Homo sapiens
agaccctcgagattaac

SEQ ID NO: 5180684 - DNA, 12 bp, Homo sapiens
agaccctcgggc

SEQ ID NO: 5180685 - DNA, 19 bp, Homo sapiens
agaccctcgggccccatcc

SEQ ID NO: 5180686 - DNA, 16 bp, Homo sapiens
agaccctctcaaacta

SEQ ID NO: 5180687 - DNA, 15 bp, Homo sapiens
agaccctctcaggct

SEQ ID NO: 5180688 - DNA, 20 bp, Homo sapiens
agaccctctgccaccagaga

SEQ ID NO: 5180689 - DNA, 21 bp, Homo sapiens
agaccctctgccaccagagac

SEQ ID NO: 5180690 - DNA, 15 bp, Homo sapiens
agaccctcttgccca

SEQ ID NO: 5180691 - DNA, 18 bp, Homo sapiens
agaccctcttgcccatcc

SEQ ID NO: 5180692 - DNA, 23 bp, Homo sapiens
agaccctctttcttgtttgtcag

SEQ ID NO: 5180693 - DNA, 15 bp, Homo sapiens
agatccacacacaga

SEQ ID NO: 5180694 - DNA, 18 bp, Homo sapiens
agatccacacacagagga

SEQ ID NO: 5180695 - DNA, 15 bp, Homo sapiens
agatccacatcctct

SEQ ID NO: 5180696 - DNA, 16 bp, Homo sapiens
agatccacatcctcta

SEQ ID NO: 5180697 - DNA, 20 bp, Homo sapiens
agatccaccccctgcccaca

SEQ ID NO: 5180698 - DNA, 13 bp, Homo sapiens
agatccaccctca

SEQ ID NO: 5180699 - DNA, 15 bp, Homo sapiens
agatccacctgcaca

SEQ ID NO: 5180700 - DNA, 13 bp, Homo sapiens
agatccactggga

SEQ ID NO: 5180701 - DNA, 21 bp, Homo sapiens
agatccagagaggctggatga

SEQ ID NO: 5180702 - DNA, 13 bp, Homo sapiens
agatccagcccaa

SEQ ID NO: 5180703 - DNA, 21 bp, Homo sapiens
agatccagcccaaacctggga

SEQ ID NO: 5180704 - DNA, 17 bp, Homo sapiens
agatccaggaacacatg

SEQ ID NO: 5180705 - DNA, 18 bp, Homo sapiens
agatccaggaacacatgc

SEQ ID NO: 5180706 - DNA, 21 bp, Homo sapiens
agatccaggaacacatgcaca

SEQ ID NO: 5180707 - DNA, 16 bp, Homo sapiens
agatccaggagctcca

SEQ ID NO: 5180708 - DNA, 16 bp, Homo sapiens
agatccaggcaggagc

SEQ ID NO: 5180709 - DNA, 14 bp, Homo sapiens
agatccaggcttct

SEQ ID NO: 5180710 - DNA, 16 bp, Homo sapiens
agatccagtgtaaact

SEQ ID NO: 5180711 - DNA, 16 bp, Homo sapiens
agatccatccttttgc

SEQ ID NO: 5180712 - DNA, 23 bp, Homo sapiens
agatccatcggtttatactattt

SEQ ID NO: 5180713 - DNA, 18 bp, Homo sapiens
agatccattaatttaaat

SEQ ID NO: 5180714 - DNA, 15 bp, Homo sapiens
agatccatttaaaac

SEQ ID NO: 5180715 - DNA, 19 bp, Homo sapiens
agatccatttaaaacaagc

SEQ ID NO: 5180716 - DNA, 19 bp, Homo sapiens
agatccatttccattgctt

SEQ ID NO: 5180717 - DNA, 20 bp, Homo sapiens
agatccatttggacaaaatg

SEQ ID NO: 5180718 - DNA, 22 bp, Homo sapiens
agatccatttggacaaaatgga

SEQ ID NO: 5180719 - DNA, 22 bp, Homo sapiens
agatccattttttatatttcaa

SEQ ID NO: 5180720 - DNA, 20 bp, Homo sapiens
agatcccaacactgccagca

SEQ ID NO: 5180721 - DNA, 11 bp, Homo sapiens
agatcccaaga

SEQ ID NO: 5180722 - DNA, 17 bp, Homo sapiens
agatcccacatatttca

SEQ ID NO: 5180723 - DNA, 15 bp, Homo sapiens
agatcccactggaag

SEQ ID NO: 5180724 - DNA, 13 bp, Homo sapiens
agatcccagccca

SEQ ID NO: 5180725 - DNA, 14 bp, Homo sapiens
agatcccatattta

SEQ ID NO: 5180726 - DNA, 18 bp, Homo sapiens
agatccccaactgctcca

SEQ ID NO: 5180727 - DNA, 23 bp, Homo sapiens
agatccccaactgctccagcctc

SEQ ID NO: 5180728 - DNA, 13 bp, Homo sapiens
agatccccagccc

SEQ ID NO: 5180729 - DNA, 17 bp, Homo sapiens
agatccccagcccctcc

SEQ ID NO: 5180730 - DNA, 15 bp, Homo sapiens
agatccccagggcag

SEQ ID NO: 5180731 - DNA, 15 bp, Homo sapiens
agatcccccagaaaa

SEQ ID NO: 5180732 - DNA, 11 bp, Homo sapiens
agatcccctca

SEQ ID NO: 5180733 - DNA, 20 bp, Homo sapiens
agatccctattagatacact

SEQ ID NO: 5180734 - DNA, 20 bp, Homo sapiens
agatccgagcgacggctcct

SEQ ID NO: 5180735 - DNA, 16 bp, Homo sapiens
agatccgcatgtgtct

SEQ ID NO: 5180736 - DNA, 20 bp, Homo sapiens
agatccgcatgtgtctgtat

SEQ ID NO: 5180737 - DNA, 20 bp, Homo sapiens
agatccgccctgggctctgg

SEQ ID NO: 5180738 - DNA, 14 bp, Homo sapiens
agatcctaagatgt

SEQ ID NO: 5180739 - DNA, 15 bp, Homo sapiens
agatcctacccctga

SEQ ID NO: 5180740 - DNA, 12 bp, Homo sapiens
agatcctcctgc

SEQ ID NO: 5180741 - DNA, 17 bp, Homo sapiens
agatcctccttccaggc

SEQ ID NO: 5180742 - DNA, 14 bp, Homo sapiens
agatcctctggaca

SEQ ID NO: 5180743 - DNA, 21 bp, Homo sapiens
agatcctcttctcaaagctgg

SEQ ID NO: 5180744 - DNA, 21 bp, Homo sapiens
agatcctcttgccacatcttg

SEQ ID NO: 5180745 - DNA, 21 bp, Homo sapiens
agatcctctttccccactgaa

SEQ ID NO: 5180746 - DNA, 13 bp, Homo sapiens
agatcctgaagca

SEQ ID NO: 5180747 - DNA, 17 bp, Homo sapiens
agatcctgcgggtgggg

SEQ ID NO: 5180748 - DNA, 18 bp, Homo sapiens
agatcctgcgggtggggc

SEQ ID NO: 5180749 - DNA, 14 bp, Homo sapiens
agatcctgctgccg

SEQ ID NO: 5180750 - DNA, 24 bp, Homo sapiens
agatcctggagtgatatgatccag

SEQ ID NO: 5180751 - DNA, 16 bp, Homo sapiens
agatcctgggtttcca

SEQ ID NO: 5180752 - DNA, 22 bp, Homo sapiens
agatcctgtcccatgggctctg

SEQ ID NO: 5180753 - DNA, 13 bp, Homo sapiens
agatcctgtgagg

SEQ ID NO: 5180754 - DNA, 16 bp, Homo sapiens
agatccttcacaggca

SEQ ID NO: 5180755 - DNA, 15 bp, Homo sapiens
agatccttccttttg

SEQ ID NO: 5180756 - DNA, 14 bp, Homo sapiens
agatccttgtttca

SEQ ID NO: 5180757 - DNA, 15 bp, Homo sapiens
agatccttgtttcaa

SEQ ID NO: 5180758 - DNA, 18 bp, Homo sapiens
agatccttgtttcaaaca

SEQ ID NO: 5180759 - DNA, 20 bp, Homo sapiens
agatcctttaaatccttcca

SEQ ID NO: 5180760 - DNA, 19 bp, Homo sapiens
agatccttttccagaaata

SEQ ID NO: 5180761 - DNA, 18 bp, Homo sapiens
agatcctttttccatcat

SEQ ID NO: 5180762 - DNA, 18 bp, Homo sapiens
agatcgagaccatcctgg

SEQ ID NO: 5180763 - DNA, 13 bp, Homo sapiens
agatcgcatggca

SEQ ID NO: 5180764 - DNA, 15 bp, Homo sapiens
agatcgcatttccta

SEQ ID NO: 5180765 - DNA, 17 bp, Homo sapiens
agatcgctcactgttgt

SEQ ID NO: 5180766 - DNA, 18 bp, Homo sapiens
agatcgctcactgttgtg

SEQ ID NO: 5180767 - DNA, 17 bp, Homo sapiens
agatcgctcccttggct

SEQ ID NO: 5180768 - DNA, 18 bp, Homo sapiens
agatcgctcccttggctt

SEQ ID NO: 5180769 - DNA, 14 bp, Homo sapiens
agatcgctggcaga

SEQ ID NO: 5180770 - DNA, 14 bp, Homo sapiens
agatcgcttgagcc

SEQ ID NO: 5180771 - DNA, 18 bp, Homo sapiens
agatcgcttgagcccagg

SEQ ID NO: 5180772 - DNA, 19 bp, Homo sapiens
agatcgcttgagcccagga

SEQ ID NO: 5180773 - DNA, 15 bp, Homo sapiens
agatcgcttttctca

SEQ ID NO: 5180774 - DNA, 16 bp, Homo sapiens
agatcgcttttctcag

SEQ ID NO: 5180775 - DNA, 18 bp, Homo sapiens
agatcggggccagaggca

SEQ ID NO: 5180776 - DNA, 14 bp, Homo sapiens
agatcggttaacaa

SEQ ID NO: 5180777 - DNA, 12 bp, Homo sapiens
agatcgtattaa

SEQ ID NO: 5180778 - DNA, 19 bp, Homo sapiens
agatcgtattaattatctg

SEQ ID NO: 5180779 - DNA, 14 bp, Homo sapiens
agatcgtcaggacc

SEQ ID NO: 5180780 - DNA, 16 bp, Homo sapiens
agatcgtccactgtca

SEQ ID NO: 5180781 - DNA, 22 bp, Homo sapiens
agatcgtgccattacactccag

SEQ ID NO: 5180782 - DNA, 23 bp, Homo sapiens
agatcgtgtattgagatttctta

SEQ ID NO: 5180783 - DNA, 17 bp, Homo sapiens
agatcgttagtatctaa

SEQ ID NO: 5180784 - DNA, 16 bp, Homo sapiens
agatcgtttaaaaaca

SEQ ID NO: 5180785 - DNA, 20 bp, Homo sapiens
agatctaaaaataactgtaa

SEQ ID NO: 5180786 - DNA, 14 bp, Homo sapiens
agatctaaacagtt

SEQ ID NO: 5180787 - DNA, 14 bp, Homo sapiens
agatctaatgtgaa

SEQ ID NO: 5180788 - DNA, 11 bp, Homo sapiens
agatctacatg

SEQ ID NO: 5180789 - DNA, 22 bp, Homo sapiens
agatctaccccagggagaatct

SEQ ID NO: 5180790 - DNA, 14 bp, Homo sapiens
agatctagaaagtg

SEQ ID NO: 5180791 - DNA, 14 bp, Homo sapiens
agatctagccaggc

SEQ ID NO: 5180792 - DNA, 18 bp, Homo sapiens
agatctagccaggcctcc

SEQ ID NO: 5180793 - DNA, 19 bp, Homo sapiens
agatctagtccggacttgc

SEQ ID NO: 5180794 - DNA, 22 bp, Homo sapiens
agatctagtgccattatttcta

SEQ ID NO: 5180795 - DNA, 22 bp, Homo sapiens
agatctatagcagagtccttat

SEQ ID NO: 5180796 - DNA, 16 bp, Homo sapiens
agatctatgggaagat

SEQ ID NO: 5180797 - DNA, 21 bp, Homo sapiens
agatctattgtttgttgcact

SEQ ID NO: 5180798 - DNA, 13 bp, Homo sapiens
agatctcaggagc

SEQ ID NO: 5180799 - DNA, 14 bp, Homo sapiens
agatctccaaagct

SEQ ID NO: 5180800 - DNA, 12 bp, Homo sapiens
agatctccagcg

SEQ ID NO: 5180801 - DNA, 14 bp, Homo sapiens
agatctcccttctc

SEQ ID NO: 5180802 - DNA, 15 bp, Homo sapiens
agatctcccttctca

SEQ ID NO: 5180803 - DNA, 13 bp, Homo sapiens
agatctcctattt

SEQ ID NO: 5180804 - DNA, 13 bp, Homo sapiens
agatctcctgtaa

SEQ ID NO: 5180805 - DNA, 20 bp, Homo sapiens
agatctcctgtaattttgta

SEQ ID NO: 5180806 - DNA, 14 bp, Homo sapiens
agatctctcctgca

SEQ ID NO: 5180807 - DNA, 16 bp, Homo sapiens
agatctgaaaggcaca

SEQ ID NO: 5180808 - DNA, 16 bp, Homo sapiens
agatctgaacccagct

SEQ ID NO: 5180809 - DNA, 17 bp, Homo sapiens
agatctgaacccagctg

SEQ ID NO: 5180810 - DNA, 12 bp, Homo sapiens
agatctgaaggg

SEQ ID NO: 5180811 - DNA, 20 bp, Homo sapiens
agatctgaagtagtgtgagt

SEQ ID NO: 5180812 - DNA, 21 bp, Homo sapiens
agatctgaagtagtgtgagtg

SEQ ID NO: 5180813 - DNA, 21 bp, Homo sapiens
agatctgacatgattccttcc

SEQ ID NO: 5180814 - DNA, 23 bp, Homo sapiens
agatctgacatgattccttcctg

SEQ ID NO: 5180815 - DNA, 15 bp, Homo sapiens
agatctgactgccaa

SEQ ID NO: 5180816 - DNA, 12 bp, Homo sapiens
agatctgagccc

SEQ ID NO: 5180817 - DNA, 18 bp, Homo sapiens
agatctgatggtgagctg

SEQ ID NO: 5180818 - DNA, 20 bp, Homo sapiens
agatctgatggtgagctggg

SEQ ID NO: 5180819 - DNA, 23 bp, Homo sapiens
agatctgatttgtaacccactga

SEQ ID NO: 5180820 - DNA, 20 bp, Homo sapiens
agatctgattttttccccct

SEQ ID NO: 5180821 - DNA, 17 bp, Homo sapiens
agatctgcacagtcaga

SEQ ID NO: 5180822 - DNA, 15 bp, Homo sapiens
agatctgcaccgccg

SEQ ID NO: 5180823 - DNA, 21 bp, Homo sapiens
agatctgcactcctgtctctt

SEQ ID NO: 5180824 - DNA, 13 bp, Homo sapiens
agatctgcatctg

SEQ ID NO: 5180825 - DNA, 20 bp, Homo sapiens
agatctgcctcccctgtgga

SEQ ID NO: 5180826 - DNA, 13 bp, Homo sapiens
agatctgcctggg

SEQ ID NO: 5180827 - DNA, 18 bp, Homo sapiens
agatctgcctgggcctgt

SEQ ID NO: 5180828 - DNA, 20 bp, Homo sapiens
agatctgcctgggcctgtgc

SEQ ID NO: 5180829 - DNA, 21 bp, Homo sapiens
agatctgcctgggcctgtgca

SEQ ID NO: 5180830 - DNA, 20 bp, Homo sapiens
agatctgcttccctggggcc

SEQ ID NO: 5180831 - DNA, 12 bp, Homo sapiens
agatctgctttc

SEQ ID NO: 5180832 - DNA, 15 bp, Homo sapiens
agatctgctttctgt

SEQ ID NO: 5180833 - DNA, 14 bp, Homo sapiens
agatctggaacctc

SEQ ID NO: 5180834 - DNA, 17 bp, Homo sapiens
agatctggaacctcagc

SEQ ID NO: 5180835 - DNA, 19 bp, Homo sapiens
agatctggaacctcagcct

SEQ ID NO: 5180836 - DNA, 13 bp, Homo sapiens
agatctggcatgt

SEQ ID NO: 5180837 - DNA, 13 bp, Homo sapiens
agatctgggcatt

SEQ ID NO: 5180838 - DNA, 16 bp, Homo sapiens
agatctggggaggcag

SEQ ID NO: 5180839 - DNA, 15 bp, Homo sapiens
agatctggtttctaa

SEQ ID NO: 5180840 - DNA, 12 bp, Homo sapiens
agatctggtttt

SEQ ID NO: 5180841 - DNA, 15 bp, Homo sapiens
agatctggttttgct

SEQ ID NO: 5180842 - DNA, 16 bp, Homo sapiens
agatctgtataaataa

SEQ ID NO: 5180843 - DNA, 15 bp, Homo sapiens
agatctgtctccaag

SEQ ID NO: 5180844 - DNA, 14 bp, Homo sapiens
agatctgtgcccca

SEQ ID NO: 5180845 - DNA, 13 bp, Homo sapiens
agatctgtgcctg

SEQ ID NO: 5180846 - DNA, 14 bp, Homo sapiens
agatctgtgcctgg

SEQ ID NO: 5180847 - DNA, 18 bp, Homo sapiens
agatctgtgcctgggatc

SEQ ID NO: 5180848 - DNA, 20 bp, Homo sapiens
agatctgtgtggctcctggg

SEQ ID NO: 5180849 - DNA, 15 bp, Homo sapiens
agatcttaatataaa

SEQ ID NO: 5180850 - DNA, 14 bp, Homo sapiens
agatcttagattct

SEQ ID NO: 5180851 - DNA, 15 bp, Homo sapiens
agatcttagattctc

SEQ ID NO: 5180852 - DNA, 15 bp, Homo sapiens
agatcttatattggt

SEQ ID NO: 5180853 - DNA, 21 bp, Homo sapiens
agatcttatattggtttgcac

SEQ ID NO: 5180854 - DNA, 17 bp, Homo sapiens
agatcttcaaccatgag

SEQ ID NO: 5180855 - DNA, 17 bp, Homo sapiens
agatcttccgtggtcag

SEQ ID NO: 5180856 - DNA, 15 bp, Homo sapiens
agatcttctgaaatg

SEQ ID NO: 5180857 - DNA, 16 bp, Homo sapiens
agatcttctttataac

SEQ ID NO: 5180858 - DNA, 12 bp, Homo sapiens
agatcttgagca

SEQ ID NO: 5180859 - DNA, 18 bp, Homo sapiens
agatcttgcagaagttct

SEQ ID NO: 5180860 - DNA, 16 bp, Homo sapiens
agatcttgttctttgc

SEQ ID NO: 5180861 - DNA, 15 bp, Homo sapiens
agatctttatatttc

SEQ ID NO: 5180862 - DNA, 23 bp, Homo sapiens
agatctttattatggaaaacatt

SEQ ID NO: 5180863 - DNA, 21 bp, Homo sapiens
agatctttcagaaatataaca

SEQ ID NO: 5180864 - DNA, 19 bp, Homo sapiens
agatctttctcttccctga

SEQ ID NO: 5180865 - DNA, 20 bp, Homo sapiens
agatctttctcttccctgaa

SEQ ID NO: 5180866 - DNA, 21 bp, Homo sapiens
agatctttggcatgatttaaa

SEQ ID NO: 5180867 - DNA, 20 bp, Homo sapiens
agatcttttagaagtgagag

SEQ ID NO: 5180868 - DNA, 14 bp, Homo sapiens
agatcttttcttta

SEQ ID NO: 5180869 - DNA, 17 bp, Homo sapiens
agatcttttttttttcc

SEQ ID NO: 5180870 - DNA, 16 bp, Homo sapiens
agatgaaaaaaactaa

SEQ ID NO: 5180871 - DNA, 14 bp, Homo sapiens
agatgaaaaagaat

SEQ ID NO: 5180872 - DNA, 16 bp, Homo sapiens
agatgaaaaagaataa

SEQ ID NO: 5180873 - DNA, 21 bp, Homo sapiens
agatgaaaaagcatgtacagt

SEQ ID NO: 5180874 - DNA, 19 bp, Homo sapiens
agaccctgaacccacacct

SEQ ID NO: 5180875 - DNA, 20 bp, Homo sapiens
agaccctgaacccacacctg

SEQ ID NO: 5180876 - DNA, 14 bp, Homo sapiens
agaccctgatgcag

SEQ ID NO: 5180877 - DNA, 20 bp, Homo sapiens
agaccctgccaactttccag

SEQ ID NO: 5180878 - DNA, 21 bp, Homo sapiens
agaccctgccaactttccaga

SEQ ID NO: 5180879 - DNA, 19 bp, Homo sapiens
agaccctgccacagccaga

SEQ ID NO: 5180880 - DNA, 22 bp, Homo sapiens
agaccctgccacagccagagga

SEQ ID NO: 5180881 - DNA, 12 bp, Homo sapiens
agaccctgcccc

SEQ ID NO: 5180882 - DNA, 12 bp, Homo sapiens
agaccctgccct

SEQ ID NO: 5180883 - DNA, 13 bp, Homo sapiens
agaccctgccctg

SEQ ID NO: 5180884 - DNA, 21 bp, Homo sapiens
agaccctgccctgtgggcccc

SEQ ID NO: 5180885 - DNA, 23 bp, Homo sapiens
agaccctgccctgtgggccccca

SEQ ID NO: 5180886 - DNA, 13 bp, Homo sapiens
agaccctgcctga

SEQ ID NO: 5180887 - DNA, 15 bp, Homo sapiens
agaccctgcctgagc

SEQ ID NO: 5180888 - DNA, 20 bp, Homo sapiens
agaccctgcgcccctgccca

SEQ ID NO: 5180889 - DNA, 22 bp, Homo sapiens
agaccctggaattcagcaccct

SEQ ID NO: 5180890 - DNA, 13 bp, Homo sapiens
agaccctggcctc

SEQ ID NO: 5180891 - DNA, 12 bp, Homo sapiens
agaccctgggag

SEQ ID NO: 5180892 - DNA, 15 bp, Homo sapiens
agaccctgggagaga

SEQ ID NO: 5180893 - DNA, 17 bp, Homo sapiens
agaccctgggagagaag

SEQ ID NO: 5180894 - DNA, 20 bp, Homo sapiens
agaccctgggcaaacagagc

SEQ ID NO: 5180895 - DNA, 19 bp, Homo sapiens
agaccctggtgcctggctc

SEQ ID NO: 5180896 - DNA, 18 bp, Homo sapiens
agaccctgtctcaataaa

SEQ ID NO: 5180897 - DNA, 12 bp, Homo sapiens
agaccctgtctt

SEQ ID NO: 5180898 - DNA, 16 bp, Homo sapiens
agaccctgtctttgct

SEQ ID NO: 5180899 - DNA, 12 bp, Homo sapiens
agaccctgttct

SEQ ID NO: 5180900 - DNA, 17 bp, Homo sapiens
agacccttattacacgg

SEQ ID NO: 5180901 - DNA, 14 bp, Homo sapiens
agacccttatttaa

SEQ ID NO: 5180902 - DNA, 16 bp, Homo sapiens
agacccttctggtgcc

SEQ ID NO: 5180903 - DNA, 23 bp, Homo sapiens
agacccttcttgcctgctgggct

SEQ ID NO: 5180904 - DNA, 21 bp, Homo sapiens
agacccttgaagatgtagctt

SEQ ID NO: 5180905 - DNA, 19 bp, Homo sapiens
agaccctttgttgaaaaat

SEQ ID NO: 5180906 - DNA, 17 bp, Homo sapiens
agacccttttgggtttc

SEQ ID NO: 5180907 - DNA, 20 bp, Homo sapiens
agaccgaactgttgtataaa

SEQ ID NO: 5180908 - DNA, 18 bp, Homo sapiens
agaccgagtgtggagctg

SEQ ID NO: 5180909 - DNA, 16 bp, Homo sapiens
agaccgatccttccca

SEQ ID NO: 5180910 - DNA, 13 bp, Homo sapiens
agaccgcagaggg

SEQ ID NO: 5180911 - DNA, 14 bp, Homo sapiens
agaccgcagaggga

SEQ ID NO: 5180912 - DNA, 16 bp, Homo sapiens
agaccgcagagggaag

SEQ ID NO: 5180913 - DNA, 17 bp, Homo sapiens
agaccgccccagggcta

SEQ ID NO: 5180914 - DNA, 17 bp, Homo sapiens
agaccgcgcccctggga

SEQ ID NO: 5180915 - DNA, 20 bp, Homo sapiens
agaccgcgcccctgggacta

SEQ ID NO: 5180916 - DNA, 14 bp, Homo sapiens
agaccgctctcttt

SEQ ID NO: 5180917 - DNA, 19 bp, Homo sapiens
agaccggaattgagaggtg

SEQ ID NO: 5180918 - DNA, 17 bp, Homo sapiens
agaccgggccctgggtt

SEQ ID NO: 5180919 - DNA, 19 bp, Homo sapiens
agaccgggggccagacaca

SEQ ID NO: 5180920 - DNA, 20 bp, Homo sapiens
agaccgggggccagacacag

SEQ ID NO: 5180921 - DNA, 15 bp, Homo sapiens
agaccgtcttcctcc

SEQ ID NO: 5180922 - DNA, 16 bp, Homo sapiens
agaccgtcttcctcca

SEQ ID NO: 5180923 - DNA, 18 bp, Homo sapiens
agaccgtcttcctccaac

SEQ ID NO: 5180924 - DNA, 14 bp, Homo sapiens
agacctaaagtgct

SEQ ID NO: 5180925 - DNA, 17 bp, Homo sapiens
agacctaaatgacctca

SEQ ID NO: 5180926 - DNA, 19 bp, Homo sapiens
agacctaaatgacctcagc

SEQ ID NO: 5180927 - DNA, 17 bp, Homo sapiens
agacctaaggcagacag

SEQ ID NO: 5180928 - DNA, 23 bp, Homo sapiens
agacctaaggcagacaggaagga

SEQ ID NO: 5180929 - DNA, 14 bp, Homo sapiens
agacctaatatcat

SEQ ID NO: 5180930 - DNA, 19 bp, Homo sapiens
agacctacagacctggctc

SEQ ID NO: 5180931 - DNA, 19 bp, Homo sapiens
agacctacagggggtctgg

SEQ ID NO: 5180932 - DNA, 23 bp, Homo sapiens
agacctacagggggtctggctgg

SEQ ID NO: 5180933 - DNA, 15 bp, Homo sapiens
agacctacattccct

SEQ ID NO: 5180934 - DNA, 18 bp, Homo sapiens
agacctacattccctctc

SEQ ID NO: 5180935 - DNA, 23 bp, Homo sapiens
agacctacattccctctcctgcc

SEQ ID NO: 5180936 - DNA, 19 bp, Homo sapiens
agacctacctcaggttgct

SEQ ID NO: 5180937 - DNA, 20 bp, Homo sapiens
agacctactgttctaaagct

SEQ ID NO: 5180938 - DNA, 21 bp, Homo sapiens
agacctactgttctaaagctc

SEQ ID NO: 5180939 - DNA, 22 bp, Homo sapiens
agacctactgttctaaagctct

SEQ ID NO: 5180940 - DNA, 14 bp, Homo sapiens
agacctagcaggga

SEQ ID NO: 5180941 - DNA, 14 bp, Homo sapiens
agacctagggagga

SEQ ID NO: 5180942 - DNA, 13 bp, Homo sapiens
agacctatactga

SEQ ID NO: 5180943 - DNA, 16 bp, Homo sapiens
agacctattcctcctg

SEQ ID NO: 5180944 - DNA, 12 bp, Homo sapiens
agacctcactgt

SEQ ID NO: 5180945 - DNA, 21 bp, Homo sapiens
agacctcagagatggcttcct

SEQ ID NO: 5180946 - DNA, 16 bp, Homo sapiens
agacctcagcctgtgc

SEQ ID NO: 5180947 - DNA, 13 bp, Homo sapiens
agacctcagcttg

SEQ ID NO: 5180948 - DNA, 14 bp, Homo sapiens
agacctcagggcac

SEQ ID NO: 5180949 - DNA, 15 bp, Homo sapiens
agacctcatcaggat

SEQ ID NO: 5180950 - DNA, 22 bp, Homo sapiens
agacctcatcaggatgaaccca

SEQ ID NO: 5180951 - DNA, 16 bp, Homo sapiens
agacctcatctgcctg

SEQ ID NO: 5180952 - DNA, 18 bp, Homo sapiens
agacctcatctgcctgca

SEQ ID NO: 5180953 - DNA, 20 bp, Homo sapiens
agacctcatctgtggagctg

SEQ ID NO: 5180954 - DNA, 19 bp, Homo sapiens
agacctcatgcccagctct

SEQ ID NO: 5180955 - DNA, 20 bp, Homo sapiens
agacctcatgcccagctctc

SEQ ID NO: 5180956 - DNA, 22 bp, Homo sapiens
agacctcatgcccagctctctg

SEQ ID NO: 5180957 - DNA, 21 bp, Homo sapiens
agacctccaataaagtgcctt

SEQ ID NO: 5180958 - DNA, 13 bp, Homo sapiens
agacctccacatt

SEQ ID NO: 5180959 - DNA, 21 bp, Homo sapiens
agacctccagattattttcta

SEQ ID NO: 5180960 - DNA, 20 bp, Homo sapiens
agacctccagtgagtacctg

SEQ ID NO: 5180961 - DNA, 23 bp, Homo sapiens
agacctccctccctccccagtgt

SEQ ID NO: 5180962 - DNA, 14 bp, Homo sapiens
agacctcctgatgt

SEQ ID NO: 5180963 - DNA, 13 bp, Homo sapiens
agacctctcccac

SEQ ID NO: 5180964 - DNA, 14 bp, Homo sapiens
agacctctcccacc

SEQ ID NO: 5180965 - DNA, 11 bp, Homo sapiens
agacctctgga

SEQ ID NO: 5180966 - DNA, 23 bp, Homo sapiens
agacctctggattaggtctctgt

SEQ ID NO: 5180967 - DNA, 18 bp, Homo sapiens
agacctcttcctggaata

SEQ ID NO: 5180968 - DNA, 17 bp, Homo sapiens
agacctgaaagagagga

SEQ ID NO: 5180969 - DNA, 13 bp, Homo sapiens
agacctgaactgg

SEQ ID NO: 5180970 - DNA, 17 bp, Homo sapiens
agacctgaataccactt

SEQ ID NO: 5180971 - DNA, 23 bp, Homo sapiens
agacctgaataccacttacctca

SEQ ID NO: 5180972 - DNA, 17 bp, Homo sapiens
agacctgacaagcactg

SEQ ID NO: 5180973 - DNA, 20 bp, Homo sapiens
agacctgacaatttgtgata

SEQ ID NO: 5180974 - DNA, 19 bp, Homo sapiens
agacctgacaccgtccctc

SEQ ID NO: 5180975 - DNA, 19 bp, Homo sapiens
agacctgacccttctctca

SEQ ID NO: 5180976 - DNA, 18 bp, Homo sapiens
agacctgactcaggcatc

SEQ ID NO: 5180977 - DNA, 18 bp, Homo sapiens
agacctgagatgaagatt

SEQ ID NO: 5180978 - DNA, 22 bp, Homo sapiens
agacctgagcgggagtcaggga

SEQ ID NO: 5180979 - DNA, 15 bp, Homo sapiens
agacctgagctttcc

SEQ ID NO: 5180980 - DNA, 21 bp, Homo sapiens
agacctgatcctggaggccca

SEQ ID NO: 5180981 - DNA, 21 bp, Homo sapiens
agacctgcagtgaggggccct

SEQ ID NO: 5180982 - DNA, 13 bp, Homo sapiens
agacctgcccctc

SEQ ID NO: 5180983 - DNA, 17 bp, Homo sapiens
agacctgcccctccctc

SEQ ID NO: 5180984 - DNA, 22 bp, Homo sapiens
agacctgcccctcctctctgcc

SEQ ID NO: 5180985 - DNA, 18 bp, Homo sapiens
agacctgccgcctgggaa

SEQ ID NO: 5180986 - DNA, 13 bp, Homo sapiens
agacctgctccag

SEQ ID NO: 5180987 - DNA, 15 bp, Homo sapiens
agacctgctccagat

SEQ ID NO: 5180988 - DNA, 17 bp, Homo sapiens
agacctgctccagatcc

SEQ ID NO: 5180989 - DNA, 20 bp, Homo sapiens
agacctgctgagggaccagc

SEQ ID NO: 5180990 - DNA, 22 bp, Homo sapiens
agacctgctgtaataaatgtat

SEQ ID NO: 5180991 - DNA, 23 bp, Homo sapiens
agacctgctttttgaaatgaaat

SEQ ID NO: 5180992 - DNA, 21 bp, Homo sapiens
agacctggaagaacaggcctc

SEQ ID NO: 5180993 - DNA, 13 bp, Homo sapiens
agacctggagccc

SEQ ID NO: 5180994 - DNA, 16 bp, Homo sapiens
agacctggagcccctg

SEQ ID NO: 5180995 - DNA, 19 bp, Homo sapiens
agacctggcctctgccatc

SEQ ID NO: 5180996 - DNA, 20 bp, Homo sapiens
agacctggctctcagaggaa

SEQ ID NO: 5180997 - DNA, 12 bp, Homo sapiens
agacctggctgg

SEQ ID NO: 5180998 - DNA, 13 bp, Homo sapiens
agacctgggactt

SEQ ID NO: 5180999 - DNA, 15 bp, Homo sapiens
agacctgggatttga

SEQ ID NO: 5181000 - DNA, 13 bp, Homo sapiens
agacctgtaatca

SEQ ID NO: 5181001 - DNA, 17 bp, Homo sapiens
agacctgtcgtctctcc

SEQ ID NO: 5181002 - DNA, 23 bp, Homo sapiens
agacctgtgacctggtctggtca

SEQ ID NO: 5181003 - DNA, 12 bp, Homo sapiens
agacctgtgcta

SEQ ID NO: 5181004 - DNA, 22 bp, Homo sapiens
agacctgtgctagttttacaga

SEQ ID NO: 5181005 - DNA, 17 bp, Homo sapiens
agacctgttggcctgtg

SEQ ID NO: 5181006 - DNA, 19 bp, Homo sapiens
agacctgttggcctgtggg

SEQ ID NO: 5181007 - DNA, 23 bp, Homo sapiens
agacctgttggtataggaatgta

SEQ ID NO: 5181008 - DNA, 22 bp, Homo sapiens
agaccttacaaccacatttctg

SEQ ID NO: 5181009 - DNA, 23 bp, Homo sapiens
agaccttcaaatgcgaacactat

SEQ ID NO: 5181010 - DNA, 15 bp, Homo sapiens
agaccttccacaaag

SEQ ID NO: 5181011 - DNA, 13 bp, Homo sapiens
agaccttccataa

SEQ ID NO: 5181012 - DNA, 11 bp, Homo sapiens
agaccttctcc

SEQ ID NO: 5181013 - DNA, 15 bp, Homo sapiens
agaccttctccttca

SEQ ID NO: 5181014 - DNA, 13 bp, Homo sapiens
agaccttctctta

SEQ ID NO: 5181015 - DNA, 18 bp, Homo sapiens
agaccttctgaagatctc

SEQ ID NO: 5181016 - DNA, 16 bp, Homo sapiens
agaccttctgatctcc

SEQ ID NO: 5181017 - DNA, 21 bp, Homo sapiens
agaccttcttccacagcaaat

SEQ ID NO: 5181018 - DNA, 23 bp, Homo sapiens
agaccttgcctcccctcctctcc

SEQ ID NO: 5181019 - DNA, 15 bp, Homo sapiens
agaccttgtgtgtat

SEQ ID NO: 5181020 - DNA, 18 bp, Homo sapiens
agaccttgtgtgtatgtg

SEQ ID NO: 5181021 - DNA, 21 bp, Homo sapiens
agaccttgttacttctgaggt

SEQ ID NO: 5181022 - DNA, 20 bp, Homo sapiens
agaccttgttcacactctca

SEQ ID NO: 5181023 - DNA, 20 bp, Homo sapiens
agacctttattcacccctgc

SEQ ID NO: 5181024 - DNA, 17 bp, Homo sapiens
agacctttatttttcta

SEQ ID NO: 5181025 - DNA, 14 bp, Homo sapiens
agacctttcctctc

SEQ ID NO: 5181026 - DNA, 18 bp, Homo sapiens
agacctttctagacatca

SEQ ID NO: 5181027 - DNA, 14 bp, Homo sapiens
agacctttgcccac

SEQ ID NO: 5181028 - DNA, 19 bp, Homo sapiens
agaccttttaactcctcaa

SEQ ID NO: 5181029 - DNA, 12 bp, Homo sapiens
agaccttttcaa

SEQ ID NO: 5181030 - DNA, 16 bp, Homo sapiens
agaccttttctctccc

SEQ ID NO: 5181031 - DNA, 17 bp, Homo sapiens
agaccttttctctccca

SEQ ID NO: 5181032 - DNA, 19 bp, Homo sapiens
agaccttttctctcccata

SEQ ID NO: 5181033 - DNA, 22 bp, Homo sapiens
agaccttttggcccaatctctg

SEQ ID NO: 5181034 - DNA, 20 bp, Homo sapiens
agacctttttctgcactata

SEQ ID NO: 5181035 - DNA, 21 bp, Homo sapiens
agaccttttttttttttccaa

SEQ ID NO: 5181036 - DNA, 22 bp, Homo sapiens
agaccttttttttttttccaat

SEQ ID NO: 5181037 - DNA, 14 bp, Homo sapiens
agacgaacatgtag

SEQ ID NO: 5181038 - DNA, 15 bp, Homo sapiens
agacgaagtgtaaac

SEQ ID NO: 5181039 - DNA, 21 bp, Homo sapiens
agacgacaaggaaaggcaaat

SEQ ID NO: 5181040 - DNA, 21 bp, Homo sapiens
agacgacacctggagactgtc

SEQ ID NO: 5181041 - DNA, 14 bp, Homo sapiens
agacgagatcctgt

SEQ ID NO: 5181042 - DNA, 18 bp, Homo sapiens
agacgagatcctgtttca

SEQ ID NO: 5181043 - DNA, 15 bp, Homo sapiens
agacgaggcaggggc

SEQ ID NO: 5181044 - DNA, 13 bp, Homo sapiens
agacgaggccctc

SEQ ID NO: 5181045 - DNA, 18 bp, Homo sapiens
agacgaggcctttgcttt

SEQ ID NO: 5181046 - DNA, 19 bp, Homo sapiens
agacgaggggcagggaagg

SEQ ID NO: 5181047 - DNA, 18 bp, Homo sapiens
agacgaggtgtcttcctt

SEQ ID NO: 5181048 - DNA, 17 bp, Homo sapiens
agacgatttgtcagtta

SEQ ID NO: 5181049 - DNA, 20 bp, Homo sapiens
agacgcaagaggtttcagca

SEQ ID NO: 5181050 - DNA, 19 bp, Homo sapiens
agacgcactgatctttgca

SEQ ID NO: 5181051 - DNA, 21 bp, Homo sapiens
agacgcagccctgggggccag

SEQ ID NO: 5181052 - DNA, 13 bp, Homo sapiens
agatgaaaactag

SEQ ID NO: 5181053 - DNA, 13 bp, Homo sapiens
agatgaaaagcta

SEQ ID NO: 5181054 - DNA, 14 bp, Homo sapiens
agatgaaaataaaa

SEQ ID NO: 5181055 - DNA, 17 bp, Homo sapiens
agatgaaaatatcagct

SEQ ID NO: 5181056 - DNA, 14 bp, Homo sapiens
agatgaaacacaaa

SEQ ID NO: 5181057 - DNA, 13 bp, Homo sapiens
agatgaaacatca

SEQ ID NO: 5181058 - DNA, 18 bp, Homo sapiens
agatgaaacatcatttca

SEQ ID NO: 5181059 - DNA, 14 bp, Homo sapiens
agatgaaacattaa

SEQ ID NO: 5181060 - DNA, 18 bp, Homo sapiens
agatgaaacattaactct

SEQ ID NO: 5181061 - DNA, 17 bp, Homo sapiens
agatgaaagaggaggtt

SEQ ID NO: 5181062 - DNA, 23 bp, Homo sapiens
agatgaaagcagggaatttctat

SEQ ID NO: 5181063 - DNA, 20 bp, Homo sapiens
agatgaaagctgtttcattt

SEQ ID NO: 5181064 - DNA, 20 bp, Homo sapiens
agatgaaatcttacagctgg

SEQ ID NO: 5181065 - DNA, 23 bp, Homo sapiens
agatgaaatcttacagctgggtg

SEQ ID NO: 5181066 - DNA, 18 bp, Homo sapiens
agatgaaattcaaataac

SEQ ID NO: 5181067 - DNA, 14 bp, Homo sapiens
agatgaaattgcca

SEQ ID NO: 5181068 - DNA, 19 bp, Homo sapiens
agatgaacaactttgcctt

SEQ ID NO: 5181069 - DNA, 13 bp, Homo sapiens
agatgaacatttc

SEQ ID NO: 5181070 - DNA, 22 bp, Homo sapiens
agatgaactgactgaaggaaaa

SEQ ID NO: 5181071 - DNA, 16 bp, Homo sapiens
agatgaacttgagctc

SEQ ID NO: 5181072 - DNA, 13 bp, Homo sapiens
agatgaactttgt

SEQ ID NO: 5181073 - DNA, 21 bp, Homo sapiens
agatgaagaaggagcagaata

SEQ ID NO: 5181074 - DNA, 12 bp, Homo sapiens
agatgaagagaa

SEQ ID NO: 5181075 - DNA, 14 bp, Homo sapiens
agatgaagagaagc

SEQ ID NO: 5181076 - DNA, 19 bp, Homo sapiens
agatgaagcaaacacatta

SEQ ID NO: 5181077 - DNA, 16 bp, Homo sapiens
agatgaaggagaggca

SEQ ID NO: 5181078 - DNA, 16 bp, Homo sapiens
agatgaaggggctctt

SEQ ID NO: 5181079 - DNA, 22 bp, Homo sapiens
agatgaagtttgtagttgtttt

SEQ ID NO: 5181080 - DNA, 15 bp, Homo sapiens
agatgaagttttaca

SEQ ID NO: 5181081 - DNA, 19 bp, Homo sapiens
agatgaagttttacattgt

SEQ ID NO: 5181082 - DNA, 17 bp, Homo sapiens
agatgaatactaaatgg

SEQ ID NO: 5181083 - DNA, 22 bp, Homo sapiens
agatgaatagaagaaagaaaat

SEQ ID NO: 5181084 - DNA, 18 bp, Homo sapiens
agatgaatatgagctcat

SEQ ID NO: 5181085 - DNA, 13 bp, Homo sapiens
agatgaatcaatg

SEQ ID NO: 5181086 - DNA, 22 bp, Homo sapiens
agatgaatcagtatgaagacac

SEQ ID NO: 5181087 - DNA, 18 bp, Homo sapiens
agatgaatccaaatgtga

SEQ ID NO: 5181088 - DNA, 19 bp, Homo sapiens
agatgaatgaagcaaatgt

SEQ ID NO: 5181089 - DNA, 15 bp, Homo sapiens
agatgaatgtcagtt

SEQ ID NO: 5181090 - DNA, 17 bp, Homo sapiens
agatgaatgtcctgaaa

SEQ ID NO: 5181091 - DNA, 21 bp, Homo sapiens
agatgaattatcctatttcag

SEQ ID NO: 5181092 - DNA, 12 bp, Homo sapiens
agatgacaacct

SEQ ID NO: 5181093 - DNA, 18 bp, Homo sapiens
agatgacacataaatctg

SEQ ID NO: 5181094 - DNA, 23 bp, Homo sapiens
agatgacacataaatctgtctga

SEQ ID NO: 5181095 - DNA, 20 bp, Homo sapiens
agatgacacgcgctctccac

SEQ ID NO: 5181096 - DNA, 14 bp, Homo sapiens
agatgacagaaata

SEQ ID NO: 5181097 - DNA, 16 bp, Homo sapiens
agatgacagaaatatg

SEQ ID NO: 5181098 - DNA, 23 bp, Homo sapiens
agatgacattgactatttttgtt

SEQ ID NO: 5181099 - DNA, 15 bp, Homo sapiens
agatgaccagggatg

SEQ ID NO: 5181100 - DNA, 15 bp, Homo sapiens
agatgacccctaccc

SEQ ID NO: 5181101 - DNA, 16 bp, Homo sapiens
agatgacccctacccc

SEQ ID NO: 5181102 - DNA, 19 bp, Homo sapiens
agatgacccctaccccctc

SEQ ID NO: 5181103 - DNA, 20 bp, Homo sapiens
agatgacccctgcccagatc

SEQ ID NO: 5181104 - DNA, 20 bp, Homo sapiens
agatgacctcgtactcagga

SEQ ID NO: 5181105 - DNA, 13 bp, Homo sapiens
agatgacctgccc

SEQ ID NO: 5181106 - DNA, 15 bp, Homo sapiens
agatgacctgcccca

SEQ ID NO: 5181107 - DNA, 13 bp, Homo sapiens
agatgactctctc

SEQ ID NO: 5181108 - DNA, 15 bp, Homo sapiens
agatgactctgtctc

SEQ ID NO: 5181109 - DNA, 18 bp, Homo sapiens
agatgactgaatttctat

SEQ ID NO: 5181110 - DNA, 24 bp, Homo sapiens
agatgactgaatttctatggcata

SEQ ID NO: 5181111 - DNA, 20 bp, Homo sapiens
agatgacttcccctgcctcc

SEQ ID NO: 5181112 - DNA, 14 bp, Homo sapiens
agatgactttgcag

SEQ ID NO: 5181113 - DNA, 20 bp, Homo sapiens
agatgactttgcagatggaa

SEQ ID NO: 5181114 - DNA, 23 bp, Homo sapiens
agatgactttgcagatggaaaga

SEQ ID NO: 5181115 - DNA, 17 bp, Homo sapiens
agatgagaaaacaggct

SEQ ID NO: 5181116 - DNA, 11 bp, Homo sapiens
agatgagaaca

SEQ ID NO: 5181117 - DNA, 16 bp, Homo sapiens
agatgagaacaaagct

SEQ ID NO: 5181118 - DNA, 19 bp, Homo sapiens
agatgagaacaaagctgtt

SEQ ID NO: 5181119 - DNA, 20 bp, Homo sapiens
agatgagaagttaagcagcc

SEQ ID NO: 5181120 - DNA, 23 bp, Homo sapiens
agatgagaagttaagcagccttt

SEQ ID NO: 5181121 - DNA, 19 bp, Homo sapiens
agatgagaattcagctgcc

SEQ ID NO: 5181122 - DNA, 15 bp, Homo sapiens
agatgagagtttctg

SEQ ID NO: 5181123 - DNA, 15 bp, Homo sapiens
agatgagattggcat

SEQ ID NO: 5181124 - DNA, 15 bp, Homo sapiens
agatgagcaaggaca

SEQ ID NO: 5181125 - DNA, 18 bp, Homo sapiens
agatgagcaaggacattg

SEQ ID NO: 5181126 - DNA, 14 bp, Homo sapiens
agatgagcacttct

SEQ ID NO: 5181127 - DNA, 14 bp, Homo sapiens
agatgagcaggagc

SEQ ID NO: 5181128 - DNA, 20 bp, Homo sapiens
agatgagcaggagcttgggt

SEQ ID NO: 5181129 - DNA, 15 bp, Homo sapiens
agatgagcagtgagt

SEQ ID NO: 5181130 - DNA, 19 bp, Homo sapiens
agatgagcagtgagtgacc

SEQ ID NO: 5181131 - DNA, 20 bp, Homo sapiens
agatgagccccacgtggagc

SEQ ID NO: 5181132 - DNA, 15 bp, Homo sapiens
agatgagccgggtcc

SEQ ID NO: 5181133 - DNA, 13 bp, Homo sapiens
agatgagcctggg

SEQ ID NO: 5181134 - DNA, 22 bp, Homo sapiens
agatgagcgtcctaaggcatgt

SEQ ID NO: 5181135 - DNA, 20 bp, Homo sapiens
agatgaggaaataagacttt

SEQ ID NO: 5181136 - DNA, 17 bp, Homo sapiens
agatgaggacagagtgg

SEQ ID NO: 5181137 - DNA, 23 bp, Homo sapiens
agatgaggaggtacaaaagttac

SEQ ID NO: 5181138 - DNA, 13 bp, Homo sapiens
agatgaggctcag

SEQ ID NO: 5181139 - DNA, 14 bp, Homo sapiens
agatgaggctcaga

SEQ ID NO: 5181140 - DNA, 17 bp, Homo sapiens
agatgaggctcagagag

SEQ ID NO: 5181141 - DNA, 18 bp, Homo sapiens
agatgaggctccttagtt

SEQ ID NO: 5181142 - DNA, 21 bp, Homo sapiens
agatgagggatgggcctggca

SEQ ID NO: 5181143 - DNA, 22 bp, Homo sapiens
agatgagggatgggcctggcat

SEQ ID NO: 5181144 - DNA, 22 bp, Homo sapiens
agatgagggtgtcggctgtgag

SEQ ID NO: 5181145 - DNA, 23 bp, Homo sapiens
agatgagggtgtcggctgtgagg

SEQ ID NO: 5181146 - DNA, 13 bp, Homo sapiens
agatgaggtcaac

SEQ ID NO: 5181147 - DNA, 16 bp, Homo sapiens
agatgaggttctgaga

SEQ ID NO: 5181148 - DNA, 16 bp, Homo sapiens
agatgaggttgagcta

SEQ ID NO: 5181149 - DNA, 21 bp, Homo sapiens
agatgaggttgagctatgata

SEQ ID NO: 5181150 - DNA, 17 bp, Homo sapiens
agatgaggttttggaaa

SEQ ID NO: 5181151 - DNA, 12 bp, Homo sapiens
agatgagtgaaa

SEQ ID NO: 5181152 - DNA, 15 bp, Homo sapiens
agatgagtgggcttc

SEQ ID NO: 5181153 - DNA, 17 bp, Homo sapiens
agatgagtgtctggagc

SEQ ID NO: 5181154 - DNA, 13 bp, Homo sapiens
agatgagtttctg

SEQ ID NO: 5181155 - DNA, 14 bp, Homo sapiens
agatgagtttctgg

SEQ ID NO: 5181156 - DNA, 16 bp, Homo sapiens
agatgagtttttcatt

SEQ ID NO: 5181157 - DNA, 17 bp, Homo sapiens
agatgagtttttcatta

SEQ ID NO: 5181158 - DNA, 16 bp, Homo sapiens
agatgataaatattta

SEQ ID NO: 5181159 - DNA, 13 bp, Homo sapiens
agatgataatgga

SEQ ID NO: 5181160 - DNA, 18 bp, Homo sapiens
agatgataatttagtgga

SEQ ID NO: 5181161 - DNA, 14 bp, Homo sapiens
agatgataattttt

SEQ ID NO: 5181162 - DNA, 16 bp, Homo sapiens
agatgatattacagga

SEQ ID NO: 5181163 - DNA, 16 bp, Homo sapiens
agatgatcacatggaa

SEQ ID NO: 5181164 - DNA, 16 bp, Homo sapiens
agatgatcagtccaac

SEQ ID NO: 5181165 - DNA, 17 bp, Homo sapiens
agatgatccatttgaac

SEQ ID NO: 5181166 - DNA, 17 bp, Homo sapiens
agatgatccttcttaga

SEQ ID NO: 5181167 - DNA, 14 bp, Homo sapiens
agatgatctctcca

SEQ ID NO: 5181168 - DNA, 23 bp, Homo sapiens
agatgatgaaaatatttaaaggc

SEQ ID NO: 5181169 - DNA, 14 bp, Homo sapiens
agatgatgagaatt

SEQ ID NO: 5181170 - DNA, 20 bp, Homo sapiens
agatgatgagaatttctaaa

SEQ ID NO: 5181171 - DNA, 15 bp, Homo sapiens
agatgatgatgatga

SEQ ID NO: 5181172 - DNA, 18 bp, Homo sapiens
agatgatgctcagtttta

SEQ ID NO: 5181173 - DNA, 18 bp, Homo sapiens
agatgatgctttggaaga

SEQ ID NO: 5181174 - DNA, 13 bp, Homo sapiens
agatgatggaaac

SEQ ID NO: 5181175 - DNA, 19 bp, Homo sapiens
agatgatggatgccaatat

SEQ ID NO: 5181176 - DNA, 13 bp, Homo sapiens
agatgatggattt

SEQ ID NO: 5181177 - DNA, 17 bp, Homo sapiens
agatgatgggggagggg

SEQ ID NO: 5181178 - DNA, 22 bp, Homo sapiens
agatgatgtgatggaacacaca

SEQ ID NO: 5181179 - DNA, 23 bp, Homo sapiens
agatgatgtttgcttttctaaga

SEQ ID NO: 5181180 - DNA, 15 bp, Homo sapiens
agatgattatatatt

SEQ ID NO: 5181181 - DNA, 14 bp, Homo sapiens
agatgattcaaata

SEQ ID NO: 5181182 - DNA, 12 bp, Homo sapiens
agatgattctgg

SEQ ID NO: 5181183 - DNA, 16 bp, Homo sapiens
agatgatttaattctt

SEQ ID NO: 5181184 - DNA, 18 bp, Homo sapiens
agatgatttaattcttac

SEQ ID NO: 5181185 - DNA, 22 bp, Homo sapiens
agatgatttcccccctccgcct

SEQ ID NO: 5181186 - DNA, 21 bp, Homo sapiens
agatgatttctagcaggcagg

SEQ ID NO: 5181187 - DNA, 14 bp, Homo sapiens
agatgatttgcaat

SEQ ID NO: 5181188 - DNA, 17 bp, Homo sapiens
agatgatttgggcagag

SEQ ID NO: 5181189 - DNA, 12 bp, Homo sapiens
agatgatttgta

SEQ ID NO: 5181190 - DNA, 13 bp, Homo sapiens
agatgatttgtac

SEQ ID NO: 5181191 - DNA, 19 bp, Homo sapiens
agatgattttcctccctgg

SEQ ID NO: 5181192 - DNA, 15 bp, Homo sapiens
agatgcaaagaggca

SEQ ID NO: 5181193 - DNA, 18 bp, Homo sapiens
agatgcaaagaggcaaga

SEQ ID NO: 5181194 - DNA, 13 bp, Homo sapiens
agatgcaaatgca

SEQ ID NO: 5181195 - DNA, 16 bp, Homo sapiens
agatgcaacctcacta

SEQ ID NO: 5181196 - DNA, 20 bp, Homo sapiens
agatgcaatgactcaggaca

SEQ ID NO: 5181197 - DNA, 14 bp, Homo sapiens
agatgcaattgttt

SEQ ID NO: 5181198 - DNA, 17 bp, Homo sapiens
agatgcacacacagatg

SEQ ID NO: 5181199 - DNA, 12 bp, Homo sapiens
agatgcactgaa

SEQ ID NO: 5181200 - DNA, 16 bp, Homo sapiens
agatgcagaaaaagaa

SEQ ID NO: 5181201 - DNA, 13 bp, Homo sapiens
agatgcagagagc

SEQ ID NO: 5181202 - DNA, 15 bp, Homo sapiens
agatgcagagagcca

SEQ ID NO: 5181203 - DNA, 17 bp, Homo sapiens
agatgcagagagccatt

SEQ ID NO: 5181204 - DNA, 19 bp, Homo sapiens
agatgcagagtaagtatta

SEQ ID NO: 5181205 - DNA, 13 bp, Homo sapiens
agatgcagccttc

SEQ ID NO: 5181206 - DNA, 16 bp, Homo sapiens
agatgcagctcttcct

SEQ ID NO: 5181207 - DNA, 15 bp, Homo sapiens
agatgcagctggaaa

SEQ ID NO: 5181208 - DNA, 18 bp, Homo sapiens
agatgcaggacaggaggc

SEQ ID NO: 5181209 - DNA, 21 bp, Homo sapiens
agatgcaggttggaaggggcc

SEQ ID NO: 5181210 - DNA, 19 bp, Homo sapiens
agatgcaggtttgaccagg

SEQ ID NO: 5181211 - DNA, 23 bp, Homo sapiens
agatgcaggtttgaccaggaaag

SEQ ID NO: 5181212 - DNA, 16 bp, Homo sapiens
agatgcaggttttcta

SEQ ID NO: 5181213 - DNA, 15 bp, Homo sapiens
agatgcagtattgag

SEQ ID NO: 5181214 - DNA, 15 bp, Homo sapiens
agatgcagtcctcag

SEQ ID NO: 5181215 - DNA, 15 bp, Homo sapiens
agatgcagtgccagg

SEQ ID NO: 5181216 - DNA, 18 bp, Homo sapiens
agatgcagttctgaagaa

SEQ ID NO: 5181217 - DNA, 21 bp, Homo sapiens
agatgcagttctgaagaagat

SEQ ID NO: 5181218 - DNA, 17 bp, Homo sapiens
agatgcatatagacaca

SEQ ID NO: 5181219 - DNA, 19 bp, Homo sapiens
agatgcatatagacacaca

SEQ ID NO: 5181220 - DNA, 13 bp, Homo sapiens
agatgcatctgtg

SEQ ID NO: 5181221 - DNA, 18 bp, Homo sapiens
agatgcatgcgcaggctc

SEQ ID NO: 5181222 - DNA, 14 bp, Homo sapiens
agatgcatggcctc

SEQ ID NO: 5181223 - DNA, 15 bp, Homo sapiens
agatgcattgtagtt

SEQ ID NO: 5181224 - DNA, 19 bp, Homo sapiens
agatgcatttgggtccagg

SEQ ID NO: 5181225 - DNA, 20 bp, Homo sapiens
agatgcatttgggtccagga

SEQ ID NO: 5181226 - DNA, 23 bp, Homo sapiens
agatgcatttgggtccaggagga

SEQ ID NO: 5181227 - DNA, 21 bp, Homo sapiens
agatgcattttaaatgtctat

SEQ ID NO: 5181228 - DNA, 19 bp, Homo sapiens
agatgcattttgtgtacag

SEQ ID NO: 5181229 - DNA, 18 bp, Homo sapiens
agatgccaaaaaagatgc

SEQ ID NO: 5181230 - DNA, 23 bp, Homo sapiens
agatgccaaggaggtcccaggaa

SEQ ID NO: 5181231 - DNA, 12 bp, Homo sapiens
agatgccaaggg

SEQ ID NO: 5181232 - DNA, 14 bp, Homo sapiens
agacgcaggaatgg

SEQ ID NO: 5181233 - DNA, 13 bp, Homo sapiens
agacgccacctgg

SEQ ID NO: 5181234 - DNA, 23 bp, Homo sapiens
agacgccactccctgggacacag

SEQ ID NO: 5181235 - DNA, 20 bp, Homo sapiens
agacgccaggcaccacagcc

SEQ ID NO: 5181236 - DNA, 22 bp, Homo sapiens
agacgccaggcaccacagcctc

SEQ ID NO: 5181237 - DNA, 21 bp, Homo sapiens
agacgcccagccccatccctg

SEQ ID NO: 5181238 - DNA, 22 bp, Homo sapiens
agacgccctaggaggagaactt

SEQ ID NO: 5181239 - DNA, 20 bp, Homo sapiens
agacgccggggacagaggcc

SEQ ID NO: 5181240 - DNA, 15 bp, Homo sapiens
agacgcctgagctca

SEQ ID NO: 5181241 - DNA, 19 bp, Homo sapiens
agacgcctgcttttgcaaa

SEQ ID NO: 5181242 - DNA, 14 bp, Homo sapiens
agacgcctggctgc

SEQ ID NO: 5181243 - DNA, 15 bp, Homo sapiens
agacgcctggctgct

SEQ ID NO: 5181244 - DNA, 20 bp, Homo sapiens
agacgccttcatctgggaca

SEQ ID NO: 5181245 - DNA, 20 bp, Homo sapiens
agacgcggcggggactcgga

SEQ ID NO: 5181246 - DNA, 18 bp, Homo sapiens
agacgctcaagaatcctc

SEQ ID NO: 5181247 - DNA, 19 bp, Homo sapiens
agacgctcattcagcatct

SEQ ID NO: 5181248 - DNA, 13 bp, Homo sapiens
agacgctcctgaa

SEQ ID NO: 5181249 - DNA, 16 bp, Homo sapiens
agacgctgtgctgccc

SEQ ID NO: 5181250 - DNA, 20 bp, Homo sapiens
agacgctgtgctgccctgcc

SEQ ID NO: 5181251 - DNA, 14 bp, Homo sapiens
agacggaaaacaat

SEQ ID NO: 5181252 - DNA, 16 bp, Homo sapiens
agacggaagtaaatta

SEQ ID NO: 5181253 - DNA, 21 bp, Homo sapiens
agacggaagtaaattatgatg

SEQ ID NO: 5181254 - DNA, 20 bp, Homo sapiens
agacggacgggacagcggcc

SEQ ID NO: 5181255 - DNA, 23 bp, Homo sapiens
agacggacgggacagcggcccgg

SEQ ID NO: 5181256 - DNA, 18 bp, Homo sapiens
agacggagtcccaccttg

SEQ ID NO: 5181257 - DNA, 17 bp, Homo sapiens
agacggatggaaggaga

SEQ ID NO: 5181258 - DNA, 18 bp, Homo sapiens
agacggatggaaggagag

SEQ ID NO: 5181259 - DNA, 13 bp, Homo sapiens
agacggatttgct

SEQ ID NO: 5181260 - DNA, 16 bp, Homo sapiens
agacggcacccaccca

SEQ ID NO: 5181261 - DNA, 20 bp, Homo sapiens
agacggcacggtcttccctc

SEQ ID NO: 5181262 - DNA, 19 bp, Homo sapiens
agacggcggccaggcacag

SEQ ID NO: 5181263 - DNA, 13 bp, Homo sapiens
agacggctggacc

SEQ ID NO: 5181264 - DNA, 14 bp, Homo sapiens
agacggctggacct

SEQ ID NO: 5181265 - DNA, 15 bp, Homo sapiens
agacggctggacctg

SEQ ID NO: 5181266 - DNA, 21 bp, Homo sapiens
agacgggaggggaaaggctgc

SEQ ID NO: 5181267 - DNA, 18 bp, Homo sapiens
agacgggcaagaagctgc

SEQ ID NO: 5181268 - DNA, 14 bp, Homo sapiens
agacgggcacagac

SEQ ID NO: 5181269 - DNA, 15 bp, Homo sapiens
agacggggagtgaga

SEQ ID NO: 5181270 - DNA, 20 bp, Homo sapiens
agacgggttgaaagacatca

SEQ ID NO: 5181271 - DNA, 13 bp, Homo sapiens
agacggtctgtgt

SEQ ID NO: 5181272 - DNA, 16 bp, Homo sapiens
agacggtctgtgtgct

SEQ ID NO: 5181273 - DNA, 21 bp, Homo sapiens
agacggtgtcttgttctgtca

SEQ ID NO: 5181274 - DNA, 13 bp, Homo sapiens
agacggtgtggtt

SEQ ID NO: 5181275 - DNA, 15 bp, Homo sapiens
agacggtgttgggag

SEQ ID NO: 5181276 - DNA, 19 bp, Homo sapiens
agacggttcaccagcctct

SEQ ID NO: 5181277 - DNA, 17 bp, Homo sapiens
agacgtaggggaggggt

SEQ ID NO: 5181278 - DNA, 18 bp, Homo sapiens
agacgtatgcttatttta

SEQ ID NO: 5181279 - DNA, 14 bp, Homo sapiens
agacgtcaggggca

SEQ ID NO: 5181280 - DNA, 16 bp, Homo sapiens
agacgtccatagctcc

SEQ ID NO: 5181281 - DNA, 18 bp, Homo sapiens
agacgtccatagctcctc

SEQ ID NO: 5181282 - DNA, 19 bp, Homo sapiens
agacgtcctggaatgaagc

SEQ ID NO: 5181283 - DNA, 22 bp, Homo sapiens
agacgtcctggaatgaagcatg

SEQ ID NO: 5181284 - DNA, 19 bp, Homo sapiens
agacgtctcaagactgaaa

SEQ ID NO: 5181285 - DNA, 19 bp, Homo sapiens
agacgtctccccttctctg

SEQ ID NO: 5181286 - DNA, 23 bp, Homo sapiens
agacgtctccccttctctgcctc

SEQ ID NO: 5181287 - DNA, 23 bp, Homo sapiens
agacgtgaaaggaatacacttgt

SEQ ID NO: 5181288 - DNA, 17 bp, Homo sapiens
agacgtgaatgtctcag

SEQ ID NO: 5181289 - DNA, 18 bp, Homo sapiens
agacgtgaatgtctcagc

SEQ ID NO: 5181290 - DNA, 19 bp, Homo sapiens
agacgtgaatgtctcagcg

SEQ ID NO: 5181291 - DNA, 20 bp, Homo sapiens
agacgtggaacctctgtctc

SEQ ID NO: 5181292 - DNA, 21 bp, Homo sapiens
agacgtggaacctctgtctca

SEQ ID NO: 5181293 - DNA, 17 bp, Homo sapiens
agacgtggtctagacca

SEQ ID NO: 5181294 - DNA, 23 bp, Homo sapiens
agacgtggtctagaccagggctg

SEQ ID NO: 5181295 - DNA, 13 bp, Homo sapiens
agacgtggtgctt

SEQ ID NO: 5181296 - DNA, 14 bp, Homo sapiens
agacgtgtttgtgt

SEQ ID NO: 5181297 - DNA, 17 bp, Homo sapiens
agacgttaccaattatg

SEQ ID NO: 5181298 - DNA, 15 bp, Homo sapiens
agacgtttaactgca

SEQ ID NO: 5181299 - DNA, 22 bp, Homo sapiens
agacgtttggactgatttgtgg

SEQ ID NO: 5181300 - DNA, 22 bp, Homo sapiens
agacgttttataagcatcatta

SEQ ID NO: 5181301 - DNA, 21 bp, Homo sapiens
agacgtttttgtgctgtgggc

SEQ ID NO: 5181302 - DNA, 22 bp, Homo sapiens
agacgtttttgtgctgtgggca

SEQ ID NO: 5181303 - DNA, 17 bp, Homo sapiens
agacgttttttctgcac

SEQ ID NO: 5181304 - DNA, 22 bp, Homo sapiens
agactaaaaaggcccctgtggt

SEQ ID NO: 5181305 - DNA, 14 bp, Homo sapiens
agactaaaaataca

SEQ ID NO: 5181306 - DNA, 16 bp, Homo sapiens
agactaaaaatacacc

SEQ ID NO: 5181307 - DNA, 22 bp, Homo sapiens
agactaaaggatccagagagca

SEQ ID NO: 5181308 - DNA, 12 bp, Homo sapiens
agactaaatgaa

SEQ ID NO: 5181309 - DNA, 14 bp, Homo sapiens
agactaaatgagag

SEQ ID NO: 5181310 - DNA, 13 bp, Homo sapiens
agactaaattcaa

SEQ ID NO: 5181311 - DNA, 19 bp, Homo sapiens
agactaaattcaatcacca

SEQ ID NO: 5181312 - DNA, 13 bp, Homo sapiens
agactaagaaata

SEQ ID NO: 5181313 - DNA, 14 bp, Homo sapiens
agactaagaaatat

SEQ ID NO: 5181314 - DNA, 14 bp, Homo sapiens
agactaagccctgt

SEQ ID NO: 5181315 - DNA, 24 bp, Homo sapiens
agactaagggcaggaagacttcca

SEQ ID NO: 5181316 - DNA, 14 bp, Homo sapiens
agactaagttgcta

SEQ ID NO: 5181317 - DNA, 16 bp, Homo sapiens
agactaatagagacac

SEQ ID NO: 5181318 - DNA, 17 bp, Homo sapiens
agactaattaaaatctg

SEQ ID NO: 5181319 - DNA, 20 bp, Homo sapiens
agactaattaaaatctggaa

SEQ ID NO: 5181320 - DNA, 16 bp, Homo sapiens
agactacacaggatga

SEQ ID NO: 5181321 - DNA, 21 bp, Homo sapiens
agactacagctggggtgcagg

SEQ ID NO: 5181322 - DNA, 16 bp, Homo sapiens
agactactattttctt

SEQ ID NO: 5181323 - DNA, 15 bp, Homo sapiens
agactactggcctct

SEQ ID NO: 5181324 - DNA, 17 bp, Homo sapiens
agactagaattctagtg

SEQ ID NO: 5181325 - DNA, 20 bp, Homo sapiens
agactagaattctagtgctg

SEQ ID NO: 5181326 - DNA, 22 bp, Homo sapiens
agactagaattctagtgctgct

SEQ ID NO: 5181327 - DNA, 23 bp, Homo sapiens
agactagaattctagtgctgctg

SEQ ID NO: 5181328 - DNA, 19 bp, Homo sapiens
agactagaggccagggcag

SEQ ID NO: 5181329 - DNA, 21 bp, Homo sapiens
agactagagtctgagatgccc

SEQ ID NO: 5181330 - DNA, 19 bp, Homo sapiens
agactagatgtagtatttt

SEQ ID NO: 5181331 - DNA, 23 bp, Homo sapiens
agactagatgtagtattttttgt

SEQ ID NO: 5181332 - DNA, 17 bp, Homo sapiens
agactagattctcacct

SEQ ID NO: 5181333 - DNA, 16 bp, Homo sapiens
agactagattgccttt

SEQ ID NO: 5181334 - DNA, 23 bp, Homo sapiens
agactagcaatctcttcattatt

SEQ ID NO: 5181335 - DNA, 13 bp, Homo sapiens
agactagccagcc

SEQ ID NO: 5181336 - DNA, 15 bp, Homo sapiens
agactagccagccag

SEQ ID NO: 5181337 - DNA, 16 bp, Homo sapiens
agactaggagaccaga

SEQ ID NO: 5181338 - DNA, 17 bp, Homo sapiens
agactaggagaccagaa

SEQ ID NO: 5181339 - DNA, 20 bp, Homo sapiens
agactaggagaccagaagtg

SEQ ID NO: 5181340 - DNA, 22 bp, Homo sapiens
agactaggagaccagaagtgaa

SEQ ID NO: 5181341 - DNA, 22 bp, Homo sapiens
agactaggctctagtgttcaga

SEQ ID NO: 5181342 - DNA, 14 bp, Homo sapiens
agactagttgaaca

SEQ ID NO: 5181343 - DNA, 22 bp, Homo sapiens
agactagtttttattccttgtg

SEQ ID NO: 5181344 - DNA, 19 bp, Homo sapiens
agactatatacatgtgtgt

SEQ ID NO: 5181345 - DNA, 21 bp, Homo sapiens
agactatatacatgtgtgtat

SEQ ID NO: 5181346 - DNA, 21 bp, Homo sapiens
agactatatatataaatgtat

SEQ ID NO: 5181347 - DNA, 19 bp, Homo sapiens
agactatctaaatgttgaa

SEQ ID NO: 5181348 - DNA, 15 bp, Homo sapiens
agactatgaaaatgc

SEQ ID NO: 5181349 - DNA, 14 bp, Homo sapiens
agactatggcctcg

SEQ ID NO: 5181350 - DNA, 23 bp, Homo sapiens
agactatggcctcgcctccccac

SEQ ID NO: 5181351 - DNA, 18 bp, Homo sapiens
agactatgtaaaaataac

SEQ ID NO: 5181352 - DNA, 19 bp, Homo sapiens
agactattatgaaatcata

SEQ ID NO: 5181353 - DNA, 16 bp, Homo sapiens
agactattcaaacagt

SEQ ID NO: 5181354 - DNA, 21 bp, Homo sapiens
agactattcaaacagtctcag

SEQ ID NO: 5181355 - DNA, 19 bp, Homo sapiens
agactattcatcaagaatg

SEQ ID NO: 5181356 - DNA, 20 bp, Homo sapiens
agactattccttttctgtat

SEQ ID NO: 5181357 - DNA, 17 bp, Homo sapiens
agactatttaaacttat

SEQ ID NO: 5181358 - DNA, 12 bp, Homo sapiens
agactatttgct

SEQ ID NO: 5181359 - DNA, 14 bp, Homo sapiens
agactatttttaga

SEQ ID NO: 5181360 - DNA, 14 bp, Homo sapiens
agactatttttcta

SEQ ID NO: 5181361 - DNA, 16 bp, Homo sapiens
agactcaaagaagtac

SEQ ID NO: 5181362 - DNA, 19 bp, Homo sapiens
agactcaaagaagtactgt

SEQ ID NO: 5181363 - DNA, 14 bp, Homo sapiens
agactcaaagaata

SEQ ID NO: 5181364 - DNA, 16 bp, Homo sapiens
agactcaaggggctgg

SEQ ID NO: 5181365 - DNA, 18 bp, Homo sapiens
agactcaatgtgctctgt

SEQ ID NO: 5181366 - DNA, 14 bp, Homo sapiens
agactcacaggaag

SEQ ID NO: 5181367 - DNA, 17 bp, Homo sapiens
agactcacctctgcctc

SEQ ID NO: 5181368 - DNA, 19 bp, Homo sapiens
agactcacggctgcacctg

SEQ ID NO: 5181369 - DNA, 22 bp, Homo sapiens
agactcactagcccaagtaatc

SEQ ID NO: 5181370 - DNA, 21 bp, Homo sapiens
agactcactgttaagaataga

SEQ ID NO: 5181371 - DNA, 18 bp, Homo sapiens
agactcacttgccattgc

SEQ ID NO: 5181372 - DNA, 15 bp, Homo sapiens
agactcagactccat

SEQ ID NO: 5181373 - DNA, 18 bp, Homo sapiens
agactcagagctctctct

SEQ ID NO: 5181374 - DNA, 15 bp, Homo sapiens
agactcagaggtcca

SEQ ID NO: 5181375 - DNA, 13 bp, Homo sapiens
agactcagatgat

SEQ ID NO: 5181376 - DNA, 14 bp, Homo sapiens
agactcagcagagt

SEQ ID NO: 5181377 - DNA, 21 bp, Homo sapiens
agactcagccaagacaaggag

SEQ ID NO: 5181378 - DNA, 17 bp, Homo sapiens
agactcagcctctgctg

SEQ ID NO: 5181379 - DNA, 23 bp, Homo sapiens
agactcagcctgcagttaattag

SEQ ID NO: 5181380 - DNA, 18 bp, Homo sapiens
agactcagcgctcctcct

SEQ ID NO: 5181381 - DNA, 17 bp, Homo sapiens
agactcagctccagaat

SEQ ID NO: 5181382 - DNA, 18 bp, Homo sapiens
agactcagctctgacatt

SEQ ID NO: 5181383 - DNA, 15 bp, Homo sapiens
agactcagctggaag

SEQ ID NO: 5181384 - DNA, 18 bp, Homo sapiens
agactcaggagtctgcca

SEQ ID NO: 5181385 - DNA, 20 bp, Homo sapiens
agactcaggagtctgccact

SEQ ID NO: 5181386 - DNA, 12 bp, Homo sapiens
agactcagggcc

SEQ ID NO: 5181387 - DNA, 20 bp, Homo sapiens
agactcagggccccagcact

SEQ ID NO: 5181388 - DNA, 23 bp, Homo sapiens
agactcaggggatcggctgggaa

SEQ ID NO: 5181389 - DNA, 13 bp, Homo sapiens
agactcagttttt

SEQ ID NO: 5181390 - DNA, 17 bp, Homo sapiens
agactcagttttttgta

SEQ ID NO: 5181391 - DNA, 18 bp, Homo sapiens
agactcagttttttgtaa

SEQ ID NO: 5181392 - DNA, 18 bp, Homo sapiens
agactcatacagaaggtg

SEQ ID NO: 5181393 - DNA, 15 bp, Homo sapiens
agactcatattactg

SEQ ID NO: 5181394 - DNA, 19 bp, Homo sapiens
agactcatcctgaacagca

SEQ ID NO: 5181395 - DNA, 18 bp, Homo sapiens
agactcattgctggaggt

SEQ ID NO: 5181396 - DNA, 19 bp, Homo sapiens
agactcatttcacagcctt

SEQ ID NO: 5181397 - DNA, 12 bp, Homo sapiens
agactccaaaga

SEQ ID NO: 5181398 - DNA, 19 bp, Homo sapiens
agactccaaagaaatgtaa

SEQ ID NO: 5181399 - DNA, 22 bp, Homo sapiens
agactccaaagaaatgtaaggg

SEQ ID NO: 5181400 - DNA, 14 bp, Homo sapiens
agactccacctcaa

SEQ ID NO: 5181401 - DNA, 14 bp, Homo sapiens
agactccagcccct

SEQ ID NO: 5181402 - DNA, 18 bp, Homo sapiens
agactccagcccctggac

SEQ ID NO: 5181403 - DNA, 21 bp, Homo sapiens
agactccaggcccccgttgaa

SEQ ID NO: 5181404 - DNA, 16 bp, Homo sapiens
agactccatagtttgg

SEQ ID NO: 5181405 - DNA, 12 bp, Homo sapiens
agactccatctc

SEQ ID NO: 5181406 - DNA, 13 bp, Homo sapiens
agactccatctct

SEQ ID NO: 5181407 - DNA, 23 bp, Homo sapiens
agactccatctctttaaaaacaa

SEQ ID NO: 5181408 - DNA, 14 bp, Homo sapiens
agactcccaggagt

SEQ ID NO: 5181409 - DNA, 22 bp, Homo sapiens
agatgccacttctcactcacca

SEQ ID NO: 5181410 - DNA, 21 bp, Homo sapiens
agatgccagagcaaagggcca

SEQ ID NO: 5181411 - DNA, 14 bp, Homo sapiens
agatgccagccctt

SEQ ID NO: 5181412 - DNA, 15 bp, Homo sapiens
agatgccagcccttc

SEQ ID NO: 5181413 - DNA, 17 bp, Homo sapiens
agatgccagcccttcag

SEQ ID NO: 5181414 - DNA, 21 bp, Homo sapiens
agatgccagcttctctctcca

SEQ ID NO: 5181415 - DNA, 13 bp, Homo sapiens
agatgccagtgaa

SEQ ID NO: 5181416 - DNA, 15 bp, Homo sapiens
agatgccatagcata

SEQ ID NO: 5181417 - DNA, 16 bp, Homo sapiens
agatgccatctgtgtc

SEQ ID NO: 5181418 - DNA, 17 bp, Homo sapiens
agatgccccagagctgt

SEQ ID NO: 5181419 - DNA, 14 bp, Homo sapiens
agatgccccaggga

SEQ ID NO: 5181420 - DNA, 15 bp, Homo sapiens
agatgccccagggat

SEQ ID NO: 5181421 - DNA, 17 bp, Homo sapiens
agatgccccattccttg

SEQ ID NO: 5181422 - DNA, 19 bp, Homo sapiens
agatgccccgagcccaggc

SEQ ID NO: 5181423 - DNA, 17 bp, Homo sapiens
agatgccggagccccaa

SEQ ID NO: 5181424 - DNA, 23 bp, Homo sapiens
agatgcctaaaaattcccttcct

SEQ ID NO: 5181425 - DNA, 22 bp, Homo sapiens
agatgcctacaaccatccctgc

SEQ ID NO: 5181426 - DNA, 19 bp, Homo sapiens
agatgcctacttttggcct

SEQ ID NO: 5181427 - DNA, 13 bp, Homo sapiens
agatgcctccacc

SEQ ID NO: 5181428 - DNA, 14 bp, Homo sapiens
agatgcctccaccg

SEQ ID NO: 5181429 - DNA, 21 bp, Homo sapiens
agatgcctccctgaccctgca

SEQ ID NO: 5181430 - DNA, 23 bp, Homo sapiens
agatgcctccctgaccctgcaga

SEQ ID NO: 5181431 - DNA, 19 bp, Homo sapiens
agatgcctcctgatgggac

SEQ ID NO: 5181432 - DNA, 13 bp, Homo sapiens
agatgcctccttc

SEQ ID NO: 5181433 - DNA, 11 bp, Homo sapiens
agatgcctctt

SEQ ID NO: 5181434 - DNA, 22 bp, Homo sapiens
agatgcctcttctacctcttcc

SEQ ID NO: 5181435 - DNA, 23 bp, Homo sapiens
agatgcctcttctacctcttcca

SEQ ID NO: 5181436 - DNA, 13 bp, Homo sapiens
agatgcctgggcc

SEQ ID NO: 5181437 - DNA, 14 bp, Homo sapiens
agatgcctgggcct

SEQ ID NO: 5181438 - DNA, 22 bp, Homo sapiens
agatgccttttttgtagttttt

SEQ ID NO: 5181439 - DNA, 19 bp, Homo sapiens
agatgcgcagccccatctg

SEQ ID NO: 5181440 - DNA, 15 bp, Homo sapiens
agatgcggggacagg

SEQ ID NO: 5181441 - DNA, 23 bp, Homo sapiens
agatgcgtcccaagatgttgatt

SEQ ID NO: 5181442 - DNA, 20 bp, Homo sapiens
agatgcgttcagcagactgg

SEQ ID NO: 5181443 - DNA, 18 bp, Homo sapiens
agatgcgtttgcctcctg

SEQ ID NO: 5181444 - DNA, 20 bp, Homo sapiens
agatgctaaaatccctggat

SEQ ID NO: 5181445 - DNA, 14 bp, Homo sapiens
agatgctaatagaa

SEQ ID NO: 5181446 - DNA, 15 bp, Homo sapiens
agatgctaatttatt

SEQ ID NO: 5181447 - DNA, 23 bp, Homo sapiens
agatgctacaatggaaaccattt

SEQ ID NO: 5181448 - DNA, 18 bp, Homo sapiens
agatgctactgtcagtgt

SEQ ID NO: 5181449 - DNA, 19 bp, Homo sapiens
agatgctagaactcccttt

SEQ ID NO: 5181450 - DNA, 22 bp, Homo sapiens
agatgctagaactccctttcaa

SEQ ID NO: 5181451 - DNA, 23 bp, Homo sapiens
agatgctagaactccctttcaac

SEQ ID NO: 5181452 - DNA, 23 bp, Homo sapiens
agatgctaggctgtctgcgaaga

SEQ ID NO: 5181453 - DNA, 18 bp, Homo sapiens
agatgctatcacagactc

SEQ ID NO: 5181454 - DNA, 17 bp, Homo sapiens
agatgctattaagaagg

SEQ ID NO: 5181455 - DNA, 10 bp, Homo sapiens
agatgctcaa

SEQ ID NO: 5181456 - DNA, 20 bp, Homo sapiens
agatgctcaaagttgttttt

SEQ ID NO: 5181457 - DNA, 21 bp, Homo sapiens
agatgctcaggtacagagaag

SEQ ID NO: 5181458 - DNA, 15 bp, Homo sapiens
agatgctccaagatt

SEQ ID NO: 5181459 - DNA, 21 bp, Homo sapiens
agatgctccaagattctagat

SEQ ID NO: 5181460 - DNA, 22 bp, Homo sapiens
agatgctccaagattctagatg

SEQ ID NO: 5181461 - DNA, 14 bp, Homo sapiens
agatgctctctgag

SEQ ID NO: 5181462 - DNA, 16 bp, Homo sapiens
agatgctctctgaggc

SEQ ID NO: 5181463 - DNA, 22 bp, Homo sapiens
agatgctcttggggttcatagg

SEQ ID NO: 5181464 - DNA, 21 bp, Homo sapiens
agatgctgaaacaggagagaa

SEQ ID NO: 5181465 - DNA, 13 bp, Homo sapiens
agatgctgaggcc

SEQ ID NO: 5181466 - DNA, 13 bp, Homo sapiens
agatgctgatgtt

SEQ ID NO: 5181467 - DNA, 17 bp, Homo sapiens
agatgctgatgttcagt

SEQ ID NO: 5181468 - DNA, 19 bp, Homo sapiens
agatgctgatgttcagtgt

SEQ ID NO: 5181469 - DNA, 23 bp, Homo sapiens
agatgctgctcccgcctgattgg

SEQ ID NO: 5181470 - DNA, 13 bp, Homo sapiens
agatgctgctgaa

SEQ ID NO: 5181471 - DNA, 18 bp, Homo sapiens
agatgctgctgaagagag

SEQ ID NO: 5181472 - DNA, 11 bp, Homo sapiens
agatgctggag

SEQ ID NO: 5181473 - DNA, 20 bp, Homo sapiens
agatgctggagaagagagga

SEQ ID NO: 5181474 - DNA, 22 bp, Homo sapiens
agatgctggagaagagaggaga

SEQ ID NO: 5181475 - DNA, 17 bp, Homo sapiens
agatgctggcccagggc

SEQ ID NO: 5181476 - DNA, 18 bp, Homo sapiens
agatgctggcccagggcc

SEQ ID NO: 5181477 - DNA, 15 bp, Homo sapiens
agatgctggccccaa

SEQ ID NO: 5181478 - DNA, 13 bp, Homo sapiens
agatgctggctgg

SEQ ID NO: 5181479 - DNA, 14 bp, Homo sapiens
agatgctggctggg

SEQ ID NO: 5181480 - DNA, 17 bp, Homo sapiens
agatgctggcttgggca

SEQ ID NO: 5181481 - DNA, 19 bp, Homo sapiens
agatgctggcttgggcagc

SEQ ID NO: 5181482 - DNA, 17 bp, Homo sapiens
agatgctgggagggctg

SEQ ID NO: 5181483 - DNA, 12 bp, Homo sapiens
agatgctgggct

SEQ ID NO: 5181484 - DNA, 23 bp, Homo sapiens
agatgctgggttggtgcacagtg

SEQ ID NO: 5181485 - DNA, 20 bp, Homo sapiens
agatgctggtcatcctgggc

SEQ ID NO: 5181486 - DNA, 14 bp, Homo sapiens
agatgctgtaaata

SEQ ID NO: 5181487 - DNA, 20 bp, Homo sapiens
agatgctgtaacttaaaata

SEQ ID NO: 5181488 - DNA, 16 bp, Homo sapiens
agatgctgtagtaact

SEQ ID NO: 5181489 - DNA, 22 bp, Homo sapiens
agatgctgtcactggcagagca

SEQ ID NO: 5181490 - DNA, 18 bp, Homo sapiens
agatgctgtgtatatggt

SEQ ID NO: 5181491 - DNA, 18 bp, Homo sapiens
agatgctgttgtgaagct

SEQ ID NO: 5181492 - DNA, 16 bp, Homo sapiens
agatgcttctcactgc

SEQ ID NO: 5181493 - DNA, 19 bp, Homo sapiens
agatgcttctctccttgcc

SEQ ID NO: 5181494 - DNA, 20 bp, Homo sapiens
agatgcttctctccttgccc

SEQ ID NO: 5181495 - DNA, 19 bp, Homo sapiens
agatgcttgctcttgggaa

SEQ ID NO: 5181496 - DNA, 14 bp, Homo sapiens
agatgcttggagca

SEQ ID NO: 5181497 - DNA, 20 bp, Homo sapiens
agatgcttttaacagagtct

SEQ ID NO: 5181498 - DNA, 14 bp, Homo sapiens
agatgcttttcaaa

SEQ ID NO: 5181499 - DNA, 19 bp, Homo sapiens
agatgcttttgctaatacc

SEQ ID NO: 5181500 - DNA, 16 bp, Homo sapiens
agatggaaaaataaca

SEQ ID NO: 5181501 - DNA, 18 bp, Homo sapiens
agatggaaaattcatttt

SEQ ID NO: 5181502 - DNA, 17 bp, Homo sapiens
agatggaaacaatgtgg

SEQ ID NO: 5181503 - DNA, 13 bp, Homo sapiens
agatggaaagagg

SEQ ID NO: 5181504 - DNA, 22 bp, Homo sapiens
agatggaaagaggtgaaaatga

SEQ ID NO: 5181505 - DNA, 18 bp, Homo sapiens
agatggaaattctgaaaa

SEQ ID NO: 5181506 - DNA, 17 bp, Homo sapiens
agatggaacactggaac

SEQ ID NO: 5181507 - DNA, 18 bp, Homo sapiens
agatggaagagataaacg

SEQ ID NO: 5181508 - DNA, 17 bp, Homo sapiens
agatggaagcttactct

SEQ ID NO: 5181509 - DNA, 18 bp, Homo sapiens
agatggaagcttgttgaa

SEQ ID NO: 5181510 - DNA, 15 bp, Homo sapiens
agatggaagtcacct

SEQ ID NO: 5181511 - DNA, 18 bp, Homo sapiens
agatggaatgctgtgtta

SEQ ID NO: 5181512 - DNA, 15 bp, Homo sapiens
agatggaatggaaaa

SEQ ID NO: 5181513 - DNA, 23 bp, Homo sapiens
agatggacacgagccacaagctg

SEQ ID NO: 5181514 - DNA, 13 bp, Homo sapiens
agatggacagaga

SEQ ID NO: 5181515 - DNA, 19 bp, Homo sapiens
agatggacagtttgtttcc

SEQ ID NO: 5181516 - DNA, 12 bp, Homo sapiens
agatggaccaaa

SEQ ID NO: 5181517 - DNA, 13 bp, Homo sapiens
agatggaccaaaa

SEQ ID NO: 5181518 - DNA, 18 bp, Homo sapiens
agatggaccccagcattt

SEQ ID NO: 5181519 - DNA, 22 bp, Homo sapiens
agatggactaattgacttgcaa

SEQ ID NO: 5181520 - DNA, 15 bp, Homo sapiens
agatggactctgaaa

SEQ ID NO: 5181521 - DNA, 13 bp, Homo sapiens
agatggactggga

SEQ ID NO: 5181522 - DNA, 23 bp, Homo sapiens
agatggacttggggcctctgacg

SEQ ID NO: 5181523 - DNA, 12 bp, Homo sapiens
agatggagaaaa

SEQ ID NO: 5181524 - DNA, 16 bp, Homo sapiens
agatggagaggaagaa

SEQ ID NO: 5181525 - DNA, 17 bp, Homo sapiens
agatggagaggaagaaa

SEQ ID NO: 5181526 - DNA, 15 bp, Homo sapiens
agatggagaggcatg

SEQ ID NO: 5181527 - DNA, 16 bp, Homo sapiens
agatggagaggcatgg

SEQ ID NO: 5181528 - DNA, 22 bp, Homo sapiens
agatggagaggctgagggacag

SEQ ID NO: 5181529 - DNA, 13 bp, Homo sapiens
agatggagcccat

SEQ ID NO: 5181530 - DNA, 15 bp, Homo sapiens
agatggaggccgagc

SEQ ID NO: 5181531 - DNA, 18 bp, Homo sapiens
agatggagggggctgggg

SEQ ID NO: 5181532 - DNA, 21 bp, Homo sapiens
agatggaggtttccttttgga

SEQ ID NO: 5181533 - DNA, 15 bp, Homo sapiens
agatggagtctcact

SEQ ID NO: 5181534 - DNA, 13 bp, Homo sapiens
agatggagtttct

SEQ ID NO: 5181535 - DNA, 15 bp, Homo sapiens
agatggagtttctaa

SEQ ID NO: 5181536 - DNA, 15 bp, Homo sapiens
agatggataaactga

SEQ ID NO: 5181537 - DNA, 17 bp, Homo sapiens
agatggatatgaccagt

SEQ ID NO: 5181538 - DNA, 22 bp, Homo sapiens
agatggatccacgtgctcgcct

SEQ ID NO: 5181539 - DNA, 21 bp, Homo sapiens
agatggatgaattatgataaa

SEQ ID NO: 5181540 - DNA, 13 bp, Homo sapiens
agatggatgtaga

SEQ ID NO: 5181541 - DNA, 11 bp, Homo sapiens
agatggattct

SEQ ID NO: 5181542 - DNA, 15 bp, Homo sapiens
agatggattctcaga

SEQ ID NO: 5181543 - DNA, 20 bp, Homo sapiens
agatggattctcagatattt

SEQ ID NO: 5181544 - DNA, 18 bp, Homo sapiens
agatggattggtgtaaaa

SEQ ID NO: 5181545 - DNA, 15 bp, Homo sapiens
agatggatttgcctg

SEQ ID NO: 5181546 - DNA, 20 bp, Homo sapiens
agatggatttgcctgtgcca

SEQ ID NO: 5181547 - DNA, 20 bp, Homo sapiens
agatggcaatagtcattaaa

SEQ ID NO: 5181548 - DNA, 22 bp, Homo sapiens
agatggcaatgggtactccagc

SEQ ID NO: 5181549 - DNA, 23 bp, Homo sapiens
agatggcacctgtggccagagca

SEQ ID NO: 5181550 - DNA, 14 bp, Homo sapiens
agatggcactgtcc

SEQ ID NO: 5181551 - DNA, 19 bp, Homo sapiens
agatggcactgtccagggc

SEQ ID NO: 5181552 - DNA, 13 bp, Homo sapiens
agatggcagagcc

SEQ ID NO: 5181553 - DNA, 14 bp, Homo sapiens
agatggcagagcca

SEQ ID NO: 5181554 - DNA, 22 bp, Homo sapiens
agatggcagagccatccaccct

SEQ ID NO: 5181555 - DNA, 15 bp, Homo sapiens
agatggcaggagagc

SEQ ID NO: 5181556 - DNA, 21 bp, Homo sapiens
agatggcataacctgtctcac

SEQ ID NO: 5181557 - DNA, 23 bp, Homo sapiens
agatggcatatatgtgatctggg

SEQ ID NO: 5181558 - DNA, 20 bp, Homo sapiens
agatggcatcaaaaaagata

SEQ ID NO: 5181559 - DNA, 17 bp, Homo sapiens
agatggcatcctgtgaa

SEQ ID NO: 5181560 - DNA, 16 bp, Homo sapiens
agatggccataggaga

SEQ ID NO: 5181561 - DNA, 16 bp, Homo sapiens
agatggcccaagggat

SEQ ID NO: 5181562 - DNA, 18 bp, Homo sapiens
agatggcccaagggatgg

SEQ ID NO: 5181563 - DNA, 13 bp, Homo sapiens
agatggccccaac

SEQ ID NO: 5181564 - DNA, 13 bp, Homo sapiens
agatggcccctcc

SEQ ID NO: 5181565 - DNA, 21 bp, Homo sapiens
agatggcccctccactgggga

SEQ ID NO: 5181566 - DNA, 21 bp, Homo sapiens
agatggccgggacatgcagct

SEQ ID NO: 5181567 - DNA, 14 bp, Homo sapiens
agatggcctgaagc

SEQ ID NO: 5181568 - DNA, 14 bp, Homo sapiens
agatggcctttgct

SEQ ID NO: 5181569 - DNA, 19 bp, Homo sapiens
agatggcgcacccggcagc

SEQ ID NO: 5181570 - DNA, 16 bp, Homo sapiens
agatggctcagagggg

SEQ ID NO: 5181571 - DNA, 17 bp, Homo sapiens
agatggctcccaggggc

SEQ ID NO: 5181572 - DNA, 15 bp, Homo sapiens
agatggctccctggg

SEQ ID NO: 5181573 - DNA, 18 bp, Homo sapiens
agatggctccctgggctg

SEQ ID NO: 5181574 - DNA, 14 bp, Homo sapiens
agatggctcctctc

SEQ ID NO: 5181575 - DNA, 15 bp, Homo sapiens
agatggctgctgcct

SEQ ID NO: 5181576 - DNA, 16 bp, Homo sapiens
agatggctgctgcctg

SEQ ID NO: 5181577 - DNA, 19 bp, Homo sapiens
agatggctgctgcctgctc

SEQ ID NO: 5181578 - DNA, 17 bp, Homo sapiens
agatggctgctgctcac

SEQ ID NO: 5181579 - DNA, 14 bp, Homo sapiens
agatggctgtgaaa

SEQ ID NO: 5181580 - DNA, 17 bp, Homo sapiens
agatggctgtgaaaatt

SEQ ID NO: 5181581 - DNA, 17 bp, Homo sapiens
agatggctgtgcctctg

SEQ ID NO: 5181582 - DNA, 18 bp, Homo sapiens
agatggctgtgcctctgc

SEQ ID NO: 5181583 - DNA, 19 bp, Homo sapiens
agatggctgtgcctctgcc

SEQ ID NO: 5181584 - DNA, 21 bp, Homo sapiens
agatggctgtgcctctgcctg

SEQ ID NO: 5181585 - DNA, 12 bp, Homo sapiens
agatggctgtgg

SEQ ID NO: 5181586 - DNA, 16 bp, Homo sapiens
agatggcttatgtcat

SEQ ID NO: 5181587 - DNA, 17 bp, Homo sapiens
agatggcttcggagggc

SEQ ID NO: 5181588 - DNA, 15 bp, Homo sapiens
agactcccaggagtt

SEQ ID NO: 5181589 - DNA, 15 bp, Homo sapiens
agactcccatgaagc

SEQ ID NO: 5181590 - DNA, 19 bp, Homo sapiens
agactcccgccccgggctg

SEQ ID NO: 5181591 - DNA, 16 bp, Homo sapiens
agactcccgcctttga

SEQ ID NO: 5181592 - DNA, 14 bp, Homo sapiens
agactccctccata

SEQ ID NO: 5181593 - DNA, 15 bp, Homo sapiens
agactccctcccctg

SEQ ID NO: 5181594 - DNA, 14 bp, Homo sapiens
agactccgccctcc

SEQ ID NO: 5181595 - DNA, 16 bp, Homo sapiens
agactccgctgtggga

SEQ ID NO: 5181596 - DNA, 17 bp, Homo sapiens
agactcctagctgtcct

SEQ ID NO: 5181597 - DNA, 22 bp, Homo sapiens
agactcctagctgtcctttttc

SEQ ID NO: 5181598 - DNA, 16 bp, Homo sapiens
agactcctaggccctt

SEQ ID NO: 5181599 - DNA, 11 bp, Homo sapiens
agactcctcag

SEQ ID NO: 5181600 - DNA, 14 bp, Homo sapiens
agactcctcctcca

SEQ ID NO: 5181601 - DNA, 13 bp, Homo sapiens
agactcctcgggc

SEQ ID NO: 5181602 - DNA, 14 bp, Homo sapiens
agactcctctgggc

SEQ ID NO: 5181603 - DNA, 23 bp, Homo sapiens
agactcctgactgtctcccggga

SEQ ID NO: 5181604 - DNA, 18 bp, Homo sapiens
agactcctgattgctctg

SEQ ID NO: 5181605 - DNA, 13 bp, Homo sapiens
agactcctgcagg

SEQ ID NO: 5181606 - DNA, 15 bp, Homo sapiens
agactcctgcaggca

SEQ ID NO: 5181607 - DNA, 11 bp, Homo sapiens
agactcctgct

SEQ ID NO: 5181608 - DNA, 15 bp, Homo sapiens
agactcctgcttctt

SEQ ID NO: 5181609 - DNA, 12 bp, Homo sapiens
agactcctggct

SEQ ID NO: 5181610 - DNA, 12 bp, Homo sapiens
agactccttctc

SEQ ID NO: 5181611 - DNA, 13 bp, Homo sapiens
agactccttctcc

SEQ ID NO: 5181612 - DNA, 16 bp, Homo sapiens
agactccttctcccca

SEQ ID NO: 5181613 - DNA, 15 bp, Homo sapiens
agactccttgtggac

SEQ ID NO: 5181614 - DNA, 18 bp, Homo sapiens
agactccttgtggactgg

SEQ ID NO: 5181615 - DNA, 17 bp, Homo sapiens
agactcctttcctctga

SEQ ID NO: 5181616 - DNA, 14 bp, Homo sapiens
agactcgagaactt

SEQ ID NO: 5181617 - DNA, 18 bp, Homo sapiens
agactcgagaactttcat

SEQ ID NO: 5181618 - DNA, 20 bp, Homo sapiens
agactcgagagggctgagcc

SEQ ID NO: 5181619 - DNA, 21 bp, Homo sapiens
agactcgagagggctgagccc

SEQ ID NO: 5181620 - DNA, 23 bp, Homo sapiens
agactcgagagggctgagcccct

SEQ ID NO: 5181621 - DNA, 23 bp, Homo sapiens
agactcgagaggtgggaggaact

SEQ ID NO: 5181622 - DNA, 18 bp, Homo sapiens
agactcgagtccccatga

SEQ ID NO: 5181623 - DNA, 20 bp, Homo sapiens
agactcgcctatcttaggta

SEQ ID NO: 5181624 - DNA, 15 bp, Homo sapiens
agactcgcgacaatg

SEQ ID NO: 5181625 - DNA, 20 bp, Homo sapiens
agactcgcgacaatgcaaac

SEQ ID NO: 5181626 - DNA, 14 bp, Homo sapiens
agactcggggtgct

SEQ ID NO: 5181627 - DNA, 22 bp, Homo sapiens
agactcggggtgcttccttgta

SEQ ID NO: 5181628 - DNA, 15 bp, Homo sapiens
agactcgtcttggca

SEQ ID NO: 5181629 - DNA, 17 bp, Homo sapiens
agactcgtcttggcaca

SEQ ID NO: 5181630 - DNA, 19 bp, Homo sapiens
agactctaaacacacaagt

SEQ ID NO: 5181631 - DNA, 14 bp, Homo sapiens
agactctaaatatt

SEQ ID NO: 5181632 - DNA, 13 bp, Homo sapiens
agactctaagata

SEQ ID NO: 5181633 - DNA, 23 bp, Homo sapiens
agactctagacaagatattgtac

SEQ ID NO: 5181634 - DNA, 19 bp, Homo sapiens
agactctagagtccaaggt

SEQ ID NO: 5181635 - DNA, 20 bp, Homo sapiens
agactctagagtccaaggtt

SEQ ID NO: 5181636 - DNA, 17 bp, Homo sapiens
agactctaggttataca

SEQ ID NO: 5181637 - DNA, 18 bp, Homo sapiens
agactctaggttatacaa

SEQ ID NO: 5181638 - DNA, 15 bp, Homo sapiens
agactctagtattta

SEQ ID NO: 5181639 - DNA, 19 bp, Homo sapiens
agactctatgctctggaaa

SEQ ID NO: 5181640 - DNA, 15 bp, Homo sapiens
agactctattctcaa

SEQ ID NO: 5181641 - DNA, 20 bp, Homo sapiens
agactctcagcccagaagaa

SEQ ID NO: 5181642 - DNA, 12 bp, Homo sapiens
agactctccact

SEQ ID NO: 5181643 - DNA, 14 bp, Homo sapiens
agactctccctgta

SEQ ID NO: 5181644 - DNA, 15 bp, Homo sapiens
agactctccttcagg

SEQ ID NO: 5181645 - DNA, 22 bp, Homo sapiens
agactctctcctctctctccct

SEQ ID NO: 5181646 - DNA, 14 bp, Homo sapiens
agactctcttagga

SEQ ID NO: 5181647 - DNA, 13 bp, Homo sapiens
agactctgagcca

SEQ ID NO: 5181648 - DNA, 22 bp, Homo sapiens
agactctgcctagaaacagtgt

SEQ ID NO: 5181649 - DNA, 14 bp, Homo sapiens
agactctgccttaa

SEQ ID NO: 5181650 - DNA, 19 bp, Homo sapiens
agactctgccttaattttt

SEQ ID NO: 5181651 - DNA, 20 bp, Homo sapiens
agactctgccttaatttttg

SEQ ID NO: 5181652 - DNA, 13 bp, Homo sapiens
agactctgctctc

SEQ ID NO: 5181653 - DNA, 15 bp, Homo sapiens
agactctggaagccc

SEQ ID NO: 5181654 - DNA, 15 bp, Homo sapiens
agactctggagccaa

SEQ ID NO: 5181655 - DNA, 16 bp, Homo sapiens
agactctggagccaag

SEQ ID NO: 5181656 - DNA, 13 bp, Homo sapiens
agactctggaggt

SEQ ID NO: 5181657 - DNA, 17 bp, Homo sapiens
agactctgtaacatcac

SEQ ID NO: 5181658 - DNA, 13 bp, Homo sapiens
agactctgtaacc

SEQ ID NO: 5181659 - DNA, 13 bp, Homo sapiens
agactctgtctaa

SEQ ID NO: 5181660 - DNA, 14 bp, Homo sapiens
agactctgtctcag

SEQ ID NO: 5181661 - DNA, 21 bp, Homo sapiens
agactctgtgtggctgtgcaa

SEQ ID NO: 5181662 - DNA, 18 bp, Homo sapiens
agactcttccaccagagc

SEQ ID NO: 5181663 - DNA, 20 bp, Homo sapiens
agactcttccaccagagcag

SEQ ID NO: 5181664 - DNA, 22 bp, Homo sapiens
agactcttccaccagagcaggg

SEQ ID NO: 5181665 - DNA, 17 bp, Homo sapiens
agactcttgcctgtttc

SEQ ID NO: 5181666 - DNA, 18 bp, Homo sapiens
agactcttgcctgtttcc

SEQ ID NO: 5181667 - DNA, 14 bp, Homo sapiens
agactctttatgct

SEQ ID NO: 5181668 - DNA, 23 bp, Homo sapiens
agactctttatttttctctttct

SEQ ID NO: 5181669 - DNA, 14 bp, Homo sapiens
agactctttgaaat

SEQ ID NO: 5181670 - DNA, 15 bp, Homo sapiens
agactctttgaaatg

SEQ ID NO: 5181671 - DNA, 22 bp, Homo sapiens
agactctttgggtccattcaga

SEQ ID NO: 5181672 - DNA, 18 bp, Homo sapiens
agactcttttccttccct

SEQ ID NO: 5181673 - DNA, 21 bp, Homo sapiens
agactctttttgtacctggtg

SEQ ID NO: 5181674 - DNA, 22 bp, Homo sapiens
agactctttttttgagtgacag

SEQ ID NO: 5181675 - DNA, 16 bp, Homo sapiens
agactgaaaaactgtt

SEQ ID NO: 5181676 - DNA, 23 bp, Homo sapiens
agactgaaaatatataagctcag

SEQ ID NO: 5181677 - DNA, 22 bp, Homo sapiens
agactgaaagaaactaagattt

SEQ ID NO: 5181678 - DNA, 14 bp, Homo sapiens
agactgaaatttag

SEQ ID NO: 5181679 - DNA, 19 bp, Homo sapiens
agactgaaatttagtacac

SEQ ID NO: 5181680 - DNA, 17 bp, Homo sapiens
agactgaacatgtacac

SEQ ID NO: 5181681 - DNA, 16 bp, Homo sapiens
agactgaacatgttta

SEQ ID NO: 5181682 - DNA, 19 bp, Homo sapiens
agactgaacatgtttacag

SEQ ID NO: 5181683 - DNA, 24 bp, Homo sapiens
agactgaatagatatgaaagctga

SEQ ID NO: 5181684 - DNA, 19 bp, Homo sapiens
agactgacaacctcatcca

SEQ ID NO: 5181685 - DNA, 18 bp, Homo sapiens
agactgacacctcactga

SEQ ID NO: 5181686 - DNA, 14 bp, Homo sapiens
agactgacactact

SEQ ID NO: 5181687 - DNA, 22 bp, Homo sapiens
agactgaccaatattgtacagt

SEQ ID NO: 5181688 - DNA, 20 bp, Homo sapiens
agactgacccattcacattt

SEQ ID NO: 5181689 - DNA, 21 bp, Homo sapiens
agactgacccattcacatttt

SEQ ID NO: 5181690 - DNA, 22 bp, Homo sapiens
agactgacccattcacatttta

SEQ ID NO: 5181691 - DNA, 14 bp, Homo sapiens
agactgacgccagg

SEQ ID NO: 5181692 - DNA, 14 bp, Homo sapiens
agactgactcacat

SEQ ID NO: 5181693 - DNA, 13 bp, Homo sapiens
agactgagaggca

SEQ ID NO: 5181694 - DNA, 15 bp, Homo sapiens
agactgagcagccgc

SEQ ID NO: 5181695 - DNA, 22 bp, Homo sapiens
agactgagctctccaggccagg

SEQ ID NO: 5181696 - DNA, 15 bp, Homo sapiens
agactgagggagaga

SEQ ID NO: 5181697 - DNA, 16 bp, Homo sapiens
agactgagggagagac

SEQ ID NO: 5181698 - DNA, 22 bp, Homo sapiens
agactgagggattttagcctct

SEQ ID NO: 5181699 - DNA, 15 bp, Homo sapiens
agactgagtaaagtg

SEQ ID NO: 5181700 - DNA, 19 bp, Homo sapiens
agactgataattttacaat

SEQ ID NO: 5181701 - DNA, 15 bp, Homo sapiens
agactgatagacacc

SEQ ID NO: 5181702 - DNA, 18 bp, Homo sapiens
agactgatagacaccata

SEQ ID NO: 5181703 - DNA, 17 bp, Homo sapiens
agactgatcaggacctc

SEQ ID NO: 5181704 - DNA, 15 bp, Homo sapiens
agactgatccctggc

SEQ ID NO: 5181705 - DNA, 20 bp, Homo sapiens
agactgatccctggccactg

SEQ ID NO: 5181706 - DNA, 15 bp, Homo sapiens
agactgatgaagaaa

SEQ ID NO: 5181707 - DNA, 16 bp, Homo sapiens
agactgatgagcacat

SEQ ID NO: 5181708 - DNA, 23 bp, Homo sapiens
agactgatggggtcgctctttgg

SEQ ID NO: 5181709 - DNA, 20 bp, Homo sapiens
agactgattggaattctttc

SEQ ID NO: 5181710 - DNA, 22 bp, Homo sapiens
agactgattggaattctttctg

SEQ ID NO: 5181711 - DNA, 23 bp, Homo sapiens
agactgattttaaaacttttctg

SEQ ID NO: 5181712 - DNA, 17 bp, Homo sapiens
agactgcaaaagaataa

SEQ ID NO: 5181713 - DNA, 21 bp, Homo sapiens
agactgcaaacttttttatat

SEQ ID NO: 5181714 - DNA, 15 bp, Homo sapiens
agactgcaagagatg

SEQ ID NO: 5181715 - DNA, 19 bp, Homo sapiens
agactgcaagaggctcctg

SEQ ID NO: 5181716 - DNA, 18 bp, Homo sapiens
agactgcacccaggaggg

SEQ ID NO: 5181717 - DNA, 13 bp, Homo sapiens
agactgcagacat

SEQ ID NO: 5181718 - DNA, 17 bp, Homo sapiens
agactgcagacattctc

SEQ ID NO: 5181719 - DNA, 20 bp, Homo sapiens
agactgcagacattctcaaa

SEQ ID NO: 5181720 - DNA, 21 bp, Homo sapiens
agactgcagacattctcaaag

SEQ ID NO: 5181721 - DNA, 11 bp, Homo sapiens
agactgcagct

SEQ ID NO: 5181722 - DNA, 14 bp, Homo sapiens
agactgcagctgct

SEQ ID NO: 5181723 - DNA, 14 bp, Homo sapiens
agactgcatctcaa

SEQ ID NO: 5181724 - DNA, 17 bp, Homo sapiens
agactgcatctcaaaaa

SEQ ID NO: 5181725 - DNA, 12 bp, Homo sapiens
agactgccagct

SEQ ID NO: 5181726 - DNA, 14 bp, Homo sapiens
agactgccagctct

SEQ ID NO: 5181727 - DNA, 18 bp, Homo sapiens
agactgcccaccctgggc

SEQ ID NO: 5181728 - DNA, 21 bp, Homo sapiens
agactgcccaccctgggcctc

SEQ ID NO: 5181729 - DNA, 15 bp, Homo sapiens
agactgccctgccca

SEQ ID NO: 5181730 - DNA, 20 bp, Homo sapiens
agactgccctgcccaggtat

SEQ ID NO: 5181731 - DNA, 11 bp, Homo sapiens
agactgcctcc

SEQ ID NO: 5181732 - DNA, 14 bp, Homo sapiens
agactgcctccctc

SEQ ID NO: 5181733 - DNA, 16 bp, Homo sapiens
agactgcctccctctc

SEQ ID NO: 5181734 - DNA, 21 bp, Homo sapiens
agactgcctccctctcttccg

SEQ ID NO: 5181735 - DNA, 17 bp, Homo sapiens
agactgccttatattat

SEQ ID NO: 5181736 - DNA, 14 bp, Homo sapiens
agactgccttcagt

SEQ ID NO: 5181737 - DNA, 18 bp, Homo sapiens
agactgccttcagtagga

SEQ ID NO: 5181738 - DNA, 17 bp, Homo sapiens
agactgcggagcagcct

SEQ ID NO: 5181739 - DNA, 20 bp, Homo sapiens
agactgcgggatggtcctgg

SEQ ID NO: 5181740 - DNA, 17 bp, Homo sapiens
agactgcgttctgcaag

SEQ ID NO: 5181741 - DNA, 18 bp, Homo sapiens
agactgctagtgttctgt

SEQ ID NO: 5181742 - DNA, 12 bp, Homo sapiens
agactgctcccg

SEQ ID NO: 5181743 - DNA, 14 bp, Homo sapiens
agactgctcccggc

SEQ ID NO: 5181744 - DNA, 16 bp, Homo sapiens
agactgctcctgggca

SEQ ID NO: 5181745 - DNA, 15 bp, Homo sapiens
agactgctgggactg

SEQ ID NO: 5181746 - DNA, 16 bp, Homo sapiens
agactgctgtcttact

SEQ ID NO: 5181747 - DNA, 16 bp, Homo sapiens
agactgctgtggccag

SEQ ID NO: 5181748 - DNA, 18 bp, Homo sapiens
agactgctgtggccagga

SEQ ID NO: 5181749 - DNA, 21 bp, Homo sapiens
agactgctgtggccaggaggt

SEQ ID NO: 5181750 - DNA, 14 bp, Homo sapiens
agactgcttcccat

SEQ ID NO: 5181751 - DNA, 16 bp, Homo sapiens
agactgcttcccatcc

SEQ ID NO: 5181752 - DNA, 17 bp, Homo sapiens
agactgcttcccatcct

SEQ ID NO: 5181753 - DNA, 22 bp, Homo sapiens
agactgcttcccatcctaccct

SEQ ID NO: 5181754 - DNA, 14 bp, Homo sapiens
agactggaaaaaat

SEQ ID NO: 5181755 - DNA, 17 bp, Homo sapiens
agactggaaaaaatgag

SEQ ID NO: 5181756 - DNA, 18 bp, Homo sapiens
agactggaaaaaatgagc

SEQ ID NO: 5181757 - DNA, 17 bp, Homo sapiens
agactggaaaaggtgga

SEQ ID NO: 5181758 - DNA, 18 bp, Homo sapiens
agactggaaaaggtggac

SEQ ID NO: 5181759 - DNA, 13 bp, Homo sapiens
agactggaacttg

SEQ ID NO: 5181760 - DNA, 18 bp, Homo sapiens
agactggaacttgaactg

SEQ ID NO: 5181761 - DNA, 23 bp, Homo sapiens
agactggaacttgaactgattca

SEQ ID NO: 5181762 - DNA, 19 bp, Homo sapiens
agactggaagacacttcag

SEQ ID NO: 5181763 - DNA, 14 bp, Homo sapiens
agactggaagctaa

SEQ ID NO: 5181764 - DNA, 19 bp, Homo sapiens
agactggaagctaatttgc

SEQ ID NO: 5181765 - DNA, 20 bp, Homo sapiens
agactggaagctaatttgca

SEQ ID NO: 5181766 - DNA, 19 bp, Homo sapiens
agactggaagttcatacct

SEQ ID NO: 5181767 - DNA, 14 bp, Homo sapiens
agactggacagctt

SEQ ID NO: 5181768 - DNA, 22 bp, Homo sapiens
agatggcttcggagggccgcag

SEQ ID NO: 5181769 - DNA, 18 bp, Homo sapiens
agatgggaagcctgtgta

SEQ ID NO: 5181770 - DNA, 16 bp, Homo sapiens
agatgggaatgaagct

SEQ ID NO: 5181771 - DNA, 21 bp, Homo sapiens
agatgggacaagttagtcttt

SEQ ID NO: 5181772 - DNA, 16 bp, Homo sapiens
agatgggacaattaga

SEQ ID NO: 5181773 - DNA, 16 bp, Homo sapiens
agatgggacagcaaca

SEQ ID NO: 5181774 - DNA, 17 bp, Homo sapiens
agatgggacagcaacaa

SEQ ID NO: 5181775 - DNA, 16 bp, Homo sapiens
agatgggactgtgtcc

SEQ ID NO: 5181776 - DNA, 19 bp, Homo sapiens
agatgggagagcaacaagt

SEQ ID NO: 5181777 - DNA, 22 bp, Homo sapiens
agatgggaggtggaagcagagg

SEQ ID NO: 5181778 - DNA, 22 bp, Homo sapiens
agatgggatgggctttctcagt

SEQ ID NO: 5181779 - DNA, 22 bp, Homo sapiens
agatgggcaaaccctggtgctt

SEQ ID NO: 5181780 - DNA, 22 bp, Homo sapiens
agatgggcacatgaggagggtg

SEQ ID NO: 5181781 - DNA, 16 bp, Homo sapiens
agatgggcatcttttg

SEQ ID NO: 5181782 - DNA, 17 bp, Homo sapiens
agatgggccaggcagag

SEQ ID NO: 5181783 - DNA, 20 bp, Homo sapiens
agatgggccggcccccttcc

SEQ ID NO: 5181784 - DNA, 21 bp, Homo sapiens
agatgggcctgtgtgcaccca

SEQ ID NO: 5181785 - DNA, 22 bp, Homo sapiens
agatgggctgaactgagcctag

SEQ ID NO: 5181786 - DNA, 17 bp, Homo sapiens
agatgggcttcccaagg

SEQ ID NO: 5181787 - DNA, 19 bp, Homo sapiens
agatgggcttgttttcttg

SEQ ID NO: 5181788 - DNA, 22 bp, Homo sapiens
agatggggaataatttccttca

SEQ ID NO: 5181789 - DNA, 20 bp, Homo sapiens
agatggggagctctggaggt

SEQ ID NO: 5181790 - DNA, 21 bp, Homo sapiens
agatggggagctctggaggtg

SEQ ID NO: 5181791 - DNA, 14 bp, Homo sapiens
agatggggagggcg

SEQ ID NO: 5181792 - DNA, 18 bp, Homo sapiens
agatggggagggcgcttt

SEQ ID NO: 5181793 - DNA, 17 bp, Homo sapiens
agatggggataaaatga

SEQ ID NO: 5181794 - DNA, 15 bp, Homo sapiens
agatggggcctctgt

SEQ ID NO: 5181795 - DNA, 16 bp, Homo sapiens
agatgggggaaagcaa

SEQ ID NO: 5181796 - DNA, 15 bp, Homo sapiens
agatgggggcaagaa

SEQ ID NO: 5181797 - DNA, 18 bp, Homo sapiens
agatgggggcctctttca

SEQ ID NO: 5181798 - DNA, 16 bp, Homo sapiens
agatgggggcttcttc

SEQ ID NO: 5181799 - DNA, 17 bp, Homo sapiens
agatgggggcttcttcc

SEQ ID NO: 5181800 - DNA, 21 bp, Homo sapiens
agatgggggtgtattggaatt

SEQ ID NO: 5181801 - DNA, 14 bp, Homo sapiens
agatggggtcttgc

SEQ ID NO: 5181802 - DNA, 16 bp, Homo sapiens
agatgggtcaagcaag

SEQ ID NO: 5181803 - DNA, 17 bp, Homo sapiens
agatgggtcaagcaagc

SEQ ID NO: 5181804 - DNA, 13 bp, Homo sapiens
agatgggtccagg

SEQ ID NO: 5181805 - DNA, 24 bp, Homo sapiens
agatgggtctccgcacttggaaag

SEQ ID NO: 5181806 - DNA, 17 bp, Homo sapiens
agatgggtctggctgag

SEQ ID NO: 5181807 - DNA, 19 bp, Homo sapiens
agatgggtctggctgagct

SEQ ID NO: 5181808 - DNA, 22 bp, Homo sapiens
agatgggtctggctgagctgaa

SEQ ID NO: 5181809 - DNA, 23 bp, Homo sapiens
agatgggtctggctgagctgaac

SEQ ID NO: 5181810 - DNA, 17 bp, Homo sapiens
agatgggtgatatataa

SEQ ID NO: 5181811 - DNA, 17 bp, Homo sapiens
agatgggtgattatgaa

SEQ ID NO: 5181812 - DNA, 21 bp, Homo sapiens
agatgggtgattatgaaatgc

SEQ ID NO: 5181813 - DNA, 20 bp, Homo sapiens
agatgggtgcttggaggaag

SEQ ID NO: 5181814 - DNA, 13 bp, Homo sapiens
agatgggtggggg

SEQ ID NO: 5181815 - DNA, 16 bp, Homo sapiens
agatgggttcttagct

SEQ ID NO: 5181816 - DNA, 12 bp, Homo sapiens
agatggtaacag

SEQ ID NO: 5181817 - DNA, 17 bp, Homo sapiens
agatggtaacagatttg

SEQ ID NO: 5181818 - DNA, 23 bp, Homo sapiens
agatggtaatcttttctgaggtt

SEQ ID NO: 5181819 - DNA, 16 bp, Homo sapiens
agatggtactgctgag

SEQ ID NO: 5181820 - DNA, 14 bp, Homo sapiens
agatggtagaaact

SEQ ID NO: 5181821 - DNA, 16 bp, Homo sapiens
agatggtagcagataa

SEQ ID NO: 5181822 - DNA, 23 bp, Homo sapiens
agatggtagcagataaagacagc

SEQ ID NO: 5181823 - DNA, 19 bp, Homo sapiens
agatggtatatttggtact

SEQ ID NO: 5181824 - DNA, 23 bp, Homo sapiens
agatggtcagtgtggagaggggt

SEQ ID NO: 5181825 - DNA, 17 bp, Homo sapiens
agatggtccatttgttc

SEQ ID NO: 5181826 - DNA, 21 bp, Homo sapiens
agatggtccatttgttcctgc

SEQ ID NO: 5181827 - DNA, 15 bp, Homo sapiens
agatggtgaaattta

SEQ ID NO: 5181828 - DNA, 22 bp, Homo sapiens
agatggtgaagcattctcccca

SEQ ID NO: 5181829 - DNA, 19 bp, Homo sapiens
agatggtgccccctggggg

SEQ ID NO: 5181830 - DNA, 22 bp, Homo sapiens
agatggtgctgggtaataaaat

SEQ ID NO: 5181831 - DNA, 17 bp, Homo sapiens
agatggtggagattggc

SEQ ID NO: 5181832 - DNA, 14 bp, Homo sapiens
agatggtggcacat

SEQ ID NO: 5181833 - DNA, 18 bp, Homo sapiens
agatggtggcacattcct

SEQ ID NO: 5181834 - DNA, 16 bp, Homo sapiens
agatggtggctgtgtc

SEQ ID NO: 5181835 - DNA, 13 bp, Homo sapiens
agatggtgtcatt

SEQ ID NO: 5181836 - DNA, 18 bp, Homo sapiens
agatggtgtcctgcatgt

SEQ ID NO: 5181837 - DNA, 14 bp, Homo sapiens
agatggtgtgtcca

SEQ ID NO: 5181838 - DNA, 19 bp, Homo sapiens
agatggtgtgtccagcact

SEQ ID NO: 5181839 - DNA, 20 bp, Homo sapiens
agatggttagaaccagcaga

SEQ ID NO: 5181840 - DNA, 14 bp, Homo sapiens
agatggttcccttt

SEQ ID NO: 5181841 - DNA, 14 bp, Homo sapiens
agatggttctagca

SEQ ID NO: 5181842 - DNA, 13 bp, Homo sapiens
agatggttgtgta

SEQ ID NO: 5181843 - DNA, 21 bp, Homo sapiens
agatggtttatgcatgtatat

SEQ ID NO: 5181844 - DNA, 17 bp, Homo sapiens
agatggtttccacattt

SEQ ID NO: 5181845 - DNA, 13 bp, Homo sapiens
agatgtaaaaaga

SEQ ID NO: 5181846 - DNA, 15 bp, Homo sapiens
agatgtaaaatgagt

SEQ ID NO: 5181847 - DNA, 19 bp, Homo sapiens
agatgtaaagttattcttg

SEQ ID NO: 5181848 - DNA, 16 bp, Homo sapiens
agatgtaaataaaatt

SEQ ID NO: 5181849 - DNA, 16 bp, Homo sapiens
agatgtaaatcgggaa

SEQ ID NO: 5181850 - DNA, 23 bp, Homo sapiens
agatgtaaatgtgccaagaatat

SEQ ID NO: 5181851 - DNA, 15 bp, Homo sapiens
agatgtaaattgaag

SEQ ID NO: 5181852 - DNA, 17 bp, Homo sapiens
agatgtaaattgaagaa

SEQ ID NO: 5181853 - DNA, 18 bp, Homo sapiens
agatgtaaattgaagaag

SEQ ID NO: 5181854 - DNA, 15 bp, Homo sapiens
agatgtaacctacaa

SEQ ID NO: 5181855 - DNA, 23 bp, Homo sapiens
agatgtaactaggccatttgtat

SEQ ID NO: 5181856 - DNA, 18 bp, Homo sapiens
agatgtaagtattaagaa

SEQ ID NO: 5181857 - DNA, 14 bp, Homo sapiens
agatgtaatacacc

SEQ ID NO: 5181858 - DNA, 20 bp, Homo sapiens
agatgtaatgacagagagtt

SEQ ID NO: 5181859 - DNA, 22 bp, Homo sapiens
agatgtaattatgttttcaact

SEQ ID NO: 5181860 - DNA, 15 bp, Homo sapiens
agatgtaattttgtg

SEQ ID NO: 5181861 - DNA, 12 bp, Homo sapiens
agatgtacatgt

SEQ ID NO: 5181862 - DNA, 18 bp, Homo sapiens
agatgtacgacttgcata

SEQ ID NO: 5181863 - DNA, 15 bp, Homo sapiens
agatgtactataaca

SEQ ID NO: 5181864 - DNA, 13 bp, Homo sapiens
agatgtactgaga

SEQ ID NO: 5181865 - DNA, 16 bp, Homo sapiens
agatgtactgagagga

SEQ ID NO: 5181866 - DNA, 17 bp, Homo sapiens
agatgtagatataaata

SEQ ID NO: 5181867 - DNA, 21 bp, Homo sapiens
agatgtagcaaaccctgtcaa

SEQ ID NO: 5181868 - DNA, 12 bp, Homo sapiens
agatgtagcatt

SEQ ID NO: 5181869 - DNA, 19 bp, Homo sapiens
agatgtagcattgttccac

SEQ ID NO: 5181870 - DNA, 21 bp, Homo sapiens
agatgtagcccctctcctgga

SEQ ID NO: 5181871 - DNA, 14 bp, Homo sapiens
agatgtaggaaccg

SEQ ID NO: 5181872 - DNA, 20 bp, Homo sapiens
agatgtaggaaccgatctgc

SEQ ID NO: 5181873 - DNA, 14 bp, Homo sapiens
agatgtaggaggga

SEQ ID NO: 5181874 - DNA, 17 bp, Homo sapiens
agatgtaggctccacct

SEQ ID NO: 5181875 - DNA, 19 bp, Homo sapiens
agatgtagtctcacactgt

SEQ ID NO: 5181876 - DNA, 16 bp, Homo sapiens
agatgtatatttgcat

SEQ ID NO: 5181877 - DNA, 14 bp, Homo sapiens
agatgtatgcacac

SEQ ID NO: 5181878 - DNA, 18 bp, Homo sapiens
agatgtatgcacacacat

SEQ ID NO: 5181879 - DNA, 15 bp, Homo sapiens
agatgtatgcccaaa

SEQ ID NO: 5181880 - DNA, 17 bp, Homo sapiens
agatgtatgctttgaat

SEQ ID NO: 5181881 - DNA, 22 bp, Homo sapiens
agatgtattaacctacctgtga

SEQ ID NO: 5181882 - DNA, 18 bp, Homo sapiens
agatgtattatgcaaagt

SEQ ID NO: 5181883 - DNA, 17 bp, Homo sapiens
agatgtattctttataa

SEQ ID NO: 5181884 - DNA, 14 bp, Homo sapiens
agatgtattttcaa

SEQ ID NO: 5181885 - DNA, 18 bp, Homo sapiens
agatgtcagactggctgg

SEQ ID NO: 5181886 - DNA, 18 bp, Homo sapiens
agatgtcagccgagccgg

SEQ ID NO: 5181887 - DNA, 15 bp, Homo sapiens
agatgtcagtctgtc

SEQ ID NO: 5181888 - DNA, 18 bp, Homo sapiens
agatgtcagtctgtccac

SEQ ID NO: 5181889 - DNA, 11 bp, Homo sapiens
agatgtcatga

SEQ ID NO: 5181890 - DNA, 18 bp, Homo sapiens
agatgtcatttccaccag

SEQ ID NO: 5181891 - DNA, 14 bp, Homo sapiens
agatgtcccacagg

SEQ ID NO: 5181892 - DNA, 21 bp, Homo sapiens
agatgtcccttgatgcacaga

SEQ ID NO: 5181893 - DNA, 14 bp, Homo sapiens
agatgtctatattg

SEQ ID NO: 5181894 - DNA, 23 bp, Homo sapiens
agatgtctcctcaagcctgtggg

SEQ ID NO: 5181895 - DNA, 15 bp, Homo sapiens
agatgtctctgtgtg

SEQ ID NO: 5181896 - DNA, 23 bp, Homo sapiens
agatgtctgagagaccatctcct

SEQ ID NO: 5181897 - DNA, 20 bp, Homo sapiens
agatgtctgggaaagcagag

SEQ ID NO: 5181898 - DNA, 18 bp, Homo sapiens
agatgtctgtgtatacat

SEQ ID NO: 5181899 - DNA, 14 bp, Homo sapiens
agatgtcttccctg

SEQ ID NO: 5181900 - DNA, 19 bp, Homo sapiens
agatgtcttccctgggctg

SEQ ID NO: 5181901 - DNA, 13 bp, Homo sapiens
agatgtcttcgta

SEQ ID NO: 5181902 - DNA, 19 bp, Homo sapiens
agatgtcttctgcctgtta

SEQ ID NO: 5181903 - DNA, 18 bp, Homo sapiens
agatgtcttggaacattg

SEQ ID NO: 5181904 - DNA, 13 bp, Homo sapiens
agatgtctttagg

SEQ ID NO: 5181905 - DNA, 23 bp, Homo sapiens
agatgtctttaggcagcagcttt

SEQ ID NO: 5181906 - DNA, 13 bp, Homo sapiens
agatgtcttttat

SEQ ID NO: 5181907 - DNA, 10 bp, Homo sapiens
agatgtgaaa

SEQ ID NO: 5181908 - DNA, 22 bp, Homo sapiens
agatgtgaaaaagcctaagaaa

SEQ ID NO: 5181909 - DNA, 13 bp, Homo sapiens
agatgtgaaaata

SEQ ID NO: 5181910 - DNA, 20 bp, Homo sapiens
agatgtgaaaataaagcaga

SEQ ID NO: 5181911 - DNA, 22 bp, Homo sapiens
agatgtgaaaataaagcagaag

SEQ ID NO: 5181912 - DNA, 18 bp, Homo sapiens
agatgtgaaaatatactt

SEQ ID NO: 5181913 - DNA, 17 bp, Homo sapiens
agatgtgaacacatcag

SEQ ID NO: 5181914 - DNA, 22 bp, Homo sapiens
agatgtgaacacatcagcttgc

SEQ ID NO: 5181915 - DNA, 19 bp, Homo sapiens
agatgtgaaggacatgaga

SEQ ID NO: 5181916 - DNA, 18 bp, Homo sapiens
agatgtgaattattgaca

SEQ ID NO: 5181917 - DNA, 21 bp, Homo sapiens
agatgtgaattattgacactg

SEQ ID NO: 5181918 - DNA, 21 bp, Homo sapiens
agatgtgacccaccagtgcct

SEQ ID NO: 5181919 - DNA, 15 bp, Homo sapiens
agatgtgagccaccg

SEQ ID NO: 5181920 - DNA, 23 bp, Homo sapiens
agatgtgagccaccgtgcctggc

SEQ ID NO: 5181921 - DNA, 14 bp, Homo sapiens
agatgtgagccttg

SEQ ID NO: 5181922 - DNA, 21 bp, Homo sapiens
agatgtgagtcctgttgaaga

SEQ ID NO: 5181923 - DNA, 15 bp, Homo sapiens
agatgtgatattcta

SEQ ID NO: 5181924 - DNA, 16 bp, Homo sapiens
agatgtgatattctaa

SEQ ID NO: 5181925 - DNA, 18 bp, Homo sapiens
agatgtgatcaggcccca

SEQ ID NO: 5181926 - DNA, 19 bp, Homo sapiens
agatgtgatcaggccccac

SEQ ID NO: 5181927 - DNA, 23 bp, Homo sapiens
agatgtgatgcttgatattttct

SEQ ID NO: 5181928 - DNA, 21 bp, Homo sapiens
agatgtgattaaagctaagga

SEQ ID NO: 5181929 - DNA, 17 bp, Homo sapiens
agatgtgcagcagattg

SEQ ID NO: 5181930 - DNA, 19 bp, Homo sapiens
agatgtgcagcatttcact

SEQ ID NO: 5181931 - DNA, 14 bp, Homo sapiens
agatgtgcccagag

SEQ ID NO: 5181932 - DNA, 16 bp, Homo sapiens
agatgtgcccagagta

SEQ ID NO: 5181933 - DNA, 16 bp, Homo sapiens
agatgtgcccccaccc

SEQ ID NO: 5181934 - DNA, 17 bp, Homo sapiens
agatgtgcccccacccc

SEQ ID NO: 5181935 - DNA, 20 bp, Homo sapiens
agatgtgcctatgagcacaa

SEQ ID NO: 5181936 - DNA, 20 bp, Homo sapiens
agatgtgcctgtgggagggg

SEQ ID NO: 5181937 - DNA, 15 bp, Homo sapiens
agatgtgctgacaag

SEQ ID NO: 5181938 - DNA, 13 bp, Homo sapiens
agatgtgctttgc

SEQ ID NO: 5181939 - DNA, 12 bp, Homo sapiens
agatgtggagcc

SEQ ID NO: 5181940 - DNA, 13 bp, Homo sapiens
agatgtggagcca

SEQ ID NO: 5181941 - DNA, 15 bp, Homo sapiens
agatgtggagccagg

SEQ ID NO: 5181942 - DNA, 23 bp, Homo sapiens
agatgtggcaaagtgctgtaccc

SEQ ID NO: 5181943 - DNA, 21 bp, Homo sapiens
agatgtggccttccatttata

SEQ ID NO: 5181944 - DNA, 16 bp, Homo sapiens
agatgtggctactgac

SEQ ID NO: 5181945 - DNA, 16 bp, Homo sapiens
agatgtgggttctttt

SEQ ID NO: 5181946 - DNA, 16 bp, Homo sapiens
agactggacccccagc

SEQ ID NO: 5181947 - DNA, 21 bp, Homo sapiens
agactggactggaccagacaa

SEQ ID NO: 5181948 - DNA, 15 bp, Homo sapiens
agactggagcatctg

SEQ ID NO: 5181949 - DNA, 16 bp, Homo sapiens
agactggagtgaggct

SEQ ID NO: 5181950 - DNA, 19 bp, Homo sapiens
agactggagtgaggcttcc

SEQ ID NO: 5181951 - DNA, 21 bp, Homo sapiens
agactggatagtccgtctctg

SEQ ID NO: 5181952 - DNA, 20 bp, Homo sapiens
agactggatttgcagaagtt

SEQ ID NO: 5181953 - DNA, 16 bp, Homo sapiens
agactggcaataaact

SEQ ID NO: 5181954 - DNA, 14 bp, Homo sapiens
agactggcacagtt

SEQ ID NO: 5181955 - DNA, 18 bp, Homo sapiens
agactggcacagttttct

SEQ ID NO: 5181956 - DNA, 20 bp, Homo sapiens
agactggcacagttttctga

SEQ ID NO: 5181957 - DNA, 15 bp, Homo sapiens
agactggcagccagg

SEQ ID NO: 5181958 - DNA, 14 bp, Homo sapiens
agactggcaggcgg

SEQ ID NO: 5181959 - DNA, 20 bp, Homo sapiens
agactggcccagtgccagca

SEQ ID NO: 5181960 - DNA, 17 bp, Homo sapiens
agactggccgggcaggc

SEQ ID NO: 5181961 - DNA, 22 bp, Homo sapiens
agactggcctaggggccagggc

SEQ ID NO: 5181962 - DNA, 20 bp, Homo sapiens
agactggcctgaaccacagg

SEQ ID NO: 5181963 - DNA, 16 bp, Homo sapiens
agactggcctgaggag

SEQ ID NO: 5181964 - DNA, 18 bp, Homo sapiens
agactggcctgaggagca

SEQ ID NO: 5181965 - DNA, 15 bp, Homo sapiens
agactggcggagaag

SEQ ID NO: 5181966 - DNA, 23 bp, Homo sapiens
agactggcgtgaacccaggaggc

SEQ ID NO: 5181967 - DNA, 18 bp, Homo sapiens
agactggctgcacagccc

SEQ ID NO: 5181968 - DNA, 14 bp, Homo sapiens
agactggctggctg

SEQ ID NO: 5181969 - DNA, 22 bp, Homo sapiens
agactggcttttattaatgcac

SEQ ID NO: 5181970 - DNA, 14 bp, Homo sapiens
agactgggaacttg

SEQ ID NO: 5181971 - DNA, 20 bp, Homo sapiens
agactgggaacttgatggct

SEQ ID NO: 5181972 - DNA, 21 bp, Homo sapiens
agactgggaaggcttgggatt

SEQ ID NO: 5181973 - DNA, 16 bp, Homo sapiens
agactgggctagggag

SEQ ID NO: 5181974 - DNA, 15 bp, Homo sapiens
agactgggctgaggg

SEQ ID NO: 5181975 - DNA, 12 bp, Homo sapiens
agactgggctgg

SEQ ID NO: 5181976 - DNA, 14 bp, Homo sapiens
agactgggctggct

SEQ ID NO: 5181977 - DNA, 15 bp, Homo sapiens
agactgggctggctg

SEQ ID NO: 5181978 - DNA, 19 bp, Homo sapiens
agactgggtaatttataaa

SEQ ID NO: 5181979 - DNA, 18 bp, Homo sapiens
agactggtaggaggaggc

SEQ ID NO: 5181980 - DNA, 22 bp, Homo sapiens
agactggtaggaggaggcatgg

SEQ ID NO: 5181981 - DNA, 15 bp, Homo sapiens
agactggtcctgtgt

SEQ ID NO: 5181982 - DNA, 12 bp, Homo sapiens
agactggtctcg

SEQ ID NO: 5181983 - DNA, 23 bp, Homo sapiens
agactggtctcgaactcctggcc

SEQ ID NO: 5181984 - DNA, 12 bp, Homo sapiens
agactggtgact

SEQ ID NO: 5181985 - DNA, 16 bp, Homo sapiens
agactggtgactgatt

SEQ ID NO: 5181986 - DNA, 21 bp, Homo sapiens
agactggtgactgattcttca

SEQ ID NO: 5181987 - DNA, 18 bp, Homo sapiens
agactggtgagcagactg

SEQ ID NO: 5181988 - DNA, 13 bp, Homo sapiens
agactggtgttaa

SEQ ID NO: 5181989 - DNA, 18 bp, Homo sapiens
agactggtgttaatgagt

SEQ ID NO: 5181990 - DNA, 19 bp, Homo sapiens
agactggtgttaatgagta

SEQ ID NO: 5181991 - DNA, 22 bp, Homo sapiens
agactggtttatccacccacaa

SEQ ID NO: 5181992 - DNA, 17 bp, Homo sapiens
agactggtttgtttgct

SEQ ID NO: 5181993 - DNA, 18 bp, Homo sapiens
agactggtttgtttgctt

SEQ ID NO: 5181994 - DNA, 20 bp, Homo sapiens
agactggtttgtttgcttaa

SEQ ID NO: 5181995 - DNA, 15 bp, Homo sapiens
agactgtaaattcca

SEQ ID NO: 5181996 - DNA, 14 bp, Homo sapiens
agactgtaactttt

SEQ ID NO: 5181997 - DNA, 14 bp, Homo sapiens
agactgtaagatgt

SEQ ID NO: 5181998 - DNA, 16 bp, Homo sapiens
agactgtaagatgttg

SEQ ID NO: 5181999 - DNA, 16 bp, Homo sapiens
agactgtacaaagtag

SEQ ID NO: 5182000 - DNA, 13 bp, Homo sapiens
agactgtacataa

SEQ ID NO: 5182001 - DNA, 22 bp, Homo sapiens
agactgtacataattgcatgaa

SEQ ID NO: 5182002 - DNA, 21 bp, Homo sapiens
agactgtactggccagtgtca

SEQ ID NO: 5182003 - DNA, 12 bp, Homo sapiens
agactgtagaga

SEQ ID NO: 5182004 - DNA, 23 bp, Homo sapiens
agactgtagatatgtattctttt

SEQ ID NO: 5182005 - DNA, 23 bp, Homo sapiens
agactgtagattgcttctgtagt

SEQ ID NO: 5182006 - DNA, 19 bp, Homo sapiens
agactgtcaaatgaacttt

SEQ ID NO: 5182007 - DNA, 21 bp, Homo sapiens
agactgtcaaatgaactttta

SEQ ID NO: 5182008 - DNA, 19 bp, Homo sapiens
agactgtcattgcccctcc

SEQ ID NO: 5182009 - DNA, 14 bp, Homo sapiens
agactgtccaggga

SEQ ID NO: 5182010 - DNA, 14 bp, Homo sapiens
agactgtgaacagc

SEQ ID NO: 5182011 - DNA, 20 bp, Homo sapiens
agactgtgaacagcttgctg

SEQ ID NO: 5182012 - DNA, 19 bp, Homo sapiens
agactgtgaggcggcagct

SEQ ID NO: 5182013 - DNA, 20 bp, Homo sapiens
agactgtgaggcggcagctg

SEQ ID NO: 5182014 - DNA, 21 bp, Homo sapiens
agactgtgaggcggcagctgg

SEQ ID NO: 5182015 - DNA, 14 bp, Homo sapiens
agactgtgattctt

SEQ ID NO: 5182016 - DNA, 20 bp, Homo sapiens
agactgtgattcttagcaaa

SEQ ID NO: 5182017 - DNA, 14 bp, Homo sapiens
agactgtgcagaag

SEQ ID NO: 5182018 - DNA, 16 bp, Homo sapiens
agactgtgccagaggc

SEQ ID NO: 5182019 - DNA, 17 bp, Homo sapiens
agactgtgctgtccttt

SEQ ID NO: 5182020 - DNA, 18 bp, Homo sapiens
agactgtggagactgctc

SEQ ID NO: 5182021 - DNA, 14 bp, Homo sapiens
agactgtggctgct

SEQ ID NO: 5182022 - DNA, 19 bp, Homo sapiens
agactgtggtaggggcagg

SEQ ID NO: 5182023 - DNA, 20 bp, Homo sapiens
agactgtggtaggggcaggg

SEQ ID NO: 5182024 - DNA, 22 bp, Homo sapiens
agactgtggtattggggtcttt

SEQ ID NO: 5182025 - DNA, 22 bp, Homo sapiens
agactgtgtctctctgatacct

SEQ ID NO: 5182026 - DNA, 21 bp, Homo sapiens
agactgtgtctgaatcatgtc

SEQ ID NO: 5182027 - DNA, 14 bp, Homo sapiens
agactgtgtttcta

SEQ ID NO: 5182028 - DNA, 18 bp, Homo sapiens
agactgttaaatgaaacc

SEQ ID NO: 5182029 - DNA, 14 bp, Homo sapiens
agactgttgctcaa

SEQ ID NO: 5182030 - DNA, 11 bp, Homo sapiens
agactgttggg

SEQ ID NO: 5182031 - DNA, 14 bp, Homo sapiens
agactgttgtgatc

SEQ ID NO: 5182032 - DNA, 14 bp, Homo sapiens
agactgtttattac

SEQ ID NO: 5182033 - DNA, 14 bp, Homo sapiens
agactgtttgaatg

SEQ ID NO: 5182034 - DNA, 14 bp, Homo sapiens
agactgttttactg

SEQ ID NO: 5182035 - DNA, 17 bp, Homo sapiens
agactgttttcagacct

SEQ ID NO: 5182036 - DNA, 18 bp, Homo sapiens
agactgttttcagacctt

SEQ ID NO: 5182037 - DNA, 15 bp, Homo sapiens
agactgtttttaagt

SEQ ID NO: 5182038 - DNA, 12 bp, Homo sapiens
agacttaaaaca

SEQ ID NO: 5182039 - DNA, 15 bp, Homo sapiens
agacttaaaacatgg

SEQ ID NO: 5182040 - DNA, 13 bp, Homo sapiens
agacttaagaaag

SEQ ID NO: 5182041 - DNA, 14 bp, Homo sapiens
agacttaagattaa

SEQ ID NO: 5182042 - DNA, 17 bp, Homo sapiens
agacttaatagaaacat

SEQ ID NO: 5182043 - DNA, 23 bp, Homo sapiens
agacttaatagaaacattgaaga

SEQ ID NO: 5182044 - DNA, 18 bp, Homo sapiens
agacttaatagacatttt

SEQ ID NO: 5182045 - DNA, 19 bp, Homo sapiens
agacttaatagacattttt

SEQ ID NO: 5182046 - DNA, 13 bp, Homo sapiens
agacttaatatgt

SEQ ID NO: 5182047 - DNA, 15 bp, Homo sapiens
agacttaattctgat

SEQ ID NO: 5182048 - DNA, 15 bp, Homo sapiens
agacttacagcaaat

SEQ ID NO: 5182049 - DNA, 15 bp, Homo sapiens
agacttaccaggaag

SEQ ID NO: 5182050 - DNA, 15 bp, Homo sapiens
agacttacggcaaga

SEQ ID NO: 5182051 - DNA, 20 bp, Homo sapiens
agacttacggcaagaaggca

SEQ ID NO: 5182052 - DNA, 14 bp, Homo sapiens
agacttactctaag

SEQ ID NO: 5182053 - DNA, 14 bp, Homo sapiens
agacttactgcatt

SEQ ID NO: 5182054 - DNA, 16 bp, Homo sapiens
agacttactgcattgc

SEQ ID NO: 5182055 - DNA, 16 bp, Homo sapiens
agacttacttattctt

SEQ ID NO: 5182056 - DNA, 19 bp, Homo sapiens
agacttagatctgagccct

SEQ ID NO: 5182057 - DNA, 22 bp, Homo sapiens
agacttagatctgagccctccc

SEQ ID NO: 5182058 - DNA, 14 bp, Homo sapiens
agacttaggccaga

SEQ ID NO: 5182059 - DNA, 16 bp, Homo sapiens
agacttagggcaccag

SEQ ID NO: 5182060 - DNA, 18 bp, Homo sapiens
agacttagtatattttct

SEQ ID NO: 5182061 - DNA, 19 bp, Homo sapiens
agacttagtttttataaaa

SEQ ID NO: 5182062 - DNA, 20 bp, Homo sapiens
agacttattcttttataata

SEQ ID NO: 5182063 - DNA, 16 bp, Homo sapiens
agacttcaaaaggaat

SEQ ID NO: 5182064 - DNA, 18 bp, Homo sapiens
agacttcaaaatattgag

SEQ ID NO: 5182065 - DNA, 18 bp, Homo sapiens
agacttcaccaaatatat

SEQ ID NO: 5182066 - DNA, 18 bp, Homo sapiens
agacttcactgcagcctt

SEQ ID NO: 5182067 - DNA, 16 bp, Homo sapiens
agacttcagatttcaa

SEQ ID NO: 5182068 - DNA, 19 bp, Homo sapiens
agacttcaggttgttctgt

SEQ ID NO: 5182069 - DNA, 16 bp, Homo sapiens
agacttcagtcctggt

SEQ ID NO: 5182070 - DNA, 15 bp, Homo sapiens
agacttcatttaaca

SEQ ID NO: 5182071 - DNA, 19 bp, Homo sapiens
agacttccaaacctgacag

SEQ ID NO: 5182072 - DNA, 19 bp, Homo sapiens
agacttccaccatgtgcat

SEQ ID NO: 5182073 - DNA, 14 bp, Homo sapiens
agacttccaccctg

SEQ ID NO: 5182074 - DNA, 19 bp, Homo sapiens
agacttcccaacagcctta

SEQ ID NO: 5182075 - DNA, 17 bp, Homo sapiens
agacttcccactgttct

SEQ ID NO: 5182076 - DNA, 14 bp, Homo sapiens
agacttcccagcta

SEQ ID NO: 5182077 - DNA, 20 bp, Homo sapiens
agacttccccaagcctggca

SEQ ID NO: 5182078 - DNA, 22 bp, Homo sapiens
agacttccccaagcctggcagg

SEQ ID NO: 5182079 - DNA, 12 bp, Homo sapiens
agacttccccat

SEQ ID NO: 5182080 - DNA, 16 bp, Homo sapiens
agacttccctaacact

SEQ ID NO: 5182081 - DNA, 20 bp, Homo sapiens
agacttcctattaatttatt

SEQ ID NO: 5182082 - DNA, 14 bp, Homo sapiens
agacttcctctcta

SEQ ID NO: 5182083 - DNA, 19 bp, Homo sapiens
agacttcctctctaccccc

SEQ ID NO: 5182084 - DNA, 17 bp, Homo sapiens
agacttctaaaataaat

SEQ ID NO: 5182085 - DNA, 20 bp, Homo sapiens
agacttctaaaataaatgtt

SEQ ID NO: 5182086 - DNA, 22 bp, Homo sapiens
agacttctaaaataaatgtttt

SEQ ID NO: 5182087 - DNA, 16 bp, Homo sapiens
agacttctaaatcata

SEQ ID NO: 5182088 - DNA, 17 bp, Homo sapiens
agacttctaaatcataa

SEQ ID NO: 5182089 - DNA, 22 bp, Homo sapiens
agacttctattttttaaagact

SEQ ID NO: 5182090 - DNA, 22 bp, Homo sapiens
agacttctctacccatcttaaa

SEQ ID NO: 5182091 - DNA, 16 bp, Homo sapiens
agacttctctgtaagt

SEQ ID NO: 5182092 - DNA, 18 bp, Homo sapiens
agacttctcttacatttt

SEQ ID NO: 5182093 - DNA, 20 bp, Homo sapiens
agacttctctttcttatttt

SEQ ID NO: 5182094 - DNA, 16 bp, Homo sapiens
agacttctctttgcct

SEQ ID NO: 5182095 - DNA, 19 bp, Homo sapiens
agacttctctttgcctcaa

SEQ ID NO: 5182096 - DNA, 13 bp, Homo sapiens
agacttctggaag

SEQ ID NO: 5182097 - DNA, 15 bp, Homo sapiens
agacttctggaaggc

SEQ ID NO: 5182098 - DNA, 18 bp, Homo sapiens
agacttctggaaggctgg

SEQ ID NO: 5182099 - DNA, 17 bp, Homo sapiens
agacttctggtgctgct

SEQ ID NO: 5182100 - DNA, 13 bp, Homo sapiens
agacttctgtttt

SEQ ID NO: 5182101 - DNA, 18 bp, Homo sapiens
agacttctgttttcaatc

SEQ ID NO: 5182102 - DNA, 17 bp, Homo sapiens
agacttgaaaagagaca

SEQ ID NO: 5182103 - DNA, 21 bp, Homo sapiens
agacttgaaaagagacaggca

SEQ ID NO: 5182104 - DNA, 14 bp, Homo sapiens
agacttgaaagttt

SEQ ID NO: 5182105 - DNA, 14 bp, Homo sapiens
agacttgaaatact

SEQ ID NO: 5182106 - DNA, 15 bp, Homo sapiens
agacttgaagcacag

SEQ ID NO: 5182107 - DNA, 19 bp, Homo sapiens
agacttgagaaatttgaaa

SEQ ID NO: 5182108 - DNA, 15 bp, Homo sapiens
agacttgagacaatg

SEQ ID NO: 5182109 - DNA, 15 bp, Homo sapiens
agacttgaggggcta

SEQ ID NO: 5182110 - DNA, 21 bp, Homo sapiens
agacttgatttacaagcatca

SEQ ID NO: 5182111 - DNA, 23 bp, Homo sapiens
agacttgccaacaccacagaaat

SEQ ID NO: 5182112 - DNA, 16 bp, Homo sapiens
agacttgccagagccg

SEQ ID NO: 5182113 - DNA, 18 bp, Homo sapiens
agacttgcggccacagca

SEQ ID NO: 5182114 - DNA, 21 bp, Homo sapiens
agacttgcggccacagcacta

SEQ ID NO: 5182115 - DNA, 22 bp, Homo sapiens
agacttgcggccacagcactag

SEQ ID NO: 5182116 - DNA, 13 bp, Homo sapiens
agacttgctccct

SEQ ID NO: 5182117 - DNA, 22 bp, Homo sapiens
agacttgctccctctccaagac

SEQ ID NO: 5182118 - DNA, 19 bp, Homo sapiens
agacttggaagaggaggag

SEQ ID NO: 5182119 - DNA, 20 bp, Homo sapiens
agacttggacatctctctgg

SEQ ID NO: 5182120 - DNA, 22 bp, Homo sapiens
agacttggacatctctctggct

SEQ ID NO: 5182121 - DNA, 18 bp, Homo sapiens
agacttggagaatactgc

SEQ ID NO: 5182122 - DNA, 13 bp, Homo sapiens
agacttggagctg

SEQ ID NO: 5182123 - DNA, 15 bp, Homo sapiens
agacttggatgagga

SEQ ID NO: 5182124 - DNA, 18 bp, Homo sapiens
agacttggcaacagaagc

SEQ ID NO: 5182125 - DNA, 20 bp, Homo sapiens
agatgtggtttttaattttg

SEQ ID NO: 5182126 - DNA, 18 bp, Homo sapiens
agatgtgtaaacaggtat

SEQ ID NO: 5182127 - DNA, 16 bp, Homo sapiens
agatgtgtaaataagc

SEQ ID NO: 5182128 - DNA, 16 bp, Homo sapiens
agatgtgtaatttttc

SEQ ID NO: 5182129 - DNA, 22 bp, Homo sapiens
agatgtgtatcagtgtttatgt

SEQ ID NO: 5182130 - DNA, 16 bp, Homo sapiens
agatgtgtctatggct

SEQ ID NO: 5182131 - DNA, 17 bp, Homo sapiens
agatgtgtcttcaattt

SEQ ID NO: 5182132 - DNA, 18 bp, Homo sapiens
agatgtgtgttgatactg

SEQ ID NO: 5182133 - DNA, 23 bp, Homo sapiens
agatgtgtgttgatactgttgca

SEQ ID NO: 5182134 - DNA, 15 bp, Homo sapiens
agatgtgttcacaat

SEQ ID NO: 5182135 - DNA, 15 bp, Homo sapiens
agatgtgttcttatt

SEQ ID NO: 5182136 - DNA, 16 bp, Homo sapiens
agatgtgttcttattt

SEQ ID NO: 5182137 - DNA, 21 bp, Homo sapiens
agatgtgtttttaatgttaaa

SEQ ID NO: 5182138 - DNA, 14 bp, Homo sapiens
agatgttaaaataa

SEQ ID NO: 5182139 - DNA, 15 bp, Homo sapiens
agatgttaaaatagt

SEQ ID NO: 5182140 - DNA, 21 bp, Homo sapiens
agatgttaattacttttgaaa

SEQ ID NO: 5182141 - DNA, 20 bp, Homo sapiens
agatgttactaccttatttt

SEQ ID NO: 5182142 - DNA, 15 bp, Homo sapiens
agatgttcaaatatt

SEQ ID NO: 5182143 - DNA, 14 bp, Homo sapiens
agatgttcaataga

SEQ ID NO: 5182144 - DNA, 15 bp, Homo sapiens
agatgttcaatagaa

SEQ ID NO: 5182145 - DNA, 17 bp, Homo sapiens
agatgttcaatagaaca

SEQ ID NO: 5182146 - DNA, 15 bp, Homo sapiens
agatgttcacccaac

SEQ ID NO: 5182147 - DNA, 17 bp, Homo sapiens
agatgttcagtcatttt

SEQ ID NO: 5182148 - DNA, 15 bp, Homo sapiens
agatgttccaaattt

SEQ ID NO: 5182149 - DNA, 17 bp, Homo sapiens
agatgttctaagtcttt

SEQ ID NO: 5182150 - DNA, 22 bp, Homo sapiens
agatgttctaagtctttccatt

SEQ ID NO: 5182151 - DNA, 15 bp, Homo sapiens
agatgttctactttg

SEQ ID NO: 5182152 - DNA, 22 bp, Homo sapiens
agatgttctactttgttctgct

SEQ ID NO: 5182153 - DNA, 15 bp, Homo sapiens
agatgttctctatca

SEQ ID NO: 5182154 - DNA, 17 bp, Homo sapiens
agatgttctctatcatt

SEQ ID NO: 5182155 - DNA, 21 bp, Homo sapiens
agatgttctctatcatttaat

SEQ ID NO: 5182156 - DNA, 19 bp, Homo sapiens
agatgttcttttctattta

SEQ ID NO: 5182157 - DNA, 20 bp, Homo sapiens
agatgttcttttctatttat

SEQ ID NO: 5182158 - DNA, 22 bp, Homo sapiens
agatgttgaggcgagcagggca

SEQ ID NO: 5182159 - DNA, 23 bp, Homo sapiens
agatgttgaggcgagcagggcag

SEQ ID NO: 5182160 - DNA, 18 bp, Homo sapiens
agatgttgaggggaggag

SEQ ID NO: 5182161 - DNA, 22 bp, Homo sapiens
agatgttgatttttactgtgtt

SEQ ID NO: 5182162 - DNA, 14 bp, Homo sapiens
agatgttgccatgt

SEQ ID NO: 5182163 - DNA, 17 bp, Homo sapiens
agatgttgccatgtgtt

SEQ ID NO: 5182164 - DNA, 17 bp, Homo sapiens
agatgttgctctttcac

SEQ ID NO: 5182165 - DNA, 16 bp, Homo sapiens
agatgttgcttttgaa

SEQ ID NO: 5182166 - DNA, 20 bp, Homo sapiens
agatgttgcttttgaaaagt

SEQ ID NO: 5182167 - DNA, 23 bp, Homo sapiens
agatgttggggggccccacggag

SEQ ID NO: 5182168 - DNA, 15 bp, Homo sapiens
agatgtttaaaacac

SEQ ID NO: 5182169 - DNA, 17 bp, Homo sapiens
agatgtttaaagaccaa

SEQ ID NO: 5182170 - DNA, 17 bp, Homo sapiens
agatgtttaacaaatct

SEQ ID NO: 5182171 - DNA, 15 bp, Homo sapiens
agatgtttacagtat

SEQ ID NO: 5182172 - DNA, 14 bp, Homo sapiens
agatgtttaccttc

SEQ ID NO: 5182173 - DNA, 19 bp, Homo sapiens
agatgtttactcattgccc

SEQ ID NO: 5182174 - DNA, 19 bp, Homo sapiens
agatgtttatatcaaatga

SEQ ID NO: 5182175 - DNA, 17 bp, Homo sapiens
agatgtttattaataga

SEQ ID NO: 5182176 - DNA, 18 bp, Homo sapiens
agatgtttattcttctag

SEQ ID NO: 5182177 - DNA, 20 bp, Homo sapiens
agatgtttattggtatattt

SEQ ID NO: 5182178 - DNA, 16 bp, Homo sapiens
agatgtttcattttac

SEQ ID NO: 5182179 - DNA, 21 bp, Homo sapiens
agatgtttccagacttccttg

SEQ ID NO: 5182180 - DNA, 23 bp, Homo sapiens
agatgtttccagacttccttgag

SEQ ID NO: 5182181 - DNA, 22 bp, Homo sapiens
agatgtttcgagtaaacttgaa

SEQ ID NO: 5182182 - DNA, 21 bp, Homo sapiens
agatgtttctcattttaaaca

SEQ ID NO: 5182183 - DNA, 12 bp, Homo sapiens
agatgtttctta

SEQ ID NO: 5182184 - DNA, 21 bp, Homo sapiens
agatgtttcttttgtatgtaa

SEQ ID NO: 5182185 - DNA, 22 bp, Homo sapiens
agatgtttcttttgtatgtaaa

SEQ ID NO: 5182186 - DNA, 13 bp, Homo sapiens
agatgtttgaaaa

SEQ ID NO: 5182187 - DNA, 15 bp, Homo sapiens
agatgtttgaaaatg

SEQ ID NO: 5182188 - DNA, 14 bp, Homo sapiens
agatgtttgacttt

SEQ ID NO: 5182189 - DNA, 18 bp, Homo sapiens
agatgtttggaaaccaca

SEQ ID NO: 5182190 - DNA, 12 bp, Homo sapiens
agatgtttggca

SEQ ID NO: 5182191 - DNA, 18 bp, Homo sapiens
agatgtttggcaagaaat

SEQ ID NO: 5182192 - DNA, 19 bp, Homo sapiens
agatgtttggcaagaaatc

SEQ ID NO: 5182193 - DNA, 13 bp, Homo sapiens
agatgttttaact

SEQ ID NO: 5182194 - DNA, 17 bp, Homo sapiens
agatgttttaacttatt

SEQ ID NO: 5182195 - DNA, 13 bp, Homo sapiens
agatgttttacaa

SEQ ID NO: 5182196 - DNA, 19 bp, Homo sapiens
agatgttttacaaatttaa

SEQ ID NO: 5182197 - DNA, 19 bp, Homo sapiens
agatgttttaccatcctta

SEQ ID NO: 5182198 - DNA, 20 bp, Homo sapiens
agatgttttacgcaaggaag

SEQ ID NO: 5182199 - DNA, 14 bp, Homo sapiens
agatgttttagaga

SEQ ID NO: 5182200 - DNA, 18 bp, Homo sapiens
agatgttttagagataaa

SEQ ID NO: 5182201 - DNA, 21 bp, Homo sapiens
agatgttttagagataaatat

SEQ ID NO: 5182202 - DNA, 23 bp, Homo sapiens
agatgttttagagttaacaatga

SEQ ID NO: 5182203 - DNA, 19 bp, Homo sapiens
agatgttttatttatgaag

SEQ ID NO: 5182204 - DNA, 15 bp, Homo sapiens
agatgttttccactg

SEQ ID NO: 5182205 - DNA, 16 bp, Homo sapiens
agatgttttccactga

SEQ ID NO: 5182206 - DNA, 23 bp, Homo sapiens
agatgttttgggatcaggagccc

SEQ ID NO: 5182207 - DNA, 21 bp, Homo sapiens
agatgttttggtagattaaat

SEQ ID NO: 5182208 - DNA, 16 bp, Homo sapiens
agatgtttttaaaagt

SEQ ID NO: 5182209 - DNA, 20 bp, Homo sapiens
agatgtttttaaaagtttca

SEQ ID NO: 5182210 - DNA, 22 bp, Homo sapiens
agattaaaaaaggtagtttttc

SEQ ID NO: 5182211 - DNA, 21 bp, Homo sapiens
agattaaaaccagagagaaag

SEQ ID NO: 5182212 - DNA, 14 bp, Homo sapiens
agattaaaatattt

SEQ ID NO: 5182213 - DNA, 14 bp, Homo sapiens
agattaaacagatg

SEQ ID NO: 5182214 - DNA, 17 bp, Homo sapiens
agattaaacagatgatg

SEQ ID NO: 5182215 - DNA, 12 bp, Homo sapiens
agattaaaggaa

SEQ ID NO: 5182216 - DNA, 15 bp, Homo sapiens
agattaaaggaagga

SEQ ID NO: 5182217 - DNA, 17 bp, Homo sapiens
agattaaatatagatta

SEQ ID NO: 5182218 - DNA, 23 bp, Homo sapiens
agattaaatatatctttgtaaat

SEQ ID NO: 5182219 - DNA, 18 bp, Homo sapiens
agattaaatgtgtcattg

SEQ ID NO: 5182220 - DNA, 16 bp, Homo sapiens
agattaacacactgaa

SEQ ID NO: 5182221 - DNA, 20 bp, Homo sapiens
agattaacactcatttccaa

SEQ ID NO: 5182222 - DNA, 19 bp, Homo sapiens
agattaacctaatgcagaa

SEQ ID NO: 5182223 - DNA, 13 bp, Homo sapiens
agattaactggta

SEQ ID NO: 5182224 - DNA, 15 bp, Homo sapiens
agattaagaaataga

SEQ ID NO: 5182225 - DNA, 21 bp, Homo sapiens
agattaagacagagaaacaga

SEQ ID NO: 5182226 - DNA, 15 bp, Homo sapiens
agattaagagcaaat

SEQ ID NO: 5182227 - DNA, 17 bp, Homo sapiens
agattaagatctgtgtt

SEQ ID NO: 5182228 - DNA, 15 bp, Homo sapiens
agattaagatgcctt

SEQ ID NO: 5182229 - DNA, 12 bp, Homo sapiens
agattaagcttt

SEQ ID NO: 5182230 - DNA, 14 bp, Homo sapiens
agattaagcttttc

SEQ ID NO: 5182231 - DNA, 14 bp, Homo sapiens
agattaaggtatct

SEQ ID NO: 5182232 - DNA, 11 bp, Homo sapiens
agattaataac

SEQ ID NO: 5182233 - DNA, 18 bp, Homo sapiens
agattaataacagaaata

SEQ ID NO: 5182234 - DNA, 19 bp, Homo sapiens
agattaataacagaaatac

SEQ ID NO: 5182235 - DNA, 18 bp, Homo sapiens
agattaatagcattcgaa

SEQ ID NO: 5182236 - DNA, 17 bp, Homo sapiens
agattaatgctatcaat

SEQ ID NO: 5182237 - DNA, 15 bp, Homo sapiens
agattaatggcactg

SEQ ID NO: 5182238 - DNA, 17 bp, Homo sapiens
agattaatggcactgat

SEQ ID NO: 5182239 - DNA, 17 bp, Homo sapiens
agattaatgtaggatga

SEQ ID NO: 5182240 - DNA, 18 bp, Homo sapiens
agattaatttgtgtagat

SEQ ID NO: 5182241 - DNA, 19 bp, Homo sapiens
agattaatttgtgtagatt

SEQ ID NO: 5182242 - DNA, 15 bp, Homo sapiens
agattacaaaagcaa

SEQ ID NO: 5182243 - DNA, 14 bp, Homo sapiens
agattacaataaat

SEQ ID NO: 5182244 - DNA, 12 bp, Homo sapiens
agattacactga

SEQ ID NO: 5182245 - DNA, 17 bp, Homo sapiens
agattacaggaatgaag

SEQ ID NO: 5182246 - DNA, 19 bp, Homo sapiens
agattacaggattaatata

SEQ ID NO: 5182247 - DNA, 16 bp, Homo sapiens
agattacatctgcctt

SEQ ID NO: 5182248 - DNA, 21 bp, Homo sapiens
agattaccccctcattgttta

SEQ ID NO: 5182249 - DNA, 19 bp, Homo sapiens
agattacctcttgcccttg

SEQ ID NO: 5182250 - DNA, 20 bp, Homo sapiens
agattacctcttgcccttgg

SEQ ID NO: 5182251 - DNA, 20 bp, Homo sapiens
agattacctgccacttccag

SEQ ID NO: 5182252 - DNA, 18 bp, Homo sapiens
agattactttgctgcctt

SEQ ID NO: 5182253 - DNA, 16 bp, Homo sapiens
agattagaaagacttt

SEQ ID NO: 5182254 - DNA, 22 bp, Homo sapiens
agattagaaagactttctaaat

SEQ ID NO: 5182255 - DNA, 22 bp, Homo sapiens
agattagaattctgtatagatt

SEQ ID NO: 5182256 - DNA, 14 bp, Homo sapiens
agattagacactat

SEQ ID NO: 5182257 - DNA, 16 bp, Homo sapiens
agattagatcttttaa

SEQ ID NO: 5182258 - DNA, 21 bp, Homo sapiens
agattagcatcccatactaga

SEQ ID NO: 5182259 - DNA, 20 bp, Homo sapiens
agattagcccttccttgcca

SEQ ID NO: 5182260 - DNA, 21 bp, Homo sapiens
agattagcccttccttgccag

SEQ ID NO: 5182261 - DNA, 14 bp, Homo sapiens
agattagctctgga

SEQ ID NO: 5182262 - DNA, 12 bp, Homo sapiens
agattaggcctg

SEQ ID NO: 5182263 - DNA, 23 bp, Homo sapiens
agattaggcctggagttgggctg

SEQ ID NO: 5182264 - DNA, 17 bp, Homo sapiens
agattagggaaaatgga

SEQ ID NO: 5182265 - DNA, 14 bp, Homo sapiens
agattaggtagact

SEQ ID NO: 5182266 - DNA, 17 bp, Homo sapiens
agattaggtcgttttcc

SEQ ID NO: 5182267 - DNA, 21 bp, Homo sapiens
agattaggtcttgctggaaga

SEQ ID NO: 5182268 - DNA, 16 bp, Homo sapiens
agattaggtgtaagac

SEQ ID NO: 5182269 - DNA, 18 bp, Homo sapiens
agattataacttgtctaa

SEQ ID NO: 5182270 - DNA, 14 bp, Homo sapiens
agattataatatgt

SEQ ID NO: 5182271 - DNA, 15 bp, Homo sapiens
agattataatatgtg

SEQ ID NO: 5182272 - DNA, 19 bp, Homo sapiens
agattataatatgtgcctt

SEQ ID NO: 5182273 - DNA, 14 bp, Homo sapiens
agattatacagaat

SEQ ID NO: 5182274 - DNA, 14 bp, Homo sapiens
agattatagattct

SEQ ID NO: 5182275 - DNA, 22 bp, Homo sapiens
agattatagctcccaaaagaat

SEQ ID NO: 5182276 - DNA, 18 bp, Homo sapiens
agattatatacaaagctg

SEQ ID NO: 5182277 - DNA, 16 bp, Homo sapiens
agattatatatcataa

SEQ ID NO: 5182278 - DNA, 18 bp, Homo sapiens
agattatatatcataaag

SEQ ID NO: 5182279 - DNA, 20 bp, Homo sapiens
agattatatatcataaagta

SEQ ID NO: 5182280 - DNA, 22 bp, Homo sapiens
agattatatatcataaagtatg

SEQ ID NO: 5182281 - DNA, 15 bp, Homo sapiens
agattatatcaaagt

SEQ ID NO: 5182282 - DNA, 15 bp, Homo sapiens
agattatatgaatgc

SEQ ID NO: 5182283 - DNA, 14 bp, Homo sapiens
agattatattataa

SEQ ID NO: 5182284 - DNA, 15 bp, Homo sapiens
agattatcagtagaa

SEQ ID NO: 5182285 - DNA, 18 bp, Homo sapiens
agattatcagtagaaaga

SEQ ID NO: 5182286 - DNA, 20 bp, Homo sapiens
agattatcagtagaaagagt

SEQ ID NO: 5182287 - DNA, 15 bp, Homo sapiens
agattatcgttttct

SEQ ID NO: 5182288 - DNA, 17 bp, Homo sapiens
agattatcgttttctta

SEQ ID NO: 5182289 - DNA, 13 bp, Homo sapiens
agattatctgatt

SEQ ID NO: 5182290 - DNA, 21 bp, Homo sapiens
agattatgtattggcatttat

SEQ ID NO: 5182291 - DNA, 22 bp, Homo sapiens
agattatgtattggcatttatt

SEQ ID NO: 5182292 - DNA, 20 bp, Homo sapiens
agattatgttcctgctgtat

SEQ ID NO: 5182293 - DNA, 22 bp, Homo sapiens
agattatgttcctgctgtattt

SEQ ID NO: 5182294 - DNA, 16 bp, Homo sapiens
agattattaaatcgtt

SEQ ID NO: 5182295 - DNA, 22 bp, Homo sapiens
agattattaaatcgtttaatgt

SEQ ID NO: 5182296 - DNA, 17 bp, Homo sapiens
agattattcaacagaga

SEQ ID NO: 5182297 - DNA, 14 bp, Homo sapiens
agattattccttct

SEQ ID NO: 5182298 - DNA, 20 bp, Homo sapiens
agattattccttcttctagt

SEQ ID NO: 5182299 - DNA, 18 bp, Homo sapiens
agattattggctgctttg

SEQ ID NO: 5182300 - DNA, 23 bp, Homo sapiens
agattattgtctgattgaaacat

SEQ ID NO: 5182301 - DNA, 15 bp, Homo sapiens
agattatttaaatgc

SEQ ID NO: 5182302 - DNA, 16 bp, Homo sapiens
agattatttaaatgct

SEQ ID NO: 5182303 - DNA, 16 bp, Homo sapiens
agacttggcccaggaa

SEQ ID NO: 5182304 - DNA, 17 bp, Homo sapiens
agacttggggaccagag

SEQ ID NO: 5182305 - DNA, 18 bp, Homo sapiens
agacttggggaccagagg

SEQ ID NO: 5182306 - DNA, 18 bp, Homo sapiens
agacttgggttgatctct

SEQ ID NO: 5182307 - DNA, 19 bp, Homo sapiens
agacttggtgtcctttccc

SEQ ID NO: 5182308 - DNA, 22 bp, Homo sapiens
agacttggtgtcctttccctcc

SEQ ID NO: 5182309 - DNA, 23 bp, Homo sapiens
agacttggtgtcctttccctcca

SEQ ID NO: 5182310 - DNA, 21 bp, Homo sapiens
agacttgtatagcatgaaata

SEQ ID NO: 5182311 - DNA, 18 bp, Homo sapiens
agacttgtatattctatt

SEQ ID NO: 5182312 - DNA, 18 bp, Homo sapiens
agacttgtgtgcatggaa

SEQ ID NO: 5182313 - DNA, 16 bp, Homo sapiens
agacttgttctagaga

SEQ ID NO: 5182314 - DNA, 22 bp, Homo sapiens
agacttgttcttggttcctgtt

SEQ ID NO: 5182315 - DNA, 11 bp, Homo sapiens
agacttgttgg

SEQ ID NO: 5182316 - DNA, 18 bp, Homo sapiens
agacttgtttcctgtgcc

SEQ ID NO: 5182317 - DNA, 16 bp, Homo sapiens
agacttgtttctttct

SEQ ID NO: 5182318 - DNA, 17 bp, Homo sapiens
agacttgttttcccctc

SEQ ID NO: 5182319 - DNA, 18 bp, Homo sapiens
agactttagaaataaatg

SEQ ID NO: 5182320 - DNA, 13 bp, Homo sapiens
agactttagctta

SEQ ID NO: 5182321 - DNA, 18 bp, Homo sapiens
agactttagcttttcctt

SEQ ID NO: 5182322 - DNA, 17 bp, Homo sapiens
agactttaggctttcag

SEQ ID NO: 5182323 - DNA, 20 bp, Homo sapiens
agactttaggctttcagctt

SEQ ID NO: 5182324 - DNA, 17 bp, Homo sapiens
agactttatgtagtttt

SEQ ID NO: 5182325 - DNA, 17 bp, Homo sapiens
agactttcccaaatgta

SEQ ID NO: 5182326 - DNA, 14 bp, Homo sapiens
agactttcccctct

SEQ ID NO: 5182327 - DNA, 21 bp, Homo sapiens
agactttctacatgcaaatct

SEQ ID NO: 5182328 - DNA, 16 bp, Homo sapiens
agactttctattaata

SEQ ID NO: 5182329 - DNA, 14 bp, Homo sapiens
agactttgagcctg

SEQ ID NO: 5182330 - DNA, 23 bp, Homo sapiens
agactttgagcctgcatcttctt

SEQ ID NO: 5182331 - DNA, 23 bp, Homo sapiens
agactttgagttgatgggggcca

SEQ ID NO: 5182332 - DNA, 18 bp, Homo sapiens
agactttgatgtcagcag

SEQ ID NO: 5182333 - DNA, 23 bp, Homo sapiens
agactttgcccagggtcctgtgc

SEQ ID NO: 5182334 - DNA, 15 bp, Homo sapiens
agactttgctgcatt

SEQ ID NO: 5182335 - DNA, 18 bp, Homo sapiens
agactttgctgcatttta

SEQ ID NO: 5182336 - DNA, 20 bp, Homo sapiens
agactttgctgttactgctt

SEQ ID NO: 5182337 - DNA, 18 bp, Homo sapiens
agacttttaatcagacaa

SEQ ID NO: 5182338 - DNA, 22 bp, Homo sapiens
agacttttcagaagatggtgaa

SEQ ID NO: 5182339 - DNA, 16 bp, Homo sapiens
agacttttcaggagag

SEQ ID NO: 5182340 - DNA, 19 bp, Homo sapiens
agacttttctttcagccaa

SEQ ID NO: 5182341 - DNA, 23 bp, Homo sapiens
agacttttgaaaaaaaagttttt

SEQ ID NO: 5182342 - DNA, 19 bp, Homo sapiens
agactttttaaattcctgc

SEQ ID NO: 5182343 - DNA, 20 bp, Homo sapiens
agactttttggtggatgtaa

SEQ ID NO: 5182344 - DNA, 19 bp, Homo sapiens
agactttttttaaatagta

SEQ ID NO: 5182345 - DNA, 16 bp, Homo sapiens
agagaaaaaaaaaata

SEQ ID NO: 5182346 - DNA, 18 bp, Homo sapiens
agagaaaaaaaaatatgt

SEQ ID NO: 5182347 - DNA, 13 bp, Homo sapiens
agagaaaaaaaag

SEQ ID NO: 5182348 - DNA, 22 bp, Homo sapiens
agagaaaaaatattttcctgcc

SEQ ID NO: 5182349 - DNA, 13 bp, Homo sapiens
agagaaaaagaaa

SEQ ID NO: 5182350 - DNA, 16 bp, Homo sapiens
agagaaaaagaaatgc

SEQ ID NO: 5182351 - DNA, 16 bp, Homo sapiens
agagaaaaagagagag

SEQ ID NO: 5182352 - DNA, 19 bp, Homo sapiens
agagaaaaagagagagcag

SEQ ID NO: 5182353 - DNA, 22 bp, Homo sapiens
agagaaaaagagagagcagggt

SEQ ID NO: 5182354 - DNA, 18 bp, Homo sapiens
agagaaaaaggctgaaaa

SEQ ID NO: 5182355 - DNA, 17 bp, Homo sapiens
agagaaaaagtgcccct

SEQ ID NO: 5182356 - DNA, 14 bp, Homo sapiens
agagaaaacacttt

SEQ ID NO: 5182357 - DNA, 12 bp, Homo sapiens
agagaaaactct

SEQ ID NO: 5182358 - DNA, 21 bp, Homo sapiens
agagaaaagaaaaaaaaagaa

SEQ ID NO: 5182359 - DNA, 16 bp, Homo sapiens
agagaaaagaaaaata

SEQ ID NO: 5182360 - DNA, 17 bp, Homo sapiens
agagaaaagaaaaatat

SEQ ID NO: 5182361 - DNA, 21 bp, Homo sapiens
agagaaaagaaaaatatgaga

SEQ ID NO: 5182362 - DNA, 13 bp, Homo sapiens
agagaaaagctgg

SEQ ID NO: 5182363 - DNA, 13 bp, Homo sapiens
agagaaaataaaa

SEQ ID NO: 5182364 - DNA, 14 bp, Homo sapiens
agagaaaataaaaa

SEQ ID NO: 5182365 - DNA, 16 bp, Homo sapiens
agagaaaataaaaagt

SEQ ID NO: 5182366 - DNA, 17 bp, Homo sapiens
agagaaaataaaaagtt

SEQ ID NO: 5182367 - DNA, 17 bp, Homo sapiens
agagaaaataaaccaag

SEQ ID NO: 5182368 - DNA, 16 bp, Homo sapiens
agagaaaatatatatt

SEQ ID NO: 5182369 - DNA, 16 bp, Homo sapiens
agagaaaatatatgta

SEQ ID NO: 5182370 - DNA, 20 bp, Homo sapiens
agagaaaatgcggttataaa

SEQ ID NO: 5182371 - DNA, 21 bp, Homo sapiens
agagaaaatgtaaaggaggga

SEQ ID NO: 5182372 - DNA, 17 bp, Homo sapiens
agagaaaatgtaaataa

SEQ ID NO: 5182373 - DNA, 17 bp, Homo sapiens
agagaaaattaattcct

SEQ ID NO: 5182374 - DNA, 16 bp, Homo sapiens
agagaaaattcaggtc

SEQ ID NO: 5182375 - DNA, 13 bp, Homo sapiens
agagaaaattcct

SEQ ID NO: 5182376 - DNA, 13 bp, Homo sapiens
agagaaaattgaa

SEQ ID NO: 5182377 - DNA, 22 bp, Homo sapiens
agagaaaattgcactaaatgaa

SEQ ID NO: 5182378 - DNA, 22 bp, Homo sapiens
agagaaacactgaaaagaagga

SEQ ID NO: 5182379 - DNA, 15 bp, Homo sapiens
agagaaacagacaga

SEQ ID NO: 5182380 - DNA, 13 bp, Homo sapiens
agagaaacagttg

SEQ ID NO: 5182381 - DNA, 21 bp, Homo sapiens
agagaaacattctttcctaaa

SEQ ID NO: 5182382 - DNA, 14 bp, Homo sapiens
agagaaaccagctt

SEQ ID NO: 5182383 - DNA, 19 bp, Homo sapiens
agagaaaccagcttccttc

SEQ ID NO: 5182384 - DNA, 21 bp, Homo sapiens
agagaaaccagcttccttcag

SEQ ID NO: 5182385 - DNA, 22 bp, Homo sapiens
agagaaaccatcctctcccttc

SEQ ID NO: 5182386 - DNA, 16 bp, Homo sapiens
agagaaaccgcttttg

SEQ ID NO: 5182387 - DNA, 20 bp, Homo sapiens
agagaaaccgtcctcttttt

SEQ ID NO: 5182388 - DNA, 23 bp, Homo sapiens
agagaaaccgtcctctttttcca

SEQ ID NO: 5182389 - DNA, 18 bp, Homo sapiens
agagaaacctgccaagga

SEQ ID NO: 5182390 - DNA, 21 bp, Homo sapiens
agagaaactctatgggtatca

SEQ ID NO: 5182391 - DNA, 10 bp, Homo sapiens
agagaaactt

SEQ ID NO: 5182392 - DNA, 16 bp, Homo sapiens
agagaaacttcaaagt

SEQ ID NO: 5182393 - DNA, 13 bp, Homo sapiens
agagaaactttat

SEQ ID NO: 5182394 - DNA, 22 bp, Homo sapiens
agagaaactttgagtacagata

SEQ ID NO: 5182395 - DNA, 23 bp, Homo sapiens
agagaaagaaaaggcaaaagact

SEQ ID NO: 5182396 - DNA, 16 bp, Homo sapiens
agagaaagaaaatgaa

SEQ ID NO: 5182397 - DNA, 22 bp, Homo sapiens
agagaaagaaagagaaagtact

SEQ ID NO: 5182398 - DNA, 16 bp, Homo sapiens
agagaaagaaagggaa

SEQ ID NO: 5182399 - DNA, 16 bp, Homo sapiens
agagaaagaaatagaa

SEQ ID NO: 5182400 - DNA, 13 bp, Homo sapiens
agagaaagaaatt

SEQ ID NO: 5182401 - DNA, 15 bp, Homo sapiens
agagaaagaagagac

SEQ ID NO: 5182402 - DNA, 13 bp, Homo sapiens
agagaaagaatga

SEQ ID NO: 5182403 - DNA, 19 bp, Homo sapiens
agagaaagacaaaatgtga

SEQ ID NO: 5182404 - DNA, 11 bp, Homo sapiens
agagaaagaga

SEQ ID NO: 5182405 - DNA, 13 bp, Homo sapiens
agagaaagagaca

SEQ ID NO: 5182406 - DNA, 13 bp, Homo sapiens
agagaaagagaga

SEQ ID NO: 5182407 - DNA, 18 bp, Homo sapiens
agagaaagagagaagcca

SEQ ID NO: 5182408 - DNA, 14 bp, Homo sapiens
agagaaagagagag

SEQ ID NO: 5182409 - DNA, 19 bp, Homo sapiens
agagaaagcaaaacatttt

SEQ ID NO: 5182410 - DNA, 14 bp, Homo sapiens
agagaaagccaggc

SEQ ID NO: 5182411 - DNA, 14 bp, Homo sapiens
agagaaaggagggc

SEQ ID NO: 5182412 - DNA, 19 bp, Homo sapiens
agagaaaggggagcccact

SEQ ID NO: 5182413 - DNA, 23 bp, Homo sapiens
agagaaaggggagcccactgtcc

SEQ ID NO: 5182414 - DNA, 17 bp, Homo sapiens
agagaaagtgacctatt

SEQ ID NO: 5182415 - DNA, 19 bp, Homo sapiens
agagaaagttggtgctgct

SEQ ID NO: 5182416 - DNA, 14 bp, Homo sapiens
agagaaatacaaaa

SEQ ID NO: 5182417 - DNA, 16 bp, Homo sapiens
agagaaatacagctgg

SEQ ID NO: 5182418 - DNA, 18 bp, Homo sapiens
agagaaatacagctggct

SEQ ID NO: 5182419 - DNA, 14 bp, Homo sapiens
agagaaatatggaa

SEQ ID NO: 5182420 - DNA, 17 bp, Homo sapiens
agagaaatcagaaaaat

SEQ ID NO: 5182421 - DNA, 16 bp, Homo sapiens
agagaaatcaggcctg

SEQ ID NO: 5182422 - DNA, 19 bp, Homo sapiens
agagaaatcaggcctgatg

SEQ ID NO: 5182423 - DNA, 13 bp, Homo sapiens
agagaaatccttc

SEQ ID NO: 5182424 - DNA, 14 bp, Homo sapiens
agagaaatgaatta

SEQ ID NO: 5182425 - DNA, 15 bp, Homo sapiens
agagaaatgccccag

SEQ ID NO: 5182426 - DNA, 18 bp, Homo sapiens
agagaaatgctaaccttg

SEQ ID NO: 5182427 - DNA, 19 bp, Homo sapiens
agagaaatgctaaccttgt

SEQ ID NO: 5182428 - DNA, 22 bp, Homo sapiens
agagaaattatgttttcatcca

SEQ ID NO: 5182429 - DNA, 13 bp, Homo sapiens
agagaaattctgt

SEQ ID NO: 5182430 - DNA, 20 bp, Homo sapiens
agagaaatttttatttttga

SEQ ID NO: 5182431 - DNA, 13 bp, Homo sapiens
agagaacaggtgg

SEQ ID NO: 5182432 - DNA, 19 bp, Homo sapiens
agagaacagtattgggcag

SEQ ID NO: 5182433 - DNA, 23 bp, Homo sapiens
agagaacagtcatgtatgcaagt

SEQ ID NO: 5182434 - DNA, 13 bp, Homo sapiens
agagaacatttta

SEQ ID NO: 5182435 - DNA, 18 bp, Homo sapiens
agagaacattttactgtt

SEQ ID NO: 5182436 - DNA, 17 bp, Homo sapiens
agagaaccagtgcagac

SEQ ID NO: 5182437 - DNA, 19 bp, Homo sapiens
agagaacctaactgtatct

SEQ ID NO: 5182438 - DNA, 21 bp, Homo sapiens
agagaacctaactgtatcttg

SEQ ID NO: 5182439 - DNA, 23 bp, Homo sapiens
agagaacctcacgcacctcccat

SEQ ID NO: 5182440 - DNA, 22 bp, Homo sapiens
agagaacctcaggtacggagaa

SEQ ID NO: 5182441 - DNA, 23 bp, Homo sapiens
agagaacctcaggtacggagaag

SEQ ID NO: 5182442 - DNA, 19 bp, Homo sapiens
agagaactaaagctggaga

SEQ ID NO: 5182443 - DNA, 14 bp, Homo sapiens
agagaactgaaaag

SEQ ID NO: 5182444 - DNA, 17 bp, Homo sapiens
agagaactgaaaagaga

SEQ ID NO: 5182445 - DNA, 16 bp, Homo sapiens
agagaactgcagacct

SEQ ID NO: 5182446 - DNA, 15 bp, Homo sapiens
agagaactgtcaccc

SEQ ID NO: 5182447 - DNA, 14 bp, Homo sapiens
agagaactgtcttt

SEQ ID NO: 5182448 - DNA, 15 bp, Homo sapiens
agagaactgtctttc

SEQ ID NO: 5182449 - DNA, 14 bp, Homo sapiens
agagaactgtggcc

SEQ ID NO: 5182450 - DNA, 14 bp, Homo sapiens
agagaactttattt

SEQ ID NO: 5182451 - DNA, 22 bp, Homo sapiens
agagaactttcggagcctgcct

SEQ ID NO: 5182452 - DNA, 19 bp, Homo sapiens
agagaacttttttcaaaat

SEQ ID NO: 5182453 - DNA, 15 bp, Homo sapiens
agagaagaaatagca

SEQ ID NO: 5182454 - DNA, 16 bp, Homo sapiens
agagaagaagaaaaaa

SEQ ID NO: 5182455 - DNA, 20 bp, Homo sapiens
agagaagaatccacaaggac

SEQ ID NO: 5182456 - DNA, 17 bp, Homo sapiens
agagaagacctagctat

SEQ ID NO: 5182457 - DNA, 12 bp, Homo sapiens
agagaagagacc

SEQ ID NO: 5182458 - DNA, 21 bp, Homo sapiens
agagaagagattgtggtttca

SEQ ID NO: 5182459 - DNA, 12 bp, Homo sapiens
agagaagaggct

SEQ ID NO: 5182460 - DNA, 16 bp, Homo sapiens
agagaagagggcccag

SEQ ID NO: 5182461 - DNA, 18 bp, Homo sapiens
agagaagagggcccagcc

SEQ ID NO: 5182462 - DNA, 20 bp, Homo sapiens
agagaagataatgttcttta

SEQ ID NO: 5182463 - DNA, 15 bp, Homo sapiens
agagaagataattgt

SEQ ID NO: 5182464 - DNA, 20 bp, Homo sapiens
agagaagatgtgatttattt

SEQ ID NO: 5182465 - DNA, 15 bp, Homo sapiens
agagaagcaagtaaa

SEQ ID NO: 5182466 - DNA, 16 bp, Homo sapiens
agagaagcaagtggtg

SEQ ID NO: 5182467 - DNA, 21 bp, Homo sapiens
agagaagcatcctccacatcc

SEQ ID NO: 5182468 - DNA, 22 bp, Homo sapiens
agagaagcattctcattggaaa

SEQ ID NO: 5182469 - DNA, 11 bp, Homo sapiens
agagaagccag

SEQ ID NO: 5182470 - DNA, 16 bp, Homo sapiens
agagaagccagcttgt

SEQ ID NO: 5182471 - DNA, 20 bp, Homo sapiens
agagaagccccttccccatg

SEQ ID NO: 5182472 - DNA, 13 bp, Homo sapiens
agagaagcctgtg

SEQ ID NO: 5182473 - DNA, 17 bp, Homo sapiens
agagaagccttcaagct

SEQ ID NO: 5182474 - DNA, 14 bp, Homo sapiens
agagaagccttggt

SEQ ID NO: 5182475 - DNA, 17 bp, Homo sapiens
agagaagctcatttagt

SEQ ID NO: 5182476 - DNA, 15 bp, Homo sapiens
agagaagctcctgct

SEQ ID NO: 5182477 - DNA, 17 bp, Homo sapiens
agagaagctcctgctac

SEQ ID NO: 5182478 - DNA, 12 bp, Homo sapiens
agagaagctgaa

SEQ ID NO: 5182479 - DNA, 12 bp, Homo sapiens
agagaagctgga

SEQ ID NO: 5182480 - DNA, 13 bp, Homo sapiens
agagaagctggac

SEQ ID NO: 5182481 - DNA, 14 bp, Homo sapiens
agagaagctggact

SEQ ID NO: 5182482 - DNA, 23 bp, Homo sapiens
agagaagctggacttctgtgggc

SEQ ID NO: 5182483 - DNA, 12 bp, Homo sapiens
agattatttaca

SEQ ID NO: 5182484 - DNA, 19 bp, Homo sapiens
agattatttacaagaagaa

SEQ ID NO: 5182485 - DNA, 15 bp, Homo sapiens
agattatttcatata

SEQ ID NO: 5182486 - DNA, 12 bp, Homo sapiens
agattatttctg

SEQ ID NO: 5182487 - DNA, 22 bp, Homo sapiens
agattattttagtctgtcatcc

SEQ ID NO: 5182488 - DNA, 14 bp, Homo sapiens
agattattttctat

SEQ ID NO: 5182489 - DNA, 19 bp, Homo sapiens
agattcaaaaaaaaaatat

SEQ ID NO: 5182490 - DNA, 22 bp, Homo sapiens
agattcaaaaaaaaaatataag

SEQ ID NO: 5182491 - DNA, 14 bp, Homo sapiens
agattcaaacccag

SEQ ID NO: 5182492 - DNA, 11 bp, Homo sapiens
agattcaaagc

SEQ ID NO: 5182493 - DNA, 18 bp, Homo sapiens
agattcaaaggttctagg

SEQ ID NO: 5182494 - DNA, 21 bp, Homo sapiens
agattcaaaggttctaggttt

SEQ ID NO: 5182495 - DNA, 21 bp, Homo sapiens
agattcaaatctcttgctttc

SEQ ID NO: 5182496 - DNA, 22 bp, Homo sapiens
agattcaagacaagagctgtta

SEQ ID NO: 5182497 - DNA, 17 bp, Homo sapiens
agattcaagtagttttg

SEQ ID NO: 5182498 - DNA, 16 bp, Homo sapiens
agattcaataatgaga

SEQ ID NO: 5182499 - DNA, 16 bp, Homo sapiens
agattcaatcccagga

SEQ ID NO: 5182500 - DNA, 21 bp, Homo sapiens
agattcaatgcccctgaattt

SEQ ID NO: 5182501 - DNA, 22 bp, Homo sapiens
agattcaatgcccctgaattta

SEQ ID NO: 5182502 - DNA, 18 bp, Homo sapiens
agattcacatgctggctc

SEQ ID NO: 5182503 - DNA, 17 bp, Homo sapiens
agattcacctaagagat

SEQ ID NO: 5182504 - DNA, 18 bp, Homo sapiens
agattcacctaagagatt

SEQ ID NO: 5182505 - DNA, 15 bp, Homo sapiens
agattcacctgtaaa

SEQ ID NO: 5182506 - DNA, 21 bp, Homo sapiens
agattcacctgtaaaacttta

SEQ ID NO: 5182507 - DNA, 13 bp, Homo sapiens
agattcacctttt

SEQ ID NO: 5182508 - DNA, 15 bp, Homo sapiens
agattcactttgaca

SEQ ID NO: 5182509 - DNA, 21 bp, Homo sapiens
agattcactttgtttatgcat

SEQ ID NO: 5182510 - DNA, 15 bp, Homo sapiens
agattcagagaaatt

SEQ ID NO: 5182511 - DNA, 16 bp, Homo sapiens
agattcagcagtgtct

SEQ ID NO: 5182512 - DNA, 21 bp, Homo sapiens
agattcaggccagcccagcca

SEQ ID NO: 5182513 - DNA, 16 bp, Homo sapiens
agattcaggtaataca

SEQ ID NO: 5182514 - DNA, 20 bp, Homo sapiens
agattcaggtaatacaaact

SEQ ID NO: 5182515 - DNA, 17 bp, Homo sapiens
agattcagtcttgcctt

SEQ ID NO: 5182516 - DNA, 21 bp, Homo sapiens
agattcagtttaagagttttc

SEQ ID NO: 5182517 - DNA, 16 bp, Homo sapiens
agattcagttttccca

SEQ ID NO: 5182518 - DNA, 15 bp, Homo sapiens
agattcataaataca

SEQ ID NO: 5182519 - DNA, 18 bp, Homo sapiens
agattcataaatacaaaa

SEQ ID NO: 5182520 - DNA, 19 bp, Homo sapiens
agattcatatttacttctt

SEQ ID NO: 5182521 - DNA, 22 bp, Homo sapiens
agattcatcattttctccacct

SEQ ID NO: 5182522 - DNA, 16 bp, Homo sapiens
agattcatgaaaatgt

SEQ ID NO: 5182523 - DNA, 18 bp, Homo sapiens
agattcatgcaagtggag

SEQ ID NO: 5182524 - DNA, 17 bp, Homo sapiens
agattcatttttaatca

SEQ ID NO: 5182525 - DNA, 9 bp, Homo sapiens
agattccac

SEQ ID NO: 5182526 - DNA, 18 bp, Homo sapiens
agattccacacaaaatgt

SEQ ID NO: 5182527 - DNA, 15 bp, Homo sapiens
agattccagaacgcc

SEQ ID NO: 5182528 - DNA, 18 bp, Homo sapiens
agattccagaacgccctg

SEQ ID NO: 5182529 - DNA, 21 bp, Homo sapiens
agattccagagagtggctcct

SEQ ID NO: 5182530 - DNA, 20 bp, Homo sapiens
agattccattggtccaagat

SEQ ID NO: 5182531 - DNA, 17 bp, Homo sapiens
agattccattttggaaa

SEQ ID NO: 5182532 - DNA, 14 bp, Homo sapiens
agattcccagagac

SEQ ID NO: 5182533 - DNA, 13 bp, Homo sapiens
agattcccagagc

SEQ ID NO: 5182534 - DNA, 12 bp, Homo sapiens
agattcccagga

SEQ ID NO: 5182535 - DNA, 16 bp, Homo sapiens
agattcccaggagttc

SEQ ID NO: 5182536 - DNA, 22 bp, Homo sapiens
agattcccaggagttctgctca

SEQ ID NO: 5182537 - DNA, 13 bp, Homo sapiens
agattcccaggcc

SEQ ID NO: 5182538 - DNA, 19 bp, Homo sapiens
agattcccaggccaggctc

SEQ ID NO: 5182539 - DNA, 22 bp, Homo sapiens
agattcccaggccagggctggg

SEQ ID NO: 5182540 - DNA, 20 bp, Homo sapiens
agattccccactcagccttt

SEQ ID NO: 5182541 - DNA, 15 bp, Homo sapiens
agattccccatcaac

SEQ ID NO: 5182542 - DNA, 23 bp, Homo sapiens
agattccccattgcctcctcctt

SEQ ID NO: 5182543 - DNA, 19 bp, Homo sapiens
agattcccggctggacttt

SEQ ID NO: 5182544 - DNA, 12 bp, Homo sapiens
agattcccttgc

SEQ ID NO: 5182545 - DNA, 23 bp, Homo sapiens
agattccggatcctaagcatcta

SEQ ID NO: 5182546 - DNA, 19 bp, Homo sapiens
agattcctacttaaacaaa

SEQ ID NO: 5182547 - DNA, 21 bp, Homo sapiens
agattcctacttaaacaaaaa

SEQ ID NO: 5182548 - DNA, 15 bp, Homo sapiens
agattcctgggcctg

SEQ ID NO: 5182549 - DNA, 16 bp, Homo sapiens
agattcctgggcctgt

SEQ ID NO: 5182550 - DNA, 17 bp, Homo sapiens
agattcctgggcctgtc

SEQ ID NO: 5182551 - DNA, 13 bp, Homo sapiens
agattcctgtcct

SEQ ID NO: 5182552 - DNA, 17 bp, Homo sapiens
agattcctgttgtgtaa

SEQ ID NO: 5182553 - DNA, 13 bp, Homo sapiens
agattccttccca

SEQ ID NO: 5182554 - DNA, 17 bp, Homo sapiens
agattccttcccatgga

SEQ ID NO: 5182555 - DNA, 16 bp, Homo sapiens
agattcctttcctgtg

SEQ ID NO: 5182556 - DNA, 17 bp, Homo sapiens
agattcctttcctgtgt

SEQ ID NO: 5182557 - DNA, 17 bp, Homo sapiens
agattctaaaacattct

SEQ ID NO: 5182558 - DNA, 11 bp, Homo sapiens
agattctaaag

SEQ ID NO: 5182559 - DNA, 12 bp, Homo sapiens
agattctaaaga

SEQ ID NO: 5182560 - DNA, 14 bp, Homo sapiens
agattctaaagatt

SEQ ID NO: 5182561 - DNA, 16 bp, Homo sapiens
agattctaaagattct

SEQ ID NO: 5182562 - DNA, 17 bp, Homo sapiens
agattctaaagctcaat

SEQ ID NO: 5182563 - DNA, 23 bp, Homo sapiens
agattctaaaggtccacaggtct

SEQ ID NO: 5182564 - DNA, 15 bp, Homo sapiens
agattctaacatatt

SEQ ID NO: 5182565 - DNA, 13 bp, Homo sapiens
agattctaatgat

SEQ ID NO: 5182566 - DNA, 14 bp, Homo sapiens
agattctactcttg

SEQ ID NO: 5182567 - DNA, 19 bp, Homo sapiens
agattctactcttgtcatt

SEQ ID NO: 5182568 - DNA, 14 bp, Homo sapiens
agattctagatgat

SEQ ID NO: 5182569 - DNA, 21 bp, Homo sapiens
agattctagcacatcatggca

SEQ ID NO: 5182570 - DNA, 19 bp, Homo sapiens
agattctagccaaactatt

SEQ ID NO: 5182571 - DNA, 16 bp, Homo sapiens
agattctatagttcta

SEQ ID NO: 5182572 - DNA, 18 bp, Homo sapiens
agattctatagttctaga

SEQ ID NO: 5182573 - DNA, 12 bp, Homo sapiens
agattctatgtt

SEQ ID NO: 5182574 - DNA, 22 bp, Homo sapiens
agattctatgttaatattttat

SEQ ID NO: 5182575 - DNA, 21 bp, Homo sapiens
agattctatttaattgaaact

SEQ ID NO: 5182576 - DNA, 13 bp, Homo sapiens
agattctcaaagg

SEQ ID NO: 5182577 - DNA, 20 bp, Homo sapiens
agattctcataacttgagac

SEQ ID NO: 5182578 - DNA, 13 bp, Homo sapiens
agattctccatta

SEQ ID NO: 5182579 - DNA, 16 bp, Homo sapiens
agattctccattacac

SEQ ID NO: 5182580 - DNA, 21 bp, Homo sapiens
agattctctgcccagccgggc

SEQ ID NO: 5182581 - DNA, 16 bp, Homo sapiens
agattctcttgaataa

SEQ ID NO: 5182582 - DNA, 22 bp, Homo sapiens
agattctgaaacaggccctctg

SEQ ID NO: 5182583 - DNA, 17 bp, Homo sapiens
agattctgaaacattgc

SEQ ID NO: 5182584 - DNA, 22 bp, Homo sapiens
agattctgagcaaaggccctgg

SEQ ID NO: 5182585 - DNA, 15 bp, Homo sapiens
agattctgattccct

SEQ ID NO: 5182586 - DNA, 14 bp, Homo sapiens
agattctgatttta

SEQ ID NO: 5182587 - DNA, 23 bp, Homo sapiens
agattctgatttttttgttgttg

SEQ ID NO: 5182588 - DNA, 12 bp, Homo sapiens
agattctgcctc

SEQ ID NO: 5182589 - DNA, 14 bp, Homo sapiens
agattctgcctctc

SEQ ID NO: 5182590 - DNA, 19 bp, Homo sapiens
agattctgcctctctggaa

SEQ ID NO: 5182591 - DNA, 19 bp, Homo sapiens
agattctgcctttgccagg

SEQ ID NO: 5182592 - DNA, 21 bp, Homo sapiens
agattctggacagtcagctct

SEQ ID NO: 5182593 - DNA, 19 bp, Homo sapiens
agattctggatctcctgct

SEQ ID NO: 5182594 - DNA, 12 bp, Homo sapiens
agattctgggaa

SEQ ID NO: 5182595 - DNA, 15 bp, Homo sapiens
agattctgggaaagg

SEQ ID NO: 5182596 - DNA, 17 bp, Homo sapiens
agattctgggaaaggtg

SEQ ID NO: 5182597 - DNA, 19 bp, Homo sapiens
agattctgggtttgcccag

SEQ ID NO: 5182598 - DNA, 20 bp, Homo sapiens
agattctgggtttgcccagt

SEQ ID NO: 5182599 - DNA, 15 bp, Homo sapiens
agattctgtcttata

SEQ ID NO: 5182600 - DNA, 16 bp, Homo sapiens
agattctgtgggcagc

SEQ ID NO: 5182601 - DNA, 23 bp, Homo sapiens
agattctgtgtattaacatgcaa

SEQ ID NO: 5182602 - DNA, 13 bp, Homo sapiens
agattctgtgtca

SEQ ID NO: 5182603 - DNA, 23 bp, Homo sapiens
agattcttcagtctggactatat

SEQ ID NO: 5182604 - DNA, 13 bp, Homo sapiens
agattcttccatt

SEQ ID NO: 5182605 - DNA, 23 bp, Homo sapiens
agattcttccattaaattgcctt

SEQ ID NO: 5182606 - DNA, 19 bp, Homo sapiens
agattcttcccattctcca

SEQ ID NO: 5182607 - DNA, 10 bp, Homo sapiens
agattcttct

SEQ ID NO: 5182608 - DNA, 19 bp, Homo sapiens
agattcttcttaaaagttt

SEQ ID NO: 5182609 - DNA, 21 bp, Homo sapiens
agattcttcttaaaagtttct

SEQ ID NO: 5182610 - DNA, 22 bp, Homo sapiens
agattcttgtatttattacaac

SEQ ID NO: 5182611 - DNA, 18 bp, Homo sapiens
agattctttaaactactg

SEQ ID NO: 5182612 - DNA, 22 bp, Homo sapiens
agattctttaaactactgaact

SEQ ID NO: 5182613 - DNA, 20 bp, Homo sapiens
agattcttttaaattagaaa

SEQ ID NO: 5182614 - DNA, 21 bp, Homo sapiens
agattcttttaaattagaaaa

SEQ ID NO: 5182615 - DNA, 15 bp, Homo sapiens
agattctttttctga

SEQ ID NO: 5182616 - DNA, 15 bp, Homo sapiens
agattgaaaaggaag

SEQ ID NO: 5182617 - DNA, 14 bp, Homo sapiens
agattgaaaagtgt

SEQ ID NO: 5182618 - DNA, 23 bp, Homo sapiens
agattgaaaggacctcttctgaa

SEQ ID NO: 5182619 - DNA, 20 bp, Homo sapiens
agattgaaattccagttgca

SEQ ID NO: 5182620 - DNA, 13 bp, Homo sapiens
agattgaaattta

SEQ ID NO: 5182621 - DNA, 15 bp, Homo sapiens
agattgaacactgcg

SEQ ID NO: 5182622 - DNA, 11 bp, Homo sapiens
agattgaactt

SEQ ID NO: 5182623 - DNA, 13 bp, Homo sapiens
agattgaactttc

SEQ ID NO: 5182624 - DNA, 11 bp, Homo sapiens
agattgaagaa

SEQ ID NO: 5182625 - DNA, 18 bp, Homo sapiens
agattgaagctaaaacac

SEQ ID NO: 5182626 - DNA, 22 bp, Homo sapiens
agattgaatatttatctagaga

SEQ ID NO: 5182627 - DNA, 17 bp, Homo sapiens
agattgacagcatatag

SEQ ID NO: 5182628 - DNA, 21 bp, Homo sapiens
agattgacctgaggagacatc

SEQ ID NO: 5182629 - DNA, 13 bp, Homo sapiens
agattgacctgga

SEQ ID NO: 5182630 - DNA, 16 bp, Homo sapiens
agattgactaaataaa

SEQ ID NO: 5182631 - DNA, 17 bp, Homo sapiens
agattgactaaataaaa

SEQ ID NO: 5182632 - DNA, 13 bp, Homo sapiens
agattgagaaatg

SEQ ID NO: 5182633 - DNA, 16 bp, Homo sapiens
agattgagaaatgtgt

SEQ ID NO: 5182634 - DNA, 17 bp, Homo sapiens
agattgagatgtgttca

SEQ ID NO: 5182635 - DNA, 17 bp, Homo sapiens
agattgatagaaaatcc

SEQ ID NO: 5182636 - DNA, 19 bp, Homo sapiens
agattgatagggagtttta

SEQ ID NO: 5182637 - DNA, 18 bp, Homo sapiens
agattgatatctataaaa

SEQ ID NO: 5182638 - DNA, 21 bp, Homo sapiens
agattgatatctataaaatag

SEQ ID NO: 5182639 - DNA, 19 bp, Homo sapiens
agattgatcatttttataa

SEQ ID NO: 5182640 - DNA, 14 bp, Homo sapiens
agattgattgtatt

SEQ ID NO: 5182641 - DNA, 15 bp, Homo sapiens
agattgattgtattg

SEQ ID NO: 5182642 - DNA, 12 bp, Homo sapiens
agattgcaaagc

SEQ ID NO: 5182643 - DNA, 16 bp, Homo sapiens
agattgcaacaggctg

SEQ ID NO: 5182644 - DNA, 24 bp, Homo sapiens
agattgcaacccagggcaaatgga

SEQ ID NO: 5182645 - DNA, 20 bp, Homo sapiens
agattgcacagtcaaaacga

SEQ ID NO: 5182646 - DNA, 19 bp, Homo sapiens
agattgcactgctgcattc

SEQ ID NO: 5182647 - DNA, 16 bp, Homo sapiens
agattgcagttctgat

SEQ ID NO: 5182648 - DNA, 15 bp, Homo sapiens
agattgcatgtgact

SEQ ID NO: 5182649 - DNA, 16 bp, Homo sapiens
agattgcatgtgactc

SEQ ID NO: 5182650 - DNA, 16 bp, Homo sapiens
agattgccccaggtct

SEQ ID NO: 5182651 - DNA, 14 bp, Homo sapiens
agattgctcaaatc

SEQ ID NO: 5182652 - DNA, 13 bp, Homo sapiens
agattgctctggg

SEQ ID NO: 5182653 - DNA, 10 bp, Homo sapiens
agattgctga

SEQ ID NO: 5182654 - DNA, 14 bp, Homo sapiens
agattgctgaaact

SEQ ID NO: 5182655 - DNA, 19 bp, Homo sapiens
agattgctgaattaaggat

SEQ ID NO: 5182656 - DNA, 15 bp, Homo sapiens
agattgctgcttctg

SEQ ID NO: 5182657 - DNA, 22 bp, Homo sapiens
agattgctgtgtgttgcctggg

SEQ ID NO: 5182658 - DNA, 21 bp, Homo sapiens
agattgcttaaaagcattttt

SEQ ID NO: 5182659 - DNA, 16 bp, Homo sapiens
agattgcttaaaatag

SEQ ID NO: 5182660 - DNA, 20 bp, Homo sapiens
agattgctttaagaaactgt

SEQ ID NO: 5182661 - DNA, 23 bp, Homo sapiens
agattgctttgattaatccagaa

SEQ ID NO: 5182662 - DNA, 14 bp, Homo sapiens
agattggaaggaga

SEQ ID NO: 5182663 - DNA, 21 bp, Homo sapiens
agagaagctggtctagactgt

SEQ ID NO: 5182664 - DNA, 22 bp, Homo sapiens
agagaaggaatcttcagaacaa

SEQ ID NO: 5182665 - DNA, 12 bp, Homo sapiens
agagaaggagat

SEQ ID NO: 5182666 - DNA, 13 bp, Homo sapiens
agagaaggagcca

SEQ ID NO: 5182667 - DNA, 21 bp, Homo sapiens
agagaaggatgggtcccctcc

SEQ ID NO: 5182668 - DNA, 22 bp, Homo sapiens
agagaaggcccataccttctgg

SEQ ID NO: 5182669 - DNA, 18 bp, Homo sapiens
agagaaggcctccctagc

SEQ ID NO: 5182670 - DNA, 13 bp, Homo sapiens
agagaaggcctgg

SEQ ID NO: 5182671 - DNA, 15 bp, Homo sapiens
agagaaggccttaca

SEQ ID NO: 5182672 - DNA, 15 bp, Homo sapiens
agagaaggggaggag

SEQ ID NO: 5182673 - DNA, 22 bp, Homo sapiens
agagaaggggcccaagagagac

SEQ ID NO: 5182674 - DNA, 23 bp, Homo sapiens
agagaaggggcccaagagagaca

SEQ ID NO: 5182675 - DNA, 22 bp, Homo sapiens
agagaagggggacgtttctgga

SEQ ID NO: 5182676 - DNA, 23 bp, Homo sapiens
agagaagggggacgtttctggaa

SEQ ID NO: 5182677 - DNA, 22 bp, Homo sapiens
agagaaggtggacctggcagtg

SEQ ID NO: 5182678 - DNA, 15 bp, Homo sapiens
agagaaggtggtctg

SEQ ID NO: 5182679 - DNA, 19 bp, Homo sapiens
agagaaggtggtctgcacc

SEQ ID NO: 5182680 - DNA, 19 bp, Homo sapiens
agagaaggttctgagctgt

SEQ ID NO: 5182681 - DNA, 17 bp, Homo sapiens
agagaagtacagaatgt

SEQ ID NO: 5182682 - DNA, 23 bp, Homo sapiens
agagaagtacaggtcatctgctg

SEQ ID NO: 5182683 - DNA, 15 bp, Homo sapiens
agagaagtacttttg

SEQ ID NO: 5182684 - DNA, 21 bp, Homo sapiens
agagaagtcacaacaaaagga

SEQ ID NO: 5182685 - DNA, 22 bp, Homo sapiens
agagaagtcacaacaaaaggaa

SEQ ID NO: 5182686 - DNA, 22 bp, Homo sapiens
agagaagtcagttggagaaaat

SEQ ID NO: 5182687 - DNA, 17 bp, Homo sapiens
agagaagtgagtggtgt

SEQ ID NO: 5182688 - DNA, 17 bp, Homo sapiens
agagaagtgcccctgct

SEQ ID NO: 5182689 - DNA, 22 bp, Homo sapiens
agagaagtggactggaggagct

SEQ ID NO: 5182690 - DNA, 19 bp, Homo sapiens
agagaagttgacatggaaa

SEQ ID NO: 5182691 - DNA, 20 bp, Homo sapiens
agagaagttgccctccaggc

SEQ ID NO: 5182692 - DNA, 20 bp, Homo sapiens
agagaagtttgtagccaggt

SEQ ID NO: 5182693 - DNA, 15 bp, Homo sapiens
agagaataaacatca

SEQ ID NO: 5182694 - DNA, 19 bp, Homo sapiens
agagaataaagacttcatg

SEQ ID NO: 5182695 - DNA, 11 bp, Homo sapiens
agagaataaat

SEQ ID NO: 5182696 - DNA, 19 bp, Homo sapiens
agagaataaattggattat

SEQ ID NO: 5182697 - DNA, 14 bp, Homo sapiens
agagaatacacata

SEQ ID NO: 5182698 - DNA, 17 bp, Homo sapiens
agagaatacacatataa

SEQ ID NO: 5182699 - DNA, 21 bp, Homo sapiens
agagaatacacatataaaaac

SEQ ID NO: 5182700 - DNA, 14 bp, Homo sapiens
agagaatagaacaa

SEQ ID NO: 5182701 - DNA, 17 bp, Homo sapiens
agagaatagagctgcca

SEQ ID NO: 5182702 - DNA, 20 bp, Homo sapiens
agagaatagagctgccactg

SEQ ID NO: 5182703 - DNA, 23 bp, Homo sapiens
agagaatagagctgccactgggc

SEQ ID NO: 5182704 - DNA, 13 bp, Homo sapiens
agagaatatttca

SEQ ID NO: 5182705 - DNA, 13 bp, Homo sapiens
agagaatatttta

SEQ ID NO: 5182706 - DNA, 14 bp, Homo sapiens
agagaatcagacct

SEQ ID NO: 5182707 - DNA, 16 bp, Homo sapiens
agagaatgaactgtgg

SEQ ID NO: 5182708 - DNA, 17 bp, Homo sapiens
agagaatgagagagtgt

SEQ ID NO: 5182709 - DNA, 19 bp, Homo sapiens
agagaatgagagagtgtgg

SEQ ID NO: 5182710 - DNA, 19 bp, Homo sapiens
agagaatgagagcgacaca

SEQ ID NO: 5182711 - DNA, 23 bp, Homo sapiens
agagaatgagagcgacacagacg

SEQ ID NO: 5182712 - DNA, 17 bp, Homo sapiens
agagaatggaaaacaga

SEQ ID NO: 5182713 - DNA, 17 bp, Homo sapiens
agagaatgggtttactc

SEQ ID NO: 5182714 - DNA, 16 bp, Homo sapiens
agagaatggtggtatt

SEQ ID NO: 5182715 - DNA, 17 bp, Homo sapiens
agagaatgtagatattg

SEQ ID NO: 5182716 - DNA, 16 bp, Homo sapiens
agagaatgtattctgt

SEQ ID NO: 5182717 - DNA, 19 bp, Homo sapiens
agagaatgtatttcctttt

SEQ ID NO: 5182718 - DNA, 14 bp, Homo sapiens
agagaatgtatttg

SEQ ID NO: 5182719 - DNA, 17 bp, Homo sapiens
agagaatgtattttcat

SEQ ID NO: 5182720 - DNA, 18 bp, Homo sapiens
agagaatgtattttcata

SEQ ID NO: 5182721 - DNA, 15 bp, Homo sapiens
agagaatgtcactgt

SEQ ID NO: 5182722 - DNA, 13 bp, Homo sapiens
agagaatgtggaa

SEQ ID NO: 5182723 - DNA, 18 bp, Homo sapiens
agagaatgtgtttcaaaa

SEQ ID NO: 5182724 - DNA, 22 bp, Homo sapiens
agagaatgttatagtgaattat

SEQ ID NO: 5182725 - DNA, 15 bp, Homo sapiens
agagaatgttcctac

SEQ ID NO: 5182726 - DNA, 14 bp, Homo sapiens
agagaattactatt

SEQ ID NO: 5182727 - DNA, 20 bp, Homo sapiens
agagaattagacaaatttgt

SEQ ID NO: 5182728 - DNA, 14 bp, Homo sapiens
agagaattctgttc

SEQ ID NO: 5182729 - DNA, 12 bp, Homo sapiens
agagaattggct

SEQ ID NO: 5182730 - DNA, 14 bp, Homo sapiens
agagaattggctca

SEQ ID NO: 5182731 - DNA, 13 bp, Homo sapiens
agagaatttggag

SEQ ID NO: 5182732 - DNA, 20 bp, Homo sapiens
agagaatttggagccaggat

SEQ ID NO: 5182733 - DNA, 19 bp, Homo sapiens
agagacaaacacctcccag

SEQ ID NO: 5182734 - DNA, 21 bp, Homo sapiens
agagacaaacacctcccagga

SEQ ID NO: 5182735 - DNA, 12 bp, Homo sapiens
agagacaaagct

SEQ ID NO: 5182736 - DNA, 13 bp, Homo sapiens
agagacaaatctt

SEQ ID NO: 5182737 - DNA, 16 bp, Homo sapiens
agagacaagaagcaaa

SEQ ID NO: 5182738 - DNA, 15 bp, Homo sapiens
agagacaataaaaca

SEQ ID NO: 5182739 - DNA, 16 bp, Homo sapiens
agagacaataaaacat

SEQ ID NO: 5182740 - DNA, 17 bp, Homo sapiens
agagacaataaaacatt

SEQ ID NO: 5182741 - DNA, 18 bp, Homo sapiens
agagacaataactttgaa

SEQ ID NO: 5182742 - DNA, 16 bp, Homo sapiens
agagacacaagccttc

SEQ ID NO: 5182743 - DNA, 20 bp, Homo sapiens
agagacacactgaagaagca

SEQ ID NO: 5182744 - DNA, 19 bp, Homo sapiens
agagacaccaaactgccaa

SEQ ID NO: 5182745 - DNA, 14 bp, Homo sapiens
agagacacctgcac

SEQ ID NO: 5182746 - DNA, 15 bp, Homo sapiens
agagacacctgcacc

SEQ ID NO: 5182747 - DNA, 17 bp, Homo sapiens
agagacactcccaggga

SEQ ID NO: 5182748 - DNA, 21 bp, Homo sapiens
agagacactcccagggacaag

SEQ ID NO: 5182749 - DNA, 13 bp, Homo sapiens
agagacactgagc

SEQ ID NO: 5182750 - DNA, 18 bp, Homo sapiens
agagacactgagccagtc

SEQ ID NO: 5182751 - DNA, 18 bp, Homo sapiens
agagacagaaacagagag

SEQ ID NO: 5182752 - DNA, 21 bp, Homo sapiens
agagacagaaacagagagaga

SEQ ID NO: 5182753 - DNA, 14 bp, Homo sapiens
agagacagaaagca

SEQ ID NO: 5182754 - DNA, 13 bp, Homo sapiens
agagacagaagca

SEQ ID NO: 5182755 - DNA, 14 bp, Homo sapiens
agagacagaagcag

SEQ ID NO: 5182756 - DNA, 12 bp, Homo sapiens
agagacagaatg

SEQ ID NO: 5182757 - DNA, 18 bp, Homo sapiens
agagacagacttgagaac

SEQ ID NO: 5182758 - DNA, 12 bp, Homo sapiens
agagacagagag

SEQ ID NO: 5182759 - DNA, 13 bp, Homo sapiens
agagacagagccc

SEQ ID NO: 5182760 - DNA, 14 bp, Homo sapiens
agagacagagcccc

SEQ ID NO: 5182761 - DNA, 19 bp, Homo sapiens
agagacagagcccccaagc

SEQ ID NO: 5182762 - DNA, 21 bp, Homo sapiens
agagacagagcccccaagcct

SEQ ID NO: 5182763 - DNA, 18 bp, Homo sapiens
agagacagatacctccaa

SEQ ID NO: 5182764 - DNA, 15 bp, Homo sapiens
agagacagatgctgg

SEQ ID NO: 5182765 - DNA, 9 bp, Homo sapiens
agagacagg

SEQ ID NO: 5182766 - DNA, 23 bp, Homo sapiens
agagacaggaaaatcctctggct

SEQ ID NO: 5182767 - DNA, 13 bp, Homo sapiens
agagacaggcagc

SEQ ID NO: 5182768 - DNA, 20 bp, Homo sapiens
agagacaggcagcccagcag

SEQ ID NO: 5182769 - DNA, 21 bp, Homo sapiens
agagacaggcagcccagcagt

SEQ ID NO: 5182770 - DNA, 13 bp, Homo sapiens
agagacagggccc

SEQ ID NO: 5182771 - DNA, 18 bp, Homo sapiens
agagacagggcccgggcc

SEQ ID NO: 5182772 - DNA, 16 bp, Homo sapiens
agagacagtgatgcct

SEQ ID NO: 5182773 - DNA, 19 bp, Homo sapiens
agagacagtgatgcctgcc

SEQ ID NO: 5182774 - DNA, 15 bp, Homo sapiens
agagacagtgttttg

SEQ ID NO: 5182775 - DNA, 23 bp, Homo sapiens
agagacagttgggtgagaacaac

SEQ ID NO: 5182776 - DNA, 17 bp, Homo sapiens
agagacatccttcattt

SEQ ID NO: 5182777 - DNA, 15 bp, Homo sapiens
agagacatggctttc

SEQ ID NO: 5182778 - DNA, 15 bp, Homo sapiens
agagacatgggcctc

SEQ ID NO: 5182779 - DNA, 17 bp, Homo sapiens
agagacatgggcctccc

SEQ ID NO: 5182780 - DNA, 12 bp, Homo sapiens
agagacattcct

SEQ ID NO: 5182781 - DNA, 12 bp, Homo sapiens
agagaccaaata

SEQ ID NO: 5182782 - DNA, 22 bp, Homo sapiens
agagaccaaataattaaaagaa

SEQ ID NO: 5182783 - DNA, 23 bp, Homo sapiens
agagaccaactttttcattccct

SEQ ID NO: 5182784 - DNA, 24 bp, Homo sapiens
agagaccaactttttcattccctg

SEQ ID NO: 5182785 - DNA, 13 bp, Homo sapiens
agagaccaagctt

SEQ ID NO: 5182786 - DNA, 15 bp, Homo sapiens
agagaccacacattt

SEQ ID NO: 5182787 - DNA, 17 bp, Homo sapiens
agagaccacacatttta

SEQ ID NO: 5182788 - DNA, 14 bp, Homo sapiens
agagaccacagcaa

SEQ ID NO: 5182789 - DNA, 13 bp, Homo sapiens
agagaccacagcc

SEQ ID NO: 5182790 - DNA, 19 bp, Homo sapiens
agagaccacttccttaaca

SEQ ID NO: 5182791 - DNA, 21 bp, Homo sapiens
agagaccagcactcagcctca

SEQ ID NO: 5182792 - DNA, 13 bp, Homo sapiens
agagaccagggct

SEQ ID NO: 5182793 - DNA, 13 bp, Homo sapiens
agagacccaagga

SEQ ID NO: 5182794 - DNA, 21 bp, Homo sapiens
agagacccaaggaggaaaaac

SEQ ID NO: 5182795 - DNA, 17 bp, Homo sapiens
agagacccagatctcat

SEQ ID NO: 5182796 - DNA, 16 bp, Homo sapiens
agagaccccaccgcca

SEQ ID NO: 5182797 - DNA, 12 bp, Homo sapiens
agagacccccag

SEQ ID NO: 5182798 - DNA, 13 bp, Homo sapiens
agagacccccagg

SEQ ID NO: 5182799 - DNA, 15 bp, Homo sapiens
agagaccccgcaccc

SEQ ID NO: 5182800 - DNA, 15 bp, Homo sapiens
agagacccctcccct

SEQ ID NO: 5182801 - DNA, 15 bp, Homo sapiens
agagacccctgtctg

SEQ ID NO: 5182802 - DNA, 14 bp, Homo sapiens
agagaccccttcct

SEQ ID NO: 5182803 - DNA, 17 bp, Homo sapiens
agagaccctacagacag

SEQ ID NO: 5182804 - DNA, 21 bp, Homo sapiens
agagaccctcactgctgggga

SEQ ID NO: 5182805 - DNA, 23 bp, Homo sapiens
agagaccctcactgctggggagt

SEQ ID NO: 5182806 - DNA, 23 bp, Homo sapiens
agagaccctctgccaccagagac

SEQ ID NO: 5182807 - DNA, 13 bp, Homo sapiens
agagaccctgcca

SEQ ID NO: 5182808 - DNA, 23 bp, Homo sapiens
agagaccctgccaactttccaga

SEQ ID NO: 5182809 - DNA, 19 bp, Homo sapiens
agagacccttcaaacttgg

SEQ ID NO: 5182810 - DNA, 15 bp, Homo sapiens
agagacctacctcag

SEQ ID NO: 5182811 - DNA, 13 bp, Homo sapiens
agagacctcatca

SEQ ID NO: 5182812 - DNA, 16 bp, Homo sapiens
agagacctcatcagga

SEQ ID NO: 5182813 - DNA, 15 bp, Homo sapiens
agagacctcatcctg

SEQ ID NO: 5182814 - DNA, 15 bp, Homo sapiens
agagacctcctgcct

SEQ ID NO: 5182815 - DNA, 13 bp, Homo sapiens
agagacctgccct

SEQ ID NO: 5182816 - DNA, 17 bp, Homo sapiens
agagacctgccctctct

SEQ ID NO: 5182817 - DNA, 14 bp, Homo sapiens
agagacctgtgtga

SEQ ID NO: 5182818 - DNA, 19 bp, Homo sapiens
agagacctgtgtgaactat

SEQ ID NO: 5182819 - DNA, 22 bp, Homo sapiens
agagacctgttttaaaaaggaa

SEQ ID NO: 5182820 - DNA, 18 bp, Homo sapiens
agagaccttcaaatgcga

SEQ ID NO: 5182821 - DNA, 20 bp, Homo sapiens
agagaccttcaaatgcgaac

SEQ ID NO: 5182822 - DNA, 16 bp, Homo sapiens
agagaccttccagaaa

SEQ ID NO: 5182823 - DNA, 13 bp, Homo sapiens
agagacctttgcc

SEQ ID NO: 5182824 - DNA, 20 bp, Homo sapiens
agagacgcagccctgggggc

SEQ ID NO: 5182825 - DNA, 18 bp, Homo sapiens
agagacgccactccctgg

SEQ ID NO: 5182826 - DNA, 19 bp, Homo sapiens
agagacgccactccctggg

SEQ ID NO: 5182827 - DNA, 15 bp, Homo sapiens
agagacgcccagccc

SEQ ID NO: 5182828 - DNA, 16 bp, Homo sapiens
agagacgcccagcccc

SEQ ID NO: 5182829 - DNA, 23 bp, Homo sapiens
agagacgcccagccccatccctg

SEQ ID NO: 5182830 - DNA, 20 bp, Homo sapiens
agagacgccctatttctatg

SEQ ID NO: 5182831 - DNA, 21 bp, Homo sapiens
agagacgccctatttctatgt

SEQ ID NO: 5182832 - DNA, 23 bp, Homo sapiens
agagacggcagaaaacagagcct

SEQ ID NO: 5182833 - DNA, 13 bp, Homo sapiens
agagacggcagcc

SEQ ID NO: 5182834 - DNA, 19 bp, Homo sapiens
agagacggcagccccatcc

SEQ ID NO: 5182835 - DNA, 21 bp, Homo sapiens
agagacggcagccccatcctt

SEQ ID NO: 5182836 - DNA, 17 bp, Homo sapiens
agagacggggcttcacc

SEQ ID NO: 5182837 - DNA, 14 bp, Homo sapiens
agagacgtgtacat

SEQ ID NO: 5182838 - DNA, 21 bp, Homo sapiens
agagactaaggggcagctcct

SEQ ID NO: 5182839 - DNA, 22 bp, Homo sapiens
agagactaaggggcagctcctg

SEQ ID NO: 5182840 - DNA, 23 bp, Homo sapiens
agagactaaggggcagctcctga

SEQ ID NO: 5182841 - DNA, 15 bp, Homo sapiens
agagactcaaagaga

SEQ ID NO: 5182842 - DNA, 23 bp, Homo sapiens
agattggaaggagacacagatgt

SEQ ID NO: 5182843 - DNA, 20 bp, Homo sapiens
agattggacatggtctcctc

SEQ ID NO: 5182844 - DNA, 16 bp, Homo sapiens
agattggagctgaaga

SEQ ID NO: 5182845 - DNA, 17 bp, Homo sapiens
agattggatcaagtatt

SEQ ID NO: 5182846 - DNA, 15 bp, Homo sapiens
agattggatttgctg

SEQ ID NO: 5182847 - DNA, 17 bp, Homo sapiens
agattggatttgctgtg

SEQ ID NO: 5182848 - DNA, 15 bp, Homo sapiens
agattggattttatg

SEQ ID NO: 5182849 - DNA, 17 bp, Homo sapiens
agattggattttatgtt

SEQ ID NO: 5182850 - DNA, 16 bp, Homo sapiens
agattgggactgagtg

SEQ ID NO: 5182851 - DNA, 16 bp, Homo sapiens
agattgggatactgta

SEQ ID NO: 5182852 - DNA, 23 bp, Homo sapiens
agattgggatactgtaatacttc

SEQ ID NO: 5182853 - DNA, 14 bp, Homo sapiens
agattgggggccct

SEQ ID NO: 5182854 - DNA, 18 bp, Homo sapiens
agattgggggccctgggg

SEQ ID NO: 5182855 - DNA, 14 bp, Homo sapiens
agattgggtgccag

SEQ ID NO: 5182856 - DNA, 18 bp, Homo sapiens
agattgggttggaatgct

SEQ ID NO: 5182857 - DNA, 16 bp, Homo sapiens
agattggtcattaaat

SEQ ID NO: 5182858 - DNA, 20 bp, Homo sapiens
agattggtcattaaatacta

SEQ ID NO: 5182859 - DNA, 14 bp, Homo sapiens
agattggtgttttt

SEQ ID NO: 5182860 - DNA, 23 bp, Homo sapiens
agattgtaaaccgctttggcctg

SEQ ID NO: 5182861 - DNA, 15 bp, Homo sapiens
agattgtaaaggtag

SEQ ID NO: 5182862 - DNA, 18 bp, Homo sapiens
agattgtaattcagaaaa

SEQ ID NO: 5182863 - DNA, 19 bp, Homo sapiens
agattgtacatatggaaat

SEQ ID NO: 5182864 - DNA, 19 bp, Homo sapiens
agattgtacattttttact

SEQ ID NO: 5182865 - DNA, 22 bp, Homo sapiens
agattgtactgttcatacagtt

SEQ ID NO: 5182866 - DNA, 12 bp, Homo sapiens
agattgtactta

SEQ ID NO: 5182867 - DNA, 16 bp, Homo sapiens
agattgtacttagcca

SEQ ID NO: 5182868 - DNA, 14 bp, Homo sapiens
agattgtagctctt

SEQ ID NO: 5182869 - DNA, 15 bp, Homo sapiens
agattgtatctctta

SEQ ID NO: 5182870 - DNA, 21 bp, Homo sapiens
agattgtccagtgcaaccaca

SEQ ID NO: 5182871 - DNA, 13 bp, Homo sapiens
agattgtcctttt

SEQ ID NO: 5182872 - DNA, 20 bp, Homo sapiens
agattgtccttttgcaaaga

SEQ ID NO: 5182873 - DNA, 22 bp, Homo sapiens
agattgtcttgcaacttcagtt

SEQ ID NO: 5182874 - DNA, 13 bp, Homo sapiens
agattgtgaataa

SEQ ID NO: 5182875 - DNA, 18 bp, Homo sapiens
agattgtgaataatgatt

SEQ ID NO: 5182876 - DNA, 16 bp, Homo sapiens
agattgtgcccctgca

SEQ ID NO: 5182877 - DNA, 21 bp, Homo sapiens
agattgtgcccctgcactcca

SEQ ID NO: 5182878 - DNA, 21 bp, Homo sapiens
agattgtggaatgttggataa

SEQ ID NO: 5182879 - DNA, 16 bp, Homo sapiens
agattgtggggagaga

SEQ ID NO: 5182880 - DNA, 14 bp, Homo sapiens
agattgtggggtgc

SEQ ID NO: 5182881 - DNA, 16 bp, Homo sapiens
agattgtggggtgcag

SEQ ID NO: 5182882 - DNA, 24 bp, Homo sapiens
agattgtggtgggccctgagtcct

SEQ ID NO: 5182883 - DNA, 20 bp, Homo sapiens
agattgtgtaaattcctgtt

SEQ ID NO: 5182884 - DNA, 14 bp, Homo sapiens
agattgtgtacata

SEQ ID NO: 5182885 - DNA, 15 bp, Homo sapiens
agattgtgtacatag

SEQ ID NO: 5182886 - DNA, 12 bp, Homo sapiens
agattgtgtctg

SEQ ID NO: 5182887 - DNA, 20 bp, Homo sapiens
agattgtgtctggtcgtttg

SEQ ID NO: 5182888 - DNA, 17 bp, Homo sapiens
agattgttattaaatgt

SEQ ID NO: 5182889 - DNA, 22 bp, Homo sapiens
agattgttgataggaactgtct

SEQ ID NO: 5182890 - DNA, 17 bp, Homo sapiens
agattgttggtgaattt

SEQ ID NO: 5182891 - DNA, 21 bp, Homo sapiens
agattgttggtgaattttcaa

SEQ ID NO: 5182892 - DNA, 15 bp, Homo sapiens
agattgttgtttgcc

SEQ ID NO: 5182893 - DNA, 14 bp, Homo sapiens
agattgtttatcta

SEQ ID NO: 5182894 - DNA, 22 bp, Homo sapiens
agattgtttatctagatgtaaa

SEQ ID NO: 5182895 - DNA, 12 bp, Homo sapiens
agattgtttgca

SEQ ID NO: 5182896 - DNA, 23 bp, Homo sapiens
agattgttttatatgtagtacta

SEQ ID NO: 5182897 - DNA, 23 bp, Homo sapiens
agattgttttatcatgacatgtt

SEQ ID NO: 5182898 - DNA, 13 bp, Homo sapiens
agatttaaagtat

SEQ ID NO: 5182899 - DNA, 19 bp, Homo sapiens
agatttaaagtattttaat

SEQ ID NO: 5182900 - DNA, 13 bp, Homo sapiens
agatttaaatgca

SEQ ID NO: 5182901 - DNA, 14 bp, Homo sapiens
agatttaacaaata

SEQ ID NO: 5182902 - DNA, 19 bp, Homo sapiens
agatttaagcacaaacttt

SEQ ID NO: 5182903 - DNA, 19 bp, Homo sapiens
agatttaagccttacaaag

SEQ ID NO: 5182904 - DNA, 17 bp, Homo sapiens
agatttaagccttgaca

SEQ ID NO: 5182905 - DNA, 19 bp, Homo sapiens
agatttaagccttgacaca

SEQ ID NO: 5182906 - DNA, 20 bp, Homo sapiens
agatttaatctgccaagggc

SEQ ID NO: 5182907 - DNA, 22 bp, Homo sapiens
agatttaattaatcatgaatgt

SEQ ID NO: 5182908 - DNA, 16 bp, Homo sapiens
agatttacactgggag

SEQ ID NO: 5182909 - DNA, 14 bp, Homo sapiens
agatttacattcca

SEQ ID NO: 5182910 - DNA, 16 bp, Homo sapiens
agatttaccctttata

SEQ ID NO: 5182911 - DNA, 18 bp, Homo sapiens
agatttagctatttattg

SEQ ID NO: 5182912 - DNA, 20 bp, Homo sapiens
agatttaggagcagaaatgc

SEQ ID NO: 5182913 - DNA, 18 bp, Homo sapiens
agatttagggttctatat

SEQ ID NO: 5182914 - DNA, 13 bp, Homo sapiens
agatttagtttac

SEQ ID NO: 5182915 - DNA, 18 bp, Homo sapiens
agatttagttttgtaact

SEQ ID NO: 5182916 - DNA, 21 bp, Homo sapiens
agatttataaatgcactgtaa

SEQ ID NO: 5182917 - DNA, 15 bp, Homo sapiens
agatttatataaatg

SEQ ID NO: 5182918 - DNA, 17 bp, Homo sapiens
agatttatcaaatcagt

SEQ ID NO: 5182919 - DNA, 19 bp, Homo sapiens
agatttatctttatacaga

SEQ ID NO: 5182920 - DNA, 15 bp, Homo sapiens
agatttattaaagaa

SEQ ID NO: 5182921 - DNA, 13 bp, Homo sapiens
agatttattatga

SEQ ID NO: 5182922 - DNA, 13 bp, Homo sapiens
agatttattgtaa

SEQ ID NO: 5182923 - DNA, 20 bp, Homo sapiens
agatttatttgtttgatttt

SEQ ID NO: 5182924 - DNA, 14 bp, Homo sapiens
agatttattttaca

SEQ ID NO: 5182925 - DNA, 15 bp, Homo sapiens
agatttattttacat

SEQ ID NO: 5182926 - DNA, 16 bp, Homo sapiens
agatttattttacatt

SEQ ID NO: 5182927 - DNA, 18 bp, Homo sapiens
agatttattttacattta

SEQ ID NO: 5182928 - DNA, 19 bp, Homo sapiens
agatttattttttggactt

SEQ ID NO: 5182929 - DNA, 14 bp, Homo sapiens
agatttcaacatat

SEQ ID NO: 5182930 - DNA, 15 bp, Homo sapiens
agatttcaacatatc

SEQ ID NO: 5182931 - DNA, 13 bp, Homo sapiens
agatttcaagaga

SEQ ID NO: 5182932 - DNA, 19 bp, Homo sapiens
agatttcactctccttggt

SEQ ID NO: 5182933 - DNA, 17 bp, Homo sapiens
agatttcagctatgcta

SEQ ID NO: 5182934 - DNA, 15 bp, Homo sapiens
agatttcagtaatgt

SEQ ID NO: 5182935 - DNA, 17 bp, Homo sapiens
agatttcagtagaattt

SEQ ID NO: 5182936 - DNA, 18 bp, Homo sapiens
agatttcatagttcagaa

SEQ ID NO: 5182937 - DNA, 15 bp, Homo sapiens
agatttcatatctaa

SEQ ID NO: 5182938 - DNA, 18 bp, Homo sapiens
agatttcatctgctctcc

SEQ ID NO: 5182939 - DNA, 23 bp, Homo sapiens
agatttcggtcataaagaatgta

SEQ ID NO: 5182940 - DNA, 16 bp, Homo sapiens
agatttctaaataaaa

SEQ ID NO: 5182941 - DNA, 22 bp, Homo sapiens
agatttctaagttaaatcattt

SEQ ID NO: 5182942 - DNA, 10 bp, Homo sapiens
agatttctac

SEQ ID NO: 5182943 - DNA, 22 bp, Homo sapiens
agatttctagaaaagcttccta

SEQ ID NO: 5182944 - DNA, 23 bp, Homo sapiens
agatttctagcagtatgtgtgct

SEQ ID NO: 5182945 - DNA, 22 bp, Homo sapiens
agatttctagttttttttctag

SEQ ID NO: 5182946 - DNA, 18 bp, Homo sapiens
agatttctcctcttcctg

SEQ ID NO: 5182947 - DNA, 15 bp, Homo sapiens
agatttctggttgat

SEQ ID NO: 5182948 - DNA, 14 bp, Homo sapiens
agatttctgttcag

SEQ ID NO: 5182949 - DNA, 15 bp, Homo sapiens
agatttcttaaatct

SEQ ID NO: 5182950 - DNA, 20 bp, Homo sapiens
agatttcttaaatctttctt

SEQ ID NO: 5182951 - DNA, 16 bp, Homo sapiens
agatttctttgaatgt

SEQ ID NO: 5182952 - DNA, 17 bp, Homo sapiens
agatttctttgaatgta

SEQ ID NO: 5182953 - DNA, 19 bp, Homo sapiens
agatttctttgaatgtatt

SEQ ID NO: 5182954 - DNA, 17 bp, Homo sapiens
agatttcttttttatgt

SEQ ID NO: 5182955 - DNA, 21 bp, Homo sapiens
agatttcttttttatgtgatg

SEQ ID NO: 5182956 - DNA, 12 bp, Homo sapiens
agatttgaaaat

SEQ ID NO: 5182957 - DNA, 18 bp, Homo sapiens
agatttgaaaattgtata

SEQ ID NO: 5182958 - DNA, 19 bp, Homo sapiens
agatttgaagatctgattt

SEQ ID NO: 5182959 - DNA, 15 bp, Homo sapiens
agatttgaccaaatc

SEQ ID NO: 5182960 - DNA, 12 bp, Homo sapiens
agatttgaccta

SEQ ID NO: 5182961 - DNA, 22 bp, Homo sapiens
agatttgcaaaaagtgaacaga

SEQ ID NO: 5182962 - DNA, 17 bp, Homo sapiens
agatttgcaacagcaaa

SEQ ID NO: 5182963 - DNA, 12 bp, Homo sapiens
agatttgcacaa

SEQ ID NO: 5182964 - DNA, 14 bp, Homo sapiens
agatttgcacaaaa

SEQ ID NO: 5182965 - DNA, 15 bp, Homo sapiens
agatttgccagcaca

SEQ ID NO: 5182966 - DNA, 14 bp, Homo sapiens
agatttgcccattt

SEQ ID NO: 5182967 - DNA, 17 bp, Homo sapiens
agatttgcccatttaca

SEQ ID NO: 5182968 - DNA, 21 bp, Homo sapiens
agatttgctttaccttcctga

SEQ ID NO: 5182969 - DNA, 16 bp, Homo sapiens
agatttggaaaattca

SEQ ID NO: 5182970 - DNA, 16 bp, Homo sapiens
agatttggaatacaca

SEQ ID NO: 5182971 - DNA, 16 bp, Homo sapiens
agatttggagcactct

SEQ ID NO: 5182972 - DNA, 17 bp, Homo sapiens
agatttggcatctcctg

SEQ ID NO: 5182973 - DNA, 17 bp, Homo sapiens
agatttgggctggaaca

SEQ ID NO: 5182974 - DNA, 20 bp, Homo sapiens
agatttggggtataggtctc

SEQ ID NO: 5182975 - DNA, 18 bp, Homo sapiens
agatttgtaaatctttgt

SEQ ID NO: 5182976 - DNA, 22 bp, Homo sapiens
agatttgtaattacaggaggga

SEQ ID NO: 5182977 - DNA, 14 bp, Homo sapiens
agatttgtacatat

SEQ ID NO: 5182978 - DNA, 17 bp, Homo sapiens
agatttgtacatattat

SEQ ID NO: 5182979 - DNA, 21 bp, Homo sapiens
agatttgtactacagttcttt

SEQ ID NO: 5182980 - DNA, 12 bp, Homo sapiens
agatttgtattt

SEQ ID NO: 5182981 - DNA, 17 bp, Homo sapiens
agatttgtatttatatt

SEQ ID NO: 5182982 - DNA, 13 bp, Homo sapiens
agatttgtgaact

SEQ ID NO: 5182983 - DNA, 19 bp, Homo sapiens
agatttgtgaactcagcca

SEQ ID NO: 5182984 - DNA, 16 bp, Homo sapiens
agatttgtgaactgga

SEQ ID NO: 5182985 - DNA, 20 bp, Homo sapiens
agatttgttactgtattttt

SEQ ID NO: 5182986 - DNA, 14 bp, Homo sapiens
agatttgttcattc

SEQ ID NO: 5182987 - DNA, 16 bp, Homo sapiens
agatttgttgacagca

SEQ ID NO: 5182988 - DNA, 22 bp, Homo sapiens
agatttgttgacagcaaaatgt

SEQ ID NO: 5182989 - DNA, 23 bp, Homo sapiens
agatttgttgacagcaaaatgtt

SEQ ID NO: 5182990 - DNA, 17 bp, Homo sapiens
agatttgttttgcattc

SEQ ID NO: 5182991 - DNA, 17 bp, Homo sapiens
agatttgtttttctctt

SEQ ID NO: 5182992 - DNA, 17 bp, Homo sapiens
agattttaaaaagtctt

SEQ ID NO: 5182993 - DNA, 19 bp, Homo sapiens
agattttaaattcacaata

SEQ ID NO: 5182994 - DNA, 15 bp, Homo sapiens
agattttaaatttta

SEQ ID NO: 5182995 - DNA, 20 bp, Homo sapiens
agattttaagaatggtctca

SEQ ID NO: 5182996 - DNA, 14 bp, Homo sapiens
agattttaattgtc

SEQ ID NO: 5182997 - DNA, 16 bp, Homo sapiens
agattttaattgtcat

SEQ ID NO: 5182998 - DNA, 17 bp, Homo sapiens
agattttaattgtcatg

SEQ ID NO: 5182999 - DNA, 15 bp, Homo sapiens
agattttaatttatt

SEQ ID NO: 5183000 - DNA, 14 bp, Homo sapiens
agattttaattttg

SEQ ID NO: 5183001 - DNA, 21 bp, Homo sapiens
agattttaattttgaataaat

SEQ ID NO: 5183002 - DNA, 16 bp, Homo sapiens
agattttacatgaagt

SEQ ID NO: 5183003 - DNA, 19 bp, Homo sapiens
agattttacatgaagtatt

SEQ ID NO: 5183004 - DNA, 20 bp, Homo sapiens
agattttacatgaagtattt

SEQ ID NO: 5183005 - DNA, 16 bp, Homo sapiens
agattttagaattctt

SEQ ID NO: 5183006 - DNA, 14 bp, Homo sapiens
agattttaggtgtt

SEQ ID NO: 5183007 - DNA, 13 bp, Homo sapiens
agattttagttca

SEQ ID NO: 5183008 - DNA, 13 bp, Homo sapiens
agattttagtttt

SEQ ID NO: 5183009 - DNA, 20 bp, Homo sapiens
agattttagttttattttct

SEQ ID NO: 5183010 - DNA, 23 bp, Homo sapiens
agattttagttttattttctaaa

SEQ ID NO: 5183011 - DNA, 14 bp, Homo sapiens
agattttatagtgt

SEQ ID NO: 5183012 - DNA, 14 bp, Homo sapiens
agattttatgtgct

SEQ ID NO: 5183013 - DNA, 15 bp, Homo sapiens
agattttatgtttaa

SEQ ID NO: 5183014 - DNA, 22 bp, Homo sapiens
agattttattatgtaaatccca

SEQ ID NO: 5183015 - DNA, 13 bp, Homo sapiens
agattttattgta

SEQ ID NO: 5183016 - DNA, 21 bp, Homo sapiens
agattttatttgtaattttaa

SEQ ID NO: 5183017 - DNA, 21 bp, Homo sapiens
agattttattttcaagcaaat

SEQ ID NO: 5183018 - DNA, 14 bp, Homo sapiens
agattttcagtcta

SEQ ID NO: 5183019 - DNA, 13 bp, Homo sapiens
agattttcattga

SEQ ID NO: 5183020 - DNA, 17 bp, Homo sapiens
agattttcctcctttcc

SEQ ID NO: 5183021 - DNA, 17 bp, Homo sapiens
agattttcctcttgtga

SEQ ID NO: 5183022 - DNA, 18 bp, Homo sapiens
agagactcaaagagactc

SEQ ID NO: 5183023 - DNA, 15 bp, Homo sapiens
agagactcagcctgc

SEQ ID NO: 5183024 - DNA, 16 bp, Homo sapiens
agagactcagcctgca

SEQ ID NO: 5183025 - DNA, 19 bp, Homo sapiens
agagactcagggccccagc

SEQ ID NO: 5183026 - DNA, 18 bp, Homo sapiens
agagactcccatgaagcc

SEQ ID NO: 5183027 - DNA, 19 bp, Homo sapiens
agagactcccatgaagcct

SEQ ID NO: 5183028 - DNA, 12 bp, Homo sapiens
agagactcctgc

SEQ ID NO: 5183029 - DNA, 15 bp, Homo sapiens
agagactcctgcagg

SEQ ID NO: 5183030 - DNA, 17 bp, Homo sapiens
agagactcctgcaggca

SEQ ID NO: 5183031 - DNA, 17 bp, Homo sapiens
agagactcgagtcccca

SEQ ID NO: 5183032 - DNA, 17 bp, Homo sapiens
agagactctattttaat

SEQ ID NO: 5183033 - DNA, 19 bp, Homo sapiens
agagactctattttaatgt

SEQ ID NO: 5183034 - DNA, 13 bp, Homo sapiens
agagactctcctg

SEQ ID NO: 5183035 - DNA, 16 bp, Homo sapiens
agagactctggaagcc

SEQ ID NO: 5183036 - DNA, 18 bp, Homo sapiens
agagactctggaagcccc

SEQ ID NO: 5183037 - DNA, 21 bp, Homo sapiens
agagactctggaagcccccca

SEQ ID NO: 5183038 - DNA, 22 bp, Homo sapiens
agagactctggcctccacagtt

SEQ ID NO: 5183039 - DNA, 13 bp, Homo sapiens
agagactctgtga

SEQ ID NO: 5183040 - DNA, 20 bp, Homo sapiens
agagactctgtgatctaagc

SEQ ID NO: 5183041 - DNA, 19 bp, Homo sapiens
agagactcttttaggatca

SEQ ID NO: 5183042 - DNA, 17 bp, Homo sapiens
agagactgaaagcagca

SEQ ID NO: 5183043 - DNA, 24 bp, Homo sapiens
agagactgaaagcagcagctagga

SEQ ID NO: 5183044 - DNA, 17 bp, Homo sapiens
agagactgagcagccgc

SEQ ID NO: 5183045 - DNA, 22 bp, Homo sapiens
agagactgagcagccgccagct

SEQ ID NO: 5183046 - DNA, 12 bp, Homo sapiens
agagactgccca

SEQ ID NO: 5183047 - DNA, 22 bp, Homo sapiens
agagactgcccaccctgggcct

SEQ ID NO: 5183048 - DNA, 16 bp, Homo sapiens
agagactgcccttctc

SEQ ID NO: 5183049 - DNA, 17 bp, Homo sapiens
agagactgcgttctgca

SEQ ID NO: 5183050 - DNA, 15 bp, Homo sapiens
agagactgcttgaca

SEQ ID NO: 5183051 - DNA, 17 bp, Homo sapiens
agagactgcttgacaaa

SEQ ID NO: 5183052 - DNA, 13 bp, Homo sapiens
agagactggagca

SEQ ID NO: 5183053 - DNA, 16 bp, Homo sapiens
agagactggcagccag

SEQ ID NO: 5183054 - DNA, 13 bp, Homo sapiens
agagactggccag

SEQ ID NO: 5183055 - DNA, 16 bp, Homo sapiens
agagactggccagagg

SEQ ID NO: 5183056 - DNA, 19 bp, Homo sapiens
agagactggccagaggcag

SEQ ID NO: 5183057 - DNA, 20 bp, Homo sapiens
agagactggccagaggcagc

SEQ ID NO: 5183058 - DNA, 13 bp, Homo sapiens
agagactgggaag

SEQ ID NO: 5183059 - DNA, 15 bp, Homo sapiens
agagactgtagattg

SEQ ID NO: 5183060 - DNA, 14 bp, Homo sapiens
agagactgtgaggc

SEQ ID NO: 5183061 - DNA, 23 bp, Homo sapiens
agagactgtgaggcggcagctgg

SEQ ID NO: 5183062 - DNA, 13 bp, Homo sapiens
agagactgtgcca

SEQ ID NO: 5183063 - DNA, 18 bp, Homo sapiens
agagactgtgcttgggag

SEQ ID NO: 5183064 - DNA, 14 bp, Homo sapiens
agagacttaagaaa

SEQ ID NO: 5183065 - DNA, 14 bp, Homo sapiens
agagacttctctgt

SEQ ID NO: 5183066 - DNA, 15 bp, Homo sapiens
agagacttctctgta

SEQ ID NO: 5183067 - DNA, 19 bp, Homo sapiens
agagacttgcagttagact

SEQ ID NO: 5183068 - DNA, 17 bp, Homo sapiens
agagacttggaagagga

SEQ ID NO: 5183069 - DNA, 20 bp, Homo sapiens
agagacttgggacattgcct

SEQ ID NO: 5183070 - DNA, 19 bp, Homo sapiens
agagactttaatcactgct

SEQ ID NO: 5183071 - DNA, 15 bp, Homo sapiens
agagactttgtcact

SEQ ID NO: 5183072 - DNA, 20 bp, Homo sapiens
agagactttgtcacttattt

SEQ ID NO: 5183073 - DNA, 22 bp, Homo sapiens
agagactttgtcacttatttcc

SEQ ID NO: 5183074 - DNA, 19 bp, Homo sapiens
agagacttttaatcagaca

SEQ ID NO: 5183075 - DNA, 19 bp, Homo sapiens
agagagaaaaaaaaaatag

SEQ ID NO: 5183076 - DNA, 13 bp, Homo sapiens
agagagaaaaaca

SEQ ID NO: 5183077 - DNA, 23 bp, Homo sapiens
agagagaaaaagagagagcaggg

SEQ ID NO: 5183078 - DNA, 18 bp, Homo sapiens
agagagaaaataaaaagt

SEQ ID NO: 5183079 - DNA, 17 bp, Homo sapiens
agagagaaacatttatg

SEQ ID NO: 5183080 - DNA, 13 bp, Homo sapiens
agagagaaagaga

SEQ ID NO: 5183081 - DNA, 15 bp, Homo sapiens
agagagaaaggactc

SEQ ID NO: 5183082 - DNA, 19 bp, Homo sapiens
agagagaaattctgttaaa

SEQ ID NO: 5183083 - DNA, 14 bp, Homo sapiens
agagagaaccagga

SEQ ID NO: 5183084 - DNA, 21 bp, Homo sapiens
agagagaacctaactgtatct

SEQ ID NO: 5183085 - DNA, 17 bp, Homo sapiens
agagagaagagtccagg

SEQ ID NO: 5183086 - DNA, 13 bp, Homo sapiens
agagagaagcagg

SEQ ID NO: 5183087 - DNA, 14 bp, Homo sapiens
agagagaagcaggc

SEQ ID NO: 5183088 - DNA, 17 bp, Homo sapiens
agagagaagcaggcaga

SEQ ID NO: 5183089 - DNA, 18 bp, Homo sapiens
agagagaagccagccaca

SEQ ID NO: 5183090 - DNA, 17 bp, Homo sapiens
agagagaataaattgga

SEQ ID NO: 5183091 - DNA, 16 bp, Homo sapiens
agagagaatagagctg

SEQ ID NO: 5183092 - DNA, 18 bp, Homo sapiens
agagagacacaagtggcc

SEQ ID NO: 5183093 - DNA, 21 bp, Homo sapiens
agagagacatggaaaaggaaa

SEQ ID NO: 5183094 - DNA, 18 bp, Homo sapiens
agagagacattgcctcca

SEQ ID NO: 5183095 - DNA, 12 bp, Homo sapiens
agagagacccca

SEQ ID NO: 5183096 - DNA, 14 bp, Homo sapiens
agagagaccccagt

SEQ ID NO: 5183097 - DNA, 17 bp, Homo sapiens
agagagaccccgcaccc

SEQ ID NO: 5183098 - DNA, 21 bp, Homo sapiens
agagagaccccgcacccggct

SEQ ID NO: 5183099 - DNA, 12 bp, Homo sapiens
agagagacctag

SEQ ID NO: 5183100 - DNA, 13 bp, Homo sapiens
agagagacctcat

SEQ ID NO: 5183101 - DNA, 14 bp, Homo sapiens
agagagactgtgtg

SEQ ID NO: 5183102 - DNA, 14 bp, Homo sapiens
agagagagaaagaa

SEQ ID NO: 5183103 - DNA, 15 bp, Homo sapiens
agagagagaaccttt

SEQ ID NO: 5183104 - DNA, 14 bp, Homo sapiens
agagagagacagag

SEQ ID NO: 5183105 - DNA, 14 bp, Homo sapiens
agagagagaccctc

SEQ ID NO: 5183106 - DNA, 15 bp, Homo sapiens
agagagagaccctca

SEQ ID NO: 5183107 - DNA, 11 bp, Homo sapiens
agagagagaga

SEQ ID NO: 5183108 - DNA, 12 bp, Homo sapiens
agagagagagaa

SEQ ID NO: 5183109 - DNA, 15 bp, Homo sapiens
agagagagagaaaga

SEQ ID NO: 5183110 - DNA, 13 bp, Homo sapiens
agagagagagaga

SEQ ID NO: 5183111 - DNA, 14 bp, Homo sapiens
agagagagagagaa

SEQ ID NO: 5183112 - DNA, 14 bp, Homo sapiens
agagagagagagcg

SEQ ID NO: 5183113 - DNA, 12 bp, Homo sapiens
agagagagagcg

SEQ ID NO: 5183114 - DNA, 15 bp, Homo sapiens
agagagagaggacag

SEQ ID NO: 5183115 - DNA, 23 bp, Homo sapiens
agagagagccttaatggatgctc

SEQ ID NO: 5183116 - DNA, 19 bp, Homo sapiens
agagagagcgcgggagaga

SEQ ID NO: 5183117 - DNA, 21 bp, Homo sapiens
agagagagcgcgggagagagt

SEQ ID NO: 5183118 - DNA, 11 bp, Homo sapiens
agagagaggcc

SEQ ID NO: 5183119 - DNA, 13 bp, Homo sapiens
agagagaggcctg

SEQ ID NO: 5183120 - DNA, 14 bp, Homo sapiens
agagagaggcctgg

SEQ ID NO: 5183121 - DNA, 22 bp, Homo sapiens
agagagagggcgcccagcccag

SEQ ID NO: 5183122 - DNA, 24 bp, Homo sapiens
agagagagggcgcccagcccaggc

SEQ ID NO: 5183123 - DNA, 13 bp, Homo sapiens
agagagaggggaa

SEQ ID NO: 5183124 - DNA, 16 bp, Homo sapiens
agagagaggggcctgc

SEQ ID NO: 5183125 - DNA, 15 bp, Homo sapiens
agagagaggttctgg

SEQ ID NO: 5183126 - DNA, 22 bp, Homo sapiens
agagagagttgacccctcctga

SEQ ID NO: 5183127 - DNA, 18 bp, Homo sapiens
agagagataaaaggtgga

SEQ ID NO: 5183128 - DNA, 22 bp, Homo sapiens
agagagatatatctgaaaactg

SEQ ID NO: 5183129 - DNA, 12 bp, Homo sapiens
agagagatgaga

SEQ ID NO: 5183130 - DNA, 18 bp, Homo sapiens
agagagatgtgtaatttt

SEQ ID NO: 5183131 - DNA, 14 bp, Homo sapiens
agagagattctcca

SEQ ID NO: 5183132 - DNA, 20 bp, Homo sapiens
agagagattggccagcaaaa

SEQ ID NO: 5183133 - DNA, 21 bp, Homo sapiens
agagagattggccagcaaaaa

SEQ ID NO: 5183134 - DNA, 13 bp, Homo sapiens
agagagcaaacat

SEQ ID NO: 5183135 - DNA, 20 bp, Homo sapiens
agagagcaaaggagaaatct

SEQ ID NO: 5183136 - DNA, 19 bp, Homo sapiens
agagagcaagacgctgtgc

SEQ ID NO: 5183137 - DNA, 23 bp, Homo sapiens
agagagcaagacgctgtgctgcc

SEQ ID NO: 5183138 - DNA, 15 bp, Homo sapiens
agagagcaaggaagc

SEQ ID NO: 5183139 - DNA, 21 bp, Homo sapiens
agagagcaatcttgctgtgaa

SEQ ID NO: 5183140 - DNA, 12 bp, Homo sapiens
agagagcaattt

SEQ ID NO: 5183141 - DNA, 22 bp, Homo sapiens
agagagcagagaagtacaggtc

SEQ ID NO: 5183142 - DNA, 19 bp, Homo sapiens
agagagcagagaatataac

SEQ ID NO: 5183143 - DNA, 17 bp, Homo sapiens
agagagcaggggagctt

SEQ ID NO: 5183144 - DNA, 16 bp, Homo sapiens
agagagcagtgctttt

SEQ ID NO: 5183145 - DNA, 15 bp, Homo sapiens
agagagccaaatctg

SEQ ID NO: 5183146 - DNA, 13 bp, Homo sapiens
agagagccaagac

SEQ ID NO: 5183147 - DNA, 14 bp, Homo sapiens
agagagccaagacg

SEQ ID NO: 5183148 - DNA, 21 bp, Homo sapiens
agagagccaagacggaggagg

SEQ ID NO: 5183149 - DNA, 19 bp, Homo sapiens
agagagccatgaagcatta

SEQ ID NO: 5183150 - DNA, 17 bp, Homo sapiens
agagagccattttgtga

SEQ ID NO: 5183151 - DNA, 18 bp, Homo sapiens
agagagcccgaggaggtg

SEQ ID NO: 5183152 - DNA, 21 bp, Homo sapiens
agagagccctagggtgctctg

SEQ ID NO: 5183153 - DNA, 19 bp, Homo sapiens
agagagcccttcccagggc

SEQ ID NO: 5183154 - DNA, 20 bp, Homo sapiens
agagagcccttcccagggca

SEQ ID NO: 5183155 - DNA, 22 bp, Homo sapiens
agagagcccttcccagggcacc

SEQ ID NO: 5183156 - DNA, 19 bp, Homo sapiens
agagagcctgtcaccagag

SEQ ID NO: 5183157 - DNA, 21 bp, Homo sapiens
agagagcctgtcaccagagct

SEQ ID NO: 5183158 - DNA, 20 bp, Homo sapiens
agagagccttaatggatgct

SEQ ID NO: 5183159 - DNA, 17 bp, Homo sapiens
agagagccttgggagcc

SEQ ID NO: 5183160 - DNA, 18 bp, Homo sapiens
agagagccttgggagcca

SEQ ID NO: 5183161 - DNA, 22 bp, Homo sapiens
agagagcgaccagcaggctcct

SEQ ID NO: 5183162 - DNA, 18 bp, Homo sapiens
agagagcgagcgctaccc

SEQ ID NO: 5183163 - DNA, 13 bp, Homo sapiens
agagagcgcagcc

SEQ ID NO: 5183164 - DNA, 20 bp, Homo sapiens
agagagcgcagccgccttca

SEQ ID NO: 5183165 - DNA, 17 bp, Homo sapiens
agagagcgcgggagaga

SEQ ID NO: 5183166 - DNA, 23 bp, Homo sapiens
agagagcggcttccccatcgcct

SEQ ID NO: 5183167 - DNA, 21 bp, Homo sapiens
agagagcggtctcaggctggt

SEQ ID NO: 5183168 - DNA, 12 bp, Homo sapiens
agagagctcaag

SEQ ID NO: 5183169 - DNA, 23 bp, Homo sapiens
agagagctcaagtttcagagtca

SEQ ID NO: 5183170 - DNA, 18 bp, Homo sapiens
agagagctgccatcgctg

SEQ ID NO: 5183171 - DNA, 11 bp, Homo sapiens
agagagctggt

SEQ ID NO: 5183172 - DNA, 12 bp, Homo sapiens
agagagctggta

SEQ ID NO: 5183173 - DNA, 16 bp, Homo sapiens
agagagcttaaattgt

SEQ ID NO: 5183174 - DNA, 22 bp, Homo sapiens
agagagcttattgttttaaaaa

SEQ ID NO: 5183175 - DNA, 18 bp, Homo sapiens
agagagcttcctgtttct

SEQ ID NO: 5183176 - DNA, 23 bp, Homo sapiens
agagaggaaaggtttgagaagca

SEQ ID NO: 5183177 - DNA, 20 bp, Homo sapiens
agagaggaaattctccactg

SEQ ID NO: 5183178 - DNA, 22 bp, Homo sapiens
agagaggaaggacccctcacca

SEQ ID NO: 5183179 - DNA, 18 bp, Homo sapiens
agagaggacaaaataaag

SEQ ID NO: 5183180 - DNA, 14 bp, Homo sapiens
agagaggacctcca

SEQ ID NO: 5183181 - DNA, 18 bp, Homo sapiens
agagaggacgtgggcggc

SEQ ID NO: 5183182 - DNA, 14 bp, Homo sapiens
agagaggagccaga

SEQ ID NO: 5183183 - DNA, 18 bp, Homo sapiens
agagaggagttcaatgat

SEQ ID NO: 5183184 - DNA, 17 bp, Homo sapiens
agagaggatgcagaggg

SEQ ID NO: 5183185 - DNA, 16 bp, Homo sapiens
agagaggcaaggggtg

SEQ ID NO: 5183186 - DNA, 19 bp, Homo sapiens
agagaggcaaggttgccct

SEQ ID NO: 5183187 - DNA, 15 bp, Homo sapiens
agagaggcaatggct

SEQ ID NO: 5183188 - DNA, 22 bp, Homo sapiens
agagaggcagaagaaccctggc

SEQ ID NO: 5183189 - DNA, 13 bp, Homo sapiens
agagaggcagaga

SEQ ID NO: 5183190 - DNA, 14 bp, Homo sapiens
agagaggcagagag

SEQ ID NO: 5183191 - DNA, 15 bp, Homo sapiens
agagaggcagagagc

SEQ ID NO: 5183192 - DNA, 20 bp, Homo sapiens
agagaggcatgtgatgtgca

SEQ ID NO: 5183193 - DNA, 12 bp, Homo sapiens
agagaggccatt

SEQ ID NO: 5183194 - DNA, 23 bp, Homo sapiens
agagaggccattctttcccaaca

SEQ ID NO: 5183195 - DNA, 21 bp, Homo sapiens
agagaggcctgggtgtgacct

SEQ ID NO: 5183196 - DNA, 16 bp, Homo sapiens
agagaggccttgtccc

SEQ ID NO: 5183197 - DNA, 16 bp, Homo sapiens
agagaggcgggcccca

SEQ ID NO: 5183198 - DNA, 16 bp, Homo sapiens
agagaggcgtcctggt

SEQ ID NO: 5183199 - DNA, 20 bp, Homo sapiens
agagaggcgttagtgggcag

SEQ ID NO: 5183200 - DNA, 17 bp, Homo sapiens
agagaggctaaaatgtt

SEQ ID NO: 5183201 - DNA, 17 bp, Homo sapiens
agagaggctctggggca

SEQ ID NO: 5183202 - DNA, 14 bp, Homo sapiens
agattttcctgaaa

SEQ ID NO: 5183203 - DNA, 13 bp, Homo sapiens
agattttcctgtg

SEQ ID NO: 5183204 - DNA, 14 bp, Homo sapiens
agattttcctgtgg

SEQ ID NO: 5183205 - DNA, 12 bp, Homo sapiens
agattttctctg

SEQ ID NO: 5183206 - DNA, 15 bp, Homo sapiens
agattttctctggaa

SEQ ID NO: 5183207 - DNA, 17 bp, Homo sapiens
agattttctctggaaat

SEQ ID NO: 5183208 - DNA, 20 bp, Homo sapiens
agattttctgggataacagt

SEQ ID NO: 5183209 - DNA, 19 bp, Homo sapiens
agattttctggttctaaca

SEQ ID NO: 5183210 - DNA, 13 bp, Homo sapiens
agattttctttaa

SEQ ID NO: 5183211 - DNA, 13 bp, Homo sapiens
agattttctttct

SEQ ID NO: 5183212 - DNA, 22 bp, Homo sapiens
agattttcttttgccttttgca

SEQ ID NO: 5183213 - DNA, 23 bp, Homo sapiens
agattttgaaaactacattttaa

SEQ ID NO: 5183214 - DNA, 21 bp, Homo sapiens
agattttgaaatttttattaa

SEQ ID NO: 5183215 - DNA, 22 bp, Homo sapiens
agattttgataatatatacaaa

SEQ ID NO: 5183216 - DNA, 15 bp, Homo sapiens
agattttgatagcaa

SEQ ID NO: 5183217 - DNA, 19 bp, Homo sapiens
agattttgatagcaaagcg

SEQ ID NO: 5183218 - DNA, 13 bp, Homo sapiens
agattttgccttt

SEQ ID NO: 5183219 - DNA, 22 bp, Homo sapiens
agattttggttggtttttacat

SEQ ID NO: 5183220 - DNA, 20 bp, Homo sapiens
agattttgtgaaatttcatg

SEQ ID NO: 5183221 - DNA, 18 bp, Homo sapiens
agattttgtgtttattct

SEQ ID NO: 5183222 - DNA, 19 bp, Homo sapiens
agattttgtgtttattctt

SEQ ID NO: 5183223 - DNA, 20 bp, Homo sapiens
agattttgtgtttattcttg

SEQ ID NO: 5183224 - DNA, 23 bp, Homo sapiens
agattttgtgtttattcttgatg

SEQ ID NO: 5183225 - DNA, 21 bp, Homo sapiens
agattttgttttgctttttct

SEQ ID NO: 5183226 - DNA, 24 bp, Homo sapiens
agattttgttttgctttttctgac

SEQ ID NO: 5183227 - DNA, 21 bp, Homo sapiens
agatttttaaaaaatattttc

SEQ ID NO: 5183228 - DNA, 13 bp, Homo sapiens
agatttttaaatt

SEQ ID NO: 5183229 - DNA, 16 bp, Homo sapiens
agatttttaaattgga

SEQ ID NO: 5183230 - DNA, 20 bp, Homo sapiens
agatttttaaattggagaaa

SEQ ID NO: 5183231 - DNA, 16 bp, Homo sapiens
agatttttaacgaatg

SEQ ID NO: 5183232 - DNA, 15 bp, Homo sapiens
agatttttaagaact

SEQ ID NO: 5183233 - DNA, 23 bp, Homo sapiens
agatttttacactaatatatgga

SEQ ID NO: 5183234 - DNA, 20 bp, Homo sapiens
agatttttactaatatatat

SEQ ID NO: 5183235 - DNA, 19 bp, Homo sapiens
agatttttaggagtgatta

SEQ ID NO: 5183236 - DNA, 17 bp, Homo sapiens
agatttttatgtgtttg

SEQ ID NO: 5183237 - DNA, 19 bp, Homo sapiens
agatttttatgtgtttgga

SEQ ID NO: 5183238 - DNA, 18 bp, Homo sapiens
agatttttatttatgagt

SEQ ID NO: 5183239 - DNA, 14 bp, Homo sapiens
agatttttcaaaat

SEQ ID NO: 5183240 - DNA, 17 bp, Homo sapiens
agatttttcatgatttt

SEQ ID NO: 5183241 - DNA, 22 bp, Homo sapiens
agatttttctcaaagttttgaa

SEQ ID NO: 5183242 - DNA, 17 bp, Homo sapiens
agatttttctcatctcc

SEQ ID NO: 5183243 - DNA, 22 bp, Homo sapiens
agatttttcttttaagccctgc

SEQ ID NO: 5183244 - DNA, 15 bp, Homo sapiens
agatttttgatatct

SEQ ID NO: 5183245 - DNA, 19 bp, Homo sapiens
agatttttgatatctcaat

SEQ ID NO: 5183246 - DNA, 20 bp, Homo sapiens
agatttttgtaaaaagctac

SEQ ID NO: 5183247 - DNA, 22 bp, Homo sapiens
agatttttgttaagctcaggat

SEQ ID NO: 5183248 - DNA, 14 bp, Homo sapiens
agattttttaaaaa

SEQ ID NO: 5183249 - DNA, 22 bp, Homo sapiens
agattttttattgctagtattt

SEQ ID NO: 5183250 - DNA, 20 bp, Homo sapiens
agattttttctttaaataaa

SEQ ID NO: 5183251 - DNA, 13 bp, Homo sapiens
agatttttttcct

SEQ ID NO: 5183252 - DNA, 15 bp, Homo sapiens
agatttttttcctga

SEQ ID NO: 5183253 - DNA, 14 bp, Homo sapiens
agatttttttgtgt

SEQ ID NO: 5183254 - DNA, 19 bp, Homo sapiens
agatttttttgtgtatgtt

SEQ ID NO: 5183255 - DNA, 16 bp, Homo sapiens
agatttttttgttgtt

SEQ ID NO: 5183256 - DNA, 13 bp, Homo sapiens
agattttttttaa

SEQ ID NO: 5183257 - DNA, 14 bp, Homo sapiens
agattttttttccg

SEQ ID NO: 5183258 - DNA, 19 bp, Homo sapiens
agattttttttgtaacttc

SEQ ID NO: 5183259 - DNA, 23 bp, Homo sapiens
agatttttttttccacttttgtt

SEQ ID NO: 5183260 - DNA, 23 bp, Homo sapiens
agcaaaaaaagcaacttttccaa

SEQ ID NO: 5183261 - DNA, 12 bp, Homo sapiens
agcaaaaaagaa

SEQ ID NO: 5183262 - DNA, 14 bp, Homo sapiens
agcaaaaaagaaaa

SEQ ID NO: 5183263 - DNA, 15 bp, Homo sapiens
agcaaaaaaggaaaa

SEQ ID NO: 5183264 - DNA, 13 bp, Homo sapiens
agcaaaaaataaa

SEQ ID NO: 5183265 - DNA, 19 bp, Homo sapiens
agcaaaaacgaaagctggg

SEQ ID NO: 5183266 - DNA, 19 bp, Homo sapiens
agcaaaaagaacaaagctg

SEQ ID NO: 5183267 - DNA, 11 bp, Homo sapiens
agcaaaaagat

SEQ ID NO: 5183268 - DNA, 17 bp, Homo sapiens
agcaaaaagatgccttt

SEQ ID NO: 5183269 - DNA, 17 bp, Homo sapiens
agcaaaaagatgtatat

SEQ ID NO: 5183270 - DNA, 16 bp, Homo sapiens
agcaaaaatataaaat

SEQ ID NO: 5183271 - DNA, 18 bp, Homo sapiens
agcaaaaatattttatga

SEQ ID NO: 5183272 - DNA, 14 bp, Homo sapiens
agcaaaaatgacaa

SEQ ID NO: 5183273 - DNA, 11 bp, Homo sapiens
agcaaaaatgc

SEQ ID NO: 5183274 - DNA, 16 bp, Homo sapiens
agcaaaaatgctaata

SEQ ID NO: 5183275 - DNA, 17 bp, Homo sapiens
agcaaaaatgctaatat

SEQ ID NO: 5183276 - DNA, 16 bp, Homo sapiens
agcaaaaatgtaaaaa

SEQ ID NO: 5183277 - DNA, 12 bp, Homo sapiens
agcaaaacaaaa

SEQ ID NO: 5183278 - DNA, 18 bp, Homo sapiens
agcaaaacaaattcaaat

SEQ ID NO: 5183279 - DNA, 18 bp, Homo sapiens
agcaaaacatcacattcc

SEQ ID NO: 5183280 - DNA, 14 bp, Homo sapiens
agcaaaacattttg

SEQ ID NO: 5183281 - DNA, 17 bp, Homo sapiens
agcaaaaccattgcttc

SEQ ID NO: 5183282 - DNA, 12 bp, Homo sapiens
agcaaaactccg

SEQ ID NO: 5183283 - DNA, 12 bp, Homo sapiens
agcaaaactgca

SEQ ID NO: 5183284 - DNA, 13 bp, Homo sapiens
agcaaaactttta

SEQ ID NO: 5183285 - DNA, 20 bp, Homo sapiens
agcaaaagaaacaccagtgt

SEQ ID NO: 5183286 - DNA, 22 bp, Homo sapiens
agcaaaagaaacaccagtgtta

SEQ ID NO: 5183287 - DNA, 14 bp, Homo sapiens
agcaaaagaaacta

SEQ ID NO: 5183288 - DNA, 14 bp, Homo sapiens
agcaaaagaagaag

SEQ ID NO: 5183289 - DNA, 17 bp, Homo sapiens
agcaaaagaatggcaga

SEQ ID NO: 5183290 - DNA, 21 bp, Homo sapiens
agcaaaagaatggcagaaaag

SEQ ID NO: 5183291 - DNA, 17 bp, Homo sapiens
agcaaaagaccaaatct

SEQ ID NO: 5183292 - DNA, 14 bp, Homo sapiens
agcaaaagagaaat

SEQ ID NO: 5183293 - DNA, 17 bp, Homo sapiens
agcaaaaggcagctcac

SEQ ID NO: 5183294 - DNA, 18 bp, Homo sapiens
agcaaaaggctgagaagg

SEQ ID NO: 5183295 - DNA, 21 bp, Homo sapiens
agcaaaagggtgtctgagccc

SEQ ID NO: 5183296 - DNA, 17 bp, Homo sapiens
agcaaaataaggaagag

SEQ ID NO: 5183297 - DNA, 18 bp, Homo sapiens
agcaaaatatgccccttc

SEQ ID NO: 5183298 - DNA, 24 bp, Homo sapiens
agcaaaatatgccccttcttgggc

SEQ ID NO: 5183299 - DNA, 21 bp, Homo sapiens
agcaaaatatttgtgaaagtg

SEQ ID NO: 5183300 - DNA, 15 bp, Homo sapiens
agcaaaatcaagaga

SEQ ID NO: 5183301 - DNA, 15 bp, Homo sapiens
agcaaaatcagaagt

SEQ ID NO: 5183302 - DNA, 15 bp, Homo sapiens
agcaaaatcatttta

SEQ ID NO: 5183303 - DNA, 18 bp, Homo sapiens
agcaaaatccaaactgct

SEQ ID NO: 5183304 - DNA, 23 bp, Homo sapiens
agcaaaatccaaactgctgtctc

SEQ ID NO: 5183305 - DNA, 15 bp, Homo sapiens
agcaaaatgcatgta

SEQ ID NO: 5183306 - DNA, 17 bp, Homo sapiens
agcaaaatggaagcaaa

SEQ ID NO: 5183307 - DNA, 21 bp, Homo sapiens
agcaaaatggaagcaaagaca

SEQ ID NO: 5183308 - DNA, 13 bp, Homo sapiens
agcaaaatgttga

SEQ ID NO: 5183309 - DNA, 19 bp, Homo sapiens
agcaaaattgatgtgttta

SEQ ID NO: 5183310 - DNA, 23 bp, Homo sapiens
agcaaaattgatgtgtttattta

SEQ ID NO: 5183311 - DNA, 15 bp, Homo sapiens
agcaaaatttctgta

SEQ ID NO: 5183312 - DNA, 15 bp, Homo sapiens
agcaaacaaaaatag

SEQ ID NO: 5183313 - DNA, 14 bp, Homo sapiens
agcaaacaaaattg

SEQ ID NO: 5183314 - DNA, 14 bp, Homo sapiens
agcaaacacaataa

SEQ ID NO: 5183315 - DNA, 16 bp, Homo sapiens
agcaaacacaataaga

SEQ ID NO: 5183316 - DNA, 18 bp, Homo sapiens
agcaaacaccagtgaggc

SEQ ID NO: 5183317 - DNA, 13 bp, Homo sapiens
agcaaacagaaaa

SEQ ID NO: 5183318 - DNA, 23 bp, Homo sapiens
agcaaacagggtggcccaggtgg

SEQ ID NO: 5183319 - DNA, 11 bp, Homo sapiens
agcaaaccaat

SEQ ID NO: 5183320 - DNA, 20 bp, Homo sapiens
agcaaaccaatggtgatcct

SEQ ID NO: 5183321 - DNA, 16 bp, Homo sapiens
agcaaacccaaagatg

SEQ ID NO: 5183322 - DNA, 17 bp, Homo sapiens
agcaaaccctgtcaaac

SEQ ID NO: 5183323 - DNA, 18 bp, Homo sapiens
agcaaaccgccctgcagc

SEQ ID NO: 5183324 - DNA, 17 bp, Homo sapiens
agcaaacctagccccca

SEQ ID NO: 5183325 - DNA, 14 bp, Homo sapiens
agcaaacctgcccc

SEQ ID NO: 5183326 - DNA, 13 bp, Homo sapiens
agcaaaccttctc

SEQ ID NO: 5183327 - DNA, 16 bp, Homo sapiens
agcaaaccttctcagg

SEQ ID NO: 5183328 - DNA, 22 bp, Homo sapiens
agcaaacgtacgggaatgtgct

SEQ ID NO: 5183329 - DNA, 23 bp, Homo sapiens
agcaaacgtacgggaatgtgctt

SEQ ID NO: 5183330 - DNA, 16 bp, Homo sapiens
agcaaacgttgggcat

SEQ ID NO: 5183331 - DNA, 23 bp, Homo sapiens
agcaaactaaccagcattcccta

SEQ ID NO: 5183332 - DNA, 18 bp, Homo sapiens
agcaaactatgatttatt

SEQ ID NO: 5183333 - DNA, 14 bp, Homo sapiens
agcaaactctgctg

SEQ ID NO: 5183334 - DNA, 15 bp, Homo sapiens
agcaaactgaaatta

SEQ ID NO: 5183335 - DNA, 19 bp, Homo sapiens
agcaaactgaagcccacag

SEQ ID NO: 5183336 - DNA, 12 bp, Homo sapiens
agcaaactgatg

SEQ ID NO: 5183337 - DNA, 15 bp, Homo sapiens
agcaaactgcatgcc

SEQ ID NO: 5183338 - DNA, 19 bp, Homo sapiens
agcaaactgcatgcccaga

SEQ ID NO: 5183339 - DNA, 22 bp, Homo sapiens
agcaaactgcatgcccagagac

SEQ ID NO: 5183340 - DNA, 15 bp, Homo sapiens
agcaaactttagtgt

SEQ ID NO: 5183341 - DNA, 12 bp, Homo sapiens
agcaaagaaact

SEQ ID NO: 5183342 - DNA, 13 bp, Homo sapiens
agcaaagaagctt

SEQ ID NO: 5183343 - DNA, 22 bp, Homo sapiens
agcaaagaaggccagcaacatt

SEQ ID NO: 5183344 - DNA, 12 bp, Homo sapiens
agcaaagacaaa

SEQ ID NO: 5183345 - DNA, 22 bp, Homo sapiens
agcaaagaggactcgcttgtaa

SEQ ID NO: 5183346 - DNA, 17 bp, Homo sapiens
agcaaagaggggcgctg

SEQ ID NO: 5183347 - DNA, 13 bp, Homo sapiens
agcaaagatcaaa

SEQ ID NO: 5183348 - DNA, 17 bp, Homo sapiens
agcaaagatcaaaataa

SEQ ID NO: 5183349 - DNA, 23 bp, Homo sapiens
agcaaagattaaatgtgtcattg

SEQ ID NO: 5183350 - DNA, 20 bp, Homo sapiens
agcaaagcaaaaggctgaga

SEQ ID NO: 5183351 - DNA, 22 bp, Homo sapiens
agcaaagcacccatttcaatgt

SEQ ID NO: 5183352 - DNA, 23 bp, Homo sapiens
agcaaagcatcggtcatgtgtgt

SEQ ID NO: 5183353 - DNA, 11 bp, Homo sapiens
agcaaagccat

SEQ ID NO: 5183354 - DNA, 19 bp, Homo sapiens
agcaaagccccatgctgga

SEQ ID NO: 5183355 - DNA, 22 bp, Homo sapiens
agcaaagcccccagagcccagg

SEQ ID NO: 5183356 - DNA, 15 bp, Homo sapiens
agcaaagcctccagc

SEQ ID NO: 5183357 - DNA, 20 bp, Homo sapiens
agcaaagcgggttataatga

SEQ ID NO: 5183358 - DNA, 15 bp, Homo sapiens
agcaaagctacagga

SEQ ID NO: 5183359 - DNA, 18 bp, Homo sapiens
agcaaagctacaggactg

SEQ ID NO: 5183360 - DNA, 18 bp, Homo sapiens
agcaaagcttaaatgcct

SEQ ID NO: 5183361 - DNA, 15 bp, Homo sapiens
agcaaaggaaaccaa

SEQ ID NO: 5183362 - DNA, 17 bp, Homo sapiens
agcaaaggaaaccaaag

SEQ ID NO: 5183363 - DNA, 13 bp, Homo sapiens
agcaaaggagaaa

SEQ ID NO: 5183364 - DNA, 21 bp, Homo sapiens
agcaaaggagacaaagcagga

SEQ ID NO: 5183365 - DNA, 23 bp, Homo sapiens
agcaaaggagacaaagcaggagt

SEQ ID NO: 5183366 - DNA, 20 bp, Homo sapiens
agcaaaggagattggaagga

SEQ ID NO: 5183367 - DNA, 11 bp, Homo sapiens
agcaaaggcag

SEQ ID NO: 5183368 - DNA, 13 bp, Homo sapiens
agcaaaggccctg

SEQ ID NO: 5183369 - DNA, 14 bp, Homo sapiens
agcaaaggccctgg

SEQ ID NO: 5183370 - DNA, 19 bp, Homo sapiens
agcaaaggctgagaacact

SEQ ID NO: 5183371 - DNA, 20 bp, Homo sapiens
agcaaagggaatgggtctgc

SEQ ID NO: 5183372 - DNA, 17 bp, Homo sapiens
agcaaaggggacagctg

SEQ ID NO: 5183373 - DNA, 18 bp, Homo sapiens
agcaaaggggggaggtca

SEQ ID NO: 5183374 - DNA, 19 bp, Homo sapiens
agcaaaggtgcactccaga

SEQ ID NO: 5183375 - DNA, 12 bp, Homo sapiens
agcaaagtaaca

SEQ ID NO: 5183376 - DNA, 16 bp, Homo sapiens
agcaaagtatcaaaga

SEQ ID NO: 5183377 - DNA, 20 bp, Homo sapiens
agcaaagtattgtgaaagta

SEQ ID NO: 5183378 - DNA, 22 bp, Homo sapiens
agcaaagtattgtgaaagtatt

SEQ ID NO: 5183379 - DNA, 15 bp, Homo sapiens
agcaaagtctaaagt

SEQ ID NO: 5183380 - DNA, 23 bp, Homo sapiens
agcaaagtctaaagtttacagta

SEQ ID NO: 5183381 - DNA, 24 bp, Homo sapiens
agagaggctgagaaatgcagagaa

SEQ ID NO: 5183382 - DNA, 13 bp, Homo sapiens
agagaggctgcct

SEQ ID NO: 5183383 - DNA, 13 bp, Homo sapiens
agagaggctggat

SEQ ID NO: 5183384 - DNA, 21 bp, Homo sapiens
agagaggctggatgacttgct

SEQ ID NO: 5183385 - DNA, 13 bp, Homo sapiens
agagaggctggca

SEQ ID NO: 5183386 - DNA, 20 bp, Homo sapiens
agagaggcttgaaggccagc

SEQ ID NO: 5183387 - DNA, 16 bp, Homo sapiens
agagagggacaggcac

SEQ ID NO: 5183388 - DNA, 16 bp, Homo sapiens
agagagggactcaagg

SEQ ID NO: 5183389 - DNA, 18 bp, Homo sapiens
agagagggaggcaagccc

SEQ ID NO: 5183390 - DNA, 17 bp, Homo sapiens
agagagggcacatctcc

SEQ ID NO: 5183391 - DNA, 15 bp, Homo sapiens
agagagggcagaggg

SEQ ID NO: 5183392 - DNA, 14 bp, Homo sapiens
agagagggcaggca

SEQ ID NO: 5183393 - DNA, 20 bp, Homo sapiens
agagagggccatgcaattca

SEQ ID NO: 5183394 - DNA, 14 bp, Homo sapiens
agagagggcccagc

SEQ ID NO: 5183395 - DNA, 12 bp, Homo sapiens
agagagggcgcc

SEQ ID NO: 5183396 - DNA, 19 bp, Homo sapiens
agagagggcgcccagccca

SEQ ID NO: 5183397 - DNA, 22 bp, Homo sapiens
agagagggcgcccagcccaggc

SEQ ID NO: 5183398 - DNA, 14 bp, Homo sapiens
agagaggggaagag

SEQ ID NO: 5183399 - DNA, 14 bp, Homo sapiens
agagaggggcctct

SEQ ID NO: 5183400 - DNA, 24 bp, Homo sapiens
agagaggggcctctggctgcctgg

SEQ ID NO: 5183401 - DNA, 14 bp, Homo sapiens
agagaggggcctgc

SEQ ID NO: 5183402 - DNA, 21 bp, Homo sapiens
agagaggggcctgcaggtgag

SEQ ID NO: 5183403 - DNA, 18 bp, Homo sapiens
agagagggggagacccct

SEQ ID NO: 5183404 - DNA, 12 bp, Homo sapiens
agagagggggca

SEQ ID NO: 5183405 - DNA, 23 bp, Homo sapiens
agagagggggcactgtggtcagg

SEQ ID NO: 5183406 - DNA, 14 bp, Homo sapiens
agagagggggccac

SEQ ID NO: 5183407 - DNA, 19 bp, Homo sapiens
agagaggggtacatttccc

SEQ ID NO: 5183408 - DNA, 22 bp, Homo sapiens
agagagggtgagtcctccagaa

SEQ ID NO: 5183409 - DNA, 14 bp, Homo sapiens
agagaggtaaaggg

SEQ ID NO: 5183410 - DNA, 19 bp, Homo sapiens
agagaggtagcgagctgct

SEQ ID NO: 5183411 - DNA, 21 bp, Homo sapiens
agagaggtggggatcctgcct

SEQ ID NO: 5183412 - DNA, 16 bp, Homo sapiens
agagaggttctgggga

SEQ ID NO: 5183413 - DNA, 22 bp, Homo sapiens
agagagtaatgggtttcatatt

SEQ ID NO: 5183414 - DNA, 16 bp, Homo sapiens
agagagtacactgtgt

SEQ ID NO: 5183415 - DNA, 16 bp, Homo sapiens
agagagtacagactgc

SEQ ID NO: 5183416 - DNA, 18 bp, Homo sapiens
agagagtagctcgtcctc

SEQ ID NO: 5183417 - DNA, 15 bp, Homo sapiens
agagagtataaataa

SEQ ID NO: 5183418 - DNA, 16 bp, Homo sapiens
agagagtattaaatat

SEQ ID NO: 5183419 - DNA, 17 bp, Homo sapiens
agagagtcaatgtcatt

SEQ ID NO: 5183420 - DNA, 23 bp, Homo sapiens
agagagtcccactgcctcaggtt

SEQ ID NO: 5183421 - DNA, 16 bp, Homo sapiens
agagagtcctctggat

SEQ ID NO: 5183422 - DNA, 19 bp, Homo sapiens
agagagtctccaagagaac

SEQ ID NO: 5183423 - DNA, 14 bp, Homo sapiens
agagagtcttttaa

SEQ ID NO: 5183424 - DNA, 18 bp, Homo sapiens
agagagtcttttaacttt

SEQ ID NO: 5183425 - DNA, 20 bp, Homo sapiens
agagagtgaatacactggaa

SEQ ID NO: 5183426 - DNA, 16 bp, Homo sapiens
agagagtgagagagag

SEQ ID NO: 5183427 - DNA, 21 bp, Homo sapiens
agagagtgagagcacaaagat

SEQ ID NO: 5183428 - DNA, 22 bp, Homo sapiens
agagagtggaaattacccactg

SEQ ID NO: 5183429 - DNA, 16 bp, Homo sapiens
agagagtggagagagc

SEQ ID NO: 5183430 - DNA, 19 bp, Homo sapiens
agagagtggagagagcagg

SEQ ID NO: 5183431 - DNA, 22 bp, Homo sapiens
agagagtggagagagcagggct

SEQ ID NO: 5183432 - DNA, 14 bp, Homo sapiens
agagagtggctcct

SEQ ID NO: 5183433 - DNA, 17 bp, Homo sapiens
agagagtggctcctccc

SEQ ID NO: 5183434 - DNA, 17 bp, Homo sapiens
agagagtggctggggca

SEQ ID NO: 5183435 - DNA, 19 bp, Homo sapiens
agagagtggggcctgccct

SEQ ID NO: 5183436 - DNA, 15 bp, Homo sapiens
agagagtgtacatca

SEQ ID NO: 5183437 - DNA, 17 bp, Homo sapiens
agagagtgtgtgtttgt

SEQ ID NO: 5183438 - DNA, 14 bp, Homo sapiens
agagagttaatcaa

SEQ ID NO: 5183439 - DNA, 15 bp, Homo sapiens
agagagttaatcaac

SEQ ID NO: 5183440 - DNA, 15 bp, Homo sapiens
agagagttagcatgt

SEQ ID NO: 5183441 - DNA, 20 bp, Homo sapiens
agagagttagcatgtatgaa

SEQ ID NO: 5183442 - DNA, 19 bp, Homo sapiens
agagagttctggatgtctg

SEQ ID NO: 5183443 - DNA, 22 bp, Homo sapiens
agagagttctggatgtctggct

SEQ ID NO: 5183444 - DNA, 20 bp, Homo sapiens
agagagttgacccctcctga

SEQ ID NO: 5183445 - DNA, 24 bp, Homo sapiens
agagagttgtctgtccaggccctt

SEQ ID NO: 5183446 - DNA, 17 bp, Homo sapiens
agagagtttatcattgg

SEQ ID NO: 5183447 - DNA, 21 bp, Homo sapiens
agagataaagcttaggtcaaa

SEQ ID NO: 5183448 - DNA, 15 bp, Homo sapiens
agagataaatattta

SEQ ID NO: 5183449 - DNA, 19 bp, Homo sapiens
agagataatgaggcaactc

SEQ ID NO: 5183450 - DNA, 14 bp, Homo sapiens
agagataattctta

SEQ ID NO: 5183451 - DNA, 13 bp, Homo sapiens
agagataattgct

SEQ ID NO: 5183452 - DNA, 19 bp, Homo sapiens
agagatacttacatttcca

SEQ ID NO: 5183453 - DNA, 20 bp, Homo sapiens
agagatacttacatttccat

SEQ ID NO: 5183454 - DNA, 20 bp, Homo sapiens
agagatagccgggctccagg

SEQ ID NO: 5183455 - DNA, 15 bp, Homo sapiens
agagatagcctgtgg

SEQ ID NO: 5183456 - DNA, 17 bp, Homo sapiens
agagatagcttctcttc

SEQ ID NO: 5183457 - DNA, 21 bp, Homo sapiens
agagatagcttctcttctttc

SEQ ID NO: 5183458 - DNA, 16 bp, Homo sapiens
agagataggaaactga

SEQ ID NO: 5183459 - DNA, 21 bp, Homo sapiens
agagataggaaactgaagcat

SEQ ID NO: 5183460 - DNA, 20 bp, Homo sapiens
agagataggaaggtcatttc

SEQ ID NO: 5183461 - DNA, 23 bp, Homo sapiens
agagataggaaggtcatttccat

SEQ ID NO: 5183462 - DNA, 15 bp, Homo sapiens
agagatagttctaaa

SEQ ID NO: 5183463 - DNA, 12 bp, Homo sapiens
agagatataata

SEQ ID NO: 5183464 - DNA, 14 bp, Homo sapiens
agagatatatctga

SEQ ID NO: 5183465 - DNA, 13 bp, Homo sapiens
agagatatgcaca

SEQ ID NO: 5183466 - DNA, 14 bp, Homo sapiens
agagatatgcacac

SEQ ID NO: 5183467 - DNA, 17 bp, Homo sapiens
agagatatggcagcgaa

SEQ ID NO: 5183468 - DNA, 16 bp, Homo sapiens
agagatattgatattg

SEQ ID NO: 5183469 - DNA, 18 bp, Homo sapiens
agagatattgatattgaa

SEQ ID NO: 5183470 - DNA, 23 bp, Homo sapiens
agagatatttaaaagacaaacac

SEQ ID NO: 5183471 - DNA, 15 bp, Homo sapiens
agagatatttatgta

SEQ ID NO: 5183472 - DNA, 16 bp, Homo sapiens
agagatatttcaagct

SEQ ID NO: 5183473 - DNA, 15 bp, Homo sapiens
agagatattttgggc

SEQ ID NO: 5183474 - DNA, 20 bp, Homo sapiens
agagatattttgggcatgtg

SEQ ID NO: 5183475 - DNA, 13 bp, Homo sapiens
agagatattttgt

SEQ ID NO: 5183476 - DNA, 15 bp, Homo sapiens
agagatcaaagatga

SEQ ID NO: 5183477 - DNA, 15 bp, Homo sapiens
agagatcaaatggaa

SEQ ID NO: 5183478 - DNA, 14 bp, Homo sapiens
agagatcaggaaga

SEQ ID NO: 5183479 - DNA, 15 bp, Homo sapiens
agagatcaggaagag

SEQ ID NO: 5183480 - DNA, 20 bp, Homo sapiens
agagatcaggaagagaagga

SEQ ID NO: 5183481 - DNA, 21 bp, Homo sapiens
agagatcatcctttccagcat

SEQ ID NO: 5183482 - DNA, 16 bp, Homo sapiens
agagatcatgagaaat

SEQ ID NO: 5183483 - DNA, 13 bp, Homo sapiens
agagatccaaaga

SEQ ID NO: 5183484 - DNA, 19 bp, Homo sapiens
agagatcccaggaggtgca

SEQ ID NO: 5183485 - DNA, 22 bp, Homo sapiens
agagatcccaggaggtgcagtg

SEQ ID NO: 5183486 - DNA, 20 bp, Homo sapiens
agagatcctacttctctgag

SEQ ID NO: 5183487 - DNA, 16 bp, Homo sapiens
agagatcgacagacag

SEQ ID NO: 5183488 - DNA, 16 bp, Homo sapiens
agagatcgagaccatc

SEQ ID NO: 5183489 - DNA, 17 bp, Homo sapiens
agagatctagaaagtgg

SEQ ID NO: 5183490 - DNA, 17 bp, Homo sapiens
agagatctatgggcatt

SEQ ID NO: 5183491 - DNA, 18 bp, Homo sapiens
agagatctatgggcattt

SEQ ID NO: 5183492 - DNA, 16 bp, Homo sapiens
agagatctccaactct

SEQ ID NO: 5183493 - DNA, 15 bp, Homo sapiens
agagatctcccttct

SEQ ID NO: 5183494 - DNA, 13 bp, Homo sapiens
agagatctgggca

SEQ ID NO: 5183495 - DNA, 15 bp, Homo sapiens
agagatctgggcatt

SEQ ID NO: 5183496 - DNA, 13 bp, Homo sapiens
agagatctgtgtg

SEQ ID NO: 5183497 - DNA, 22 bp, Homo sapiens
agagatcttcccataataaagc

SEQ ID NO: 5183498 - DNA, 15 bp, Homo sapiens
agagatgacccctac

SEQ ID NO: 5183499 - DNA, 18 bp, Homo sapiens
agagatgacccctacccc

SEQ ID NO: 5183500 - DNA, 14 bp, Homo sapiens
agagatgactgaaa

SEQ ID NO: 5183501 - DNA, 14 bp, Homo sapiens
agagatgagcagtg

SEQ ID NO: 5183502 - DNA, 15 bp, Homo sapiens
agagatgattcagag

SEQ ID NO: 5183503 - DNA, 13 bp, Homo sapiens
agagatgcagaaa

SEQ ID NO: 5183504 - DNA, 16 bp, Homo sapiens
agagatgcagaaatat

SEQ ID NO: 5183505 - DNA, 15 bp, Homo sapiens
agagatgccagccct

SEQ ID NO: 5183506 - DNA, 14 bp, Homo sapiens
agagatgcctccac

SEQ ID NO: 5183507 - DNA, 16 bp, Homo sapiens
agagatgcctccaccg

SEQ ID NO: 5183508 - DNA, 23 bp, Homo sapiens
agagatgcctccaccgctgccta

SEQ ID NO: 5183509 - DNA, 14 bp, Homo sapiens
agagatgcctccct

SEQ ID NO: 5183510 - DNA, 18 bp, Homo sapiens
agagatgcctccctgagc

SEQ ID NO: 5183511 - DNA, 21 bp, Homo sapiens
agagatgctgtaacttaaaat

SEQ ID NO: 5183512 - DNA, 12 bp, Homo sapiens
agagatggagga

SEQ ID NO: 5183513 - DNA, 13 bp, Homo sapiens
agagatggaggag

SEQ ID NO: 5183514 - DNA, 14 bp, Homo sapiens
agagatggcagagc

SEQ ID NO: 5183515 - DNA, 15 bp, Homo sapiens
agagatggcagagcc

SEQ ID NO: 5183516 - DNA, 12 bp, Homo sapiens
agagatggctcc

SEQ ID NO: 5183517 - DNA, 23 bp, Homo sapiens
agagatggcttacaaaaagaaat

SEQ ID NO: 5183518 - DNA, 16 bp, Homo sapiens
agagatgggaaaacca

SEQ ID NO: 5183519 - DNA, 19 bp, Homo sapiens
agagatgggaatgaggtgg

SEQ ID NO: 5183520 - DNA, 22 bp, Homo sapiens
agagatgggactgggagggccc

SEQ ID NO: 5183521 - DNA, 15 bp, Homo sapiens
agagatgggagctcc

SEQ ID NO: 5183522 - DNA, 12 bp, Homo sapiens
agagatgtagca

SEQ ID NO: 5183523 - DNA, 17 bp, Homo sapiens
agagatgtagcagaata

SEQ ID NO: 5183524 - DNA, 16 bp, Homo sapiens
agagatgtcaaaatgt

SEQ ID NO: 5183525 - DNA, 19 bp, Homo sapiens
agagatgtctgttctaagt

SEQ ID NO: 5183526 - DNA, 17 bp, Homo sapiens
agagatgtgcccccacc

SEQ ID NO: 5183527 - DNA, 18 bp, Homo sapiens
agagatgtgcctgtggga

SEQ ID NO: 5183528 - DNA, 14 bp, Homo sapiens
agagatgtgtaatt

SEQ ID NO: 5183529 - DNA, 19 bp, Homo sapiens
agagatgtgtaatttttct

SEQ ID NO: 5183530 - DNA, 15 bp, Homo sapiens
agagatgtgtgttga

SEQ ID NO: 5183531 - DNA, 18 bp, Homo sapiens
agagatgtgtgttgatac

SEQ ID NO: 5183532 - DNA, 21 bp, Homo sapiens
agagatgtgtgttgatactgt

SEQ ID NO: 5183533 - DNA, 23 bp, Homo sapiens
agagatgtttacagtatgatgaa

SEQ ID NO: 5183534 - DNA, 22 bp, Homo sapiens
agagatgtttttaaaagtttca

SEQ ID NO: 5183535 - DNA, 14 bp, Homo sapiens
agagattaaaggta

SEQ ID NO: 5183536 - DNA, 15 bp, Homo sapiens
agagattaactggga

SEQ ID NO: 5183537 - DNA, 13 bp, Homo sapiens
agagattaatttg

SEQ ID NO: 5183538 - DNA, 14 bp, Homo sapiens
agagattaatttgt

SEQ ID NO: 5183539 - DNA, 19 bp, Homo sapiens
agagattaatttgtgtaga

SEQ ID NO: 5183540 - DNA, 19 bp, Homo sapiens
agagattacctcctgagaa

SEQ ID NO: 5183541 - DNA, 21 bp, Homo sapiens
agagattagtaaatatgtgaa

SEQ ID NO: 5183542 - DNA, 13 bp, Homo sapiens
agagattcactca

SEQ ID NO: 5183543 - DNA, 18 bp, Homo sapiens
agagattcattttctaga

SEQ ID NO: 5183544 - DNA, 15 bp, Homo sapiens
agagattcccctgga

SEQ ID NO: 5183545 - DNA, 17 bp, Homo sapiens
agagattcccctggacc

SEQ ID NO: 5183546 - DNA, 18 bp, Homo sapiens
agagattcccctggacca

SEQ ID NO: 5183547 - DNA, 23 bp, Homo sapiens
agagattcccctggaccacacct

SEQ ID NO: 5183548 - DNA, 13 bp, Homo sapiens
agagattcttcta

SEQ ID NO: 5183549 - DNA, 20 bp, Homo sapiens
agagattggaatgggcagct

SEQ ID NO: 5183550 - DNA, 17 bp, Homo sapiens
agagattggatcaagta

SEQ ID NO: 5183551 - DNA, 19 bp, Homo sapiens
agagattggcacttccctg

SEQ ID NO: 5183552 - DNA, 13 bp, Homo sapiens
agagattgggggg

SEQ ID NO: 5183553 - DNA, 16 bp, Homo sapiens
agagattgtggtttca

SEQ ID NO: 5183554 - DNA, 17 bp, Homo sapiens
agagattgtttttagag

SEQ ID NO: 5183555 - DNA, 23 bp, Homo sapiens
agagatttatataaatgtaaaaa

SEQ ID NO: 5183556 - DNA, 13 bp, Homo sapiens
agagatttatctt

SEQ ID NO: 5183557 - DNA, 18 bp, Homo sapiens
agagatttcaacaagaat

SEQ ID NO: 5183558 - DNA, 12 bp, Homo sapiens
agagatttctca

SEQ ID NO: 5183559 - DNA, 14 bp, Homo sapiens
agagatttggggct

SEQ ID NO: 5183560 - DNA, 13 bp, Homo sapiens
agagattttacaa

SEQ ID NO: 5183561 - DNA, 16 bp, Homo sapiens
agcaaagtgtcagtgt

SEQ ID NO: 5183562 - DNA, 18 bp, Homo sapiens
agcaaagtgtcagtgttg

SEQ ID NO: 5183563 - DNA, 18 bp, Homo sapiens
agcaaagttatcttaaat

SEQ ID NO: 5183564 - DNA, 23 bp, Homo sapiens
agcaaagttatcttaaatatgaa

SEQ ID NO: 5183565 - DNA, 23 bp, Homo sapiens
agcaaagttcaacttatttcata

SEQ ID NO: 5183566 - DNA, 14 bp, Homo sapiens
agcaaataaagcag

SEQ ID NO: 5183567 - DNA, 15 bp, Homo sapiens
agcaaataaatacgt

SEQ ID NO: 5183568 - DNA, 22 bp, Homo sapiens
agcaaataagctctattatatt

SEQ ID NO: 5183569 - DNA, 22 bp, Homo sapiens
agcaaatacaattcacagcaca

SEQ ID NO: 5183570 - DNA, 15 bp, Homo sapiens
agcaaataccaaagc

SEQ ID NO: 5183571 - DNA, 16 bp, Homo sapiens
agcaaataccaaagca

SEQ ID NO: 5183572 - DNA, 19 bp, Homo sapiens
agcaaatactgattttcaa

SEQ ID NO: 5183573 - DNA, 22 bp, Homo sapiens
agcaaatactgattttcaaaaa

SEQ ID NO: 5183574 - DNA, 14 bp, Homo sapiens
agcaaatacttagc

SEQ ID NO: 5183575 - DNA, 15 bp, Homo sapiens
agcaaatacttagca

SEQ ID NO: 5183576 - DNA, 14 bp, Homo sapiens
agcaaatatatgat

SEQ ID NO: 5183577 - DNA, 14 bp, Homo sapiens
agcaaatatgctgt

SEQ ID NO: 5183578 - DNA, 23 bp, Homo sapiens
agcaaatcaccacaaactgtaat

SEQ ID NO: 5183579 - DNA, 17 bp, Homo sapiens
agcaaatcagaaaaccc

SEQ ID NO: 5183580 - DNA, 13 bp, Homo sapiens
agcaaatcagttt

SEQ ID NO: 5183581 - DNA, 20 bp, Homo sapiens
agcaaatcatctgcattcct

SEQ ID NO: 5183582 - DNA, 14 bp, Homo sapiens
agcaaatcccattt

SEQ ID NO: 5183583 - DNA, 16 bp, Homo sapiens
agcaaatcccatttct

SEQ ID NO: 5183584 - DNA, 17 bp, Homo sapiens
agcaaatcccatttctt

SEQ ID NO: 5183585 - DNA, 17 bp, Homo sapiens
agcaaatcgaatgaaat

SEQ ID NO: 5183586 - DNA, 15 bp, Homo sapiens
agcaaatcgtacatt

SEQ ID NO: 5183587 - DNA, 22 bp, Homo sapiens
agcaaatctttctgtaaacaga

SEQ ID NO: 5183588 - DNA, 17 bp, Homo sapiens
agcaaatgaaaaagtca

SEQ ID NO: 5183589 - DNA, 16 bp, Homo sapiens
agcaaatgacagattt

SEQ ID NO: 5183590 - DNA, 21 bp, Homo sapiens
agcaaatgagatgtatgccca

SEQ ID NO: 5183591 - DNA, 14 bp, Homo sapiens
agcaaatgcaaaaa

SEQ ID NO: 5183592 - DNA, 21 bp, Homo sapiens
agcaaatgcattctatcgtta

SEQ ID NO: 5183593 - DNA, 20 bp, Homo sapiens
agcaaatgccactctgggca

SEQ ID NO: 5183594 - DNA, 18 bp, Homo sapiens
agcaaatgcctgccaaat

SEQ ID NO: 5183595 - DNA, 17 bp, Homo sapiens
agcaaatgccttttcaa

SEQ ID NO: 5183596 - DNA, 22 bp, Homo sapiens
agcaaatgctggatgagcaact

SEQ ID NO: 5183597 - DNA, 18 bp, Homo sapiens
agcaaatgcttaaaacaa

SEQ ID NO: 5183598 - DNA, 15 bp, Homo sapiens
agcaaatggcctcat

SEQ ID NO: 5183599 - DNA, 20 bp, Homo sapiens
agcaaatggcctcatgtcaa

SEQ ID NO: 5183600 - DNA, 21 bp, Homo sapiens
agcaaatgtcatgctgcctta

SEQ ID NO: 5183601 - DNA, 17 bp, Homo sapiens
agcaaatgtcttcctgg

SEQ ID NO: 5183602 - DNA, 13 bp, Homo sapiens
agcaaatgttaca

SEQ ID NO: 5183603 - DNA, 17 bp, Homo sapiens
agcaaatgtttctgcag

SEQ ID NO: 5183604 - DNA, 18 bp, Homo sapiens
agcaaatgtttctgcagt

SEQ ID NO: 5183605 - DNA, 15 bp, Homo sapiens
agcaaattaattggc

SEQ ID NO: 5183606 - DNA, 22 bp, Homo sapiens
agcaaattaattggcagcagat

SEQ ID NO: 5183607 - DNA, 14 bp, Homo sapiens
agcaaattagtaat

SEQ ID NO: 5183608 - DNA, 13 bp, Homo sapiens
agcaaattccaga

SEQ ID NO: 5183609 - DNA, 16 bp, Homo sapiens
agcaaattccagattt

SEQ ID NO: 5183610 - DNA, 17 bp, Homo sapiens
agcaaattccagatttg

SEQ ID NO: 5183611 - DNA, 18 bp, Homo sapiens
agcaaattcttgaataaa

SEQ ID NO: 5183612 - DNA, 14 bp, Homo sapiens
agcaaattgtttca

SEQ ID NO: 5183613 - DNA, 16 bp, Homo sapiens
agcaaatttataattt

SEQ ID NO: 5183614 - DNA, 18 bp, Homo sapiens
agcaaatttataatttta

SEQ ID NO: 5183615 - DNA, 18 bp, Homo sapiens
agcaaatttcaaaagaca

SEQ ID NO: 5183616 - DNA, 19 bp, Homo sapiens
agcaaatttcaaaagacat

SEQ ID NO: 5183617 - DNA, 12 bp, Homo sapiens
agcaaatttcat

SEQ ID NO: 5183618 - DNA, 15 bp, Homo sapiens
agcaaatttctatca

SEQ ID NO: 5183619 - DNA, 16 bp, Homo sapiens
agcaacaaaactatgg

SEQ ID NO: 5183620 - DNA, 18 bp, Homo sapiens
agcaacaaaactatggaa

SEQ ID NO: 5183621 - DNA, 22 bp, Homo sapiens
agcaacaaagattgagaagcca

SEQ ID NO: 5183622 - DNA, 19 bp, Homo sapiens
agcaacaacagaagggaaa

SEQ ID NO: 5183623 - DNA, 12 bp, Homo sapiens
agcaacaactta

SEQ ID NO: 5183624 - DNA, 13 bp, Homo sapiens
agcaacaacttac

SEQ ID NO: 5183625 - DNA, 17 bp, Homo sapiens
agcaacaagactgccag

SEQ ID NO: 5183626 - DNA, 15 bp, Homo sapiens
agcaacaagctattt

SEQ ID NO: 5183627 - DNA, 12 bp, Homo sapiens
agcaacaataaa

SEQ ID NO: 5183628 - DNA, 17 bp, Homo sapiens
agcaacacaagctggaa

SEQ ID NO: 5183629 - DNA, 18 bp, Homo sapiens
agcaacacaagctggaag

SEQ ID NO: 5183630 - DNA, 11 bp, Homo sapiens
agcaacacaga

SEQ ID NO: 5183631 - DNA, 18 bp, Homo sapiens
agcaacacagcctgggcc

SEQ ID NO: 5183632 - DNA, 21 bp, Homo sapiens
agcaacacagcctgggcccca

SEQ ID NO: 5183633 - DNA, 15 bp, Homo sapiens
agcaacacctgccgt

SEQ ID NO: 5183634 - DNA, 11 bp, Homo sapiens
agcaacacttg

SEQ ID NO: 5183635 - DNA, 15 bp, Homo sapiens
agcaacagactctca

SEQ ID NO: 5183636 - DNA, 15 bp, Homo sapiens
agcaacagataaagt

SEQ ID NO: 5183637 - DNA, 17 bp, Homo sapiens
agcaacagcctttgaat

SEQ ID NO: 5183638 - DNA, 23 bp, Homo sapiens
agcaacagcctttgaatgtaacc

SEQ ID NO: 5183639 - DNA, 17 bp, Homo sapiens
agcaacagcttcagaaa

SEQ ID NO: 5183640 - DNA, 18 bp, Homo sapiens
agcaacaggaatctcaga

SEQ ID NO: 5183641 - DNA, 19 bp, Homo sapiens
agcaacaggaatctcagag

SEQ ID NO: 5183642 - DNA, 13 bp, Homo sapiens
agcaacaggacca

SEQ ID NO: 5183643 - DNA, 22 bp, Homo sapiens
agcaacaggaccaggagccagg

SEQ ID NO: 5183644 - DNA, 18 bp, Homo sapiens
agcaacatatctctgccg

SEQ ID NO: 5183645 - DNA, 15 bp, Homo sapiens
agcaacatcttttga

SEQ ID NO: 5183646 - DNA, 19 bp, Homo sapiens
agcaacatgaattaagaac

SEQ ID NO: 5183647 - DNA, 20 bp, Homo sapiens
agcaacatgcttcatgaaaa

SEQ ID NO: 5183648 - DNA, 15 bp, Homo sapiens
agcaacattcatagt

SEQ ID NO: 5183649 - DNA, 12 bp, Homo sapiens
agcaacatttta

SEQ ID NO: 5183650 - DNA, 19 bp, Homo sapiens
agcaacattttcttgaatt

SEQ ID NO: 5183651 - DNA, 13 bp, Homo sapiens
agcaaccacactg

SEQ ID NO: 5183652 - DNA, 14 bp, Homo sapiens
agcaaccacattta

SEQ ID NO: 5183653 - DNA, 16 bp, Homo sapiens
agcaaccacatttaga

SEQ ID NO: 5183654 - DNA, 17 bp, Homo sapiens
agcaaccagctggaagg

SEQ ID NO: 5183655 - DNA, 22 bp, Homo sapiens
agcaaccatatagaaagctttg

SEQ ID NO: 5183656 - DNA, 14 bp, Homo sapiens
agcaacccagaatg

SEQ ID NO: 5183657 - DNA, 22 bp, Homo sapiens
agcaacccaggtgttgtccgtg

SEQ ID NO: 5183658 - DNA, 20 bp, Homo sapiens
agcaacccctgtacccagct

SEQ ID NO: 5183659 - DNA, 22 bp, Homo sapiens
agcaacccctgtacccagctcc

SEQ ID NO: 5183660 - DNA, 17 bp, Homo sapiens
agcaacccgctggagcc

SEQ ID NO: 5183661 - DNA, 17 bp, Homo sapiens
agcaaccctacagtata

SEQ ID NO: 5183662 - DNA, 20 bp, Homo sapiens
agcaaccctacagtatataa

SEQ ID NO: 5183663 - DNA, 13 bp, Homo sapiens
agcaaccctctga

SEQ ID NO: 5183664 - DNA, 21 bp, Homo sapiens
agcaaccgcctcaaaatgtgt

SEQ ID NO: 5183665 - DNA, 20 bp, Homo sapiens
agcaaccgtggcccttcctg

SEQ ID NO: 5183666 - DNA, 23 bp, Homo sapiens
agcaaccgtggcccttcctggac

SEQ ID NO: 5183667 - DNA, 24 bp, Homo sapiens
agcaacctactgtctaagcagttt

SEQ ID NO: 5183668 - DNA, 13 bp, Homo sapiens
agcaacctatttg

SEQ ID NO: 5183669 - DNA, 13 bp, Homo sapiens
agcaacctgggca

SEQ ID NO: 5183670 - DNA, 19 bp, Homo sapiens
agcaacctgggtccaaata

SEQ ID NO: 5183671 - DNA, 21 bp, Homo sapiens
agcaacctgggtccaaataaa

SEQ ID NO: 5183672 - DNA, 15 bp, Homo sapiens
agcaaccttcatttt

SEQ ID NO: 5183673 - DNA, 18 bp, Homo sapiens
agcaacgatcacaaatga

SEQ ID NO: 5183674 - DNA, 20 bp, Homo sapiens
agcaacgatcacaaatgact

SEQ ID NO: 5183675 - DNA, 22 bp, Homo sapiens
agcaacgatcacaaatgacttt

SEQ ID NO: 5183676 - DNA, 14 bp, Homo sapiens
agcaacgcaggccc

SEQ ID NO: 5183677 - DNA, 21 bp, Homo sapiens
agcaacgcctgccttctgggc

SEQ ID NO: 5183678 - DNA, 20 bp, Homo sapiens
agcaacgctattccagctgt

SEQ ID NO: 5183679 - DNA, 14 bp, Homo sapiens
agcaacgcttgtag

SEQ ID NO: 5183680 - DNA, 13 bp, Homo sapiens
agcaacggcacag

SEQ ID NO: 5183681 - DNA, 21 bp, Homo sapiens
agcaacggcccatagccttgg

SEQ ID NO: 5183682 - DNA, 15 bp, Homo sapiens
agcaacgtgttaatt

SEQ ID NO: 5183683 - DNA, 19 bp, Homo sapiens
agcaacgttagtagaactt

SEQ ID NO: 5183684 - DNA, 16 bp, Homo sapiens
agcaactaatgtttga

SEQ ID NO: 5183685 - DNA, 17 bp, Homo sapiens
agcaactaattttctcc

SEQ ID NO: 5183686 - DNA, 11 bp, Homo sapiens
agcaactccca

SEQ ID NO: 5183687 - DNA, 15 bp, Homo sapiens
agcaactccgtgtgc

SEQ ID NO: 5183688 - DNA, 21 bp, Homo sapiens
agcaactctccactccatatt

SEQ ID NO: 5183689 - DNA, 19 bp, Homo sapiens
agcaactcttatttctttc

SEQ ID NO: 5183690 - DNA, 14 bp, Homo sapiens
agcaactcttgatt

SEQ ID NO: 5183691 - DNA, 16 bp, Homo sapiens
agcaactgaagacaat

SEQ ID NO: 5183692 - DNA, 16 bp, Homo sapiens
agcaactgaggtaacc

SEQ ID NO: 5183693 - DNA, 18 bp, Homo sapiens
agcaactgatcatatttg

SEQ ID NO: 5183694 - DNA, 16 bp, Homo sapiens
agcaactgcccttcca

SEQ ID NO: 5183695 - DNA, 17 bp, Homo sapiens
agcaactgcccttccag

SEQ ID NO: 5183696 - DNA, 13 bp, Homo sapiens
agcaactgctggt

SEQ ID NO: 5183697 - DNA, 19 bp, Homo sapiens
agcaactggaaaagtgttc

SEQ ID NO: 5183698 - DNA, 13 bp, Homo sapiens
agcaactgtctat

SEQ ID NO: 5183699 - DNA, 17 bp, Homo sapiens
agcaactgtctatttct

SEQ ID NO: 5183700 - DNA, 13 bp, Homo sapiens
agcaactgttatg

SEQ ID NO: 5183701 - DNA, 18 bp, Homo sapiens
agcaactgttatgaaata

SEQ ID NO: 5183702 - DNA, 20 bp, Homo sapiens
agcaacttgcccaattttaa

SEQ ID NO: 5183703 - DNA, 14 bp, Homo sapiens
agcaacttgcttct

SEQ ID NO: 5183704 - DNA, 15 bp, Homo sapiens
agcaacttgcttcta

SEQ ID NO: 5183705 - DNA, 16 bp, Homo sapiens
agcaacttgcttctaa

SEQ ID NO: 5183706 - DNA, 21 bp, Homo sapiens
agcaacttgtctttttctgga

SEQ ID NO: 5183707 - DNA, 15 bp, Homo sapiens
agcaactttcccttg

SEQ ID NO: 5183708 - DNA, 18 bp, Homo sapiens
agcaactttgatggaaga

SEQ ID NO: 5183709 - DNA, 16 bp, Homo sapiens
agcaagaaacagtttc

SEQ ID NO: 5183710 - DNA, 18 bp, Homo sapiens
agcaagaaataaatcaga

SEQ ID NO: 5183711 - DNA, 17 bp, Homo sapiens
agcaagaactgcacggt

SEQ ID NO: 5183712 - DNA, 15 bp, Homo sapiens
agcaagaagaaaatg

SEQ ID NO: 5183713 - DNA, 16 bp, Homo sapiens
agcaagaagaaaatgt

SEQ ID NO: 5183714 - DNA, 14 bp, Homo sapiens
agcaagaagaattg

SEQ ID NO: 5183715 - DNA, 16 bp, Homo sapiens
agcaagaaggaaagat

SEQ ID NO: 5183716 - DNA, 18 bp, Homo sapiens
agcaagaaggcaacttga

SEQ ID NO: 5183717 - DNA, 21 bp, Homo sapiens
agcaagaatgcagtacagaat

SEQ ID NO: 5183718 - DNA, 22 bp, Homo sapiens
agcaagaatgcagtacagaatt

SEQ ID NO: 5183719 - DNA, 22 bp, Homo sapiens
agcaagacacgtggcctcgtga

SEQ ID NO: 5183720 - DNA, 15 bp, Homo sapiens
agcaagacagagacg

SEQ ID NO: 5183721 - DNA, 12 bp, Homo sapiens
agcaagacagct

SEQ ID NO: 5183722 - DNA, 15 bp, Homo sapiens
agcaagacagctctt

SEQ ID NO: 5183723 - DNA, 19 bp, Homo sapiens
agcaagaccaaatcattgt

SEQ ID NO: 5183724 - DNA, 17 bp, Homo sapiens
agcaagaccccatctca

SEQ ID NO: 5183725 - DNA, 21 bp, Homo sapiens
agcaagaccctaaacatccat

SEQ ID NO: 5183726 - DNA, 22 bp, Homo sapiens
agcaagacctcatctgtggagc

SEQ ID NO: 5183727 - DNA, 18 bp, Homo sapiens
agcaagacctgttggtta

SEQ ID NO: 5183728 - DNA, 16 bp, Homo sapiens
agcaagacgctgtgct

SEQ ID NO: 5183729 - DNA, 17 bp, Homo sapiens
agcaagacgctgtgctg

SEQ ID NO: 5183730 - DNA, 19 bp, Homo sapiens
agcaagacgtaaagaattt

SEQ ID NO: 5183731 - DNA, 22 bp, Homo sapiens
agcaagactccgtctcaaaaaa

SEQ ID NO: 5183732 - DNA, 15 bp, Homo sapiens
agcaagactgcaaga

SEQ ID NO: 5183733 - DNA, 15 bp, Homo sapiens
agcaagactgggccc

SEQ ID NO: 5183734 - DNA, 23 bp, Homo sapiens
agcaagagagagctcgctcttgg

SEQ ID NO: 5183735 - DNA, 15 bp, Homo sapiens
agcaagagagatgtt

SEQ ID NO: 5183736 - DNA, 13 bp, Homo sapiens
agcaagagcacaa

SEQ ID NO: 5183737 - DNA, 13 bp, Homo sapiens
agcaagagccagg

SEQ ID NO: 5183738 - DNA, 22 bp, Homo sapiens
agcaagaggaaggggtgctgtg

SEQ ID NO: 5183739 - DNA, 12 bp, Homo sapiens
agcaagaggagg

SEQ ID NO: 5183740 - DNA, 21 bp, Homo sapiens
agcaagaggccgtggctgctg

SEQ ID NO: 5183741 - DNA, 22 bp, Homo sapiens
agagattttgtcgggacagaga

SEQ ID NO: 5183742 - DNA, 16 bp, Homo sapiens
agagatttttatgtgt

SEQ ID NO: 5183743 - DNA, 17 bp, Homo sapiens
agagatttttgtttgtt

SEQ ID NO: 5183744 - DNA, 17 bp, Homo sapiens
agagattttttttccct

SEQ ID NO: 5183745 - DNA, 20 bp, Homo sapiens
agagatttttttttaaagaa

SEQ ID NO: 5183746 - DNA, 13 bp, Homo sapiens
agagcaaaaatgt

SEQ ID NO: 5183747 - DNA, 20 bp, Homo sapiens
agagcaaaaatgtaaaaaac

SEQ ID NO: 5183748 - DNA, 18 bp, Homo sapiens
agagcaaaagcctcagaa

SEQ ID NO: 5183749 - DNA, 15 bp, Homo sapiens
agagcaaaatgctct

SEQ ID NO: 5183750 - DNA, 20 bp, Homo sapiens
agagcaaaattgatgtgttt

SEQ ID NO: 5183751 - DNA, 13 bp, Homo sapiens
agagcaaacagaa

SEQ ID NO: 5183752 - DNA, 13 bp, Homo sapiens
agagcaaaggaga

SEQ ID NO: 5183753 - DNA, 18 bp, Homo sapiens
agagcaaaggagaaatct

SEQ ID NO: 5183754 - DNA, 14 bp, Homo sapiens
agagcaaaggagac

SEQ ID NO: 5183755 - DNA, 23 bp, Homo sapiens
agagcaaaggagacaaagcagga

SEQ ID NO: 5183756 - DNA, 15 bp, Homo sapiens
agagcaaagtcatgt

SEQ ID NO: 5183757 - DNA, 15 bp, Homo sapiens
agagcaaatgcaaaa

SEQ ID NO: 5183758 - DNA, 22 bp, Homo sapiens
agagcaaatgcaaaaataacca

SEQ ID NO: 5183759 - DNA, 18 bp, Homo sapiens
agagcaacccctggaccc

SEQ ID NO: 5183760 - DNA, 15 bp, Homo sapiens
agagcaacccctgta

SEQ ID NO: 5183761 - DNA, 15 bp, Homo sapiens
agagcaagaaggaaa

SEQ ID NO: 5183762 - DNA, 18 bp, Homo sapiens
agagcaagaccccatctc

SEQ ID NO: 5183763 - DNA, 18 bp, Homo sapiens
agagcaagactctgtcta

SEQ ID NO: 5183764 - DNA, 21 bp, Homo sapiens
agagcaagactctgtctaaaa

SEQ ID NO: 5183765 - DNA, 13 bp, Homo sapiens
agagcaagagagc

SEQ ID NO: 5183766 - DNA, 20 bp, Homo sapiens
agagcaagagagcagcaagg

SEQ ID NO: 5183767 - DNA, 23 bp, Homo sapiens
agagcaagagtctgtctcaaaaa

SEQ ID NO: 5183768 - DNA, 15 bp, Homo sapiens
agagcaagctttttt

SEQ ID NO: 5183769 - DNA, 12 bp, Homo sapiens
agagcaaggaag

SEQ ID NO: 5183770 - DNA, 21 bp, Homo sapiens
agagcaaggaaggtaaaaagt

SEQ ID NO: 5183771 - DNA, 23 bp, Homo sapiens
agagcaaggtttcgtggcagcac

SEQ ID NO: 5183772 - DNA, 16 bp, Homo sapiens
agagcaagtctgcagg

SEQ ID NO: 5183773 - DNA, 19 bp, Homo sapiens
agagcaataacactatatt

SEQ ID NO: 5183774 - DNA, 21 bp, Homo sapiens
agagcaataacactatattta

SEQ ID NO: 5183775 - DNA, 17 bp, Homo sapiens
agagcaatactttttgt

SEQ ID NO: 5183776 - DNA, 15 bp, Homo sapiens
agagcaatctgggca

SEQ ID NO: 5183777 - DNA, 16 bp, Homo sapiens
agagcaatcttgctgt

SEQ ID NO: 5183778 - DNA, 23 bp, Homo sapiens
agagcaatgcattctggagacag

SEQ ID NO: 5183779 - DNA, 21 bp, Homo sapiens
agagcaatgcttttaatgaat

SEQ ID NO: 5183780 - DNA, 22 bp, Homo sapiens
agagcaatgcttttaatgaatt

SEQ ID NO: 5183781 - DNA, 16 bp, Homo sapiens
agagcaattccaggct

SEQ ID NO: 5183782 - DNA, 19 bp, Homo sapiens
agagcaattccaggctgag

SEQ ID NO: 5183783 - DNA, 20 bp, Homo sapiens
agagcaattccaggctgagc

SEQ ID NO: 5183784 - DNA, 19 bp, Homo sapiens
agagcaatttacctggtac

SEQ ID NO: 5183785 - DNA, 18 bp, Homo sapiens
agagcacaaacttcagaa

SEQ ID NO: 5183786 - DNA, 22 bp, Homo sapiens
agagcacaagaaggccagccca

SEQ ID NO: 5183787 - DNA, 22 bp, Homo sapiens
agagcacaagaggaagagagag

SEQ ID NO: 5183788 - DNA, 12 bp, Homo sapiens
agagcacacaga

SEQ ID NO: 5183789 - DNA, 14 bp, Homo sapiens
agagcacactgtag

SEQ ID NO: 5183790 - DNA, 15 bp, Homo sapiens
agagcacacttattt

SEQ ID NO: 5183791 - DNA, 20 bp, Homo sapiens
agagcacacttggcccaagt

SEQ ID NO: 5183792 - DNA, 16 bp, Homo sapiens
agagcacagagccctg

SEQ ID NO: 5183793 - DNA, 14 bp, Homo sapiens
agagcacagcccac

SEQ ID NO: 5183794 - DNA, 23 bp, Homo sapiens
agagcacagcgtttacatattta

SEQ ID NO: 5183795 - DNA, 18 bp, Homo sapiens
agagcacccacagccgca

SEQ ID NO: 5183796 - DNA, 22 bp, Homo sapiens
agagcaccccctgctccaccag

SEQ ID NO: 5183797 - DNA, 19 bp, Homo sapiens
agagcacctagtccagtga

SEQ ID NO: 5183798 - DNA, 23 bp, Homo sapiens
agagcaccttagacagtccctgc

SEQ ID NO: 5183799 - DNA, 14 bp, Homo sapiens
agagcaccttcctc

SEQ ID NO: 5183800 - DNA, 15 bp, Homo sapiens
agagcacgcctgcca

SEQ ID NO: 5183801 - DNA, 20 bp, Homo sapiens
agagcacgcctgtactagag

SEQ ID NO: 5183802 - DNA, 21 bp, Homo sapiens
agagcacgcctgtactagagc

SEQ ID NO: 5183803 - DNA, 20 bp, Homo sapiens
agagcacgggcgttatgtaa

SEQ ID NO: 5183804 - DNA, 22 bp, Homo sapiens
agagcactagttgtgaatttag

SEQ ID NO: 5183805 - DNA, 12 bp, Homo sapiens
agagcactgcca

SEQ ID NO: 5183806 - DNA, 18 bp, Homo sapiens
agagcactgccaccagta

SEQ ID NO: 5183807 - DNA, 23 bp, Homo sapiens
agagcactgcctctatgccctgc

SEQ ID NO: 5183808 - DNA, 12 bp, Homo sapiens
agagcactgctc

SEQ ID NO: 5183809 - DNA, 21 bp, Homo sapiens
agagcactgggttgcagggga

SEQ ID NO: 5183810 - DNA, 17 bp, Homo sapiens
agagcactgtgtaacca

SEQ ID NO: 5183811 - DNA, 19 bp, Homo sapiens
agagcacttaagagaatat

SEQ ID NO: 5183812 - DNA, 16 bp, Homo sapiens
agagcacttgagctgt

SEQ ID NO: 5183813 - DNA, 14 bp, Homo sapiens
agagcagaaattct

SEQ ID NO: 5183814 - DNA, 22 bp, Homo sapiens
agagcagaaattctgtttttaa

SEQ ID NO: 5183815 - DNA, 23 bp, Homo sapiens
agagcagaacggagccccaggcc

SEQ ID NO: 5183816 - DNA, 17 bp, Homo sapiens
agagcagaaggaaggat

SEQ ID NO: 5183817 - DNA, 12 bp, Homo sapiens
agagcagacagg

SEQ ID NO: 5183818 - DNA, 23 bp, Homo sapiens
agagcagacaggctacaaagcag

SEQ ID NO: 5183819 - DNA, 14 bp, Homo sapiens
agagcagagaatat

SEQ ID NO: 5183820 - DNA, 13 bp, Homo sapiens
agagcagagagca

SEQ ID NO: 5183821 - DNA, 14 bp, Homo sapiens
agagcagagagcag

SEQ ID NO: 5183822 - DNA, 18 bp, Homo sapiens
agagcagagcaaatgagg

SEQ ID NO: 5183823 - DNA, 12 bp, Homo sapiens
agagcagatgca

SEQ ID NO: 5183824 - DNA, 18 bp, Homo sapiens
agagcagatgcagagagc

SEQ ID NO: 5183825 - DNA, 17 bp, Homo sapiens
agagcagcacaaagaaa

SEQ ID NO: 5183826 - DNA, 23 bp, Homo sapiens
agagcagcacctcctcagcctga

SEQ ID NO: 5183827 - DNA, 13 bp, Homo sapiens
agagcagcaggtg

SEQ ID NO: 5183828 - DNA, 23 bp, Homo sapiens
agagcagcagtgaaaacaagtgc

SEQ ID NO: 5183829 - DNA, 21 bp, Homo sapiens
agagcagccagcacccacctg

SEQ ID NO: 5183830 - DNA, 13 bp, Homo sapiens
agagcagccagga

SEQ ID NO: 5183831 - DNA, 16 bp, Homo sapiens
agagcagcctcgtgga

SEQ ID NO: 5183832 - DNA, 11 bp, Homo sapiens
agagcagcctg

SEQ ID NO: 5183833 - DNA, 12 bp, Homo sapiens
agagcagcctga

SEQ ID NO: 5183834 - DNA, 16 bp, Homo sapiens
agagcagcctgatggc

SEQ ID NO: 5183835 - DNA, 15 bp, Homo sapiens
agagcagcctggcca

SEQ ID NO: 5183836 - DNA, 22 bp, Homo sapiens
agagcagcctggccaacatggc

SEQ ID NO: 5183837 - DNA, 16 bp, Homo sapiens
agagcagcgcccaggc

SEQ ID NO: 5183838 - DNA, 22 bp, Homo sapiens
agagcagcgcccaggcctgctg

SEQ ID NO: 5183839 - DNA, 21 bp, Homo sapiens
agagcagctccctttctcagg

SEQ ID NO: 5183840 - DNA, 22 bp, Homo sapiens
agagcagctccctttctcagga

SEQ ID NO: 5183841 - DNA, 11 bp, Homo sapiens
agagcagctgg

SEQ ID NO: 5183842 - DNA, 23 bp, Homo sapiens
agagcaggaagcattcagagagc

SEQ ID NO: 5183843 - DNA, 14 bp, Homo sapiens
agagcaggaaggac

SEQ ID NO: 5183844 - DNA, 13 bp, Homo sapiens
agagcaggacctc

SEQ ID NO: 5183845 - DNA, 22 bp, Homo sapiens
agagcaggactccaggcccaag

SEQ ID NO: 5183846 - DNA, 17 bp, Homo sapiens
agagcaggactgatgtc

SEQ ID NO: 5183847 - DNA, 13 bp, Homo sapiens
agagcaggagccc

SEQ ID NO: 5183848 - DNA, 16 bp, Homo sapiens
agagcaggagcccctg

SEQ ID NO: 5183849 - DNA, 21 bp, Homo sapiens
agagcaggaggcagggctctg

SEQ ID NO: 5183850 - DNA, 13 bp, Homo sapiens
agagcaggcacat

SEQ ID NO: 5183851 - DNA, 20 bp, Homo sapiens
agagcaggccacgctcaggc

SEQ ID NO: 5183852 - DNA, 16 bp, Homo sapiens
agagcaggccagcccg

SEQ ID NO: 5183853 - DNA, 18 bp, Homo sapiens
agagcaggccagcccgga

SEQ ID NO: 5183854 - DNA, 21 bp, Homo sapiens
agagcaggccaggcgcggtgg

SEQ ID NO: 5183855 - DNA, 19 bp, Homo sapiens
agagcaggcgttcagctca

SEQ ID NO: 5183856 - DNA, 18 bp, Homo sapiens
agagcaggctttgtgaga

SEQ ID NO: 5183857 - DNA, 20 bp, Homo sapiens
agagcaggctttgtgagaga

SEQ ID NO: 5183858 - DNA, 13 bp, Homo sapiens
agagcagggcaag

SEQ ID NO: 5183859 - DNA, 18 bp, Homo sapiens
agagcaggggagcttggg

SEQ ID NO: 5183860 - DNA, 21 bp, Homo sapiens
agagcaggggagcttgggact

SEQ ID NO: 5183861 - DNA, 18 bp, Homo sapiens
agagcaggggctccagca

SEQ ID NO: 5183862 - DNA, 21 bp, Homo sapiens
agagcagggggacctaggctc

SEQ ID NO: 5183863 - DNA, 20 bp, Homo sapiens
agagcaggtctgcaggccac

SEQ ID NO: 5183864 - DNA, 23 bp, Homo sapiens
agagcaggtgactgtgctgtgca

SEQ ID NO: 5183865 - DNA, 15 bp, Homo sapiens
agagcagtgcttttg

SEQ ID NO: 5183866 - DNA, 14 bp, Homo sapiens
agagcagtgggcag

SEQ ID NO: 5183867 - DNA, 13 bp, Homo sapiens
agagcagttcaag

SEQ ID NO: 5183868 - DNA, 19 bp, Homo sapiens
agagcagttgagaggacac

SEQ ID NO: 5183869 - DNA, 23 bp, Homo sapiens
agagcagtttggtttctagcatg

SEQ ID NO: 5183870 - DNA, 16 bp, Homo sapiens
agagcataaaacctaa

SEQ ID NO: 5183871 - DNA, 17 bp, Homo sapiens
agagcataaaacctaaa

SEQ ID NO: 5183872 - DNA, 23 bp, Homo sapiens
agagcataattccgaaacaaaac

SEQ ID NO: 5183873 - DNA, 14 bp, Homo sapiens
agagcataatttaa

SEQ ID NO: 5183874 - DNA, 20 bp, Homo sapiens
agagcataatttaaaaatat

SEQ ID NO: 5183875 - DNA, 15 bp, Homo sapiens
agagcatacaaaata

SEQ ID NO: 5183876 - DNA, 15 bp, Homo sapiens
agagcatcaggccta

SEQ ID NO: 5183877 - DNA, 23 bp, Homo sapiens
agagcatcatgcctctgaggcca

SEQ ID NO: 5183878 - DNA, 23 bp, Homo sapiens
agagcatcctgcttctaccatgt

SEQ ID NO: 5183879 - DNA, 16 bp, Homo sapiens
agagcatcgtgaccct

SEQ ID NO: 5183880 - DNA, 19 bp, Homo sapiens
agagcatcgtgacccttca

SEQ ID NO: 5183881 - DNA, 21 bp, Homo sapiens
agagcatctcaggaggggcag

SEQ ID NO: 5183882 - DNA, 16 bp, Homo sapiens
agagcatctcatttat

SEQ ID NO: 5183883 - DNA, 14 bp, Homo sapiens
agagcatctctgcc

SEQ ID NO: 5183884 - DNA, 17 bp, Homo sapiens
agagcatctgccccagg

SEQ ID NO: 5183885 - DNA, 17 bp, Homo sapiens
agagcatctgctctgag

SEQ ID NO: 5183886 - DNA, 18 bp, Homo sapiens
agagcatctgtcccactg

SEQ ID NO: 5183887 - DNA, 19 bp, Homo sapiens
agagcatctgtcccactgg

SEQ ID NO: 5183888 - DNA, 23 bp, Homo sapiens
agagcatctgtcccactgggaca

SEQ ID NO: 5183889 - DNA, 14 bp, Homo sapiens
agagcatgaaattt

SEQ ID NO: 5183890 - DNA, 20 bp, Homo sapiens
agagcatgatgggaggtgtg

SEQ ID NO: 5183891 - DNA, 16 bp, Homo sapiens
agagcatggttccagt

SEQ ID NO: 5183892 - DNA, 19 bp, Homo sapiens
agagcatgtgggggaaggc

SEQ ID NO: 5183893 - DNA, 16 bp, Homo sapiens
agagcatgtgtcagag

SEQ ID NO: 5183894 - DNA, 12 bp, Homo sapiens
agagcattaaaa

SEQ ID NO: 5183895 - DNA, 18 bp, Homo sapiens
agagcattaaaataacta

SEQ ID NO: 5183896 - DNA, 17 bp, Homo sapiens
agagcattacgtgagcc

SEQ ID NO: 5183897 - DNA, 19 bp, Homo sapiens
agagcattacgtgagccag

SEQ ID NO: 5183898 - DNA, 18 bp, Homo sapiens
agagcattccagtcaggc

SEQ ID NO: 5183899 - DNA, 14 bp, Homo sapiens
agagcattctgggg

SEQ ID NO: 5183900 - DNA, 20 bp, Homo sapiens
agagcattctggggtggggc

SEQ ID NO: 5183901 - DNA, 18 bp, Homo sapiens
agagcattgccattccct

SEQ ID NO: 5183902 - DNA, 24 bp, Homo sapiens
agagcattgtcaccgcaggtgctc

SEQ ID NO: 5183903 - DNA, 19 bp, Homo sapiens
agagcatttggcagagtct

SEQ ID NO: 5183904 - DNA, 23 bp, Homo sapiens
agagcatttggtacacacttgac

SEQ ID NO: 5183905 - DNA, 20 bp, Homo sapiens
agagccaaacagagcccagg

SEQ ID NO: 5183906 - DNA, 14 bp, Homo sapiens
agagccaaatctga

SEQ ID NO: 5183907 - DNA, 24 bp, Homo sapiens
agagccaaattcatcctcttacca

SEQ ID NO: 5183908 - DNA, 16 bp, Homo sapiens
agagccaacctcggct

SEQ ID NO: 5183909 - DNA, 21 bp, Homo sapiens
agagccaacctcggcttgtgg

SEQ ID NO: 5183910 - DNA, 13 bp, Homo sapiens
agagccaacctgg

SEQ ID NO: 5183911 - DNA, 18 bp, Homo sapiens
agagccaacctggacttc

SEQ ID NO: 5183912 - DNA, 19 bp, Homo sapiens
agagccaacctggacttcc

SEQ ID NO: 5183913 - DNA, 20 bp, Homo sapiens
agagccaacctggacttcct

SEQ ID NO: 5183914 - DNA, 17 bp, Homo sapiens
agagccaagacggagga

SEQ ID NO: 5183915 - DNA, 18 bp, Homo sapiens
agagccaagacggaggag

SEQ ID NO: 5183916 - DNA, 12 bp, Homo sapiens
agagccaagcct

SEQ ID NO: 5183917 - DNA, 13 bp, Homo sapiens
agagccaagcctt

SEQ ID NO: 5183918 - DNA, 15 bp, Homo sapiens
agcaagataaacatt

SEQ ID NO: 5183919 - DNA, 17 bp, Homo sapiens
agcaagatcgctgtgct

SEQ ID NO: 5183920 - DNA, 18 bp, Homo sapiens
agcaagatcgctgtgcta

SEQ ID NO: 5183921 - DNA, 23 bp, Homo sapiens
agcaagatcgctgtgctaggtct

SEQ ID NO: 5183922 - DNA, 19 bp, Homo sapiens
agcaagatgatttttaagt

SEQ ID NO: 5183923 - DNA, 12 bp, Homo sapiens
agcaagatgttt

SEQ ID NO: 5183924 - DNA, 21 bp, Homo sapiens
agcaagatgtttcttgccttt

SEQ ID NO: 5183925 - DNA, 11 bp, Homo sapiens
agcaagcaaaa

SEQ ID NO: 5183926 - DNA, 16 bp, Homo sapiens
agcaagcaactgagat

SEQ ID NO: 5183927 - DNA, 15 bp, Homo sapiens
agcaagcaattctgc

SEQ ID NO: 5183928 - DNA, 20 bp, Homo sapiens
agcaagcaccaacctccaga

SEQ ID NO: 5183929 - DNA, 21 bp, Homo sapiens
agcaagcaccaacctccagac

SEQ ID NO: 5183930 - DNA, 13 bp, Homo sapiens
agcaagcacctgg

SEQ ID NO: 5183931 - DNA, 12 bp, Homo sapiens
agcaagcagggg

SEQ ID NO: 5183932 - DNA, 18 bp, Homo sapiens
agcaagcattcagaagaa

SEQ ID NO: 5183933 - DNA, 22 bp, Homo sapiens
agcaagcattcagaagaaaaag

SEQ ID NO: 5183934 - DNA, 12 bp, Homo sapiens
agcaagccagga

SEQ ID NO: 5183935 - DNA, 14 bp, Homo sapiens
agcaagccaggaga

SEQ ID NO: 5183936 - DNA, 13 bp, Homo sapiens
agcaagccctact

SEQ ID NO: 5183937 - DNA, 12 bp, Homo sapiens
agcaagccctga

SEQ ID NO: 5183938 - DNA, 21 bp, Homo sapiens
agcaagccggcagaaatagct

SEQ ID NO: 5183939 - DNA, 15 bp, Homo sapiens
agcaagcgggagccc

SEQ ID NO: 5183940 - DNA, 18 bp, Homo sapiens
agcaagcgtctgggcaag

SEQ ID NO: 5183941 - DNA, 19 bp, Homo sapiens
agcaagcgtctgggcaaga

SEQ ID NO: 5183942 - DNA, 15 bp, Homo sapiens
agcaagctagaactg

SEQ ID NO: 5183943 - DNA, 15 bp, Homo sapiens
agcaagctctgccct

SEQ ID NO: 5183944 - DNA, 13 bp, Homo sapiens
agcaagctcttcc

SEQ ID NO: 5183945 - DNA, 17 bp, Homo sapiens
agcaagctgattaaatg

SEQ ID NO: 5183946 - DNA, 15 bp, Homo sapiens
agcaagctggatgca

SEQ ID NO: 5183947 - DNA, 12 bp, Homo sapiens
agcaagctggcc

SEQ ID NO: 5183948 - DNA, 15 bp, Homo sapiens
agcaagctggcctct

SEQ ID NO: 5183949 - DNA, 22 bp, Homo sapiens
agcaagctgtgttacttgaagt

SEQ ID NO: 5183950 - DNA, 23 bp, Homo sapiens
agcaagcttttacaacagtgctg

SEQ ID NO: 5183951 - DNA, 16 bp, Homo sapiens
agcaaggaaaacttat

SEQ ID NO: 5183952 - DNA, 18 bp, Homo sapiens
agcaaggaaatgtcctgc

SEQ ID NO: 5183953 - DNA, 13 bp, Homo sapiens
agcaaggaaggac

SEQ ID NO: 5183954 - DNA, 21 bp, Homo sapiens
agcaaggaaggtaaaaagtta

SEQ ID NO: 5183955 - DNA, 14 bp, Homo sapiens
agcaaggaagtaag

SEQ ID NO: 5183956 - DNA, 22 bp, Homo sapiens
agcaaggaagtaagggagtcat

SEQ ID NO: 5183957 - DNA, 20 bp, Homo sapiens
agcaaggacaacctgcccct

SEQ ID NO: 5183958 - DNA, 11 bp, Homo sapiens
agcaaggacat

SEQ ID NO: 5183959 - DNA, 14 bp, Homo sapiens
agcaaggacattgc

SEQ ID NO: 5183960 - DNA, 19 bp, Homo sapiens
agcaaggacattgccccaa

SEQ ID NO: 5183961 - DNA, 19 bp, Homo sapiens
agcaaggagatttacaact

SEQ ID NO: 5183962 - DNA, 16 bp, Homo sapiens
agcaaggaggctggct

SEQ ID NO: 5183963 - DNA, 22 bp, Homo sapiens
agcaaggaggctggctggggcc

SEQ ID NO: 5183964 - DNA, 15 bp, Homo sapiens
agcaaggatctttca

SEQ ID NO: 5183965 - DNA, 18 bp, Homo sapiens
agcaaggcaagaagtggg

SEQ ID NO: 5183966 - DNA, 20 bp, Homo sapiens
agcaaggcaagaagtgggat

SEQ ID NO: 5183967 - DNA, 16 bp, Homo sapiens
agcaaggcacctgcag

SEQ ID NO: 5183968 - DNA, 14 bp, Homo sapiens
agcaaggcagagcc

SEQ ID NO: 5183969 - DNA, 12 bp, Homo sapiens
agcaaggcaggt

SEQ ID NO: 5183970 - DNA, 23 bp, Homo sapiens
agcaaggcataatgtaatttagc

SEQ ID NO: 5183971 - DNA, 14 bp, Homo sapiens
agcaaggccacctc

SEQ ID NO: 5183972 - DNA, 19 bp, Homo sapiens
agcaaggccacctcttcct

SEQ ID NO: 5183973 - DNA, 15 bp, Homo sapiens
agcaaggccagggca

SEQ ID NO: 5183974 - DNA, 22 bp, Homo sapiens
agcaaggccagggcacagctgg

SEQ ID NO: 5183975 - DNA, 18 bp, Homo sapiens
agcaaggcccgagcagct

SEQ ID NO: 5183976 - DNA, 19 bp, Homo sapiens
agcaaggcccgagcagctg

SEQ ID NO: 5183977 - DNA, 17 bp, Homo sapiens
agcaaggccctgctgcc

SEQ ID NO: 5183978 - DNA, 20 bp, Homo sapiens
agcaaggcgcctgccttggg

SEQ ID NO: 5183979 - DNA, 21 bp, Homo sapiens
agcaaggcgcctgccttggga

SEQ ID NO: 5183980 - DNA, 21 bp, Homo sapiens
agcaaggcggtggacttgaac

SEQ ID NO: 5183981 - DNA, 11 bp, Homo sapiens
agcaaggctgc

SEQ ID NO: 5183982 - DNA, 14 bp, Homo sapiens
agcaaggctgccct

SEQ ID NO: 5183983 - DNA, 15 bp, Homo sapiens
agcaaggctgctaag

SEQ ID NO: 5183984 - DNA, 12 bp, Homo sapiens
agcaagggagaa

SEQ ID NO: 5183985 - DNA, 16 bp, Homo sapiens
agcaagggagaaaaga

SEQ ID NO: 5183986 - DNA, 24 bp, Homo sapiens
agcaagggcacaaactgcagctgt

SEQ ID NO: 5183987 - DNA, 16 bp, Homo sapiens
agcaagggcgcctcac

SEQ ID NO: 5183988 - DNA, 14 bp, Homo sapiens
agcaagggctccag

SEQ ID NO: 5183989 - DNA, 15 bp, Homo sapiens
agcaaggggctctgc

SEQ ID NO: 5183990 - DNA, 14 bp, Homo sapiens
agcaagggggccca

SEQ ID NO: 5183991 - DNA, 18 bp, Homo sapiens
agcaaggtcatggtctga

SEQ ID NO: 5183992 - DNA, 20 bp, Homo sapiens
agcaaggtcatttcttcagt

SEQ ID NO: 5183993 - DNA, 21 bp, Homo sapiens
agcaaggtctcagacttaaca

SEQ ID NO: 5183994 - DNA, 23 bp, Homo sapiens
agcaaggtctcagacttaacaga

SEQ ID NO: 5183995 - DNA, 20 bp, Homo sapiens
agcaaggtcttgctctccta

SEQ ID NO: 5183996 - DNA, 23 bp, Homo sapiens
agcaaggtgctcacaccccattg

SEQ ID NO: 5183997 - DNA, 14 bp, Homo sapiens
agcaaggtggagtg

SEQ ID NO: 5183998 - DNA, 17 bp, Homo sapiens
agcaaggtggccacagt

SEQ ID NO: 5183999 - DNA, 16 bp, Homo sapiens
agcaaggtgtggaggc

SEQ ID NO: 5184000 - DNA, 22 bp, Homo sapiens
agcaaggtgtggaggctcctgt

SEQ ID NO: 5184001 - DNA, 21 bp, Homo sapiens
agcaaggtttaaatttgttat

SEQ ID NO: 5184002 - DNA, 18 bp, Homo sapiens
agcaaggtttcgtggcag

SEQ ID NO: 5184003 - DNA, 20 bp, Homo sapiens
agcaaggtttcgtggcagca

SEQ ID NO: 5184004 - DNA, 18 bp, Homo sapiens
agcaagtaaaaaggctaa

SEQ ID NO: 5184005 - DNA, 16 bp, Homo sapiens
agcaagtagagcagag

SEQ ID NO: 5184006 - DNA, 23 bp, Homo sapiens
agcaagtaggaatcgtttttgct

SEQ ID NO: 5184007 - DNA, 14 bp, Homo sapiens
agcaagtatattta

SEQ ID NO: 5184008 - DNA, 14 bp, Homo sapiens
agcaagtcagggtt

SEQ ID NO: 5184009 - DNA, 13 bp, Homo sapiens
agcaagtctgcag

SEQ ID NO: 5184010 - DNA, 16 bp, Homo sapiens
agcaagtcttaacaaa

SEQ ID NO: 5184011 - DNA, 18 bp, Homo sapiens
agcaagtgagagctgggt

SEQ ID NO: 5184012 - DNA, 19 bp, Homo sapiens
agcaagtgagcactgaggg

SEQ ID NO: 5184013 - DNA, 15 bp, Homo sapiens
agcaagtgagcagag

SEQ ID NO: 5184014 - DNA, 22 bp, Homo sapiens
agcaagtgagtctggtggagga

SEQ ID NO: 5184015 - DNA, 21 bp, Homo sapiens
agcaagtgattgggacagagg

SEQ ID NO: 5184016 - DNA, 12 bp, Homo sapiens
agcaagtgtaca

SEQ ID NO: 5184017 - DNA, 19 bp, Homo sapiens
agcaagtgtgcactccagc

SEQ ID NO: 5184018 - DNA, 22 bp, Homo sapiens
agcaagtgtgctggcctctctg

SEQ ID NO: 5184019 - DNA, 21 bp, Homo sapiens
agcaagtgttcactgctcctt

SEQ ID NO: 5184020 - DNA, 16 bp, Homo sapiens
agcaagttacagtgat

SEQ ID NO: 5184021 - DNA, 15 bp, Homo sapiens
agcaagttcgtctgt

SEQ ID NO: 5184022 - DNA, 17 bp, Homo sapiens
agcaagttctagagaag

SEQ ID NO: 5184023 - DNA, 15 bp, Homo sapiens
agcaagttttcttcc

SEQ ID NO: 5184024 - DNA, 14 bp, Homo sapiens
agcaataaaactgc

SEQ ID NO: 5184025 - DNA, 17 bp, Homo sapiens
agcaataaagatttttc

SEQ ID NO: 5184026 - DNA, 18 bp, Homo sapiens
agcaataaagtggaaaca

SEQ ID NO: 5184027 - DNA, 13 bp, Homo sapiens
agcaataaataac

SEQ ID NO: 5184028 - DNA, 21 bp, Homo sapiens
agcaataaataacacttgtca

SEQ ID NO: 5184029 - DNA, 14 bp, Homo sapiens
agcaataaatgaat

SEQ ID NO: 5184030 - DNA, 17 bp, Homo sapiens
agcaataacactatatt

SEQ ID NO: 5184031 - DNA, 17 bp, Homo sapiens
agcaataactccaagca

SEQ ID NO: 5184032 - DNA, 24 bp, Homo sapiens
agcaataactccaagcagactcca

SEQ ID NO: 5184033 - DNA, 14 bp, Homo sapiens
agcaataactgaaa

SEQ ID NO: 5184034 - DNA, 15 bp, Homo sapiens
agcaataacttctat

SEQ ID NO: 5184035 - DNA, 16 bp, Homo sapiens
agcaataagaaatgaa

SEQ ID NO: 5184036 - DNA, 17 bp, Homo sapiens
agcaataagaaatgaac

SEQ ID NO: 5184037 - DNA, 23 bp, Homo sapiens
agcaataatggtcccatccaggc

SEQ ID NO: 5184038 - DNA, 14 bp, Homo sapiens
agcaataattagga

SEQ ID NO: 5184039 - DNA, 17 bp, Homo sapiens
agcaataattgtttcca

SEQ ID NO: 5184040 - DNA, 13 bp, Homo sapiens
agcaatacaggga

SEQ ID NO: 5184041 - DNA, 15 bp, Homo sapiens
agcaatacagggagg

SEQ ID NO: 5184042 - DNA, 19 bp, Homo sapiens
agcaatacgtttgtgcaga

SEQ ID NO: 5184043 - DNA, 21 bp, Homo sapiens
agcaatactcatcagagcagc

SEQ ID NO: 5184044 - DNA, 18 bp, Homo sapiens
agcaatactgtttccatt

SEQ ID NO: 5184045 - DNA, 19 bp, Homo sapiens
agcaataggtagctgggga

SEQ ID NO: 5184046 - DNA, 22 bp, Homo sapiens
agcaatatattaccagcaagaa

SEQ ID NO: 5184047 - DNA, 21 bp, Homo sapiens
agcaatatcagttattttttg

SEQ ID NO: 5184048 - DNA, 17 bp, Homo sapiens
agcaatatgagacacag

SEQ ID NO: 5184049 - DNA, 15 bp, Homo sapiens
agcaatatgtaaata

SEQ ID NO: 5184050 - DNA, 19 bp, Homo sapiens
agcaatattgcctgtgctt

SEQ ID NO: 5184051 - DNA, 20 bp, Homo sapiens
agcaatattgcctgtgcttc

SEQ ID NO: 5184052 - DNA, 21 bp, Homo sapiens
agcaatattgtatatttttat

SEQ ID NO: 5184053 - DNA, 11 bp, Homo sapiens
agcaatattta

SEQ ID NO: 5184054 - DNA, 18 bp, Homo sapiens
agcaatatttaaggagat

SEQ ID NO: 5184055 - DNA, 17 bp, Homo sapiens
agcaatcaagcaccagg

SEQ ID NO: 5184056 - DNA, 22 bp, Homo sapiens
agcaatcaaggttataattttt

SEQ ID NO: 5184057 - DNA, 16 bp, Homo sapiens
agcaatcacaggaaaa

SEQ ID NO: 5184058 - DNA, 22 bp, Homo sapiens
agcaatcactgggcccagagga

SEQ ID NO: 5184059 - DNA, 15 bp, Homo sapiens
agcaatcagaattgt

SEQ ID NO: 5184060 - DNA, 17 bp, Homo sapiens
agcaatcagcaaacaca

SEQ ID NO: 5184061 - DNA, 20 bp, Homo sapiens
agcaatcagcaaacacaata

SEQ ID NO: 5184062 - DNA, 15 bp, Homo sapiens
agcaatcattaagtg

SEQ ID NO: 5184063 - DNA, 17 bp, Homo sapiens
agcaatcatttcccctc

SEQ ID NO: 5184064 - DNA, 19 bp, Homo sapiens
agcaatcatttcccctccc

SEQ ID NO: 5184065 - DNA, 14 bp, Homo sapiens
agcaatcattttat

SEQ ID NO: 5184066 - DNA, 15 bp, Homo sapiens
agcaatcattttatg

SEQ ID NO: 5184067 - DNA, 23 bp, Homo sapiens
agcaatccatgatctatacacat

SEQ ID NO: 5184068 - DNA, 13 bp, Homo sapiens
agcaatcctccta

SEQ ID NO: 5184069 - DNA, 14 bp, Homo sapiens
agcaatcctcctga

SEQ ID NO: 5184070 - DNA, 17 bp, Homo sapiens
agcaatcctcctgagtg

SEQ ID NO: 5184071 - DNA, 14 bp, Homo sapiens
agcaatcctcctgc

SEQ ID NO: 5184072 - DNA, 18 bp, Homo sapiens
agcaatcctcctgcctca

SEQ ID NO: 5184073 - DNA, 15 bp, Homo sapiens
agcaatccttaaaaa

SEQ ID NO: 5184074 - DNA, 16 bp, Homo sapiens
agcaatccttaaaaag

SEQ ID NO: 5184075 - DNA, 21 bp, Homo sapiens
agcaatccttaaaaagaccat

SEQ ID NO: 5184076 - DNA, 20 bp, Homo sapiens
agcaatcgcatcccggctga

SEQ ID NO: 5184077 - DNA, 16 bp, Homo sapiens
agcaatctccatgtgt

SEQ ID NO: 5184078 - DNA, 18 bp, Homo sapiens
agcaatctccttactgtg

SEQ ID NO: 5184079 - DNA, 15 bp, Homo sapiens
agcaatctcttcatt

SEQ ID NO: 5184080 - DNA, 16 bp, Homo sapiens
agcaatctgaccctat

SEQ ID NO: 5184081 - DNA, 16 bp, Homo sapiens
agcaatctgcatttta

SEQ ID NO: 5184082 - DNA, 20 bp, Homo sapiens
agcaatctgcattttaacaa

SEQ ID NO: 5184083 - DNA, 21 bp, Homo sapiens
agcaatctgcattttaacaag

SEQ ID NO: 5184084 - DNA, 18 bp, Homo sapiens
agcaatctgcctgtatct

SEQ ID NO: 5184085 - DNA, 19 bp, Homo sapiens
agcaatctggaagaaagcc

SEQ ID NO: 5184086 - DNA, 13 bp, Homo sapiens
agcaatctgtctt

SEQ ID NO: 5184087 - DNA, 19 bp, Homo sapiens
agcaatcttggcagactaa

SEQ ID NO: 5184088 - DNA, 12 bp, Homo sapiens
agcaatctttga

SEQ ID NO: 5184089 - DNA, 14 bp, Homo sapiens
agcaatctttgaaa

SEQ ID NO: 5184090 - DNA, 17 bp, Homo sapiens
agcaatgaattagttgc

SEQ ID NO: 5184091 - DNA, 18 bp, Homo sapiens
agcaatgacatctcaggg

SEQ ID NO: 5184092 - DNA, 19 bp, Homo sapiens
agcaatgataatgagcaga

SEQ ID NO: 5184093 - DNA, 23 bp, Homo sapiens
agcaatgataatgagcagatgag

SEQ ID NO: 5184094 - DNA, 20 bp, Homo sapiens
agcaatgatgacccactaaa

SEQ ID NO: 5184095 - DNA, 12 bp, Homo sapiens
agcaatgcaaga

SEQ ID NO: 5184096 - DNA, 14 bp, Homo sapiens
agcaatgcattctg

SEQ ID NO: 5184097 - DNA, 13 bp, Homo sapiens
agcaatgcatttt

SEQ ID NO: 5184098 - DNA, 22 bp, Homo sapiens
agagccaagctaatgtggtagt

SEQ ID NO: 5184099 - DNA, 13 bp, Homo sapiens
agagccaagctgc

SEQ ID NO: 5184100 - DNA, 13 bp, Homo sapiens
agagccaaggcca

SEQ ID NO: 5184101 - DNA, 14 bp, Homo sapiens
agagccaaggccac

SEQ ID NO: 5184102 - DNA, 16 bp, Homo sapiens
agagccaaggcctatg

SEQ ID NO: 5184103 - DNA, 24 bp, Homo sapiens
agagccaaggcctatgccacctgc

SEQ ID NO: 5184104 - DNA, 13 bp, Homo sapiens
agagccaagtcct

SEQ ID NO: 5184105 - DNA, 18 bp, Homo sapiens
agagccaagttcaaagaa

SEQ ID NO: 5184106 - DNA, 20 bp, Homo sapiens
agagccaagttcaaagaacc

SEQ ID NO: 5184107 - DNA, 22 bp, Homo sapiens
agagccacagaaaatggaggat

SEQ ID NO: 5184108 - DNA, 15 bp, Homo sapiens
agagccacagggtct

SEQ ID NO: 5184109 - DNA, 19 bp, Homo sapiens
agagccacagggtctgcct

SEQ ID NO: 5184110 - DNA, 20 bp, Homo sapiens
agagccacagggtctgcctc

SEQ ID NO: 5184111 - DNA, 17 bp, Homo sapiens
agagccacaggtcttta

SEQ ID NO: 5184112 - DNA, 10 bp, Homo sapiens
agagccacct

SEQ ID NO: 5184113 - DNA, 15 bp, Homo sapiens
agagccacctgcaag

SEQ ID NO: 5184114 - DNA, 17 bp, Homo sapiens
agagccacctgcaagat

SEQ ID NO: 5184115 - DNA, 16 bp, Homo sapiens
agagccactctatgag

SEQ ID NO: 5184116 - DNA, 17 bp, Homo sapiens
agagccactgggcccct

SEQ ID NO: 5184117 - DNA, 20 bp, Homo sapiens
agagccactttcaagctgca

SEQ ID NO: 5184118 - DNA, 15 bp, Homo sapiens
agagccagagaagtg

SEQ ID NO: 5184119 - DNA, 17 bp, Homo sapiens
agagccagagaagtgac

SEQ ID NO: 5184120 - DNA, 12 bp, Homo sapiens
agagccagaggc

SEQ ID NO: 5184121 - DNA, 17 bp, Homo sapiens
agagccagatgcctccc

SEQ ID NO: 5184122 - DNA, 13 bp, Homo sapiens
agagccagcaact

SEQ ID NO: 5184123 - DNA, 17 bp, Homo sapiens
agagccagccctccctg

SEQ ID NO: 5184124 - DNA, 23 bp, Homo sapiens
agagccagccgtaatggggactc

SEQ ID NO: 5184125 - DNA, 14 bp, Homo sapiens
agagccagcctggc

SEQ ID NO: 5184126 - DNA, 19 bp, Homo sapiens
agagccagcctggctctgc

SEQ ID NO: 5184127 - DNA, 23 bp, Homo sapiens
agagccagcctggctctgccccc

SEQ ID NO: 5184128 - DNA, 18 bp, Homo sapiens
agagccagcctgggactc

SEQ ID NO: 5184129 - DNA, 13 bp, Homo sapiens
agagccagctctc

SEQ ID NO: 5184130 - DNA, 9 bp, Homo sapiens
agagccagg

SEQ ID NO: 5184131 - DNA, 13 bp, Homo sapiens
agagccaggagaa

SEQ ID NO: 5184132 - DNA, 22 bp, Homo sapiens
agagccaggagaagctcagctg

SEQ ID NO: 5184133 - DNA, 21 bp, Homo sapiens
agagccaggatgcccagatga

SEQ ID NO: 5184134 - DNA, 20 bp, Homo sapiens
agagccaggcacacactgtg

SEQ ID NO: 5184135 - DNA, 16 bp, Homo sapiens
agagccaggctctgcc

SEQ ID NO: 5184136 - DNA, 11 bp, Homo sapiens
agagccagggc

SEQ ID NO: 5184137 - DNA, 14 bp, Homo sapiens
agagccagggcagg

SEQ ID NO: 5184138 - DNA, 15 bp, Homo sapiens
agagccagggcaggg

SEQ ID NO: 5184139 - DNA, 12 bp, Homo sapiens
agagccagggct

SEQ ID NO: 5184140 - DNA, 13 bp, Homo sapiens
agagccagggctg

SEQ ID NO: 5184141 - DNA, 14 bp, Homo sapiens
agagccagggctgt

SEQ ID NO: 5184142 - DNA, 18 bp, Homo sapiens
agagccagggctgtcctt

SEQ ID NO: 5184143 - DNA, 19 bp, Homo sapiens
agagccagggctgtcctta

SEQ ID NO: 5184144 - DNA, 23 bp, Homo sapiens
agagccataaaaatataacataa

SEQ ID NO: 5184145 - DNA, 20 bp, Homo sapiens
agagccatacataaaagaaa

SEQ ID NO: 5184146 - DNA, 21 bp, Homo sapiens
agagccatacataaaagaaat

SEQ ID NO: 5184147 - DNA, 22 bp, Homo sapiens
agagccatactgcgtccaccct

SEQ ID NO: 5184148 - DNA, 20 bp, Homo sapiens
agagccatataagtttgaag

SEQ ID NO: 5184149 - DNA, 19 bp, Homo sapiens
agagccatccaccctgagg

SEQ ID NO: 5184150 - DNA, 17 bp, Homo sapiens
agagccatctgaagcca

SEQ ID NO: 5184151 - DNA, 14 bp, Homo sapiens
agagccatctgcga

SEQ ID NO: 5184152 - DNA, 14 bp, Homo sapiens
agagccatgaagca

SEQ ID NO: 5184153 - DNA, 16 bp, Homo sapiens
agagccatgccaggct

SEQ ID NO: 5184154 - DNA, 20 bp, Homo sapiens
agagccatgtagaagctgca

SEQ ID NO: 5184155 - DNA, 19 bp, Homo sapiens
agagccatgtcttctccct

SEQ ID NO: 5184156 - DNA, 18 bp, Homo sapiens
agagcccaaggtcaggga

SEQ ID NO: 5184157 - DNA, 15 bp, Homo sapiens
agagcccaatcactg

SEQ ID NO: 5184158 - DNA, 17 bp, Homo sapiens
agagcccaatcactgcc

SEQ ID NO: 5184159 - DNA, 19 bp, Homo sapiens
agagcccaatcactgccta

SEQ ID NO: 5184160 - DNA, 23 bp, Homo sapiens
agagcccaatgcatagagccctg

SEQ ID NO: 5184161 - DNA, 14 bp, Homo sapiens
agagcccaccagcc

SEQ ID NO: 5184162 - DNA, 17 bp, Homo sapiens
agagcccaccagccagc

SEQ ID NO: 5184163 - DNA, 14 bp, Homo sapiens
agagcccagaggta

SEQ ID NO: 5184164 - DNA, 20 bp, Homo sapiens
agagcccagaggtaacagaa

SEQ ID NO: 5184165 - DNA, 10 bp, Homo sapiens
agagcccagc

SEQ ID NO: 5184166 - DNA, 14 bp, Homo sapiens
agagcccagccatt

SEQ ID NO: 5184167 - DNA, 16 bp, Homo sapiens
agagcccagcccagga

SEQ ID NO: 5184168 - DNA, 15 bp, Homo sapiens
agagcccagctccaa

SEQ ID NO: 5184169 - DNA, 17 bp, Homo sapiens
agagcccaggagctccc

SEQ ID NO: 5184170 - DNA, 15 bp, Homo sapiens
agagcccaggcctcc

SEQ ID NO: 5184171 - DNA, 14 bp, Homo sapiens
agagcccaggcctg

SEQ ID NO: 5184172 - DNA, 18 bp, Homo sapiens
agagcccattaatcttga

SEQ ID NO: 5184173 - DNA, 17 bp, Homo sapiens
agagccccacacggagg

SEQ ID NO: 5184174 - DNA, 13 bp, Homo sapiens
agagccccacagc

SEQ ID NO: 5184175 - DNA, 22 bp, Homo sapiens
agagccccactcccggccaggc

SEQ ID NO: 5184176 - DNA, 15 bp, Homo sapiens
agagccccactctca

SEQ ID NO: 5184177 - DNA, 16 bp, Homo sapiens
agagccccagctgaca

SEQ ID NO: 5184178 - DNA, 15 bp, Homo sapiens
agagccccaggactg

SEQ ID NO: 5184179 - DNA, 16 bp, Homo sapiens
agagcccccaagcctc

SEQ ID NO: 5184180 - DNA, 17 bp, Homo sapiens
agagcccccaagcctct

SEQ ID NO: 5184181 - DNA, 14 bp, Homo sapiens
agagcccccaccag

SEQ ID NO: 5184182 - DNA, 18 bp, Homo sapiens
agagcccccaccagcagc

SEQ ID NO: 5184183 - DNA, 16 bp, Homo sapiens
agagccccccacaatg

SEQ ID NO: 5184184 - DNA, 21 bp, Homo sapiens
agagccccccgtgtggcttac

SEQ ID NO: 5184185 - DNA, 12 bp, Homo sapiens
agagccccggag

SEQ ID NO: 5184186 - DNA, 19 bp, Homo sapiens
agagcccctcctccagccc

SEQ ID NO: 5184187 - DNA, 15 bp, Homo sapiens
agagcccctggggcc

SEQ ID NO: 5184188 - DNA, 21 bp, Homo sapiens
agagcccgaggaggtgtctca

SEQ ID NO: 5184189 - DNA, 19 bp, Homo sapiens
agagcccgccgtctgcagg

SEQ ID NO: 5184190 - DNA, 22 bp, Homo sapiens
agagcccgccgtctgcaggggc

SEQ ID NO: 5184191 - DNA, 23 bp, Homo sapiens
agagcccgccgtctgcaggggcc

SEQ ID NO: 5184192 - DNA, 18 bp, Homo sapiens
agagcccgcgtgctggag

SEQ ID NO: 5184193 - DNA, 16 bp, Homo sapiens
agagcccgcttttgtt

SEQ ID NO: 5184194 - DNA, 19 bp, Homo sapiens
agagcccggagctccggcc

SEQ ID NO: 5184195 - DNA, 14 bp, Homo sapiens
agagcccggcccca

SEQ ID NO: 5184196 - DNA, 17 bp, Homo sapiens
agagcccgtcgcgctgg

SEQ ID NO: 5184197 - DNA, 20 bp, Homo sapiens
agagcccgtcgcgctggaca

SEQ ID NO: 5184198 - DNA, 20 bp, Homo sapiens
agagcccgtgccacccccag

SEQ ID NO: 5184199 - DNA, 20 bp, Homo sapiens
agagccctatctatgtcctg

SEQ ID NO: 5184200 - DNA, 22 bp, Homo sapiens
agagccctatctatgtcctgga

SEQ ID NO: 5184201 - DNA, 20 bp, Homo sapiens
agagccctcaactattctgt

SEQ ID NO: 5184202 - DNA, 16 bp, Homo sapiens
agagccctccaggcct

SEQ ID NO: 5184203 - DNA, 17 bp, Homo sapiens
agagccctccaggcctg

SEQ ID NO: 5184204 - DNA, 12 bp, Homo sapiens
agagccctctcc

SEQ ID NO: 5184205 - DNA, 18 bp, Homo sapiens
agagccctctcctccctc

SEQ ID NO: 5184206 - DNA, 20 bp, Homo sapiens
agagccctctcctccctctg

SEQ ID NO: 5184207 - DNA, 23 bp, Homo sapiens
agagccctctgctgctttccaac

SEQ ID NO: 5184208 - DNA, 15 bp, Homo sapiens
agagccctgagctca

SEQ ID NO: 5184209 - DNA, 20 bp, Homo sapiens
agagccctgagctcaggctg

SEQ ID NO: 5184210 - DNA, 19 bp, Homo sapiens
agagccctgaggggctggg

SEQ ID NO: 5184211 - DNA, 22 bp, Homo sapiens
agagccctgaggggctgggctg

SEQ ID NO: 5184212 - DNA, 14 bp, Homo sapiens
agagccctgctccc

SEQ ID NO: 5184213 - DNA, 20 bp, Homo sapiens
agagccctgctgtgggagag

SEQ ID NO: 5184214 - DNA, 11 bp, Homo sapiens
agagccctgga

SEQ ID NO: 5184215 - DNA, 22 bp, Homo sapiens
agagccctggacacccctgctc

SEQ ID NO: 5184216 - DNA, 19 bp, Homo sapiens
agagccctggaccttgggc

SEQ ID NO: 5184217 - DNA, 13 bp, Homo sapiens
agagccctggcca

SEQ ID NO: 5184218 - DNA, 14 bp, Homo sapiens
agagccctggccag

SEQ ID NO: 5184219 - DNA, 15 bp, Homo sapiens
agagccctggccagc

SEQ ID NO: 5184220 - DNA, 19 bp, Homo sapiens
agagccctggctctgcccc

SEQ ID NO: 5184221 - DNA, 20 bp, Homo sapiens
agagccctggctctgcccct

SEQ ID NO: 5184222 - DNA, 21 bp, Homo sapiens
agagccctggctctgcccctc

SEQ ID NO: 5184223 - DNA, 22 bp, Homo sapiens
agagccctggctctgcccctca

SEQ ID NO: 5184224 - DNA, 13 bp, Homo sapiens
agagccctggctg

SEQ ID NO: 5184225 - DNA, 17 bp, Homo sapiens
agagccctgggaccgct

SEQ ID NO: 5184226 - DNA, 19 bp, Homo sapiens
agagccctgtcagtagagt

SEQ ID NO: 5184227 - DNA, 15 bp, Homo sapiens
agagccctgtggccg

SEQ ID NO: 5184228 - DNA, 22 bp, Homo sapiens
agagccctgtggccgactctgc

SEQ ID NO: 5184229 - DNA, 18 bp, Homo sapiens
agagccctgtggccgcca

SEQ ID NO: 5184230 - DNA, 22 bp, Homo sapiens
agagccctgtggccgccacctg

SEQ ID NO: 5184231 - DNA, 15 bp, Homo sapiens
agagcccttcactgc

SEQ ID NO: 5184232 - DNA, 19 bp, Homo sapiens
agagcccttcactgccatg

SEQ ID NO: 5184233 - DNA, 14 bp, Homo sapiens
agagcccttcccag

SEQ ID NO: 5184234 - DNA, 16 bp, Homo sapiens
agagcccttcccaggg

SEQ ID NO: 5184235 - DNA, 19 bp, Homo sapiens
agagcccttgcctccccat

SEQ ID NO: 5184236 - DNA, 18 bp, Homo sapiens
agagccgaggggagagag

SEQ ID NO: 5184237 - DNA, 23 bp, Homo sapiens
agagccgcaaatcaaccccagac

SEQ ID NO: 5184238 - DNA, 18 bp, Homo sapiens
agagccgcaccctggctg

SEQ ID NO: 5184239 - DNA, 21 bp, Homo sapiens
agagccgccccgtgtcccccc

SEQ ID NO: 5184240 - DNA, 22 bp, Homo sapiens
agagccgccccgtgtcccccca

SEQ ID NO: 5184241 - DNA, 19 bp, Homo sapiens
agagccggcccgcctctcc

SEQ ID NO: 5184242 - DNA, 20 bp, Homo sapiens
agagccggccgccttctccc

SEQ ID NO: 5184243 - DNA, 15 bp, Homo sapiens
agagccgggccccgg

SEQ ID NO: 5184244 - DNA, 22 bp, Homo sapiens
agagccggggtggggtggctgc

SEQ ID NO: 5184245 - DNA, 14 bp, Homo sapiens
agagccgtaaaaac

SEQ ID NO: 5184246 - DNA, 19 bp, Homo sapiens
agagccgtaaaaactgaag

SEQ ID NO: 5184247 - DNA, 15 bp, Homo sapiens
agagcctagccacct

SEQ ID NO: 5184248 - DNA, 21 bp, Homo sapiens
agagcctagccacctcccacc

SEQ ID NO: 5184249 - DNA, 16 bp, Homo sapiens
agagcctatggaaagg

SEQ ID NO: 5184250 - DNA, 21 bp, Homo sapiens
agagcctatggaaagggtgtg

SEQ ID NO: 5184251 - DNA, 11 bp, Homo sapiens
agagcctcagc

SEQ ID NO: 5184252 - DNA, 15 bp, Homo sapiens
agagcctcagtgagc

SEQ ID NO: 5184253 - DNA, 18 bp, Homo sapiens
agagcctccaggttcctc

SEQ ID NO: 5184254 - DNA, 19 bp, Homo sapiens
agagcctccaggttcctca

SEQ ID NO: 5184255 - DNA, 12 bp, Homo sapiens
agagcctccctc

SEQ ID NO: 5184256 - DNA, 22 bp, Homo sapiens
agagcctccctcaattccccct

SEQ ID NO: 5184257 - DNA, 17 bp, Homo sapiens
agagcctccctcagcca

SEQ ID NO: 5184258 - DNA, 13 bp, Homo sapiens
agagcctcctggg

SEQ ID NO: 5184259 - DNA, 19 bp, Homo sapiens
agagcctcgacaccccccc

SEQ ID NO: 5184260 - DNA, 20 bp, Homo sapiens
agagcctcgacaccccccca

SEQ ID NO: 5184261 - DNA, 14 bp, Homo sapiens
agagcctcgctttt

SEQ ID NO: 5184262 - DNA, 17 bp, Homo sapiens
agagcctcgctttttca

SEQ ID NO: 5184263 - DNA, 19 bp, Homo sapiens
agagcctcgctttttcatc

SEQ ID NO: 5184264 - DNA, 21 bp, Homo sapiens
agagcctcgctttttcatcct

SEQ ID NO: 5184265 - DNA, 22 bp, Homo sapiens
agagcctcgctttttcatcctt

SEQ ID NO: 5184266 - DNA, 17 bp, Homo sapiens
agagcctcgtccctccc

SEQ ID NO: 5184267 - DNA, 12 bp, Homo sapiens
agagcctctgag

SEQ ID NO: 5184268 - DNA, 13 bp, Homo sapiens
agagcctctgaga

SEQ ID NO: 5184269 - DNA, 13 bp, Homo sapiens
agagcctctggaa

SEQ ID NO: 5184270 - DNA, 15 bp, Homo sapiens
agagcctctggcccc

SEQ ID NO: 5184271 - DNA, 17 bp, Homo sapiens
agagcctcttggggaag

SEQ ID NO: 5184272 - DNA, 21 bp, Homo sapiens
agagcctcttgtggaccccgc

SEQ ID NO: 5184273 - DNA, 14 bp, Homo sapiens
agagcctgaagctg

SEQ ID NO: 5184274 - DNA, 17 bp, Homo sapiens
agagcctgaagctggcc

SEQ ID NO: 5184275 - DNA, 17 bp, Homo sapiens
agagcctgacgctcagc

SEQ ID NO: 5184276 - DNA, 23 bp, Homo sapiens
agagcctgacgctcagccccagg

SEQ ID NO: 5184277 - DNA, 17 bp, Homo sapiens
agcaatgccacgattta

SEQ ID NO: 5184278 - DNA, 22 bp, Homo sapiens
agcaatgccacgatttagattt

SEQ ID NO: 5184279 - DNA, 23 bp, Homo sapiens
agcaatgccatttcagtggcttc

SEQ ID NO: 5184280 - DNA, 13 bp, Homo sapiens
agcaatgccctgc

SEQ ID NO: 5184281 - DNA, 14 bp, Homo sapiens
agcaatgcctgcct

SEQ ID NO: 5184282 - DNA, 22 bp, Homo sapiens
agcaatgctgatgaatcactgt

SEQ ID NO: 5184283 - DNA, 15 bp, Homo sapiens
agcaatgctgtgaat

SEQ ID NO: 5184284 - DNA, 16 bp, Homo sapiens
agcaatgctgtgaata

SEQ ID NO: 5184285 - DNA, 22 bp, Homo sapiens
agcaatgcttttaatgaattta

SEQ ID NO: 5184286 - DNA, 13 bp, Homo sapiens
agcaatggacctt

SEQ ID NO: 5184287 - DNA, 21 bp, Homo sapiens
agcaatggacggtccgcagaa

SEQ ID NO: 5184288 - DNA, 16 bp, Homo sapiens
agcaatggccagagcc

SEQ ID NO: 5184289 - DNA, 20 bp, Homo sapiens
agcaatggccagagcctctg

SEQ ID NO: 5184290 - DNA, 11 bp, Homo sapiens
agcaatgggac

SEQ ID NO: 5184291 - DNA, 13 bp, Homo sapiens
agcaatgggactg

SEQ ID NO: 5184292 - DNA, 14 bp, Homo sapiens
agcaatgggactgg

SEQ ID NO: 5184293 - DNA, 15 bp, Homo sapiens
agcaatgggactgga

SEQ ID NO: 5184294 - DNA, 13 bp, Homo sapiens
agcaatgggaggg

SEQ ID NO: 5184295 - DNA, 19 bp, Homo sapiens
agcaatgggagggggctcc

SEQ ID NO: 5184296 - DNA, 17 bp, Homo sapiens
agcaatgggatataata

SEQ ID NO: 5184297 - DNA, 21 bp, Homo sapiens
agcaatgggatataatacctt

SEQ ID NO: 5184298 - DNA, 18 bp, Homo sapiens
agcaatggggaatacaag

SEQ ID NO: 5184299 - DNA, 23 bp, Homo sapiens
agcaatggtgtcagtatccaggc

SEQ ID NO: 5184300 - DNA, 14 bp, Homo sapiens
agcaatgtctgtgc

SEQ ID NO: 5184301 - DNA, 16 bp, Homo sapiens
agcaatgtctgtgcta

SEQ ID NO: 5184302 - DNA, 13 bp, Homo sapiens
agcaatgtgagtc

SEQ ID NO: 5184303 - DNA, 15 bp, Homo sapiens
agcaatgtgagtccc

SEQ ID NO: 5184304 - DNA, 16 bp, Homo sapiens
agcaatgtgagtccca

SEQ ID NO: 5184305 - DNA, 11 bp, Homo sapiens
agcaatgtgtt

SEQ ID NO: 5184306 - DNA, 15 bp, Homo sapiens
agcaatgttccagga

SEQ ID NO: 5184307 - DNA, 14 bp, Homo sapiens
agcaatgtttttct

SEQ ID NO: 5184308 - DNA, 21 bp, Homo sapiens
agcaatgtttttctcaaaaag

SEQ ID NO: 5184309 - DNA, 23 bp, Homo sapiens
agcaatgtttttctcaaaaagct

SEQ ID NO: 5184310 - DNA, 14 bp, Homo sapiens
agcaattagcagaa

SEQ ID NO: 5184311 - DNA, 19 bp, Homo sapiens
agcaattaggtagcacagc

SEQ ID NO: 5184312 - DNA, 15 bp, Homo sapiens
agcaattagtgatat

SEQ ID NO: 5184313 - DNA, 14 bp, Homo sapiens
agcaattatattgt

SEQ ID NO: 5184314 - DNA, 15 bp, Homo sapiens
agcaattatgaaaat

SEQ ID NO: 5184315 - DNA, 17 bp, Homo sapiens
agcaattatgaaaataa

SEQ ID NO: 5184316 - DNA, 17 bp, Homo sapiens
agcaattatttaaagaa

SEQ ID NO: 5184317 - DNA, 19 bp, Homo sapiens
agcaattatttaaagaaag

SEQ ID NO: 5184318 - DNA, 14 bp, Homo sapiens
agcaattcatttca

SEQ ID NO: 5184319 - DNA, 18 bp, Homo sapiens
agcaattcatttcacttt

SEQ ID NO: 5184320 - DNA, 23 bp, Homo sapiens
agcaattcatttcactttaaagt

SEQ ID NO: 5184321 - DNA, 14 bp, Homo sapiens
agcaattccaacct

SEQ ID NO: 5184322 - DNA, 18 bp, Homo sapiens
agcaattccaggctgagc

SEQ ID NO: 5184323 - DNA, 13 bp, Homo sapiens
agcaattctaagt

SEQ ID NO: 5184324 - DNA, 17 bp, Homo sapiens
agcaattctcctgcctc

SEQ ID NO: 5184325 - DNA, 19 bp, Homo sapiens
agcaattctcctgcctcag

SEQ ID NO: 5184326 - DNA, 11 bp, Homo sapiens
agcaattctgc

SEQ ID NO: 5184327 - DNA, 16 bp, Homo sapiens
agcaattctttcaagt

SEQ ID NO: 5184328 - DNA, 13 bp, Homo sapiens
agcaattgcagca

SEQ ID NO: 5184329 - DNA, 14 bp, Homo sapiens
agcaattgccctgt

SEQ ID NO: 5184330 - DNA, 15 bp, Homo sapiens
agcaattgccctgta

SEQ ID NO: 5184331 - DNA, 22 bp, Homo sapiens
agcaattgctcatgttggccaa

SEQ ID NO: 5184332 - DNA, 15 bp, Homo sapiens
agcaattgtagacag

SEQ ID NO: 5184333 - DNA, 19 bp, Homo sapiens
agcaatttaaatgttatga

SEQ ID NO: 5184334 - DNA, 18 bp, Homo sapiens
agcaatttactgatgaga

SEQ ID NO: 5184335 - DNA, 21 bp, Homo sapiens
agcaatttactgatgagagaa

SEQ ID NO: 5184336 - DNA, 15 bp, Homo sapiens
agcaatttatatctt

SEQ ID NO: 5184337 - DNA, 17 bp, Homo sapiens
agcaatttatatcttta

SEQ ID NO: 5184338 - DNA, 23 bp, Homo sapiens
agcaatttatatctttatgcaaa

SEQ ID NO: 5184339 - DNA, 24 bp, Homo sapiens
agcaatttccccctaaaccaactg

SEQ ID NO: 5184340 - DNA, 16 bp, Homo sapiens
agcaatttgaaataat

SEQ ID NO: 5184341 - DNA, 16 bp, Homo sapiens
agcaattttctttgtt

SEQ ID NO: 5184342 - DNA, 19 bp, Homo sapiens
agcaattttctttgtttct

SEQ ID NO: 5184343 - DNA, 20 bp, Homo sapiens
agcaattttctttgtttctt

SEQ ID NO: 5184344 - DNA, 21 bp, Homo sapiens
agcaattttgtatccatttaa

SEQ ID NO: 5184345 - DNA, 16 bp, Homo sapiens
agcacaaaaagaaact

SEQ ID NO: 5184346 - DNA, 16 bp, Homo sapiens
agcacaaaagacaagc

SEQ ID NO: 5184347 - DNA, 16 bp, Homo sapiens
agcacaaaagcctctc

SEQ ID NO: 5184348 - DNA, 21 bp, Homo sapiens
agcacaaaatggattttagtc

SEQ ID NO: 5184349 - DNA, 11 bp, Homo sapiens
agcacaaaatt

SEQ ID NO: 5184350 - DNA, 15 bp, Homo sapiens
agcacaaaattcaaa

SEQ ID NO: 5184351 - DNA, 22 bp, Homo sapiens
agcacaaaattcaaagcatgga

SEQ ID NO: 5184352 - DNA, 14 bp, Homo sapiens
agcacaaacacaag

SEQ ID NO: 5184353 - DNA, 21 bp, Homo sapiens
agcacaaacattgctgccttt

SEQ ID NO: 5184354 - DNA, 16 bp, Homo sapiens
agcacaaaccctgggg

SEQ ID NO: 5184355 - DNA, 17 bp, Homo sapiens
agcacaaaccctgggga

SEQ ID NO: 5184356 - DNA, 14 bp, Homo sapiens
agcacaaagcactg

SEQ ID NO: 5184357 - DNA, 15 bp, Homo sapiens
agcacaaagcactgg

SEQ ID NO: 5184358 - DNA, 21 bp, Homo sapiens
agcacaaagttctcagagctc

SEQ ID NO: 5184359 - DNA, 18 bp, Homo sapiens
agcacaaatttcatctcc

SEQ ID NO: 5184360 - DNA, 19 bp, Homo sapiens
agcacaacccccagctccc

SEQ ID NO: 5184361 - DNA, 16 bp, Homo sapiens
agcacaaccggtccct

SEQ ID NO: 5184362 - DNA, 19 bp, Homo sapiens
agcacaaccggtcccttcc

SEQ ID NO: 5184363 - DNA, 18 bp, Homo sapiens
agcacaaccttcaagctg

SEQ ID NO: 5184364 - DNA, 22 bp, Homo sapiens
agcacaaccttcaagctgcttt

SEQ ID NO: 5184365 - DNA, 13 bp, Homo sapiens
agcacaactccct

SEQ ID NO: 5184366 - DNA, 18 bp, Homo sapiens
agcacaagaagcgtgaga

SEQ ID NO: 5184367 - DNA, 17 bp, Homo sapiens
agcacaagactggccca

SEQ ID NO: 5184368 - DNA, 18 bp, Homo sapiens
agcacaagcgtgtttcta

SEQ ID NO: 5184369 - DNA, 13 bp, Homo sapiens
agcacaaggaatt

SEQ ID NO: 5184370 - DNA, 21 bp, Homo sapiens
agcacaaggccttgcctggcc

SEQ ID NO: 5184371 - DNA, 21 bp, Homo sapiens
agcacaagttatttaaatctg

SEQ ID NO: 5184372 - DNA, 17 bp, Homo sapiens
agcacaagttccagctg

SEQ ID NO: 5184373 - DNA, 19 bp, Homo sapiens
agcacaagttccagctggt

SEQ ID NO: 5184374 - DNA, 20 bp, Homo sapiens
agcacaagttccagctggtc

SEQ ID NO: 5184375 - DNA, 18 bp, Homo sapiens
agcacaataaatatactt

SEQ ID NO: 5184376 - DNA, 18 bp, Homo sapiens
agcacaataaatggctgt

SEQ ID NO: 5184377 - DNA, 17 bp, Homo sapiens
agcacaatcaacttttc

SEQ ID NO: 5184378 - DNA, 21 bp, Homo sapiens
agcacaatcctattactcttc

SEQ ID NO: 5184379 - DNA, 15 bp, Homo sapiens
agcacaatctgttct

SEQ ID NO: 5184380 - DNA, 16 bp, Homo sapiens
agcacaattaattaaa

SEQ ID NO: 5184381 - DNA, 14 bp, Homo sapiens
agcacaattcattg

SEQ ID NO: 5184382 - DNA, 22 bp, Homo sapiens
agcacaattctgtccctgtccc

SEQ ID NO: 5184383 - DNA, 14 bp, Homo sapiens
agcacaatttatat

SEQ ID NO: 5184384 - DNA, 22 bp, Homo sapiens
agcacacacaaacctactgccc

SEQ ID NO: 5184385 - DNA, 20 bp, Homo sapiens
agcacacacatctggccctg

SEQ ID NO: 5184386 - DNA, 21 bp, Homo sapiens
agcacacacatctggccctga

SEQ ID NO: 5184387 - DNA, 20 bp, Homo sapiens
agcacacacttttggttaag

SEQ ID NO: 5184388 - DNA, 20 bp, Homo sapiens
agcacacaggtacagcaaca

SEQ ID NO: 5184389 - DNA, 19 bp, Homo sapiens
agcacacatgcatcctccc

SEQ ID NO: 5184390 - DNA, 17 bp, Homo sapiens
agcacaccaagtggctg

SEQ ID NO: 5184391 - DNA, 19 bp, Homo sapiens
agcacaccaatcttacttt

SEQ ID NO: 5184392 - DNA, 16 bp, Homo sapiens
agcacaccacaattct

SEQ ID NO: 5184393 - DNA, 15 bp, Homo sapiens
agcacaccagccgct

SEQ ID NO: 5184394 - DNA, 17 bp, Homo sapiens
agcacaccagccgctgc

SEQ ID NO: 5184395 - DNA, 20 bp, Homo sapiens
agcacaccagccgctgcagg

SEQ ID NO: 5184396 - DNA, 14 bp, Homo sapiens
agcacaccccaagg

SEQ ID NO: 5184397 - DNA, 17 bp, Homo sapiens
agcacaccccaagggac

SEQ ID NO: 5184398 - DNA, 16 bp, Homo sapiens
agcacacccttagcct

SEQ ID NO: 5184399 - DNA, 23 bp, Homo sapiens
agcacacccttcacactgttatc

SEQ ID NO: 5184400 - DNA, 15 bp, Homo sapiens
agcacacctcagccc

SEQ ID NO: 5184401 - DNA, 18 bp, Homo sapiens
agcacacctcagccccac

SEQ ID NO: 5184402 - DNA, 23 bp, Homo sapiens
agcacacctcggccgaggcctgc

SEQ ID NO: 5184403 - DNA, 13 bp, Homo sapiens
agcacacctctgg

SEQ ID NO: 5184404 - DNA, 21 bp, Homo sapiens
agcacacctgaatcagctgga

SEQ ID NO: 5184405 - DNA, 18 bp, Homo sapiens
agcacacggtgagggtgc

SEQ ID NO: 5184406 - DNA, 20 bp, Homo sapiens
agcacactcatcccctcact

SEQ ID NO: 5184407 - DNA, 15 bp, Homo sapiens
agcacactgcagggc

SEQ ID NO: 5184408 - DNA, 19 bp, Homo sapiens
agcacactgcagggctgct

SEQ ID NO: 5184409 - DNA, 12 bp, Homo sapiens
agcacactggct

SEQ ID NO: 5184410 - DNA, 19 bp, Homo sapiens
agcacactgtagcattaca

SEQ ID NO: 5184411 - DNA, 19 bp, Homo sapiens
agcacagaaacagaggaga

SEQ ID NO: 5184412 - DNA, 18 bp, Homo sapiens
agcacagaaatctgaaaa

SEQ ID NO: 5184413 - DNA, 23 bp, Homo sapiens
agcacagaaggaatctgtgcaga

SEQ ID NO: 5184414 - DNA, 13 bp, Homo sapiens
agcacagaaggag

SEQ ID NO: 5184415 - DNA, 23 bp, Homo sapiens
agcacagacaattctaatggtaa

SEQ ID NO: 5184416 - DNA, 21 bp, Homo sapiens
agcacagaccctgccctgtgg

SEQ ID NO: 5184417 - DNA, 21 bp, Homo sapiens
agcacagacggaggaagccgc

SEQ ID NO: 5184418 - DNA, 23 bp, Homo sapiens
agcacagactgttccctccaagg

SEQ ID NO: 5184419 - DNA, 16 bp, Homo sapiens
agcacagagagcggct

SEQ ID NO: 5184420 - DNA, 21 bp, Homo sapiens
agcacagagagcggcttcccc

SEQ ID NO: 5184421 - DNA, 16 bp, Homo sapiens
agcacagagagggaca

SEQ ID NO: 5184422 - DNA, 19 bp, Homo sapiens
agcacagagagggggccac

SEQ ID NO: 5184423 - DNA, 12 bp, Homo sapiens
agcacagagagt

SEQ ID NO: 5184424 - DNA, 22 bp, Homo sapiens
agcacagagccctgaggggctg

SEQ ID NO: 5184425 - DNA, 16 bp, Homo sapiens
agcacagagcctggcc

SEQ ID NO: 5184426 - DNA, 20 bp, Homo sapiens
agcacagagcctggccccag

SEQ ID NO: 5184427 - DNA, 22 bp, Homo sapiens
agcacagagcctggccccaggc

SEQ ID NO: 5184428 - DNA, 18 bp, Homo sapiens
agcacagaggcctcctgt

SEQ ID NO: 5184429 - DNA, 15 bp, Homo sapiens
agcacagaggcctga

SEQ ID NO: 5184430 - DNA, 13 bp, Homo sapiens
agcacagagggct

SEQ ID NO: 5184431 - DNA, 17 bp, Homo sapiens
agcacagagtcgctggc

SEQ ID NO: 5184432 - DNA, 17 bp, Homo sapiens
agcacagatggccagcc

SEQ ID NO: 5184433 - DNA, 20 bp, Homo sapiens
agcacagatggccagcccct

SEQ ID NO: 5184434 - DNA, 13 bp, Homo sapiens
agcacagatttgc

SEQ ID NO: 5184435 - DNA, 22 bp, Homo sapiens
agcacagattttaattgtcatg

SEQ ID NO: 5184436 - DNA, 16 bp, Homo sapiens
agcacagattttgaat

SEQ ID NO: 5184437 - DNA, 19 bp, Homo sapiens
agcacagcactttggtttt

SEQ ID NO: 5184438 - DNA, 12 bp, Homo sapiens
agcacagcagcc

SEQ ID NO: 5184439 - DNA, 15 bp, Homo sapiens
agcacagcagcctgg

SEQ ID NO: 5184440 - DNA, 23 bp, Homo sapiens
agcacagcagcctggggctggcc

SEQ ID NO: 5184441 - DNA, 22 bp, Homo sapiens
agcacagcagtggagagtgttc

SEQ ID NO: 5184442 - DNA, 12 bp, Homo sapiens
agcacagccacc

SEQ ID NO: 5184443 - DNA, 13 bp, Homo sapiens
agcacagccacct

SEQ ID NO: 5184444 - DNA, 19 bp, Homo sapiens
agcacagccacctccgcca

SEQ ID NO: 5184445 - DNA, 23 bp, Homo sapiens
agcacagccacctccgccagacc

SEQ ID NO: 5184446 - DNA, 13 bp, Homo sapiens
agcacagccatag

SEQ ID NO: 5184447 - DNA, 14 bp, Homo sapiens
agcacagccatagc

SEQ ID NO: 5184448 - DNA, 12 bp, Homo sapiens
agcacagccctc

SEQ ID NO: 5184449 - DNA, 21 bp, Homo sapiens
agcacagccctcccgcccctt

SEQ ID NO: 5184450 - DNA, 14 bp, Homo sapiens
agcacagccctggg

SEQ ID NO: 5184451 - DNA, 17 bp, Homo sapiens
agcacagccctgggagg

SEQ ID NO: 5184452 - DNA, 22 bp, Homo sapiens
agcacagccctgggagggggct

SEQ ID NO: 5184453 - DNA, 12 bp, Homo sapiens
agcacagcctag

SEQ ID NO: 5184454 - DNA, 17 bp, Homo sapiens
agcacagcctcacccct

SEQ ID NO: 5184455 - DNA, 20 bp, Homo sapiens
agcacagcgtttacatattt

SEQ ID NO: 5184456 - DNA, 14 bp, Homo sapiens
agagcctgactgtg

SEQ ID NO: 5184457 - DNA, 15 bp, Homo sapiens
agagcctgagagtga

SEQ ID NO: 5184458 - DNA, 13 bp, Homo sapiens
agagcctgatctc

SEQ ID NO: 5184459 - DNA, 14 bp, Homo sapiens
agagcctgatctct

SEQ ID NO: 5184460 - DNA, 16 bp, Homo sapiens
agagcctgcaggatct

SEQ ID NO: 5184461 - DNA, 17 bp, Homo sapiens
agagcctgcaggtgctg

SEQ ID NO: 5184462 - DNA, 19 bp, Homo sapiens
agagcctgcaggtgctgct

SEQ ID NO: 5184463 - DNA, 15 bp, Homo sapiens
agagcctgcccggcc

SEQ ID NO: 5184464 - DNA, 19 bp, Homo sapiens
agagcctgcccggccggag

SEQ ID NO: 5184465 - DNA, 20 bp, Homo sapiens
agagcctgcccggccggaga

SEQ ID NO: 5184466 - DNA, 12 bp, Homo sapiens
agagcctgccta

SEQ ID NO: 5184467 - DNA, 19 bp, Homo sapiens
agagcctgcctaaccaggc

SEQ ID NO: 5184468 - DNA, 20 bp, Homo sapiens
agagcctgcctaaccaggcc

SEQ ID NO: 5184469 - DNA, 21 bp, Homo sapiens
agagcctgcctaaccaggccc

SEQ ID NO: 5184470 - DNA, 23 bp, Homo sapiens
agagcctgcctaaccaggcccag

SEQ ID NO: 5184471 - DNA, 16 bp, Homo sapiens
agagcctgcctggagc

SEQ ID NO: 5184472 - DNA, 17 bp, Homo sapiens
agagcctgcctggagcg

SEQ ID NO: 5184473 - DNA, 12 bp, Homo sapiens
agagcctgctgc

SEQ ID NO: 5184474 - DNA, 17 bp, Homo sapiens
agagcctgctgcatggg

SEQ ID NO: 5184475 - DNA, 13 bp, Homo sapiens
agagcctgctgga

SEQ ID NO: 5184476 - DNA, 13 bp, Homo sapiens
agagcctggcaag

SEQ ID NO: 5184477 - DNA, 15 bp, Homo sapiens
agagcctggccccag

SEQ ID NO: 5184478 - DNA, 10 bp, Homo sapiens
agagcctggg

SEQ ID NO: 5184479 - DNA, 12 bp, Homo sapiens
agagcctggggc

SEQ ID NO: 5184480 - DNA, 23 bp, Homo sapiens
agagcctggggctctaacgcctg

SEQ ID NO: 5184481 - DNA, 12 bp, Homo sapiens
agagcctggggt

SEQ ID NO: 5184482 - DNA, 18 bp, Homo sapiens
agagcctggggtgttctc

SEQ ID NO: 5184483 - DNA, 16 bp, Homo sapiens
agagcctggtgctgct

SEQ ID NO: 5184484 - DNA, 20 bp, Homo sapiens
agagcctggttgcccaggga

SEQ ID NO: 5184485 - DNA, 12 bp, Homo sapiens
agagcctgtcac

SEQ ID NO: 5184486 - DNA, 15 bp, Homo sapiens
agagcctgtccccgc

SEQ ID NO: 5184487 - DNA, 12 bp, Homo sapiens
agagcctgtgga

SEQ ID NO: 5184488 - DNA, 13 bp, Homo sapiens
agagcctgtggag

SEQ ID NO: 5184489 - DNA, 19 bp, Homo sapiens
agagcctgtggaggggctt

SEQ ID NO: 5184490 - DNA, 15 bp, Homo sapiens
agagccttcaagtgc

SEQ ID NO: 5184491 - DNA, 20 bp, Homo sapiens
agagccttcacatgaaatta

SEQ ID NO: 5184492 - DNA, 14 bp, Homo sapiens
agagccttcagcct

SEQ ID NO: 5184493 - DNA, 20 bp, Homo sapiens
agagccttccacagtgaatg

SEQ ID NO: 5184494 - DNA, 17 bp, Homo sapiens
agagccttccacccagg

SEQ ID NO: 5184495 - DNA, 13 bp, Homo sapiens
agagccttccagg

SEQ ID NO: 5184496 - DNA, 17 bp, Homo sapiens
agagccttccatgacct

SEQ ID NO: 5184497 - DNA, 18 bp, Homo sapiens
agagccttctcagaagca

SEQ ID NO: 5184498 - DNA, 11 bp, Homo sapiens
agagccttgcg

SEQ ID NO: 5184499 - DNA, 18 bp, Homo sapiens
agagccttgggagccact

SEQ ID NO: 5184500 - DNA, 19 bp, Homo sapiens
agagccttgggagccactg

SEQ ID NO: 5184501 - DNA, 22 bp, Homo sapiens
agagcctttatagattatatga

SEQ ID NO: 5184502 - DNA, 19 bp, Homo sapiens
agagcctttctccagccca

SEQ ID NO: 5184503 - DNA, 23 bp, Homo sapiens
agagcctttctccagcccatgct

SEQ ID NO: 5184504 - DNA, 19 bp, Homo sapiens
agagcctttggtgaataac

SEQ ID NO: 5184505 - DNA, 15 bp, Homo sapiens
agagccttttgtgca

SEQ ID NO: 5184506 - DNA, 20 bp, Homo sapiens
agagcctttttacctggcct

SEQ ID NO: 5184507 - DNA, 17 bp, Homo sapiens
agagcgagagtctgtct

SEQ ID NO: 5184508 - DNA, 12 bp, Homo sapiens
agagcgccagct

SEQ ID NO: 5184509 - DNA, 14 bp, Homo sapiens
agagcgccaggaag

SEQ ID NO: 5184510 - DNA, 18 bp, Homo sapiens
agagcgccgtgagttctc

SEQ ID NO: 5184511 - DNA, 20 bp, Homo sapiens
agagcgccgtgagttctcag

SEQ ID NO: 5184512 - DNA, 21 bp, Homo sapiens
agagcgccgtgagttctcagg

SEQ ID NO: 5184513 - DNA, 22 bp, Homo sapiens
agagcgccgtgagttctcaggg

SEQ ID NO: 5184514 - DNA, 21 bp, Homo sapiens
agagcgcctgcccctcccaga

SEQ ID NO: 5184515 - DNA, 23 bp, Homo sapiens
agagcgcctgcccctcccagaac

SEQ ID NO: 5184516 - DNA, 16 bp, Homo sapiens
agagcgcggctggctc

SEQ ID NO: 5184517 - DNA, 15 bp, Homo sapiens
agagcgcgggagaga

SEQ ID NO: 5184518 - DNA, 16 bp, Homo sapiens
agagcgctcctctgcc

SEQ ID NO: 5184519 - DNA, 18 bp, Homo sapiens
agagcgctcctctgcctt

SEQ ID NO: 5184520 - DNA, 14 bp, Homo sapiens
agagcgctggcctc

SEQ ID NO: 5184521 - DNA, 15 bp, Homo sapiens
agagcgctggcctct

SEQ ID NO: 5184522 - DNA, 12 bp, Homo sapiens
agagcggaggag

SEQ ID NO: 5184523 - DNA, 19 bp, Homo sapiens
agagcggaggctgtgtgcc

SEQ ID NO: 5184524 - DNA, 16 bp, Homo sapiens
agagcggctggagaaa

SEQ ID NO: 5184525 - DNA, 17 bp, Homo sapiens
agagcgggactctgtcc

SEQ ID NO: 5184526 - DNA, 19 bp, Homo sapiens
agagcgggactctgtccaa

SEQ ID NO: 5184527 - DNA, 14 bp, Homo sapiens
agagcggggaggtg

SEQ ID NO: 5184528 - DNA, 18 bp, Homo sapiens
agagcggggaggtgcctg

SEQ ID NO: 5184529 - DNA, 17 bp, Homo sapiens
agagcgtccttccccct

SEQ ID NO: 5184530 - DNA, 13 bp, Homo sapiens
agagcgtccttgg

SEQ ID NO: 5184531 - DNA, 21 bp, Homo sapiens
agagcgtgctccagcctggct

SEQ ID NO: 5184532 - DNA, 20 bp, Homo sapiens
agagcgtggctgtgctctca

SEQ ID NO: 5184533 - DNA, 13 bp, Homo sapiens
agagcgtttggtt

SEQ ID NO: 5184534 - DNA, 18 bp, Homo sapiens
agagctaaaaaggccctt

SEQ ID NO: 5184535 - DNA, 21 bp, Homo sapiens
agagctaacagacatagactg

SEQ ID NO: 5184536 - DNA, 18 bp, Homo sapiens
agagctaagggtgggtgc

SEQ ID NO: 5184537 - DNA, 22 bp, Homo sapiens
agagctaagggtgggtgctcag

SEQ ID NO: 5184538 - DNA, 23 bp, Homo sapiens
agagctaagggtgggtgctcaga

SEQ ID NO: 5184539 - DNA, 20 bp, Homo sapiens
agagctaataaatctcttct

SEQ ID NO: 5184540 - DNA, 20 bp, Homo sapiens
agagctacactcgccttctg

SEQ ID NO: 5184541 - DNA, 23 bp, Homo sapiens
agagctactgagacttggaacct

SEQ ID NO: 5184542 - DNA, 17 bp, Homo sapiens
agagctacttctaatta

SEQ ID NO: 5184543 - DNA, 16 bp, Homo sapiens
agagctacttgggcca

SEQ ID NO: 5184544 - DNA, 16 bp, Homo sapiens
agagctagaaaaataa

SEQ ID NO: 5184545 - DNA, 20 bp, Homo sapiens
agagctagcagcagggaggg

SEQ ID NO: 5184546 - DNA, 16 bp, Homo sapiens
agagctagctgccact

SEQ ID NO: 5184547 - DNA, 23 bp, Homo sapiens
agagctagctgccactttcacgt

SEQ ID NO: 5184548 - DNA, 19 bp, Homo sapiens
agagctaggaaccctggag

SEQ ID NO: 5184549 - DNA, 21 bp, Homo sapiens
agagctaggagcaaagcctgt

SEQ ID NO: 5184550 - DNA, 14 bp, Homo sapiens
agagctagggctgc

SEQ ID NO: 5184551 - DNA, 18 bp, Homo sapiens
agagctagggctgctgct

SEQ ID NO: 5184552 - DNA, 20 bp, Homo sapiens
agagctagggctgctgcttc

SEQ ID NO: 5184553 - DNA, 19 bp, Homo sapiens
agagctatacagttttcct

SEQ ID NO: 5184554 - DNA, 19 bp, Homo sapiens
agagctatatccttaacca

SEQ ID NO: 5184555 - DNA, 17 bp, Homo sapiens
agagctatcaggagaaa

SEQ ID NO: 5184556 - DNA, 15 bp, Homo sapiens
agagctatgttccct

SEQ ID NO: 5184557 - DNA, 13 bp, Homo sapiens
agagctattttag

SEQ ID NO: 5184558 - DNA, 21 bp, Homo sapiens
agagctattttagaaagctaa

SEQ ID NO: 5184559 - DNA, 12 bp, Homo sapiens
agagctcagagg

SEQ ID NO: 5184560 - DNA, 16 bp, Homo sapiens
agagctcagcctgcct

SEQ ID NO: 5184561 - DNA, 20 bp, Homo sapiens
agagctcaggagaaggcctg

SEQ ID NO: 5184562 - DNA, 18 bp, Homo sapiens
agagctcagtacagggca

SEQ ID NO: 5184563 - DNA, 17 bp, Homo sapiens
agagctcagtatactaa

SEQ ID NO: 5184564 - DNA, 21 bp, Homo sapiens
agagctcagtatactaatgcc

SEQ ID NO: 5184565 - DNA, 15 bp, Homo sapiens
agagctcatcccccc

SEQ ID NO: 5184566 - DNA, 22 bp, Homo sapiens
agagctcatcccccctgctgcc

SEQ ID NO: 5184567 - DNA, 14 bp, Homo sapiens
agagctccacagaa

SEQ ID NO: 5184568 - DNA, 12 bp, Homo sapiens
agagctcccagg

SEQ ID NO: 5184569 - DNA, 14 bp, Homo sapiens
agagctcccaggac

SEQ ID NO: 5184570 - DNA, 22 bp, Homo sapiens
agagctcccccgtggtgcctgc

SEQ ID NO: 5184571 - DNA, 16 bp, Homo sapiens
agagctcccgaggaag

SEQ ID NO: 5184572 - DNA, 20 bp, Homo sapiens
agagctcccgaggaagcaca

SEQ ID NO: 5184573 - DNA, 14 bp, Homo sapiens
agagctccgatgcc

SEQ ID NO: 5184574 - DNA, 23 bp, Homo sapiens
agagctcctccttgtcttggcag

SEQ ID NO: 5184575 - DNA, 15 bp, Homo sapiens
agagctcctgtccct

SEQ ID NO: 5184576 - DNA, 16 bp, Homo sapiens
agagctcctgtcccta

SEQ ID NO: 5184577 - DNA, 18 bp, Homo sapiens
agagctcctgtccctacc

SEQ ID NO: 5184578 - DNA, 21 bp, Homo sapiens
agagctcctgtccctacccac

SEQ ID NO: 5184579 - DNA, 22 bp, Homo sapiens
agagctcctgtccctacccact

SEQ ID NO: 5184580 - DNA, 19 bp, Homo sapiens
agagctcgctcttgggagt

SEQ ID NO: 5184581 - DNA, 17 bp, Homo sapiens
agagctctacaggcctg

SEQ ID NO: 5184582 - DNA, 15 bp, Homo sapiens
agagctctccagaag

SEQ ID NO: 5184583 - DNA, 22 bp, Homo sapiens
agagctctcccctcctgctggg

SEQ ID NO: 5184584 - DNA, 23 bp, Homo sapiens
agagctctcccctcctgctgggc

SEQ ID NO: 5184585 - DNA, 13 bp, Homo sapiens
agagctctctcta

SEQ ID NO: 5184586 - DNA, 22 bp, Homo sapiens
agagctctctctacagagagga

SEQ ID NO: 5184587 - DNA, 14 bp, Homo sapiens
agagctctctcttc

SEQ ID NO: 5184588 - DNA, 22 bp, Homo sapiens
agagctctgacccacagcctcc

SEQ ID NO: 5184589 - DNA, 14 bp, Homo sapiens
agagctctggagcc

SEQ ID NO: 5184590 - DNA, 20 bp, Homo sapiens
agagctctggccccgctagc

SEQ ID NO: 5184591 - DNA, 19 bp, Homo sapiens
agagctcttcaagctgtcc

SEQ ID NO: 5184592 - DNA, 22 bp, Homo sapiens
agagctcttcaagctgtcccct

SEQ ID NO: 5184593 - DNA, 20 bp, Homo sapiens
agagctcttcggtttctgag

SEQ ID NO: 5184594 - DNA, 12 bp, Homo sapiens
agagctcttggc

SEQ ID NO: 5184595 - DNA, 14 bp, Homo sapiens
agagctcttggccc

SEQ ID NO: 5184596 - DNA, 22 bp, Homo sapiens
agagctcttgtgttcagaagaa

SEQ ID NO: 5184597 - DNA, 21 bp, Homo sapiens
agagctcttttttagctctct

SEQ ID NO: 5184598 - DNA, 19 bp, Homo sapiens
agagctgaaccttgagggg

SEQ ID NO: 5184599 - DNA, 21 bp, Homo sapiens
agagctgaagagttgccccgt

SEQ ID NO: 5184600 - DNA, 23 bp, Homo sapiens
agagctgaaggttgtggcctttg

SEQ ID NO: 5184601 - DNA, 16 bp, Homo sapiens
agagctgacgggaggc

SEQ ID NO: 5184602 - DNA, 19 bp, Homo sapiens
agagctgacgggaggcccc

SEQ ID NO: 5184603 - DNA, 21 bp, Homo sapiens
agagctgagagtctgaaagac

SEQ ID NO: 5184604 - DNA, 12 bp, Homo sapiens
agagctgagcca

SEQ ID NO: 5184605 - DNA, 19 bp, Homo sapiens
agagctgaggatttcctgg

SEQ ID NO: 5184606 - DNA, 23 bp, Homo sapiens
agagctgaggatttcctggagtg

SEQ ID NO: 5184607 - DNA, 11 bp, Homo sapiens
agagctgaggc

SEQ ID NO: 5184608 - DNA, 19 bp, Homo sapiens
agagctgagggccctgtgg

SEQ ID NO: 5184609 - DNA, 21 bp, Homo sapiens
agagctgagtactcaggccac

SEQ ID NO: 5184610 - DNA, 22 bp, Homo sapiens
agagctgagtggcagccgcctc

SEQ ID NO: 5184611 - DNA, 14 bp, Homo sapiens
agagctgatccaga

SEQ ID NO: 5184612 - DNA, 18 bp, Homo sapiens
agagctgatccagagcac

SEQ ID NO: 5184613 - DNA, 21 bp, Homo sapiens
agagctgatccagagcacaga

SEQ ID NO: 5184614 - DNA, 20 bp, Homo sapiens
agagctgatggagaaggaag

SEQ ID NO: 5184615 - DNA, 21 bp, Homo sapiens
agagctgatggagaaggaagg

SEQ ID NO: 5184616 - DNA, 15 bp, Homo sapiens
agagctgcacagcaa

SEQ ID NO: 5184617 - DNA, 23 bp, Homo sapiens
agagctgcataatgtccctctct

SEQ ID NO: 5184618 - DNA, 18 bp, Homo sapiens
agagctgccacctgcctg

SEQ ID NO: 5184619 - DNA, 13 bp, Homo sapiens
agagctgccactg

SEQ ID NO: 5184620 - DNA, 20 bp, Homo sapiens
agagctgccctccttgtcca

SEQ ID NO: 5184621 - DNA, 14 bp, Homo sapiens
agagctgccctctc

SEQ ID NO: 5184622 - DNA, 16 bp, Homo sapiens
agagctgccctctcct

SEQ ID NO: 5184623 - DNA, 19 bp, Homo sapiens
agagctgccctctcctggg

SEQ ID NO: 5184624 - DNA, 22 bp, Homo sapiens
agagctgccctctcctgggcag

SEQ ID NO: 5184625 - DNA, 11 bp, Homo sapiens
agagctgcctc

SEQ ID NO: 5184626 - DNA, 16 bp, Homo sapiens
agagctgcctccccaa

SEQ ID NO: 5184627 - DNA, 14 bp, Homo sapiens
agagctgctctgga

SEQ ID NO: 5184628 - DNA, 11 bp, Homo sapiens
agagctgctga

SEQ ID NO: 5184629 - DNA, 12 bp, Homo sapiens
agagctgctgag

SEQ ID NO: 5184630 - DNA, 21 bp, Homo sapiens
agagctgctgagggaccttgg

SEQ ID NO: 5184631 - DNA, 20 bp, Homo sapiens
agagctgctgcacacactca

SEQ ID NO: 5184632 - DNA, 22 bp, Homo sapiens
agagctgctgcacacactcacc

SEQ ID NO: 5184633 - DNA, 15 bp, Homo sapiens
agagctggaacacaa

SEQ ID NO: 5184634 - DNA, 21 bp, Homo sapiens
agcacagctcaggaactagac

SEQ ID NO: 5184635 - DNA, 15 bp, Homo sapiens
agcacagctccctgc

SEQ ID NO: 5184636 - DNA, 14 bp, Homo sapiens
agcacagctccctt

SEQ ID NO: 5184637 - DNA, 18 bp, Homo sapiens
agcacagctcctcccctg

SEQ ID NO: 5184638 - DNA, 20 bp, Homo sapiens
agcacagctcctcccctgcc

SEQ ID NO: 5184639 - DNA, 21 bp, Homo sapiens
agcacagctcctcccctgccg

SEQ ID NO: 5184640 - DNA, 15 bp, Homo sapiens
agcacagctcctgcc

SEQ ID NO: 5184641 - DNA, 18 bp, Homo sapiens
agcacagctcctgccagg

SEQ ID NO: 5184642 - DNA, 20 bp, Homo sapiens
agcacagctgaggaccctca

SEQ ID NO: 5184643 - DNA, 23 bp, Homo sapiens
agcacagctgaggaccctcagcc

SEQ ID NO: 5184644 - DNA, 13 bp, Homo sapiens
agcacagctgtat

SEQ ID NO: 5184645 - DNA, 20 bp, Homo sapiens
agcacagctgtgaggacaga

SEQ ID NO: 5184646 - DNA, 16 bp, Homo sapiens
agcacagcttcatttc

SEQ ID NO: 5184647 - DNA, 18 bp, Homo sapiens
agcacagcttgggtcagg

SEQ ID NO: 5184648 - DNA, 20 bp, Homo sapiens
agcacagcttgggtcaggtt

SEQ ID NO: 5184649 - DNA, 17 bp, Homo sapiens
agcacaggaattctcaa

SEQ ID NO: 5184650 - DNA, 16 bp, Homo sapiens
agcacaggcaacatta

SEQ ID NO: 5184651 - DNA, 21 bp, Homo sapiens
agcacaggcaacattacaaac

SEQ ID NO: 5184652 - DNA, 23 bp, Homo sapiens
agcacaggcaacattacaaacaa

SEQ ID NO: 5184653 - DNA, 13 bp, Homo sapiens
agcacaggccagg

SEQ ID NO: 5184654 - DNA, 12 bp, Homo sapiens
agcacaggctaa

SEQ ID NO: 5184655 - DNA, 17 bp, Homo sapiens
agcacaggctaattttt

SEQ ID NO: 5184656 - DNA, 18 bp, Homo sapiens
agcacaggctgagtgcag

SEQ ID NO: 5184657 - DNA, 21 bp, Homo sapiens
agcacaggctgagtgcaggcc

SEQ ID NO: 5184658 - DNA, 23 bp, Homo sapiens
agcacaggctgagtgcaggccca

SEQ ID NO: 5184659 - DNA, 16 bp, Homo sapiens
agcacagggcaggggt

SEQ ID NO: 5184660 - DNA, 12 bp, Homo sapiens
agcacaggggcc

SEQ ID NO: 5184661 - DNA, 19 bp, Homo sapiens
agcacaggtgggcttccca

SEQ ID NO: 5184662 - DNA, 20 bp, Homo sapiens
agcacaggtgtctgcctaga

SEQ ID NO: 5184663 - DNA, 19 bp, Homo sapiens
agcacaggttagggtgtgt

SEQ ID NO: 5184664 - DNA, 22 bp, Homo sapiens
agcacaggttagggtgtgtgcc

SEQ ID NO: 5184665 - DNA, 15 bp, Homo sapiens
agcacagtatttaac

SEQ ID NO: 5184666 - DNA, 20 bp, Homo sapiens
agcacagtatttaacattct

SEQ ID NO: 5184667 - DNA, 15 bp, Homo sapiens
agcacagtggtggca

SEQ ID NO: 5184668 - DNA, 17 bp, Homo sapiens
agcacagtggtggcagg

SEQ ID NO: 5184669 - DNA, 18 bp, Homo sapiens
agcacagtggtggcaggg

SEQ ID NO: 5184670 - DNA, 20 bp, Homo sapiens
agcacagtggtggcagggcc

SEQ ID NO: 5184671 - DNA, 17 bp, Homo sapiens
agcacataatgtccaga

SEQ ID NO: 5184672 - DNA, 16 bp, Homo sapiens
agcacatacattaaaa

SEQ ID NO: 5184673 - DNA, 19 bp, Homo sapiens
agcacatacggcagacctc

SEQ ID NO: 5184674 - DNA, 13 bp, Homo sapiens
agcacatactacc

SEQ ID NO: 5184675 - DNA, 15 bp, Homo sapiens
agcacatagatgtct

SEQ ID NO: 5184676 - DNA, 15 bp, Homo sapiens
agcacatagccctgt

SEQ ID NO: 5184677 - DNA, 22 bp, Homo sapiens
agcacatagccctgttgacctg

SEQ ID NO: 5184678 - DNA, 23 bp, Homo sapiens
agcacatcacctctttgcccccg

SEQ ID NO: 5184679 - DNA, 22 bp, Homo sapiens
agcacatcactgagaagatggc

SEQ ID NO: 5184680 - DNA, 19 bp, Homo sapiens
agcacatcatggcagtggg

SEQ ID NO: 5184681 - DNA, 17 bp, Homo sapiens
agcacatccaccaaact

SEQ ID NO: 5184682 - DNA, 20 bp, Homo sapiens
agcacatccaccaaactcct

SEQ ID NO: 5184683 - DNA, 16 bp, Homo sapiens
agcacatccacccagg

SEQ ID NO: 5184684 - DNA, 18 bp, Homo sapiens
agcacatccccctctcct

SEQ ID NO: 5184685 - DNA, 23 bp, Homo sapiens
agcacatctcaacaggcctcagg

SEQ ID NO: 5184686 - DNA, 18 bp, Homo sapiens
agcacatctctctgccct

SEQ ID NO: 5184687 - DNA, 13 bp, Homo sapiens
agcacatctggga

SEQ ID NO: 5184688 - DNA, 23 bp, Homo sapiens
agcacatgaaaccttattttttc

SEQ ID NO: 5184689 - DNA, 18 bp, Homo sapiens
agcacatgcactactgaa

SEQ ID NO: 5184690 - DNA, 15 bp, Homo sapiens
agcacatgccaggga

SEQ ID NO: 5184691 - DNA, 23 bp, Homo sapiens
agcacatgccagggaaaaagacc

SEQ ID NO: 5184692 - DNA, 23 bp, Homo sapiens
agcacatgccctaatgtctgtat

SEQ ID NO: 5184693 - DNA, 19 bp, Homo sapiens
agcacatgcctctctcagg

SEQ ID NO: 5184694 - DNA, 22 bp, Homo sapiens
agcacatgcctctctcaggcca

SEQ ID NO: 5184695 - DNA, 16 bp, Homo sapiens
agcacatgctggccag

SEQ ID NO: 5184696 - DNA, 20 bp, Homo sapiens
agcacatgctggccagcctg

SEQ ID NO: 5184697 - DNA, 22 bp, Homo sapiens
agcacatggccatagaggccca

SEQ ID NO: 5184698 - DNA, 23 bp, Homo sapiens
agcacatggtttaaatatgaatg

SEQ ID NO: 5184699 - DNA, 15 bp, Homo sapiens
agcacatgtaataaa

SEQ ID NO: 5184700 - DNA, 21 bp, Homo sapiens
agcacatgtctgtcctcagag

SEQ ID NO: 5184701 - DNA, 22 bp, Homo sapiens
agcacatgtctgtcctcagagc

SEQ ID NO: 5184702 - DNA, 16 bp, Homo sapiens
agcacatgttttacaa

SEQ ID NO: 5184703 - DNA, 19 bp, Homo sapiens
agcacatgttttacaaaga

SEQ ID NO: 5184704 - DNA, 16 bp, Homo sapiens
agcacattccacggca

SEQ ID NO: 5184705 - DNA, 23 bp, Homo sapiens
agcacattcgggaccaatatata

SEQ ID NO: 5184706 - DNA, 17 bp, Homo sapiens
agcacattgccctgagg

SEQ ID NO: 5184707 - DNA, 14 bp, Homo sapiens
agcacatttcctct

SEQ ID NO: 5184708 - DNA, 17 bp, Homo sapiens
agcacatttcctctcta

SEQ ID NO: 5184709 - DNA, 19 bp, Homo sapiens
agcacatttgttaatgatt

SEQ ID NO: 5184710 - DNA, 23 bp, Homo sapiens
agcaccaaaaaactaaagcagtt

SEQ ID NO: 5184711 - DNA, 22 bp, Homo sapiens
agcaccaaaagcttaccaaggg

SEQ ID NO: 5184712 - DNA, 17 bp, Homo sapiens
agcaccaaatcaaaatc

SEQ ID NO: 5184713 - DNA, 15 bp, Homo sapiens
agcaccaacctccag

SEQ ID NO: 5184714 - DNA, 23 bp, Homo sapiens
agcaccaagagcagctgggaact

SEQ ID NO: 5184715 - DNA, 14 bp, Homo sapiens
agcaccaagcatgt

SEQ ID NO: 5184716 - DNA, 16 bp, Homo sapiens
agcaccaatcatgaat

SEQ ID NO: 5184717 - DNA, 17 bp, Homo sapiens
agcaccacattgcctca

SEQ ID NO: 5184718 - DNA, 18 bp, Homo sapiens
agcaccacattgcctcat

SEQ ID NO: 5184719 - DNA, 15 bp, Homo sapiens
agcaccaccagggct

SEQ ID NO: 5184720 - DNA, 18 bp, Homo sapiens
agcaccaccagggctcca

SEQ ID NO: 5184721 - DNA, 15 bp, Homo sapiens
agcaccaccaggtct

SEQ ID NO: 5184722 - DNA, 20 bp, Homo sapiens
agcaccaccaggtctcccgg

SEQ ID NO: 5184723 - DNA, 18 bp, Homo sapiens
agcaccaccatttaattt

SEQ ID NO: 5184724 - DNA, 18 bp, Homo sapiens
agcaccaccctccttccc

SEQ ID NO: 5184725 - DNA, 21 bp, Homo sapiens
agcaccacctacacaggagtc

SEQ ID NO: 5184726 - DNA, 17 bp, Homo sapiens
agcaccacggccagaag

SEQ ID NO: 5184727 - DNA, 22 bp, Homo sapiens
agcaccacggggtcgggggagg

SEQ ID NO: 5184728 - DNA, 18 bp, Homo sapiens
agcaccactctgggcaca

SEQ ID NO: 5184729 - DNA, 19 bp, Homo sapiens
agcaccactctgggcacaa

SEQ ID NO: 5184730 - DNA, 16 bp, Homo sapiens
agcaccactgctgagg

SEQ ID NO: 5184731 - DNA, 17 bp, Homo sapiens
agcaccactgctgagga

SEQ ID NO: 5184732 - DNA, 15 bp, Homo sapiens
agcaccagcctcagt

SEQ ID NO: 5184733 - DNA, 21 bp, Homo sapiens
agcaccagcctgagccacagt

SEQ ID NO: 5184734 - DNA, 21 bp, Homo sapiens
agcaccagcttctccaggctc

SEQ ID NO: 5184735 - DNA, 12 bp, Homo sapiens
agcaccagggaa

SEQ ID NO: 5184736 - DNA, 21 bp, Homo sapiens
agcaccagttatgtttgaatg

SEQ ID NO: 5184737 - DNA, 16 bp, Homo sapiens
agcaccatctctcctc

SEQ ID NO: 5184738 - DNA, 20 bp, Homo sapiens
agcaccattttaagtccctg

SEQ ID NO: 5184739 - DNA, 19 bp, Homo sapiens
agcacccactgtgcaccag

SEQ ID NO: 5184740 - DNA, 22 bp, Homo sapiens
agcacccagagcaccccctgct

SEQ ID NO: 5184741 - DNA, 20 bp, Homo sapiens
agcacccagatcagactctc

SEQ ID NO: 5184742 - DNA, 20 bp, Homo sapiens
agcacccagtcctctgcctc

SEQ ID NO: 5184743 - DNA, 14 bp, Homo sapiens
agcacccatttcaa

SEQ ID NO: 5184744 - DNA, 21 bp, Homo sapiens
agcacccatttcaatgtgtat

SEQ ID NO: 5184745 - DNA, 14 bp, Homo sapiens
agcaccccaaggct

SEQ ID NO: 5184746 - DNA, 18 bp, Homo sapiens
agcaccccactcctcagt

SEQ ID NO: 5184747 - DNA, 10 bp, Homo sapiens
agcaccccag

SEQ ID NO: 5184748 - DNA, 13 bp, Homo sapiens
agcaccccagacc

SEQ ID NO: 5184749 - DNA, 20 bp, Homo sapiens
agcaccccatagagttgtga

SEQ ID NO: 5184750 - DNA, 19 bp, Homo sapiens
agcaccccatgccaaagct

SEQ ID NO: 5184751 - DNA, 15 bp, Homo sapiens
agcacccccacccac

SEQ ID NO: 5184752 - DNA, 17 bp, Homo sapiens
agcacccccacccacct

SEQ ID NO: 5184753 - DNA, 19 bp, Homo sapiens
agcacccccacccacctcc

SEQ ID NO: 5184754 - DNA, 11 bp, Homo sapiens
agcacccccag

SEQ ID NO: 5184755 - DNA, 16 bp, Homo sapiens
agcacccccagcctcc

SEQ ID NO: 5184756 - DNA, 21 bp, Homo sapiens
agcacccccagcctcccccag

SEQ ID NO: 5184757 - DNA, 16 bp, Homo sapiens
agcaccccctcattcc

SEQ ID NO: 5184758 - DNA, 21 bp, Homo sapiens
agcaccccctgctccaccagc

SEQ ID NO: 5184759 - DNA, 23 bp, Homo sapiens
agcaccccgaagggagcatctgt

SEQ ID NO: 5184760 - DNA, 16 bp, Homo sapiens
agcacccctctctgca

SEQ ID NO: 5184761 - DNA, 13 bp, Homo sapiens
agcacccctgtct

SEQ ID NO: 5184762 - DNA, 14 bp, Homo sapiens
agcaccccttccat

SEQ ID NO: 5184763 - DNA, 15 bp, Homo sapiens
agcacccgggctcag

SEQ ID NO: 5184764 - DNA, 17 bp, Homo sapiens
agcacccgggctcaggg

SEQ ID NO: 5184765 - DNA, 18 bp, Homo sapiens
agcaccctcccccgcagc

SEQ ID NO: 5184766 - DNA, 15 bp, Homo sapiens
agcaccctcgagaag

SEQ ID NO: 5184767 - DNA, 17 bp, Homo sapiens
agcaccctcgagaaggg

SEQ ID NO: 5184768 - DNA, 14 bp, Homo sapiens
agcaccctctcctg

SEQ ID NO: 5184769 - DNA, 15 bp, Homo sapiens
agcaccctctcctgg

SEQ ID NO: 5184770 - DNA, 23 bp, Homo sapiens
agcaccctgccctcatgggacct

SEQ ID NO: 5184771 - DNA, 17 bp, Homo sapiens
agcaccctgggtgccat

SEQ ID NO: 5184772 - DNA, 14 bp, Homo sapiens
agcaccctgtcttc

SEQ ID NO: 5184773 - DNA, 14 bp, Homo sapiens
agcaccgaggggcc

SEQ ID NO: 5184774 - DNA, 18 bp, Homo sapiens
agcaccgaggggcctttg

SEQ ID NO: 5184775 - DNA, 18 bp, Homo sapiens
agcaccgcagcctctgcc

SEQ ID NO: 5184776 - DNA, 12 bp, Homo sapiens
agcaccgccggc

SEQ ID NO: 5184777 - DNA, 16 bp, Homo sapiens
agcaccgcctcttccc

SEQ ID NO: 5184778 - DNA, 18 bp, Homo sapiens
agcaccgcctcttcccgc

SEQ ID NO: 5184779 - DNA, 16 bp, Homo sapiens
agcaccggaccagcct

SEQ ID NO: 5184780 - DNA, 23 bp, Homo sapiens
agcaccgtgatggagaggacaga

SEQ ID NO: 5184781 - DNA, 20 bp, Homo sapiens
agcaccgtggtgtgaggccc

SEQ ID NO: 5184782 - DNA, 22 bp, Homo sapiens
agcaccgtggtgtgaggccccc

SEQ ID NO: 5184783 - DNA, 18 bp, Homo sapiens
agcacctaaacttacatt

SEQ ID NO: 5184784 - DNA, 20 bp, Homo sapiens
agcacctactatgtgctggg

SEQ ID NO: 5184785 - DNA, 14 bp, Homo sapiens
agcacctaggtggg

SEQ ID NO: 5184786 - DNA, 18 bp, Homo sapiens
agcacctagtccagtgac

SEQ ID NO: 5184787 - DNA, 14 bp, Homo sapiens
agcacctatgaaag

SEQ ID NO: 5184788 - DNA, 14 bp, Homo sapiens
agcacctcaagtgc

SEQ ID NO: 5184789 - DNA, 12 bp, Homo sapiens
agcacctcagga

SEQ ID NO: 5184790 - DNA, 16 bp, Homo sapiens
agcacctccagcctga

SEQ ID NO: 5184791 - DNA, 20 bp, Homo sapiens
agcacctccagcctgaacag

SEQ ID NO: 5184792 - DNA, 17 bp, Homo sapiens
agcacctccaggcctgt

SEQ ID NO: 5184793 - DNA, 21 bp, Homo sapiens
agcacctccattaaagtctga

SEQ ID NO: 5184794 - DNA, 16 bp, Homo sapiens
agcacctcccagcccc

SEQ ID NO: 5184795 - DNA, 14 bp, Homo sapiens
agcacctccccaga

SEQ ID NO: 5184796 - DNA, 15 bp, Homo sapiens
agcacctccccagac

SEQ ID NO: 5184797 - DNA, 21 bp, Homo sapiens
agcacctccccagacagggct

SEQ ID NO: 5184798 - DNA, 16 bp, Homo sapiens
agcacctccccagatg

SEQ ID NO: 5184799 - DNA, 15 bp, Homo sapiens
agcacctcctcagcc

SEQ ID NO: 5184800 - DNA, 16 bp, Homo sapiens
agcacctcctcagcct

SEQ ID NO: 5184801 - DNA, 15 bp, Homo sapiens
agcacctcctctctg

SEQ ID NO: 5184802 - DNA, 13 bp, Homo sapiens
agcacctctcaga

SEQ ID NO: 5184803 - DNA, 15 bp, Homo sapiens
agcacctctcagagc

SEQ ID NO: 5184804 - DNA, 21 bp, Homo sapiens
agcacctctcagagcaagcct

SEQ ID NO: 5184805 - DNA, 13 bp, Homo sapiens
agcacctctcagc

SEQ ID NO: 5184806 - DNA, 14 bp, Homo sapiens
agcacctgagaaga

SEQ ID NO: 5184807 - DNA, 17 bp, Homo sapiens
agcacctgagaagagga

SEQ ID NO: 5184808 - DNA, 12 bp, Homo sapiens
agcacctgccag

SEQ ID NO: 5184809 - DNA, 13 bp, Homo sapiens
agcacctgccaga

SEQ ID NO: 5184810 - DNA, 22 bp, Homo sapiens
agcacctgccctacctgcccca

SEQ ID NO: 5184811 - DNA, 11 bp, Homo sapiens
agcacctgccg

SEQ ID NO: 5184812 - DNA, 22 bp, Homo sapiens
agagctggaaggcagggcagag

SEQ ID NO: 5184813 - DNA, 23 bp, Homo sapiens
agagctggaaggcagggcagagg

SEQ ID NO: 5184814 - DNA, 21 bp, Homo sapiens
agagctggagatgaggccaga

SEQ ID NO: 5184815 - DNA, 17 bp, Homo sapiens
agagctggagcctggtg

SEQ ID NO: 5184816 - DNA, 18 bp, Homo sapiens
agagctggagtctgggct

SEQ ID NO: 5184817 - DNA, 20 bp, Homo sapiens
agagctggcaaactgtgaat

SEQ ID NO: 5184818 - DNA, 15 bp, Homo sapiens
agagctggcaaaggt

SEQ ID NO: 5184819 - DNA, 22 bp, Homo sapiens
agagctggcagtgtgcggagct

SEQ ID NO: 5184820 - DNA, 17 bp, Homo sapiens
agagctggcctccccca

SEQ ID NO: 5184821 - DNA, 17 bp, Homo sapiens
agagctggcgctcagca

SEQ ID NO: 5184822 - DNA, 18 bp, Homo sapiens
agagctggcgctcagcag

SEQ ID NO: 5184823 - DNA, 20 bp, Homo sapiens
agagctggcgctcagcagcc

SEQ ID NO: 5184824 - DNA, 24 bp, Homo sapiens
agagctggcgctcagcagccctag

SEQ ID NO: 5184825 - DNA, 16 bp, Homo sapiens
agagctggctctgagc

SEQ ID NO: 5184826 - DNA, 20 bp, Homo sapiens
agagctgggaaacagggagc

SEQ ID NO: 5184827 - DNA, 20 bp, Homo sapiens
agagctgggaaattcatgtg

SEQ ID NO: 5184828 - DNA, 15 bp, Homo sapiens
agagctgggactcag

SEQ ID NO: 5184829 - DNA, 24 bp, Homo sapiens
agagctgggactcagttcttggcc

SEQ ID NO: 5184830 - DNA, 18 bp, Homo sapiens
agagctgggatcccacag

SEQ ID NO: 5184831 - DNA, 22 bp, Homo sapiens
agagctgggatcccacagccct

SEQ ID NO: 5184832 - DNA, 23 bp, Homo sapiens
agagctgggatcccacagcccta

SEQ ID NO: 5184833 - DNA, 10 bp, Homo sapiens
agagctgggc

SEQ ID NO: 5184834 - DNA, 15 bp, Homo sapiens
agagctgggcagaca

SEQ ID NO: 5184835 - DNA, 20 bp, Homo sapiens
agagctgggcagacaggtgg

SEQ ID NO: 5184836 - DNA, 21 bp, Homo sapiens
agagctgggcagacaggtggg

SEQ ID NO: 5184837 - DNA, 19 bp, Homo sapiens
agagctggggctgccagcc

SEQ ID NO: 5184838 - DNA, 21 bp, Homo sapiens
agagctggggctgccagcctg

SEQ ID NO: 5184839 - DNA, 22 bp, Homo sapiens
agagctggggctgccagcctga

SEQ ID NO: 5184840 - DNA, 19 bp, Homo sapiens
agagctgggtaccaggcca

SEQ ID NO: 5184841 - DNA, 11 bp, Homo sapiens
agagctgggtg

SEQ ID NO: 5184842 - DNA, 12 bp, Homo sapiens
agagctgggtga

SEQ ID NO: 5184843 - DNA, 14 bp, Homo sapiens
agagctgggtgggg

SEQ ID NO: 5184844 - DNA, 20 bp, Homo sapiens
agagctggtgactttgggga

SEQ ID NO: 5184845 - DNA, 13 bp, Homo sapiens
agagctggtgccc

SEQ ID NO: 5184846 - DNA, 18 bp, Homo sapiens
agagctggtgcggctggc

SEQ ID NO: 5184847 - DNA, 14 bp, Homo sapiens
agagctggtggttt

SEQ ID NO: 5184848 - DNA, 16 bp, Homo sapiens
agagctggttgggaag

SEQ ID NO: 5184849 - DNA, 21 bp, Homo sapiens
agagctgtattaagtgactga

SEQ ID NO: 5184850 - DNA, 22 bp, Homo sapiens
agagctgtattaagtgactgac

SEQ ID NO: 5184851 - DNA, 18 bp, Homo sapiens
agagctgtctatgcagcc

SEQ ID NO: 5184852 - DNA, 21 bp, Homo sapiens
agagctgtctatgcagcctgc

SEQ ID NO: 5184853 - DNA, 16 bp, Homo sapiens
agagctgtctgaactc

SEQ ID NO: 5184854 - DNA, 17 bp, Homo sapiens
agagctgtctgaactca

SEQ ID NO: 5184855 - DNA, 15 bp, Homo sapiens
agagctgtcttcccc

SEQ ID NO: 5184856 - DNA, 21 bp, Homo sapiens
agagctgtcttcccctgagag

SEQ ID NO: 5184857 - DNA, 17 bp, Homo sapiens
agagctgtgccagcagg

SEQ ID NO: 5184858 - DNA, 12 bp, Homo sapiens
agagctgtgcct

SEQ ID NO: 5184859 - DNA, 19 bp, Homo sapiens
agagctgtgcctgctcagc

SEQ ID NO: 5184860 - DNA, 21 bp, Homo sapiens
agagctgtgcctgctcagcag

SEQ ID NO: 5184861 - DNA, 22 bp, Homo sapiens
agagctgtgcctgctcagcagc

SEQ ID NO: 5184862 - DNA, 22 bp, Homo sapiens
agagctgtgggcaaaagagtgt

SEQ ID NO: 5184863 - DNA, 18 bp, Homo sapiens
agagctgttataaattta

SEQ ID NO: 5184864 - DNA, 14 bp, Homo sapiens
agagctgttatgct

SEQ ID NO: 5184865 - DNA, 16 bp, Homo sapiens
agagctgttatgctgt

SEQ ID NO: 5184866 - DNA, 18 bp, Homo sapiens
agagctgttatgctgttt

SEQ ID NO: 5184867 - DNA, 23 bp, Homo sapiens
agagctgttatgctgtttcctag

SEQ ID NO: 5184868 - DNA, 19 bp, Homo sapiens
agagctgttcgctcctccc

SEQ ID NO: 5184869 - DNA, 21 bp, Homo sapiens
agagctgttcgctcctcccag

SEQ ID NO: 5184870 - DNA, 19 bp, Homo sapiens
agagctgttctttttgact

SEQ ID NO: 5184871 - DNA, 19 bp, Homo sapiens
agagctgtttatggcctca

SEQ ID NO: 5184872 - DNA, 20 bp, Homo sapiens
agagctgtttatggcctcag

SEQ ID NO: 5184873 - DNA, 17 bp, Homo sapiens
agagctgttttggatga

SEQ ID NO: 5184874 - DNA, 15 bp, Homo sapiens
agagcttaacagtgt

SEQ ID NO: 5184875 - DNA, 14 bp, Homo sapiens
agagcttagaaact

SEQ ID NO: 5184876 - DNA, 18 bp, Homo sapiens
agagcttagaaactggaa

SEQ ID NO: 5184877 - DNA, 14 bp, Homo sapiens
agagcttagatttc

SEQ ID NO: 5184878 - DNA, 18 bp, Homo sapiens
agagcttagcctggagca

SEQ ID NO: 5184879 - DNA, 19 bp, Homo sapiens
agagcttattggccactgg

SEQ ID NO: 5184880 - DNA, 19 bp, Homo sapiens
agagcttcaggccccagga

SEQ ID NO: 5184881 - DNA, 22 bp, Homo sapiens
agagcttcagggctgggcaggt

SEQ ID NO: 5184882 - DNA, 15 bp, Homo sapiens
agagcttccactgtc

SEQ ID NO: 5184883 - DNA, 21 bp, Homo sapiens
agagcttccagagctctgacc

SEQ ID NO: 5184884 - DNA, 13 bp, Homo sapiens
agagcttcccagg

SEQ ID NO: 5184885 - DNA, 23 bp, Homo sapiens
agagcttcccctaacctgggttg

SEQ ID NO: 5184886 - DNA, 12 bp, Homo sapiens
agagcttccctg

SEQ ID NO: 5184887 - DNA, 16 bp, Homo sapiens
agagcttccctgactc

SEQ ID NO: 5184888 - DNA, 20 bp, Homo sapiens
agagcttccctgactcattc

SEQ ID NO: 5184889 - DNA, 14 bp, Homo sapiens
agagcttctcctga

SEQ ID NO: 5184890 - DNA, 17 bp, Homo sapiens
agagcttctcctgacca

SEQ ID NO: 5184891 - DNA, 18 bp, Homo sapiens
agagcttctctgggctga

SEQ ID NO: 5184892 - DNA, 17 bp, Homo sapiens
agagcttctgtattttc

SEQ ID NO: 5184893 - DNA, 18 bp, Homo sapiens
agagcttctgtattttca

SEQ ID NO: 5184894 - DNA, 19 bp, Homo sapiens
agagcttctgttgctgcct

SEQ ID NO: 5184895 - DNA, 20 bp, Homo sapiens
agagcttctgttgctgcctc

SEQ ID NO: 5184896 - DNA, 22 bp, Homo sapiens
agagcttctgttgctgcctcat

SEQ ID NO: 5184897 - DNA, 17 bp, Homo sapiens
agagcttgaggtgggag

SEQ ID NO: 5184898 - DNA, 22 bp, Homo sapiens
agagcttgatctgtgatttctt

SEQ ID NO: 5184899 - DNA, 17 bp, Homo sapiens
agagcttgatgcctccc

SEQ ID NO: 5184900 - DNA, 21 bp, Homo sapiens
agagcttgatgcctcccggct

SEQ ID NO: 5184901 - DNA, 21 bp, Homo sapiens
agagcttgcagtgaagtgttc

SEQ ID NO: 5184902 - DNA, 18 bp, Homo sapiens
agagcttggacagtctga

SEQ ID NO: 5184903 - DNA, 13 bp, Homo sapiens
agagcttggactg

SEQ ID NO: 5184904 - DNA, 14 bp, Homo sapiens
agagcttggactgg

SEQ ID NO: 5184905 - DNA, 19 bp, Homo sapiens
agagcttgtagccctggat

SEQ ID NO: 5184906 - DNA, 14 bp, Homo sapiens
agagcttgtggaaa

SEQ ID NO: 5184907 - DNA, 17 bp, Homo sapiens
agagctttacaaaaaga

SEQ ID NO: 5184908 - DNA, 23 bp, Homo sapiens
agagctttctgtccttttggcac

SEQ ID NO: 5184909 - DNA, 16 bp, Homo sapiens
agagctttctttcaca

SEQ ID NO: 5184910 - DNA, 13 bp, Homo sapiens
agagctttgtcac

SEQ ID NO: 5184911 - DNA, 19 bp, Homo sapiens
agagctttgtcacttgcca

SEQ ID NO: 5184912 - DNA, 15 bp, Homo sapiens
agagctttgtgcttg

SEQ ID NO: 5184913 - DNA, 20 bp, Homo sapiens
agagctttgtgcttgtcatt

SEQ ID NO: 5184914 - DNA, 16 bp, Homo sapiens
agagcttttcactgtg

SEQ ID NO: 5184915 - DNA, 13 bp, Homo sapiens
agagcttttcaga

SEQ ID NO: 5184916 - DNA, 20 bp, Homo sapiens
agagcttttcgaactgtgct

SEQ ID NO: 5184917 - DNA, 20 bp, Homo sapiens
agagctttttaatagcacta

SEQ ID NO: 5184918 - DNA, 17 bp, Homo sapiens
agagcttttttataaca

SEQ ID NO: 5184919 - DNA, 14 bp, Homo sapiens
agaggaaaaagaaa

SEQ ID NO: 5184920 - DNA, 15 bp, Homo sapiens
agaggaaaaagaaaa

SEQ ID NO: 5184921 - DNA, 16 bp, Homo sapiens
agaggaaaaagaaaaa

SEQ ID NO: 5184922 - DNA, 23 bp, Homo sapiens
agaggaaaaatgggagccaggag

SEQ ID NO: 5184923 - DNA, 15 bp, Homo sapiens
agaggaaaagactcc

SEQ ID NO: 5184924 - DNA, 19 bp, Homo sapiens
agaggaaaagtaaggtgca

SEQ ID NO: 5184925 - DNA, 22 bp, Homo sapiens
agaggaaaagtaaggtgcagtt

SEQ ID NO: 5184926 - DNA, 14 bp, Homo sapiens
agaggaaaatcaat

SEQ ID NO: 5184927 - DNA, 16 bp, Homo sapiens
agaggaaaatgaataa

SEQ ID NO: 5184928 - DNA, 20 bp, Homo sapiens
agaggaaacttaagcataaa

SEQ ID NO: 5184929 - DNA, 23 bp, Homo sapiens
agaggaaataagaaaaatcatgt

SEQ ID NO: 5184930 - DNA, 20 bp, Homo sapiens
agaggaaatattgctggggt

SEQ ID NO: 5184931 - DNA, 21 bp, Homo sapiens
agaggaaatcaccgaaaacgt

SEQ ID NO: 5184932 - DNA, 23 bp, Homo sapiens
agaggaaattaaataattttaca

SEQ ID NO: 5184933 - DNA, 16 bp, Homo sapiens
agaggaaattcaaatc

SEQ ID NO: 5184934 - DNA, 21 bp, Homo sapiens
agaggaacagcactggggagt

SEQ ID NO: 5184935 - DNA, 20 bp, Homo sapiens
agaggaacccccaccagaca

SEQ ID NO: 5184936 - DNA, 15 bp, Homo sapiens
agaggaacgtgccac

SEQ ID NO: 5184937 - DNA, 17 bp, Homo sapiens
agaggaactccttggcc

SEQ ID NO: 5184938 - DNA, 13 bp, Homo sapiens
agaggaactgggc

SEQ ID NO: 5184939 - DNA, 15 bp, Homo sapiens
agaggaactgtccag

SEQ ID NO: 5184940 - DNA, 20 bp, Homo sapiens
agaggaactgtccagagagc

SEQ ID NO: 5184941 - DNA, 12 bp, Homo sapiens
agaggaagaaat

SEQ ID NO: 5184942 - DNA, 14 bp, Homo sapiens
agaggaagaaatgt

SEQ ID NO: 5184943 - DNA, 15 bp, Homo sapiens
agaggaagaaattca

SEQ ID NO: 5184944 - DNA, 22 bp, Homo sapiens
agaggaagaatttgttatcagt

SEQ ID NO: 5184945 - DNA, 18 bp, Homo sapiens
agaggaagacgagacagg

SEQ ID NO: 5184946 - DNA, 22 bp, Homo sapiens
agaggaagatgaagagaagctg

SEQ ID NO: 5184947 - DNA, 15 bp, Homo sapiens
agaggaagccagtgg

SEQ ID NO: 5184948 - DNA, 19 bp, Homo sapiens
agaggaagccagtggagct

SEQ ID NO: 5184949 - DNA, 14 bp, Homo sapiens
agaggaagcccagc

SEQ ID NO: 5184950 - DNA, 20 bp, Homo sapiens
agaggaaggaaacatagaaa

SEQ ID NO: 5184951 - DNA, 13 bp, Homo sapiens
agaggaaggaccc

SEQ ID NO: 5184952 - DNA, 19 bp, Homo sapiens
agaggaaggacccctcacc

SEQ ID NO: 5184953 - DNA, 16 bp, Homo sapiens
agaggaaggagaggag

SEQ ID NO: 5184954 - DNA, 14 bp, Homo sapiens
agaggaaggagatt

SEQ ID NO: 5184955 - DNA, 10 bp, Homo sapiens
agaggaaggc

SEQ ID NO: 5184956 - DNA, 13 bp, Homo sapiens
agaggaaggctga

SEQ ID NO: 5184957 - DNA, 14 bp, Homo sapiens
agaggaagggaggc

SEQ ID NO: 5184958 - DNA, 16 bp, Homo sapiens
agaggaaggggtgctg

SEQ ID NO: 5184959 - DNA, 13 bp, Homo sapiens
agaggaagggtgg

SEQ ID NO: 5184960 - DNA, 17 bp, Homo sapiens
agaggaagttaaaattt

SEQ ID NO: 5184961 - DNA, 18 bp, Homo sapiens
agaggaagttagagataa

SEQ ID NO: 5184962 - DNA, 15 bp, Homo sapiens
agaggaagttcagat

SEQ ID NO: 5184963 - DNA, 18 bp, Homo sapiens
agaggaagttcagatctt

SEQ ID NO: 5184964 - DNA, 16 bp, Homo sapiens
agaggaataaaatgat

SEQ ID NO: 5184965 - DNA, 21 bp, Homo sapiens
agaggaataaagctgtgagca

SEQ ID NO: 5184966 - DNA, 23 bp, Homo sapiens
agaggaatcagacttcacactgc

SEQ ID NO: 5184967 - DNA, 19 bp, Homo sapiens
agaggaatccatgaagaat

SEQ ID NO: 5184968 - DNA, 15 bp, Homo sapiens
agaggaatgaaaaaa

SEQ ID NO: 5184969 - DNA, 19 bp, Homo sapiens
agaggaatgatgggctttt

SEQ ID NO: 5184970 - DNA, 16 bp, Homo sapiens
agaggaatgtgggcta

SEQ ID NO: 5184971 - DNA, 18 bp, Homo sapiens
agaggaattacgtgctct

SEQ ID NO: 5184972 - DNA, 14 bp, Homo sapiens
agaggaattatgaa

SEQ ID NO: 5184973 - DNA, 18 bp, Homo sapiens
agaggaatttggctgctt

SEQ ID NO: 5184974 - DNA, 15 bp, Homo sapiens
agaggacaaaataaa

SEQ ID NO: 5184975 - DNA, 16 bp, Homo sapiens
agaggacaaaataaag

SEQ ID NO: 5184976 - DNA, 21 bp, Homo sapiens
agaggacaaggaagtgggggc

SEQ ID NO: 5184977 - DNA, 14 bp, Homo sapiens
agaggacacaatgg

SEQ ID NO: 5184978 - DNA, 20 bp, Homo sapiens
agaggacactagatgatatt

SEQ ID NO: 5184979 - DNA, 20 bp, Homo sapiens
agaggacacttcaaactgcg

SEQ ID NO: 5184980 - DNA, 23 bp, Homo sapiens
agaggacagagcaggggctccag

SEQ ID NO: 5184981 - DNA, 18 bp, Homo sapiens
agaggacagatcaatggc

SEQ ID NO: 5184982 - DNA, 16 bp, Homo sapiens
agaggacagtctggag

SEQ ID NO: 5184983 - DNA, 14 bp, Homo sapiens
agaggacagtgctg

SEQ ID NO: 5184984 - DNA, 15 bp, Homo sapiens
agaggacagtgctga

SEQ ID NO: 5184985 - DNA, 12 bp, Homo sapiens
agaggacatcac

SEQ ID NO: 5184986 - DNA, 14 bp, Homo sapiens
agaggaccaatgct

SEQ ID NO: 5184987 - DNA, 17 bp, Homo sapiens
agaggaccagaggagca

SEQ ID NO: 5184988 - DNA, 12 bp, Homo sapiens
agaggaccagca

SEQ ID NO: 5184989 - DNA, 15 bp, Homo sapiens
agaggaccccagggt

SEQ ID NO: 5184990 - DNA, 21 bp, Homo sapiens
agcacctgccgacctcgtcct

SEQ ID NO: 5184991 - DNA, 22 bp, Homo sapiens
agcacctgccgacctcgtcctc

SEQ ID NO: 5184992 - DNA, 14 bp, Homo sapiens
agcacctgcctcct

SEQ ID NO: 5184993 - DNA, 18 bp, Homo sapiens
agcacctgcctcctcgtt

SEQ ID NO: 5184994 - DNA, 20 bp, Homo sapiens
agcacctgcttcatgctcag

SEQ ID NO: 5184995 - DNA, 20 bp, Homo sapiens
agcacctggaccccctgccc

SEQ ID NO: 5184996 - DNA, 23 bp, Homo sapiens
agcacctggaccccctgcccgcc

SEQ ID NO: 5184997 - DNA, 12 bp, Homo sapiens
agcacctggagc

SEQ ID NO: 5184998 - DNA, 21 bp, Homo sapiens
agcacctggaggggcaccagg

SEQ ID NO: 5184999 - DNA, 22 bp, Homo sapiens
agcacctgggccccactggaca

SEQ ID NO: 5185000 - DNA, 23 bp, Homo sapiens
agcacctgggccccactggacaa

SEQ ID NO: 5185001 - DNA, 20 bp, Homo sapiens
agcacctgggctgaggaggc

SEQ ID NO: 5185002 - DNA, 21 bp, Homo sapiens
agcacctgggtgtgctccagg

SEQ ID NO: 5185003 - DNA, 18 bp, Homo sapiens
agcacctgttgtgtgcct

SEQ ID NO: 5185004 - DNA, 19 bp, Homo sapiens
agcacctgttgtgtgcctg

SEQ ID NO: 5185005 - DNA, 13 bp, Homo sapiens
agcaccttaatat

SEQ ID NO: 5185006 - DNA, 21 bp, Homo sapiens
agcaccttcaagcgctccagg

SEQ ID NO: 5185007 - DNA, 18 bp, Homo sapiens
agcaccttcagggctgag

SEQ ID NO: 5185008 - DNA, 16 bp, Homo sapiens
agcaccttctttctgg

SEQ ID NO: 5185009 - DNA, 17 bp, Homo sapiens
agcaccttctttctgga

SEQ ID NO: 5185010 - DNA, 14 bp, Homo sapiens
agcaccttgaatgg

SEQ ID NO: 5185011 - DNA, 16 bp, Homo sapiens
agcaccttgaatggaa

SEQ ID NO: 5185012 - DNA, 13 bp, Homo sapiens
agcacctttagaa

SEQ ID NO: 5185013 - DNA, 14 bp, Homo sapiens
agcacctttctagc

SEQ ID NO: 5185014 - DNA, 17 bp, Homo sapiens
agcacctttctctgaga

SEQ ID NO: 5185015 - DNA, 20 bp, Homo sapiens
agcacctttctggcttttaa

SEQ ID NO: 5185016 - DNA, 19 bp, Homo sapiens
agcacctttgcacaggatg

SEQ ID NO: 5185017 - DNA, 17 bp, Homo sapiens
agcacgaaatgttattt

SEQ ID NO: 5185018 - DNA, 18 bp, Homo sapiens
agcacgaaatgttatttt

SEQ ID NO: 5185019 - DNA, 15 bp, Homo sapiens
agcacgagcctgggc

SEQ ID NO: 5185020 - DNA, 21 bp, Homo sapiens
agcacgatttctgtttagata

SEQ ID NO: 5185021 - DNA, 18 bp, Homo sapiens
agcacgattttgcacaaa

SEQ ID NO: 5185022 - DNA, 16 bp, Homo sapiens
agcacgcatgtccctc

SEQ ID NO: 5185023 - DNA, 18 bp, Homo sapiens
agcacgccaaccccagca

SEQ ID NO: 5185024 - DNA, 13 bp, Homo sapiens
agcacgcctctcc

SEQ ID NO: 5185025 - DNA, 15 bp, Homo sapiens
agcacgcctctcccc

SEQ ID NO: 5185026 - DNA, 18 bp, Homo sapiens
agcacgcctctccccacc

SEQ ID NO: 5185027 - DNA, 16 bp, Homo sapiens
agcacgcctgccatct

SEQ ID NO: 5185028 - DNA, 19 bp, Homo sapiens
agcacgcgacttctcagga

SEQ ID NO: 5185029 - DNA, 23 bp, Homo sapiens
agcacgctgcctgccaaagtagt

SEQ ID NO: 5185030 - DNA, 18 bp, Homo sapiens
agcacgggacggaagtgc

SEQ ID NO: 5185031 - DNA, 18 bp, Homo sapiens
agcacgggcacagctgct

SEQ ID NO: 5185032 - DNA, 22 bp, Homo sapiens
agcacgggcacagctgctgtgc

SEQ ID NO: 5185033 - DNA, 14 bp, Homo sapiens
agcacggggaggaa

SEQ ID NO: 5185034 - DNA, 23 bp, Homo sapiens
agcacgggttaagatctgaaagt

SEQ ID NO: 5185035 - DNA, 15 bp, Homo sapiens
agcacggtgcctccg

SEQ ID NO: 5185036 - DNA, 16 bp, Homo sapiens
agcacggttgcctgag

SEQ ID NO: 5185037 - DNA, 17 bp, Homo sapiens
agcacggttgcctgagg

SEQ ID NO: 5185038 - DNA, 15 bp, Homo sapiens
agcacgtctcagaga

SEQ ID NO: 5185039 - DNA, 17 bp, Homo sapiens
agcacgtggagatagtg

SEQ ID NO: 5185040 - DNA, 17 bp, Homo sapiens
agcacgtggtaaaacac

SEQ ID NO: 5185041 - DNA, 17 bp, Homo sapiens
agcacgttctccagact

SEQ ID NO: 5185042 - DNA, 16 bp, Homo sapiens
agcacgttggcgagga

SEQ ID NO: 5185043 - DNA, 16 bp, Homo sapiens
agcacgtttaaagttc

SEQ ID NO: 5185044 - DNA, 17 bp, Homo sapiens
agcacgtttaaagttct

SEQ ID NO: 5185045 - DNA, 13 bp, Homo sapiens
agcacgttttctg

SEQ ID NO: 5185046 - DNA, 15 bp, Homo sapiens
agcacgttttctggc

SEQ ID NO: 5185047 - DNA, 20 bp, Homo sapiens
agcacgttttctggcttctg

SEQ ID NO: 5185048 - DNA, 19 bp, Homo sapiens
agcactaaccaatgccttt

SEQ ID NO: 5185049 - DNA, 22 bp, Homo sapiens
agcactaaggtggacagcagac

SEQ ID NO: 5185050 - DNA, 20 bp, Homo sapiens
agcactaaggtgtgctctga

SEQ ID NO: 5185051 - DNA, 21 bp, Homo sapiens
agcactacataaactgacttt

SEQ ID NO: 5185052 - DNA, 16 bp, Homo sapiens
agcactactgggtgtc

SEQ ID NO: 5185053 - DNA, 17 bp, Homo sapiens
agcactactgggtgtca

SEQ ID NO: 5185054 - DNA, 18 bp, Homo sapiens
agcactactgggtgtcat

SEQ ID NO: 5185055 - DNA, 20 bp, Homo sapiens
agcactactgggtgtcattt

SEQ ID NO: 5185056 - DNA, 23 bp, Homo sapiens
agcactactgggtgtcatttcat

SEQ ID NO: 5185057 - DNA, 19 bp, Homo sapiens
agcactagaaattgggcag

SEQ ID NO: 5185058 - DNA, 14 bp, Homo sapiens
agcactagaagtgg

SEQ ID NO: 5185059 - DNA, 18 bp, Homo sapiens
agcactagaatgagaaat

SEQ ID NO: 5185060 - DNA, 17 bp, Homo sapiens
agcactagagaatgcac

SEQ ID NO: 5185061 - DNA, 22 bp, Homo sapiens
agcactagagtcacccccccag

SEQ ID NO: 5185062 - DNA, 17 bp, Homo sapiens
agcactagccttcccag

SEQ ID NO: 5185063 - DNA, 20 bp, Homo sapiens
agcactagttgtgaatttag

SEQ ID NO: 5185064 - DNA, 14 bp, Homo sapiens
agcactatacagat

SEQ ID NO: 5185065 - DNA, 20 bp, Homo sapiens
agcactatctttcaggaaat

SEQ ID NO: 5185066 - DNA, 17 bp, Homo sapiens
agcactatgctttcctt

SEQ ID NO: 5185067 - DNA, 16 bp, Homo sapiens
agcactatttaaaata

SEQ ID NO: 5185068 - DNA, 22 bp, Homo sapiens
agcactcaaacctggagctgag

SEQ ID NO: 5185069 - DNA, 14 bp, Homo sapiens
agcactcaagaccc

SEQ ID NO: 5185070 - DNA, 14 bp, Homo sapiens
agcactcaataaag

SEQ ID NO: 5185071 - DNA, 15 bp, Homo sapiens
agcactcaataaagt

SEQ ID NO: 5185072 - DNA, 18 bp, Homo sapiens
agcactcacgccctaagc

SEQ ID NO: 5185073 - DNA, 22 bp, Homo sapiens
agcactcagaaaagaaaaccat

SEQ ID NO: 5185074 - DNA, 14 bp, Homo sapiens
agcactcagcctca

SEQ ID NO: 5185075 - DNA, 17 bp, Homo sapiens
agcactcaggctctcca

SEQ ID NO: 5185076 - DNA, 17 bp, Homo sapiens
agcactccatcactgag

SEQ ID NO: 5185077 - DNA, 18 bp, Homo sapiens
agcactcccagggcccga

SEQ ID NO: 5185078 - DNA, 21 bp, Homo sapiens
agcactccccagagctgtgcc

SEQ ID NO: 5185079 - DNA, 16 bp, Homo sapiens
agcactccccttgcct

SEQ ID NO: 5185080 - DNA, 19 bp, Homo sapiens
agcactccccttgccttcc

SEQ ID NO: 5185081 - DNA, 20 bp, Homo sapiens
agcactccccttgccttccc

SEQ ID NO: 5185082 - DNA, 15 bp, Homo sapiens
agcactcccgctgca

SEQ ID NO: 5185083 - DNA, 21 bp, Homo sapiens
agcactcccttaggcattatt

SEQ ID NO: 5185084 - DNA, 17 bp, Homo sapiens
agcactcctcaagactt

SEQ ID NO: 5185085 - DNA, 19 bp, Homo sapiens
agcactcctcaagactttg

SEQ ID NO: 5185086 - DNA, 14 bp, Homo sapiens
agcactcctttaaa

SEQ ID NO: 5185087 - DNA, 16 bp, Homo sapiens
agcactcgagaccatc

SEQ ID NO: 5185088 - DNA, 23 bp, Homo sapiens
agcactcgctagcagtggcaggc

SEQ ID NO: 5185089 - DNA, 12 bp, Homo sapiens
agcactctcaga

SEQ ID NO: 5185090 - DNA, 14 bp, Homo sapiens
agcactctctgcag

SEQ ID NO: 5185091 - DNA, 19 bp, Homo sapiens
agcactctgagtttaccat

SEQ ID NO: 5185092 - DNA, 13 bp, Homo sapiens
agcactctgctgg

SEQ ID NO: 5185093 - DNA, 15 bp, Homo sapiens
agcactctggactcc

SEQ ID NO: 5185094 - DNA, 10 bp, Homo sapiens
agcactgaaa

SEQ ID NO: 5185095 - DNA, 22 bp, Homo sapiens
agcactgaaaataccatcaggc

SEQ ID NO: 5185096 - DNA, 15 bp, Homo sapiens
agcactgaactgctt

SEQ ID NO: 5185097 - DNA, 13 bp, Homo sapiens
agcactgacagat

SEQ ID NO: 5185098 - DNA, 17 bp, Homo sapiens
agcactgacttctaagt

SEQ ID NO: 5185099 - DNA, 20 bp, Homo sapiens
agcactgagctcacatggga

SEQ ID NO: 5185100 - DNA, 11 bp, Homo sapiens
agcactgagga

SEQ ID NO: 5185101 - DNA, 14 bp, Homo sapiens
agcactgaggaaga

SEQ ID NO: 5185102 - DNA, 22 bp, Homo sapiens
agcactgatagtcctttttcca

SEQ ID NO: 5185103 - DNA, 18 bp, Homo sapiens
agcactgatttcacaaca

SEQ ID NO: 5185104 - DNA, 23 bp, Homo sapiens
agcactgcacactcagttctgct

SEQ ID NO: 5185105 - DNA, 23 bp, Homo sapiens
agcactgcagaaacctttaaaaa

SEQ ID NO: 5185106 - DNA, 15 bp, Homo sapiens
agcactgcagatagc

SEQ ID NO: 5185107 - DNA, 21 bp, Homo sapiens
agcactgcagatagccagaca

SEQ ID NO: 5185108 - DNA, 19 bp, Homo sapiens
agcactgcatgtcagagca

SEQ ID NO: 5185109 - DNA, 22 bp, Homo sapiens
agcactgcatgtcagagcactt

SEQ ID NO: 5185110 - DNA, 17 bp, Homo sapiens
agcactgcccatcccac

SEQ ID NO: 5185111 - DNA, 12 bp, Homo sapiens
agcactgcctcc

SEQ ID NO: 5185112 - DNA, 15 bp, Homo sapiens
agcactgcctcctgt

SEQ ID NO: 5185113 - DNA, 13 bp, Homo sapiens
agcactgcctcta

SEQ ID NO: 5185114 - DNA, 22 bp, Homo sapiens
agcactgcctctatgccctgca

SEQ ID NO: 5185115 - DNA, 13 bp, Homo sapiens
agcactgcctgct

SEQ ID NO: 5185116 - DNA, 21 bp, Homo sapiens
agcactgcctgctcccatcct

SEQ ID NO: 5185117 - DNA, 21 bp, Homo sapiens
agcactgctcacgtctctgcc

SEQ ID NO: 5185118 - DNA, 12 bp, Homo sapiens
agcactgctgcc

SEQ ID NO: 5185119 - DNA, 16 bp, Homo sapiens
agcactgctgcctcag

SEQ ID NO: 5185120 - DNA, 20 bp, Homo sapiens
agcactgctgtgtccgcttt

SEQ ID NO: 5185121 - DNA, 20 bp, Homo sapiens
agcactggaggcctctgcaa

SEQ ID NO: 5185122 - DNA, 20 bp, Homo sapiens
agcactggagtgcagggagg

SEQ ID NO: 5185123 - DNA, 23 bp, Homo sapiens
agcactggagtgcagggaggaga

SEQ ID NO: 5185124 - DNA, 16 bp, Homo sapiens
agcactggatggagct

SEQ ID NO: 5185125 - DNA, 19 bp, Homo sapiens
agcactggattgtagaact

SEQ ID NO: 5185126 - DNA, 22 bp, Homo sapiens
agcactggattgtagaacttgt

SEQ ID NO: 5185127 - DNA, 23 bp, Homo sapiens
agcactggccagagagggcccag

SEQ ID NO: 5185128 - DNA, 13 bp, Homo sapiens
agcactggcctgc

SEQ ID NO: 5185129 - DNA, 13 bp, Homo sapiens
agcactggccttg

SEQ ID NO: 5185130 - DNA, 20 bp, Homo sapiens
agcactggccttgcctccag

SEQ ID NO: 5185131 - DNA, 22 bp, Homo sapiens
agcactggccttgcctccagga

SEQ ID NO: 5185132 - DNA, 13 bp, Homo sapiens
agcactggctctc

SEQ ID NO: 5185133 - DNA, 17 bp, Homo sapiens
agcactggctctctcca

SEQ ID NO: 5185134 - DNA, 21 bp, Homo sapiens
agcactgggaacaggagaccc

SEQ ID NO: 5185135 - DNA, 17 bp, Homo sapiens
agcactgggaagctgga

SEQ ID NO: 5185136 - DNA, 19 bp, Homo sapiens
agcactgggaagctggagt

SEQ ID NO: 5185137 - DNA, 12 bp, Homo sapiens
agcactgggctc

SEQ ID NO: 5185138 - DNA, 15 bp, Homo sapiens
agcactgggctcccg

SEQ ID NO: 5185139 - DNA, 18 bp, Homo sapiens
agcactgggctcccgggc

SEQ ID NO: 5185140 - DNA, 21 bp, Homo sapiens
agcactgggctcccgggcccc

SEQ ID NO: 5185141 - DNA, 16 bp, Homo sapiens
agcactggggaaaaat

SEQ ID NO: 5185142 - DNA, 18 bp, Homo sapiens
agcactggggaaaaataa

SEQ ID NO: 5185143 - DNA, 19 bp, Homo sapiens
agcactgggttgcagggga

SEQ ID NO: 5185144 - DNA, 20 bp, Homo sapiens
agcactggtgtgaactcacc

SEQ ID NO: 5185145 - DNA, 21 bp, Homo sapiens
agcactggtttcaagaatatg

SEQ ID NO: 5185146 - DNA, 12 bp, Homo sapiens
agcactgtccct

SEQ ID NO: 5185147 - DNA, 22 bp, Homo sapiens
agcactgtcccttgcctcaatg

SEQ ID NO: 5185148 - DNA, 20 bp, Homo sapiens
agcactgtctcagtttcact

SEQ ID NO: 5185149 - DNA, 20 bp, Homo sapiens
agcactgtgaagacccagca

SEQ ID NO: 5185150 - DNA, 22 bp, Homo sapiens
agcactgtgaagacccagcagg

SEQ ID NO: 5185151 - DNA, 16 bp, Homo sapiens
agcactgtgcagccgg

SEQ ID NO: 5185152 - DNA, 14 bp, Homo sapiens
agcactgtgctaat

SEQ ID NO: 5185153 - DNA, 14 bp, Homo sapiens
agcactgtgctcag

SEQ ID NO: 5185154 - DNA, 18 bp, Homo sapiens
agcactgtgctcagggct

SEQ ID NO: 5185155 - DNA, 19 bp, Homo sapiens
agcactgtgctcagggcta

SEQ ID NO: 5185156 - DNA, 15 bp, Homo sapiens
agcactgtggacacc

SEQ ID NO: 5185157 - DNA, 18 bp, Homo sapiens
agcactgtgtaaccagca

SEQ ID NO: 5185158 - DNA, 23 bp, Homo sapiens
agcactgtgtaaccagcagtcac

SEQ ID NO: 5185159 - DNA, 16 bp, Homo sapiens
agcactgttccagcct

SEQ ID NO: 5185160 - DNA, 15 bp, Homo sapiens
agcactgttgatgta

SEQ ID NO: 5185161 - DNA, 18 bp, Homo sapiens
agcactgttgatgtatct

SEQ ID NO: 5185162 - DNA, 20 bp, Homo sapiens
agcactgttgatgtatctga

SEQ ID NO: 5185163 - DNA, 20 bp, Homo sapiens
agcactgtttggatatgaga

SEQ ID NO: 5185164 - DNA, 15 bp, Homo sapiens
agcacttaaagtttt

SEQ ID NO: 5185165 - DNA, 13 bp, Homo sapiens
agcacttaagaga

SEQ ID NO: 5185166 - DNA, 18 bp, Homo sapiens
agcacttacaccagtttg

SEQ ID NO: 5185167 - DNA, 17 bp, Homo sapiens
agaggaccccagggtgg

SEQ ID NO: 5185168 - DNA, 20 bp, Homo sapiens
agaggaccccattctgggac

SEQ ID NO: 5185169 - DNA, 22 bp, Homo sapiens
agaggacctatcccaaatgtgg

SEQ ID NO: 5185170 - DNA, 22 bp, Homo sapiens
agaggacgcacgctcgctgcca

SEQ ID NO: 5185171 - DNA, 16 bp, Homo sapiens
agaggacggccctgcc

SEQ ID NO: 5185172 - DNA, 23 bp, Homo sapiens
agaggacggcttccccatcgcct

SEQ ID NO: 5185173 - DNA, 23 bp, Homo sapiens
agaggacgtgcagacaggctggc

SEQ ID NO: 5185174 - DNA, 24 bp, Homo sapiens
agaggactagggtaatctgacttc

SEQ ID NO: 5185175 - DNA, 19 bp, Homo sapiens
agaggactcacttgcccac

SEQ ID NO: 5185176 - DNA, 18 bp, Homo sapiens
agaggactcgcttgtaaa

SEQ ID NO: 5185177 - DNA, 19 bp, Homo sapiens
agaggactcgcttgtaaat

SEQ ID NO: 5185178 - DNA, 12 bp, Homo sapiens
agaggactctgc

SEQ ID NO: 5185179 - DNA, 21 bp, Homo sapiens
agaggactctgcttaaacaaa

SEQ ID NO: 5185180 - DNA, 23 bp, Homo sapiens
agaggactctgcttaaacaaagc

SEQ ID NO: 5185181 - DNA, 20 bp, Homo sapiens
agaggactgagactggcact

SEQ ID NO: 5185182 - DNA, 22 bp, Homo sapiens
agaggactggttctgaggccag

SEQ ID NO: 5185183 - DNA, 22 bp, Homo sapiens
agaggactgtagggagggcggc

SEQ ID NO: 5185184 - DNA, 14 bp, Homo sapiens
agaggacttttctt

SEQ ID NO: 5185185 - DNA, 21 bp, Homo sapiens
agaggacttttctttgtggct

SEQ ID NO: 5185186 - DNA, 17 bp, Homo sapiens
agaggagaaaaaaaaag

SEQ ID NO: 5185187 - DNA, 20 bp, Homo sapiens
agaggagaaaaaaaaagtga

SEQ ID NO: 5185188 - DNA, 21 bp, Homo sapiens
agaggagaaaaaaaaagtgaa

SEQ ID NO: 5185189 - DNA, 23 bp, Homo sapiens
agaggagaaaaaaaaagtgaaaa

SEQ ID NO: 5185190 - DNA, 14 bp, Homo sapiens
agaggagaaacaca

SEQ ID NO: 5185191 - DNA, 11 bp, Homo sapiens
agaggagaagg

SEQ ID NO: 5185192 - DNA, 12 bp, Homo sapiens
agaggagaagga

SEQ ID NO: 5185193 - DNA, 13 bp, Homo sapiens
agaggagaaggag

SEQ ID NO: 5185194 - DNA, 14 bp, Homo sapiens
agaggagaaggaga

SEQ ID NO: 5185195 - DNA, 15 bp, Homo sapiens
agaggagaaggagag

SEQ ID NO: 5185196 - DNA, 13 bp, Homo sapiens
agaggagacagac

SEQ ID NO: 5185197 - DNA, 14 bp, Homo sapiens
agaggagacagaca

SEQ ID NO: 5185198 - DNA, 13 bp, Homo sapiens
agaggagacagcc

SEQ ID NO: 5185199 - DNA, 14 bp, Homo sapiens
agaggagaccctgg

SEQ ID NO: 5185200 - DNA, 21 bp, Homo sapiens
agaggagagaatgagagagtg

SEQ ID NO: 5185201 - DNA, 16 bp, Homo sapiens
agaggagagaggaccc

SEQ ID NO: 5185202 - DNA, 17 bp, Homo sapiens
agaggagagaggcagag

SEQ ID NO: 5185203 - DNA, 14 bp, Homo sapiens
agaggagagcatct

SEQ ID NO: 5185204 - DNA, 15 bp, Homo sapiens
agaggagagccagag

SEQ ID NO: 5185205 - DNA, 17 bp, Homo sapiens
agaggagagccagagaa

SEQ ID NO: 5185206 - DNA, 16 bp, Homo sapiens
agaggagaggagagag

SEQ ID NO: 5185207 - DNA, 14 bp, Homo sapiens
agaggagaggctgc

SEQ ID NO: 5185208 - DNA, 22 bp, Homo sapiens
agaggagagtacccccctgaga

SEQ ID NO: 5185209 - DNA, 16 bp, Homo sapiens
agaggagagtggcctg

SEQ ID NO: 5185210 - DNA, 18 bp, Homo sapiens
agaggagataaggtggct

SEQ ID NO: 5185211 - DNA, 20 bp, Homo sapiens
agaggagataaggtggcttc

SEQ ID NO: 5185212 - DNA, 14 bp, Homo sapiens
agaggagatcaggg

SEQ ID NO: 5185213 - DNA, 21 bp, Homo sapiens
agaggagatgtgatcaggccc

SEQ ID NO: 5185214 - DNA, 18 bp, Homo sapiens
agaggagcaaacaggaaa

SEQ ID NO: 5185215 - DNA, 20 bp, Homo sapiens
agaggagcagaccagcactt

SEQ ID NO: 5185216 - DNA, 13 bp, Homo sapiens
agaggagcagagg

SEQ ID NO: 5185217 - DNA, 16 bp, Homo sapiens
agaggagcaggaagca

SEQ ID NO: 5185218 - DNA, 16 bp, Homo sapiens
agaggagcatcagctg

SEQ ID NO: 5185219 - DNA, 23 bp, Homo sapiens
agaggagcatcagctgtctgtca

SEQ ID NO: 5185220 - DNA, 17 bp, Homo sapiens
agaggagccacctgggc

SEQ ID NO: 5185221 - DNA, 18 bp, Homo sapiens
agaggagccacctgggct

SEQ ID NO: 5185222 - DNA, 15 bp, Homo sapiens
agaggagccagacag

SEQ ID NO: 5185223 - DNA, 17 bp, Homo sapiens
agaggagccagacagac

SEQ ID NO: 5185224 - DNA, 13 bp, Homo sapiens
agaggagcccagt

SEQ ID NO: 5185225 - DNA, 22 bp, Homo sapiens
agaggagcccagtgggctgcac

SEQ ID NO: 5185226 - DNA, 23 bp, Homo sapiens
agaggagcccccaccctgttcct

SEQ ID NO: 5185227 - DNA, 12 bp, Homo sapiens
agaggagccctg

SEQ ID NO: 5185228 - DNA, 13 bp, Homo sapiens
agaggagcctcag

SEQ ID NO: 5185229 - DNA, 14 bp, Homo sapiens
agaggagcctggag

SEQ ID NO: 5185230 - DNA, 22 bp, Homo sapiens
agaggagcctgtttttgtgaga

SEQ ID NO: 5185231 - DNA, 20 bp, Homo sapiens
agaggagcgcaggcagcgca

SEQ ID NO: 5185232 - DNA, 21 bp, Homo sapiens
agaggagcgggacctgtggct

SEQ ID NO: 5185233 - DNA, 16 bp, Homo sapiens
agaggagcgtgtccta

SEQ ID NO: 5185234 - DNA, 13 bp, Homo sapiens
agaggagctctac

SEQ ID NO: 5185235 - DNA, 20 bp, Homo sapiens
agaggaggaaaagtcttcct

SEQ ID NO: 5185236 - DNA, 16 bp, Homo sapiens
agaggaggaggaggag

SEQ ID NO: 5185237 - DNA, 12 bp, Homo sapiens
agaggaggatgt

SEQ ID NO: 5185238 - DNA, 20 bp, Homo sapiens
agaggaggatgtaaggcctt

SEQ ID NO: 5185239 - DNA, 14 bp, Homo sapiens
agaggaggcagaaa

SEQ ID NO: 5185240 - DNA, 15 bp, Homo sapiens
agaggaggcagaaag

SEQ ID NO: 5185241 - DNA, 13 bp, Homo sapiens
agaggaggcctca

SEQ ID NO: 5185242 - DNA, 21 bp, Homo sapiens
agaggaggcctcaaagcaacc

SEQ ID NO: 5185243 - DNA, 19 bp, Homo sapiens
agaggaggcctggaccgag

SEQ ID NO: 5185244 - DNA, 17 bp, Homo sapiens
agaggagggatagagac

SEQ ID NO: 5185245 - DNA, 19 bp, Homo sapiens
agaggagggatagagacgc

SEQ ID NO: 5185246 - DNA, 14 bp, Homo sapiens
agaggagggcagag

SEQ ID NO: 5185247 - DNA, 23 bp, Homo sapiens
agaggagggcagcagaagggggt

SEQ ID NO: 5185248 - DNA, 14 bp, Homo sapiens
agaggagggcatgg

SEQ ID NO: 5185249 - DNA, 19 bp, Homo sapiens
agaggagggcgtgactcac

SEQ ID NO: 5185250 - DNA, 12 bp, Homo sapiens
agaggaggggcc

SEQ ID NO: 5185251 - DNA, 23 bp, Homo sapiens
agaggagggggcaggctgagggt

SEQ ID NO: 5185252 - DNA, 21 bp, Homo sapiens
agaggaggggtaaatatatgt

SEQ ID NO: 5185253 - DNA, 15 bp, Homo sapiens
agaggaggtgcccgg

SEQ ID NO: 5185254 - DNA, 14 bp, Homo sapiens
agaggaggtgtgga

SEQ ID NO: 5185255 - DNA, 18 bp, Homo sapiens
agaggaggtgtggagtgg

SEQ ID NO: 5185256 - DNA, 22 bp, Homo sapiens
agaggaggtgtggagtggaggg

SEQ ID NO: 5185257 - DNA, 19 bp, Homo sapiens
agaggaggtttgcctgtga

SEQ ID NO: 5185258 - DNA, 19 bp, Homo sapiens
agaggagtccagggcggga

SEQ ID NO: 5185259 - DNA, 16 bp, Homo sapiens
agaggagtctgtggct

SEQ ID NO: 5185260 - DNA, 16 bp, Homo sapiens
agaggagtgcgctaga

SEQ ID NO: 5185261 - DNA, 14 bp, Homo sapiens
agaggagtgcttgt

SEQ ID NO: 5185262 - DNA, 22 bp, Homo sapiens
agaggagttaaccccaaaggtg

SEQ ID NO: 5185263 - DNA, 17 bp, Homo sapiens
agaggagttcaatgatc

SEQ ID NO: 5185264 - DNA, 13 bp, Homo sapiens
agaggagttcttt

SEQ ID NO: 5185265 - DNA, 18 bp, Homo sapiens
agaggataattagcatct

SEQ ID NO: 5185266 - DNA, 17 bp, Homo sapiens
agaggatcaccagtgca

SEQ ID NO: 5185267 - DNA, 15 bp, Homo sapiens
agaggatgaaggaag

SEQ ID NO: 5185268 - DNA, 13 bp, Homo sapiens
agaggatgagagc

SEQ ID NO: 5185269 - DNA, 18 bp, Homo sapiens
agaggatgagagcccaga

SEQ ID NO: 5185270 - DNA, 16 bp, Homo sapiens
agaggatgatttcaga

SEQ ID NO: 5185271 - DNA, 18 bp, Homo sapiens
agaggatgatttcagaag

SEQ ID NO: 5185272 - DNA, 21 bp, Homo sapiens
agaggatgctctttcccagga

SEQ ID NO: 5185273 - DNA, 13 bp, Homo sapiens
agaggatgctgaa

SEQ ID NO: 5185274 - DNA, 17 bp, Homo sapiens
agaggatgctgggctct

SEQ ID NO: 5185275 - DNA, 14 bp, Homo sapiens
agaggatggccagt

SEQ ID NO: 5185276 - DNA, 17 bp, Homo sapiens
agaggatgtggaaagca

SEQ ID NO: 5185277 - DNA, 19 bp, Homo sapiens
agaggatgtggcaggggca

SEQ ID NO: 5185278 - DNA, 20 bp, Homo sapiens
agaggatgtggcaggggcag

SEQ ID NO: 5185279 - DNA, 13 bp, Homo sapiens
agaggatgtggct

SEQ ID NO: 5185280 - DNA, 13 bp, Homo sapiens
agaggatgttctg

SEQ ID NO: 5185281 - DNA, 16 bp, Homo sapiens
agaggattgcttccct

SEQ ID NO: 5185282 - DNA, 18 bp, Homo sapiens
agaggattgcttgagccc

SEQ ID NO: 5185283 - DNA, 18 bp, Homo sapiens
agaggatttcttcaaatc

SEQ ID NO: 5185284 - DNA, 16 bp, Homo sapiens
agaggatttggctcgc

SEQ ID NO: 5185285 - DNA, 19 bp, Homo sapiens
agaggatttggctcgctgt

SEQ ID NO: 5185286 - DNA, 20 bp, Homo sapiens
agaggatttggctcgctgtg

SEQ ID NO: 5185287 - DNA, 22 bp, Homo sapiens
agaggattttgcgtcagagaaa

SEQ ID NO: 5185288 - DNA, 14 bp, Homo sapiens
agaggcaaacattt

SEQ ID NO: 5185289 - DNA, 17 bp, Homo sapiens
agaggcaaacatttctt

SEQ ID NO: 5185290 - DNA, 21 bp, Homo sapiens
agaggcaacactggaacatgg

SEQ ID NO: 5185291 - DNA, 16 bp, Homo sapiens
agaggcaacagtgttc

SEQ ID NO: 5185292 - DNA, 22 bp, Homo sapiens
agaggcaacagtgttctgagcc

SEQ ID NO: 5185293 - DNA, 18 bp, Homo sapiens
agaggcaactgcattggc

SEQ ID NO: 5185294 - DNA, 18 bp, Homo sapiens
agaggcaagagacagaat

SEQ ID NO: 5185295 - DNA, 13 bp, Homo sapiens
agaggcaataaat

SEQ ID NO: 5185296 - DNA, 24 bp, Homo sapiens
agaggcaccactaaaagatcgcag

SEQ ID NO: 5185297 - DNA, 16 bp, Homo sapiens
agaggcagaaccctgg

SEQ ID NO: 5185298 - DNA, 19 bp, Homo sapiens
agaggcagaagtcagcccg

SEQ ID NO: 5185299 - DNA, 12 bp, Homo sapiens
agaggcagagag

SEQ ID NO: 5185300 - DNA, 13 bp, Homo sapiens
agaggcagagagc

SEQ ID NO: 5185301 - DNA, 12 bp, Homo sapiens
agaggcagaggt

SEQ ID NO: 5185302 - DNA, 17 bp, Homo sapiens
agaggcagcatgcttgg

SEQ ID NO: 5185303 - DNA, 22 bp, Homo sapiens
agaggcagcatgcttgggctga

SEQ ID NO: 5185304 - DNA, 14 bp, Homo sapiens
agaggcagccagac

SEQ ID NO: 5185305 - DNA, 13 bp, Homo sapiens
agaggcagcccag

SEQ ID NO: 5185306 - DNA, 16 bp, Homo sapiens
agaggcagcccgcaca

SEQ ID NO: 5185307 - DNA, 17 bp, Homo sapiens
agaggcagcttctttgc

SEQ ID NO: 5185308 - DNA, 19 bp, Homo sapiens
agaggcaggaatgggggtc

SEQ ID NO: 5185309 - DNA, 21 bp, Homo sapiens
agaggcaggaatgggggtcag

SEQ ID NO: 5185310 - DNA, 17 bp, Homo sapiens
agaggcaggaccagaag

SEQ ID NO: 5185311 - DNA, 18 bp, Homo sapiens
agaggcaggaccagaagg

SEQ ID NO: 5185312 - DNA, 10 bp, Homo sapiens
agaggcaggc

SEQ ID NO: 5185313 - DNA, 13 bp, Homo sapiens
agaggcaggctgg

SEQ ID NO: 5185314 - DNA, 14 bp, Homo sapiens
agaggcaggctggg

SEQ ID NO: 5185315 - DNA, 17 bp, Homo sapiens
agaggcaggctgggacg

SEQ ID NO: 5185316 - DNA, 17 bp, Homo sapiens
agaggcagggccctggg

SEQ ID NO: 5185317 - DNA, 22 bp, Homo sapiens
agaggcagtaggaacccagctc

SEQ ID NO: 5185318 - DNA, 18 bp, Homo sapiens
agaggcagtgatgacttg

SEQ ID NO: 5185319 - DNA, 16 bp, Homo sapiens
agaggcagtggcagca

SEQ ID NO: 5185320 - DNA, 19 bp, Homo sapiens
agaggcatcccaagacctc

SEQ ID NO: 5185321 - DNA, 16 bp, Homo sapiens
agaggcatcctgcctg

SEQ ID NO: 5185322 - DNA, 17 bp, Homo sapiens
agaggcatcctgcctgg

SEQ ID NO: 5185323 - DNA, 15 bp, Homo sapiens
agaggcatcttttct

SEQ ID NO: 5185324 - DNA, 13 bp, Homo sapiens
agaggcatggctg

SEQ ID NO: 5185325 - DNA, 17 bp, Homo sapiens
agaggcatgggggccca

SEQ ID NO: 5185326 - DNA, 21 bp, Homo sapiens
agaggcatgggggcccaaagg

SEQ ID NO: 5185327 - DNA, 22 bp, Homo sapiens
agaggcatgtgatgtgcaagga

SEQ ID NO: 5185328 - DNA, 17 bp, Homo sapiens
agaggcatttaaaatgg

SEQ ID NO: 5185329 - DNA, 17 bp, Homo sapiens
agaggcatttgagcagc

SEQ ID NO: 5185330 - DNA, 15 bp, Homo sapiens
agaggcatttgtctt

SEQ ID NO: 5185331 - DNA, 16 bp, Homo sapiens
agaggcatttgtctta

SEQ ID NO: 5185332 - DNA, 19 bp, Homo sapiens
agaggccaaacaggccctc

SEQ ID NO: 5185333 - DNA, 16 bp, Homo sapiens
agaggccaaagaagga

SEQ ID NO: 5185334 - DNA, 23 bp, Homo sapiens
agaggccaagtctaatgaagaga

SEQ ID NO: 5185335 - DNA, 13 bp, Homo sapiens
agaggccaatgcc

SEQ ID NO: 5185336 - DNA, 13 bp, Homo sapiens
agaggccagaggc

SEQ ID NO: 5185337 - DNA, 16 bp, Homo sapiens
agaggccagccccacc

SEQ ID NO: 5185338 - DNA, 18 bp, Homo sapiens
agaggccaggaatctgcc

SEQ ID NO: 5185339 - DNA, 19 bp, Homo sapiens
agaggccaggaatctgcca

SEQ ID NO: 5185340 - DNA, 13 bp, Homo sapiens
agaggccaggatg

SEQ ID NO: 5185341 - DNA, 22 bp, Homo sapiens
agaggccaggatgcctgagccc

SEQ ID NO: 5185342 - DNA, 19 bp, Homo sapiens
agaggccagggcagcaagg

SEQ ID NO: 5185343 - DNA, 19 bp, Homo sapiens
agaggccagggtggccagg

SEQ ID NO: 5185344 - DNA, 19 bp, Homo sapiens
agaggccatgattcgccca

SEQ ID NO: 5185345 - DNA, 15 bp, Homo sapiens
agaggccatggcaga

SEQ ID NO: 5185346 - DNA, 21 bp, Homo sapiens
agcacttagacctgccagcca

SEQ ID NO: 5185347 - DNA, 15 bp, Homo sapiens
agcacttatttaatg

SEQ ID NO: 5185348 - DNA, 13 bp, Homo sapiens
agcacttcagatc

SEQ ID NO: 5185349 - DNA, 12 bp, Homo sapiens
agcacttccaaa

SEQ ID NO: 5185350 - DNA, 19 bp, Homo sapiens
agcacttccaaaattctta

SEQ ID NO: 5185351 - DNA, 23 bp, Homo sapiens
agcacttcccaggatctgctcca

SEQ ID NO: 5185352 - DNA, 20 bp, Homo sapiens
agcacttccttgccagtctt

SEQ ID NO: 5185353 - DNA, 13 bp, Homo sapiens
agcacttctagaa

SEQ ID NO: 5185354 - DNA, 22 bp, Homo sapiens
agcacttctttcctctccaatt

SEQ ID NO: 5185355 - DNA, 16 bp, Homo sapiens
agcacttgagctgtct

SEQ ID NO: 5185356 - DNA, 18 bp, Homo sapiens
agcacttgagctgtctga

SEQ ID NO: 5185357 - DNA, 21 bp, Homo sapiens
agcacttgcctggaataaaat

SEQ ID NO: 5185358 - DNA, 14 bp, Homo sapiens
agcacttgcgtcct

SEQ ID NO: 5185359 - DNA, 21 bp, Homo sapiens
agcacttgcttacatcctctg

SEQ ID NO: 5185360 - DNA, 17 bp, Homo sapiens
agcacttggagccaagg

SEQ ID NO: 5185361 - DNA, 22 bp, Homo sapiens
agcacttgggggttcaggcccg

SEQ ID NO: 5185362 - DNA, 16 bp, Homo sapiens
agcacttgtccagctg

SEQ ID NO: 5185363 - DNA, 19 bp, Homo sapiens
agcacttgtctcattttaa

SEQ ID NO: 5185364 - DNA, 21 bp, Homo sapiens
agcacttgtgggtttttgttt

SEQ ID NO: 5185365 - DNA, 15 bp, Homo sapiens
agcacttgttttaaa

SEQ ID NO: 5185366 - DNA, 17 bp, Homo sapiens
agcacttgttttaaaat

SEQ ID NO: 5185367 - DNA, 18 bp, Homo sapiens
agcacttgttttaaaatg

SEQ ID NO: 5185368 - DNA, 17 bp, Homo sapiens
agcactttaaccctctc

SEQ ID NO: 5185369 - DNA, 19 bp, Homo sapiens
agcactttaaccctctctt

SEQ ID NO: 5185370 - DNA, 20 bp, Homo sapiens
agcactttaaccctctcttc

SEQ ID NO: 5185371 - DNA, 23 bp, Homo sapiens
agcactttaaccctctcttccct

SEQ ID NO: 5185372 - DNA, 22 bp, Homo sapiens
agcactttacagatgagattcc

SEQ ID NO: 5185373 - DNA, 22 bp, Homo sapiens
agcactttacgctgtctgtaat

SEQ ID NO: 5185374 - DNA, 20 bp, Homo sapiens
agcactttagaatatgcctt

SEQ ID NO: 5185375 - DNA, 21 bp, Homo sapiens
agcactttagaatatgccttg

SEQ ID NO: 5185376 - DNA, 17 bp, Homo sapiens
agcactttataagccaa

SEQ ID NO: 5185377 - DNA, 19 bp, Homo sapiens
agcactttattctcctccg

SEQ ID NO: 5185378 - DNA, 23 bp, Homo sapiens
agcactttccacttccagagggg

SEQ ID NO: 5185379 - DNA, 20 bp, Homo sapiens
agcactttgaaatacctcat

SEQ ID NO: 5185380 - DNA, 19 bp, Homo sapiens
agcactttgcaaggaatgt

SEQ ID NO: 5185381 - DNA, 19 bp, Homo sapiens
agcactttgggaagctgag

SEQ ID NO: 5185382 - DNA, 22 bp, Homo sapiens
agcactttgggaggccaaggtg

SEQ ID NO: 5185383 - DNA, 22 bp, Homo sapiens
agcactttgggaggctgaggcg

SEQ ID NO: 5185384 - DNA, 18 bp, Homo sapiens
agcacttttgttattcca

SEQ ID NO: 5185385 - DNA, 20 bp, Homo sapiens
agcagaaaaacaggcacagg

SEQ ID NO: 5185386 - DNA, 17 bp, Homo sapiens
agcagaaaaatgaaaga

SEQ ID NO: 5185387 - DNA, 20 bp, Homo sapiens
agcagaaaacagaggccaca

SEQ ID NO: 5185388 - DNA, 21 bp, Homo sapiens
agcagaaaacccttgggccag

SEQ ID NO: 5185389 - DNA, 22 bp, Homo sapiens
agcagaaaacccttgggccaga

SEQ ID NO: 5185390 - DNA, 20 bp, Homo sapiens
agcagaaaacctgttcaggc

SEQ ID NO: 5185391 - DNA, 22 bp, Homo sapiens
agcagaaaactggccctgccct

SEQ ID NO: 5185392 - DNA, 12 bp, Homo sapiens
agcagaaaagtg

SEQ ID NO: 5185393 - DNA, 23 bp, Homo sapiens
agcagaaaagtgcttagaaagtt

SEQ ID NO: 5185394 - DNA, 13 bp, Homo sapiens
agcagaaacacac

SEQ ID NO: 5185395 - DNA, 17 bp, Homo sapiens
agcagaaacacacagtc

SEQ ID NO: 5185396 - DNA, 15 bp, Homo sapiens
agcagaaacagccat

SEQ ID NO: 5185397 - DNA, 17 bp, Homo sapiens
agcagaaacagccattg

SEQ ID NO: 5185398 - DNA, 18 bp, Homo sapiens
agcagaaaccaagtctac

SEQ ID NO: 5185399 - DNA, 16 bp, Homo sapiens
agcagaaacccccagg

SEQ ID NO: 5185400 - DNA, 19 bp, Homo sapiens
agcagaaagattaaatatg

SEQ ID NO: 5185401 - DNA, 14 bp, Homo sapiens
agcagaaagtgcct

SEQ ID NO: 5185402 - DNA, 19 bp, Homo sapiens
agcagaaagtgcctttcag

SEQ ID NO: 5185403 - DNA, 20 bp, Homo sapiens
agcagaaagtgcctttcagg

SEQ ID NO: 5185404 - DNA, 23 bp, Homo sapiens
agcagaaagtgcctttcaggatc

SEQ ID NO: 5185405 - DNA, 12 bp, Homo sapiens
agcagaaatgcc

SEQ ID NO: 5185406 - DNA, 13 bp, Homo sapiens
agcagaaatgcct

SEQ ID NO: 5185407 - DNA, 16 bp, Homo sapiens
agcagaaattctgttt

SEQ ID NO: 5185408 - DNA, 14 bp, Homo sapiens
agcagaacaggtag

SEQ ID NO: 5185409 - DNA, 15 bp, Homo sapiens
agcagaacaggtagt

SEQ ID NO: 5185410 - DNA, 20 bp, Homo sapiens
agcagaacagttaagcagcc

SEQ ID NO: 5185411 - DNA, 15 bp, Homo sapiens
agcagaaccagcctc

SEQ ID NO: 5185412 - DNA, 20 bp, Homo sapiens
agcagaacctgcacacagga

SEQ ID NO: 5185413 - DNA, 16 bp, Homo sapiens
agcagaactcattcta

SEQ ID NO: 5185414 - DNA, 14 bp, Homo sapiens
agcagaactgaacc

SEQ ID NO: 5185415 - DNA, 15 bp, Homo sapiens
agcagaactgaagcc

SEQ ID NO: 5185416 - DNA, 14 bp, Homo sapiens
agcagaagaaagga

SEQ ID NO: 5185417 - DNA, 22 bp, Homo sapiens
agcagaagacgggaggggaggc

SEQ ID NO: 5185418 - DNA, 16 bp, Homo sapiens
agcagaagactctcca

SEQ ID NO: 5185419 - DNA, 16 bp, Homo sapiens
agcagaagagggaggc

SEQ ID NO: 5185420 - DNA, 23 bp, Homo sapiens
agcagaagagggaggcttcctga

SEQ ID NO: 5185421 - DNA, 18 bp, Homo sapiens
agcagaagcagggtaccc

SEQ ID NO: 5185422 - DNA, 20 bp, Homo sapiens
agcagaagccagagggtggg

SEQ ID NO: 5185423 - DNA, 18 bp, Homo sapiens
agcagaaggattttttaa

SEQ ID NO: 5185424 - DNA, 13 bp, Homo sapiens
agcagaaggcctt

SEQ ID NO: 5185425 - DNA, 15 bp, Homo sapiens
agcagaaggccttgc

SEQ ID NO: 5185426 - DNA, 16 bp, Homo sapiens
agcagaagtctggctt

SEQ ID NO: 5185427 - DNA, 17 bp, Homo sapiens
agcagaagtggaatcca

SEQ ID NO: 5185428 - DNA, 15 bp, Homo sapiens
agcagaataaagcaa

SEQ ID NO: 5185429 - DNA, 17 bp, Homo sapiens
agcagaatacaatggga

SEQ ID NO: 5185430 - DNA, 14 bp, Homo sapiens
agcagaatactggt

SEQ ID NO: 5185431 - DNA, 17 bp, Homo sapiens
agcagaatactggtctc

SEQ ID NO: 5185432 - DNA, 19 bp, Homo sapiens
agcagaatcaaaatgacct

SEQ ID NO: 5185433 - DNA, 19 bp, Homo sapiens
agcagaatctttgcaagaa

SEQ ID NO: 5185434 - DNA, 21 bp, Homo sapiens
agcagaatctttgcaagaaag

SEQ ID NO: 5185435 - DNA, 16 bp, Homo sapiens
agcagaatgaagacct

SEQ ID NO: 5185436 - DNA, 17 bp, Homo sapiens
agcagaatgagatgatt

SEQ ID NO: 5185437 - DNA, 21 bp, Homo sapiens
agcagaatggagaaagtaagt

SEQ ID NO: 5185438 - DNA, 18 bp, Homo sapiens
agcagttcatgtctgaaa

SEQ ID NO: 5185439 - DNA, 13 bp, Homo sapiens
agcagttcccaag

SEQ ID NO: 5185440 - DNA, 16 bp, Homo sapiens
agcagttcctgtccca

SEQ ID NO: 5185441 - DNA, 13 bp, Homo sapiens
agcagttctgatg

SEQ ID NO: 5185442 - DNA, 13 bp, Homo sapiens
agcagttctgcaa

SEQ ID NO: 5185443 - DNA, 16 bp, Homo sapiens
agcagttctgcagagg

SEQ ID NO: 5185444 - DNA, 13 bp, Homo sapiens
agcagttgaaaag

SEQ ID NO: 5185445 - DNA, 21 bp, Homo sapiens
agcagttgaaaagactccaaa

SEQ ID NO: 5185446 - DNA, 21 bp, Homo sapiens
agcagttgacatccaaatcta

SEQ ID NO: 5185447 - DNA, 16 bp, Homo sapiens
agcagttgactcagag

SEQ ID NO: 5185448 - DNA, 20 bp, Homo sapiens
agcagttgctggtaaaatga

SEQ ID NO: 5185449 - DNA, 20 bp, Homo sapiens
agcagttggccaagcagaaa

SEQ ID NO: 5185450 - DNA, 15 bp, Homo sapiens
agcagttggcctgtg

SEQ ID NO: 5185451 - DNA, 22 bp, Homo sapiens
agcagttggcctgtgcttggag

SEQ ID NO: 5185452 - DNA, 14 bp, Homo sapiens
agcagttggggccc

SEQ ID NO: 5185453 - DNA, 19 bp, Homo sapiens
agcagttggggccctcttg

SEQ ID NO: 5185454 - DNA, 21 bp, Homo sapiens
agcagttggggccctcttgcc

SEQ ID NO: 5185455 - DNA, 14 bp, Homo sapiens
agcagttgtaaaat

SEQ ID NO: 5185456 - DNA, 18 bp, Homo sapiens
agcagttgttatattcat

SEQ ID NO: 5185457 - DNA, 22 bp, Homo sapiens
agcagttgttatattcattctt

SEQ ID NO: 5185458 - DNA, 14 bp, Homo sapiens
agcagtttcaataa

SEQ ID NO: 5185459 - DNA, 20 bp, Homo sapiens
agcagtttcaataaagtttg

SEQ ID NO: 5185460 - DNA, 21 bp, Homo sapiens
agcagtttcaataaagtttga

SEQ ID NO: 5185461 - DNA, 13 bp, Homo sapiens
agcagtttcagat

SEQ ID NO: 5185462 - DNA, 15 bp, Homo sapiens
agcagtttcagataa

SEQ ID NO: 5185463 - DNA, 14 bp, Homo sapiens
agcagtttcccaga

SEQ ID NO: 5185464 - DNA, 17 bp, Homo sapiens
agcagtttcctcagtga

SEQ ID NO: 5185465 - DNA, 16 bp, Homo sapiens
agcagtttctgtccta

SEQ ID NO: 5185466 - DNA, 18 bp, Homo sapiens
agcagtttctgtcctgct

SEQ ID NO: 5185467 - DNA, 15 bp, Homo sapiens
agcagtttgcctctg

SEQ ID NO: 5185468 - DNA, 14 bp, Homo sapiens
agcagtttgctttg

SEQ ID NO: 5185469 - DNA, 18 bp, Homo sapiens
agcagtttggggcagggg

SEQ ID NO: 5185470 - DNA, 20 bp, Homo sapiens
agcagtttggtttctagcat

SEQ ID NO: 5185471 - DNA, 17 bp, Homo sapiens
agcagtttgtgatatag

SEQ ID NO: 5185472 - DNA, 16 bp, Homo sapiens
agcagttttccaggag

SEQ ID NO: 5185473 - DNA, 17 bp, Homo sapiens
agcagttttcccctggc

SEQ ID NO: 5185474 - DNA, 20 bp, Homo sapiens
agcagttttcttttaatttt

SEQ ID NO: 5185475 - DNA, 24 bp, Homo sapiens
agcagttttgtaaatgtactggta

SEQ ID NO: 5185476 - DNA, 13 bp, Homo sapiens
agcagtttttccc

SEQ ID NO: 5185477 - DNA, 15 bp, Homo sapiens
agcataaaagatgaa

SEQ ID NO: 5185478 - DNA, 14 bp, Homo sapiens
agcataaaatgaaa

SEQ ID NO: 5185479 - DNA, 17 bp, Homo sapiens
agcataaataaaactga

SEQ ID NO: 5185480 - DNA, 18 bp, Homo sapiens
agcataaataaaactgaa

SEQ ID NO: 5185481 - DNA, 19 bp, Homo sapiens
agcataaataaaactgaat

SEQ ID NO: 5185482 - DNA, 14 bp, Homo sapiens
agcataaatgcaaa

SEQ ID NO: 5185483 - DNA, 16 bp, Homo sapiens
agcataaatgggaact

SEQ ID NO: 5185484 - DNA, 23 bp, Homo sapiens
agcataaatgttgacatgggaca

SEQ ID NO: 5185485 - DNA, 15 bp, Homo sapiens
agcataaatttaatg

SEQ ID NO: 5185486 - DNA, 24 bp, Homo sapiens
agcataaggccggacgcatctcaa

SEQ ID NO: 5185487 - DNA, 17 bp, Homo sapiens
agcataagtttctggga

SEQ ID NO: 5185488 - DNA, 19 bp, Homo sapiens
agcataatatgaagccttt

SEQ ID NO: 5185489 - DNA, 23 bp, Homo sapiens
agcataatattttctttcttttt

SEQ ID NO: 5185490 - DNA, 21 bp, Homo sapiens
agcataatctgaaaacatcta

SEQ ID NO: 5185491 - DNA, 18 bp, Homo sapiens
agcataatgctcccatct

SEQ ID NO: 5185492 - DNA, 17 bp, Homo sapiens
agcataatttaaaaata

SEQ ID NO: 5185493 - DNA, 16 bp, Homo sapiens
agcatacaaaaatata

SEQ ID NO: 5185494 - DNA, 17 bp, Homo sapiens
agcatacaaaaatatat

SEQ ID NO: 5185495 - DNA, 24 bp, Homo sapiens
agcatacagagtgtcctgatttgt

SEQ ID NO: 5185496 - DNA, 22 bp, Homo sapiens
agcatacatgcaaaaagaaatg

SEQ ID NO: 5185497 - DNA, 14 bp, Homo sapiens
agcatacatttata

SEQ ID NO: 5185498 - DNA, 15 bp, Homo sapiens
agcatacattttctg

SEQ ID NO: 5185499 - DNA, 18 bp, Homo sapiens
agcatacattttctggtg

SEQ ID NO: 5185500 - DNA, 19 bp, Homo sapiens
agcataccaacacgagcag

SEQ ID NO: 5185501 - DNA, 22 bp, Homo sapiens
agcataccaacacgagcaggct

SEQ ID NO: 5185502 - DNA, 20 bp, Homo sapiens
agcataccagtactcagtat

SEQ ID NO: 5185503 - DNA, 18 bp, Homo sapiens
agcataccagttcttgca

SEQ ID NO: 5185504 - DNA, 19 bp, Homo sapiens
agcatacctttattgtgat

SEQ ID NO: 5185505 - DNA, 16 bp, Homo sapiens
agcatacgtacacatt

SEQ ID NO: 5185506 - DNA, 17 bp, Homo sapiens
agcatactagaatcaga

SEQ ID NO: 5185507 - DNA, 22 bp, Homo sapiens
agcatactccgtgaggctgctg

SEQ ID NO: 5185508 - DNA, 22 bp, Homo sapiens
agcatactgatgagacaacaca

SEQ ID NO: 5185509 - DNA, 15 bp, Homo sapiens
agcatactgtgtatg

SEQ ID NO: 5185510 - DNA, 17 bp, Homo sapiens
agcatactgtgtatgtt

SEQ ID NO: 5185511 - DNA, 16 bp, Homo sapiens
agcatagaaggcaggt

SEQ ID NO: 5185512 - DNA, 13 bp, Homo sapiens
agcatagccagca

SEQ ID NO: 5185513 - DNA, 22 bp, Homo sapiens
agcatagccagcattcagcaca

SEQ ID NO: 5185514 - DNA, 13 bp, Homo sapiens
agcatagcctgcc

SEQ ID NO: 5185515 - DNA, 20 bp, Homo sapiens
agcataggctagtgggcagg

SEQ ID NO: 5185516 - DNA, 16 bp, Homo sapiens
agcataggctggggac

SEQ ID NO: 5185517 - DNA, 13 bp, Homo sapiens
agcatagggggga

SEQ ID NO: 5185518 - DNA, 16 bp, Homo sapiens
agcatagtaaactacg

SEQ ID NO: 5185519 - DNA, 19 bp, Homo sapiens
agcatagttattttacaaa

SEQ ID NO: 5185520 - DNA, 17 bp, Homo sapiens
agcatataaaaacatca

SEQ ID NO: 5185521 - DNA, 19 bp, Homo sapiens
agcatataaaatggcaaca

SEQ ID NO: 5185522 - DNA, 23 bp, Homo sapiens
agcatataaaatggcaacaaact

SEQ ID NO: 5185523 - DNA, 15 bp, Homo sapiens
agcatataaatgttt

SEQ ID NO: 5185524 - DNA, 20 bp, Homo sapiens
agcatataaggctaaatgta

SEQ ID NO: 5185525 - DNA, 21 bp, Homo sapiens
agcatataaggctaaatgtaa

SEQ ID NO: 5185526 - DNA, 17 bp, Homo sapiens
agcatatacaataatgt

SEQ ID NO: 5185527 - DNA, 13 bp, Homo sapiens
agcatatataaaa

SEQ ID NO: 5185528 - DNA, 16 bp, Homo sapiens
agcatatatacttgca

SEQ ID NO: 5185529 - DNA, 19 bp, Homo sapiens
agcatatatataaaataca

SEQ ID NO: 5185530 - DNA, 15 bp, Homo sapiens
agagttagactgttg

SEQ ID NO: 5185531 - DNA, 13 bp, Homo sapiens
agagttagcatgt

SEQ ID NO: 5185532 - DNA, 22 bp, Homo sapiens
agagttagcctggatagccttg

SEQ ID NO: 5185533 - DNA, 16 bp, Homo sapiens
agagttagctgataag

SEQ ID NO: 5185534 - DNA, 16 bp, Homo sapiens
agagttatatgacttc

SEQ ID NO: 5185535 - DNA, 20 bp, Homo sapiens
agagttatcttctttattat

SEQ ID NO: 5185536 - DNA, 19 bp, Homo sapiens
agagttattcaaatgaagg

SEQ ID NO: 5185537 - DNA, 22 bp, Homo sapiens
agagttattcaaatgaaggtgg

SEQ ID NO: 5185538 - DNA, 20 bp, Homo sapiens
agagttcaatggctgctgaa

SEQ ID NO: 5185539 - DNA, 21 bp, Homo sapiens
agagttcaatggctgctgaag

SEQ ID NO: 5185540 - DNA, 14 bp, Homo sapiens
agagttcacaggag

SEQ ID NO: 5185541 - DNA, 16 bp, Homo sapiens
agagttcactataaat

SEQ ID NO: 5185542 - DNA, 18 bp, Homo sapiens
agagttcagggaagataa

SEQ ID NO: 5185543 - DNA, 13 bp, Homo sapiens
agagttcagggag

SEQ ID NO: 5185544 - DNA, 17 bp, Homo sapiens
agagttcatagaaatac

SEQ ID NO: 5185545 - DNA, 20 bp, Homo sapiens
agagttcatagaaatacatc

SEQ ID NO: 5185546 - DNA, 22 bp, Homo sapiens
agagttccaagttgaagggaaa

SEQ ID NO: 5185547 - DNA, 17 bp, Homo sapiens
agagttccacaaatcta

SEQ ID NO: 5185548 - DNA, 13 bp, Homo sapiens
agagttccagagg

SEQ ID NO: 5185549 - DNA, 18 bp, Homo sapiens
agagttccggggagaaac

SEQ ID NO: 5185550 - DNA, 22 bp, Homo sapiens
agagttcctgcggagtgaagag

SEQ ID NO: 5185551 - DNA, 12 bp, Homo sapiens
agagttccttct

SEQ ID NO: 5185552 - DNA, 15 bp, Homo sapiens
agagttcctttctgg

SEQ ID NO: 5185553 - DNA, 15 bp, Homo sapiens
agagttcgtgaagag

SEQ ID NO: 5185554 - DNA, 16 bp, Homo sapiens
agagttcgtgaagagg

SEQ ID NO: 5185555 - DNA, 18 bp, Homo sapiens
agagttcgtgaagaggga

SEQ ID NO: 5185556 - DNA, 21 bp, Homo sapiens
agagttctatccccaagctgg

SEQ ID NO: 5185557 - DNA, 18 bp, Homo sapiens
agagttctccttgtactt

SEQ ID NO: 5185558 - DNA, 21 bp, Homo sapiens
agagttctccttgtacttgaa

SEQ ID NO: 5185559 - DNA, 20 bp, Homo sapiens
agagttctggatgtctggct

SEQ ID NO: 5185560 - DNA, 22 bp, Homo sapiens
agagttctggatgtctggctca

SEQ ID NO: 5185561 - DNA, 22 bp, Homo sapiens
agagttctttaggtgcctcctg

SEQ ID NO: 5185562 - DNA, 23 bp, Homo sapiens
agagttctttaggtgcctcctgt

SEQ ID NO: 5185563 - DNA, 13 bp, Homo sapiens
agagttctttgca

SEQ ID NO: 5185564 - DNA, 14 bp, Homo sapiens
agagttctttgctg

SEQ ID NO: 5185565 - DNA, 18 bp, Homo sapiens
agagttctttgctgcccc

SEQ ID NO: 5185566 - DNA, 14 bp, Homo sapiens
agagttgaagacag

SEQ ID NO: 5185567 - DNA, 21 bp, Homo sapiens
agagttgaccgttttcatcct

SEQ ID NO: 5185568 - DNA, 14 bp, Homo sapiens
agagttgaggatgt

SEQ ID NO: 5185569 - DNA, 20 bp, Homo sapiens
agagttgatggttgtacata

SEQ ID NO: 5185570 - DNA, 16 bp, Homo sapiens
agagttgctgggagct

SEQ ID NO: 5185571 - DNA, 17 bp, Homo sapiens
agagttgctttaaagta

SEQ ID NO: 5185572 - DNA, 20 bp, Homo sapiens
agagttggaaatcagttgtg

SEQ ID NO: 5185573 - DNA, 15 bp, Homo sapiens
agagttggccatatt

SEQ ID NO: 5185574 - DNA, 17 bp, Homo sapiens
agagttggctcaggcag

SEQ ID NO: 5185575 - DNA, 17 bp, Homo sapiens
agagttgggggccagca

SEQ ID NO: 5185576 - DNA, 18 bp, Homo sapiens
agagttgggggccagcac

SEQ ID NO: 5185577 - DNA, 19 bp, Homo sapiens
agagttggtgttcataatt

SEQ ID NO: 5185578 - DNA, 13 bp, Homo sapiens
agagttgtaaata

SEQ ID NO: 5185579 - DNA, 20 bp, Homo sapiens
agagttgtgacaacttcctg

SEQ ID NO: 5185580 - DNA, 21 bp, Homo sapiens
agagttgtgatggaggggaga

SEQ ID NO: 5185581 - DNA, 19 bp, Homo sapiens
agagttgtgcacatggctt

SEQ ID NO: 5185582 - DNA, 14 bp, Homo sapiens
agagttgtgttgtt

SEQ ID NO: 5185583 - DNA, 20 bp, Homo sapiens
agagttgttacatttttaag

SEQ ID NO: 5185584 - DNA, 19 bp, Homo sapiens
agagttgttctcaggggtg

SEQ ID NO: 5185585 - DNA, 17 bp, Homo sapiens
agagtttaaacaaaaaa

SEQ ID NO: 5185586 - DNA, 20 bp, Homo sapiens
agagtttaaacaaaaaaccc

SEQ ID NO: 5185587 - DNA, 20 bp, Homo sapiens
agagtttaacagatatttaa

SEQ ID NO: 5185588 - DNA, 21 bp, Homo sapiens
agagtttaactttgggcccag

SEQ ID NO: 5185589 - DNA, 22 bp, Homo sapiens
agagtttaactttgggcccaga

SEQ ID NO: 5185590 - DNA, 22 bp, Homo sapiens
agagtttacagtttgtgtttta

SEQ ID NO: 5185591 - DNA, 16 bp, Homo sapiens
agagtttactgatgaa

SEQ ID NO: 5185592 - DNA, 16 bp, Homo sapiens
agagtttatacagtgt

SEQ ID NO: 5185593 - DNA, 19 bp, Homo sapiens
agagtttattattgtactt

SEQ ID NO: 5185594 - DNA, 21 bp, Homo sapiens
agagtttattattgtacttta

SEQ ID NO: 5185595 - DNA, 19 bp, Homo sapiens
agagtttatttttttgatg

SEQ ID NO: 5185596 - DNA, 22 bp, Homo sapiens
agagtttatttttttgatggct

SEQ ID NO: 5185597 - DNA, 13 bp, Homo sapiens
agagtttcagctt

SEQ ID NO: 5185598 - DNA, 17 bp, Homo sapiens
agagtttctgcagttcc

SEQ ID NO: 5185599 - DNA, 18 bp, Homo sapiens
agagtttctgtttgattc

SEQ ID NO: 5185600 - DNA, 22 bp, Homo sapiens
agagtttcttgtaagccatcag

SEQ ID NO: 5185601 - DNA, 16 bp, Homo sapiens
agagtttgaaaaacta

SEQ ID NO: 5185602 - DNA, 19 bp, Homo sapiens
agagtttgaaggaggtgag

SEQ ID NO: 5185603 - DNA, 18 bp, Homo sapiens
agagtttgatgaggccct

SEQ ID NO: 5185604 - DNA, 20 bp, Homo sapiens
agagtttgatgaggccctcc

SEQ ID NO: 5185605 - DNA, 14 bp, Homo sapiens
agagtttgcaaatg

SEQ ID NO: 5185606 - DNA, 19 bp, Homo sapiens
agagtttgcctccctgcac

SEQ ID NO: 5185607 - DNA, 21 bp, Homo sapiens
agagtttgccttcctttctcc

SEQ ID NO: 5185608 - DNA, 12 bp, Homo sapiens
agagtttgtaaa

SEQ ID NO: 5185609 - DNA, 23 bp, Homo sapiens
agagtttgtagtaaatattatga

SEQ ID NO: 5185610 - DNA, 15 bp, Homo sapiens
agagtttgtgtgtat

SEQ ID NO: 5185611 - DNA, 16 bp, Homo sapiens
agagtttgtgtgtatt

SEQ ID NO: 5185612 - DNA, 16 bp, Homo sapiens
agagtttgtgtgttgt

SEQ ID NO: 5185613 - DNA, 19 bp, Homo sapiens
agagtttgtgtgttgtctt

SEQ ID NO: 5185614 - DNA, 20 bp, Homo sapiens
agagtttgttctgttctggg

SEQ ID NO: 5185615 - DNA, 23 bp, Homo sapiens
agagtttgttctgttctggggga

SEQ ID NO: 5185616 - DNA, 13 bp, Homo sapiens
agagttttcctca

SEQ ID NO: 5185617 - DNA, 15 bp, Homo sapiens
agagttttctttctt

SEQ ID NO: 5185618 - DNA, 18 bp, Homo sapiens
agagttttggatgcagtg

SEQ ID NO: 5185619 - DNA, 16 bp, Homo sapiens
agagttttgtcttgaa

SEQ ID NO: 5185620 - DNA, 19 bp, Homo sapiens
agagttttgtcttgaatgt

SEQ ID NO: 5185621 - DNA, 17 bp, Homo sapiens
agagtttttaaagcctt

SEQ ID NO: 5185622 - DNA, 17 bp, Homo sapiens
agagtttttaatagaac

SEQ ID NO: 5185623 - DNA, 23 bp, Homo sapiens
agagtttttatgcctttctctcc

SEQ ID NO: 5185624 - DNA, 22 bp, Homo sapiens
agagttttttaaacaaatgagt

SEQ ID NO: 5185625 - DNA, 17 bp, Homo sapiens
agataaaaaaacagctt

SEQ ID NO: 5185626 - DNA, 18 bp, Homo sapiens
agataaaaaaacagcttt

SEQ ID NO: 5185627 - DNA, 20 bp, Homo sapiens
agataaaaaaactgttacca

SEQ ID NO: 5185628 - DNA, 14 bp, Homo sapiens
agataaaaagatgg

SEQ ID NO: 5185629 - DNA, 18 bp, Homo sapiens
agataaaagctgaagtta

SEQ ID NO: 5185630 - DNA, 13 bp, Homo sapiens
agataaaaggaga

SEQ ID NO: 5185631 - DNA, 19 bp, Homo sapiens
agataaaaggataggaaaa

SEQ ID NO: 5185632 - DNA, 22 bp, Homo sapiens
agataaaaggtggagtttctct

SEQ ID NO: 5185633 - DNA, 18 bp, Homo sapiens
agataaaatatcctcagg

SEQ ID NO: 5185634 - DNA, 14 bp, Homo sapiens
agataaaatgatgt

SEQ ID NO: 5185635 - DNA, 12 bp, Homo sapiens
agataaaatgta

SEQ ID NO: 5185636 - DNA, 14 bp, Homo sapiens
agataaacacaaga

SEQ ID NO: 5185637 - DNA, 21 bp, Homo sapiens
agataaacacagctgctttct

SEQ ID NO: 5185638 - DNA, 12 bp, Homo sapiens
agataaacatta

SEQ ID NO: 5185639 - DNA, 14 bp, Homo sapiens
agataaacattatt

SEQ ID NO: 5185640 - DNA, 19 bp, Homo sapiens
agataaaccgtttttaaca

SEQ ID NO: 5185641 - DNA, 19 bp, Homo sapiens
agataaacgaccaaactca

SEQ ID NO: 5185642 - DNA, 20 bp, Homo sapiens
agataaacgtggatgttact

SEQ ID NO: 5185643 - DNA, 16 bp, Homo sapiens
agataaactgaaattt

SEQ ID NO: 5185644 - DNA, 21 bp, Homo sapiens
agataaagaaactgaggccca

SEQ ID NO: 5185645 - DNA, 14 bp, Homo sapiens
agataaagacagct

SEQ ID NO: 5185646 - DNA, 17 bp, Homo sapiens
agataaagaccagaaat

SEQ ID NO: 5185647 - DNA, 16 bp, Homo sapiens
agataaagatgatcta

SEQ ID NO: 5185648 - DNA, 23 bp, Homo sapiens
agataaagatttctagtaggcag

SEQ ID NO: 5185649 - DNA, 18 bp, Homo sapiens
agataaagatttcttgag

SEQ ID NO: 5185650 - DNA, 20 bp, Homo sapiens
agataaagcactgtttggat

SEQ ID NO: 5185651 - DNA, 14 bp, Homo sapiens
agataaagcttagg

SEQ ID NO: 5185652 - DNA, 14 bp, Homo sapiens
agataaataatgta

SEQ ID NO: 5185653 - DNA, 13 bp, Homo sapiens
agataaatacatt

SEQ ID NO: 5185654 - DNA, 16 bp, Homo sapiens
agataaatacatttat

SEQ ID NO: 5185655 - DNA, 12 bp, Homo sapiens
agataaatatta

SEQ ID NO: 5185656 - DNA, 12 bp, Homo sapiens
agataaatattt

SEQ ID NO: 5185657 - DNA, 16 bp, Homo sapiens
agataaatatttatgc

SEQ ID NO: 5185658 - DNA, 20 bp, Homo sapiens
agataaatatttgacttgca

SEQ ID NO: 5185659 - DNA, 16 bp, Homo sapiens
agataaatccaatagt

SEQ ID NO: 5185660 - DNA, 16 bp, Homo sapiens
agataaatccttaaca

SEQ ID NO: 5185661 - DNA, 17 bp, Homo sapiens
agataaatccttaacat

SEQ ID NO: 5185662 - DNA, 19 bp, Homo sapiens
agataaatccttaacattt

SEQ ID NO: 5185663 - DNA, 17 bp, Homo sapiens
agataaatttgttgaat

SEQ ID NO: 5185664 - DNA, 15 bp, Homo sapiens
agataacatttgtgt

SEQ ID NO: 5185665 - DNA, 13 bp, Homo sapiens
agataacattttc

SEQ ID NO: 5185666 - DNA, 14 bp, Homo sapiens
agataacattttca

SEQ ID NO: 5185667 - DNA, 20 bp, Homo sapiens
agataacctaataattgtat

SEQ ID NO: 5185668 - DNA, 22 bp, Homo sapiens
agataacgaagtgcacttacac

SEQ ID NO: 5185669 - DNA, 16 bp, Homo sapiens
agataacggctctcca

SEQ ID NO: 5185670 - DNA, 18 bp, Homo sapiens
agataactctctttcctt

SEQ ID NO: 5185671 - DNA, 14 bp, Homo sapiens
agataactctttgg

SEQ ID NO: 5185672 - DNA, 16 bp, Homo sapiens
agataactctttggat

SEQ ID NO: 5185673 - DNA, 13 bp, Homo sapiens
agataactgctgt

SEQ ID NO: 5185674 - DNA, 14 bp, Homo sapiens
agataactgctgta

SEQ ID NO: 5185675 - DNA, 16 bp, Homo sapiens
agataactgctttgca

SEQ ID NO: 5185676 - DNA, 16 bp, Homo sapiens
agataactgttattta

SEQ ID NO: 5185677 - DNA, 21 bp, Homo sapiens
agataacttactgtatatgta

SEQ ID NO: 5185678 - DNA, 11 bp, Homo sapiens
agataactttt

SEQ ID NO: 5185679 - DNA, 13 bp, Homo sapiens
agataagaaagca

SEQ ID NO: 5185680 - DNA, 22 bp, Homo sapiens
agataagaatgctggttttcct

SEQ ID NO: 5185681 - DNA, 13 bp, Homo sapiens
agataagacttgt

SEQ ID NO: 5185682 - DNA, 17 bp, Homo sapiens
agataagacttgtttct

SEQ ID NO: 5185683 - DNA, 13 bp, Homo sapiens
agataagcaagag

SEQ ID NO: 5185684 - DNA, 20 bp, Homo sapiens
agataagcaagagagatgtt

SEQ ID NO: 5185685 - DNA, 22 bp, Homo sapiens
agataagcctgaaacagcctct

SEQ ID NO: 5185686 - DNA, 21 bp, Homo sapiens
agataaggactagatactact

SEQ ID NO: 5185687 - DNA, 18 bp, Homo sapiens
agataaggccgagcccac

SEQ ID NO: 5185688 - DNA, 19 bp, Homo sapiens
agataaggccgagcccaca

SEQ ID NO: 5185689 - DNA, 22 bp, Homo sapiens
agataaggccgagcccacacca

SEQ ID NO: 5185690 - DNA, 18 bp, Homo sapiens
agataaggtaaaatgcca

SEQ ID NO: 5185691 - DNA, 13 bp, Homo sapiens
agataaggtttta

SEQ ID NO: 5185692 - DNA, 21 bp, Homo sapiens
agataagtctacattaaacaa

SEQ ID NO: 5185693 - DNA, 23 bp, Homo sapiens
agataagtggccttgacacatta

SEQ ID NO: 5185694 - DNA, 20 bp, Homo sapiens
agataagtgtatttttcaat

SEQ ID NO: 5185695 - DNA, 20 bp, Homo sapiens
agataagttggaaacactaa

SEQ ID NO: 5185696 - DNA, 21 bp, Homo sapiens
agataagttggaaacactaaa

SEQ ID NO: 5185697 - DNA, 14 bp, Homo sapiens
agataataagatta

SEQ ID NO: 5185698 - DNA, 14 bp, Homo sapiens
agataataatatat

SEQ ID NO: 5185699 - DNA, 17 bp, Homo sapiens
agataataatatatgtt

SEQ ID NO: 5185700 - DNA, 21 bp, Homo sapiens
agataatagggttttcagatg

SEQ ID NO: 5185701 - DNA, 16 bp, Homo sapiens
agataatatctgtgag

SEQ ID NO: 5185702 - DNA, 21 bp, Homo sapiens
agataatatctgtgaggtgct

SEQ ID NO: 5185703 - DNA, 17 bp, Homo sapiens
agataatatgagaatca

SEQ ID NO: 5185704 - DNA, 18 bp, Homo sapiens
agataatattaaggaaga

SEQ ID NO: 5185705 - DNA, 15 bp, Homo sapiens
agataatattactgt

SEQ ID NO: 5185706 - DNA, 13 bp, Homo sapiens
agataatatttaa

SEQ ID NO: 5185707 - DNA, 17 bp, Homo sapiens
agataatatttaaaata

SEQ ID NO: 5185708 - DNA, 22 bp, Homo sapiens
agcatatatataaaatacacgt

SEQ ID NO: 5185709 - DNA, 20 bp, Homo sapiens
agcatatattcatacctgtt

SEQ ID NO: 5185710 - DNA, 18 bp, Homo sapiens
agcatatatttttatatt

SEQ ID NO: 5185711 - DNA, 16 bp, Homo sapiens
agcatatctgccttta

SEQ ID NO: 5185712 - DNA, 20 bp, Homo sapiens
agcatatctgcctttattgt

SEQ ID NO: 5185713 - DNA, 23 bp, Homo sapiens
agcatatctgcctttattgtgtt

SEQ ID NO: 5185714 - DNA, 16 bp, Homo sapiens
agcatatctggtatat

SEQ ID NO: 5185715 - DNA, 20 bp, Homo sapiens
agcatatgacaaatgtttct

SEQ ID NO: 5185716 - DNA, 16 bp, Homo sapiens
agcatatgaggatgca

SEQ ID NO: 5185717 - DNA, 23 bp, Homo sapiens
agcatatgaggatgcagagtcag

SEQ ID NO: 5185718 - DNA, 20 bp, Homo sapiens
agcatatgattgctccagag

SEQ ID NO: 5185719 - DNA, 21 bp, Homo sapiens
agcatatgatttcttgctttg

SEQ ID NO: 5185720 - DNA, 18 bp, Homo sapiens
agcatatgcctacttgta

SEQ ID NO: 5185721 - DNA, 22 bp, Homo sapiens
agcatatgcctacttgtaattt

SEQ ID NO: 5185722 - DNA, 16 bp, Homo sapiens
agcatatgctatcatt

SEQ ID NO: 5185723 - DNA, 20 bp, Homo sapiens
agcatatgtgttacttcaag

SEQ ID NO: 5185724 - DNA, 18 bp, Homo sapiens
agcatatgttccatgcct

SEQ ID NO: 5185725 - DNA, 22 bp, Homo sapiens
agcatatgttccatgcctggcc

SEQ ID NO: 5185726 - DNA, 19 bp, Homo sapiens
agcatattaatgcgatttc

SEQ ID NO: 5185727 - DNA, 21 bp, Homo sapiens
agcatattcaggaagctcagg

SEQ ID NO: 5185728 - DNA, 22 bp, Homo sapiens
agcatattcaggaagctcaggg

SEQ ID NO: 5185729 - DNA, 13 bp, Homo sapiens
agcatatttgaga

SEQ ID NO: 5185730 - DNA, 23 bp, Homo sapiens
agcatattttctccgaaaggcaa

SEQ ID NO: 5185731 - DNA, 22 bp, Homo sapiens
agcatattttctctaggctttt

SEQ ID NO: 5185732 - DNA, 16 bp, Homo sapiens
agcatattttcttact

SEQ ID NO: 5185733 - DNA, 14 bp, Homo sapiens
agcatattttgctg

SEQ ID NO: 5185734 - DNA, 16 bp, Homo sapiens
agcatattttgctggt

SEQ ID NO: 5185735 - DNA, 21 bp, Homo sapiens
agcatattttgtggcatttga

SEQ ID NO: 5185736 - DNA, 16 bp, Homo sapiens
agcatcaaaatacaac

SEQ ID NO: 5185737 - DNA, 13 bp, Homo sapiens
agcatcaaactct

SEQ ID NO: 5185738 - DNA, 14 bp, Homo sapiens
agcatcaaactctt

SEQ ID NO: 5185739 - DNA, 15 bp, Homo sapiens
agcatcaaataatac

SEQ ID NO: 5185740 - DNA, 17 bp, Homo sapiens
agcatcaaataatacat

SEQ ID NO: 5185741 - DNA, 20 bp, Homo sapiens
agcatcaagttctccccagg

SEQ ID NO: 5185742 - DNA, 14 bp, Homo sapiens
agcatcaatcttgt

SEQ ID NO: 5185743 - DNA, 16 bp, Homo sapiens
agcatcaatcttgtta

SEQ ID NO: 5185744 - DNA, 13 bp, Homo sapiens
agcatcacagaat

SEQ ID NO: 5185745 - DNA, 21 bp, Homo sapiens
agcatcaccaccacacccctg

SEQ ID NO: 5185746 - DNA, 16 bp, Homo sapiens
agcatcaccatgcatg

SEQ ID NO: 5185747 - DNA, 14 bp, Homo sapiens
agcatcacccacct

SEQ ID NO: 5185748 - DNA, 14 bp, Homo sapiens
agcatcacctcagg

SEQ ID NO: 5185749 - DNA, 14 bp, Homo sapiens
agcatcacttaaaa

SEQ ID NO: 5185750 - DNA, 18 bp, Homo sapiens
agcatcacttaaaacacg

SEQ ID NO: 5185751 - DNA, 23 bp, Homo sapiens
agcatcagaaggttcacccagca

SEQ ID NO: 5185752 - DNA, 16 bp, Homo sapiens
agcatcagagagtgta

SEQ ID NO: 5185753 - DNA, 15 bp, Homo sapiens
agcatcagagggctg

SEQ ID NO: 5185754 - DNA, 23 bp, Homo sapiens
agcatcagaggtttgcttcctca

SEQ ID NO: 5185755 - DNA, 14 bp, Homo sapiens
agcatcagcaagac

SEQ ID NO: 5185756 - DNA, 21 bp, Homo sapiens
agcatcaggccaggccctctg

SEQ ID NO: 5185757 - DNA, 22 bp, Homo sapiens
agcatcaggccaggccctctgc

SEQ ID NO: 5185758 - DNA, 20 bp, Homo sapiens
agcatcaggctaagaccctg

SEQ ID NO: 5185759 - DNA, 23 bp, Homo sapiens
agcatcaggctaagaccctgtgt

SEQ ID NO: 5185760 - DNA, 20 bp, Homo sapiens
agcatcagtacttgtttcta

SEQ ID NO: 5185761 - DNA, 14 bp, Homo sapiens
agcatcatcctgca

SEQ ID NO: 5185762 - DNA, 15 bp, Homo sapiens
agcatcatgcctctg

SEQ ID NO: 5185763 - DNA, 18 bp, Homo sapiens
agcatcatgcctctgagg

SEQ ID NO: 5185764 - DNA, 22 bp, Homo sapiens
agcatcatgcctctgaggccag

SEQ ID NO: 5185765 - DNA, 23 bp, Homo sapiens
agcatcatgcctctgaggccagc

SEQ ID NO: 5185766 - DNA, 22 bp, Homo sapiens
agcatcattatttatgtattgt

SEQ ID NO: 5185767 - DNA, 22 bp, Homo sapiens
agcatcattcagcaaatgcctt

SEQ ID NO: 5185768 - DNA, 18 bp, Homo sapiens
agcatcattgtaaattat

SEQ ID NO: 5185769 - DNA, 16 bp, Homo sapiens
agcatcattttgcatt

SEQ ID NO: 5185770 - DNA, 18 bp, Homo sapiens
agcatccacctccttctc

SEQ ID NO: 5185771 - DNA, 14 bp, Homo sapiens
agcatccagcctgt

SEQ ID NO: 5185772 - DNA, 22 bp, Homo sapiens
agcatccatgcggccggcctgg

SEQ ID NO: 5185773 - DNA, 17 bp, Homo sapiens
agcatcccagcctcaga

SEQ ID NO: 5185774 - DNA, 22 bp, Homo sapiens
agcatcccagcctcagaagcct

SEQ ID NO: 5185775 - DNA, 14 bp, Homo sapiens
agcatcccagcctt

SEQ ID NO: 5185776 - DNA, 20 bp, Homo sapiens
agcatccccttgaactcttc

SEQ ID NO: 5185777 - DNA, 13 bp, Homo sapiens
agcatcccggagg

SEQ ID NO: 5185778 - DNA, 14 bp, Homo sapiens
agcatcccggagga

SEQ ID NO: 5185779 - DNA, 18 bp, Homo sapiens
agcatccctaattcttca

SEQ ID NO: 5185780 - DNA, 21 bp, Homo sapiens
agcatccctatgggcttggac

SEQ ID NO: 5185781 - DNA, 17 bp, Homo sapiens
agcatccctcagcctgt

SEQ ID NO: 5185782 - DNA, 14 bp, Homo sapiens
agcatccctggagc

SEQ ID NO: 5185783 - DNA, 21 bp, Homo sapiens
agcatccctggagcaggagcc

SEQ ID NO: 5185784 - DNA, 13 bp, Homo sapiens
agcatccctgtga

SEQ ID NO: 5185785 - DNA, 23 bp, Homo sapiens
agcatcccttgaccaggcctggg

SEQ ID NO: 5185786 - DNA, 21 bp, Homo sapiens
agcatccgcaggtgctggtcc

SEQ ID NO: 5185787 - DNA, 19 bp, Homo sapiens
agcatccggccaaatgcaa

SEQ ID NO: 5185788 - DNA, 18 bp, Homo sapiens
agcatccgtctcccctcg

SEQ ID NO: 5185789 - DNA, 19 bp, Homo sapiens
agcatccgtctcccctcgt

SEQ ID NO: 5185790 - DNA, 23 bp, Homo sapiens
agcatcctaagaaatatgtgaga

SEQ ID NO: 5185791 - DNA, 15 bp, Homo sapiens
agcatcctcagttcc

SEQ ID NO: 5185792 - DNA, 16 bp, Homo sapiens
agcatcctcagttcct

SEQ ID NO: 5185793 - DNA, 15 bp, Homo sapiens
agcatcctccacatc

SEQ ID NO: 5185794 - DNA, 22 bp, Homo sapiens
agcatcctccacatcctgtgtc

SEQ ID NO: 5185795 - DNA, 12 bp, Homo sapiens
agcatcctcccc

SEQ ID NO: 5185796 - DNA, 13 bp, Homo sapiens
agcatcctcccca

SEQ ID NO: 5185797 - DNA, 22 bp, Homo sapiens
agcatcctccccaccagagctg

SEQ ID NO: 5185798 - DNA, 12 bp, Homo sapiens
agcatcctcctc

SEQ ID NO: 5185799 - DNA, 19 bp, Homo sapiens
agcatcctgagccccgccc

SEQ ID NO: 5185800 - DNA, 23 bp, Homo sapiens
agcatcctgccttagagccaggc

SEQ ID NO: 5185801 - DNA, 16 bp, Homo sapiens
agcatcctggaaattt

SEQ ID NO: 5185802 - DNA, 17 bp, Homo sapiens
agcatcctggcacccgg

SEQ ID NO: 5185803 - DNA, 18 bp, Homo sapiens
agcatcctggcacccggc

SEQ ID NO: 5185804 - DNA, 23 bp, Homo sapiens
agcatcctggcacccggcccctg

SEQ ID NO: 5185805 - DNA, 20 bp, Homo sapiens
agcatccttaagtatcagaa

SEQ ID NO: 5185806 - DNA, 19 bp, Homo sapiens
agcatccttttctgcagag

SEQ ID NO: 5185807 - DNA, 19 bp, Homo sapiens
agcatcgcactctggcagc

SEQ ID NO: 5185808 - DNA, 19 bp, Homo sapiens
agcatcgcttaggagaagt

SEQ ID NO: 5185809 - DNA, 22 bp, Homo sapiens
agcatcggacaagacccccagc

SEQ ID NO: 5185810 - DNA, 21 bp, Homo sapiens
agcatcggcctagggccccca

SEQ ID NO: 5185811 - DNA, 12 bp, Homo sapiens
agcatcgggagc

SEQ ID NO: 5185812 - DNA, 21 bp, Homo sapiens
agcatcgggagcacccagagc

SEQ ID NO: 5185813 - DNA, 22 bp, Homo sapiens
agcatcgggagcacccagagca

SEQ ID NO: 5185814 - DNA, 18 bp, Homo sapiens
agcatcgggggcctgcaa

SEQ ID NO: 5185815 - DNA, 21 bp, Homo sapiens
agcatcgggggcctgcaaatc

SEQ ID NO: 5185816 - DNA, 17 bp, Homo sapiens
agcatcggtcatgtgtg

SEQ ID NO: 5185817 - DNA, 22 bp, Homo sapiens
agcatcgtctcatgtaaaataa

SEQ ID NO: 5185818 - DNA, 18 bp, Homo sapiens
agcatcgtgacccttcag

SEQ ID NO: 5185819 - DNA, 23 bp, Homo sapiens
agcatcgtgacccttcagggcca

SEQ ID NO: 5185820 - DNA, 17 bp, Homo sapiens
agcatcgtgatcactga

SEQ ID NO: 5185821 - DNA, 21 bp, Homo sapiens
agcatcgtgatcactgagcca

SEQ ID NO: 5185822 - DNA, 22 bp, Homo sapiens
agcatctaagttataagactct

SEQ ID NO: 5185823 - DNA, 23 bp, Homo sapiens
agcatctaagttataagactctc

SEQ ID NO: 5185824 - DNA, 16 bp, Homo sapiens
agcatctaatgaatgt

SEQ ID NO: 5185825 - DNA, 15 bp, Homo sapiens
agcatctactctagg

SEQ ID NO: 5185826 - DNA, 15 bp, Homo sapiens
agcatctcagagtcc

SEQ ID NO: 5185827 - DNA, 20 bp, Homo sapiens
agcatctcagcctaccatga

SEQ ID NO: 5185828 - DNA, 15 bp, Homo sapiens
agcatctcagctcat

SEQ ID NO: 5185829 - DNA, 23 bp, Homo sapiens
agcatctccagcattctcagcca

SEQ ID NO: 5185830 - DNA, 12 bp, Homo sapiens
agcatctcccag

SEQ ID NO: 5185831 - DNA, 14 bp, Homo sapiens
agcatctcccagca

SEQ ID NO: 5185832 - DNA, 17 bp, Homo sapiens
agcatctcccagcaaga

SEQ ID NO: 5185833 - DNA, 22 bp, Homo sapiens
agcatctccctcactgaaacca

SEQ ID NO: 5185834 - DNA, 19 bp, Homo sapiens
agcatctccggggctttgt

SEQ ID NO: 5185835 - DNA, 15 bp, Homo sapiens
agcatctctaccttc

SEQ ID NO: 5185836 - DNA, 14 bp, Homo sapiens
agcatctctgacca

SEQ ID NO: 5185837 - DNA, 14 bp, Homo sapiens
agcatctcttcttc

SEQ ID NO: 5185838 - DNA, 21 bp, Homo sapiens
agcatctcttcttccctgtca

SEQ ID NO: 5185839 - DNA, 17 bp, Homo sapiens
agcatctcttgaggcca

SEQ ID NO: 5185840 - DNA, 16 bp, Homo sapiens
agcatctgaccatctg

SEQ ID NO: 5185841 - DNA, 20 bp, Homo sapiens
agcatctgagaaggccctgt

SEQ ID NO: 5185842 - DNA, 22 bp, Homo sapiens
agcatctgatagaatgatgttt

SEQ ID NO: 5185843 - DNA, 14 bp, Homo sapiens
agcatctgcaacaa

SEQ ID NO: 5185844 - DNA, 24 bp, Homo sapiens
agcatctgcattgcccagtctttc

SEQ ID NO: 5185845 - DNA, 12 bp, Homo sapiens
agcatctgcccc

SEQ ID NO: 5185846 - DNA, 23 bp, Homo sapiens
agcatctgccccaggtacacctc

SEQ ID NO: 5185847 - DNA, 16 bp, Homo sapiens
agcatctgctctgaga

SEQ ID NO: 5185848 - DNA, 19 bp, Homo sapiens
agcatctggattctgccta

SEQ ID NO: 5185849 - DNA, 16 bp, Homo sapiens
agcatctggctctaat

SEQ ID NO: 5185850 - DNA, 13 bp, Homo sapiens
agcatctggctgt

SEQ ID NO: 5185851 - DNA, 23 bp, Homo sapiens
agcatctggctgtctagaatgtg

SEQ ID NO: 5185852 - DNA, 18 bp, Homo sapiens
agcatctgggccttggcc

SEQ ID NO: 5185853 - DNA, 15 bp, Homo sapiens
agcatctgtcccact

SEQ ID NO: 5185854 - DNA, 20 bp, Homo sapiens
agcatctgtttacctggcag

SEQ ID NO: 5185855 - DNA, 18 bp, Homo sapiens
agcatcttcacttctaaa

SEQ ID NO: 5185856 - DNA, 20 bp, Homo sapiens
agcatcttccagaagtgtga

SEQ ID NO: 5185857 - DNA, 19 bp, Homo sapiens
agcatcttctcactccctt

SEQ ID NO: 5185858 - DNA, 23 bp, Homo sapiens
agcatcttgggggggtggccgct

SEQ ID NO: 5185859 - DNA, 16 bp, Homo sapiens
agcatctttgcccttc

SEQ ID NO: 5185860 - DNA, 21 bp, Homo sapiens
agcatcttttccatcctgagg

SEQ ID NO: 5185861 - DNA, 17 bp, Homo sapiens
agcatgaaaatgtgtgt

SEQ ID NO: 5185862 - DNA, 13 bp, Homo sapiens
agcatgaaacatt

SEQ ID NO: 5185863 - DNA, 14 bp, Homo sapiens
agcatgaaaggtaa

SEQ ID NO: 5185864 - DNA, 17 bp, Homo sapiens
agcatgaaataaaatat

SEQ ID NO: 5185865 - DNA, 19 bp, Homo sapiens
agcatgaaataaaatatat

SEQ ID NO: 5185866 - DNA, 16 bp, Homo sapiens
agcatgaaatgtgaat

SEQ ID NO: 5185867 - DNA, 18 bp, Homo sapiens
agcatgaacgccaaggaa

SEQ ID NO: 5185868 - DNA, 19 bp, Homo sapiens
agcatgaacgccaaggaat

SEQ ID NO: 5185869 - DNA, 22 bp, Homo sapiens
agcatgaagaattttttctcat

SEQ ID NO: 5185870 - DNA, 22 bp, Homo sapiens
agcatgaagataaacacagctg

SEQ ID NO: 5185871 - DNA, 21 bp, Homo sapiens
agcatgaataaaacactcatc

SEQ ID NO: 5185872 - DNA, 14 bp, Homo sapiens
agcatgaataaaat

SEQ ID NO: 5185873 - DNA, 18 bp, Homo sapiens
agcatgaataacatttaa

SEQ ID NO: 5185874 - DNA, 19 bp, Homo sapiens
agcatgaataacatttaaa

SEQ ID NO: 5185875 - DNA, 20 bp, Homo sapiens
agcatgaataacatttaaat

SEQ ID NO: 5185876 - DNA, 18 bp, Homo sapiens
agcatgacaaaaataaca

SEQ ID NO: 5185877 - DNA, 21 bp, Homo sapiens
agcatgacaaaaataacactg

SEQ ID NO: 5185878 - DNA, 20 bp, Homo sapiens
agcatgacaaaagtgacaga

SEQ ID NO: 5185879 - DNA, 17 bp, Homo sapiens
agcatgacaacttttaa

SEQ ID NO: 5185880 - DNA, 19 bp, Homo sapiens
agcatgacaagccccaggc

SEQ ID NO: 5185881 - DNA, 21 bp, Homo sapiens
agcatgacaagccccaggcag

SEQ ID NO: 5185882 - DNA, 20 bp, Homo sapiens
agcatgacagcctgcagcag

SEQ ID NO: 5185883 - DNA, 15 bp, Homo sapiens
agataatcagcctct

SEQ ID NO: 5185884 - DNA, 16 bp, Homo sapiens
agataatcagcctctt

SEQ ID NO: 5185885 - DNA, 19 bp, Homo sapiens
agataatcagtgtgtctaa

SEQ ID NO: 5185886 - DNA, 20 bp, Homo sapiens
agataatcgaagcaaaagta

SEQ ID NO: 5185887 - DNA, 23 bp, Homo sapiens
agataatctagaacacaggcaaa

SEQ ID NO: 5185888 - DNA, 23 bp, Homo sapiens
agataatgaaatagttattttaa

SEQ ID NO: 5185889 - DNA, 14 bp, Homo sapiens
agataatgatactt

SEQ ID NO: 5185890 - DNA, 17 bp, Homo sapiens
agataatgatacttaac

SEQ ID NO: 5185891 - DNA, 21 bp, Homo sapiens
agataatgcatatttttgcac

SEQ ID NO: 5185892 - DNA, 13 bp, Homo sapiens
agataatggagaa

SEQ ID NO: 5185893 - DNA, 12 bp, Homo sapiens
agataatggtaa

SEQ ID NO: 5185894 - DNA, 18 bp, Homo sapiens
agataatggtaatttagt

SEQ ID NO: 5185895 - DNA, 19 bp, Homo sapiens
agataatgtgatattatac

SEQ ID NO: 5185896 - DNA, 17 bp, Homo sapiens
agataatgttctttaat

SEQ ID NO: 5185897 - DNA, 15 bp, Homo sapiens
agataattaaaaaga

SEQ ID NO: 5185898 - DNA, 22 bp, Homo sapiens
agataattaaaaagatggttgc

SEQ ID NO: 5185899 - DNA, 20 bp, Homo sapiens
agataattaaatgaaatact

SEQ ID NO: 5185900 - DNA, 17 bp, Homo sapiens
agataattactgccttg

SEQ ID NO: 5185901 - DNA, 17 bp, Homo sapiens
agataattatcagtcat

SEQ ID NO: 5185902 - DNA, 24 bp, Homo sapiens
agataattatcagtcatgaggaaa

SEQ ID NO: 5185903 - DNA, 13 bp, Homo sapiens
agataattctgga

SEQ ID NO: 5185904 - DNA, 14 bp, Homo sapiens
agataattgtactt

SEQ ID NO: 5185905 - DNA, 15 bp, Homo sapiens
agataattgtacttt

SEQ ID NO: 5185906 - DNA, 21 bp, Homo sapiens
agataattgtactttgaaaac

SEQ ID NO: 5185907 - DNA, 22 bp, Homo sapiens
agataattgtactttgaaaaca

SEQ ID NO: 5185908 - DNA, 17 bp, Homo sapiens
agataattgttgaaatt

SEQ ID NO: 5185909 - DNA, 18 bp, Homo sapiens
agataattgttgaaattt

SEQ ID NO: 5185910 - DNA, 18 bp, Homo sapiens
agataatttacaagatat

SEQ ID NO: 5185911 - DNA, 19 bp, Homo sapiens
agataatttacaagatatt

SEQ ID NO: 5185912 - DNA, 20 bp, Homo sapiens
agataatttacaagatatta

SEQ ID NO: 5185913 - DNA, 19 bp, Homo sapiens
agataatttattttgtatt

SEQ ID NO: 5185914 - DNA, 16 bp, Homo sapiens
agataattttatgtgt

SEQ ID NO: 5185915 - DNA, 18 bp, Homo sapiens
agataattttcagctgca

SEQ ID NO: 5185916 - DNA, 20 bp, Homo sapiens
agatacaaataaggacacaa

SEQ ID NO: 5185917 - DNA, 19 bp, Homo sapiens
agatacaaatggtggagga

SEQ ID NO: 5185918 - DNA, 17 bp, Homo sapiens
agatacaaggcccagaa

SEQ ID NO: 5185919 - DNA, 15 bp, Homo sapiens
agatacaagtttcag

SEQ ID NO: 5185920 - DNA, 21 bp, Homo sapiens
agatacaatcagctgctttgt

SEQ ID NO: 5185921 - DNA, 13 bp, Homo sapiens
agatacaatgtat

SEQ ID NO: 5185922 - DNA, 16 bp, Homo sapiens
agatacaatgtattta

SEQ ID NO: 5185923 - DNA, 15 bp, Homo sapiens
agatacacaaaatat

SEQ ID NO: 5185924 - DNA, 15 bp, Homo sapiens
agatacacaagtgag

SEQ ID NO: 5185925 - DNA, 22 bp, Homo sapiens
agatacacagctccgagctgta

SEQ ID NO: 5185926 - DNA, 14 bp, Homo sapiens
agatacactcctgc

SEQ ID NO: 5185927 - DNA, 18 bp, Homo sapiens
agatacactgcactttgt

SEQ ID NO: 5185928 - DNA, 21 bp, Homo sapiens
agatacactgcactttgttta

SEQ ID NO: 5185929 - DNA, 14 bp, Homo sapiens
agatacagacattc

SEQ ID NO: 5185930 - DNA, 20 bp, Homo sapiens
agatacagatccgcatgtgt

SEQ ID NO: 5185931 - DNA, 21 bp, Homo sapiens
agatacagatccgcatgtgtc

SEQ ID NO: 5185932 - DNA, 14 bp, Homo sapiens
agatacaggaaaaa

SEQ ID NO: 5185933 - DNA, 19 bp, Homo sapiens
agatacaggaaaagctgct

SEQ ID NO: 5185934 - DNA, 22 bp, Homo sapiens
agatacagttactcagaattct

SEQ ID NO: 5185935 - DNA, 16 bp, Homo sapiens
agatacatacagaatt

SEQ ID NO: 5185936 - DNA, 18 bp, Homo sapiens
agatacatatgagtgtgg

SEQ ID NO: 5185937 - DNA, 13 bp, Homo sapiens
agatacatcactg

SEQ ID NO: 5185938 - DNA, 20 bp, Homo sapiens
agatacatcactgcttgatg

SEQ ID NO: 5185939 - DNA, 16 bp, Homo sapiens
agatacatgattgaaa

SEQ ID NO: 5185940 - DNA, 17 bp, Homo sapiens
agatacatggggaactg

SEQ ID NO: 5185941 - DNA, 19 bp, Homo sapiens
agatacattccctatcaaa

SEQ ID NO: 5185942 - DNA, 23 bp, Homo sapiens
agatacatttgtatgttgtgaag

SEQ ID NO: 5185943 - DNA, 18 bp, Homo sapiens
agataccaaatagaaaca

SEQ ID NO: 5185944 - DNA, 22 bp, Homo sapiens
agataccacaaaccctgctgaa

SEQ ID NO: 5185945 - DNA, 19 bp, Homo sapiens
agataccagcgaggaggct

SEQ ID NO: 5185946 - DNA, 23 bp, Homo sapiens
agataccagctttttctctcagg

SEQ ID NO: 5185947 - DNA, 18 bp, Homo sapiens
agataccaggttgaaaga

SEQ ID NO: 5185948 - DNA, 19 bp, Homo sapiens
agataccaggttgaaagac

SEQ ID NO: 5185949 - DNA, 16 bp, Homo sapiens
agataccatactcatt

SEQ ID NO: 5185950 - DNA, 14 bp, Homo sapiens
agataccatcagca

SEQ ID NO: 5185951 - DNA, 15 bp, Homo sapiens
agatacccagagaga

SEQ ID NO: 5185952 - DNA, 23 bp, Homo sapiens
agataccctacgctgtccagaaa

SEQ ID NO: 5185953 - DNA, 16 bp, Homo sapiens
agataccgagaatgat

SEQ ID NO: 5185954 - DNA, 19 bp, Homo sapiens
agatacctcatcatccacc

SEQ ID NO: 5185955 - DNA, 15 bp, Homo sapiens
agatacctgtgagga

SEQ ID NO: 5185956 - DNA, 16 bp, Homo sapiens
agatacctgtgaggac

SEQ ID NO: 5185957 - DNA, 22 bp, Homo sapiens
agataccttatcttacaatatt

SEQ ID NO: 5185958 - DNA, 21 bp, Homo sapiens
agataccttgaaaggcaggaa

SEQ ID NO: 5185959 - DNA, 15 bp, Homo sapiens
agatactaaagcaaa

SEQ ID NO: 5185960 - DNA, 21 bp, Homo sapiens
agatactactgaccagacaag

SEQ ID NO: 5185961 - DNA, 23 bp, Homo sapiens
agatactactgaccagacaagct

SEQ ID NO: 5185962 - DNA, 17 bp, Homo sapiens
agatactactttctctt

SEQ ID NO: 5185963 - DNA, 24 bp, Homo sapiens
agatactatttagataacaagaat

SEQ ID NO: 5185964 - DNA, 16 bp, Homo sapiens
agatactcaagcaggt

SEQ ID NO: 5185965 - DNA, 23 bp, Homo sapiens
agatactgaagtgcagctcagga

SEQ ID NO: 5185966 - DNA, 22 bp, Homo sapiens
agatactgcatgtttgctgttc

SEQ ID NO: 5185967 - DNA, 23 bp, Homo sapiens
agatactgctactgtaattttat

SEQ ID NO: 5185968 - DNA, 22 bp, Homo sapiens
agatactgctgatgctgaaata

SEQ ID NO: 5185969 - DNA, 22 bp, Homo sapiens
agatactgctgtgtaatggtta

SEQ ID NO: 5185970 - DNA, 19 bp, Homo sapiens
agatactgtatatgtcaaa

SEQ ID NO: 5185971 - DNA, 16 bp, Homo sapiens
agatactgtatcatga

SEQ ID NO: 5185972 - DNA, 16 bp, Homo sapiens
agatacttaagtgctg

SEQ ID NO: 5185973 - DNA, 15 bp, Homo sapiens
agatacttacatttc

SEQ ID NO: 5185974 - DNA, 22 bp, Homo sapiens
agatacttacatttccatttat

SEQ ID NO: 5185975 - DNA, 15 bp, Homo sapiens
agatacttatgaaat

SEQ ID NO: 5185976 - DNA, 18 bp, Homo sapiens
agatacttatttttctga

SEQ ID NO: 5185977 - DNA, 17 bp, Homo sapiens
agatacttgatgcactt

SEQ ID NO: 5185978 - DNA, 18 bp, Homo sapiens
agatacttgatgcactta

SEQ ID NO: 5185979 - DNA, 22 bp, Homo sapiens
agatacttggggggctgaggtg

SEQ ID NO: 5185980 - DNA, 19 bp, Homo sapiens
agatactttgcattgtctg

SEQ ID NO: 5185981 - DNA, 15 bp, Homo sapiens
agatactttgtattg

SEQ ID NO: 5185982 - DNA, 16 bp, Homo sapiens
agatactttgtattgt

SEQ ID NO: 5185983 - DNA, 21 bp, Homo sapiens
agatactttttcttttgtaag

SEQ ID NO: 5185984 - DNA, 23 bp, Homo sapiens
agatagaaaacagcccccactcc

SEQ ID NO: 5185985 - DNA, 19 bp, Homo sapiens
agatagaaagcaataaaaa

SEQ ID NO: 5185986 - DNA, 14 bp, Homo sapiens
agatagaaagcatt

SEQ ID NO: 5185987 - DNA, 11 bp, Homo sapiens
agatagaaata

SEQ ID NO: 5185988 - DNA, 22 bp, Homo sapiens
agatagaaataaatagctatat

SEQ ID NO: 5185989 - DNA, 22 bp, Homo sapiens
agatagaacacaaaacttgaaa

SEQ ID NO: 5185990 - DNA, 12 bp, Homo sapiens
agatagaacagg

SEQ ID NO: 5185991 - DNA, 20 bp, Homo sapiens
agatagaacaggctggttct

SEQ ID NO: 5185992 - DNA, 13 bp, Homo sapiens
agatagaagaact

SEQ ID NO: 5185993 - DNA, 14 bp, Homo sapiens
agatagaagaactg

SEQ ID NO: 5185994 - DNA, 18 bp, Homo sapiens
agatagaatgtcaatatt

SEQ ID NO: 5185995 - DNA, 18 bp, Homo sapiens
agatagacgggttgaaag

SEQ ID NO: 5185996 - DNA, 19 bp, Homo sapiens
agatagacgggttgaaaga

SEQ ID NO: 5185997 - DNA, 23 bp, Homo sapiens
agatagagattcccctggaccac

SEQ ID NO: 5185998 - DNA, 14 bp, Homo sapiens
agatagagctgggt

SEQ ID NO: 5185999 - DNA, 15 bp, Homo sapiens
agatagaggatgggc

SEQ ID NO: 5186000 - DNA, 14 bp, Homo sapiens
agatagatttggaa

SEQ ID NO: 5186001 - DNA, 16 bp, Homo sapiens
agatagatttggaata

SEQ ID NO: 5186002 - DNA, 19 bp, Homo sapiens
agatagcagaggaaaaaga

SEQ ID NO: 5186003 - DNA, 17 bp, Homo sapiens
agatagcattgtgaact

SEQ ID NO: 5186004 - DNA, 22 bp, Homo sapiens
agatagcattgtgaactgacag

SEQ ID NO: 5186005 - DNA, 16 bp, Homo sapiens
agatagccaaggccaa

SEQ ID NO: 5186006 - DNA, 20 bp, Homo sapiens
agatagccaaggccaaagga

SEQ ID NO: 5186007 - DNA, 16 bp, Homo sapiens
agatagccagacacat

SEQ ID NO: 5186008 - DNA, 14 bp, Homo sapiens
agatagcccaggag

SEQ ID NO: 5186009 - DNA, 23 bp, Homo sapiens
agatagcccaggagcaacagcct

SEQ ID NO: 5186010 - DNA, 19 bp, Homo sapiens
agatagccccacaggaggt

SEQ ID NO: 5186011 - DNA, 15 bp, Homo sapiens
agatagccctgtcct

SEQ ID NO: 5186012 - DNA, 18 bp, Homo sapiens
agatagccgggctccagg

SEQ ID NO: 5186013 - DNA, 15 bp, Homo sapiens
agatagcctgtggcc

SEQ ID NO: 5186014 - DNA, 18 bp, Homo sapiens
agatagcgcatatatttg

SEQ ID NO: 5186015 - DNA, 22 bp, Homo sapiens
agatagctcaatactctctgag

SEQ ID NO: 5186016 - DNA, 21 bp, Homo sapiens
agatagctgcatgtggctttt

SEQ ID NO: 5186017 - DNA, 16 bp, Homo sapiens
agatagctgtgacttc

SEQ ID NO: 5186018 - DNA, 12 bp, Homo sapiens
agataggacctt

SEQ ID NO: 5186019 - DNA, 18 bp, Homo sapiens
agataggaccttgggcca

SEQ ID NO: 5186020 - DNA, 13 bp, Homo sapiens
agataggctctgc

SEQ ID NO: 5186021 - DNA, 16 bp, Homo sapiens
agataggctctgcaca

SEQ ID NO: 5186022 - DNA, 13 bp, Homo sapiens
agatagggaacac

SEQ ID NO: 5186023 - DNA, 14 bp, Homo sapiens
agataggggagggg

SEQ ID NO: 5186024 - DNA, 16 bp, Homo sapiens
agataggggagggggg

SEQ ID NO: 5186025 - DNA, 17 bp, Homo sapiens
agataggggagggggga

SEQ ID NO: 5186026 - DNA, 18 bp, Homo sapiens
agatagggggaagacaga

SEQ ID NO: 5186027 - DNA, 21 bp, Homo sapiens
agataggtcagtgcaaatact

SEQ ID NO: 5186028 - DNA, 23 bp, Homo sapiens
agatagtcatgctgctagatctt

SEQ ID NO: 5186029 - DNA, 13 bp, Homo sapiens
agatagtgccagg

SEQ ID NO: 5186030 - DNA, 20 bp, Homo sapiens
agatagtgctttattttgtt

SEQ ID NO: 5186031 - DNA, 18 bp, Homo sapiens
agatagttaaaagactgc

SEQ ID NO: 5186032 - DNA, 22 bp, Homo sapiens
agatagttaaaagactgcagct

SEQ ID NO: 5186033 - DNA, 23 bp, Homo sapiens
agatagttaaaagactgcagctg

SEQ ID NO: 5186034 - DNA, 18 bp, Homo sapiens
agatagttacatttatgt

SEQ ID NO: 5186035 - DNA, 22 bp, Homo sapiens
agatagttacatttatgtgctg

SEQ ID NO: 5186036 - DNA, 13 bp, Homo sapiens
agatagttgtaaa

SEQ ID NO: 5186037 - DNA, 12 bp, Homo sapiens
agatagttttgc

SEQ ID NO: 5186038 - DNA, 15 bp, Homo sapiens
agatataaaagactg

SEQ ID NO: 5186039 - DNA, 16 bp, Homo sapiens
agatataaaataggct

SEQ ID NO: 5186040 - DNA, 12 bp, Homo sapiens
agatataaaatc

SEQ ID NO: 5186041 - DNA, 13 bp, Homo sapiens
agatataaagcca

SEQ ID NO: 5186042 - DNA, 14 bp, Homo sapiens
agatataaatactg

SEQ ID NO: 5186043 - DNA, 13 bp, Homo sapiens
agatataaatgaa

SEQ ID NO: 5186044 - DNA, 15 bp, Homo sapiens
agatataaatggctg

SEQ ID NO: 5186045 - DNA, 16 bp, Homo sapiens
agatataacattcagt

SEQ ID NO: 5186046 - DNA, 21 bp, Homo sapiens
agatataagatttgtacatat

SEQ ID NO: 5186047 - DNA, 22 bp, Homo sapiens
agatataagatttgtacatatt

SEQ ID NO: 5186048 - DNA, 13 bp, Homo sapiens
agatataagtgct

SEQ ID NO: 5186049 - DNA, 15 bp, Homo sapiens
agatataagtgctgt

SEQ ID NO: 5186050 - DNA, 18 bp, Homo sapiens
agatataagtgctgtata

SEQ ID NO: 5186051 - DNA, 20 bp, Homo sapiens
agatataagtgctgtataaa

SEQ ID NO: 5186052 - DNA, 22 bp, Homo sapiens
agatataagtgctgtataaaat

SEQ ID NO: 5186053 - DNA, 19 bp, Homo sapiens
agatataatgaacaaaatt

SEQ ID NO: 5186054 - DNA, 15 bp, Homo sapiens
agatatacttgtttt

SEQ ID NO: 5186055 - DNA, 19 bp, Homo sapiens
agatatagaaactctcatt

SEQ ID NO: 5186056 - DNA, 23 bp, Homo sapiens
agatatagcattaataaaactgt

SEQ ID NO: 5186057 - DNA, 16 bp, Homo sapiens
agatataggataaaat

SEQ ID NO: 5186058 - DNA, 18 bp, Homo sapiens
agatataggataaaataa

SEQ ID NO: 5186059 - DNA, 11 bp, Homo sapiens
agatatataaa

SEQ ID NO: 5186060 - DNA, 20 bp, Homo sapiens
agcatgacataacagtgcag

SEQ ID NO: 5186061 - DNA, 22 bp, Homo sapiens
agcatgacctgtgaccagcact

SEQ ID NO: 5186062 - DNA, 12 bp, Homo sapiens
agcatgaccttt

SEQ ID NO: 5186063 - DNA, 21 bp, Homo sapiens
agcatgaccttttggcctttg

SEQ ID NO: 5186064 - DNA, 22 bp, Homo sapiens
agcatgagactatgtaaaaata

SEQ ID NO: 5186065 - DNA, 13 bp, Homo sapiens
agcatgagacttt

SEQ ID NO: 5186066 - DNA, 19 bp, Homo sapiens
agcatgagattgtacattt

SEQ ID NO: 5186067 - DNA, 17 bp, Homo sapiens
agcatgagccagctctg

SEQ ID NO: 5186068 - DNA, 15 bp, Homo sapiens
agcatgagctttcca

SEQ ID NO: 5186069 - DNA, 16 bp, Homo sapiens
agcatgagctttccag

SEQ ID NO: 5186070 - DNA, 15 bp, Homo sapiens
agcatgagtggcctt

SEQ ID NO: 5186071 - DNA, 16 bp, Homo sapiens
agcatgagttctgcac

SEQ ID NO: 5186072 - DNA, 13 bp, Homo sapiens
agcatgatgggaa

SEQ ID NO: 5186073 - DNA, 14 bp, Homo sapiens
agcatgatgggaaa

SEQ ID NO: 5186074 - DNA, 20 bp, Homo sapiens
agcatgattctttaatagaa

SEQ ID NO: 5186075 - DNA, 14 bp, Homo sapiens
agcatgatttgaaa

SEQ ID NO: 5186076 - DNA, 15 bp, Homo sapiens
agcatgatttgaaaa

SEQ ID NO: 5186077 - DNA, 23 bp, Homo sapiens
agcatgatttgaaaaaaagcatg

SEQ ID NO: 5186078 - DNA, 21 bp, Homo sapiens
agcatgcaataatgtgcaaat

SEQ ID NO: 5186079 - DNA, 16 bp, Homo sapiens
agcatgcacaaagtgt

SEQ ID NO: 5186080 - DNA, 14 bp, Homo sapiens
agcatgcacaaatt

SEQ ID NO: 5186081 - DNA, 17 bp, Homo sapiens
agcatgcacactgagaa

SEQ ID NO: 5186082 - DNA, 18 bp, Homo sapiens
agcatgcacagctgcttg

SEQ ID NO: 5186083 - DNA, 15 bp, Homo sapiens
agcatgcaccacggg

SEQ ID NO: 5186084 - DNA, 20 bp, Homo sapiens
agcatgcagaggaggtgaga

SEQ ID NO: 5186085 - DNA, 21 bp, Homo sapiens
agcatgcagcgaattcagaaa

SEQ ID NO: 5186086 - DNA, 22 bp, Homo sapiens
agcatgcatagtgctaagaaag

SEQ ID NO: 5186087 - DNA, 21 bp, Homo sapiens
agcatgcatatcattaaacaa

SEQ ID NO: 5186088 - DNA, 20 bp, Homo sapiens
agcatgcattgaaaaatttc

SEQ ID NO: 5186089 - DNA, 18 bp, Homo sapiens
agcatgcatttagcatga

SEQ ID NO: 5186090 - DNA, 18 bp, Homo sapiens
agcatgccaacaagaatg

SEQ ID NO: 5186091 - DNA, 22 bp, Homo sapiens
agcatgcccaaatataacatga

SEQ ID NO: 5186092 - DNA, 13 bp, Homo sapiens
agcatgcccagat

SEQ ID NO: 5186093 - DNA, 20 bp, Homo sapiens
agcatgcccagattcccaga

SEQ ID NO: 5186094 - DNA, 14 bp, Homo sapiens
agcatgccccaccc

SEQ ID NO: 5186095 - DNA, 17 bp, Homo sapiens
agcatgccccacccacc

SEQ ID NO: 5186096 - DNA, 12 bp, Homo sapiens
agcatgcccctt

SEQ ID NO: 5186097 - DNA, 12 bp, Homo sapiens
agcatgcctgga

SEQ ID NO: 5186098 - DNA, 23 bp, Homo sapiens
agcatgcctggatggggctgcac

SEQ ID NO: 5186099 - DNA, 14 bp, Homo sapiens
agcatgctgctttg

SEQ ID NO: 5186100 - DNA, 19 bp, Homo sapiens
agcatgcttcccagaggga

SEQ ID NO: 5186101 - DNA, 17 bp, Homo sapiens
agcatgcttccctgcag

SEQ ID NO: 5186102 - DNA, 14 bp, Homo sapiens
agcatgcttccttt

SEQ ID NO: 5186103 - DNA, 23 bp, Homo sapiens
agcatgcttcctttctctcctgg

SEQ ID NO: 5186104 - DNA, 17 bp, Homo sapiens
agcatgcttgggctgac

SEQ ID NO: 5186105 - DNA, 20 bp, Homo sapiens
agcatgcttgggctgaccca

SEQ ID NO: 5186106 - DNA, 23 bp, Homo sapiens
agcatgcttgggctgacccagca

SEQ ID NO: 5186107 - DNA, 17 bp, Homo sapiens
agcatgcttgtgaaaat

SEQ ID NO: 5186108 - DNA, 17 bp, Homo sapiens
agcatgctttgctgcta

SEQ ID NO: 5186109 - DNA, 22 bp, Homo sapiens
agcatggaaaaatggttgatgg

SEQ ID NO: 5186110 - DNA, 18 bp, Homo sapiens
agcatggactgttcattt

SEQ ID NO: 5186111 - DNA, 22 bp, Homo sapiens
agcatggactgttcatttgaaa

SEQ ID NO: 5186112 - DNA, 16 bp, Homo sapiens
agcatggagaacagtg

SEQ ID NO: 5186113 - DNA, 20 bp, Homo sapiens
agcatggagagcctcttagt

SEQ ID NO: 5186114 - DNA, 14 bp, Homo sapiens
agcatggagctggc

SEQ ID NO: 5186115 - DNA, 16 bp, Homo sapiens
agcatggagctggccg

SEQ ID NO: 5186116 - DNA, 19 bp, Homo sapiens
agcatggaggaggagggag

SEQ ID NO: 5186117 - DNA, 21 bp, Homo sapiens
agcatggaggaggagggaggc

SEQ ID NO: 5186118 - DNA, 15 bp, Homo sapiens
agcatggatgcattt

SEQ ID NO: 5186119 - DNA, 19 bp, Homo sapiens
agcatggatgcatttcaaa

SEQ ID NO: 5186120 - DNA, 22 bp, Homo sapiens
agcatggatgcatttcaaatgt

SEQ ID NO: 5186121 - DNA, 19 bp, Homo sapiens
agcatggatgtgtctcagg

SEQ ID NO: 5186122 - DNA, 16 bp, Homo sapiens
agcatggcactccctc

SEQ ID NO: 5186123 - DNA, 13 bp, Homo sapiens
agcatggcagctg

SEQ ID NO: 5186124 - DNA, 23 bp, Homo sapiens
agcatggcatatagtgcccttgg

SEQ ID NO: 5186125 - DNA, 21 bp, Homo sapiens
agcatggcatatttttcacat

SEQ ID NO: 5186126 - DNA, 19 bp, Homo sapiens
agcatggccagactattcc

SEQ ID NO: 5186127 - DNA, 15 bp, Homo sapiens
agcatggctagattt

SEQ ID NO: 5186128 - DNA, 17 bp, Homo sapiens
agcatggctattttata

SEQ ID NO: 5186129 - DNA, 18 bp, Homo sapiens
agcatggctattttatat

SEQ ID NO: 5186130 - DNA, 18 bp, Homo sapiens
agcatggctcaaagtgca

SEQ ID NO: 5186131 - DNA, 22 bp, Homo sapiens
agcatggctcattctgcaatga

SEQ ID NO: 5186132 - DNA, 15 bp, Homo sapiens
agcatggctgtctgc

SEQ ID NO: 5186133 - DNA, 20 bp, Homo sapiens
agcatggctgtctgcacaga

SEQ ID NO: 5186134 - DNA, 17 bp, Homo sapiens
agcatggctgtgaggat

SEQ ID NO: 5186135 - DNA, 15 bp, Homo sapiens
agcatgggaaaaaga

SEQ ID NO: 5186136 - DNA, 16 bp, Homo sapiens
agcatgggaaaaagag

SEQ ID NO: 5186137 - DNA, 19 bp, Homo sapiens
agcatgggaaaaagagact

SEQ ID NO: 5186138 - DNA, 22 bp, Homo sapiens
agcatgggactgtgcctttggg

SEQ ID NO: 5186139 - DNA, 11 bp, Homo sapiens
agcatggggat

SEQ ID NO: 5186140 - DNA, 15 bp, Homo sapiens
agcatggggccagga

SEQ ID NO: 5186141 - DNA, 21 bp, Homo sapiens
agcatggggcccctggcccag

SEQ ID NO: 5186142 - DNA, 13 bp, Homo sapiens
agcatggggcgct

SEQ ID NO: 5186143 - DNA, 20 bp, Homo sapiens
agcatgggggaccccttccc

SEQ ID NO: 5186144 - DNA, 23 bp, Homo sapiens
agcatgggggaccccttcccaca

SEQ ID NO: 5186145 - DNA, 18 bp, Homo sapiens
agcatgggggctgccagc

SEQ ID NO: 5186146 - DNA, 19 bp, Homo sapiens
agcatggggtcagccccaa

SEQ ID NO: 5186147 - DNA, 16 bp, Homo sapiens
agcatgggtccaagag

SEQ ID NO: 5186148 - DNA, 14 bp, Homo sapiens
agcatggtataatt

SEQ ID NO: 5186149 - DNA, 17 bp, Homo sapiens
agcatggtcacaagcac

SEQ ID NO: 5186150 - DNA, 20 bp, Homo sapiens
agcatggtgaaacctcatct

SEQ ID NO: 5186151 - DNA, 19 bp, Homo sapiens
agcatgtaagaaataagtt

SEQ ID NO: 5186152 - DNA, 15 bp, Homo sapiens
agcatgtaagtgtta

SEQ ID NO: 5186153 - DNA, 19 bp, Homo sapiens
agcatgtaagtgttaagtt

SEQ ID NO: 5186154 - DNA, 12 bp, Homo sapiens
agcatgtaatat

SEQ ID NO: 5186155 - DNA, 16 bp, Homo sapiens
agcatgtaatattaaa

SEQ ID NO: 5186156 - DNA, 11 bp, Homo sapiens
agcatgtacaa

SEQ ID NO: 5186157 - DNA, 14 bp, Homo sapiens
agcatgtacagtgt

SEQ ID NO: 5186158 - DNA, 21 bp, Homo sapiens
agcatgtactgagccttgtaa

SEQ ID NO: 5186159 - DNA, 19 bp, Homo sapiens
agcatgtagactgtgccag

SEQ ID NO: 5186160 - DNA, 15 bp, Homo sapiens
agcatgtaggagaat

SEQ ID NO: 5186161 - DNA, 19 bp, Homo sapiens
agcatgtagggcttctgtg

SEQ ID NO: 5186162 - DNA, 17 bp, Homo sapiens
agcatgtatagttgctt

SEQ ID NO: 5186163 - DNA, 22 bp, Homo sapiens
agcatgtatgaatgtaaggatg

SEQ ID NO: 5186164 - DNA, 16 bp, Homo sapiens
agcatgtattgtgtct

SEQ ID NO: 5186165 - DNA, 17 bp, Homo sapiens
agcatgtcaacttttga

SEQ ID NO: 5186166 - DNA, 20 bp, Homo sapiens
agcatgtcaacttttgacta

SEQ ID NO: 5186167 - DNA, 22 bp, Homo sapiens
agcatgtcaattcataaaaaca

SEQ ID NO: 5186168 - DNA, 19 bp, Homo sapiens
agcatgtcctatccctgga

SEQ ID NO: 5186169 - DNA, 17 bp, Homo sapiens
agcatgtcgtcaaagct

SEQ ID NO: 5186170 - DNA, 20 bp, Homo sapiens
agcatgtcgtcaaagctgaa

SEQ ID NO: 5186171 - DNA, 17 bp, Homo sapiens
agcatgtctattcagct

SEQ ID NO: 5186172 - DNA, 17 bp, Homo sapiens
agcatgtctctgcttcc

SEQ ID NO: 5186173 - DNA, 18 bp, Homo sapiens
agcatgtctctgcttcca

SEQ ID NO: 5186174 - DNA, 17 bp, Homo sapiens
agcatgtcttatttaaa

SEQ ID NO: 5186175 - DNA, 20 bp, Homo sapiens
agcatgtgacacccacaatc

SEQ ID NO: 5186176 - DNA, 22 bp, Homo sapiens
agcatgtgccaagattctactc

SEQ ID NO: 5186177 - DNA, 16 bp, Homo sapiens
agcatgtgccctcctg

SEQ ID NO: 5186178 - DNA, 19 bp, Homo sapiens
agcatgtggggaagcaaga

SEQ ID NO: 5186179 - DNA, 16 bp, Homo sapiens
agcatgtgggggaagg

SEQ ID NO: 5186180 - DNA, 23 bp, Homo sapiens
agcatgtgggggaaggccttgct

SEQ ID NO: 5186181 - DNA, 21 bp, Homo sapiens
agcatgtgggtgtcagtgtca

SEQ ID NO: 5186182 - DNA, 13 bp, Homo sapiens
agcatgtggtctt

SEQ ID NO: 5186183 - DNA, 16 bp, Homo sapiens
agcatgtgtcagagtg

SEQ ID NO: 5186184 - DNA, 19 bp, Homo sapiens
agcatgtgtgactttcagg

SEQ ID NO: 5186185 - DNA, 17 bp, Homo sapiens
agcatgtgttaatctta

SEQ ID NO: 5186186 - DNA, 16 bp, Homo sapiens
agcatgtgttcattct

SEQ ID NO: 5186187 - DNA, 16 bp, Homo sapiens
agcatgtgttgaaaaa

SEQ ID NO: 5186188 - DNA, 14 bp, Homo sapiens
agcatgtgttgcag

SEQ ID NO: 5186189 - DNA, 15 bp, Homo sapiens
agcatgtgttgcagc

SEQ ID NO: 5186190 - DNA, 22 bp, Homo sapiens
agcatgtgttgcagctgtcacc

SEQ ID NO: 5186191 - DNA, 22 bp, Homo sapiens
agcatgtgtttggttctggggc

SEQ ID NO: 5186192 - DNA, 18 bp, Homo sapiens
agcatgttgaatgtatct

SEQ ID NO: 5186193 - DNA, 20 bp, Homo sapiens
agcatgttgagccaggcctg

SEQ ID NO: 5186194 - DNA, 19 bp, Homo sapiens
agcatgttgggttgttaca

SEQ ID NO: 5186195 - DNA, 15 bp, Homo sapiens
agcatgttgtagata

SEQ ID NO: 5186196 - DNA, 20 bp, Homo sapiens
agcatgttgtgatgtacaca

SEQ ID NO: 5186197 - DNA, 19 bp, Homo sapiens
agcatgttgttttttcata

SEQ ID NO: 5186198 - DNA, 22 bp, Homo sapiens
agcatgttgttttttcatagtg

SEQ ID NO: 5186199 - DNA, 15 bp, Homo sapiens
agcatgtttaaaaca

SEQ ID NO: 5186200 - DNA, 12 bp, Homo sapiens
agcatgtttaga

SEQ ID NO: 5186201 - DNA, 22 bp, Homo sapiens
agcatgtttagactttaacata

SEQ ID NO: 5186202 - DNA, 24 bp, Homo sapiens
agcatgtttagactttaacataag

SEQ ID NO: 5186203 - DNA, 19 bp, Homo sapiens
agcatgtttattctgttcc

SEQ ID NO: 5186204 - DNA, 20 bp, Homo sapiens
agcatgtttgctgaacacct

SEQ ID NO: 5186205 - DNA, 16 bp, Homo sapiens
agcatgttttgcatgt

SEQ ID NO: 5186206 - DNA, 19 bp, Homo sapiens
agcatgttttgtatacaaa

SEQ ID NO: 5186207 - DNA, 14 bp, Homo sapiens
agcattaaaatttt

SEQ ID NO: 5186208 - DNA, 18 bp, Homo sapiens
agcattaaaattttacct

SEQ ID NO: 5186209 - DNA, 16 bp, Homo sapiens
agcattaaatataaaa

SEQ ID NO: 5186210 - DNA, 16 bp, Homo sapiens
agcattaaatcccaaa

SEQ ID NO: 5186211 - DNA, 21 bp, Homo sapiens
agcattaactaaatgctcata

SEQ ID NO: 5186212 - DNA, 18 bp, Homo sapiens
agcattaactaatctatt

SEQ ID NO: 5186213 - DNA, 18 bp, Homo sapiens
agcattaacttctctgga

SEQ ID NO: 5186214 - DNA, 20 bp, Homo sapiens
agcattaagctgttcctgtt

SEQ ID NO: 5186215 - DNA, 16 bp, Homo sapiens
agcattaataaaactg

SEQ ID NO: 5186216 - DNA, 14 bp, Homo sapiens
agcattacaggcaa

SEQ ID NO: 5186217 - DNA, 17 bp, Homo sapiens
agcattacctctttgga

SEQ ID NO: 5186218 - DNA, 19 bp, Homo sapiens
agcattacctctttggaaa

SEQ ID NO: 5186219 - DNA, 23 bp, Homo sapiens
agcattacctctttggaaaagga

SEQ ID NO: 5186220 - DNA, 19 bp, Homo sapiens
agcattacgtgagccaggt

SEQ ID NO: 5186221 - DNA, 16 bp, Homo sapiens
agcattactcttgtaa

SEQ ID NO: 5186222 - DNA, 20 bp, Homo sapiens
agcattactcttgtaagatt

SEQ ID NO: 5186223 - DNA, 16 bp, Homo sapiens
agcattagattccttt

SEQ ID NO: 5186224 - DNA, 20 bp, Homo sapiens
agcattagattcctttcctg

SEQ ID NO: 5186225 - DNA, 18 bp, Homo sapiens
agcattagctttaattaa

SEQ ID NO: 5186226 - DNA, 21 bp, Homo sapiens
agcattaggcttttaagaaac

SEQ ID NO: 5186227 - DNA, 16 bp, Homo sapiens
agcattagtgggaaaa

SEQ ID NO: 5186228 - DNA, 21 bp, Homo sapiens
agcattataatcaccagggcc

SEQ ID NO: 5186229 - DNA, 19 bp, Homo sapiens
agcattattagtttgttat

SEQ ID NO: 5186230 - DNA, 13 bp, Homo sapiens
agcattcaaaata

SEQ ID NO: 5186231 - DNA, 20 bp, Homo sapiens
agcattcaaaatagttctat

SEQ ID NO: 5186232 - DNA, 15 bp, Homo sapiens
agcattcagaagaaa

SEQ ID NO: 5186233 - DNA, 21 bp, Homo sapiens
agcattcagaagaaaaagaag

SEQ ID NO: 5186234 - DNA, 16 bp, Homo sapiens
agcattcagcacacac

SEQ ID NO: 5186235 - DNA, 20 bp, Homo sapiens
agcattcaggcagcactgac

SEQ ID NO: 5186236 - DNA, 18 bp, Homo sapiens
agcattcattacctgttt

SEQ ID NO: 5186237 - DNA, 14 bp, Homo sapiens
agatatataaataa

SEQ ID NO: 5186238 - DNA, 15 bp, Homo sapiens
agatatataaataat

SEQ ID NO: 5186239 - DNA, 14 bp, Homo sapiens
agatatatagagat

SEQ ID NO: 5186240 - DNA, 19 bp, Homo sapiens
agatatatattcaccaatg

SEQ ID NO: 5186241 - DNA, 21 bp, Homo sapiens
agatatatattcaccaatgtt

SEQ ID NO: 5186242 - DNA, 18 bp, Homo sapiens
agatatatatttccaaat

SEQ ID NO: 5186243 - DNA, 22 bp, Homo sapiens
agatatatcagtgttgtctcat

SEQ ID NO: 5186244 - DNA, 20 bp, Homo sapiens
agatatattaagtgactgtt

SEQ ID NO: 5186245 - DNA, 12 bp, Homo sapiens
agatatattctc

SEQ ID NO: 5186246 - DNA, 20 bp, Homo sapiens
agatatattctctaataaaa

SEQ ID NO: 5186247 - DNA, 22 bp, Homo sapiens
agatatattctctaataaaatt

SEQ ID NO: 5186248 - DNA, 17 bp, Homo sapiens
agatatatttaagcctt

SEQ ID NO: 5186249 - DNA, 21 bp, Homo sapiens
agatatatttaagccttataa

SEQ ID NO: 5186250 - DNA, 23 bp, Homo sapiens
agatatatttggcttatattcta

SEQ ID NO: 5186251 - DNA, 15 bp, Homo sapiens
agatatattttgagt

SEQ ID NO: 5186252 - DNA, 20 bp, Homo sapiens
agatatatttttaagataat

SEQ ID NO: 5186253 - DNA, 16 bp, Homo sapiens
agatatatttttcaca

SEQ ID NO: 5186254 - DNA, 15 bp, Homo sapiens
agatatcaatcagta

SEQ ID NO: 5186255 - DNA, 15 bp, Homo sapiens
agatatcacttactc

SEQ ID NO: 5186256 - DNA, 15 bp, Homo sapiens
agatatcagagctct

SEQ ID NO: 5186257 - DNA, 16 bp, Homo sapiens
agatatcagagctctt

SEQ ID NO: 5186258 - DNA, 19 bp, Homo sapiens
agatatcagagctcttaat

SEQ ID NO: 5186259 - DNA, 14 bp, Homo sapiens
agatatcagtgtct

SEQ ID NO: 5186260 - DNA, 19 bp, Homo sapiens
agatatccacataaatgct

SEQ ID NO: 5186261 - DNA, 14 bp, Homo sapiens
agatatccatcttt

SEQ ID NO: 5186262 - DNA, 12 bp, Homo sapiens
agatatcctctc

SEQ ID NO: 5186263 - DNA, 17 bp, Homo sapiens
agatatcctctccccct

SEQ ID NO: 5186264 - DNA, 20 bp, Homo sapiens
agatatcctctccccctcct

SEQ ID NO: 5186265 - DNA, 19 bp, Homo sapiens
agatatcgagagtttctat

SEQ ID NO: 5186266 - DNA, 15 bp, Homo sapiens
agatatctatgactg

SEQ ID NO: 5186267 - DNA, 20 bp, Homo sapiens
agatatcttcagtttaatgc

SEQ ID NO: 5186268 - DNA, 23 bp, Homo sapiens
agatatcttcagtttaatgcaag

SEQ ID NO: 5186269 - DNA, 21 bp, Homo sapiens
agatatcttggacaaatcaca

SEQ ID NO: 5186270 - DNA, 22 bp, Homo sapiens
agatatcttggacaaatcacat

SEQ ID NO: 5186271 - DNA, 17 bp, Homo sapiens
agatatcttttctttag

SEQ ID NO: 5186272 - DNA, 18 bp, Homo sapiens
agatatcttttctttaga

SEQ ID NO: 5186273 - DNA, 23 bp, Homo sapiens
agatatcttttctttagagaact

SEQ ID NO: 5186274 - DNA, 18 bp, Homo sapiens
agatatctttttcattat

SEQ ID NO: 5186275 - DNA, 17 bp, Homo sapiens
agatatgaacagggccc

SEQ ID NO: 5186276 - DNA, 19 bp, Homo sapiens
agatatgaagaactattat

SEQ ID NO: 5186277 - DNA, 21 bp, Homo sapiens
agatatgagaaatataaaaat

SEQ ID NO: 5186278 - DNA, 20 bp, Homo sapiens
agatatgcaataaatattat

SEQ ID NO: 5186279 - DNA, 11 bp, Homo sapiens
agatatgcaca

SEQ ID NO: 5186280 - DNA, 19 bp, Homo sapiens
agatatgcacacacagatg

SEQ ID NO: 5186281 - DNA, 19 bp, Homo sapiens
agatatgcattcaagagag

SEQ ID NO: 5186282 - DNA, 21 bp, Homo sapiens
agatatgccactaacttctaa

SEQ ID NO: 5186283 - DNA, 19 bp, Homo sapiens
agatatgctaagcagtagt

SEQ ID NO: 5186284 - DNA, 22 bp, Homo sapiens
agatatgcttactaaatcttca

SEQ ID NO: 5186285 - DNA, 20 bp, Homo sapiens
agatatggagaattgctgaa

SEQ ID NO: 5186286 - DNA, 23 bp, Homo sapiens
agatatggagtgagtcacctgct

SEQ ID NO: 5186287 - DNA, 16 bp, Homo sapiens
agatatggcacttctc

SEQ ID NO: 5186288 - DNA, 17 bp, Homo sapiens
agatatggcagcgaaag

SEQ ID NO: 5186289 - DNA, 21 bp, Homo sapiens
agatatggcattgcactgctt

SEQ ID NO: 5186290 - DNA, 21 bp, Homo sapiens
agatatgtatcataaaaataa

SEQ ID NO: 5186291 - DNA, 20 bp, Homo sapiens
agatatgtgagaacttttca

SEQ ID NO: 5186292 - DNA, 20 bp, Homo sapiens
agatatgttaagcatggatt

SEQ ID NO: 5186293 - DNA, 23 bp, Homo sapiens
agatattaaaaattgaaaacttt

SEQ ID NO: 5186294 - DNA, 13 bp, Homo sapiens
agatattaaaatt

SEQ ID NO: 5186295 - DNA, 21 bp, Homo sapiens
agatattaccctcagaatatt

SEQ ID NO: 5186296 - DNA, 22 bp, Homo sapiens
agatattaggggggaaagtcat

SEQ ID NO: 5186297 - DNA, 13 bp, Homo sapiens
agatattatgtat

SEQ ID NO: 5186298 - DNA, 20 bp, Homo sapiens
agatattatgtataaaatgt

SEQ ID NO: 5186299 - DNA, 20 bp, Homo sapiens
agatattatgtatagaaaat

SEQ ID NO: 5186300 - DNA, 21 bp, Homo sapiens
agatattattcaccatgtaaa

SEQ ID NO: 5186301 - DNA, 19 bp, Homo sapiens
agatattatttgtcttaaa

SEQ ID NO: 5186302 - DNA, 17 bp, Homo sapiens
agatattcatactttcc

SEQ ID NO: 5186303 - DNA, 19 bp, Homo sapiens
agatattcatactttccaa

SEQ ID NO: 5186304 - DNA, 14 bp, Homo sapiens
agatattcattaat

SEQ ID NO: 5186305 - DNA, 13 bp, Homo sapiens
agatattctgctc

SEQ ID NO: 5186306 - DNA, 16 bp, Homo sapiens
agatattcttatttca

SEQ ID NO: 5186307 - DNA, 14 bp, Homo sapiens
agatattctttaca

SEQ ID NO: 5186308 - DNA, 22 bp, Homo sapiens
agatattgaggccaagaatatt

SEQ ID NO: 5186309 - DNA, 16 bp, Homo sapiens
agatattgatattgaa

SEQ ID NO: 5186310 - DNA, 17 bp, Homo sapiens
agatattgctactataa

SEQ ID NO: 5186311 - DNA, 17 bp, Homo sapiens
agatattggacaaagaa

SEQ ID NO: 5186312 - DNA, 17 bp, Homo sapiens
agatattgggacacaca

SEQ ID NO: 5186313 - DNA, 17 bp, Homo sapiens
agatattgtattatcat

SEQ ID NO: 5186314 - DNA, 18 bp, Homo sapiens
agatattgtattatcata

SEQ ID NO: 5186315 - DNA, 13 bp, Homo sapiens
agatattgttcaa

SEQ ID NO: 5186316 - DNA, 23 bp, Homo sapiens
agatattgttcaaacaatatcat

SEQ ID NO: 5186317 - DNA, 18 bp, Homo sapiens
agatattgttgttttcca

SEQ ID NO: 5186318 - DNA, 18 bp, Homo sapiens
agatatttaaatttagtg

SEQ ID NO: 5186319 - DNA, 20 bp, Homo sapiens
agatatttacatccagcttc

SEQ ID NO: 5186320 - DNA, 14 bp, Homo sapiens
agatatttatatgt

SEQ ID NO: 5186321 - DNA, 20 bp, Homo sapiens
agatatttatatttttattt

SEQ ID NO: 5186322 - DNA, 16 bp, Homo sapiens
agatatttatgtatct

SEQ ID NO: 5186323 - DNA, 23 bp, Homo sapiens
agatatttattgtttatttatca

SEQ ID NO: 5186324 - DNA, 12 bp, Homo sapiens
agatatttcaaa

SEQ ID NO: 5186325 - DNA, 12 bp, Homo sapiens
agatatttccaa

SEQ ID NO: 5186326 - DNA, 13 bp, Homo sapiens
agatatttccaag

SEQ ID NO: 5186327 - DNA, 20 bp, Homo sapiens
agatatttcgaccctggggc

SEQ ID NO: 5186328 - DNA, 20 bp, Homo sapiens
agatatttggcttaaatata

SEQ ID NO: 5186329 - DNA, 21 bp, Homo sapiens
agatatttggcttaaatatag

SEQ ID NO: 5186330 - DNA, 15 bp, Homo sapiens
agatattttaaaatg

SEQ ID NO: 5186331 - DNA, 11 bp, Homo sapiens
agatattttat

SEQ ID NO: 5186332 - DNA, 18 bp, Homo sapiens
agatattttatatgtatg

SEQ ID NO: 5186333 - DNA, 18 bp, Homo sapiens
agatattttatttctgat

SEQ ID NO: 5186334 - DNA, 14 bp, Homo sapiens
agatattttcatat

SEQ ID NO: 5186335 - DNA, 17 bp, Homo sapiens
agatattttcatattta

SEQ ID NO: 5186336 - DNA, 16 bp, Homo sapiens
agatattttccatata

SEQ ID NO: 5186337 - DNA, 19 bp, Homo sapiens
agatattttccatatattg

SEQ ID NO: 5186338 - DNA, 20 bp, Homo sapiens
agatattttccatatattgg

SEQ ID NO: 5186339 - DNA, 13 bp, Homo sapiens
agatattttgcac

SEQ ID NO: 5186340 - DNA, 22 bp, Homo sapiens
agatattttgctttgtgatttt

SEQ ID NO: 5186341 - DNA, 15 bp, Homo sapiens
agatattttgtaaaa

SEQ ID NO: 5186342 - DNA, 20 bp, Homo sapiens
agatattttgtaaaatgtat

SEQ ID NO: 5186343 - DNA, 19 bp, Homo sapiens
agatatttttattcaaact

SEQ ID NO: 5186344 - DNA, 16 bp, Homo sapiens
agatatttttcataaa

SEQ ID NO: 5186345 - DNA, 19 bp, Homo sapiens
agatatttttcatgatttt

SEQ ID NO: 5186346 - DNA, 19 bp, Homo sapiens
agatatttttccatttttt

SEQ ID NO: 5186347 - DNA, 16 bp, Homo sapiens
agatcaaaaaggctta

SEQ ID NO: 5186348 - DNA, 14 bp, Homo sapiens
agatcaaaataaaa

SEQ ID NO: 5186349 - DNA, 17 bp, Homo sapiens
agatcaaaatgcctttc

SEQ ID NO: 5186350 - DNA, 15 bp, Homo sapiens
agatcaaatacttta

SEQ ID NO: 5186351 - DNA, 16 bp, Homo sapiens
agatcaaatactttaa

SEQ ID NO: 5186352 - DNA, 17 bp, Homo sapiens
agatcaaattaatacaa

SEQ ID NO: 5186353 - DNA, 23 bp, Homo sapiens
agatcaaatttcacgtcgtcttc

SEQ ID NO: 5186354 - DNA, 21 bp, Homo sapiens
agatcaaccccttcgctcctg

SEQ ID NO: 5186355 - DNA, 17 bp, Homo sapiens
agatcaacgcctcactg

SEQ ID NO: 5186356 - DNA, 18 bp, Homo sapiens
agatcaagaaaaaaaggg

SEQ ID NO: 5186357 - DNA, 20 bp, Homo sapiens
agatcaagagttttggagat

SEQ ID NO: 5186358 - DNA, 18 bp, Homo sapiens
agatcaagctgtgagaca

SEQ ID NO: 5186359 - DNA, 19 bp, Homo sapiens
agatcaaggagcccagaaa

SEQ ID NO: 5186360 - DNA, 23 bp, Homo sapiens
agatcaattacttattttaggaa

SEQ ID NO: 5186361 - DNA, 14 bp, Homo sapiens
agatcaatttctcc

SEQ ID NO: 5186362 - DNA, 14 bp, Homo sapiens
agatcacaaatagt

SEQ ID NO: 5186363 - DNA, 15 bp, Homo sapiens
agatcacaaatagtg

SEQ ID NO: 5186364 - DNA, 16 bp, Homo sapiens
agatcacaccactgca

SEQ ID NO: 5186365 - DNA, 19 bp, Homo sapiens
agatcacaccactgtactc

SEQ ID NO: 5186366 - DNA, 15 bp, Homo sapiens
agatcacagcagggc

SEQ ID NO: 5186367 - DNA, 18 bp, Homo sapiens
agatcacagccccaccct

SEQ ID NO: 5186368 - DNA, 12 bp, Homo sapiens
agatcacagcct

SEQ ID NO: 5186369 - DNA, 18 bp, Homo sapiens
agatcacagcctccaggg

SEQ ID NO: 5186370 - DNA, 16 bp, Homo sapiens
agatcacataacagaa

SEQ ID NO: 5186371 - DNA, 19 bp, Homo sapiens
agatcacataacagaatgc

SEQ ID NO: 5186372 - DNA, 16 bp, Homo sapiens
agatcacataccagag

SEQ ID NO: 5186373 - DNA, 18 bp, Homo sapiens
agatcacatcttaaattc

SEQ ID NO: 5186374 - DNA, 15 bp, Homo sapiens
agatcaccagcccgg

SEQ ID NO: 5186375 - DNA, 21 bp, Homo sapiens
agatcaccagtgtgtggcttt

SEQ ID NO: 5186376 - DNA, 16 bp, Homo sapiens
agatcaccccagcctc

SEQ ID NO: 5186377 - DNA, 12 bp, Homo sapiens
agatcaccttgt

SEQ ID NO: 5186378 - DNA, 23 bp, Homo sapiens
agatcacgccattgtactccagc

SEQ ID NO: 5186379 - DNA, 18 bp, Homo sapiens
agatcacgttccttcccc

SEQ ID NO: 5186380 - DNA, 13 bp, Homo sapiens
agatcactcctgg

SEQ ID NO: 5186381 - DNA, 17 bp, Homo sapiens
agatcactgaacttttc

SEQ ID NO: 5186382 - DNA, 18 bp, Homo sapiens
agatcactgaacttttca

SEQ ID NO: 5186383 - DNA, 20 bp, Homo sapiens
agatcactgaacttttcaaa

SEQ ID NO: 5186384 - DNA, 22 bp, Homo sapiens
agatcactgaattggaactttt

SEQ ID NO: 5186385 - DNA, 19 bp, Homo sapiens
agatcactgccctttttga

SEQ ID NO: 5186386 - DNA, 22 bp, Homo sapiens
agatcactgtgcttattttgtt

SEQ ID NO: 5186387 - DNA, 19 bp, Homo sapiens
agatcactgtttagatttg

SEQ ID NO: 5186388 - DNA, 20 bp, Homo sapiens
agatcacttgatgccaggag

SEQ ID NO: 5186389 - DNA, 17 bp, Homo sapiens
agatcacttgtcctctt

SEQ ID NO: 5186390 - DNA, 22 bp, Homo sapiens
agatcacttgtcctcttgccag

SEQ ID NO: 5186391 - DNA, 11 bp, Homo sapiens
agatcactttc

SEQ ID NO: 5186392 - DNA, 14 bp, Homo sapiens
agatcactttgctc

SEQ ID NO: 5186393 - DNA, 18 bp, Homo sapiens
agatcagagagcaagaaa

SEQ ID NO: 5186394 - DNA, 17 bp, Homo sapiens
agatcagagcagcagtg

SEQ ID NO: 5186395 - DNA, 17 bp, Homo sapiens
agatcagagctgcagcc

SEQ ID NO: 5186396 - DNA, 19 bp, Homo sapiens
agatcagagctgcagccag

SEQ ID NO: 5186397 - DNA, 22 bp, Homo sapiens
agatcagatgctccaagattct

SEQ ID NO: 5186398 - DNA, 17 bp, Homo sapiens
agatcagcagtggcagg

SEQ ID NO: 5186399 - DNA, 15 bp, Homo sapiens
agatcagccattaaa

SEQ ID NO: 5186400 - DNA, 16 bp, Homo sapiens
agatcagccattaaaa

SEQ ID NO: 5186401 - DNA, 13 bp, Homo sapiens
agatcaggaacca

SEQ ID NO: 5186402 - DNA, 15 bp, Homo sapiens
agatcaggaaccagg

SEQ ID NO: 5186403 - DNA, 19 bp, Homo sapiens
agatcaggaaccagggcct

SEQ ID NO: 5186404 - DNA, 22 bp, Homo sapiens
agatcaggaaccagggcctccc

SEQ ID NO: 5186405 - DNA, 21 bp, Homo sapiens
agatcagggcctgccccctgg

SEQ ID NO: 5186406 - DNA, 18 bp, Homo sapiens
agatcagtgtaccatttg

SEQ ID NO: 5186407 - DNA, 21 bp, Homo sapiens
agatcatagatttctgatttt

SEQ ID NO: 5186408 - DNA, 23 bp, Homo sapiens
agatcatagatttctgattttat

SEQ ID NO: 5186409 - DNA, 17 bp, Homo sapiens
agatcatagttttattt

SEQ ID NO: 5186410 - DNA, 15 bp, Homo sapiens
agatcatatcctcag

SEQ ID NO: 5186411 - DNA, 16 bp, Homo sapiens
agatcatatttaaaga

SEQ ID NO: 5186412 - DNA, 12 bp, Homo sapiens
agatcatgaaga

SEQ ID NO: 5186413 - DNA, 14 bp, Homo sapiens
agatcatttctagg

SEQ ID NO: 5186414 - DNA, 13 bp, Homo sapiens
agcattccaacaa

SEQ ID NO: 5186415 - DNA, 17 bp, Homo sapiens
agcattccaacaaaggg

SEQ ID NO: 5186416 - DNA, 23 bp, Homo sapiens
agcattccacactgcagggagga

SEQ ID NO: 5186417 - DNA, 15 bp, Homo sapiens
agcattccagacttc

SEQ ID NO: 5186418 - DNA, 17 bp, Homo sapiens
agcattccagacttcaa

SEQ ID NO: 5186419 - DNA, 20 bp, Homo sapiens
agcattccagcccctctggt

SEQ ID NO: 5186420 - DNA, 18 bp, Homo sapiens
agcattccagctctgccc

SEQ ID NO: 5186421 - DNA, 15 bp, Homo sapiens
agcattccagtaact

SEQ ID NO: 5186422 - DNA, 22 bp, Homo sapiens
agcattccagtaacttttttgt

SEQ ID NO: 5186423 - DNA, 14 bp, Homo sapiens
agcattcccaccaa

SEQ ID NO: 5186424 - DNA, 12 bp, Homo sapiens
agcattcccagg

SEQ ID NO: 5186425 - DNA, 20 bp, Homo sapiens
agcattcccagggaccttgg

SEQ ID NO: 5186426 - DNA, 20 bp, Homo sapiens
agcattcctcaggaaggaca

SEQ ID NO: 5186427 - DNA, 21 bp, Homo sapiens
agcattccttagcagctcagg

SEQ ID NO: 5186428 - DNA, 24 bp, Homo sapiens
agcattccttctttgataatgtta

SEQ ID NO: 5186429 - DNA, 18 bp, Homo sapiens
agcattctcactcctacc

SEQ ID NO: 5186430 - DNA, 14 bp, Homo sapiens
agcattctcattgg

SEQ ID NO: 5186431 - DNA, 16 bp, Homo sapiens
agcattctgcaacatt

SEQ ID NO: 5186432 - DNA, 13 bp, Homo sapiens
agcattctgcctg

SEQ ID NO: 5186433 - DNA, 14 bp, Homo sapiens
agcattctgcctgc

SEQ ID NO: 5186434 - DNA, 14 bp, Homo sapiens
agcattctggcagt

SEQ ID NO: 5186435 - DNA, 20 bp, Homo sapiens
agcattctggggtggggctt

SEQ ID NO: 5186436 - DNA, 14 bp, Homo sapiens
agcattcttagact

SEQ ID NO: 5186437 - DNA, 17 bp, Homo sapiens
agcattcttagcctgtg

SEQ ID NO: 5186438 - DNA, 20 bp, Homo sapiens
agcattcttagcctgtggca

SEQ ID NO: 5186439 - DNA, 13 bp, Homo sapiens
agcattcttccct

SEQ ID NO: 5186440 - DNA, 21 bp, Homo sapiens
agcattcttgtcacaataaat

SEQ ID NO: 5186441 - DNA, 19 bp, Homo sapiens
agcattgaaaacaaagaca

SEQ ID NO: 5186442 - DNA, 18 bp, Homo sapiens
agcattgataatcttcag

SEQ ID NO: 5186443 - DNA, 21 bp, Homo sapiens
agcattgatatttgtgcattt

SEQ ID NO: 5186444 - DNA, 12 bp, Homo sapiens
agcattgcagcc

SEQ ID NO: 5186445 - DNA, 19 bp, Homo sapiens
agcattgcagcctaagaag

SEQ ID NO: 5186446 - DNA, 20 bp, Homo sapiens
agcattgcagtcactttgac

SEQ ID NO: 5186447 - DNA, 16 bp, Homo sapiens
agcattgccattgaag

SEQ ID NO: 5186448 - DNA, 21 bp, Homo sapiens
agcattgcctggactgaccac

SEQ ID NO: 5186449 - DNA, 13 bp, Homo sapiens
agcattgcctggc

SEQ ID NO: 5186450 - DNA, 21 bp, Homo sapiens
agcattgcctggccttcctgt

SEQ ID NO: 5186451 - DNA, 19 bp, Homo sapiens
agcattgctactgctcagc

SEQ ID NO: 5186452 - DNA, 16 bp, Homo sapiens
agcattgctggttcta

SEQ ID NO: 5186453 - DNA, 16 bp, Homo sapiens
agcattgctgttatgt

SEQ ID NO: 5186454 - DNA, 14 bp, Homo sapiens
agcattgctttctg

SEQ ID NO: 5186455 - DNA, 20 bp, Homo sapiens
agcattggggatgtttttct

SEQ ID NO: 5186456 - DNA, 13 bp, Homo sapiens
agcattgggtcag

SEQ ID NO: 5186457 - DNA, 15 bp, Homo sapiens
agcattgtaaaataa

SEQ ID NO: 5186458 - DNA, 20 bp, Homo sapiens
agcattgtaaaataattctg

SEQ ID NO: 5186459 - DNA, 13 bp, Homo sapiens
agcattgtaatta

SEQ ID NO: 5186460 - DNA, 16 bp, Homo sapiens
agcattgtaattatgt

SEQ ID NO: 5186461 - DNA, 18 bp, Homo sapiens
agcattgtagtgctttga

SEQ ID NO: 5186462 - DNA, 22 bp, Homo sapiens
agcattgtagtgctttgagaga

SEQ ID NO: 5186463 - DNA, 22 bp, Homo sapiens
agcattgtctatttttctcttc

SEQ ID NO: 5186464 - DNA, 17 bp, Homo sapiens
agcattgtcttgttctg

SEQ ID NO: 5186465 - DNA, 19 bp, Homo sapiens
agcattgtctttgctgtac

SEQ ID NO: 5186466 - DNA, 21 bp, Homo sapiens
agcattgtctttgctgtactc

SEQ ID NO: 5186467 - DNA, 17 bp, Homo sapiens
agcattgtgaactgaca

SEQ ID NO: 5186468 - DNA, 15 bp, Homo sapiens
agcattgtgtggaat

SEQ ID NO: 5186469 - DNA, 16 bp, Homo sapiens
agcattgttgagctgt

SEQ ID NO: 5186470 - DNA, 16 bp, Homo sapiens
agcattgtttcaaaat

SEQ ID NO: 5186471 - DNA, 15 bp, Homo sapiens
agcattgtttctaga

SEQ ID NO: 5186472 - DNA, 23 bp, Homo sapiens
agcattgttttcttttacagact

SEQ ID NO: 5186473 - DNA, 13 bp, Homo sapiens
agcatttaaaaga

SEQ ID NO: 5186474 - DNA, 17 bp, Homo sapiens
agcatttaaagttgtat

SEQ ID NO: 5186475 - DNA, 22 bp, Homo sapiens
agcatttaacccccctgtacac

SEQ ID NO: 5186476 - DNA, 23 bp, Homo sapiens
agcatttaacccccctgtacaca

SEQ ID NO: 5186477 - DNA, 16 bp, Homo sapiens
agcatttaatccaaac

SEQ ID NO: 5186478 - DNA, 16 bp, Homo sapiens
agcatttactatgcac

SEQ ID NO: 5186479 - DNA, 23 bp, Homo sapiens
agcatttagaacgagcctggaag

SEQ ID NO: 5186480 - DNA, 17 bp, Homo sapiens
agcatttagcacaattt

SEQ ID NO: 5186481 - DNA, 18 bp, Homo sapiens
agcatttagcacaatttg

SEQ ID NO: 5186482 - DNA, 16 bp, Homo sapiens
agcatttagctggcca

SEQ ID NO: 5186483 - DNA, 23 bp, Homo sapiens
agcatttaggagaatagcagaga

SEQ ID NO: 5186484 - DNA, 20 bp, Homo sapiens
agcatttagtccaatgtctt

SEQ ID NO: 5186485 - DNA, 18 bp, Homo sapiens
agcatttagtcttgccag

SEQ ID NO: 5186486 - DNA, 12 bp, Homo sapiens
agcatttatcat

SEQ ID NO: 5186487 - DNA, 15 bp, Homo sapiens
agcatttatcattct

SEQ ID NO: 5186488 - DNA, 23 bp, Homo sapiens
agcatttatgtagacattgtaaa

SEQ ID NO: 5186489 - DNA, 13 bp, Homo sapiens
agcatttatgttt

SEQ ID NO: 5186490 - DNA, 22 bp, Homo sapiens
agcatttatttctctggcaaac

SEQ ID NO: 5186491 - DNA, 18 bp, Homo sapiens
agcatttcaaagccctgc

SEQ ID NO: 5186492 - DNA, 20 bp, Homo sapiens
agcatttcaggttgtgcatt

SEQ ID NO: 5186493 - DNA, 20 bp, Homo sapiens
agcatttcattcttctctag

SEQ ID NO: 5186494 - DNA, 21 bp, Homo sapiens
agcatttccagagcagagcct

SEQ ID NO: 5186495 - DNA, 19 bp, Homo sapiens
agcatttcccgaaggccga

SEQ ID NO: 5186496 - DNA, 18 bp, Homo sapiens
agcatttccttccagccc

SEQ ID NO: 5186497 - DNA, 19 bp, Homo sapiens
agcatttccttccagccca

SEQ ID NO: 5186498 - DNA, 20 bp, Homo sapiens
agcatttccttccagcccat

SEQ ID NO: 5186499 - DNA, 20 bp, Homo sapiens
agcatttctagaacaattac

SEQ ID NO: 5186500 - DNA, 13 bp, Homo sapiens
agcatttctgaag

SEQ ID NO: 5186501 - DNA, 23 bp, Homo sapiens
agcatttcttatttgtttggtca

SEQ ID NO: 5186502 - DNA, 17 bp, Homo sapiens
agcatttgaatgcattt

SEQ ID NO: 5186503 - DNA, 17 bp, Homo sapiens
agcatttgactttctgt

SEQ ID NO: 5186504 - DNA, 21 bp, Homo sapiens
agcatttgactttctgtctgt

SEQ ID NO: 5186505 - DNA, 14 bp, Homo sapiens
agcatttgataatg

SEQ ID NO: 5186506 - DNA, 15 bp, Homo sapiens
agcatttgataatga

SEQ ID NO: 5186507 - DNA, 19 bp, Homo sapiens
agcatttgataatgataaa

SEQ ID NO: 5186508 - DNA, 15 bp, Homo sapiens
agcatttgatctgtt

SEQ ID NO: 5186509 - DNA, 13 bp, Homo sapiens
agcatttgatttc

SEQ ID NO: 5186510 - DNA, 19 bp, Homo sapiens
agcatttgctttcctctga

SEQ ID NO: 5186511 - DNA, 17 bp, Homo sapiens
agcatttggaaggaaag

SEQ ID NO: 5186512 - DNA, 14 bp, Homo sapiens
agcatttggtgcct

SEQ ID NO: 5186513 - DNA, 15 bp, Homo sapiens
agcatttggtgcttg

SEQ ID NO: 5186514 - DNA, 14 bp, Homo sapiens
agcatttggtttta

SEQ ID NO: 5186515 - DNA, 22 bp, Homo sapiens
agcatttggttttacacaggaa

SEQ ID NO: 5186516 - DNA, 12 bp, Homo sapiens
agcatttgtata

SEQ ID NO: 5186517 - DNA, 23 bp, Homo sapiens
agcatttgtataaagaaactggt

SEQ ID NO: 5186518 - DNA, 13 bp, Homo sapiens
agcatttgtattt

SEQ ID NO: 5186519 - DNA, 22 bp, Homo sapiens
agcatttgtccttttgtgaaat

SEQ ID NO: 5186520 - DNA, 16 bp, Homo sapiens
agcatttgtgtgttac

SEQ ID NO: 5186521 - DNA, 18 bp, Homo sapiens
agcatttgtgttgaagag

SEQ ID NO: 5186522 - DNA, 19 bp, Homo sapiens
agcatttgtttctactttg

SEQ ID NO: 5186523 - DNA, 20 bp, Homo sapiens
agcatttgtttgaccccagt

SEQ ID NO: 5186524 - DNA, 17 bp, Homo sapiens
agcattttaaacaaaat

SEQ ID NO: 5186525 - DNA, 12 bp, Homo sapiens
agcattttaagg

SEQ ID NO: 5186526 - DNA, 17 bp, Homo sapiens
agcattttactgtctgt

SEQ ID NO: 5186527 - DNA, 19 bp, Homo sapiens
agcattttactgtctgtaa

SEQ ID NO: 5186528 - DNA, 18 bp, Homo sapiens
agcattttagaaactaca

SEQ ID NO: 5186529 - DNA, 13 bp, Homo sapiens
agcattttcctct

SEQ ID NO: 5186530 - DNA, 14 bp, Homo sapiens
agcattttcctctg

SEQ ID NO: 5186531 - DNA, 12 bp, Homo sapiens
agcattttcctg

SEQ ID NO: 5186532 - DNA, 13 bp, Homo sapiens
agcattttcctgt

SEQ ID NO: 5186533 - DNA, 14 bp, Homo sapiens
agcattttcctgtt

SEQ ID NO: 5186534 - DNA, 19 bp, Homo sapiens
agcattttcctgtttactg

SEQ ID NO: 5186535 - DNA, 18 bp, Homo sapiens
agcattttctgcatctcc

SEQ ID NO: 5186536 - DNA, 20 bp, Homo sapiens
agcattttctgcatctccac

SEQ ID NO: 5186537 - DNA, 18 bp, Homo sapiens
agcattttgaaacaaagt

SEQ ID NO: 5186538 - DNA, 20 bp, Homo sapiens
agcattttgggatccttcag

SEQ ID NO: 5186539 - DNA, 17 bp, Homo sapiens
agcattttgtaagttga

SEQ ID NO: 5186540 - DNA, 14 bp, Homo sapiens
agcatttttaaggg

SEQ ID NO: 5186541 - DNA, 17 bp, Homo sapiens
agcatttttaattttca

SEQ ID NO: 5186542 - DNA, 15 bp, Homo sapiens
agcatttttataaac

SEQ ID NO: 5186543 - DNA, 12 bp, Homo sapiens
agcatttttcag

SEQ ID NO: 5186544 - DNA, 13 bp, Homo sapiens
agcatttttccat

SEQ ID NO: 5186545 - DNA, 22 bp, Homo sapiens
agcatttttctttagtcattta

SEQ ID NO: 5186546 - DNA, 18 bp, Homo sapiens
agcatttttgatttatgc

SEQ ID NO: 5186547 - DNA, 17 bp, Homo sapiens
agcattttttatgatat

SEQ ID NO: 5186548 - DNA, 19 bp, Homo sapiens
agcattttttatgatatca

SEQ ID NO: 5186549 - DNA, 19 bp, Homo sapiens
agcatttttttaaaagaag

SEQ ID NO: 5186550 - DNA, 19 bp, Homo sapiens
agcatttttttattcagca

SEQ ID NO: 5186551 - DNA, 14 bp, Homo sapiens
agccaaaaatagct

SEQ ID NO: 5186552 - DNA, 15 bp, Homo sapiens
agccaaaaatagcta

SEQ ID NO: 5186553 - DNA, 18 bp, Homo sapiens
agccaaaaatagctaaat

SEQ ID NO: 5186554 - DNA, 15 bp, Homo sapiens
agccaaaacacttag

SEQ ID NO: 5186555 - DNA, 16 bp, Homo sapiens
agccaaaacagatcca

SEQ ID NO: 5186556 - DNA, 18 bp, Homo sapiens
agccaaaaccatcttctg

SEQ ID NO: 5186557 - DNA, 15 bp, Homo sapiens
agccaaaactgagca

SEQ ID NO: 5186558 - DNA, 14 bp, Homo sapiens
agccaaaagtccct

SEQ ID NO: 5186559 - DNA, 15 bp, Homo sapiens
agccaaaagtccctc

SEQ ID NO: 5186560 - DNA, 23 bp, Homo sapiens
agccaaaagtccctccctgcctg

SEQ ID NO: 5186561 - DNA, 19 bp, Homo sapiens
agccaaaatgactttgaac

SEQ ID NO: 5186562 - DNA, 17 bp, Homo sapiens
agccaaaatgtaggctt

SEQ ID NO: 5186563 - DNA, 22 bp, Homo sapiens
agccaaaatgtaggcttagttt

SEQ ID NO: 5186564 - DNA, 20 bp, Homo sapiens
agccaaacacactgtaaata

SEQ ID NO: 5186565 - DNA, 19 bp, Homo sapiens
agccaaaccagcagggagt

SEQ ID NO: 5186566 - DNA, 15 bp, Homo sapiens
agccaaaccctgtct

SEQ ID NO: 5186567 - DNA, 17 bp, Homo sapiens
agccaaactcaggccca

SEQ ID NO: 5186568 - DNA, 15 bp, Homo sapiens
agccaaactctgcca

SEQ ID NO: 5186569 - DNA, 20 bp, Homo sapiens
agccaaactgtagatgaaga

SEQ ID NO: 5186570 - DNA, 15 bp, Homo sapiens
agccaaagaaacaag

SEQ ID NO: 5186571 - DNA, 16 bp, Homo sapiens
agccaaagaaacaagc

SEQ ID NO: 5186572 - DNA, 19 bp, Homo sapiens
agccaaagaaacaagctgt

SEQ ID NO: 5186573 - DNA, 21 bp, Homo sapiens
agccaaagaaacaagctgtgc

SEQ ID NO: 5186574 - DNA, 22 bp, Homo sapiens
agccaaagaaacaagctgtgca

SEQ ID NO: 5186575 - DNA, 13 bp, Homo sapiens
agccaaagaaact

SEQ ID NO: 5186576 - DNA, 21 bp, Homo sapiens
agccaaagaaactcagaagag

SEQ ID NO: 5186577 - DNA, 22 bp, Homo sapiens
agccaaagaaactcagaagagt

SEQ ID NO: 5186578 - DNA, 16 bp, Homo sapiens
agccaaagaaatgaac

SEQ ID NO: 5186579 - DNA, 22 bp, Homo sapiens
agccaaagaaatgggcctgcct

SEQ ID NO: 5186580 - DNA, 13 bp, Homo sapiens
agccaaagagaaa

SEQ ID NO: 5186581 - DNA, 15 bp, Homo sapiens
agccaaagagaatgc

SEQ ID NO: 5186582 - DNA, 14 bp, Homo sapiens
agccaaagcatgcc

SEQ ID NO: 5186583 - DNA, 12 bp, Homo sapiens
agccaaagccaa

SEQ ID NO: 5186584 - DNA, 19 bp, Homo sapiens
agccaaagctaggcctggc

SEQ ID NO: 5186585 - DNA, 13 bp, Homo sapiens
agccaaagctgtt

SEQ ID NO: 5186586 - DNA, 19 bp, Homo sapiens
agccaaaggcatccaggcc

SEQ ID NO: 5186587 - DNA, 21 bp, Homo sapiens
agccaaaggccgtgcctggtg

SEQ ID NO: 5186588 - DNA, 19 bp, Homo sapiens
agccaaaggggagccagaa

SEQ ID NO: 5186589 - DNA, 17 bp, Homo sapiens
agccaaagttaaatgta

SEQ ID NO: 5186590 - DNA, 17 bp, Homo sapiens
agccaaagtttctgttg

SEQ ID NO: 5186591 - DNA, 19 bp, Homo sapiens
agccaaagtttctgttgaa

SEQ ID NO: 5186592 - DNA, 17 bp, Homo sapiens
agccaaatcaaaatatg

SEQ ID NO: 5186593 - DNA, 16 bp, Homo sapiens
agatcatttgttctgg

SEQ ID NO: 5186594 - DNA, 21 bp, Homo sapiens
agatccaaaagaagcccccag

SEQ ID NO: 5186595 - DNA, 14 bp, Homo sapiens
agatccaaatgtaa

SEQ ID NO: 5186596 - DNA, 17 bp, Homo sapiens
agatccaaatgtaaagg

SEQ ID NO: 5186597 - DNA, 13 bp, Homo sapiens
agatccaccccct

SEQ ID NO: 5186598 - DNA, 14 bp, Homo sapiens
agatccaccctcaa

SEQ ID NO: 5186599 - DNA, 14 bp, Homo sapiens
agatccacctgcac

SEQ ID NO: 5186600 - DNA, 22 bp, Homo sapiens
agatccacctgcacaaacatag

SEQ ID NO: 5186601 - DNA, 22 bp, Homo sapiens
agatccagactgtaagatgttg

SEQ ID NO: 5186602 - DNA, 14 bp, Homo sapiens
agatccagagaggc

SEQ ID NO: 5186603 - DNA, 10 bp, Homo sapiens
agatccagga

SEQ ID NO: 5186604 - DNA, 23 bp, Homo sapiens
agatccaggaacacatgcacaca

SEQ ID NO: 5186605 - DNA, 12 bp, Homo sapiens
agatccaggact

SEQ ID NO: 5186606 - DNA, 17 bp, Homo sapiens
agatccaggagctccag

SEQ ID NO: 5186607 - DNA, 13 bp, Homo sapiens
agatccaggcttc

SEQ ID NO: 5186608 - DNA, 15 bp, Homo sapiens
agatccaggcttctc

SEQ ID NO: 5186609 - DNA, 16 bp, Homo sapiens
agatccaggcttctcc

SEQ ID NO: 5186610 - DNA, 22 bp, Homo sapiens
agatccagggacagaggcccca

SEQ ID NO: 5186611 - DNA, 19 bp, Homo sapiens
agatccagggatggagatg

SEQ ID NO: 5186612 - DNA, 20 bp, Homo sapiens
agatccaggtggtcccatag

SEQ ID NO: 5186613 - DNA, 16 bp, Homo sapiens
agatccagtgcagttg

SEQ ID NO: 5186614 - DNA, 22 bp, Homo sapiens
agatccagttgaatatttaaag

SEQ ID NO: 5186615 - DNA, 18 bp, Homo sapiens
agatccatttccattgct

SEQ ID NO: 5186616 - DNA, 18 bp, Homo sapiens
agatccatttgcctttct

SEQ ID NO: 5186617 - DNA, 22 bp, Homo sapiens
agatcccaagtagaatctcagt

SEQ ID NO: 5186618 - DNA, 23 bp, Homo sapiens
agatcccactggaagatcccctc

SEQ ID NO: 5186619 - DNA, 21 bp, Homo sapiens
agatcccagaaggacctcctg

SEQ ID NO: 5186620 - DNA, 11 bp, Homo sapiens
agatcccaggg

SEQ ID NO: 5186621 - DNA, 15 bp, Homo sapiens
agatcccagggtaca

SEQ ID NO: 5186622 - DNA, 21 bp, Homo sapiens
agatcccatccatcagctccc

SEQ ID NO: 5186623 - DNA, 13 bp, Homo sapiens
agatcccatctct

SEQ ID NO: 5186624 - DNA, 14 bp, Homo sapiens
agatcccatgtcac

SEQ ID NO: 5186625 - DNA, 19 bp, Homo sapiens
agatcccatgtcacctcag

SEQ ID NO: 5186626 - DNA, 22 bp, Homo sapiens
agatcccatgtcacctcagctg

SEQ ID NO: 5186627 - DNA, 15 bp, Homo sapiens
agatccccaactgct

SEQ ID NO: 5186628 - DNA, 17 bp, Homo sapiens
agatccccaactgctcc

SEQ ID NO: 5186629 - DNA, 22 bp, Homo sapiens
agatccccagcccctcctccct

SEQ ID NO: 5186630 - DNA, 16 bp, Homo sapiens
agatccccagggcagc

SEQ ID NO: 5186631 - DNA, 18 bp, Homo sapiens
agatccccagggcagcct

SEQ ID NO: 5186632 - DNA, 19 bp, Homo sapiens
agatccccagggcagcctc

SEQ ID NO: 5186633 - DNA, 20 bp, Homo sapiens
agatccccagggcagcctcg

SEQ ID NO: 5186634 - DNA, 21 bp, Homo sapiens
agatccccagggcagcctcgt

SEQ ID NO: 5186635 - DNA, 19 bp, Homo sapiens
agatcccccagaaaagaaa

SEQ ID NO: 5186636 - DNA, 13 bp, Homo sapiens
agatccccctccc

SEQ ID NO: 5186637 - DNA, 15 bp, Homo sapiens
agatcccctcaggac

SEQ ID NO: 5186638 - DNA, 15 bp, Homo sapiens
agatcccgcctcttc

SEQ ID NO: 5186639 - DNA, 19 bp, Homo sapiens
agatcccgcctcttcttct

SEQ ID NO: 5186640 - DNA, 18 bp, Homo sapiens
agatccctattagataca

SEQ ID NO: 5186641 - DNA, 22 bp, Homo sapiens
agatccctattagatacacttc

SEQ ID NO: 5186642 - DNA, 19 bp, Homo sapiens
agatccctcggtcagcacc

SEQ ID NO: 5186643 - DNA, 16 bp, Homo sapiens
agatccctgcagaacc

SEQ ID NO: 5186644 - DNA, 17 bp, Homo sapiens
agatccctgcagaaccc

SEQ ID NO: 5186645 - DNA, 16 bp, Homo sapiens
agatcccttaagaagt

SEQ ID NO: 5186646 - DNA, 15 bp, Homo sapiens
agatcctaaactctc

SEQ ID NO: 5186647 - DNA, 16 bp, Homo sapiens
agatcctaaactctct

SEQ ID NO: 5186648 - DNA, 16 bp, Homo sapiens
agatcctaagatgtgt

SEQ ID NO: 5186649 - DNA, 14 bp, Homo sapiens
agatcctaagggtc

SEQ ID NO: 5186650 - DNA, 16 bp, Homo sapiens
agatcctagatcctaa

SEQ ID NO: 5186651 - DNA, 21 bp, Homo sapiens
agatcctccgcggaggcccct

SEQ ID NO: 5186652 - DNA, 22 bp, Homo sapiens
agatcctccgcggaggcccctg

SEQ ID NO: 5186653 - DNA, 12 bp, Homo sapiens
agatcctcctca

SEQ ID NO: 5186654 - DNA, 15 bp, Homo sapiens
agatcctcctcattc

SEQ ID NO: 5186655 - DNA, 15 bp, Homo sapiens
agatcctccttccag

SEQ ID NO: 5186656 - DNA, 16 bp, Homo sapiens
agatcctccttccagg

SEQ ID NO: 5186657 - DNA, 16 bp, Homo sapiens
agatcctctctggggc

SEQ ID NO: 5186658 - DNA, 16 bp, Homo sapiens
agatcctctgctgact

SEQ ID NO: 5186659 - DNA, 20 bp, Homo sapiens
agatcctcttctcaaagctg

SEQ ID NO: 5186660 - DNA, 14 bp, Homo sapiens
agatcctgaagcag

SEQ ID NO: 5186661 - DNA, 22 bp, Homo sapiens
agatcctgaagcagttcagaag

SEQ ID NO: 5186662 - DNA, 15 bp, Homo sapiens
agatcctgagctcac

SEQ ID NO: 5186663 - DNA, 11 bp, Homo sapiens
agatcctgctg

SEQ ID NO: 5186664 - DNA, 13 bp, Homo sapiens
agatcctgctgcc

SEQ ID NO: 5186665 - DNA, 13 bp, Homo sapiens
agatcctggaaat

SEQ ID NO: 5186666 - DNA, 14 bp, Homo sapiens
agatcctggaaatc

SEQ ID NO: 5186667 - DNA, 16 bp, Homo sapiens
agatcctgtcccatgg

SEQ ID NO: 5186668 - DNA, 17 bp, Homo sapiens
agatccttcacaggcag

SEQ ID NO: 5186669 - DNA, 19 bp, Homo sapiens
agatccttcgggtgctgga

SEQ ID NO: 5186670 - DNA, 17 bp, Homo sapiens
agatcctttcaaaagaa

SEQ ID NO: 5186671 - DNA, 18 bp, Homo sapiens
agatccttttattctcca

SEQ ID NO: 5186672 - DNA, 18 bp, Homo sapiens
agatccttttccatccca

SEQ ID NO: 5186673 - DNA, 20 bp, Homo sapiens
agatcctttttccatcattt

SEQ ID NO: 5186674 - DNA, 23 bp, Homo sapiens
agatcctttttccatcattttac

SEQ ID NO: 5186675 - DNA, 15 bp, Homo sapiens
agatcgacagacagc

SEQ ID NO: 5186676 - DNA, 17 bp, Homo sapiens
agatcgagaccatcctg

SEQ ID NO: 5186677 - DNA, 20 bp, Homo sapiens
agatcgagaccatcctggct

SEQ ID NO: 5186678 - DNA, 21 bp, Homo sapiens
agatcgagaccatcctggcta

SEQ ID NO: 5186679 - DNA, 14 bp, Homo sapiens
agatcgcagtttgc

SEQ ID NO: 5186680 - DNA, 15 bp, Homo sapiens
agatcgcagtttgcc

SEQ ID NO: 5186681 - DNA, 16 bp, Homo sapiens
agatcgcatttcctaa

SEQ ID NO: 5186682 - DNA, 15 bp, Homo sapiens
agatcgcccccacct

SEQ ID NO: 5186683 - DNA, 15 bp, Homo sapiens
agatcgcgccactgc

SEQ ID NO: 5186684 - DNA, 17 bp, Homo sapiens
agatcgcgccactgcac

SEQ ID NO: 5186685 - DNA, 14 bp, Homo sapiens
agatcgctcactgt

SEQ ID NO: 5186686 - DNA, 16 bp, Homo sapiens
agatcgctcactgttg

SEQ ID NO: 5186687 - DNA, 20 bp, Homo sapiens
agatcgcttgagcccaggag

SEQ ID NO: 5186688 - DNA, 17 bp, Homo sapiens
agatcggaacagctcct

SEQ ID NO: 5186689 - DNA, 21 bp, Homo sapiens
agatcggatccagtttcccat

SEQ ID NO: 5186690 - DNA, 14 bp, Homo sapiens
agatcggggccaga

SEQ ID NO: 5186691 - DNA, 17 bp, Homo sapiens
agatcggggccagaggc

SEQ ID NO: 5186692 - DNA, 21 bp, Homo sapiens
agatcgtccactgtcaagtgt

SEQ ID NO: 5186693 - DNA, 23 bp, Homo sapiens
agatcgtgccattacactccagc

SEQ ID NO: 5186694 - DNA, 22 bp, Homo sapiens
agatcgtgccgtggagcttgga

SEQ ID NO: 5186695 - DNA, 22 bp, Homo sapiens
agatcgtgccgttactctccaa

SEQ ID NO: 5186696 - DNA, 22 bp, Homo sapiens
agatcgttcattgcctttccag

SEQ ID NO: 5186697 - DNA, 16 bp, Homo sapiens
agatctaaacagttat

SEQ ID NO: 5186698 - DNA, 20 bp, Homo sapiens
agatctaaacagttatttct

SEQ ID NO: 5186699 - DNA, 15 bp, Homo sapiens
agatctaatgtgaaa

SEQ ID NO: 5186700 - DNA, 14 bp, Homo sapiens
agatctacaggaca

SEQ ID NO: 5186701 - DNA, 16 bp, Homo sapiens
agatctacaggacaaa

SEQ ID NO: 5186702 - DNA, 20 bp, Homo sapiens
agatctacatgtctagagaa

SEQ ID NO: 5186703 - DNA, 21 bp, Homo sapiens
agatctaccctgcctgtacta

SEQ ID NO: 5186704 - DNA, 19 bp, Homo sapiens
agatctacctgcaacacaa

SEQ ID NO: 5186705 - DNA, 15 bp, Homo sapiens
agatctagccaggcc

SEQ ID NO: 5186706 - DNA, 16 bp, Homo sapiens
agatctagccaggcct

SEQ ID NO: 5186707 - DNA, 23 bp, Homo sapiens
agatctagtgccattatttctac

SEQ ID NO: 5186708 - DNA, 14 bp, Homo sapiens
agatctataaagcg

SEQ ID NO: 5186709 - DNA, 16 bp, Homo sapiens
agatctataaagcgat

SEQ ID NO: 5186710 - DNA, 17 bp, Homo sapiens
agatctatatggagctt

SEQ ID NO: 5186711 - DNA, 19 bp, Homo sapiens
agatctatatttttgtact

SEQ ID NO: 5186712 - DNA, 19 bp, Homo sapiens
agatctatggcgaacacag

SEQ ID NO: 5186713 - DNA, 16 bp, Homo sapiens
agatctatgggcattt

SEQ ID NO: 5186714 - DNA, 18 bp, Homo sapiens
agatctatgggcatttgg

SEQ ID NO: 5186715 - DNA, 16 bp, Homo sapiens
agatctcaattttata

SEQ ID NO: 5186716 - DNA, 21 bp, Homo sapiens
agatctcataatgctttgtta

SEQ ID NO: 5186717 - DNA, 22 bp, Homo sapiens
agatctccaaagctttcctgga

SEQ ID NO: 5186718 - DNA, 12 bp, Homo sapiens
agatctcccact

SEQ ID NO: 5186719 - DNA, 23 bp, Homo sapiens
agatctcccactgcggggagaca

SEQ ID NO: 5186720 - DNA, 15 bp, Homo sapiens
agatctccctccagg

SEQ ID NO: 5186721 - DNA, 14 bp, Homo sapiens
agatctcctggcaa

SEQ ID NO: 5186722 - DNA, 15 bp, Homo sapiens
agatctcggtgctga

SEQ ID NO: 5186723 - DNA, 16 bp, Homo sapiens
agatctcggtttgcca

SEQ ID NO: 5186724 - DNA, 18 bp, Homo sapiens
agatctctaacttcacca

SEQ ID NO: 5186725 - DNA, 23 bp, Homo sapiens
agatctctgctttggaaatcaca

SEQ ID NO: 5186726 - DNA, 15 bp, Homo sapiens
agatctctgtcacat

SEQ ID NO: 5186727 - DNA, 23 bp, Homo sapiens
agatctctttctctttaatggaa

SEQ ID NO: 5186728 - DNA, 18 bp, Homo sapiens
agatctgaaggggcgggg

SEQ ID NO: 5186729 - DNA, 14 bp, Homo sapiens
agatctgaataaag

SEQ ID NO: 5186730 - DNA, 13 bp, Homo sapiens
agatctgactgcc

SEQ ID NO: 5186731 - DNA, 14 bp, Homo sapiens
agatctgactgcca

SEQ ID NO: 5186732 - DNA, 14 bp, Homo sapiens
agatctgatcaaga

SEQ ID NO: 5186733 - DNA, 12 bp, Homo sapiens
agatctgatttt

SEQ ID NO: 5186734 - DNA, 16 bp, Homo sapiens
agatctgcactcctgt

SEQ ID NO: 5186735 - DNA, 16 bp, Homo sapiens
agatctgcactgggtg

SEQ ID NO: 5186736 - DNA, 14 bp, Homo sapiens
agatctgcaggctg

SEQ ID NO: 5186737 - DNA, 15 bp, Homo sapiens
agatctgcaggctgc

SEQ ID NO: 5186738 - DNA, 15 bp, Homo sapiens
agatctgccagacct

SEQ ID NO: 5186739 - DNA, 18 bp, Homo sapiens
agatctgcctaaggactt

SEQ ID NO: 5186740 - DNA, 19 bp, Homo sapiens
agatctgcctaaggacttc

SEQ ID NO: 5186741 - DNA, 17 bp, Homo sapiens
agatctgcctgggcctg

SEQ ID NO: 5186742 - DNA, 19 bp, Homo sapiens
agatctgcctgggcctgtg

SEQ ID NO: 5186743 - DNA, 12 bp, Homo sapiens
agatctgctcct

SEQ ID NO: 5186744 - DNA, 13 bp, Homo sapiens
agatctgctcctc

SEQ ID NO: 5186745 - DNA, 19 bp, Homo sapiens
agatctgcttccctggggc

SEQ ID NO: 5186746 - DNA, 18 bp, Homo sapiens
agatctgctttctgttca

SEQ ID NO: 5186747 - DNA, 21 bp, Homo sapiens
agatctgctttctgttcatct

SEQ ID NO: 5186748 - DNA, 13 bp, Homo sapiens
agatctggaacct

SEQ ID NO: 5186749 - DNA, 16 bp, Homo sapiens
agatctggaatgtgaa

SEQ ID NO: 5186750 - DNA, 12 bp, Homo sapiens
agatctgggcat

SEQ ID NO: 5186751 - DNA, 15 bp, Homo sapiens
agatctggggaggca

SEQ ID NO: 5186752 - DNA, 17 bp, Homo sapiens
agatctggggaggcagg

SEQ ID NO: 5186753 - DNA, 15 bp, Homo sapiens
agatctggtgtccag

SEQ ID NO: 5186754 - DNA, 20 bp, Homo sapiens
agatctggtgtccagcatgg

SEQ ID NO: 5186755 - DNA, 17 bp, Homo sapiens
agatctggttttgctat

SEQ ID NO: 5186756 - DNA, 18 bp, Homo sapiens
agatctggttttgctatt

SEQ ID NO: 5186757 - DNA, 15 bp, Homo sapiens
agatctgtataaata

SEQ ID NO: 5186758 - DNA, 17 bp, Homo sapiens
agatctgtataaataag

SEQ ID NO: 5186759 - DNA, 18 bp, Homo sapiens
agatctgtataaataaga

SEQ ID NO: 5186760 - DNA, 22 bp, Homo sapiens
agatctgtataaataagagcat

SEQ ID NO: 5186761 - DNA, 13 bp, Homo sapiens
agatctgtcctgg

SEQ ID NO: 5186762 - DNA, 16 bp, Homo sapiens
agatctgtcctggggg

SEQ ID NO: 5186763 - DNA, 12 bp, Homo sapiens
agatctgtcttg

SEQ ID NO: 5186764 - DNA, 12 bp, Homo sapiens
agatctgtgccc

SEQ ID NO: 5186765 - DNA, 14 bp, Homo sapiens
agatctgtgtggct

SEQ ID NO: 5186766 - DNA, 17 bp, Homo sapiens
agatctgtgtggctcct

SEQ ID NO: 5186767 - DNA, 22 bp, Homo sapiens
agatctgttttgtggtttggaa

SEQ ID NO: 5186768 - DNA, 13 bp, Homo sapiens
agatcttaaattt

SEQ ID NO: 5186769 - DNA, 16 bp, Homo sapiens
agatcttacaagttta

SEQ ID NO: 5186770 - DNA, 16 bp, Homo sapiens
agatcttacatctgca

SEQ ID NO: 5186771 - DNA, 13 bp, Homo sapiens
agatcttaggtat

SEQ ID NO: 5186772 - DNA, 23 bp, Homo sapiens
agatcttaggtatagaggaccct

SEQ ID NO: 5186773 - DNA, 12 bp, Homo sapiens
agccaaatctga

SEQ ID NO: 5186774 - DNA, 19 bp, Homo sapiens
agccaaatgacttcatttc

SEQ ID NO: 5186775 - DNA, 20 bp, Homo sapiens
agccaaatgtaattgaataa

SEQ ID NO: 5186776 - DNA, 23 bp, Homo sapiens
agccaaatgtggcatttgtgatc

SEQ ID NO: 5186777 - DNA, 17 bp, Homo sapiens
agccaaattgcagaaga

SEQ ID NO: 5186778 - DNA, 18 bp, Homo sapiens
agccaaattgcagaagaa

SEQ ID NO: 5186779 - DNA, 13 bp, Homo sapiens
agccaaatttaaa

SEQ ID NO: 5186780 - DNA, 16 bp, Homo sapiens
agccaaatttatcaaa

SEQ ID NO: 5186781 - DNA, 13 bp, Homo sapiens
agccaaatttctt

SEQ ID NO: 5186782 - DNA, 21 bp, Homo sapiens
agccaacaagaccgccccagg

SEQ ID NO: 5186783 - DNA, 24 bp, Homo sapiens
agccaacaagaccgccccagggct

SEQ ID NO: 5186784 - DNA, 23 bp, Homo sapiens
agccaacaccctgtctaaaaaac

SEQ ID NO: 5186785 - DNA, 22 bp, Homo sapiens
agccaacacgcacctgcctcag

SEQ ID NO: 5186786 - DNA, 13 bp, Homo sapiens
agccaacagcagc

SEQ ID NO: 5186787 - DNA, 12 bp, Homo sapiens
agccaacagcta

SEQ ID NO: 5186788 - DNA, 14 bp, Homo sapiens
agccaacagctaca

SEQ ID NO: 5186789 - DNA, 21 bp, Homo sapiens
agccaacaggtggcaggacca

SEQ ID NO: 5186790 - DNA, 23 bp, Homo sapiens
agccaacaggtggcaggaccagg

SEQ ID NO: 5186791 - DNA, 21 bp, Homo sapiens
agccaacagtcaaaacagaga

SEQ ID NO: 5186792 - DNA, 13 bp, Homo sapiens
agccaaccagcct

SEQ ID NO: 5186793 - DNA, 14 bp, Homo sapiens
agccaacccctgtg

SEQ ID NO: 5186794 - DNA, 15 bp, Homo sapiens
agccaacctggactt

SEQ ID NO: 5186795 - DNA, 22 bp, Homo sapiens
agccaacctggacttcctgtca

SEQ ID NO: 5186796 - DNA, 23 bp, Homo sapiens
agccaacctggacttcctgtcat

SEQ ID NO: 5186797 - DNA, 16 bp, Homo sapiens
agccaaccttcaaaga

SEQ ID NO: 5186798 - DNA, 22 bp, Homo sapiens
agccaacgtgtgtgtcagctgg

SEQ ID NO: 5186799 - DNA, 15 bp, Homo sapiens
agccaactcctcctt

SEQ ID NO: 5186800 - DNA, 20 bp, Homo sapiens
agccaactctaacaggcact

SEQ ID NO: 5186801 - DNA, 19 bp, Homo sapiens
agccaactctcccaaaggg

SEQ ID NO: 5186802 - DNA, 13 bp, Homo sapiens
agccaactctggg

SEQ ID NO: 5186803 - DNA, 21 bp, Homo sapiens
agccaactgacaaagatgcat

SEQ ID NO: 5186804 - DNA, 16 bp, Homo sapiens
agccaactgattttgt

SEQ ID NO: 5186805 - DNA, 17 bp, Homo sapiens
agccaactgattttgta

SEQ ID NO: 5186806 - DNA, 18 bp, Homo sapiens
agccaactgattttgtat

SEQ ID NO: 5186807 - DNA, 20 bp, Homo sapiens
agccaactgtttccctgctg

SEQ ID NO: 5186808 - DNA, 21 bp, Homo sapiens
agccaactgtttccctgctga

SEQ ID NO: 5186809 - DNA, 23 bp, Homo sapiens
agccaactgtttccctgctgaat

SEQ ID NO: 5186810 - DNA, 12 bp, Homo sapiens
agccaacttcaa

SEQ ID NO: 5186811 - DNA, 19 bp, Homo sapiens
agccaacttgtaaatacac

SEQ ID NO: 5186812 - DNA, 20 bp, Homo sapiens
agccaacttgtaaatacacc

SEQ ID NO: 5186813 - DNA, 15 bp, Homo sapiens
agccaacttttgcat

SEQ ID NO: 5186814 - DNA, 17 bp, Homo sapiens
agccaagacagtggcag

SEQ ID NO: 5186815 - DNA, 23 bp, Homo sapiens
agccaagaccatctctccctcct

SEQ ID NO: 5186816 - DNA, 21 bp, Homo sapiens
agccaagacccaacaggtgct

SEQ ID NO: 5186817 - DNA, 22 bp, Homo sapiens
agccaagacctcacacacacaa

SEQ ID NO: 5186818 - DNA, 15 bp, Homo sapiens
agccaagagagcctc

SEQ ID NO: 5186819 - DNA, 14 bp, Homo sapiens
agccaagaggctgc

SEQ ID NO: 5186820 - DNA, 15 bp, Homo sapiens
agccaagaggctgca

SEQ ID NO: 5186821 - DNA, 19 bp, Homo sapiens
agccaagatcacgccactg

SEQ ID NO: 5186822 - DNA, 14 bp, Homo sapiens
agccaagatcgcac

SEQ ID NO: 5186823 - DNA, 18 bp, Homo sapiens
agccaagatcgcaccact

SEQ ID NO: 5186824 - DNA, 19 bp, Homo sapiens
agccaagattgcgccattg

SEQ ID NO: 5186825 - DNA, 13 bp, Homo sapiens
agccaagcacagt

SEQ ID NO: 5186826 - DNA, 17 bp, Homo sapiens
agccaagcacagtggtg

SEQ ID NO: 5186827 - DNA, 21 bp, Homo sapiens
agccaagcacagtggtggcag

SEQ ID NO: 5186828 - DNA, 23 bp, Homo sapiens
agccaagccctaagcctgtcccc

SEQ ID NO: 5186829 - DNA, 13 bp, Homo sapiens
agccaagccctcc

SEQ ID NO: 5186830 - DNA, 20 bp, Homo sapiens
agccaagccctccgcctaga

SEQ ID NO: 5186831 - DNA, 16 bp, Homo sapiens
agccaagcctggagta

SEQ ID NO: 5186832 - DNA, 15 bp, Homo sapiens
agccaagcgctcatg

SEQ ID NO: 5186833 - DNA, 19 bp, Homo sapiens
agccaagctccctggagcc

SEQ ID NO: 5186834 - DNA, 15 bp, Homo sapiens
agccaagctccttgg

SEQ ID NO: 5186835 - DNA, 23 bp, Homo sapiens
agccaagctccttgggaggcccc

SEQ ID NO: 5186836 - DNA, 12 bp, Homo sapiens
agccaagctgca

SEQ ID NO: 5186837 - DNA, 14 bp, Homo sapiens
agccaagctgtgtt

SEQ ID NO: 5186838 - DNA, 15 bp, Homo sapiens
agccaagctgtgttc

SEQ ID NO: 5186839 - DNA, 17 bp, Homo sapiens
agccaagctgtgttcat

SEQ ID NO: 5186840 - DNA, 16 bp, Homo sapiens
agccaagctttaaatt

SEQ ID NO: 5186841 - DNA, 19 bp, Homo sapiens
agccaagctttaaattatg

SEQ ID NO: 5186842 - DNA, 13 bp, Homo sapiens
agccaaggaaaaa

SEQ ID NO: 5186843 - DNA, 16 bp, Homo sapiens
agccaaggaagttggt

SEQ ID NO: 5186844 - DNA, 14 bp, Homo sapiens
agccaaggaatgtg

SEQ ID NO: 5186845 - DNA, 17 bp, Homo sapiens
agccaaggaatgtgtcc

SEQ ID NO: 5186846 - DNA, 18 bp, Homo sapiens
agccaaggaatgtgtcca

SEQ ID NO: 5186847 - DNA, 16 bp, Homo sapiens
agccaaggacagggct

SEQ ID NO: 5186848 - DNA, 20 bp, Homo sapiens
agccaaggacagggctggct

SEQ ID NO: 5186849 - DNA, 22 bp, Homo sapiens
agccaaggacagggctggctcc

SEQ ID NO: 5186850 - DNA, 15 bp, Homo sapiens
agccaaggaggcctg

SEQ ID NO: 5186851 - DNA, 20 bp, Homo sapiens
agccaaggaggcctggggag

SEQ ID NO: 5186852 - DNA, 21 bp, Homo sapiens
agccaaggagtcactgagacc

SEQ ID NO: 5186853 - DNA, 18 bp, Homo sapiens
agccaaggagtcagatgg

SEQ ID NO: 5186854 - DNA, 16 bp, Homo sapiens
agccaaggcagagggg

SEQ ID NO: 5186855 - DNA, 14 bp, Homo sapiens
agccaaggcagcga

SEQ ID NO: 5186856 - DNA, 22 bp, Homo sapiens
agccaaggcagcgaccccagga

SEQ ID NO: 5186857 - DNA, 20 bp, Homo sapiens
agccaaggccaaaggaagca

SEQ ID NO: 5186858 - DNA, 20 bp, Homo sapiens
agccaaggccgaagctctgg

SEQ ID NO: 5186859 - DNA, 18 bp, Homo sapiens
agccaaggccgccagcgt

SEQ ID NO: 5186860 - DNA, 20 bp, Homo sapiens
agccaaggccgccagcgtgt

SEQ ID NO: 5186861 - DNA, 14 bp, Homo sapiens
agccaaggctcccg

SEQ ID NO: 5186862 - DNA, 19 bp, Homo sapiens
agccaagggaacctgtgtc

SEQ ID NO: 5186863 - DNA, 20 bp, Homo sapiens
agccaagggaacctgtgtcc

SEQ ID NO: 5186864 - DNA, 17 bp, Homo sapiens
agccaagggacacagga

SEQ ID NO: 5186865 - DNA, 22 bp, Homo sapiens
agccaagggagggaagggccac

SEQ ID NO: 5186866 - DNA, 11 bp, Homo sapiens
agccaagggat

SEQ ID NO: 5186867 - DNA, 14 bp, Homo sapiens
agccaagggatgga

SEQ ID NO: 5186868 - DNA, 20 bp, Homo sapiens
agccaagggatggacatctt

SEQ ID NO: 5186869 - DNA, 17 bp, Homo sapiens
agccaagggctaggctc

SEQ ID NO: 5186870 - DNA, 14 bp, Homo sapiens
agccaaggggctgc

SEQ ID NO: 5186871 - DNA, 16 bp, Homo sapiens
agccaaggggtctgct

SEQ ID NO: 5186872 - DNA, 20 bp, Homo sapiens
agccaaggggtctgctcctg

SEQ ID NO: 5186873 - DNA, 14 bp, Homo sapiens
agccaagtaaagtg

SEQ ID NO: 5186874 - DNA, 21 bp, Homo sapiens
agccaagtcagctttgccttc

SEQ ID NO: 5186875 - DNA, 15 bp, Homo sapiens
agccaagtccagatt

SEQ ID NO: 5186876 - DNA, 19 bp, Homo sapiens
agccaagtgccaaatgctc

SEQ ID NO: 5186877 - DNA, 18 bp, Homo sapiens
agccaagtggtccagcgt

SEQ ID NO: 5186878 - DNA, 14 bp, Homo sapiens
agccaagtgtcctg

SEQ ID NO: 5186879 - DNA, 22 bp, Homo sapiens
agccaagtgttttgtattttat

SEQ ID NO: 5186880 - DNA, 19 bp, Homo sapiens
agccaagttccaaaataaa

SEQ ID NO: 5186881 - DNA, 17 bp, Homo sapiens
agccaagttgtgacagt

SEQ ID NO: 5186882 - DNA, 20 bp, Homo sapiens
agccaagttttaaatattat

SEQ ID NO: 5186883 - DNA, 22 bp, Homo sapiens
agccaagttttataatccttaa

SEQ ID NO: 5186884 - DNA, 16 bp, Homo sapiens
agccaataaagaaatt

SEQ ID NO: 5186885 - DNA, 19 bp, Homo sapiens
agccaataaagctcacact

SEQ ID NO: 5186886 - DNA, 14 bp, Homo sapiens
agccaataaataat

SEQ ID NO: 5186887 - DNA, 16 bp, Homo sapiens
agccaataaataatat

SEQ ID NO: 5186888 - DNA, 16 bp, Homo sapiens
agccaatactgagtgc

SEQ ID NO: 5186889 - DNA, 17 bp, Homo sapiens
agccaatactgagtgcc

SEQ ID NO: 5186890 - DNA, 20 bp, Homo sapiens
agccaatatcccttacttta

SEQ ID NO: 5186891 - DNA, 22 bp, Homo sapiens
agccaatatcccttactttaac

SEQ ID NO: 5186892 - DNA, 14 bp, Homo sapiens
agccaatcccctcc

SEQ ID NO: 5186893 - DNA, 22 bp, Homo sapiens
agccaatcccctccttgggcac

SEQ ID NO: 5186894 - DNA, 17 bp, Homo sapiens
agccaatccctggccat

SEQ ID NO: 5186895 - DNA, 16 bp, Homo sapiens
agccaatctggacact

SEQ ID NO: 5186896 - DNA, 23 bp, Homo sapiens
agccaatctggacacttctttat

SEQ ID NO: 5186897 - DNA, 20 bp, Homo sapiens
agccaatggcccggcccctc

SEQ ID NO: 5186898 - DNA, 17 bp, Homo sapiens
agccaatggtgagggct

SEQ ID NO: 5186899 - DNA, 18 bp, Homo sapiens
agccaatggtgagggctg

SEQ ID NO: 5186900 - DNA, 14 bp, Homo sapiens
agccaatgtgaatt

SEQ ID NO: 5186901 - DNA, 12 bp, Homo sapiens
agccaatgttat

SEQ ID NO: 5186902 - DNA, 17 bp, Homo sapiens
agccaattatgttaaac

SEQ ID NO: 5186903 - DNA, 20 bp, Homo sapiens
agccaattatgttaaactag

SEQ ID NO: 5186904 - DNA, 17 bp, Homo sapiens
agccaattcagacaggc

SEQ ID NO: 5186905 - DNA, 18 bp, Homo sapiens
agccaattcagacaggca

SEQ ID NO: 5186906 - DNA, 17 bp, Homo sapiens
agccaatttcaaagaaa

SEQ ID NO: 5186907 - DNA, 13 bp, Homo sapiens
agccaatttttct

SEQ ID NO: 5186908 - DNA, 17 bp, Homo sapiens
agccaatttttctgcac

SEQ ID NO: 5186909 - DNA, 15 bp, Homo sapiens
agccacaaagccccc

SEQ ID NO: 5186910 - DNA, 16 bp, Homo sapiens
agccacaaagcccccc

SEQ ID NO: 5186911 - DNA, 19 bp, Homo sapiens
agccacaaagccccccagc

SEQ ID NO: 5186912 - DNA, 20 bp, Homo sapiens
agccacaaagccccccagct

SEQ ID NO: 5186913 - DNA, 17 bp, Homo sapiens
agccacaaatgccttga

SEQ ID NO: 5186914 - DNA, 17 bp, Homo sapiens
agccacaagctgcactg

SEQ ID NO: 5186915 - DNA, 22 bp, Homo sapiens
agccacaagctgcactgtgaac

SEQ ID NO: 5186916 - DNA, 17 bp, Homo sapiens
agccacaattatataaa

SEQ ID NO: 5186917 - DNA, 20 bp, Homo sapiens
agccacacacacagaaaata

SEQ ID NO: 5186918 - DNA, 23 bp, Homo sapiens
agccacacacacagaaaatatac

SEQ ID NO: 5186919 - DNA, 18 bp, Homo sapiens
agccacacagagcctgcc

SEQ ID NO: 5186920 - DNA, 19 bp, Homo sapiens
agccacacagagcctgcct

SEQ ID NO: 5186921 - DNA, 20 bp, Homo sapiens
agccacacagcccagaaggc

SEQ ID NO: 5186922 - DNA, 21 bp, Homo sapiens
agccacacagcccagaaggcc

SEQ ID NO: 5186923 - DNA, 14 bp, Homo sapiens
agccacaccacagg

SEQ ID NO: 5186924 - DNA, 19 bp, Homo sapiens
agccacaccgctggctccg

SEQ ID NO: 5186925 - DNA, 21 bp, Homo sapiens
agccacacgcaggcggccagg

SEQ ID NO: 5186926 - DNA, 14 bp, Homo sapiens
agccacactgggcc

SEQ ID NO: 5186927 - DNA, 16 bp, Homo sapiens
agccacactgggcctg

SEQ ID NO: 5186928 - DNA, 18 bp, Homo sapiens
agccacactgggcctgga

SEQ ID NO: 5186929 - DNA, 21 bp, Homo sapiens
agccacactgtgggactcttc

SEQ ID NO: 5186930 - DNA, 15 bp, Homo sapiens
agccacacttccttt

SEQ ID NO: 5186931 - DNA, 20 bp, Homo sapiens
agccacacttctcaggacac

SEQ ID NO: 5186932 - DNA, 10 bp, Homo sapiens
agccacagaa

SEQ ID NO: 5186933 - DNA, 16 bp, Homo sapiens
agccacagaaatgtgt

SEQ ID NO: 5186934 - DNA, 12 bp, Homo sapiens
agccacagaagc

SEQ ID NO: 5186935 - DNA, 19 bp, Homo sapiens
agccacagacccctgggag

SEQ ID NO: 5186936 - DNA, 20 bp, Homo sapiens
agccacagacccctgggagc

SEQ ID NO: 5186937 - DNA, 18 bp, Homo sapiens
agccacagcagcattttt

SEQ ID NO: 5186938 - DNA, 17 bp, Homo sapiens
agccacagcccaggcct

SEQ ID NO: 5186939 - DNA, 21 bp, Homo sapiens
agccacagcccaggcctccag

SEQ ID NO: 5186940 - DNA, 18 bp, Homo sapiens
agccacagcctccccacc

SEQ ID NO: 5186941 - DNA, 12 bp, Homo sapiens
agccacagcctg

SEQ ID NO: 5186942 - DNA, 13 bp, Homo sapiens
agccacagctgct

SEQ ID NO: 5186943 - DNA, 22 bp, Homo sapiens
agccacagctgctgttctcagg

SEQ ID NO: 5186944 - DNA, 12 bp, Homo sapiens
agccacaggaac

SEQ ID NO: 5186945 - DNA, 15 bp, Homo sapiens
agccacaggaacggc

SEQ ID NO: 5186946 - DNA, 16 bp, Homo sapiens
agccacaggaacggcc

SEQ ID NO: 5186947 - DNA, 15 bp, Homo sapiens
agccacaggaaggag

SEQ ID NO: 5186948 - DNA, 22 bp, Homo sapiens
agccacaggaaggaggggagag

SEQ ID NO: 5186949 - DNA, 18 bp, Homo sapiens
agccacaggaccacctcc

SEQ ID NO: 5186950 - DNA, 17 bp, Homo sapiens
agccacaggactgagcc

SEQ ID NO: 5186951 - DNA, 13 bp, Homo sapiens
agatcttatattg

SEQ ID NO: 5186952 - DNA, 18 bp, Homo sapiens
agatcttatttattaact

SEQ ID NO: 5186953 - DNA, 22 bp, Homo sapiens
agatcttcccataataaagcaa

SEQ ID NO: 5186954 - DNA, 23 bp, Homo sapiens
agatcttcccataataaagcaat

SEQ ID NO: 5186955 - DNA, 22 bp, Homo sapiens
agatcttcccctaacctttggg

SEQ ID NO: 5186956 - DNA, 17 bp, Homo sapiens
agatcttgagagctgct

SEQ ID NO: 5186957 - DNA, 17 bp, Homo sapiens
agatcttgagcaaggca

SEQ ID NO: 5186958 - DNA, 20 bp, Homo sapiens
agatcttgagcaaggcaaga

SEQ ID NO: 5186959 - DNA, 14 bp, Homo sapiens
agatcttgcctcca

SEQ ID NO: 5186960 - DNA, 19 bp, Homo sapiens
agatcttggcttaatttaa

SEQ ID NO: 5186961 - DNA, 15 bp, Homo sapiens
agatctttaaataca

SEQ ID NO: 5186962 - DNA, 12 bp, Homo sapiens
agatctttcagg

SEQ ID NO: 5186963 - DNA, 21 bp, Homo sapiens
agatctttcaggaaagacgga

SEQ ID NO: 5186964 - DNA, 14 bp, Homo sapiens
agatctttcatttt

SEQ ID NO: 5186965 - DNA, 22 bp, Homo sapiens
agatctttccaaagacaatgtg

SEQ ID NO: 5186966 - DNA, 13 bp, Homo sapiens
agatctttcccag

SEQ ID NO: 5186967 - DNA, 16 bp, Homo sapiens
agatctttctccttga

SEQ ID NO: 5186968 - DNA, 14 bp, Homo sapiens
agatctttctcttc

SEQ ID NO: 5186969 - DNA, 15 bp, Homo sapiens
agatctttcttaata

SEQ ID NO: 5186970 - DNA, 20 bp, Homo sapiens
agatctttctttccaaaaca

SEQ ID NO: 5186971 - DNA, 23 bp, Homo sapiens
agatctttgcaccagatactcat

SEQ ID NO: 5186972 - DNA, 14 bp, Homo sapiens
agatcttttaaaaa

SEQ ID NO: 5186973 - DNA, 15 bp, Homo sapiens
agatcttttagaagt

SEQ ID NO: 5186974 - DNA, 22 bp, Homo sapiens
agatcttttagaagtgagagaa

SEQ ID NO: 5186975 - DNA, 16 bp, Homo sapiens
agatcttttattttgc

SEQ ID NO: 5186976 - DNA, 18 bp, Homo sapiens
agatcttttattttgcca

SEQ ID NO: 5186977 - DNA, 18 bp, Homo sapiens
agatctttttttaagtgt

SEQ ID NO: 5186978 - DNA, 19 bp, Homo sapiens
agatctttttttaagtgtt

SEQ ID NO: 5186979 - DNA, 17 bp, Homo sapiens
agatgaaaaagcatgta

SEQ ID NO: 5186980 - DNA, 14 bp, Homo sapiens
agatgaaaagctac

SEQ ID NO: 5186981 - DNA, 17 bp, Homo sapiens
agatgaaaataaaataa

SEQ ID NO: 5186982 - DNA, 14 bp, Homo sapiens
agatgaaactgaaa

SEQ ID NO: 5186983 - DNA, 17 bp, Homo sapiens
agatgaaactgaaagca

SEQ ID NO: 5186984 - DNA, 19 bp, Homo sapiens
agatgaaactggttcctac

SEQ ID NO: 5186985 - DNA, 15 bp, Homo sapiens
agatgaaagagcagt

SEQ ID NO: 5186986 - DNA, 22 bp, Homo sapiens
agatgaaagcagggaatttcta

SEQ ID NO: 5186987 - DNA, 15 bp, Homo sapiens
agatgaaaggagaca

SEQ ID NO: 5186988 - DNA, 21 bp, Homo sapiens
agatgaaaggagtaagaaatt

SEQ ID NO: 5186989 - DNA, 12 bp, Homo sapiens
agatgaaataat

SEQ ID NO: 5186990 - DNA, 21 bp, Homo sapiens
agatgaaatatatattgtaaa

SEQ ID NO: 5186991 - DNA, 14 bp, Homo sapiens
agatgaaatgcact

SEQ ID NO: 5186992 - DNA, 14 bp, Homo sapiens
agatgaaatgcctt

SEQ ID NO: 5186993 - DNA, 17 bp, Homo sapiens
agatgaaatttgataaa

SEQ ID NO: 5186994 - DNA, 18 bp, Homo sapiens
agatgaacagactgacct

SEQ ID NO: 5186995 - DNA, 14 bp, Homo sapiens
agatgaacatctct

SEQ ID NO: 5186996 - DNA, 16 bp, Homo sapiens
agatgaacatttcaaa

SEQ ID NO: 5186997 - DNA, 21 bp, Homo sapiens
agatgaaccaagtgtctaaaa

SEQ ID NO: 5186998 - DNA, 21 bp, Homo sapiens
agatgaactctgaactttgga

SEQ ID NO: 5186999 - DNA, 19 bp, Homo sapiens
agatgaactcttagaaatg

SEQ ID NO: 5187000 - DNA, 19 bp, Homo sapiens
agatgaactgactgaagga

SEQ ID NO: 5187001 - DNA, 19 bp, Homo sapiens
agatgaacttgagctctgt

SEQ ID NO: 5187002 - DNA, 21 bp, Homo sapiens
agatgaactttgtcattatga

SEQ ID NO: 5187003 - DNA, 22 bp, Homo sapiens
agatgaactttttaacaaatgt

SEQ ID NO: 5187004 - DNA, 12 bp, Homo sapiens
agatgaagaaag

SEQ ID NO: 5187005 - DNA, 14 bp, Homo sapiens
agatgaagaaagag

SEQ ID NO: 5187006 - DNA, 13 bp, Homo sapiens
agatgaagaagaa

SEQ ID NO: 5187007 - DNA, 19 bp, Homo sapiens
agatgaagagaagctgaga

SEQ ID NO: 5187008 - DNA, 19 bp, Homo sapiens
agatgaagagtgagagggc

SEQ ID NO: 5187009 - DNA, 17 bp, Homo sapiens
agatgaagattcatgtt

SEQ ID NO: 5187010 - DNA, 17 bp, Homo sapiens
agatgaagcaaacacat

SEQ ID NO: 5187011 - DNA, 17 bp, Homo sapiens
agatgaaggtctgtttt

SEQ ID NO: 5187012 - DNA, 20 bp, Homo sapiens
agatgaagtgagatacaaag

SEQ ID NO: 5187013 - DNA, 11 bp, Homo sapiens
agatgaataaa

SEQ ID NO: 5187014 - DNA, 22 bp, Homo sapiens
agatgaatacaaacaatggaaa

SEQ ID NO: 5187015 - DNA, 16 bp, Homo sapiens
agatgaatagaagaaa

SEQ ID NO: 5187016 - DNA, 16 bp, Homo sapiens
agatgaatatgagctc

SEQ ID NO: 5187017 - DNA, 18 bp, Homo sapiens
agatgaatcaatgggaaa

SEQ ID NO: 5187018 - DNA, 18 bp, Homo sapiens
agatgaatcagtatgaag

SEQ ID NO: 5187019 - DNA, 16 bp, Homo sapiens
agatgaatgccgtgga

SEQ ID NO: 5187020 - DNA, 23 bp, Homo sapiens
agatgaatgtcagttgttattta

SEQ ID NO: 5187021 - DNA, 15 bp, Homo sapiens
agatgaattgataaa

SEQ ID NO: 5187022 - DNA, 18 bp, Homo sapiens
agatgaattgataaaaga

SEQ ID NO: 5187023 - DNA, 16 bp, Homo sapiens
agatgaatttgtccaa

SEQ ID NO: 5187024 - DNA, 11 bp, Homo sapiens
agatgacaaaa

SEQ ID NO: 5187025 - DNA, 19 bp, Homo sapiens
agatgacaaaagaaaattt

SEQ ID NO: 5187026 - DNA, 14 bp, Homo sapiens
agatgacaaatatt

SEQ ID NO: 5187027 - DNA, 16 bp, Homo sapiens
agatgacaaatattct

SEQ ID NO: 5187028 - DNA, 17 bp, Homo sapiens
agatgacaaattatatt

SEQ ID NO: 5187029 - DNA, 18 bp, Homo sapiens
agatgacaagaaaggctg

SEQ ID NO: 5187030 - DNA, 12 bp, Homo sapiens
agatgacaatgt

SEQ ID NO: 5187031 - DNA, 14 bp, Homo sapiens
agatgacacataaa

SEQ ID NO: 5187032 - DNA, 17 bp, Homo sapiens
agatgacacttttaaaa

SEQ ID NO: 5187033 - DNA, 13 bp, Homo sapiens
agatgacagctct

SEQ ID NO: 5187034 - DNA, 19 bp, Homo sapiens
agatgaccagggatgctgg

SEQ ID NO: 5187035 - DNA, 23 bp, Homo sapiens
agatgacccctgcccagatcagc

SEQ ID NO: 5187036 - DNA, 17 bp, Homo sapiens
agatgaccgtgtacaat

SEQ ID NO: 5187037 - DNA, 15 bp, Homo sapiens
agatgacctcattaa

SEQ ID NO: 5187038 - DNA, 16 bp, Homo sapiens
agatgacctgccccaa

SEQ ID NO: 5187039 - DNA, 19 bp, Homo sapiens
agatgactacatttagccc

SEQ ID NO: 5187040 - DNA, 20 bp, Homo sapiens
agatgactatgcagaggcct

SEQ ID NO: 5187041 - DNA, 14 bp, Homo sapiens
agatgactctctcc

SEQ ID NO: 5187042 - DNA, 14 bp, Homo sapiens
agatgactgagtcc

SEQ ID NO: 5187043 - DNA, 20 bp, Homo sapiens
agatgactggaaacaaggaa

SEQ ID NO: 5187044 - DNA, 15 bp, Homo sapiens
agatgacttcttttc

SEQ ID NO: 5187045 - DNA, 19 bp, Homo sapiens
agatgagaaaactgagagg

SEQ ID NO: 5187046 - DNA, 21 bp, Homo sapiens
agatgagaacagataaagatt

SEQ ID NO: 5187047 - DNA, 14 bp, Homo sapiens
agatgagaagccag

SEQ ID NO: 5187048 - DNA, 13 bp, Homo sapiens
agatgagaattag

SEQ ID NO: 5187049 - DNA, 23 bp, Homo sapiens
agatgagaggggagagctgaaca

SEQ ID NO: 5187050 - DNA, 19 bp, Homo sapiens
agatgagatttgccagcac

SEQ ID NO: 5187051 - DNA, 17 bp, Homo sapiens
agatgagcaaggacatt

SEQ ID NO: 5187052 - DNA, 15 bp, Homo sapiens
agatgagcaggagct

SEQ ID NO: 5187053 - DNA, 15 bp, Homo sapiens
agatgagcagtcaca

SEQ ID NO: 5187054 - DNA, 19 bp, Homo sapiens
agatgagcagtcacactgt

SEQ ID NO: 5187055 - DNA, 11 bp, Homo sapiens
agatgagccca

SEQ ID NO: 5187056 - DNA, 13 bp, Homo sapiens
agatgagcccacc

SEQ ID NO: 5187057 - DNA, 21 bp, Homo sapiens
agatgagcccagccctgttct

SEQ ID NO: 5187058 - DNA, 16 bp, Homo sapiens
agatgagcctgggctc

SEQ ID NO: 5187059 - DNA, 16 bp, Homo sapiens
agatgagcgaaaatgt

SEQ ID NO: 5187060 - DNA, 14 bp, Homo sapiens
agatgaggaaataa

SEQ ID NO: 5187061 - DNA, 19 bp, Homo sapiens
agatgaggaaataagactt

SEQ ID NO: 5187062 - DNA, 21 bp, Homo sapiens
agatgaggaaataagactttt

SEQ ID NO: 5187063 - DNA, 23 bp, Homo sapiens
agatgaggaaataagacttttag

SEQ ID NO: 5187064 - DNA, 19 bp, Homo sapiens
agatgaggagcagctgggg

SEQ ID NO: 5187065 - DNA, 15 bp, Homo sapiens
agatgaggaggggag

SEQ ID NO: 5187066 - DNA, 13 bp, Homo sapiens
agatgaggccaga

SEQ ID NO: 5187067 - DNA, 14 bp, Homo sapiens
agatgaggccagac

SEQ ID NO: 5187068 - DNA, 11 bp, Homo sapiens
agatgaggccc

SEQ ID NO: 5187069 - DNA, 13 bp, Homo sapiens
agatgaggccctg

SEQ ID NO: 5187070 - DNA, 18 bp, Homo sapiens
agatgaggccctgcacct

SEQ ID NO: 5187071 - DNA, 15 bp, Homo sapiens
agatgaggctcagag

SEQ ID NO: 5187072 - DNA, 18 bp, Homo sapiens
agatgaggctcagagagg

SEQ ID NO: 5187073 - DNA, 19 bp, Homo sapiens
agatgagggatgggcctgg

SEQ ID NO: 5187074 - DNA, 15 bp, Homo sapiens
agatgaggggccact

SEQ ID NO: 5187075 - DNA, 14 bp, Homo sapiens
agatgaggggttga

SEQ ID NO: 5187076 - DNA, 18 bp, Homo sapiens
agatgaggggttgaggga

SEQ ID NO: 5187077 - DNA, 18 bp, Homo sapiens
agatgaggtcagttgtgt

SEQ ID NO: 5187078 - DNA, 21 bp, Homo sapiens
agatgaggtcagttgtgtttt

SEQ ID NO: 5187079 - DNA, 22 bp, Homo sapiens
agatgaggttgagctatgatat

SEQ ID NO: 5187080 - DNA, 14 bp, Homo sapiens
agatgagtgagcat

SEQ ID NO: 5187081 - DNA, 22 bp, Homo sapiens
agatgagtgggttagctacctg

SEQ ID NO: 5187082 - DNA, 17 bp, Homo sapiens
agatgagtgtgtgttct

SEQ ID NO: 5187083 - DNA, 22 bp, Homo sapiens
agatgagttatctaagaataca

SEQ ID NO: 5187084 - DNA, 15 bp, Homo sapiens
agatgagttgcagtt

SEQ ID NO: 5187085 - DNA, 18 bp, Homo sapiens
agatgagttgcagttttt

SEQ ID NO: 5187086 - DNA, 15 bp, Homo sapiens
agatgagtttttcat

SEQ ID NO: 5187087 - DNA, 20 bp, Homo sapiens
agatgataaaagagaagcca

SEQ ID NO: 5187088 - DNA, 15 bp, Homo sapiens
agatgataaaaggaa

SEQ ID NO: 5187089 - DNA, 18 bp, Homo sapiens
agatgataaaaggaatct

SEQ ID NO: 5187090 - DNA, 20 bp, Homo sapiens
agatgataaaaggaatctgg

SEQ ID NO: 5187091 - DNA, 14 bp, Homo sapiens
agatgataaagaga

SEQ ID NO: 5187092 - DNA, 16 bp, Homo sapiens
agatgataaagagaca

SEQ ID NO: 5187093 - DNA, 18 bp, Homo sapiens
agatgataaagagacagt

SEQ ID NO: 5187094 - DNA, 16 bp, Homo sapiens
agatgatacatccaaa

SEQ ID NO: 5187095 - DNA, 16 bp, Homo sapiens
agatgatattaagaac

SEQ ID NO: 5187096 - DNA, 14 bp, Homo sapiens
agatgatcaacata

SEQ ID NO: 5187097 - DNA, 13 bp, Homo sapiens
agatgatccatga

SEQ ID NO: 5187098 - DNA, 14 bp, Homo sapiens
agatgatccatttg

SEQ ID NO: 5187099 - DNA, 19 bp, Homo sapiens
agatgatcccagtcactcc

SEQ ID NO: 5187100 - DNA, 18 bp, Homo sapiens
agatgatgaaaatattta

SEQ ID NO: 5187101 - DNA, 18 bp, Homo sapiens
agatgatgagaatttcta

SEQ ID NO: 5187102 - DNA, 12 bp, Homo sapiens
agatgatgatga

SEQ ID NO: 5187103 - DNA, 14 bp, Homo sapiens
agatgatgatgatg

SEQ ID NO: 5187104 - DNA, 18 bp, Homo sapiens
agatgatgcatgatgccc

SEQ ID NO: 5187105 - DNA, 19 bp, Homo sapiens
agatgatgcatgatgccct

SEQ ID NO: 5187106 - DNA, 19 bp, Homo sapiens
agatgatgccagctgtctc

SEQ ID NO: 5187107 - DNA, 15 bp, Homo sapiens
agatgatgctcagtt

SEQ ID NO: 5187108 - DNA, 22 bp, Homo sapiens
agatgatgctttgagaacatac

SEQ ID NO: 5187109 - DNA, 16 bp, Homo sapiens
agatgatggaaacgca

SEQ ID NO: 5187110 - DNA, 21 bp, Homo sapiens
agatgatggggtcagcaggcc

SEQ ID NO: 5187111 - DNA, 23 bp, Homo sapiens
agatgatggggtcagcaggccca

SEQ ID NO: 5187112 - DNA, 12 bp, Homo sapiens
agatgatgtatt

SEQ ID NO: 5187113 - DNA, 15 bp, Homo sapiens
agatgatgttaaatg

SEQ ID NO: 5187114 - DNA, 14 bp, Homo sapiens
agatgattaaaatg

SEQ ID NO: 5187115 - DNA, 20 bp, Homo sapiens
agatgattaaataagattct

SEQ ID NO: 5187116 - DNA, 22 bp, Homo sapiens
agatgattaaataagattctaa

SEQ ID NO: 5187117 - DNA, 21 bp, Homo sapiens
agatgattatatattgttgtt

SEQ ID NO: 5187118 - DNA, 14 bp, Homo sapiens
agatgattcaaagt

SEQ ID NO: 5187119 - DNA, 15 bp, Homo sapiens
agatgattcaaatat

SEQ ID NO: 5187120 - DNA, 19 bp, Homo sapiens
agatgatttcagttcatca

SEQ ID NO: 5187121 - DNA, 18 bp, Homo sapiens
agatgatttcccccctcc

SEQ ID NO: 5187122 - DNA, 18 bp, Homo sapiens
agatgatttgtacttgga

SEQ ID NO: 5187123 - DNA, 21 bp, Homo sapiens
agatgatttgtacttggaagc

SEQ ID NO: 5187124 - DNA, 14 bp, Homo sapiens
agatgattttcctc

SEQ ID NO: 5187125 - DNA, 20 bp, Homo sapiens
agatgatttttaagtacaaa

SEQ ID NO: 5187126 - DNA, 15 bp, Homo sapiens
agatgattttttgaa

SEQ ID NO: 5187127 - DNA, 19 bp, Homo sapiens
agatgcaacctcactatgg

SEQ ID NO: 5187128 - DNA, 17 bp, Homo sapiens
agatgcaaggaccagga

SEQ ID NO: 5187129 - DNA, 18 bp, Homo sapiens
agatgcaagttattttat

SEQ ID NO: 5187130 - DNA, 13 bp, Homo sapiens
agatgcaatcaga

SEQ ID NO: 5187131 - DNA, 21 bp, Homo sapiens
agccacaggactgagccctct

SEQ ID NO: 5187132 - DNA, 23 bp, Homo sapiens
agccacaggactgagccctctca

SEQ ID NO: 5187133 - DNA, 11 bp, Homo sapiens
agccacaggag

SEQ ID NO: 5187134 - DNA, 14 bp, Homo sapiens
agccacaggagccc

SEQ ID NO: 5187135 - DNA, 15 bp, Homo sapiens
agccacaggagccct

SEQ ID NO: 5187136 - DNA, 18 bp, Homo sapiens
agccacaggagccctgct

SEQ ID NO: 5187137 - DNA, 22 bp, Homo sapiens
agccacaggcaggggtgagagc

SEQ ID NO: 5187138 - DNA, 13 bp, Homo sapiens
agccacaggcctg

SEQ ID NO: 5187139 - DNA, 14 bp, Homo sapiens
agccacaggcctga

SEQ ID NO: 5187140 - DNA, 16 bp, Homo sapiens
agccacaggcctgaga

SEQ ID NO: 5187141 - DNA, 17 bp, Homo sapiens
agccacaggcctgagat

SEQ ID NO: 5187142 - DNA, 21 bp, Homo sapiens
agccacaggcctgagatttca

SEQ ID NO: 5187143 - DNA, 17 bp, Homo sapiens
agccacagggtctgcct

SEQ ID NO: 5187144 - DNA, 18 bp, Homo sapiens
agccacagggtctgcctc

SEQ ID NO: 5187145 - DNA, 15 bp, Homo sapiens
agccacagtacatat

SEQ ID NO: 5187146 - DNA, 16 bp, Homo sapiens
agccacagtcactgga

SEQ ID NO: 5187147 - DNA, 13 bp, Homo sapiens
agccacagtggga

SEQ ID NO: 5187148 - DNA, 23 bp, Homo sapiens
agccacagttctaagacccaaag

SEQ ID NO: 5187149 - DNA, 22 bp, Homo sapiens
agccacagtttcctcatctgtc

SEQ ID NO: 5187150 - DNA, 14 bp, Homo sapiens
agccacataaccag

SEQ ID NO: 5187151 - DNA, 14 bp, Homo sapiens
agccacatacttta

SEQ ID NO: 5187152 - DNA, 14 bp, Homo sapiens
agccacatccccaa

SEQ ID NO: 5187153 - DNA, 17 bp, Homo sapiens
agccacatccccaagcc

SEQ ID NO: 5187154 - DNA, 13 bp, Homo sapiens
agccacatcttgc

SEQ ID NO: 5187155 - DNA, 14 bp, Homo sapiens
agccacatgcccca

SEQ ID NO: 5187156 - DNA, 20 bp, Homo sapiens
agccacatgccccaggctct

SEQ ID NO: 5187157 - DNA, 15 bp, Homo sapiens
agccacatggcccca

SEQ ID NO: 5187158 - DNA, 22 bp, Homo sapiens
agccacattgagactttcttct

SEQ ID NO: 5187159 - DNA, 15 bp, Homo sapiens
agccacatttggaat

SEQ ID NO: 5187160 - DNA, 23 bp, Homo sapiens
agccacatttggaatactttttg

SEQ ID NO: 5187161 - DNA, 21 bp, Homo sapiens
agccaccaaagtcacatccac

SEQ ID NO: 5187162 - DNA, 20 bp, Homo sapiens
agccaccaacatactcccat

SEQ ID NO: 5187163 - DNA, 17 bp, Homo sapiens
agccaccaactcttgca

SEQ ID NO: 5187164 - DNA, 23 bp, Homo sapiens
agccaccaaggctgcctgcccca

SEQ ID NO: 5187165 - DNA, 19 bp, Homo sapiens
agccaccacacccagcctc

SEQ ID NO: 5187166 - DNA, 20 bp, Homo sapiens
agccaccaccctcaggtgcc

SEQ ID NO: 5187167 - DNA, 21 bp, Homo sapiens
agccaccaccggggcactggc

SEQ ID NO: 5187168 - DNA, 16 bp, Homo sapiens
agccaccacgccctgc

SEQ ID NO: 5187169 - DNA, 20 bp, Homo sapiens
agccaccagacttggcctcc

SEQ ID NO: 5187170 - DNA, 18 bp, Homo sapiens
agccaccagggagtggcc

SEQ ID NO: 5187171 - DNA, 14 bp, Homo sapiens
agccaccagtgtcc

SEQ ID NO: 5187172 - DNA, 18 bp, Homo sapiens
agccaccatccccaccct

SEQ ID NO: 5187173 - DNA, 16 bp, Homo sapiens
agccaccatctttgca

SEQ ID NO: 5187174 - DNA, 22 bp, Homo sapiens
agccaccatgcttgcctgaagc

SEQ ID NO: 5187175 - DNA, 15 bp, Homo sapiens
agccacccaaagcag

SEQ ID NO: 5187176 - DNA, 18 bp, Homo sapiens
agccacccaaagcagtgg

SEQ ID NO: 5187177 - DNA, 17 bp, Homo sapiens
agccacccaagcctgct

SEQ ID NO: 5187178 - DNA, 15 bp, Homo sapiens
agccacccagccagg

SEQ ID NO: 5187179 - DNA, 19 bp, Homo sapiens
agccaccccatgagctcgg

SEQ ID NO: 5187180 - DNA, 14 bp, Homo sapiens
agccaccccctccc

SEQ ID NO: 5187181 - DNA, 21 bp, Homo sapiens
agccaccccgggctctctgct

SEQ ID NO: 5187182 - DNA, 13 bp, Homo sapiens
agccacccctgag

SEQ ID NO: 5187183 - DNA, 14 bp, Homo sapiens
agccacccctgcca

SEQ ID NO: 5187184 - DNA, 15 bp, Homo sapiens
agccacccctgccac

SEQ ID NO: 5187185 - DNA, 17 bp, Homo sapiens
agccacccctgccactc

SEQ ID NO: 5187186 - DNA, 20 bp, Homo sapiens
agccacccggatctccaggc

SEQ ID NO: 5187187 - DNA, 21 bp, Homo sapiens
agccacccggatctccaggcc

SEQ ID NO: 5187188 - DNA, 23 bp, Homo sapiens
agccacccgtggggtgctgccct

SEQ ID NO: 5187189 - DNA, 21 bp, Homo sapiens
agccaccctaactgagctgcc

SEQ ID NO: 5187190 - DNA, 16 bp, Homo sapiens
agccaccctaccatga

SEQ ID NO: 5187191 - DNA, 23 bp, Homo sapiens
agccaccctcaccgcggctggat

SEQ ID NO: 5187192 - DNA, 20 bp, Homo sapiens
agccaccctcccagctctga

SEQ ID NO: 5187193 - DNA, 12 bp, Homo sapiens
agccaccctgag

SEQ ID NO: 5187194 - DNA, 18 bp, Homo sapiens
agccaccctgaggagtct

SEQ ID NO: 5187195 - DNA, 20 bp, Homo sapiens
agccaccctgaggagtctga

SEQ ID NO: 5187196 - DNA, 19 bp, Homo sapiens
agccaccctgccatggagg

SEQ ID NO: 5187197 - DNA, 20 bp, Homo sapiens
agccaccctgcccagtctgg

SEQ ID NO: 5187198 - DNA, 13 bp, Homo sapiens
agccacccttccc

SEQ ID NO: 5187199 - DNA, 21 bp, Homo sapiens
agccacccttccctgcctcca

SEQ ID NO: 5187200 - DNA, 15 bp, Homo sapiens
agccacccttggtct

SEQ ID NO: 5187201 - DNA, 20 bp, Homo sapiens
agccaccgaagccgcctgtg

SEQ ID NO: 5187202 - DNA, 17 bp, Homo sapiens
agccaccgcagctgctg

SEQ ID NO: 5187203 - DNA, 23 bp, Homo sapiens
agccaccgcagctgctgccactc

SEQ ID NO: 5187204 - DNA, 15 bp, Homo sapiens
agccaccgcgcctgg

SEQ ID NO: 5187205 - DNA, 16 bp, Homo sapiens
agccaccgctgccagc

SEQ ID NO: 5187206 - DNA, 21 bp, Homo sapiens
agccaccgctgccagcacaga

SEQ ID NO: 5187207 - DNA, 21 bp, Homo sapiens
agccaccgtgcctggccagat

SEQ ID NO: 5187208 - DNA, 18 bp, Homo sapiens
agccacctccacccccaa

SEQ ID NO: 5187209 - DNA, 21 bp, Homo sapiens
agccacctcccaccccactcc

SEQ ID NO: 5187210 - DNA, 19 bp, Homo sapiens
agccacctccgccagaccc

SEQ ID NO: 5187211 - DNA, 21 bp, Homo sapiens
agccacctcggatcccactga

SEQ ID NO: 5187212 - DNA, 22 bp, Homo sapiens
agccacctctccctcaacaagg

SEQ ID NO: 5187213 - DNA, 23 bp, Homo sapiens
agccacctctgtcatttgttgtg

SEQ ID NO: 5187214 - DNA, 19 bp, Homo sapiens
agccacctgcaagatggac

SEQ ID NO: 5187215 - DNA, 14 bp, Homo sapiens
agccacctggcagg

SEQ ID NO: 5187216 - DNA, 14 bp, Homo sapiens
agccacctgggctg

SEQ ID NO: 5187217 - DNA, 18 bp, Homo sapiens
agccacctgtcccacctc

SEQ ID NO: 5187218 - DNA, 16 bp, Homo sapiens
agccaccttccagtga

SEQ ID NO: 5187219 - DNA, 17 bp, Homo sapiens
agccaccttcctgactg

SEQ ID NO: 5187220 - DNA, 22 bp, Homo sapiens
agccacgaacacgcatgcctca

SEQ ID NO: 5187221 - DNA, 14 bp, Homo sapiens
agccacgaccagcc

SEQ ID NO: 5187222 - DNA, 17 bp, Homo sapiens
agccacgaccagcccct

SEQ ID NO: 5187223 - DNA, 21 bp, Homo sapiens
agccacgaccagccccttcct

SEQ ID NO: 5187224 - DNA, 23 bp, Homo sapiens
agccacgaggtggtagctctgag

SEQ ID NO: 5187225 - DNA, 16 bp, Homo sapiens
agccacgcagggccat

SEQ ID NO: 5187226 - DNA, 14 bp, Homo sapiens
agccacgccctccc

SEQ ID NO: 5187227 - DNA, 20 bp, Homo sapiens
agccacgcctctctcagccc

SEQ ID NO: 5187228 - DNA, 19 bp, Homo sapiens
agccacgctggccttcgtc

SEQ ID NO: 5187229 - DNA, 23 bp, Homo sapiens
agccacgctgtcctctcgagccc

SEQ ID NO: 5187230 - DNA, 19 bp, Homo sapiens
agccacggaaacatagaaa

SEQ ID NO: 5187231 - DNA, 19 bp, Homo sapiens
agccacggacgctggctcc

SEQ ID NO: 5187232 - DNA, 14 bp, Homo sapiens
agccacggccaggc

SEQ ID NO: 5187233 - DNA, 15 bp, Homo sapiens
agccacggccaggcc

SEQ ID NO: 5187234 - DNA, 18 bp, Homo sapiens
agccacggccaggccaga

SEQ ID NO: 5187235 - DNA, 21 bp, Homo sapiens
agccacggccccgggtccagg

SEQ ID NO: 5187236 - DNA, 19 bp, Homo sapiens
agccacggggactcagccc

SEQ ID NO: 5187237 - DNA, 18 bp, Homo sapiens
agccacgggtgccagaag

SEQ ID NO: 5187238 - DNA, 17 bp, Homo sapiens
agccacgtgctggagag

SEQ ID NO: 5187239 - DNA, 20 bp, Homo sapiens
agccacgtgctggagagtag

SEQ ID NO: 5187240 - DNA, 17 bp, Homo sapiens
agccacgttccttactg

SEQ ID NO: 5187241 - DNA, 22 bp, Homo sapiens
agccacgttccttactgcagaa

SEQ ID NO: 5187242 - DNA, 16 bp, Homo sapiens
agccactaaaacacaa

SEQ ID NO: 5187243 - DNA, 15 bp, Homo sapiens
agccactaccttctg

SEQ ID NO: 5187244 - DNA, 20 bp, Homo sapiens
agccactccaagccccctgg

SEQ ID NO: 5187245 - DNA, 12 bp, Homo sapiens
agccactccagg

SEQ ID NO: 5187246 - DNA, 17 bp, Homo sapiens
agccactccccagccag

SEQ ID NO: 5187247 - DNA, 22 bp, Homo sapiens
agccactccccagccagcctgg

SEQ ID NO: 5187248 - DNA, 23 bp, Homo sapiens
agccactccccagccagcctggc

SEQ ID NO: 5187249 - DNA, 15 bp, Homo sapiens
agccactccctccca

SEQ ID NO: 5187250 - DNA, 12 bp, Homo sapiens
agccactcctca

SEQ ID NO: 5187251 - DNA, 22 bp, Homo sapiens
agccactcctctgactcagggc

SEQ ID NO: 5187252 - DNA, 14 bp, Homo sapiens
agccactcctgtcc

SEQ ID NO: 5187253 - DNA, 19 bp, Homo sapiens
agccactcctgtcccgcct

SEQ ID NO: 5187254 - DNA, 23 bp, Homo sapiens
agccactcctgtcccgccttcct

SEQ ID NO: 5187255 - DNA, 21 bp, Homo sapiens
agccactccttccttcaggac

SEQ ID NO: 5187256 - DNA, 22 bp, Homo sapiens
agccactccttccttcaggact

SEQ ID NO: 5187257 - DNA, 23 bp, Homo sapiens
agccactccttccttcaggactc

SEQ ID NO: 5187258 - DNA, 20 bp, Homo sapiens
agccactcgcagtcgcagga

SEQ ID NO: 5187259 - DNA, 16 bp, Homo sapiens
agccactctcttccct

SEQ ID NO: 5187260 - DNA, 17 bp, Homo sapiens
agccactctgtcccttc

SEQ ID NO: 5187261 - DNA, 13 bp, Homo sapiens
agccactctgttc

SEQ ID NO: 5187262 - DNA, 16 bp, Homo sapiens
agccactgcaccgggc

SEQ ID NO: 5187263 - DNA, 20 bp, Homo sapiens
agccactgcaccgggccaca

SEQ ID NO: 5187264 - DNA, 17 bp, Homo sapiens
agccactgcacctgacc

SEQ ID NO: 5187265 - DNA, 20 bp, Homo sapiens
agccactgcacctgcccagc

SEQ ID NO: 5187266 - DNA, 13 bp, Homo sapiens
agccactgcagca

SEQ ID NO: 5187267 - DNA, 14 bp, Homo sapiens
agccactgccaagc

SEQ ID NO: 5187268 - DNA, 15 bp, Homo sapiens
agccactgccaagct

SEQ ID NO: 5187269 - DNA, 21 bp, Homo sapiens
agccactgccaagcttcctgt

SEQ ID NO: 5187270 - DNA, 22 bp, Homo sapiens
agccactgccaagcttcctgtg

SEQ ID NO: 5187271 - DNA, 23 bp, Homo sapiens
agccactgccaagcttcctgtgc

SEQ ID NO: 5187272 - DNA, 16 bp, Homo sapiens
agccactgcctctccc

SEQ ID NO: 5187273 - DNA, 18 bp, Homo sapiens
agccactgcctctccctc

SEQ ID NO: 5187274 - DNA, 15 bp, Homo sapiens
agccactgcgcccag

SEQ ID NO: 5187275 - DNA, 17 bp, Homo sapiens
agccactgctggtgttt

SEQ ID NO: 5187276 - DNA, 19 bp, Homo sapiens
agccactgctggtgtttat

SEQ ID NO: 5187277 - DNA, 12 bp, Homo sapiens
agccactggaag

SEQ ID NO: 5187278 - DNA, 13 bp, Homo sapiens
agccactggaagg

SEQ ID NO: 5187279 - DNA, 14 bp, Homo sapiens
agccactggaagga

SEQ ID NO: 5187280 - DNA, 20 bp, Homo sapiens
agccactggaaggagcacat

SEQ ID NO: 5187281 - DNA, 23 bp, Homo sapiens
agccactggaaggagcacatact

SEQ ID NO: 5187282 - DNA, 16 bp, Homo sapiens
agccactgggcccctg

SEQ ID NO: 5187283 - DNA, 17 bp, Homo sapiens
agccactgggcccctgt

SEQ ID NO: 5187284 - DNA, 19 bp, Homo sapiens
agccactgggcccctgtcc

SEQ ID NO: 5187285 - DNA, 18 bp, Homo sapiens
agccactggtttctcaga

SEQ ID NO: 5187286 - DNA, 14 bp, Homo sapiens
agccactgtcaccg

SEQ ID NO: 5187287 - DNA, 13 bp, Homo sapiens
agccactgtgata

SEQ ID NO: 5187288 - DNA, 17 bp, Homo sapiens
agccactgtgcttggcc

SEQ ID NO: 5187289 - DNA, 18 bp, Homo sapiens
agccacttaccttcaata

SEQ ID NO: 5187290 - DNA, 14 bp, Homo sapiens
agccacttccccct

SEQ ID NO: 5187291 - DNA, 16 bp, Homo sapiens
agccacttccccctct

SEQ ID NO: 5187292 - DNA, 14 bp, Homo sapiens
agccacttggccca

SEQ ID NO: 5187293 - DNA, 17 bp, Homo sapiens
agccacttggcccagaa

SEQ ID NO: 5187294 - DNA, 21 bp, Homo sapiens
agccacttggcccagaaagct

SEQ ID NO: 5187295 - DNA, 21 bp, Homo sapiens
agccacttgtcttgaaaactg

SEQ ID NO: 5187296 - DNA, 15 bp, Homo sapiens
agccacttgtgagta

SEQ ID NO: 5187297 - DNA, 14 bp, Homo sapiens
agccactttcctct

SEQ ID NO: 5187298 - DNA, 13 bp, Homo sapiens
agccagaaaaaga

SEQ ID NO: 5187299 - DNA, 16 bp, Homo sapiens
agccagaaacgcagat

SEQ ID NO: 5187300 - DNA, 21 bp, Homo sapiens
agccagaaagcactacaatca

SEQ ID NO: 5187301 - DNA, 16 bp, Homo sapiens
agccagaaatgggcag

SEQ ID NO: 5187302 - DNA, 13 bp, Homo sapiens
agccagaaattga

SEQ ID NO: 5187303 - DNA, 16 bp, Homo sapiens
agccagaaccccgagc

SEQ ID NO: 5187304 - DNA, 20 bp, Homo sapiens
agccagaaccccgagcccta

SEQ ID NO: 5187305 - DNA, 22 bp, Homo sapiens
agccagaacttgaccctgagct

SEQ ID NO: 5187306 - DNA, 22 bp, Homo sapiens
agccagaagccacccaaagcag

SEQ ID NO: 5187307 - DNA, 14 bp, Homo sapiens
agccagaagctgag

SEQ ID NO: 5187308 - DNA, 19 bp, Homo sapiens
agatgcaatgtgctactga

SEQ ID NO: 5187309 - DNA, 23 bp, Homo sapiens
agatgcacacacaccgatgctga

SEQ ID NO: 5187310 - DNA, 19 bp, Homo sapiens
agatgcacacacagatgca

SEQ ID NO: 5187311 - DNA, 22 bp, Homo sapiens
agatgcacacacagatgcacac

SEQ ID NO: 5187312 - DNA, 19 bp, Homo sapiens
agatgcacatgttggagga

SEQ ID NO: 5187313 - DNA, 15 bp, Homo sapiens
agatgcaccagccct

SEQ ID NO: 5187314 - DNA, 19 bp, Homo sapiens
agatgcaccccaacattga

SEQ ID NO: 5187315 - DNA, 22 bp, Homo sapiens
agatgcacgtggggcccactgc

SEQ ID NO: 5187316 - DNA, 22 bp, Homo sapiens
agatgcactatatgtttacaca

SEQ ID NO: 5187317 - DNA, 19 bp, Homo sapiens
agatgcactttgctttaat

SEQ ID NO: 5187318 - DNA, 12 bp, Homo sapiens
agatgcagagag

SEQ ID NO: 5187319 - DNA, 14 bp, Homo sapiens
agatgcagagagcc

SEQ ID NO: 5187320 - DNA, 19 bp, Homo sapiens
agatgcagagagccatttt

SEQ ID NO: 5187321 - DNA, 14 bp, Homo sapiens
agatgcagcaaaat

SEQ ID NO: 5187322 - DNA, 14 bp, Homo sapiens
agatgcagctcttc

SEQ ID NO: 5187323 - DNA, 17 bp, Homo sapiens
agatgcagctcttcctg

SEQ ID NO: 5187324 - DNA, 16 bp, Homo sapiens
agatgcagctggatgg

SEQ ID NO: 5187325 - DNA, 16 bp, Homo sapiens
agatgcaggaggctca

SEQ ID NO: 5187326 - DNA, 13 bp, Homo sapiens
agatgcagggcag

SEQ ID NO: 5187327 - DNA, 17 bp, Homo sapiens
agatgcaggtgatgcca

SEQ ID NO: 5187328 - DNA, 20 bp, Homo sapiens
agatgcaggttggaaggggc

SEQ ID NO: 5187329 - DNA, 22 bp, Homo sapiens
agatgcaggtttgaccaggaaa

SEQ ID NO: 5187330 - DNA, 19 bp, Homo sapiens
agatgcagttctgaagaag

SEQ ID NO: 5187331 - DNA, 18 bp, Homo sapiens
agatgcagttttcaaatt

SEQ ID NO: 5187332 - DNA, 21 bp, Homo sapiens
agatgcatatagacacacata

SEQ ID NO: 5187333 - DNA, 20 bp, Homo sapiens
agatgcatcatctcttcctc

SEQ ID NO: 5187334 - DNA, 17 bp, Homo sapiens
agatgcatcgggaaaga

SEQ ID NO: 5187335 - DNA, 18 bp, Homo sapiens
agatgcatcgggaaagaa

SEQ ID NO: 5187336 - DNA, 19 bp, Homo sapiens
agatgcatcgggaaagaag

SEQ ID NO: 5187337 - DNA, 20 bp, Homo sapiens
agatgcatcgggaaagaaga

SEQ ID NO: 5187338 - DNA, 22 bp, Homo sapiens
agatgcatcgggaaagaagaaa

SEQ ID NO: 5187339 - DNA, 23 bp, Homo sapiens
agatgcatcgggaaagaagaaac

SEQ ID NO: 5187340 - DNA, 18 bp, Homo sapiens
agatgcatctgtggcctg

SEQ ID NO: 5187341 - DNA, 21 bp, Homo sapiens
agatgcatctgtggcctgggg

SEQ ID NO: 5187342 - DNA, 17 bp, Homo sapiens
agatgcatgttgaccat

SEQ ID NO: 5187343 - DNA, 16 bp, Homo sapiens
agatgcattgtagttt

SEQ ID NO: 5187344 - DNA, 14 bp, Homo sapiens
agatgcattttaaa

SEQ ID NO: 5187345 - DNA, 20 bp, Homo sapiens
agatgcattttgtgtacagt

SEQ ID NO: 5187346 - DNA, 11 bp, Homo sapiens
agatgccaagg

SEQ ID NO: 5187347 - DNA, 15 bp, Homo sapiens
agatgccaccctagc

SEQ ID NO: 5187348 - DNA, 13 bp, Homo sapiens
agatgccagagca

SEQ ID NO: 5187349 - DNA, 13 bp, Homo sapiens
agatgccagccct

SEQ ID NO: 5187350 - DNA, 17 bp, Homo sapiens
agatgccagcttctctc

SEQ ID NO: 5187351 - DNA, 17 bp, Homo sapiens
agatgccatagcataat

SEQ ID NO: 5187352 - DNA, 19 bp, Homo sapiens
agatgccatagcataatat

SEQ ID NO: 5187353 - DNA, 19 bp, Homo sapiens
agatgccatcctctttctc

SEQ ID NO: 5187354 - DNA, 17 bp, Homo sapiens
agatgccatggcctgtg

SEQ ID NO: 5187355 - DNA, 21 bp, Homo sapiens
agatgccatggcctgtgctgg

SEQ ID NO: 5187356 - DNA, 15 bp, Homo sapiens
agatgccattcatag

SEQ ID NO: 5187357 - DNA, 16 bp, Homo sapiens
agatgccattcataga

SEQ ID NO: 5187358 - DNA, 13 bp, Homo sapiens
agatgccattttg

SEQ ID NO: 5187359 - DNA, 18 bp, Homo sapiens
agatgccattttgtacat

SEQ ID NO: 5187360 - DNA, 22 bp, Homo sapiens
agatgccattttgtacatgtat

SEQ ID NO: 5187361 - DNA, 14 bp, Homo sapiens
agatgccccaaagt

SEQ ID NO: 5187362 - DNA, 16 bp, Homo sapiens
agatgccccagggatg

SEQ ID NO: 5187363 - DNA, 15 bp, Homo sapiens
agatgccccattcct

SEQ ID NO: 5187364 - DNA, 18 bp, Homo sapiens
agatgcccgagggagggg

SEQ ID NO: 5187365 - DNA, 19 bp, Homo sapiens
agatgcccgagggagggga

SEQ ID NO: 5187366 - DNA, 23 bp, Homo sapiens
agatgcccgcacagtaatgtaga

SEQ ID NO: 5187367 - DNA, 23 bp, Homo sapiens
agatgccctgttggtttcacaga

SEQ ID NO: 5187368 - DNA, 21 bp, Homo sapiens
agatgccctttggaaagccat

SEQ ID NO: 5187369 - DNA, 16 bp, Homo sapiens
agatgccgcatttgga

SEQ ID NO: 5187370 - DNA, 23 bp, Homo sapiens
agatgcctacaaccatccctgcc

SEQ ID NO: 5187371 - DNA, 17 bp, Homo sapiens
agatgcctacttttggc

SEQ ID NO: 5187372 - DNA, 21 bp, Homo sapiens
agatgcctccaccccccagaa

SEQ ID NO: 5187373 - DNA, 16 bp, Homo sapiens
agatgcctccaccgct

SEQ ID NO: 5187374 - DNA, 17 bp, Homo sapiens
agatgcctccccaagac

SEQ ID NO: 5187375 - DNA, 13 bp, Homo sapiens
agatgcctccctg

SEQ ID NO: 5187376 - DNA, 22 bp, Homo sapiens
agatgcctccctgaccctgcag

SEQ ID NO: 5187377 - DNA, 17 bp, Homo sapiens
agatgcctcctgtcaga

SEQ ID NO: 5187378 - DNA, 15 bp, Homo sapiens
agatgcctgaagcca

SEQ ID NO: 5187379 - DNA, 17 bp, Homo sapiens
agatgcctgatttcatt

SEQ ID NO: 5187380 - DNA, 16 bp, Homo sapiens
agatgcctgcttgata

SEQ ID NO: 5187381 - DNA, 12 bp, Homo sapiens
agatgcctgggc

SEQ ID NO: 5187382 - DNA, 16 bp, Homo sapiens
agatgcctgttaattt

SEQ ID NO: 5187383 - DNA, 21 bp, Homo sapiens
agatgccttcctgtctttctg

SEQ ID NO: 5187384 - DNA, 13 bp, Homo sapiens
agatgccttctag

SEQ ID NO: 5187385 - DNA, 22 bp, Homo sapiens
agatgcgcattctaacctggag

SEQ ID NO: 5187386 - DNA, 14 bp, Homo sapiens
agatgcggggacag

SEQ ID NO: 5187387 - DNA, 20 bp, Homo sapiens
agatgcgtcccaagatgttg

SEQ ID NO: 5187388 - DNA, 18 bp, Homo sapiens
agatgctaatagaaaact

SEQ ID NO: 5187389 - DNA, 21 bp, Homo sapiens
agatgctacttcccactgtat

SEQ ID NO: 5187390 - DNA, 21 bp, Homo sapiens
agatgctagaactccctttca

SEQ ID NO: 5187391 - DNA, 20 bp, Homo sapiens
agatgctagcgcgttgcctg

SEQ ID NO: 5187392 - DNA, 17 bp, Homo sapiens
agatgctaggctgtctg

SEQ ID NO: 5187393 - DNA, 19 bp, Homo sapiens
agatgctattaagaaggca

SEQ ID NO: 5187394 - DNA, 15 bp, Homo sapiens
agatgctcaaagttg

SEQ ID NO: 5187395 - DNA, 16 bp, Homo sapiens
agatgctcactttatt

SEQ ID NO: 5187396 - DNA, 19 bp, Homo sapiens
agatgctccaagattctag

SEQ ID NO: 5187397 - DNA, 23 bp, Homo sapiens
agatgctccaagattctagatga

SEQ ID NO: 5187398 - DNA, 15 bp, Homo sapiens
agatgctccttgggc

SEQ ID NO: 5187399 - DNA, 17 bp, Homo sapiens
agatgctctatcttgct

SEQ ID NO: 5187400 - DNA, 18 bp, Homo sapiens
agatgctctatcttgctc

SEQ ID NO: 5187401 - DNA, 21 bp, Homo sapiens
agatgctctatcttgctctgt

SEQ ID NO: 5187402 - DNA, 11 bp, Homo sapiens
agatgctctct

SEQ ID NO: 5187403 - DNA, 22 bp, Homo sapiens
agatgctctctgaggcaaggcc

SEQ ID NO: 5187404 - DNA, 13 bp, Homo sapiens
agatgctctttta

SEQ ID NO: 5187405 - DNA, 18 bp, Homo sapiens
agatgctgaatatctgtt

SEQ ID NO: 5187406 - DNA, 20 bp, Homo sapiens
agatgctgactgtactcctc

SEQ ID NO: 5187407 - DNA, 11 bp, Homo sapiens
agatgctgatg

SEQ ID NO: 5187408 - DNA, 19 bp, Homo sapiens
agatgctgctgagcacatc

SEQ ID NO: 5187409 - DNA, 16 bp, Homo sapiens
agatgctggagaagag

SEQ ID NO: 5187410 - DNA, 18 bp, Homo sapiens
agatgctggagaagagag

SEQ ID NO: 5187411 - DNA, 19 bp, Homo sapiens
agatgctggagaagagagg

SEQ ID NO: 5187412 - DNA, 19 bp, Homo sapiens
agatgctggcatctctgca

SEQ ID NO: 5187413 - DNA, 20 bp, Homo sapiens
agatgctggcatctctgcag

SEQ ID NO: 5187414 - DNA, 12 bp, Homo sapiens
agatgctggccc

SEQ ID NO: 5187415 - DNA, 14 bp, Homo sapiens
agatgctggcccag

SEQ ID NO: 5187416 - DNA, 19 bp, Homo sapiens
agatgctggcccagggccc

SEQ ID NO: 5187417 - DNA, 14 bp, Homo sapiens
agatgctggcctct

SEQ ID NO: 5187418 - DNA, 15 bp, Homo sapiens
agatgctggcctctt

SEQ ID NO: 5187419 - DNA, 18 bp, Homo sapiens
agatgctggcttgggcag

SEQ ID NO: 5187420 - DNA, 14 bp, Homo sapiens
agatgctgggaggg

SEQ ID NO: 5187421 - DNA, 16 bp, Homo sapiens
agatgctgggcccagg

SEQ ID NO: 5187422 - DNA, 17 bp, Homo sapiens
agatgctgggctgtctc

SEQ ID NO: 5187423 - DNA, 20 bp, Homo sapiens
agatgctgggctgtctctcc

SEQ ID NO: 5187424 - DNA, 19 bp, Homo sapiens
agatgctggtcatcctggg

SEQ ID NO: 5187425 - DNA, 21 bp, Homo sapiens
agatgctggtcatcctgggca

SEQ ID NO: 5187426 - DNA, 22 bp, Homo sapiens
agatgctggtcatcctgggcat

SEQ ID NO: 5187427 - DNA, 13 bp, Homo sapiens
agatgctggtgga

SEQ ID NO: 5187428 - DNA, 16 bp, Homo sapiens
agatgctggtggagga

SEQ ID NO: 5187429 - DNA, 15 bp, Homo sapiens
agatgctggttttct

SEQ ID NO: 5187430 - DNA, 18 bp, Homo sapiens
agatgctgtcactggcag

SEQ ID NO: 5187431 - DNA, 21 bp, Homo sapiens
agatgctgtcactggcagagc

SEQ ID NO: 5187432 - DNA, 23 bp, Homo sapiens
agatgctgtcactggcagagcac

SEQ ID NO: 5187433 - DNA, 23 bp, Homo sapiens
agatgctgtcattagtctatatg

SEQ ID NO: 5187434 - DNA, 20 bp, Homo sapiens
agatgctgtgcccctggcct

SEQ ID NO: 5187435 - DNA, 16 bp, Homo sapiens
agatgctgtgtatatg

SEQ ID NO: 5187436 - DNA, 19 bp, Homo sapiens
agatgctgtgtatatggta

SEQ ID NO: 5187437 - DNA, 13 bp, Homo sapiens
agatgcttaaaaa

SEQ ID NO: 5187438 - DNA, 23 bp, Homo sapiens
agatgcttcactttccttctctg

SEQ ID NO: 5187439 - DNA, 13 bp, Homo sapiens
agatgcttctctc

SEQ ID NO: 5187440 - DNA, 16 bp, Homo sapiens
agatgcttctctcctt

SEQ ID NO: 5187441 - DNA, 15 bp, Homo sapiens
agatgcttggagcaa

SEQ ID NO: 5187442 - DNA, 18 bp, Homo sapiens
agatgcttggagcaatca

SEQ ID NO: 5187443 - DNA, 17 bp, Homo sapiens
agatgctttaattgtgt

SEQ ID NO: 5187444 - DNA, 18 bp, Homo sapiens
agatgcttttaacagagt

SEQ ID NO: 5187445 - DNA, 15 bp, Homo sapiens
agatgcttttcaaac

SEQ ID NO: 5187446 - DNA, 14 bp, Homo sapiens
agatgcttttgtga

SEQ ID NO: 5187447 - DNA, 17 bp, Homo sapiens
agatgcttttgtgagaa

SEQ ID NO: 5187448 - DNA, 13 bp, Homo sapiens
agatggaaaaaaa

SEQ ID NO: 5187449 - DNA, 18 bp, Homo sapiens
agatggaaaaaaaaaaca

SEQ ID NO: 5187450 - DNA, 21 bp, Homo sapiens
agatggaaaaaaaaaacaaaa

SEQ ID NO: 5187451 - DNA, 16 bp, Homo sapiens
agatggaaaaatgtga

SEQ ID NO: 5187452 - DNA, 22 bp, Homo sapiens
agatggaaaattcattttttaa

SEQ ID NO: 5187453 - DNA, 18 bp, Homo sapiens
agatggaaacaatgtgga

SEQ ID NO: 5187454 - DNA, 23 bp, Homo sapiens
agatggaaagaggtgaaaatgaa

SEQ ID NO: 5187455 - DNA, 21 bp, Homo sapiens
agatggaagcttactctctgc

SEQ ID NO: 5187456 - DNA, 21 bp, Homo sapiens
agatggaaggccttttgcccg

SEQ ID NO: 5187457 - DNA, 23 bp, Homo sapiens
agatggaagttgcagtgagctga

SEQ ID NO: 5187458 - DNA, 21 bp, Homo sapiens
agatggaatatcaatgcccaa

SEQ ID NO: 5187459 - DNA, 13 bp, Homo sapiens
agatggaatgctg

SEQ ID NO: 5187460 - DNA, 19 bp, Homo sapiens
agatggacacgagccacaa

SEQ ID NO: 5187461 - DNA, 20 bp, Homo sapiens
agatggacactgccaagagc

SEQ ID NO: 5187462 - DNA, 16 bp, Homo sapiens
agatggacagagaact

SEQ ID NO: 5187463 - DNA, 23 bp, Homo sapiens
agatggacagttcacaccctgca

SEQ ID NO: 5187464 - DNA, 21 bp, Homo sapiens
agatggacagtttgtttcctg

SEQ ID NO: 5187465 - DNA, 20 bp, Homo sapiens
agatggacatggctcattgt

SEQ ID NO: 5187466 - DNA, 15 bp, Homo sapiens
agatggaccccagca

SEQ ID NO: 5187467 - DNA, 17 bp, Homo sapiens
agatggacccctccctt

SEQ ID NO: 5187468 - DNA, 18 bp, Homo sapiens
agatggacccctcccttg

SEQ ID NO: 5187469 - DNA, 17 bp, Homo sapiens
agatggacgcaggccct

SEQ ID NO: 5187470 - DNA, 16 bp, Homo sapiens
agatggactgggaaaa

SEQ ID NO: 5187471 - DNA, 17 bp, Homo sapiens
agatggactgggaggag

SEQ ID NO: 5187472 - DNA, 18 bp, Homo sapiens
agatggactgggaggagg

SEQ ID NO: 5187473 - DNA, 23 bp, Homo sapiens
agatggagaaacaggctctgaga

SEQ ID NO: 5187474 - DNA, 21 bp, Homo sapiens
agatggagaataaattattga

SEQ ID NO: 5187475 - DNA, 20 bp, Homo sapiens
agatggagacaccctctggg

SEQ ID NO: 5187476 - DNA, 13 bp, Homo sapiens
agatggagaggct

SEQ ID NO: 5187477 - DNA, 14 bp, Homo sapiens
agatggagaggctg

SEQ ID NO: 5187478 - DNA, 23 bp, Homo sapiens
agatggagcaggtctttgggaag

SEQ ID NO: 5187479 - DNA, 14 bp, Homo sapiens
agatggagcccata

SEQ ID NO: 5187480 - DNA, 16 bp, Homo sapiens
agatggaggaggaggc

SEQ ID NO: 5187481 - DNA, 18 bp, Homo sapiens
agatggagggcttggccc

SEQ ID NO: 5187482 - DNA, 17 bp, Homo sapiens
agatggagggggctggg

SEQ ID NO: 5187483 - DNA, 20 bp, Homo sapiens
agatggaggtagggctggct

SEQ ID NO: 5187484 - DNA, 17 bp, Homo sapiens
agatggaggttctcaga

SEQ ID NO: 5187485 - DNA, 15 bp, Homo sapiens
agccagaagctgagc

SEQ ID NO: 5187486 - DNA, 20 bp, Homo sapiens
agccagaagctgagcaccag

SEQ ID NO: 5187487 - DNA, 23 bp, Homo sapiens
agccagaaggggctgcttgcttt

SEQ ID NO: 5187488 - DNA, 22 bp, Homo sapiens
agccagaatcttcgtcctgccc

SEQ ID NO: 5187489 - DNA, 21 bp, Homo sapiens
agccagaatgtttcctgtgga

SEQ ID NO: 5187490 - DNA, 23 bp, Homo sapiens
agccagaattcactaggaggtca

SEQ ID NO: 5187491 - DNA, 12 bp, Homo sapiens
agccagaattct

SEQ ID NO: 5187492 - DNA, 13 bp, Homo sapiens
agccagacagacc

SEQ ID NO: 5187493 - DNA, 15 bp, Homo sapiens
agccagacagaccct

SEQ ID NO: 5187494 - DNA, 20 bp, Homo sapiens
agccagacagccccaagctt

SEQ ID NO: 5187495 - DNA, 22 bp, Homo sapiens
agccagacagccccaagcttct

SEQ ID NO: 5187496 - DNA, 22 bp, Homo sapiens
agccagacccagagccctctga

SEQ ID NO: 5187497 - DNA, 23 bp, Homo sapiens
agccagacgccatttaaaagtct

SEQ ID NO: 5187498 - DNA, 16 bp, Homo sapiens
agccagactctgtctc

SEQ ID NO: 5187499 - DNA, 19 bp, Homo sapiens
agccagactggcacagttt

SEQ ID NO: 5187500 - DNA, 16 bp, Homo sapiens
agccagactgtccagg

SEQ ID NO: 5187501 - DNA, 17 bp, Homo sapiens
agccagactgtccaggg

SEQ ID NO: 5187502 - DNA, 19 bp, Homo sapiens
agccagactgtccagggaa

SEQ ID NO: 5187503 - DNA, 14 bp, Homo sapiens
agccagagaagtga

SEQ ID NO: 5187504 - DNA, 16 bp, Homo sapiens
agccagagaagtgaca

SEQ ID NO: 5187505 - DNA, 19 bp, Homo sapiens
agccagagaagtgacaggg

SEQ ID NO: 5187506 - DNA, 16 bp, Homo sapiens
agccagagatgcaata

SEQ ID NO: 5187507 - DNA, 12 bp, Homo sapiens
agccagagcccc

SEQ ID NO: 5187508 - DNA, 13 bp, Homo sapiens
agccagagcccca

SEQ ID NO: 5187509 - DNA, 23 bp, Homo sapiens
agccagagcccttcactgccatg

SEQ ID NO: 5187510 - DNA, 22 bp, Homo sapiens
agccagagccgcaccctggctg

SEQ ID NO: 5187511 - DNA, 23 bp, Homo sapiens
agccagagccgcaccctggctgg

SEQ ID NO: 5187512 - DNA, 12 bp, Homo sapiens
agccagagcctg

SEQ ID NO: 5187513 - DNA, 13 bp, Homo sapiens
agccagagcctgg

SEQ ID NO: 5187514 - DNA, 20 bp, Homo sapiens
agccagagcctgtctttcag

SEQ ID NO: 5187515 - DNA, 23 bp, Homo sapiens
agccagagcgttagaggggccag

SEQ ID NO: 5187516 - DNA, 15 bp, Homo sapiens
agccagagctgtgcc

SEQ ID NO: 5187517 - DNA, 16 bp, Homo sapiens
agccagagctgtgcct

SEQ ID NO: 5187518 - DNA, 23 bp, Homo sapiens
agccagagctgtgcctgctcagc

SEQ ID NO: 5187519 - DNA, 13 bp, Homo sapiens
agccagaggactg

SEQ ID NO: 5187520 - DNA, 13 bp, Homo sapiens
agccagaggagag

SEQ ID NO: 5187521 - DNA, 18 bp, Homo sapiens
agccagaggagagaggac

SEQ ID NO: 5187522 - DNA, 22 bp, Homo sapiens
agccagaggagggcagagggag

SEQ ID NO: 5187523 - DNA, 10 bp, Homo sapiens
agccagaggc

SEQ ID NO: 5187524 - DNA, 16 bp, Homo sapiens
agccagaggccaggat

SEQ ID NO: 5187525 - DNA, 18 bp, Homo sapiens
agccagaggccaggatgc

SEQ ID NO: 5187526 - DNA, 19 bp, Homo sapiens
agccagagggtgggagcct

SEQ ID NO: 5187527 - DNA, 12 bp, Homo sapiens
agccagagtcaa

SEQ ID NO: 5187528 - DNA, 12 bp, Homo sapiens
agccagagtgta

SEQ ID NO: 5187529 - DNA, 23 bp, Homo sapiens
agccagatccccagggcagcctc

SEQ ID NO: 5187530 - DNA, 20 bp, Homo sapiens
agccagatctcgggactcag

SEQ ID NO: 5187531 - DNA, 16 bp, Homo sapiens
agccagatgcaggaca

SEQ ID NO: 5187532 - DNA, 15 bp, Homo sapiens
agccagatgcctccc

SEQ ID NO: 5187533 - DNA, 12 bp, Homo sapiens
agccagatgcta

SEQ ID NO: 5187534 - DNA, 22 bp, Homo sapiens
agccagatgctaggctgtctgc

SEQ ID NO: 5187535 - DNA, 16 bp, Homo sapiens
agccagattaggcctg

SEQ ID NO: 5187536 - DNA, 20 bp, Homo sapiens
agccagattaggcctggagt

SEQ ID NO: 5187537 - DNA, 16 bp, Homo sapiens
agccagattctcttga

SEQ ID NO: 5187538 - DNA, 17 bp, Homo sapiens
agccagattctcttgaa

SEQ ID NO: 5187539 - DNA, 22 bp, Homo sapiens
agccagatttcactctccttgg

SEQ ID NO: 5187540 - DNA, 17 bp, Homo sapiens
agccagcaaagcctcca

SEQ ID NO: 5187541 - DNA, 19 bp, Homo sapiens
agccagcaaagcctccagc

SEQ ID NO: 5187542 - DNA, 23 bp, Homo sapiens
agccagcaatgatgtccagaaga

SEQ ID NO: 5187543 - DNA, 17 bp, Homo sapiens
agccagcacaaaaggca

SEQ ID NO: 5187544 - DNA, 17 bp, Homo sapiens
agccagcacacagggca

SEQ ID NO: 5187545 - DNA, 13 bp, Homo sapiens
agccagcaccacc

SEQ ID NO: 5187546 - DNA, 14 bp, Homo sapiens
agccagcacctggc

SEQ ID NO: 5187547 - DNA, 22 bp, Homo sapiens
agccagcagagggggagtagcc

SEQ ID NO: 5187548 - DNA, 14 bp, Homo sapiens
agccagcagaggtc

SEQ ID NO: 5187549 - DNA, 18 bp, Homo sapiens
agccagcagcagcccaag

SEQ ID NO: 5187550 - DNA, 21 bp, Homo sapiens
agccagcagcagcccaagctt

SEQ ID NO: 5187551 - DNA, 13 bp, Homo sapiens
agccagcagcagg

SEQ ID NO: 5187552 - DNA, 14 bp, Homo sapiens
agccagcagcagga

SEQ ID NO: 5187553 - DNA, 11 bp, Homo sapiens
agccagcagct

SEQ ID NO: 5187554 - DNA, 20 bp, Homo sapiens
agccagcaggctctcaggcc

SEQ ID NO: 5187555 - DNA, 11 bp, Homo sapiens
agccagcaggg

SEQ ID NO: 5187556 - DNA, 11 bp, Homo sapiens
agccagcaggt

SEQ ID NO: 5187557 - DNA, 22 bp, Homo sapiens
agccagcaggttctctcctgtg

SEQ ID NO: 5187558 - DNA, 15 bp, Homo sapiens
agccagcagttcaga

SEQ ID NO: 5187559 - DNA, 19 bp, Homo sapiens
agccagcagttcagagctg

SEQ ID NO: 5187560 - DNA, 19 bp, Homo sapiens
agccagcattcagcacaca

SEQ ID NO: 5187561 - DNA, 22 bp, Homo sapiens
agccagccaaacacacagaagg

SEQ ID NO: 5187562 - DNA, 23 bp, Homo sapiens
agccagccaaacacacagaaggg

SEQ ID NO: 5187563 - DNA, 19 bp, Homo sapiens
agccagccaagctttaaat

SEQ ID NO: 5187564 - DNA, 14 bp, Homo sapiens
agccagccacccct

SEQ ID NO: 5187565 - DNA, 16 bp, Homo sapiens
agccagccacccctgc

SEQ ID NO: 5187566 - DNA, 23 bp, Homo sapiens
agccagccaccctaactgagctg

SEQ ID NO: 5187567 - DNA, 14 bp, Homo sapiens
agccagccaggaag

SEQ ID NO: 5187568 - DNA, 17 bp, Homo sapiens
agccagccatcggaaga

SEQ ID NO: 5187569 - DNA, 20 bp, Homo sapiens
agccagccatcggaagagag

SEQ ID NO: 5187570 - DNA, 22 bp, Homo sapiens
agccagccatcggaagagaggg

SEQ ID NO: 5187571 - DNA, 19 bp, Homo sapiens
agccagcccaaaccttggg

SEQ ID NO: 5187572 - DNA, 20 bp, Homo sapiens
agccagcccaagtagagggg

SEQ ID NO: 5187573 - DNA, 14 bp, Homo sapiens
agccagcccacatc

SEQ ID NO: 5187574 - DNA, 14 bp, Homo sapiens
agccagcccagctc

SEQ ID NO: 5187575 - DNA, 15 bp, Homo sapiens
agccagcccagctcc

SEQ ID NO: 5187576 - DNA, 16 bp, Homo sapiens
agccagcccagctcca

SEQ ID NO: 5187577 - DNA, 17 bp, Homo sapiens
agccagcccagctccac

SEQ ID NO: 5187578 - DNA, 21 bp, Homo sapiens
agccagcccagctccactcag

SEQ ID NO: 5187579 - DNA, 21 bp, Homo sapiens
agccagccccctccagctcat

SEQ ID NO: 5187580 - DNA, 18 bp, Homo sapiens
agccagccctccctgtcc

SEQ ID NO: 5187581 - DNA, 22 bp, Homo sapiens
agccagccctcttctgacacta

SEQ ID NO: 5187582 - DNA, 14 bp, Homo sapiens
agccagccctgcct

SEQ ID NO: 5187583 - DNA, 15 bp, Homo sapiens
agccagccctgcctg

SEQ ID NO: 5187584 - DNA, 16 bp, Homo sapiens
agccagccctgcctgg

SEQ ID NO: 5187585 - DNA, 17 bp, Homo sapiens
agccagccctgcctgga

SEQ ID NO: 5187586 - DNA, 21 bp, Homo sapiens
agccagccctgcctggaggac

SEQ ID NO: 5187587 - DNA, 20 bp, Homo sapiens
agccagccctggaggctgga

SEQ ID NO: 5187588 - DNA, 16 bp, Homo sapiens
agccagccctggccca

SEQ ID NO: 5187589 - DNA, 15 bp, Homo sapiens
agccagcccttccca

SEQ ID NO: 5187590 - DNA, 17 bp, Homo sapiens
agccagcccttcccagg

SEQ ID NO: 5187591 - DNA, 19 bp, Homo sapiens
agccagcccttcccaggcc

SEQ ID NO: 5187592 - DNA, 20 bp, Homo sapiens
agccagcccttcccaggcca

SEQ ID NO: 5187593 - DNA, 17 bp, Homo sapiens
agccagcccttccctgg

SEQ ID NO: 5187594 - DNA, 22 bp, Homo sapiens
agccagccgccctgggctgtct

SEQ ID NO: 5187595 - DNA, 16 bp, Homo sapiens
agccagccggggcgag

SEQ ID NO: 5187596 - DNA, 19 bp, Homo sapiens
agccagccggggcgagtgg

SEQ ID NO: 5187597 - DNA, 17 bp, Homo sapiens
agccagccggtgcctgg

SEQ ID NO: 5187598 - DNA, 17 bp, Homo sapiens
agccagcctcagaaggc

SEQ ID NO: 5187599 - DNA, 22 bp, Homo sapiens
agccagcctcagaaggccccag

SEQ ID NO: 5187600 - DNA, 14 bp, Homo sapiens
agccagcctgacct

SEQ ID NO: 5187601 - DNA, 15 bp, Homo sapiens
agccagcctgacctt

SEQ ID NO: 5187602 - DNA, 23 bp, Homo sapiens
agccagcctgaccttccttcctg

SEQ ID NO: 5187603 - DNA, 11 bp, Homo sapiens
agccagcctgg

SEQ ID NO: 5187604 - DNA, 12 bp, Homo sapiens
agccagcctggc

SEQ ID NO: 5187605 - DNA, 16 bp, Homo sapiens
agccagcctggctctg

SEQ ID NO: 5187606 - DNA, 21 bp, Homo sapiens
agccagcctggctctgccccc

SEQ ID NO: 5187607 - DNA, 13 bp, Homo sapiens
agccagcctggga

SEQ ID NO: 5187608 - DNA, 15 bp, Homo sapiens
agccagcctgggact

SEQ ID NO: 5187609 - DNA, 23 bp, Homo sapiens
agccagcctgggactcccagtga

SEQ ID NO: 5187610 - DNA, 13 bp, Homo sapiens
agccagcctggtc

SEQ ID NO: 5187611 - DNA, 15 bp, Homo sapiens
agccagccttcccca

SEQ ID NO: 5187612 - DNA, 21 bp, Homo sapiens
agccagccttcttccatccca

SEQ ID NO: 5187613 - DNA, 22 bp, Homo sapiens
agccagcgcctccctccacccc

SEQ ID NO: 5187614 - DNA, 23 bp, Homo sapiens
agccagcgcctccctccacccca

SEQ ID NO: 5187615 - DNA, 14 bp, Homo sapiens
agccagcggctcca

SEQ ID NO: 5187616 - DNA, 22 bp, Homo sapiens
agccagcgggaatggcagctgc

SEQ ID NO: 5187617 - DNA, 21 bp, Homo sapiens
agccagcgtcctcctctgtga

SEQ ID NO: 5187618 - DNA, 23 bp, Homo sapiens
agccagcgtcctcctctgtgacc

SEQ ID NO: 5187619 - DNA, 20 bp, Homo sapiens
agccagcgtttattgtagta

SEQ ID NO: 5187620 - DNA, 23 bp, Homo sapiens
agccagctaaggggtggggctgc

SEQ ID NO: 5187621 - DNA, 15 bp, Homo sapiens
agccagctcacagtg

SEQ ID NO: 5187622 - DNA, 23 bp, Homo sapiens
agccagctcacagtgctgtgtgc

SEQ ID NO: 5187623 - DNA, 15 bp, Homo sapiens
agccagctccctcta

SEQ ID NO: 5187624 - DNA, 19 bp, Homo sapiens
agccagctccctctattta

SEQ ID NO: 5187625 - DNA, 23 bp, Homo sapiens
agccagctccctgaatctgacca

SEQ ID NO: 5187626 - DNA, 13 bp, Homo sapiens
agccagctcctgg

SEQ ID NO: 5187627 - DNA, 20 bp, Homo sapiens
agccagctcctgggcagctt

SEQ ID NO: 5187628 - DNA, 16 bp, Homo sapiens
agccagctcctttccc

SEQ ID NO: 5187629 - DNA, 14 bp, Homo sapiens
agccagctctaggc

SEQ ID NO: 5187630 - DNA, 11 bp, Homo sapiens
agccagctctc

SEQ ID NO: 5187631 - DNA, 13 bp, Homo sapiens
agccagctctcag

SEQ ID NO: 5187632 - DNA, 14 bp, Homo sapiens
agccagctctctct

SEQ ID NO: 5187633 - DNA, 17 bp, Homo sapiens
agccagctctgagcaga

SEQ ID NO: 5187634 - DNA, 17 bp, Homo sapiens
agccagctctgtcccag

SEQ ID NO: 5187635 - DNA, 11 bp, Homo sapiens
agccagctgca

SEQ ID NO: 5187636 - DNA, 16 bp, Homo sapiens
agccagctgcagggca

SEQ ID NO: 5187637 - DNA, 11 bp, Homo sapiens
agccagctgcc

SEQ ID NO: 5187638 - DNA, 14 bp, Homo sapiens
agccagctgcccac

SEQ ID NO: 5187639 - DNA, 16 bp, Homo sapiens
agccagctgcccacaa

SEQ ID NO: 5187640 - DNA, 13 bp, Homo sapiens
agccagcttaaac

SEQ ID NO: 5187641 - DNA, 22 bp, Homo sapiens
agccagcttaaacccatacaat

SEQ ID NO: 5187642 - DNA, 16 bp, Homo sapiens
agccagcttagcaact

SEQ ID NO: 5187643 - DNA, 14 bp, Homo sapiens
agccagcttcctgt

SEQ ID NO: 5187644 - DNA, 15 bp, Homo sapiens
agccagcttcctgtg

SEQ ID NO: 5187645 - DNA, 23 bp, Homo sapiens
agccagcttcctgtgcagaaggt

SEQ ID NO: 5187646 - DNA, 12 bp, Homo sapiens
agccagcttggt

SEQ ID NO: 5187647 - DNA, 14 bp, Homo sapiens
agccagcttggtgg

SEQ ID NO: 5187648 - DNA, 19 bp, Homo sapiens
agccagcttgtttacatgc

SEQ ID NO: 5187649 - DNA, 21 bp, Homo sapiens
agccagcttgtttacatgctt

SEQ ID NO: 5187650 - DNA, 22 bp, Homo sapiens
agccagctttccctgcctctca

SEQ ID NO: 5187651 - DNA, 15 bp, Homo sapiens
agccaggaaacatga

SEQ ID NO: 5187652 - DNA, 17 bp, Homo sapiens
agccaggaacagggacc

SEQ ID NO: 5187653 - DNA, 23 bp, Homo sapiens
agccaggaacagggaccagctcc

SEQ ID NO: 5187654 - DNA, 17 bp, Homo sapiens
agccaggaactggctcc

SEQ ID NO: 5187655 - DNA, 20 bp, Homo sapiens
agccaggaagatcccccaga

SEQ ID NO: 5187656 - DNA, 12 bp, Homo sapiens
agccaggacccg

SEQ ID NO: 5187657 - DNA, 11 bp, Homo sapiens
agccaggactc

SEQ ID NO: 5187658 - DNA, 12 bp, Homo sapiens
agccaggactcc

SEQ ID NO: 5187659 - DNA, 14 bp, Homo sapiens
agccaggactccca

SEQ ID NO: 5187660 - DNA, 17 bp, Homo sapiens
agccaggactcccagaa

SEQ ID NO: 5187661 - DNA, 19 bp, Homo sapiens
agccaggactcccagaacc

SEQ ID NO: 5187662 - DNA, 15 bp, Homo sapiens
agccaggagaagacc

SEQ ID NO: 5187663 - DNA, 15 bp, Homo sapiens
agccaggagaccctg

SEQ ID NO: 5187664 - DNA, 18 bp, Homo sapiens
agatggaggttctcagag

SEQ ID NO: 5187665 - DNA, 11 bp, Homo sapiens
agatggagtcc

SEQ ID NO: 5187666 - DNA, 15 bp, Homo sapiens
agatggagtctcgct

SEQ ID NO: 5187667 - DNA, 19 bp, Homo sapiens
agatggagtctcgctctgc

SEQ ID NO: 5187668 - DNA, 22 bp, Homo sapiens
agatggagtcttgctctgtcac

SEQ ID NO: 5187669 - DNA, 17 bp, Homo sapiens
agatggagttcttgtgc

SEQ ID NO: 5187670 - DNA, 19 bp, Homo sapiens
agatggagttcttgtgcca

SEQ ID NO: 5187671 - DNA, 16 bp, Homo sapiens
agatggagtttctaag

SEQ ID NO: 5187672 - DNA, 17 bp, Homo sapiens
agatggagtttctaagg

SEQ ID NO: 5187673 - DNA, 19 bp, Homo sapiens
agatggagtttctctcttg

SEQ ID NO: 5187674 - DNA, 19 bp, Homo sapiens
agatggataaactgagcct

SEQ ID NO: 5187675 - DNA, 19 bp, Homo sapiens
agatggatgaattatgata

SEQ ID NO: 5187676 - DNA, 15 bp, Homo sapiens
agatggatggacaga

SEQ ID NO: 5187677 - DNA, 15 bp, Homo sapiens
agatggatgtaaagt

SEQ ID NO: 5187678 - DNA, 14 bp, Homo sapiens
agatggatgtaatt

SEQ ID NO: 5187679 - DNA, 16 bp, Homo sapiens
agatggatgtagatac

SEQ ID NO: 5187680 - DNA, 14 bp, Homo sapiens
agatggatgtattt

SEQ ID NO: 5187681 - DNA, 22 bp, Homo sapiens
agatggatgtatttgtagccag

SEQ ID NO: 5187682 - DNA, 17 bp, Homo sapiens
agatggattctcagata

SEQ ID NO: 5187683 - DNA, 20 bp, Homo sapiens
agatggcaacattggacaga

SEQ ID NO: 5187684 - DNA, 22 bp, Homo sapiens
agatggcaactgtattaaagaa

SEQ ID NO: 5187685 - DNA, 16 bp, Homo sapiens
agatggcactgtccag

SEQ ID NO: 5187686 - DNA, 14 bp, Homo sapiens
agatggcactttga

SEQ ID NO: 5187687 - DNA, 17 bp, Homo sapiens
agatggcagcagtgaag

SEQ ID NO: 5187688 - DNA, 12 bp, Homo sapiens
agatggcagctt

SEQ ID NO: 5187689 - DNA, 14 bp, Homo sapiens
agatggcagtcact

SEQ ID NO: 5187690 - DNA, 19 bp, Homo sapiens
agatggcatcctgtgaagt

SEQ ID NO: 5187691 - DNA, 15 bp, Homo sapiens
agatggccatgctca

SEQ ID NO: 5187692 - DNA, 15 bp, Homo sapiens
agatggcccatcctg

SEQ ID NO: 5187693 - DNA, 18 bp, Homo sapiens
agatggcccccagctggt

SEQ ID NO: 5187694 - DNA, 15 bp, Homo sapiens
agatggccctctggt

SEQ ID NO: 5187695 - DNA, 22 bp, Homo sapiens
agatggcctcttactaatgtaa

SEQ ID NO: 5187696 - DNA, 23 bp, Homo sapiens
agatggcctttgcttatgaatat

SEQ ID NO: 5187697 - DNA, 13 bp, Homo sapiens
agatggcgatgtg

SEQ ID NO: 5187698 - DNA, 16 bp, Homo sapiens
agatggcgatgtgtta

SEQ ID NO: 5187699 - DNA, 17 bp, Homo sapiens
agatggcgatgtgttat

SEQ ID NO: 5187700 - DNA, 14 bp, Homo sapiens
agatggcgcacccg

SEQ ID NO: 5187701 - DNA, 16 bp, Homo sapiens
agatggcgcacccggc

SEQ ID NO: 5187702 - DNA, 21 bp, Homo sapiens
agatggcgcacccggcagccc

SEQ ID NO: 5187703 - DNA, 22 bp, Homo sapiens
agatggcgcacccggcagcccc

SEQ ID NO: 5187704 - DNA, 23 bp, Homo sapiens
agatggcgcacccggcagccccc

SEQ ID NO: 5187705 - DNA, 21 bp, Homo sapiens
agatggcggtgatcagcagag

SEQ ID NO: 5187706 - DNA, 22 bp, Homo sapiens
agatggcggtgatcagcagaga

SEQ ID NO: 5187707 - DNA, 13 bp, Homo sapiens
agatggctcccag

SEQ ID NO: 5187708 - DNA, 17 bp, Homo sapiens
agatggctccctgggct

SEQ ID NO: 5187709 - DNA, 21 bp, Homo sapiens
agatggctccctgggctggca

SEQ ID NO: 5187710 - DNA, 21 bp, Homo sapiens
agatggctgaggcaggagaac

SEQ ID NO: 5187711 - DNA, 14 bp, Homo sapiens
agatggctgctgcc

SEQ ID NO: 5187712 - DNA, 14 bp, Homo sapiens
agatggctgctgct

SEQ ID NO: 5187713 - DNA, 22 bp, Homo sapiens
agatggctgtgcctctgcctgt

SEQ ID NO: 5187714 - DNA, 23 bp, Homo sapiens
agatggctgtggcatttccaaac

SEQ ID NO: 5187715 - DNA, 18 bp, Homo sapiens
agatggcttcggagggcc

SEQ ID NO: 5187716 - DNA, 20 bp, Homo sapiens
agatggcttcggagggccgc

SEQ ID NO: 5187717 - DNA, 17 bp, Homo sapiens
agatggctttcagggca

SEQ ID NO: 5187718 - DNA, 15 bp, Homo sapiens
agatgggaagggctt

SEQ ID NO: 5187719 - DNA, 16 bp, Homo sapiens
agatgggaagggctta

SEQ ID NO: 5187720 - DNA, 21 bp, Homo sapiens
agatgggaaggttagaaaggc

SEQ ID NO: 5187721 - DNA, 14 bp, Homo sapiens
agatgggaatgaag

SEQ ID NO: 5187722 - DNA, 15 bp, Homo sapiens
agatgggaatgaagc

SEQ ID NO: 5187723 - DNA, 23 bp, Homo sapiens
agatgggaatgaagcttgtgtat

SEQ ID NO: 5187724 - DNA, 13 bp, Homo sapiens
agatgggaatgag

SEQ ID NO: 5187725 - DNA, 17 bp, Homo sapiens
agatgggaattgcacag

SEQ ID NO: 5187726 - DNA, 13 bp, Homo sapiens
agatgggacagca

SEQ ID NO: 5187727 - DNA, 21 bp, Homo sapiens
agatgggagaatcacttgaac

SEQ ID NO: 5187728 - DNA, 18 bp, Homo sapiens
agatgggagctcctctcc

SEQ ID NO: 5187729 - DNA, 20 bp, Homo sapiens
agatgggaggaaagagagca

SEQ ID NO: 5187730 - DNA, 13 bp, Homo sapiens
agatgggaggaga

SEQ ID NO: 5187731 - DNA, 21 bp, Homo sapiens
agatgggaggtggaagcagag

SEQ ID NO: 5187732 - DNA, 23 bp, Homo sapiens
agatgggcaaaccctggtgcttt

SEQ ID NO: 5187733 - DNA, 19 bp, Homo sapiens
agatgggcaaggcctttgg

SEQ ID NO: 5187734 - DNA, 19 bp, Homo sapiens
agatgggcacatgaggagg

SEQ ID NO: 5187735 - DNA, 21 bp, Homo sapiens
agatgggcatcttttgtatta

SEQ ID NO: 5187736 - DNA, 22 bp, Homo sapiens
agatgggcatggggtgggcctc

SEQ ID NO: 5187737 - DNA, 16 bp, Homo sapiens
agatgggccaggcaga

SEQ ID NO: 5187738 - DNA, 23 bp, Homo sapiens
agatgggccggcccccttcctgg

SEQ ID NO: 5187739 - DNA, 19 bp, Homo sapiens
agatgggcctgtatgagac

SEQ ID NO: 5187740 - DNA, 22 bp, Homo sapiens
agatgggcttcccaagggctgc

SEQ ID NO: 5187741 - DNA, 19 bp, Homo sapiens
agatggggagctctggagg

SEQ ID NO: 5187742 - DNA, 20 bp, Homo sapiens
agatggggataaaatgacta

SEQ ID NO: 5187743 - DNA, 12 bp, Homo sapiens
agatggggcacc

SEQ ID NO: 5187744 - DNA, 13 bp, Homo sapiens
agatggggcacca

SEQ ID NO: 5187745 - DNA, 15 bp, Homo sapiens
agatggggcctgggc

SEQ ID NO: 5187746 - DNA, 15 bp, Homo sapiens
agatggggcgggggt

SEQ ID NO: 5187747 - DNA, 15 bp, Homo sapiens
agatgggggaaagca

SEQ ID NO: 5187748 - DNA, 21 bp, Homo sapiens
agatgggggaaagcaaagcac

SEQ ID NO: 5187749 - DNA, 23 bp, Homo sapiens
agatgggggaaagcaaagcacag

SEQ ID NO: 5187750 - DNA, 24 bp, Homo sapiens
agatgggggaaagcaaagcacaga

SEQ ID NO: 5187751 - DNA, 18 bp, Homo sapiens
agatgggggcaagaagat

SEQ ID NO: 5187752 - DNA, 15 bp, Homo sapiens
agatgggggcctctt

SEQ ID NO: 5187753 - DNA, 17 bp, Homo sapiens
agatgggggctggaggg

SEQ ID NO: 5187754 - DNA, 18 bp, Homo sapiens
agatgggggcttcttcct

SEQ ID NO: 5187755 - DNA, 14 bp, Homo sapiens
agatggggtctgtg

SEQ ID NO: 5187756 - DNA, 18 bp, Homo sapiens
agatggggtctgtgactg

SEQ ID NO: 5187757 - DNA, 20 bp, Homo sapiens
agatggggtctgtgactgga

SEQ ID NO: 5187758 - DNA, 22 bp, Homo sapiens
agatggggtctgtgactggatc

SEQ ID NO: 5187759 - DNA, 15 bp, Homo sapiens
agatggggtttcacc

SEQ ID NO: 5187760 - DNA, 16 bp, Homo sapiens
agatggggtttcacca

SEQ ID NO: 5187761 - DNA, 16 bp, Homo sapiens
agatgggtccaggggt

SEQ ID NO: 5187762 - DNA, 19 bp, Homo sapiens
agatgggtgattatgaaat

SEQ ID NO: 5187763 - DNA, 12 bp, Homo sapiens
agatgggtgggg

SEQ ID NO: 5187764 - DNA, 15 bp, Homo sapiens
agatggtagagagag

SEQ ID NO: 5187765 - DNA, 21 bp, Homo sapiens
agatggtatgcagcatacaaa

SEQ ID NO: 5187766 - DNA, 23 bp, Homo sapiens
agatggtcacacagagatacgca

SEQ ID NO: 5187767 - DNA, 15 bp, Homo sapiens
agatggtcatccaga

SEQ ID NO: 5187768 - DNA, 16 bp, Homo sapiens
agatggtccatttgtt

SEQ ID NO: 5187769 - DNA, 18 bp, Homo sapiens
agatggtccatttgttcc

SEQ ID NO: 5187770 - DNA, 22 bp, Homo sapiens
agatggtccgtgcccaggccct

SEQ ID NO: 5187771 - DNA, 23 bp, Homo sapiens
agatggtccgtgcccaggccctt

SEQ ID NO: 5187772 - DNA, 20 bp, Homo sapiens
agatggtctgcatcagcttt

SEQ ID NO: 5187773 - DNA, 11 bp, Homo sapiens
agatggtgctg

SEQ ID NO: 5187774 - DNA, 20 bp, Homo sapiens
agatggtggcacattccttt

SEQ ID NO: 5187775 - DNA, 14 bp, Homo sapiens
agatggtggcagta

SEQ ID NO: 5187776 - DNA, 20 bp, Homo sapiens
agatggtggcattttgagaa

SEQ ID NO: 5187777 - DNA, 14 bp, Homo sapiens
agatggtggctgtg

SEQ ID NO: 5187778 - DNA, 20 bp, Homo sapiens
agatggtggctgtgtctctc

SEQ ID NO: 5187779 - DNA, 21 bp, Homo sapiens
agatggtgtgggtgtcctgcc

SEQ ID NO: 5187780 - DNA, 22 bp, Homo sapiens
agatggttaaaaaggccaaaga

SEQ ID NO: 5187781 - DNA, 15 bp, Homo sapiens
agatggttaaacatt

SEQ ID NO: 5187782 - DNA, 18 bp, Homo sapiens
agatggttaaacattttc

SEQ ID NO: 5187783 - DNA, 14 bp, Homo sapiens
agatggttacactg

SEQ ID NO: 5187784 - DNA, 16 bp, Homo sapiens
agatggttacactgtt

SEQ ID NO: 5187785 - DNA, 18 bp, Homo sapiens
agatggttacactgttag

SEQ ID NO: 5187786 - DNA, 22 bp, Homo sapiens
agatggttagtggggtaattct

SEQ ID NO: 5187787 - DNA, 14 bp, Homo sapiens
agatggttgccaag

SEQ ID NO: 5187788 - DNA, 16 bp, Homo sapiens
agatggttgtgtatgg

SEQ ID NO: 5187789 - DNA, 18 bp, Homo sapiens
agatggtttgagcctgag

SEQ ID NO: 5187790 - DNA, 22 bp, Homo sapiens
agatggttttgccctccctctc

SEQ ID NO: 5187791 - DNA, 17 bp, Homo sapiens
agatgtaaaaggtatta

SEQ ID NO: 5187792 - DNA, 16 bp, Homo sapiens
agatgtaaaatgagtt

SEQ ID NO: 5187793 - DNA, 12 bp, Homo sapiens
agatgtaaatcg

SEQ ID NO: 5187794 - DNA, 20 bp, Homo sapiens
agatgtaaatcgggaaggat

SEQ ID NO: 5187795 - DNA, 17 bp, Homo sapiens
agatgtaaatgatgtgt

SEQ ID NO: 5187796 - DNA, 23 bp, Homo sapiens
agatgtaagaagcccgatccaca

SEQ ID NO: 5187797 - DNA, 21 bp, Homo sapiens
agatgtaagagctttacaaaa

SEQ ID NO: 5187798 - DNA, 14 bp, Homo sapiens
agatgtaaggaatt

SEQ ID NO: 5187799 - DNA, 15 bp, Homo sapiens
agatgtaatacacca

SEQ ID NO: 5187800 - DNA, 19 bp, Homo sapiens
agatgtaatgacagagagt

SEQ ID NO: 5187801 - DNA, 14 bp, Homo sapiens
agatgtaatgtttt

SEQ ID NO: 5187802 - DNA, 17 bp, Homo sapiens
agatgtaatgttttctt

SEQ ID NO: 5187803 - DNA, 14 bp, Homo sapiens
agatgtacacccac

SEQ ID NO: 5187804 - DNA, 17 bp, Homo sapiens
agatgtacttctctgtg

SEQ ID NO: 5187805 - DNA, 14 bp, Homo sapiens
agatgtagaggaga

SEQ ID NO: 5187806 - DNA, 19 bp, Homo sapiens
agatgtagaggagaaactg

SEQ ID NO: 5187807 - DNA, 17 bp, Homo sapiens
agatgtagagtttttaa

SEQ ID NO: 5187808 - DNA, 20 bp, Homo sapiens
agatgtaggggaagagatgt

SEQ ID NO: 5187809 - DNA, 14 bp, Homo sapiens
agatgtagtatttt

SEQ ID NO: 5187810 - DNA, 15 bp, Homo sapiens
agatgtatatttgca

SEQ ID NO: 5187811 - DNA, 17 bp, Homo sapiens
agatgtatgaaggcttt

SEQ ID NO: 5187812 - DNA, 20 bp, Homo sapiens
agatgtattaacctacctgt

SEQ ID NO: 5187813 - DNA, 21 bp, Homo sapiens
agatgtattaacctacctgtg

SEQ ID NO: 5187814 - DNA, 16 bp, Homo sapiens
agatgtattcagagcc

SEQ ID NO: 5187815 - DNA, 14 bp, Homo sapiens
agatgtattcttta

SEQ ID NO: 5187816 - DNA, 17 bp, Homo sapiens
agatgtattgactgtac

SEQ ID NO: 5187817 - DNA, 15 bp, Homo sapiens
agatgtattttcaat

SEQ ID NO: 5187818 - DNA, 21 bp, Homo sapiens
agatgtattttcaataaagaa

SEQ ID NO: 5187819 - DNA, 21 bp, Homo sapiens
agatgtatttttgatgtatat

SEQ ID NO: 5187820 - DNA, 22 bp, Homo sapiens
agatgtatttttgatgtatata

SEQ ID NO: 5187821 - DNA, 23 bp, Homo sapiens
agatgtatttttgatgtatatat

SEQ ID NO: 5187822 - DNA, 15 bp, Homo sapiens
agatgtcaaatatct

SEQ ID NO: 5187823 - DNA, 18 bp, Homo sapiens
agatgtcaaatatctcag

SEQ ID NO: 5187824 - DNA, 15 bp, Homo sapiens
agatgtcaagctggc

SEQ ID NO: 5187825 - DNA, 20 bp, Homo sapiens
agatgtcaagctggccgtgg

SEQ ID NO: 5187826 - DNA, 18 bp, Homo sapiens
agatgtcagcttcccagc

SEQ ID NO: 5187827 - DNA, 17 bp, Homo sapiens
agatgtcagtctgtcca

SEQ ID NO: 5187828 - DNA, 23 bp, Homo sapiens
agatgtcatttagttcagcatcc

SEQ ID NO: 5187829 - DNA, 23 bp, Homo sapiens
agatgtccatcagatgacaagaa

SEQ ID NO: 5187830 - DNA, 19 bp, Homo sapiens
agatgtcccacagggacca

SEQ ID NO: 5187831 - DNA, 20 bp, Homo sapiens
agatgtcccacagggaccac

SEQ ID NO: 5187832 - DNA, 21 bp, Homo sapiens
agatgtcccacagggaccaca

SEQ ID NO: 5187833 - DNA, 17 bp, Homo sapiens
agatgtcccccactgct

SEQ ID NO: 5187834 - DNA, 22 bp, Homo sapiens
agatgtcccccaggggcccagg

SEQ ID NO: 5187835 - DNA, 23 bp, Homo sapiens
agatgtcccccaggggcccaggc

SEQ ID NO: 5187836 - DNA, 18 bp, Homo sapiens
agatgtccctgaagtctt

SEQ ID NO: 5187837 - DNA, 21 bp, Homo sapiens
agatgtccctgaagtcttgca

SEQ ID NO: 5187838 - DNA, 12 bp, Homo sapiens
agatgtcccttg

SEQ ID NO: 5187839 - DNA, 20 bp, Homo sapiens
agatgtccctttcttggcca

SEQ ID NO: 5187840 - DNA, 14 bp, Homo sapiens
agatgtccgtctct

SEQ ID NO: 5187841 - DNA, 17 bp, Homo sapiens
agccaggagaccctgtc

SEQ ID NO: 5187842 - DNA, 17 bp, Homo sapiens
agccaggagcagccctg

SEQ ID NO: 5187843 - DNA, 18 bp, Homo sapiens
agccaggagcagccctgg

SEQ ID NO: 5187844 - DNA, 16 bp, Homo sapiens
agccaggagcctcctg

SEQ ID NO: 5187845 - DNA, 18 bp, Homo sapiens
agccaggagcctcctgac

SEQ ID NO: 5187846 - DNA, 20 bp, Homo sapiens
agccaggagtaagacaagtg

SEQ ID NO: 5187847 - DNA, 18 bp, Homo sapiens
agccaggagtctgtgctc

SEQ ID NO: 5187848 - DNA, 21 bp, Homo sapiens
agccaggagtctgtgctcttt

SEQ ID NO: 5187849 - DNA, 21 bp, Homo sapiens
agccaggagttgacgcatcct

SEQ ID NO: 5187850 - DNA, 15 bp, Homo sapiens
agccaggatcatggt

SEQ ID NO: 5187851 - DNA, 22 bp, Homo sapiens
agccaggatcatggtgtaataa

SEQ ID NO: 5187852 - DNA, 16 bp, Homo sapiens
agccaggcaagaaagc

SEQ ID NO: 5187853 - DNA, 21 bp, Homo sapiens
agccaggcaagaaagcttcct

SEQ ID NO: 5187854 - DNA, 11 bp, Homo sapiens
agccaggcaca

SEQ ID NO: 5187855 - DNA, 11 bp, Homo sapiens
agccaggcaga

SEQ ID NO: 5187856 - DNA, 21 bp, Homo sapiens
agccaggcaggtagccagggg

SEQ ID NO: 5187857 - DNA, 14 bp, Homo sapiens
agccaggccacaag

SEQ ID NO: 5187858 - DNA, 14 bp, Homo sapiens
agccaggcccagcc

SEQ ID NO: 5187859 - DNA, 13 bp, Homo sapiens
agccaggcccagg

SEQ ID NO: 5187860 - DNA, 14 bp, Homo sapiens
agccaggcccaggc

SEQ ID NO: 5187861 - DNA, 17 bp, Homo sapiens
agccaggcccaggccag

SEQ ID NO: 5187862 - DNA, 21 bp, Homo sapiens
agccaggcccaggccagcccc

SEQ ID NO: 5187863 - DNA, 16 bp, Homo sapiens
agccaggccccacccc

SEQ ID NO: 5187864 - DNA, 21 bp, Homo sapiens
agccaggccccaccccttccc

SEQ ID NO: 5187865 - DNA, 22 bp, Homo sapiens
agccaggccccaccccttccct

SEQ ID NO: 5187866 - DNA, 14 bp, Homo sapiens
agccaggcctcccg

SEQ ID NO: 5187867 - DNA, 15 bp, Homo sapiens
agccaggcctcccgc

SEQ ID NO: 5187868 - DNA, 21 bp, Homo sapiens
agccaggcctcccgcatgctg

SEQ ID NO: 5187869 - DNA, 12 bp, Homo sapiens
agccaggcctcg

SEQ ID NO: 5187870 - DNA, 17 bp, Homo sapiens
agccaggcctcgcctgc

SEQ ID NO: 5187871 - DNA, 11 bp, Homo sapiens
agccaggctat

SEQ ID NO: 5187872 - DNA, 18 bp, Homo sapiens
agccaggctcactcacag

SEQ ID NO: 5187873 - DNA, 14 bp, Homo sapiens
agccaggctcagga

SEQ ID NO: 5187874 - DNA, 16 bp, Homo sapiens
agccaggctcaggaga

SEQ ID NO: 5187875 - DNA, 20 bp, Homo sapiens
agccaggctcaggagaagcc

SEQ ID NO: 5187876 - DNA, 21 bp, Homo sapiens
agccaggctcaggagaagcca

SEQ ID NO: 5187877 - DNA, 18 bp, Homo sapiens
agccaggctcaggccatg

SEQ ID NO: 5187878 - DNA, 11 bp, Homo sapiens
agccaggctcc

SEQ ID NO: 5187879 - DNA, 23 bp, Homo sapiens
agccaggctcctacctgtctgct

SEQ ID NO: 5187880 - DNA, 20 bp, Homo sapiens
agccaggctctccgggcctt

SEQ ID NO: 5187881 - DNA, 14 bp, Homo sapiens
agccaggctctgcc

SEQ ID NO: 5187882 - DNA, 14 bp, Homo sapiens
agccaggctctgtg

SEQ ID NO: 5187883 - DNA, 16 bp, Homo sapiens
agccaggctctgtgct

SEQ ID NO: 5187884 - DNA, 21 bp, Homo sapiens
agccaggctgccaaggccaga

SEQ ID NO: 5187885 - DNA, 23 bp, Homo sapiens
agccaggctgggccgcaagggcc

SEQ ID NO: 5187886 - DNA, 15 bp, Homo sapiens
agccaggcttttctc

SEQ ID NO: 5187887 - DNA, 13 bp, Homo sapiens
agccagggaaggc

SEQ ID NO: 5187888 - DNA, 19 bp, Homo sapiens
agccagggagactttctga

SEQ ID NO: 5187889 - DNA, 16 bp, Homo sapiens
agccagggagagccca

SEQ ID NO: 5187890 - DNA, 17 bp, Homo sapiens
agccagggagagcccag

SEQ ID NO: 5187891 - DNA, 20 bp, Homo sapiens
agccagggatggggccacag

SEQ ID NO: 5187892 - DNA, 22 bp, Homo sapiens
agccagggatggggccacagcc

SEQ ID NO: 5187893 - DNA, 19 bp, Homo sapiens
agccagggcaacataataa

SEQ ID NO: 5187894 - DNA, 12 bp, Homo sapiens
agccagggcaag

SEQ ID NO: 5187895 - DNA, 12 bp, Homo sapiens
agccagggccag

SEQ ID NO: 5187896 - DNA, 14 bp, Homo sapiens
agccagggccaggg

SEQ ID NO: 5187897 - DNA, 11 bp, Homo sapiens
agccagggccc

SEQ ID NO: 5187898 - DNA, 12 bp, Homo sapiens
agccagggccca

SEQ ID NO: 5187899 - DNA, 13 bp, Homo sapiens
agccagggcccag

SEQ ID NO: 5187900 - DNA, 16 bp, Homo sapiens
agccagggcccagagc

SEQ ID NO: 5187901 - DNA, 17 bp, Homo sapiens
agccagggcccagagcc

SEQ ID NO: 5187902 - DNA, 22 bp, Homo sapiens
agccagggcccagagcccttga

SEQ ID NO: 5187903 - DNA, 18 bp, Homo sapiens
agccagggcccctggatc

SEQ ID NO: 5187904 - DNA, 13 bp, Homo sapiens
agccagggctcaa

SEQ ID NO: 5187905 - DNA, 22 bp, Homo sapiens
agccagggctcgcgagggcagc

SEQ ID NO: 5187906 - DNA, 15 bp, Homo sapiens
agccagggctggaga

SEQ ID NO: 5187907 - DNA, 13 bp, Homo sapiens
agccagggctggg

SEQ ID NO: 5187908 - DNA, 14 bp, Homo sapiens
agccagggctgggg

SEQ ID NO: 5187909 - DNA, 15 bp, Homo sapiens
agccagggctgtcct

SEQ ID NO: 5187910 - DNA, 20 bp, Homo sapiens
agccagggcttacctgtaca

SEQ ID NO: 5187911 - DNA, 23 bp, Homo sapiens
agccaggggagcagaggggcaga

SEQ ID NO: 5187912 - DNA, 19 bp, Homo sapiens
agccaggggctgctcatca

SEQ ID NO: 5187913 - DNA, 23 bp, Homo sapiens
agccagggggactagcccctgtg

SEQ ID NO: 5187914 - DNA, 19 bp, Homo sapiens
agccagggggagctgggcc

SEQ ID NO: 5187915 - DNA, 18 bp, Homo sapiens
agccaggggtgtcccagt

SEQ ID NO: 5187916 - DNA, 23 bp, Homo sapiens
agccaggggtgtcccagtcccag

SEQ ID NO: 5187917 - DNA, 16 bp, Homo sapiens
agccagggtagagcaa

SEQ ID NO: 5187918 - DNA, 20 bp, Homo sapiens
agccagggtagagcaaagga

SEQ ID NO: 5187919 - DNA, 15 bp, Homo sapiens
agccagggtcctgag

SEQ ID NO: 5187920 - DNA, 19 bp, Homo sapiens
agccagggtcctgagtggc

SEQ ID NO: 5187921 - DNA, 15 bp, Homo sapiens
agccagggtctccag

SEQ ID NO: 5187922 - DNA, 21 bp, Homo sapiens
agccagggtgtggccctgcca

SEQ ID NO: 5187923 - DNA, 22 bp, Homo sapiens
agccagggtgtggccctgccat

SEQ ID NO: 5187924 - DNA, 13 bp, Homo sapiens
agccagggttcca

SEQ ID NO: 5187925 - DNA, 18 bp, Homo sapiens
agccaggtaatgagggac

SEQ ID NO: 5187926 - DNA, 18 bp, Homo sapiens
agccaggtacaggagagg

SEQ ID NO: 5187927 - DNA, 17 bp, Homo sapiens
agccaggtatggctctg

SEQ ID NO: 5187928 - DNA, 15 bp, Homo sapiens
agccaggtctcctgg

SEQ ID NO: 5187929 - DNA, 17 bp, Homo sapiens
agccaggtctcctggga

SEQ ID NO: 5187930 - DNA, 18 bp, Homo sapiens
agccaggtctgactccaa

SEQ ID NO: 5187931 - DNA, 23 bp, Homo sapiens
agccaggtgagctctgacccttg

SEQ ID NO: 5187932 - DNA, 15 bp, Homo sapiens
agccaggtggcacct

SEQ ID NO: 5187933 - DNA, 17 bp, Homo sapiens
agccaggtgtcctgact

SEQ ID NO: 5187934 - DNA, 23 bp, Homo sapiens
agccaggtgtcctgactgtccta

SEQ ID NO: 5187935 - DNA, 18 bp, Homo sapiens
agccaggttcacactcag

SEQ ID NO: 5187936 - DNA, 17 bp, Homo sapiens
agccaggtttagcggca

SEQ ID NO: 5187937 - DNA, 22 bp, Homo sapiens
agccagtaaatgggggtgcatt

SEQ ID NO: 5187938 - DNA, 20 bp, Homo sapiens
agccagtaaggcagctctgt

SEQ ID NO: 5187939 - DNA, 15 bp, Homo sapiens
agccagtaatcctgt

SEQ ID NO: 5187940 - DNA, 19 bp, Homo sapiens
agccagtcaccttctgggc

SEQ ID NO: 5187941 - DNA, 16 bp, Homo sapiens
agccagtcatcatctc

SEQ ID NO: 5187942 - DNA, 18 bp, Homo sapiens
agccagtcatcatctctt

SEQ ID NO: 5187943 - DNA, 15 bp, Homo sapiens
agccagtcattgtaa

SEQ ID NO: 5187944 - DNA, 23 bp, Homo sapiens
agccagtcattgtaacctcgtgt

SEQ ID NO: 5187945 - DNA, 14 bp, Homo sapiens
agccagtctcagag

SEQ ID NO: 5187946 - DNA, 16 bp, Homo sapiens
agccagtctcagagac

SEQ ID NO: 5187947 - DNA, 23 bp, Homo sapiens
agccagtctcagagaccagcact

SEQ ID NO: 5187948 - DNA, 15 bp, Homo sapiens
agccagtcttaacat

SEQ ID NO: 5187949 - DNA, 13 bp, Homo sapiens
agccagtctttac

SEQ ID NO: 5187950 - DNA, 22 bp, Homo sapiens
agccagtctttgaactgcagca

SEQ ID NO: 5187951 - DNA, 16 bp, Homo sapiens
agccagtgaaacactt

SEQ ID NO: 5187952 - DNA, 16 bp, Homo sapiens
agccagtgaaatgtga

SEQ ID NO: 5187953 - DNA, 21 bp, Homo sapiens
agccagtgaaatgtgaaggaa

SEQ ID NO: 5187954 - DNA, 17 bp, Homo sapiens
agccagtgacctgagga

SEQ ID NO: 5187955 - DNA, 16 bp, Homo sapiens
agccagtgacctttga

SEQ ID NO: 5187956 - DNA, 18 bp, Homo sapiens
agccagtgactccaggag

SEQ ID NO: 5187957 - DNA, 21 bp, Homo sapiens
agccagtgactccaggagagg

SEQ ID NO: 5187958 - DNA, 13 bp, Homo sapiens
agccagtgagatg

SEQ ID NO: 5187959 - DNA, 16 bp, Homo sapiens
agccagtgagggcagt

SEQ ID NO: 5187960 - DNA, 14 bp, Homo sapiens
agccagtgccattc

SEQ ID NO: 5187961 - DNA, 16 bp, Homo sapiens
agccagtgccctgagc

SEQ ID NO: 5187962 - DNA, 17 bp, Homo sapiens
agccagtgccctgagcc

SEQ ID NO: 5187963 - DNA, 18 bp, Homo sapiens
agccagtgccctgagcca

SEQ ID NO: 5187964 - DNA, 14 bp, Homo sapiens
agccagtggagctg

SEQ ID NO: 5187965 - DNA, 19 bp, Homo sapiens
agccagtggagctggtctg

SEQ ID NO: 5187966 - DNA, 18 bp, Homo sapiens
agccagtggcacaggaga

SEQ ID NO: 5187967 - DNA, 11 bp, Homo sapiens
agccagtggcc

SEQ ID NO: 5187968 - DNA, 21 bp, Homo sapiens
agccagtggccgaacccccca

SEQ ID NO: 5187969 - DNA, 22 bp, Homo sapiens
agccagtggggtcccccctgag

SEQ ID NO: 5187970 - DNA, 23 bp, Homo sapiens
agccagtggggtcccccctgagt

SEQ ID NO: 5187971 - DNA, 16 bp, Homo sapiens
agccagtgggtgctat

SEQ ID NO: 5187972 - DNA, 14 bp, Homo sapiens
agccagtgtgccca

SEQ ID NO: 5187973 - DNA, 21 bp, Homo sapiens
agccagttacctttgctgtca

SEQ ID NO: 5187974 - DNA, 20 bp, Homo sapiens
agccagttcaaagtgtatat

SEQ ID NO: 5187975 - DNA, 21 bp, Homo sapiens
agccagttcagtacctggagg

SEQ ID NO: 5187976 - DNA, 22 bp, Homo sapiens
agccagttcagtacctggagga

SEQ ID NO: 5187977 - DNA, 16 bp, Homo sapiens
agccagttctggggcc

SEQ ID NO: 5187978 - DNA, 14 bp, Homo sapiens
agccagttggtggg

SEQ ID NO: 5187979 - DNA, 14 bp, Homo sapiens
agccagttgtccta

SEQ ID NO: 5187980 - DNA, 17 bp, Homo sapiens
agccagttgtcctatgg

SEQ ID NO: 5187981 - DNA, 20 bp, Homo sapiens
agccagttgtcctatggaca

SEQ ID NO: 5187982 - DNA, 21 bp, Homo sapiens
agccagttgtcctatggacaa

SEQ ID NO: 5187983 - DNA, 21 bp, Homo sapiens
agccagtttgccggatacaaa

SEQ ID NO: 5187984 - DNA, 23 bp, Homo sapiens
agccataaaaatataacataatc

SEQ ID NO: 5187985 - DNA, 16 bp, Homo sapiens
agccataaaagcattg

SEQ ID NO: 5187986 - DNA, 21 bp, Homo sapiens
agccataaaagcattgtctct

SEQ ID NO: 5187987 - DNA, 20 bp, Homo sapiens
agccataacgtgcccccaga

SEQ ID NO: 5187988 - DNA, 21 bp, Homo sapiens
agccataacgtgcccccagag

SEQ ID NO: 5187989 - DNA, 21 bp, Homo sapiens
agccataattccaccatcata

SEQ ID NO: 5187990 - DNA, 16 bp, Homo sapiens
agccatacataaaaga

SEQ ID NO: 5187991 - DNA, 17 bp, Homo sapiens
agccatacataaaagaa

SEQ ID NO: 5187992 - DNA, 18 bp, Homo sapiens
agccatacataaaagaaa

SEQ ID NO: 5187993 - DNA, 22 bp, Homo sapiens
agccatacataaaagaaataaa

SEQ ID NO: 5187994 - DNA, 22 bp, Homo sapiens
agccatacttatctctctgtgc

SEQ ID NO: 5187995 - DNA, 20 bp, Homo sapiens
agccatacttccagcgaaat

SEQ ID NO: 5187996 - DNA, 21 bp, Homo sapiens
agccatagaccctgaggccct

SEQ ID NO: 5187997 - DNA, 20 bp, Homo sapiens
agccatagacctacagacct

SEQ ID NO: 5187998 - DNA, 21 bp, Homo sapiens
agccatagacctacagacctg

SEQ ID NO: 5187999 - DNA, 15 bp, Homo sapiens
agccatagccccagg

SEQ ID NO: 5188000 - DNA, 18 bp, Homo sapiens
agccatagcttgattgct

SEQ ID NO: 5188001 - DNA, 21 bp, Homo sapiens
agccatagcttgattgctcag

SEQ ID NO: 5188002 - DNA, 14 bp, Homo sapiens
agccataggcccag

SEQ ID NO: 5188003 - DNA, 13 bp, Homo sapiens
agccatagggggc

SEQ ID NO: 5188004 - DNA, 15 bp, Homo sapiens
agccatagggggctg

SEQ ID NO: 5188005 - DNA, 17 bp, Homo sapiens
agccatagggggctgca

SEQ ID NO: 5188006 - DNA, 19 bp, Homo sapiens
agccatagggggctgcacg

SEQ ID NO: 5188007 - DNA, 20 bp, Homo sapiens
agccatagggggctgcacgg

SEQ ID NO: 5188008 - DNA, 21 bp, Homo sapiens
agccatagtgtcacttccaca

SEQ ID NO: 5188009 - DNA, 23 bp, Homo sapiens
agccatagtttgggtatttttgg

SEQ ID NO: 5188010 - DNA, 20 bp, Homo sapiens
agccatatatgaccagaagc

SEQ ID NO: 5188011 - DNA, 21 bp, Homo sapiens
agccatatatgaccagaagcc

SEQ ID NO: 5188012 - DNA, 22 bp, Homo sapiens
agccatatcatgctaaaattct

SEQ ID NO: 5188013 - DNA, 22 bp, Homo sapiens
agccatatgacaatttcaaaat

SEQ ID NO: 5188014 - DNA, 14 bp, Homo sapiens
agccatatggacac

SEQ ID NO: 5188015 - DNA, 15 bp, Homo sapiens
agccatatggacact

SEQ ID NO: 5188016 - DNA, 16 bp, Homo sapiens
agccatatggacactg

SEQ ID NO: 5188017 - DNA, 20 bp, Homo sapiens
agccatattaattgcctgtt

SEQ ID NO: 5188018 - DNA, 17 bp, Homo sapiens
agatgtccgtctctctt

SEQ ID NO: 5188019 - DNA, 19 bp, Homo sapiens
agatgtcgtggactccagc

SEQ ID NO: 5188020 - DNA, 20 bp, Homo sapiens
agatgtcgtggactccagct

SEQ ID NO: 5188021 - DNA, 21 bp, Homo sapiens
agatgtctaaaagattcttta

SEQ ID NO: 5188022 - DNA, 18 bp, Homo sapiens
agatgtctaatagttatt

SEQ ID NO: 5188023 - DNA, 12 bp, Homo sapiens
agatgtctattc

SEQ ID NO: 5188024 - DNA, 16 bp, Homo sapiens
agatgtctcagagcct

SEQ ID NO: 5188025 - DNA, 17 bp, Homo sapiens
agatgtctcagagcctt

SEQ ID NO: 5188026 - DNA, 19 bp, Homo sapiens
agatgtctcccctgccact

SEQ ID NO: 5188027 - DNA, 13 bp, Homo sapiens
agatgtctctggg

SEQ ID NO: 5188028 - DNA, 23 bp, Homo sapiens
agatgtctgggaaagcagagtgg

SEQ ID NO: 5188029 - DNA, 15 bp, Homo sapiens
agatgtctgtctctg

SEQ ID NO: 5188030 - DNA, 16 bp, Homo sapiens
agatgtctgtgtatac

SEQ ID NO: 5188031 - DNA, 20 bp, Homo sapiens
agatgtctgtgtatacatat

SEQ ID NO: 5188032 - DNA, 21 bp, Homo sapiens
agatgtctgtgtatacatatg

SEQ ID NO: 5188033 - DNA, 20 bp, Homo sapiens
agatgtcttaacctcaggga

SEQ ID NO: 5188034 - DNA, 18 bp, Homo sapiens
agatgtcttccctgggct

SEQ ID NO: 5188035 - DNA, 18 bp, Homo sapiens
agatgtcttcgtacagtt

SEQ ID NO: 5188036 - DNA, 19 bp, Homo sapiens
agatgtcttcgtacagttc

SEQ ID NO: 5188037 - DNA, 16 bp, Homo sapiens
agatgtcttctgcctg

SEQ ID NO: 5188038 - DNA, 17 bp, Homo sapiens
agatgtcttctgcctgt

SEQ ID NO: 5188039 - DNA, 22 bp, Homo sapiens
agatgtcttttcccatttatct

SEQ ID NO: 5188040 - DNA, 13 bp, Homo sapiens
agatgtgaaaact

SEQ ID NO: 5188041 - DNA, 14 bp, Homo sapiens
agatgtgaaaactc

SEQ ID NO: 5188042 - DNA, 19 bp, Homo sapiens
agatgtgaaaatatacttg

SEQ ID NO: 5188043 - DNA, 21 bp, Homo sapiens
agatgtgaaaatgctttgaaa

SEQ ID NO: 5188044 - DNA, 21 bp, Homo sapiens
agatgtgaaggacatgagact

SEQ ID NO: 5188045 - DNA, 20 bp, Homo sapiens
agatgtgaattattgacact

SEQ ID NO: 5188046 - DNA, 23 bp, Homo sapiens
agatgtgaattattgacactgaa

SEQ ID NO: 5188047 - DNA, 20 bp, Homo sapiens
agatgtgagccaccgtgcct

SEQ ID NO: 5188048 - DNA, 21 bp, Homo sapiens
agatgtgagccaccgtgcctg

SEQ ID NO: 5188049 - DNA, 22 bp, Homo sapiens
agatgtgagccaccgtgcctgg

SEQ ID NO: 5188050 - DNA, 18 bp, Homo sapiens
agatgtgagccttgtgca

SEQ ID NO: 5188051 - DNA, 21 bp, Homo sapiens
agatgtgagccttgtgcatgt

SEQ ID NO: 5188052 - DNA, 16 bp, Homo sapiens
agatgtgagtcctgtt

SEQ ID NO: 5188053 - DNA, 17 bp, Homo sapiens
agatgtgagtcctgttg

SEQ ID NO: 5188054 - DNA, 17 bp, Homo sapiens
agatgtgatattctaag

SEQ ID NO: 5188055 - DNA, 20 bp, Homo sapiens
agatgtgatattctaagact

SEQ ID NO: 5188056 - DNA, 21 bp, Homo sapiens
agatgtgatcaggccccaccc

SEQ ID NO: 5188057 - DNA, 22 bp, Homo sapiens
agatgtgatcaggccccacccc

SEQ ID NO: 5188058 - DNA, 12 bp, Homo sapiens
agatgtgattta

SEQ ID NO: 5188059 - DNA, 16 bp, Homo sapiens
agatgtgcaaaatcac

SEQ ID NO: 5188060 - DNA, 19 bp, Homo sapiens
agatgtgcaacctgtggct

SEQ ID NO: 5188061 - DNA, 12 bp, Homo sapiens
agatgtgcaata

SEQ ID NO: 5188062 - DNA, 13 bp, Homo sapiens
agatgtgcaataa

SEQ ID NO: 5188063 - DNA, 22 bp, Homo sapiens
agatgtgcaataatttgtacaa

SEQ ID NO: 5188064 - DNA, 18 bp, Homo sapiens
agatgtgcaatagaaata

SEQ ID NO: 5188065 - DNA, 13 bp, Homo sapiens
agatgtgcaccca

SEQ ID NO: 5188066 - DNA, 21 bp, Homo sapiens
agatgtgcacccatgggctct

SEQ ID NO: 5188067 - DNA, 14 bp, Homo sapiens
agatgtgcagcaga

SEQ ID NO: 5188068 - DNA, 15 bp, Homo sapiens
agatgtgcagcagat

SEQ ID NO: 5188069 - DNA, 18 bp, Homo sapiens
agatgtgcagcagattgg

SEQ ID NO: 5188070 - DNA, 23 bp, Homo sapiens
agatgtgcagcagattggaagga

SEQ ID NO: 5188071 - DNA, 14 bp, Homo sapiens
agatgtgcagtttg

SEQ ID NO: 5188072 - DNA, 16 bp, Homo sapiens
agatgtgcagtttgga

SEQ ID NO: 5188073 - DNA, 23 bp, Homo sapiens
agatgtgcatttcacctgtgaca

SEQ ID NO: 5188074 - DNA, 19 bp, Homo sapiens
agatgtgcccccaccccca

SEQ ID NO: 5188075 - DNA, 23 bp, Homo sapiens
agatgtgcccccacccccaccct

SEQ ID NO: 5188076 - DNA, 22 bp, Homo sapiens
agatgtgcctgtgggaggggga

SEQ ID NO: 5188077 - DNA, 14 bp, Homo sapiens
agatgtgctgcttt

SEQ ID NO: 5188078 - DNA, 21 bp, Homo sapiens
agatgtgcttctgaaccgcaa

SEQ ID NO: 5188079 - DNA, 15 bp, Homo sapiens
agatgtggacatgca

SEQ ID NO: 5188080 - DNA, 17 bp, Homo sapiens
agatgtggacatgcacc

SEQ ID NO: 5188081 - DNA, 14 bp, Homo sapiens
agatgtggagactg

SEQ ID NO: 5188082 - DNA, 16 bp, Homo sapiens
agatgtggagccaggc

SEQ ID NO: 5188083 - DNA, 16 bp, Homo sapiens
agatgtggatttggca

SEQ ID NO: 5188084 - DNA, 20 bp, Homo sapiens
agatgtgggccaccattgca

SEQ ID NO: 5188085 - DNA, 14 bp, Homo sapiens
agatgtggggatgt

SEQ ID NO: 5188086 - DNA, 20 bp, Homo sapiens
agatgtggttaattttgcat

SEQ ID NO: 5188087 - DNA, 13 bp, Homo sapiens
agatgtgtaaaca

SEQ ID NO: 5188088 - DNA, 17 bp, Homo sapiens
agatgtgtaatttttct

SEQ ID NO: 5188089 - DNA, 15 bp, Homo sapiens
agatgtgtctgggag

SEQ ID NO: 5188090 - DNA, 15 bp, Homo sapiens
agatgtgtgttgata

SEQ ID NO: 5188091 - DNA, 22 bp, Homo sapiens
agatgtgtgttgatactgttgc

SEQ ID NO: 5188092 - DNA, 16 bp, Homo sapiens
agatgtgttcctcctg

SEQ ID NO: 5188093 - DNA, 18 bp, Homo sapiens
agatgtgttcctcctgct

SEQ ID NO: 5188094 - DNA, 19 bp, Homo sapiens
agatgtgttgctatcctga

SEQ ID NO: 5188095 - DNA, 17 bp, Homo sapiens
agatgtgttttgttttg

SEQ ID NO: 5188096 - DNA, 23 bp, Homo sapiens
agatgtgttttgttttggactct

SEQ ID NO: 5188097 - DNA, 16 bp, Homo sapiens
agatgtgtttttaatg

SEQ ID NO: 5188098 - DNA, 18 bp, Homo sapiens
agatgttaaaataaatgg

SEQ ID NO: 5188099 - DNA, 13 bp, Homo sapiens
agatgttaaatgg

SEQ ID NO: 5188100 - DNA, 19 bp, Homo sapiens
agatgttaaatgttattat

SEQ ID NO: 5188101 - DNA, 19 bp, Homo sapiens
agatgttaacagtatttta

SEQ ID NO: 5188102 - DNA, 14 bp, Homo sapiens
agatgttaagcatt

SEQ ID NO: 5188103 - DNA, 21 bp, Homo sapiens
agatgttaatggggaccctcc

SEQ ID NO: 5188104 - DNA, 16 bp, Homo sapiens
agatgttaatttactt

SEQ ID NO: 5188105 - DNA, 16 bp, Homo sapiens
agatgttactgtgtga

SEQ ID NO: 5188106 - DNA, 17 bp, Homo sapiens
agatgttactgtgtgaa

SEQ ID NO: 5188107 - DNA, 15 bp, Homo sapiens
agatgttagactcat

SEQ ID NO: 5188108 - DNA, 22 bp, Homo sapiens
agatgttagggtataagttgct

SEQ ID NO: 5188109 - DNA, 13 bp, Homo sapiens
agatgttatatta

SEQ ID NO: 5188110 - DNA, 16 bp, Homo sapiens
agatgttatattaaag

SEQ ID NO: 5188111 - DNA, 21 bp, Homo sapiens
agatgttatattaaagaaaaa

SEQ ID NO: 5188112 - DNA, 22 bp, Homo sapiens
agatgttatattaaagaaaaac

SEQ ID NO: 5188113 - DNA, 18 bp, Homo sapiens
agatgttattatgctaat

SEQ ID NO: 5188114 - DNA, 23 bp, Homo sapiens
agatgttatttttgtatttttaa

SEQ ID NO: 5188115 - DNA, 21 bp, Homo sapiens
agatgttcagattgctttgat

SEQ ID NO: 5188116 - DNA, 17 bp, Homo sapiens
agatgttccaaatttag

SEQ ID NO: 5188117 - DNA, 18 bp, Homo sapiens
agatgttccatcctgtac

SEQ ID NO: 5188118 - DNA, 14 bp, Homo sapiens
agatgttcccccat

SEQ ID NO: 5188119 - DNA, 14 bp, Homo sapiens
agatgttctacttt

SEQ ID NO: 5188120 - DNA, 19 bp, Homo sapiens
agatgttctctatcattta

SEQ ID NO: 5188121 - DNA, 21 bp, Homo sapiens
agatgttgagaggaacaagaa

SEQ ID NO: 5188122 - DNA, 12 bp, Homo sapiens
agatgttgctct

SEQ ID NO: 5188123 - DNA, 14 bp, Homo sapiens
agatgttgctcttt

SEQ ID NO: 5188124 - DNA, 15 bp, Homo sapiens
agatgttgcttttga

SEQ ID NO: 5188125 - DNA, 22 bp, Homo sapiens
agatgttgcttttgaaaagttg

SEQ ID NO: 5188126 - DNA, 15 bp, Homo sapiens
agatgttgtgtggca

SEQ ID NO: 5188127 - DNA, 13 bp, Homo sapiens
agatgttgtttta

SEQ ID NO: 5188128 - DNA, 19 bp, Homo sapiens
agatgttgttttaggggct

SEQ ID NO: 5188129 - DNA, 15 bp, Homo sapiens
agatgtttaaataaa

SEQ ID NO: 5188130 - DNA, 12 bp, Homo sapiens
agatgtttaaca

SEQ ID NO: 5188131 - DNA, 19 bp, Homo sapiens
agatgtttaacaaatctaa

SEQ ID NO: 5188132 - DNA, 19 bp, Homo sapiens
agatgtttaatgaagtcac

SEQ ID NO: 5188133 - DNA, 14 bp, Homo sapiens
agatgtttacattt

SEQ ID NO: 5188134 - DNA, 16 bp, Homo sapiens
agatgtttagtagctg

SEQ ID NO: 5188135 - DNA, 21 bp, Homo sapiens
agatgtttagtagctgataaa

SEQ ID NO: 5188136 - DNA, 20 bp, Homo sapiens
agatgtttattcttctagag

SEQ ID NO: 5188137 - DNA, 15 bp, Homo sapiens
agatgtttatttcag

SEQ ID NO: 5188138 - DNA, 19 bp, Homo sapiens
agatgtttcatcaatgcag

SEQ ID NO: 5188139 - DNA, 18 bp, Homo sapiens
agatgtttctcattttaa

SEQ ID NO: 5188140 - DNA, 22 bp, Homo sapiens
agatgtttctcattttaaacaa

SEQ ID NO: 5188141 - DNA, 23 bp, Homo sapiens
agatgtttctcattttaaacaac

SEQ ID NO: 5188142 - DNA, 22 bp, Homo sapiens
agatgtttcttgccttttgtta

SEQ ID NO: 5188143 - DNA, 19 bp, Homo sapiens
agatgtttgaaaatgctct

SEQ ID NO: 5188144 - DNA, 15 bp, Homo sapiens
agatgtttggatatt

SEQ ID NO: 5188145 - DNA, 21 bp, Homo sapiens
agatgtttggatattttttgg

SEQ ID NO: 5188146 - DNA, 15 bp, Homo sapiens
agatgtttggcaaga

SEQ ID NO: 5188147 - DNA, 15 bp, Homo sapiens
agatgtttgtcagat

SEQ ID NO: 5188148 - DNA, 17 bp, Homo sapiens
agatgtttgtcagatat

SEQ ID NO: 5188149 - DNA, 19 bp, Homo sapiens
agatgtttgtcagatatga

SEQ ID NO: 5188150 - DNA, 20 bp, Homo sapiens
agatgtttgtttacataaga

SEQ ID NO: 5188151 - DNA, 18 bp, Homo sapiens
agatgtttgttttcaaaa

SEQ ID NO: 5188152 - DNA, 12 bp, Homo sapiens
agatgttttaac

SEQ ID NO: 5188153 - DNA, 14 bp, Homo sapiens
agatgttttaactt

SEQ ID NO: 5188154 - DNA, 21 bp, Homo sapiens
agatgttttacgcaaggaagg

SEQ ID NO: 5188155 - DNA, 17 bp, Homo sapiens
agatgttttacgtctgg

SEQ ID NO: 5188156 - DNA, 12 bp, Homo sapiens
agatgttttaga

SEQ ID NO: 5188157 - DNA, 20 bp, Homo sapiens
agatgttttagagataaata

SEQ ID NO: 5188158 - DNA, 14 bp, Homo sapiens
agatgttttcaagt

SEQ ID NO: 5188159 - DNA, 22 bp, Homo sapiens
agatgttttgggatcaggagcc

SEQ ID NO: 5188160 - DNA, 19 bp, Homo sapiens
agatgttttggtagattaa

SEQ ID NO: 5188161 - DNA, 23 bp, Homo sapiens
agatgttttggtcaagtagtttg

SEQ ID NO: 5188162 - DNA, 16 bp, Homo sapiens
agatgttttgtataaa

SEQ ID NO: 5188163 - DNA, 19 bp, Homo sapiens
agatgttttgtataaaatc

SEQ ID NO: 5188164 - DNA, 22 bp, Homo sapiens
agatgttttgtataaaatctga

SEQ ID NO: 5188165 - DNA, 18 bp, Homo sapiens
agatgtttttaattctag

SEQ ID NO: 5188166 - DNA, 19 bp, Homo sapiens
agatgtttttaattctagt

SEQ ID NO: 5188167 - DNA, 15 bp, Homo sapiens
agattaaaaccacag

SEQ ID NO: 5188168 - DNA, 20 bp, Homo sapiens
agattaaaaccagagagaaa

SEQ ID NO: 5188169 - DNA, 23 bp, Homo sapiens
agattaaaattatatagctgctc

SEQ ID NO: 5188170 - DNA, 20 bp, Homo sapiens
agattaaaccaattataact

SEQ ID NO: 5188171 - DNA, 16 bp, Homo sapiens
agattaaacttcatat

SEQ ID NO: 5188172 - DNA, 18 bp, Homo sapiens
agattaaaggaaggaaaa

SEQ ID NO: 5188173 - DNA, 12 bp, Homo sapiens
agattaaatata

SEQ ID NO: 5188174 - DNA, 13 bp, Homo sapiens
agattaaatatag

SEQ ID NO: 5188175 - DNA, 19 bp, Homo sapiens
agattaaatatatctttgt

SEQ ID NO: 5188176 - DNA, 17 bp, Homo sapiens
agattaaattacagctt

SEQ ID NO: 5188177 - DNA, 12 bp, Homo sapiens
agattaacacac

SEQ ID NO: 5188178 - DNA, 15 bp, Homo sapiens
agattaacactaatt

SEQ ID NO: 5188179 - DNA, 19 bp, Homo sapiens
agattaacactcatttcca

SEQ ID NO: 5188180 - DNA, 18 bp, Homo sapiens
agattaacctgaaagaac

SEQ ID NO: 5188181 - DNA, 14 bp, Homo sapiens
agattaagaaatag

SEQ ID NO: 5188182 - DNA, 18 bp, Homo sapiens
agattaaggtgatgtgat

SEQ ID NO: 5188183 - DNA, 20 bp, Homo sapiens
agattaagttataccagcaa

SEQ ID NO: 5188184 - DNA, 22 bp, Homo sapiens
agattaagttataccagcaaaa

SEQ ID NO: 5188185 - DNA, 21 bp, Homo sapiens
agattaataagatttttcaaa

SEQ ID NO: 5188186 - DNA, 11 bp, Homo sapiens
agattaatatt

SEQ ID NO: 5188187 - DNA, 20 bp, Homo sapiens
agattaatattgttctctgt

SEQ ID NO: 5188188 - DNA, 12 bp, Homo sapiens
agattaatgact

SEQ ID NO: 5188189 - DNA, 15 bp, Homo sapiens
agattaattaaaatt

SEQ ID NO: 5188190 - DNA, 11 bp, Homo sapiens
agattaatttt

SEQ ID NO: 5188191 - DNA, 20 bp, Homo sapiens
agattacaaatcagaagtca

SEQ ID NO: 5188192 - DNA, 18 bp, Homo sapiens
agattacaggaatgaaga

SEQ ID NO: 5188193 - DNA, 18 bp, Homo sapiens
agattacaggcgcacacc

SEQ ID NO: 5188194 - DNA, 13 bp, Homo sapiens
agattacctgcca

SEQ ID NO: 5188195 - DNA, 15 bp, Homo sapiens
agattacctgccact

SEQ ID NO: 5188196 - DNA, 18 bp, Homo sapiens
agccatattcacacctca

SEQ ID NO: 5188197 - DNA, 18 bp, Homo sapiens
agccatattccagcagtg

SEQ ID NO: 5188198 - DNA, 17 bp, Homo sapiens
agccatattctaaattc

SEQ ID NO: 5188199 - DNA, 18 bp, Homo sapiens
agccatattctaaattca

SEQ ID NO: 5188200 - DNA, 21 bp, Homo sapiens
agccatatttgtaaaatgaca

SEQ ID NO: 5188201 - DNA, 14 bp, Homo sapiens
agccatcaaaatgc

SEQ ID NO: 5188202 - DNA, 15 bp, Homo sapiens
agccatcaagcactt

SEQ ID NO: 5188203 - DNA, 19 bp, Homo sapiens
agccatcaagcacttccca

SEQ ID NO: 5188204 - DNA, 15 bp, Homo sapiens
agccatcacaagggg

SEQ ID NO: 5188205 - DNA, 14 bp, Homo sapiens
agccatcagaagtt

SEQ ID NO: 5188206 - DNA, 16 bp, Homo sapiens
agccatcagatgaggc

SEQ ID NO: 5188207 - DNA, 13 bp, Homo sapiens
agccatcatggat

SEQ ID NO: 5188208 - DNA, 20 bp, Homo sapiens
agccatcatgtgcctggaaa

SEQ ID NO: 5188209 - DNA, 13 bp, Homo sapiens
agccatccaccct

SEQ ID NO: 5188210 - DNA, 16 bp, Homo sapiens
agccatcccaaggctc

SEQ ID NO: 5188211 - DNA, 18 bp, Homo sapiens
agccatcccagccttggc

SEQ ID NO: 5188212 - DNA, 19 bp, Homo sapiens
agccatcccatgaacacac

SEQ ID NO: 5188213 - DNA, 18 bp, Homo sapiens
agccatcccgcttagcct

SEQ ID NO: 5188214 - DNA, 22 bp, Homo sapiens
agccatcccgcttagcctgcct

SEQ ID NO: 5188215 - DNA, 23 bp, Homo sapiens
agccatcccgcttagcctgcctc

SEQ ID NO: 5188216 - DNA, 18 bp, Homo sapiens
agccatcccgtcttctcc

SEQ ID NO: 5188217 - DNA, 20 bp, Homo sapiens
agccatcccttccctgtcca

SEQ ID NO: 5188218 - DNA, 18 bp, Homo sapiens
agccatcccttcggagcc

SEQ ID NO: 5188219 - DNA, 14 bp, Homo sapiens
agccatcctccctc

SEQ ID NO: 5188220 - DNA, 19 bp, Homo sapiens
agccatcctccctccacct

SEQ ID NO: 5188221 - DNA, 18 bp, Homo sapiens
agccatcgattgtgtact

SEQ ID NO: 5188222 - DNA, 23 bp, Homo sapiens
agccatcgccaacttgtctctgt

SEQ ID NO: 5188223 - DNA, 21 bp, Homo sapiens
agccatcggaagagagggctg

SEQ ID NO: 5188224 - DNA, 16 bp, Homo sapiens
agccatcgtcctggga

SEQ ID NO: 5188225 - DNA, 19 bp, Homo sapiens
agccatcgtcctgggactc

SEQ ID NO: 5188226 - DNA, 12 bp, Homo sapiens
agccatctcagg

SEQ ID NO: 5188227 - DNA, 16 bp, Homo sapiens
agccatctcaggttgg

SEQ ID NO: 5188228 - DNA, 21 bp, Homo sapiens
agccatctcatgaggggagag

SEQ ID NO: 5188229 - DNA, 22 bp, Homo sapiens
agccatctctctactcctacct

SEQ ID NO: 5188230 - DNA, 16 bp, Homo sapiens
agccatctgacagcag

SEQ ID NO: 5188231 - DNA, 15 bp, Homo sapiens
agccatctgcccagg

SEQ ID NO: 5188232 - DNA, 21 bp, Homo sapiens
agccatcttcccgcctcagcc

SEQ ID NO: 5188233 - DNA, 17 bp, Homo sapiens
agccatcttggtaaatt

SEQ ID NO: 5188234 - DNA, 19 bp, Homo sapiens
agccatctttggcaaaggt

SEQ ID NO: 5188235 - DNA, 17 bp, Homo sapiens
agccatgaccttacatt

SEQ ID NO: 5188236 - DNA, 23 bp, Homo sapiens
agccatgactagggtcctcaggc

SEQ ID NO: 5188237 - DNA, 20 bp, Homo sapiens
agccatgacttgagaaacaa

SEQ ID NO: 5188238 - DNA, 18 bp, Homo sapiens
agccatgaggaggcagag

SEQ ID NO: 5188239 - DNA, 18 bp, Homo sapiens
agccatgataactgcaat

SEQ ID NO: 5188240 - DNA, 23 bp, Homo sapiens
agccatgatgtggagtggggcag

SEQ ID NO: 5188241 - DNA, 17 bp, Homo sapiens
agccatgatttgtccca

SEQ ID NO: 5188242 - DNA, 22 bp, Homo sapiens
agccatgatttgtcccagcctg

SEQ ID NO: 5188243 - DNA, 18 bp, Homo sapiens
agccatgattttctaaaa

SEQ ID NO: 5188244 - DNA, 14 bp, Homo sapiens
agccatgccaggct

SEQ ID NO: 5188245 - DNA, 16 bp, Homo sapiens
agccatgccaggctgc

SEQ ID NO: 5188246 - DNA, 13 bp, Homo sapiens
agccatgcctccc

SEQ ID NO: 5188247 - DNA, 14 bp, Homo sapiens
agccatgcctccct

SEQ ID NO: 5188248 - DNA, 23 bp, Homo sapiens
agccatgcctccctgggccacct

SEQ ID NO: 5188249 - DNA, 23 bp, Homo sapiens
agccatgcgccccctccgccctg

SEQ ID NO: 5188250 - DNA, 15 bp, Homo sapiens
agccatgctgggaag

SEQ ID NO: 5188251 - DNA, 14 bp, Homo sapiens
agccatggaaggtg

SEQ ID NO: 5188252 - DNA, 17 bp, Homo sapiens
agccatggaaggtgcca

SEQ ID NO: 5188253 - DNA, 20 bp, Homo sapiens
agccatggaaggtgccagaa

SEQ ID NO: 5188254 - DNA, 20 bp, Homo sapiens
agccatggagattctcataa

SEQ ID NO: 5188255 - DNA, 15 bp, Homo sapiens
agccatggctcaggc

SEQ ID NO: 5188256 - DNA, 16 bp, Homo sapiens
agccatggctcaggca

SEQ ID NO: 5188257 - DNA, 18 bp, Homo sapiens
agccatggctcaggcaag

SEQ ID NO: 5188258 - DNA, 20 bp, Homo sapiens
agccatggctcaggcaagcc

SEQ ID NO: 5188259 - DNA, 13 bp, Homo sapiens
agccatggctgga

SEQ ID NO: 5188260 - DNA, 16 bp, Homo sapiens
agccatggctggatgt

SEQ ID NO: 5188261 - DNA, 20 bp, Homo sapiens
agccatgggacctcctccct

SEQ ID NO: 5188262 - DNA, 13 bp, Homo sapiens
agccatgggcctg

SEQ ID NO: 5188263 - DNA, 17 bp, Homo sapiens
agccatgggcctgggcc

SEQ ID NO: 5188264 - DNA, 18 bp, Homo sapiens
agccatgggcctgggcct

SEQ ID NO: 5188265 - DNA, 18 bp, Homo sapiens
agccatgggtagcctggg

SEQ ID NO: 5188266 - DNA, 23 bp, Homo sapiens
agccatggtgaactgataatttt

SEQ ID NO: 5188267 - DNA, 13 bp, Homo sapiens
agccatgtacaga

SEQ ID NO: 5188268 - DNA, 14 bp, Homo sapiens
agccatgtacagac

SEQ ID NO: 5188269 - DNA, 23 bp, Homo sapiens
agccatgtaccagtgtactgctt

SEQ ID NO: 5188270 - DNA, 22 bp, Homo sapiens
agccatgtagaagctgcatctt

SEQ ID NO: 5188271 - DNA, 16 bp, Homo sapiens
agccatgtataaatgt

SEQ ID NO: 5188272 - DNA, 17 bp, Homo sapiens
agccatgtataaatgtg

SEQ ID NO: 5188273 - DNA, 20 bp, Homo sapiens
agccatgtatttcagggacc

SEQ ID NO: 5188274 - DNA, 18 bp, Homo sapiens
agccatgtcatgtgccac

SEQ ID NO: 5188275 - DNA, 23 bp, Homo sapiens
agccatgtcatgtgccacgacct

SEQ ID NO: 5188276 - DNA, 16 bp, Homo sapiens
agccatgtccaagttc

SEQ ID NO: 5188277 - DNA, 21 bp, Homo sapiens
agccatgtccaagttcttcac

SEQ ID NO: 5188278 - DNA, 23 bp, Homo sapiens
agccatgtccaagttcttcacct

SEQ ID NO: 5188279 - DNA, 16 bp, Homo sapiens
agccatgtcttctccc

SEQ ID NO: 5188280 - DNA, 15 bp, Homo sapiens
agccatgtgaaactc

SEQ ID NO: 5188281 - DNA, 23 bp, Homo sapiens
agccatgtggggttgctgaagat

SEQ ID NO: 5188282 - DNA, 13 bp, Homo sapiens
agccatgtgtcat

SEQ ID NO: 5188283 - DNA, 17 bp, Homo sapiens
agccatgtgtcatgtaa

SEQ ID NO: 5188284 - DNA, 19 bp, Homo sapiens
agccatgtgtcatgtaata

SEQ ID NO: 5188285 - DNA, 20 bp, Homo sapiens
agccatgttccccagttcag

SEQ ID NO: 5188286 - DNA, 15 bp, Homo sapiens
agccatgtttaagat

SEQ ID NO: 5188287 - DNA, 16 bp, Homo sapiens
agccatgtttaagatt

SEQ ID NO: 5188288 - DNA, 20 bp, Homo sapiens
agccatgtttaagatttaat

SEQ ID NO: 5188289 - DNA, 22 bp, Homo sapiens
agccatgtttaagatttaattt

SEQ ID NO: 5188290 - DNA, 14 bp, Homo sapiens
agccatgtttatta

SEQ ID NO: 5188291 - DNA, 17 bp, Homo sapiens
agccatgtttattacag

SEQ ID NO: 5188292 - DNA, 15 bp, Homo sapiens
agccattaaaataaa

SEQ ID NO: 5188293 - DNA, 16 bp, Homo sapiens
agccattaaaataaaa

SEQ ID NO: 5188294 - DNA, 14 bp, Homo sapiens
agccattaaatgaa

SEQ ID NO: 5188295 - DNA, 12 bp, Homo sapiens
agccattaatga

SEQ ID NO: 5188296 - DNA, 21 bp, Homo sapiens
agccattcacaacacaatcaa

SEQ ID NO: 5188297 - DNA, 17 bp, Homo sapiens
agccattcatctgggct

SEQ ID NO: 5188298 - DNA, 20 bp, Homo sapiens
agccattcctggtacccagc

SEQ ID NO: 5188299 - DNA, 22 bp, Homo sapiens
agccattcctggtacccagcca

SEQ ID NO: 5188300 - DNA, 23 bp, Homo sapiens
agccattcctggtacccagccat

SEQ ID NO: 5188301 - DNA, 17 bp, Homo sapiens
agccattctgactcata

SEQ ID NO: 5188302 - DNA, 19 bp, Homo sapiens
agccattctgcctttgccg

SEQ ID NO: 5188303 - DNA, 23 bp, Homo sapiens
agccattctggcactttaatgat

SEQ ID NO: 5188304 - DNA, 16 bp, Homo sapiens
agccattctgtcccag

SEQ ID NO: 5188305 - DNA, 13 bp, Homo sapiens
agccattcttcag

SEQ ID NO: 5188306 - DNA, 13 bp, Homo sapiens
agccattgaaatg

SEQ ID NO: 5188307 - DNA, 14 bp, Homo sapiens
agccattgaacagc

SEQ ID NO: 5188308 - DNA, 20 bp, Homo sapiens
agccattgcacccagcccag

SEQ ID NO: 5188309 - DNA, 16 bp, Homo sapiens
agccattgcggcccca

SEQ ID NO: 5188310 - DNA, 17 bp, Homo sapiens
agccattgcggccccag

SEQ ID NO: 5188311 - DNA, 19 bp, Homo sapiens
agccattgcggccccagga

SEQ ID NO: 5188312 - DNA, 22 bp, Homo sapiens
agccattgcggccccaggaggg

SEQ ID NO: 5188313 - DNA, 18 bp, Homo sapiens
agccattggagagctgtc

SEQ ID NO: 5188314 - DNA, 18 bp, Homo sapiens
agccattggcctctgtct

SEQ ID NO: 5188315 - DNA, 21 bp, Homo sapiens
agccattggctatttaaaact

SEQ ID NO: 5188316 - DNA, 21 bp, Homo sapiens
agccattgtaatttgaagatg

SEQ ID NO: 5188317 - DNA, 14 bp, Homo sapiens
agccattgtccctc

SEQ ID NO: 5188318 - DNA, 19 bp, Homo sapiens
agccattgtcgtttcattc

SEQ ID NO: 5188319 - DNA, 17 bp, Homo sapiens
agccattgtggaagaca

SEQ ID NO: 5188320 - DNA, 23 bp, Homo sapiens
agccatttatacctttgaaatat

SEQ ID NO: 5188321 - DNA, 22 bp, Homo sapiens
agccatttcactctcaaacttc

SEQ ID NO: 5188322 - DNA, 18 bp, Homo sapiens
agccatttctaagcagat

SEQ ID NO: 5188323 - DNA, 18 bp, Homo sapiens
agccatttgtcccaagtg

SEQ ID NO: 5188324 - DNA, 19 bp, Homo sapiens
agccatttgtcccaagtgc

SEQ ID NO: 5188325 - DNA, 22 bp, Homo sapiens
agccatttgttggggcagtggt

SEQ ID NO: 5188326 - DNA, 15 bp, Homo sapiens
agccattttgtaact

SEQ ID NO: 5188327 - DNA, 14 bp, Homo sapiens
agccattttgtgaa

SEQ ID NO: 5188328 - DNA, 12 bp, Homo sapiens
agccatttttaa

SEQ ID NO: 5188329 - DNA, 22 bp, Homo sapiens
agccatttttcaatttttcttt

SEQ ID NO: 5188330 - DNA, 15 bp, Homo sapiens
agcccaaaacccagg

SEQ ID NO: 5188331 - DNA, 16 bp, Homo sapiens
agcccaaaagagggca

SEQ ID NO: 5188332 - DNA, 21 bp, Homo sapiens
agcccaaacaccctcctggca

SEQ ID NO: 5188333 - DNA, 17 bp, Homo sapiens
agcccaaaccaccagaa

SEQ ID NO: 5188334 - DNA, 19 bp, Homo sapiens
agcccaaaccaccagaagc

SEQ ID NO: 5188335 - DNA, 20 bp, Homo sapiens
agcccaaaccaccagaagcc

SEQ ID NO: 5188336 - DNA, 14 bp, Homo sapiens
agcccaaacctggg

SEQ ID NO: 5188337 - DNA, 23 bp, Homo sapiens
agcccaaacctgggaaggccagc

SEQ ID NO: 5188338 - DNA, 18 bp, Homo sapiens
agcccaaactcctttctt

SEQ ID NO: 5188339 - DNA, 19 bp, Homo sapiens
agcccaaactcctttctta

SEQ ID NO: 5188340 - DNA, 15 bp, Homo sapiens
agcccaaagcctgag

SEQ ID NO: 5188341 - DNA, 22 bp, Homo sapiens
agcccaaagctgcaggtgccag

SEQ ID NO: 5188342 - DNA, 14 bp, Homo sapiens
agcccaaagctgga

SEQ ID NO: 5188343 - DNA, 20 bp, Homo sapiens
agcccaaaggggacaggcct

SEQ ID NO: 5188344 - DNA, 22 bp, Homo sapiens
agcccaaatggctctgtgaaat

SEQ ID NO: 5188345 - DNA, 17 bp, Homo sapiens
agcccaaattcatataa

SEQ ID NO: 5188346 - DNA, 23 bp, Homo sapiens
agcccaacagacaccatcttttg

SEQ ID NO: 5188347 - DNA, 15 bp, Homo sapiens
agcccaacagcactt

SEQ ID NO: 5188348 - DNA, 22 bp, Homo sapiens
agcccaacatggggcccctctc

SEQ ID NO: 5188349 - DNA, 13 bp, Homo sapiens
agcccaaccagga

SEQ ID NO: 5188350 - DNA, 16 bp, Homo sapiens
agcccaacccggccca

SEQ ID NO: 5188351 - DNA, 13 bp, Homo sapiens
agcccaacccttc

SEQ ID NO: 5188352 - DNA, 14 bp, Homo sapiens
agcccaacctacat

SEQ ID NO: 5188353 - DNA, 11 bp, Homo sapiens
agcccaacctc

SEQ ID NO: 5188354 - DNA, 15 bp, Homo sapiens
agcccaacctcttcc

SEQ ID NO: 5188355 - DNA, 23 bp, Homo sapiens
agcccaacttccagaggacagct

SEQ ID NO: 5188356 - DNA, 16 bp, Homo sapiens
agcccaagattcttca

SEQ ID NO: 5188357 - DNA, 19 bp, Homo sapiens
agcccaagcttaatagccc

SEQ ID NO: 5188358 - DNA, 22 bp, Homo sapiens
agcccaagcttaatagccctcc

SEQ ID NO: 5188359 - DNA, 16 bp, Homo sapiens
agcccaaggacagttc

SEQ ID NO: 5188360 - DNA, 21 bp, Homo sapiens
agcccaaggacagttcagaga

SEQ ID NO: 5188361 - DNA, 23 bp, Homo sapiens
agcccaaggacagttcagagatc

SEQ ID NO: 5188362 - DNA, 24 bp, Homo sapiens
agcccaaggacagttcagagatca

SEQ ID NO: 5188363 - DNA, 17 bp, Homo sapiens
agcccaagtgccatccc

SEQ ID NO: 5188364 - DNA, 19 bp, Homo sapiens
agcccaagtgccatcccac

SEQ ID NO: 5188365 - DNA, 9 bp, Homo sapiens
agcccaata

SEQ ID NO: 5188366 - DNA, 16 bp, Homo sapiens
agcccaataaacctct

SEQ ID NO: 5188367 - DNA, 14 bp, Homo sapiens
agcccaataaaggt

SEQ ID NO: 5188368 - DNA, 13 bp, Homo sapiens
agcccaatcactg

SEQ ID NO: 5188369 - DNA, 22 bp, Homo sapiens
agcccaatccaggtacgcacag

SEQ ID NO: 5188370 - DNA, 16 bp, Homo sapiens
agcccaatgaaatgaa

SEQ ID NO: 5188371 - DNA, 20 bp, Homo sapiens
agcccacaccatctggccca

SEQ ID NO: 5188372 - DNA, 21 bp, Homo sapiens
agcccacaccatctggcccag

SEQ ID NO: 5188373 - DNA, 23 bp, Homo sapiens
agattacttaaataatttgggtg

SEQ ID NO: 5188374 - DNA, 13 bp, Homo sapiens
agattagaaaaat

SEQ ID NO: 5188375 - DNA, 16 bp, Homo sapiens
agattagaaagaatta

SEQ ID NO: 5188376 - DNA, 15 bp, Homo sapiens
agattagaacattta

SEQ ID NO: 5188377 - DNA, 17 bp, Homo sapiens
agattagaacatttaat

SEQ ID NO: 5188378 - DNA, 21 bp, Homo sapiens
agattagaatgaaaattgtat

SEQ ID NO: 5188379 - DNA, 21 bp, Homo sapiens
agattagaatggctaccccat

SEQ ID NO: 5188380 - DNA, 15 bp, Homo sapiens
agattagatctttta

SEQ ID NO: 5188381 - DNA, 17 bp, Homo sapiens
agattagcccttccttg

SEQ ID NO: 5188382 - DNA, 16 bp, Homo sapiens
agattagcctgtagct

SEQ ID NO: 5188383 - DNA, 15 bp, Homo sapiens
agattaggacacagt

SEQ ID NO: 5188384 - DNA, 11 bp, Homo sapiens
agattaggatt

SEQ ID NO: 5188385 - DNA, 13 bp, Homo sapiens
agattaggattaa

SEQ ID NO: 5188386 - DNA, 13 bp, Homo sapiens
agattagtgattc

SEQ ID NO: 5188387 - DNA, 18 bp, Homo sapiens
agattagttctttttgcc

SEQ ID NO: 5188388 - DNA, 13 bp, Homo sapiens
agattataacttg

SEQ ID NO: 5188389 - DNA, 14 bp, Homo sapiens
agattataacttgt

SEQ ID NO: 5188390 - DNA, 13 bp, Homo sapiens
agattataataaa

SEQ ID NO: 5188391 - DNA, 14 bp, Homo sapiens
agattataataaat

SEQ ID NO: 5188392 - DNA, 20 bp, Homo sapiens
agattatagattctaaagat

SEQ ID NO: 5188393 - DNA, 19 bp, Homo sapiens
agattatatacaaagctgt

SEQ ID NO: 5188394 - DNA, 15 bp, Homo sapiens
agattatatatcata

SEQ ID NO: 5188395 - DNA, 16 bp, Homo sapiens
agattatatcaaagta

SEQ ID NO: 5188396 - DNA, 22 bp, Homo sapiens
agattatattataataatgttc

SEQ ID NO: 5188397 - DNA, 16 bp, Homo sapiens
agattatattgagaca

SEQ ID NO: 5188398 - DNA, 15 bp, Homo sapiens
agattatcacattaa

SEQ ID NO: 5188399 - DNA, 16 bp, Homo sapiens
agattatcgttttctt

SEQ ID NO: 5188400 - DNA, 19 bp, Homo sapiens
agattatcgttttcttaaa

SEQ ID NO: 5188401 - DNA, 15 bp, Homo sapiens
agattatctggcgtt

SEQ ID NO: 5188402 - DNA, 20 bp, Homo sapiens
agattatggagcttttttcc

SEQ ID NO: 5188403 - DNA, 20 bp, Homo sapiens
agattatggcctttttaagt

SEQ ID NO: 5188404 - DNA, 17 bp, Homo sapiens
agattatgtgacttgca

SEQ ID NO: 5188405 - DNA, 17 bp, Homo sapiens
agattatgttcctgctg

SEQ ID NO: 5188406 - DNA, 15 bp, Homo sapiens
agattattaaaatta

SEQ ID NO: 5188407 - DNA, 16 bp, Homo sapiens
agattattaaaattag

SEQ ID NO: 5188408 - DNA, 15 bp, Homo sapiens
agattattaaatcgt

SEQ ID NO: 5188409 - DNA, 15 bp, Homo sapiens
agattattataaact

SEQ ID NO: 5188410 - DNA, 18 bp, Homo sapiens
agattattataaactata

SEQ ID NO: 5188411 - DNA, 16 bp, Homo sapiens
agattattcactgatt

SEQ ID NO: 5188412 - DNA, 16 bp, Homo sapiens
agattattcataatgt

SEQ ID NO: 5188413 - DNA, 16 bp, Homo sapiens
agattattgaaatatt

SEQ ID NO: 5188414 - DNA, 19 bp, Homo sapiens
agattattgtgacttcact

SEQ ID NO: 5188415 - DNA, 18 bp, Homo sapiens
agattatttaaatgcttt

SEQ ID NO: 5188416 - DNA, 16 bp, Homo sapiens
agattatttgtgcatt

SEQ ID NO: 5188417 - DNA, 15 bp, Homo sapiens
agattattttctata

SEQ ID NO: 5188418 - DNA, 13 bp, Homo sapiens
agattattttgga

SEQ ID NO: 5188419 - DNA, 14 bp, Homo sapiens
agattattttggaa

SEQ ID NO: 5188420 - DNA, 17 bp, Homo sapiens
agattattttggaaagt

SEQ ID NO: 5188421 - DNA, 20 bp, Homo sapiens
agattattttggaaagtttt

SEQ ID NO: 5188422 - DNA, 15 bp, Homo sapiens
agattattttttaaa

SEQ ID NO: 5188423 - DNA, 21 bp, Homo sapiens
agattcaaaaaaaaaatataa

SEQ ID NO: 5188424 - DNA, 16 bp, Homo sapiens
agattcaaagctctaa

SEQ ID NO: 5188425 - DNA, 19 bp, Homo sapiens
agattcaaaggttctaggt

SEQ ID NO: 5188426 - DNA, 21 bp, Homo sapiens
agattcaagttgtgtctgaaa

SEQ ID NO: 5188427 - DNA, 19 bp, Homo sapiens
agattcacacatgccacta

SEQ ID NO: 5188428 - DNA, 22 bp, Homo sapiens
agattcacacctgactctgaaa

SEQ ID NO: 5188429 - DNA, 17 bp, Homo sapiens
agattcacctgtaaaac

SEQ ID NO: 5188430 - DNA, 19 bp, Homo sapiens
agattcacctgtaaaactt

SEQ ID NO: 5188431 - DNA, 16 bp, Homo sapiens
agattcacttctgaat

SEQ ID NO: 5188432 - DNA, 23 bp, Homo sapiens
agattcactttgtttatgcatat

SEQ ID NO: 5188433 - DNA, 22 bp, Homo sapiens
agattcagcagtgtctgttctt

SEQ ID NO: 5188434 - DNA, 13 bp, Homo sapiens
agattcagctagt

SEQ ID NO: 5188435 - DNA, 16 bp, Homo sapiens
agattcaggagctcag

SEQ ID NO: 5188436 - DNA, 15 bp, Homo sapiens
agattcaggcttgca

SEQ ID NO: 5188437 - DNA, 14 bp, Homo sapiens
agattcaggggaag

SEQ ID NO: 5188438 - DNA, 16 bp, Homo sapiens
agattcaggggaaggg

SEQ ID NO: 5188439 - DNA, 21 bp, Homo sapiens
agattcaggggaagggcaggc

SEQ ID NO: 5188440 - DNA, 13 bp, Homo sapiens
agattcagtcttg

SEQ ID NO: 5188441 - DNA, 18 bp, Homo sapiens
agattcatataaccacaa

SEQ ID NO: 5188442 - DNA, 21 bp, Homo sapiens
agattcatcattttctccacc

SEQ ID NO: 5188443 - DNA, 15 bp, Homo sapiens
agattcatctatgga

SEQ ID NO: 5188444 - DNA, 22 bp, Homo sapiens
agattcatgcaagtggagctgt

SEQ ID NO: 5188445 - DNA, 20 bp, Homo sapiens
agattcatttttaatcatga

SEQ ID NO: 5188446 - DNA, 23 bp, Homo sapiens
agattccacaggacacgaaggct

SEQ ID NO: 5188447 - DNA, 19 bp, Homo sapiens
agattccagaacgccctgt

SEQ ID NO: 5188448 - DNA, 18 bp, Homo sapiens
agattccagagagtggct

SEQ ID NO: 5188449 - DNA, 21 bp, Homo sapiens
agattccattggtccaagatt

SEQ ID NO: 5188450 - DNA, 22 bp, Homo sapiens
agattccattggtccaagattc

SEQ ID NO: 5188451 - DNA, 23 bp, Homo sapiens
agattccattggtccaagattcc

SEQ ID NO: 5188452 - DNA, 18 bp, Homo sapiens
agattccattttatacaa

SEQ ID NO: 5188453 - DNA, 18 bp, Homo sapiens
agattcccaccttccata

SEQ ID NO: 5188454 - DNA, 12 bp, Homo sapiens
agattcccagac

SEQ ID NO: 5188455 - DNA, 20 bp, Homo sapiens
agattcccagaccttaagac

SEQ ID NO: 5188456 - DNA, 13 bp, Homo sapiens
agattcccagaga

SEQ ID NO: 5188457 - DNA, 11 bp, Homo sapiens
agattcccagg

SEQ ID NO: 5188458 - DNA, 12 bp, Homo sapiens
agattcccaggc

SEQ ID NO: 5188459 - DNA, 16 bp, Homo sapiens
agattcccaggccagg

SEQ ID NO: 5188460 - DNA, 17 bp, Homo sapiens
agattcccaggccaggg

SEQ ID NO: 5188461 - DNA, 23 bp, Homo sapiens
agattcccaggccagggctgggt

SEQ ID NO: 5188462 - DNA, 16 bp, Homo sapiens
agattccccactcagc

SEQ ID NO: 5188463 - DNA, 21 bp, Homo sapiens
agattccccattgcctcctcc

SEQ ID NO: 5188464 - DNA, 22 bp, Homo sapiens
agattccccattgcctcctcct

SEQ ID NO: 5188465 - DNA, 15 bp, Homo sapiens
agattcccctgtgtc

SEQ ID NO: 5188466 - DNA, 16 bp, Homo sapiens
agattcccctgtgtca

SEQ ID NO: 5188467 - DNA, 20 bp, Homo sapiens
agattcccggctggactttt

SEQ ID NO: 5188468 - DNA, 15 bp, Homo sapiens
agattccctgagcag

SEQ ID NO: 5188469 - DNA, 16 bp, Homo sapiens
agattccggatcctaa

SEQ ID NO: 5188470 - DNA, 20 bp, Homo sapiens
agattccggatcctaagcat

SEQ ID NO: 5188471 - DNA, 17 bp, Homo sapiens
agattcctacttaaaca

SEQ ID NO: 5188472 - DNA, 20 bp, Homo sapiens
agattcctacttaaacaaaa

SEQ ID NO: 5188473 - DNA, 15 bp, Homo sapiens
agattcctctgtatt

SEQ ID NO: 5188474 - DNA, 19 bp, Homo sapiens
agattcctcttgcctctct

SEQ ID NO: 5188475 - DNA, 23 bp, Homo sapiens
agattcctcttgcctctctcagg

SEQ ID NO: 5188476 - DNA, 12 bp, Homo sapiens
agattcctggtt

SEQ ID NO: 5188477 - DNA, 18 bp, Homo sapiens
agattcctgtaaatgtga

SEQ ID NO: 5188478 - DNA, 14 bp, Homo sapiens
agattccttttctt

SEQ ID NO: 5188479 - DNA, 20 bp, Homo sapiens
agattcgctgtcccctcagc

SEQ ID NO: 5188480 - DNA, 21 bp, Homo sapiens
agattcgctgtcccctcagcg

SEQ ID NO: 5188481 - DNA, 15 bp, Homo sapiens
agattctaaagattc

SEQ ID NO: 5188482 - DNA, 18 bp, Homo sapiens
agattctaaagattctat

SEQ ID NO: 5188483 - DNA, 20 bp, Homo sapiens
agattctaagagaaggcctt

SEQ ID NO: 5188484 - DNA, 13 bp, Homo sapiens
agattctactaac

SEQ ID NO: 5188485 - DNA, 11 bp, Homo sapiens
agattctagat

SEQ ID NO: 5188486 - DNA, 17 bp, Homo sapiens
agattctagcacatcat

SEQ ID NO: 5188487 - DNA, 20 bp, Homo sapiens
agattctatagttctagaca

SEQ ID NO: 5188488 - DNA, 21 bp, Homo sapiens
agattctatagttctagacat

SEQ ID NO: 5188489 - DNA, 16 bp, Homo sapiens
agattctatattatta

SEQ ID NO: 5188490 - DNA, 19 bp, Homo sapiens
agattctcataacttgaga

SEQ ID NO: 5188491 - DNA, 15 bp, Homo sapiens
agattctcgcccctt

SEQ ID NO: 5188492 - DNA, 14 bp, Homo sapiens
agattctctatgta

SEQ ID NO: 5188493 - DNA, 16 bp, Homo sapiens
agattctctgtgtcta

SEQ ID NO: 5188494 - DNA, 19 bp, Homo sapiens
agattctctgtgtctaaga

SEQ ID NO: 5188495 - DNA, 23 bp, Homo sapiens
agattctctgtgtctaagattct

SEQ ID NO: 5188496 - DNA, 13 bp, Homo sapiens
agattctcttgaa

SEQ ID NO: 5188497 - DNA, 13 bp, Homo sapiens
agattctctttaa

SEQ ID NO: 5188498 - DNA, 11 bp, Homo sapiens
agattctgaag

SEQ ID NO: 5188499 - DNA, 15 bp, Homo sapiens
agattctgacattta

SEQ ID NO: 5188500 - DNA, 18 bp, Homo sapiens
agattctgacatttatat

SEQ ID NO: 5188501 - DNA, 19 bp, Homo sapiens
agattctgacatttatatt

SEQ ID NO: 5188502 - DNA, 22 bp, Homo sapiens
agattctgacatttatatttgt

SEQ ID NO: 5188503 - DNA, 14 bp, Homo sapiens
agattctgagcaaa

SEQ ID NO: 5188504 - DNA, 23 bp, Homo sapiens
agattctgagcaaaggccctggg

SEQ ID NO: 5188505 - DNA, 14 bp, Homo sapiens
agattctgattcag

SEQ ID NO: 5188506 - DNA, 13 bp, Homo sapiens
agattctgcattt

SEQ ID NO: 5188507 - DNA, 21 bp, Homo sapiens
agattctgcctatgtaaaatg

SEQ ID NO: 5188508 - DNA, 14 bp, Homo sapiens
agattctgggaaag

SEQ ID NO: 5188509 - DNA, 16 bp, Homo sapiens
agattctgggaaaggt

SEQ ID NO: 5188510 - DNA, 21 bp, Homo sapiens
agattctgggaaaggtgctca

SEQ ID NO: 5188511 - DNA, 21 bp, Homo sapiens
agattctgggtttgcccagtc

SEQ ID NO: 5188512 - DNA, 19 bp, Homo sapiens
agattctgtgatcttttaa

SEQ ID NO: 5188513 - DNA, 22 bp, Homo sapiens
agattctgtgggcagctggctc

SEQ ID NO: 5188514 - DNA, 23 bp, Homo sapiens
agattctgtgtcagagcccagcc

SEQ ID NO: 5188515 - DNA, 20 bp, Homo sapiens
agattcttccactggctcca

SEQ ID NO: 5188516 - DNA, 22 bp, Homo sapiens
agattcttcccattctccattt

SEQ ID NO: 5188517 - DNA, 14 bp, Homo sapiens
agattcttcctttt

SEQ ID NO: 5188518 - DNA, 11 bp, Homo sapiens
agattcttctt

SEQ ID NO: 5188519 - DNA, 16 bp, Homo sapiens
agattctttaaactac

SEQ ID NO: 5188520 - DNA, 14 bp, Homo sapiens
agattctttaagga

SEQ ID NO: 5188521 - DNA, 16 bp, Homo sapiens
agattctttaaggaga

SEQ ID NO: 5188522 - DNA, 14 bp, Homo sapiens
agattctttattag

SEQ ID NO: 5188523 - DNA, 20 bp, Homo sapiens
agattctttcagttctttgg

SEQ ID NO: 5188524 - DNA, 14 bp, Homo sapiens
agattctttcctga

SEQ ID NO: 5188525 - DNA, 15 bp, Homo sapiens
agattctttcctgag

SEQ ID NO: 5188526 - DNA, 17 bp, Homo sapiens
agattctttgagatagc

SEQ ID NO: 5188527 - DNA, 12 bp, Homo sapiens
agattcttttaa

SEQ ID NO: 5188528 - DNA, 15 bp, Homo sapiens
agattgaaatttatg

SEQ ID NO: 5188529 - DNA, 20 bp, Homo sapiens
agattgaaatttgaactatg

SEQ ID NO: 5188530 - DNA, 12 bp, Homo sapiens
agattgaacttt

SEQ ID NO: 5188531 - DNA, 19 bp, Homo sapiens
agattgaagaatctgcccc

SEQ ID NO: 5188532 - DNA, 19 bp, Homo sapiens
agattgaagtaaactgcag

SEQ ID NO: 5188533 - DNA, 23 bp, Homo sapiens
agattgacctggatggggcaggc

SEQ ID NO: 5188534 - DNA, 19 bp, Homo sapiens
agattgactaactcaaata

SEQ ID NO: 5188535 - DNA, 21 bp, Homo sapiens
agattgactaactcaaataca

SEQ ID NO: 5188536 - DNA, 13 bp, Homo sapiens
agattgagaagcc

SEQ ID NO: 5188537 - DNA, 17 bp, Homo sapiens
agattgagaagccatgt

SEQ ID NO: 5188538 - DNA, 17 bp, Homo sapiens
agattgagaaggagaga

SEQ ID NO: 5188539 - DNA, 18 bp, Homo sapiens
agattgagaaggagagaa

SEQ ID NO: 5188540 - DNA, 19 bp, Homo sapiens
agattgagaaggagagaaa

SEQ ID NO: 5188541 - DNA, 19 bp, Homo sapiens
agattgagagaagagacaa

SEQ ID NO: 5188542 - DNA, 13 bp, Homo sapiens
agattgagagaat

SEQ ID NO: 5188543 - DNA, 22 bp, Homo sapiens
agattgaggcctgccctcaggg

SEQ ID NO: 5188544 - DNA, 18 bp, Homo sapiens
agattgagtaagatttac

SEQ ID NO: 5188545 - DNA, 22 bp, Homo sapiens
agattgagtaagatttacccag

SEQ ID NO: 5188546 - DNA, 17 bp, Homo sapiens
agattgatatctataaa

SEQ ID NO: 5188547 - DNA, 19 bp, Homo sapiens
agattgatatctataaaat

SEQ ID NO: 5188548 - DNA, 20 bp, Homo sapiens
agattgatatctataaaata

SEQ ID NO: 5188549 - DNA, 12 bp, Homo sapiens
agattgcaaagg

SEQ ID NO: 5188550 - DNA, 18 bp, Homo sapiens
agattgcaaagtcgacat

SEQ ID NO: 5188551 - DNA, 21 bp, Homo sapiens
agattgcaaggaaggaaacaa

SEQ ID NO: 5188552 - DNA, 22 bp, Homo sapiens
agcccacaccatctggcccagg

SEQ ID NO: 5188553 - DNA, 18 bp, Homo sapiens
agcccacactatgcacag

SEQ ID NO: 5188554 - DNA, 20 bp, Homo sapiens
agcccacactatgcacagag

SEQ ID NO: 5188555 - DNA, 22 bp, Homo sapiens
agcccacactatgcacagagcc

SEQ ID NO: 5188556 - DNA, 24 bp, Homo sapiens
agcccacactatgcacagagccca

SEQ ID NO: 5188557 - DNA, 15 bp, Homo sapiens
agcccacacttgaga

SEQ ID NO: 5188558 - DNA, 17 bp, Homo sapiens
agcccacacttgagagg

SEQ ID NO: 5188559 - DNA, 15 bp, Homo sapiens
agcccacagaggaca

SEQ ID NO: 5188560 - DNA, 23 bp, Homo sapiens
agcccacagcacagctccctgcc

SEQ ID NO: 5188561 - DNA, 13 bp, Homo sapiens
agcccacagcgag

SEQ ID NO: 5188562 - DNA, 15 bp, Homo sapiens
agcccacagcgagcc

SEQ ID NO: 5188563 - DNA, 17 bp, Homo sapiens
agcccacagcgagcctg

SEQ ID NO: 5188564 - DNA, 24 bp, Homo sapiens
agcccacagcgagcctgtgccttc

SEQ ID NO: 5188565 - DNA, 17 bp, Homo sapiens
agcccacagtgctcagt

SEQ ID NO: 5188566 - DNA, 14 bp, Homo sapiens
agcccacatattct

SEQ ID NO: 5188567 - DNA, 16 bp, Homo sapiens
agcccacatccagtgg

SEQ ID NO: 5188568 - DNA, 21 bp, Homo sapiens
agcccacatccattccagagc

SEQ ID NO: 5188569 - DNA, 22 bp, Homo sapiens
agcccacatccattccagagct

SEQ ID NO: 5188570 - DNA, 23 bp, Homo sapiens
agcccacattggattcatcagca

SEQ ID NO: 5188571 - DNA, 19 bp, Homo sapiens
agcccaccaatctgccctt

SEQ ID NO: 5188572 - DNA, 18 bp, Homo sapiens
agcccaccagccacctca

SEQ ID NO: 5188573 - DNA, 19 bp, Homo sapiens
agcccaccagccacctcat

SEQ ID NO: 5188574 - DNA, 24 bp, Homo sapiens
agcccaccaggagcacctggaccc

SEQ ID NO: 5188575 - DNA, 14 bp, Homo sapiens
agcccaccaggtgt

SEQ ID NO: 5188576 - DNA, 15 bp, Homo sapiens
agcccaccaggtgtc

SEQ ID NO: 5188577 - DNA, 22 bp, Homo sapiens
agcccaccatttggcatccctg

SEQ ID NO: 5188578 - DNA, 13 bp, Homo sapiens
agcccacccccct

SEQ ID NO: 5188579 - DNA, 18 bp, Homo sapiens
agcccacccccctcccca

SEQ ID NO: 5188580 - DNA, 23 bp, Homo sapiens
agcccaccccgtccatggtgcta

SEQ ID NO: 5188581 - DNA, 23 bp, Homo sapiens
agcccacccctcaacacctctgc

SEQ ID NO: 5188582 - DNA, 22 bp, Homo sapiens
agcccaccccttctccatcttt

SEQ ID NO: 5188583 - DNA, 23 bp, Homo sapiens
agcccaccccttctccatctttg

SEQ ID NO: 5188584 - DNA, 16 bp, Homo sapiens
agcccacccgccccag

SEQ ID NO: 5188585 - DNA, 18 bp, Homo sapiens
agcccacccgccccagag

SEQ ID NO: 5188586 - DNA, 19 bp, Homo sapiens
agcccacccgccccagaga

SEQ ID NO: 5188587 - DNA, 16 bp, Homo sapiens
agcccaccctctgtga

SEQ ID NO: 5188588 - DNA, 13 bp, Homo sapiens
agcccaccctgct

SEQ ID NO: 5188589 - DNA, 14 bp, Homo sapiens
agcccaccctgctg

SEQ ID NO: 5188590 - DNA, 19 bp, Homo sapiens
agcccaccctgctgctggt

SEQ ID NO: 5188591 - DNA, 9 bp, Homo sapiens
agcccacct

SEQ ID NO: 5188592 - DNA, 17 bp, Homo sapiens
agcccacctgcacccag

SEQ ID NO: 5188593 - DNA, 15 bp, Homo sapiens
agcccacctgctccc

SEQ ID NO: 5188594 - DNA, 18 bp, Homo sapiens
agcccacctgctcccagg

SEQ ID NO: 5188595 - DNA, 14 bp, Homo sapiens
agcccacctgctgc

SEQ ID NO: 5188596 - DNA, 16 bp, Homo sapiens
agcccacctgggctgg

SEQ ID NO: 5188597 - DNA, 21 bp, Homo sapiens
agcccacctgggttggaggaa

SEQ ID NO: 5188598 - DNA, 13 bp, Homo sapiens
agcccaccttggc

SEQ ID NO: 5188599 - DNA, 17 bp, Homo sapiens
agcccacgcccccactg

SEQ ID NO: 5188600 - DNA, 18 bp, Homo sapiens
agcccacggggcaaagct

SEQ ID NO: 5188601 - DNA, 18 bp, Homo sapiens
agcccacggtctggaggc

SEQ ID NO: 5188602 - DNA, 22 bp, Homo sapiens
agcccacgtcctgtcagtgccg

SEQ ID NO: 5188603 - DNA, 14 bp, Homo sapiens
agcccactctactg

SEQ ID NO: 5188604 - DNA, 21 bp, Homo sapiens
agcccactctactgccccagc

SEQ ID NO: 5188605 - DNA, 22 bp, Homo sapiens
agcccactctactgccccagct

SEQ ID NO: 5188606 - DNA, 13 bp, Homo sapiens
agcccactctgct

SEQ ID NO: 5188607 - DNA, 19 bp, Homo sapiens
agcccactgcccaccccct

SEQ ID NO: 5188608 - DNA, 12 bp, Homo sapiens
agcccactggat

SEQ ID NO: 5188609 - DNA, 14 bp, Homo sapiens
agcccactgtactt

SEQ ID NO: 5188610 - DNA, 15 bp, Homo sapiens
agcccactgtcctgg

SEQ ID NO: 5188611 - DNA, 18 bp, Homo sapiens
agcccagaaagtgataag

SEQ ID NO: 5188612 - DNA, 19 bp, Homo sapiens
agcccagaacaaaaagaaa

SEQ ID NO: 5188613 - DNA, 19 bp, Homo sapiens
agcccagaacgggcctccc

SEQ ID NO: 5188614 - DNA, 12 bp, Homo sapiens
agcccagaagaa

SEQ ID NO: 5188615 - DNA, 14 bp, Homo sapiens
agcccagaaggcca

SEQ ID NO: 5188616 - DNA, 15 bp, Homo sapiens
agcccagaaggccag

SEQ ID NO: 5188617 - DNA, 12 bp, Homo sapiens
agcccagacaaa

SEQ ID NO: 5188618 - DNA, 22 bp, Homo sapiens
agcccagacagcaaggtgtgga

SEQ ID NO: 5188619 - DNA, 18 bp, Homo sapiens
agcccagacccccagtgt

SEQ ID NO: 5188620 - DNA, 15 bp, Homo sapiens
agcccagactttagt

SEQ ID NO: 5188621 - DNA, 22 bp, Homo sapiens
agcccagagacatacttgaagg

SEQ ID NO: 5188622 - DNA, 19 bp, Homo sapiens
agcccagagactgaacggc

SEQ ID NO: 5188623 - DNA, 14 bp, Homo sapiens
agcccagagagacc

SEQ ID NO: 5188624 - DNA, 17 bp, Homo sapiens
agcccagagagaccctg

SEQ ID NO: 5188625 - DNA, 13 bp, Homo sapiens
agcccagagcaga

SEQ ID NO: 5188626 - DNA, 15 bp, Homo sapiens
agcccagagccacct

SEQ ID NO: 5188627 - DNA, 14 bp, Homo sapiens
agcccagagcctgg

SEQ ID NO: 5188628 - DNA, 20 bp, Homo sapiens
agcccagagggccaagagag

SEQ ID NO: 5188629 - DNA, 15 bp, Homo sapiens
agcccagagggtctg

SEQ ID NO: 5188630 - DNA, 13 bp, Homo sapiens
agcccagaggtaa

SEQ ID NO: 5188631 - DNA, 17 bp, Homo sapiens
agcccagaggtaacaga

SEQ ID NO: 5188632 - DNA, 18 bp, Homo sapiens
agcccagaggtaacagaa

SEQ ID NO: 5188633 - DNA, 20 bp, Homo sapiens
agcccagagtccccccactc

SEQ ID NO: 5188634 - DNA, 15 bp, Homo sapiens
agcccagcacactgc

SEQ ID NO: 5188635 - DNA, 16 bp, Homo sapiens
agcccagcacactgct

SEQ ID NO: 5188636 - DNA, 14 bp, Homo sapiens
agcccagcacccct

SEQ ID NO: 5188637 - DNA, 14 bp, Homo sapiens
agcccagcacctgc

SEQ ID NO: 5188638 - DNA, 21 bp, Homo sapiens
agcccagcactgcttgaggaa

SEQ ID NO: 5188639 - DNA, 13 bp, Homo sapiens
agcccagcactgt

SEQ ID NO: 5188640 - DNA, 14 bp, Homo sapiens
agcccagcactgtg

SEQ ID NO: 5188641 - DNA, 15 bp, Homo sapiens
agcccagcactgtga

SEQ ID NO: 5188642 - DNA, 20 bp, Homo sapiens
agcccagcactgtgaagacc

SEQ ID NO: 5188643 - DNA, 19 bp, Homo sapiens
agcccagcagtgtggagac

SEQ ID NO: 5188644 - DNA, 22 bp, Homo sapiens
agcccagcagtgtggagaccct

SEQ ID NO: 5188645 - DNA, 11 bp, Homo sapiens
agcccagccac

SEQ ID NO: 5188646 - DNA, 13 bp, Homo sapiens
agcccagccacct

SEQ ID NO: 5188647 - DNA, 17 bp, Homo sapiens
agcccagccacctccca

SEQ ID NO: 5188648 - DNA, 12 bp, Homo sapiens
agcccagccagc

SEQ ID NO: 5188649 - DNA, 14 bp, Homo sapiens
agcccagccaggcc

SEQ ID NO: 5188650 - DNA, 23 bp, Homo sapiens
agcccagccattaccatggagac

SEQ ID NO: 5188651 - DNA, 16 bp, Homo sapiens
agcccagccccactcc

SEQ ID NO: 5188652 - DNA, 19 bp, Homo sapiens
agcccagcccctactgctg

SEQ ID NO: 5188653 - DNA, 14 bp, Homo sapiens
agcccagcccggct

SEQ ID NO: 5188654 - DNA, 20 bp, Homo sapiens
agcccagcctagcccacttg

SEQ ID NO: 5188655 - DNA, 15 bp, Homo sapiens
agcccagcctctgtc

SEQ ID NO: 5188656 - DNA, 16 bp, Homo sapiens
agcccagcctgagccc

SEQ ID NO: 5188657 - DNA, 17 bp, Homo sapiens
agcccagcctgggagcc

SEQ ID NO: 5188658 - DNA, 22 bp, Homo sapiens
agcccagccttttgagagtaat

SEQ ID NO: 5188659 - DNA, 17 bp, Homo sapiens
agcccagcgccatcctg

SEQ ID NO: 5188660 - DNA, 17 bp, Homo sapiens
agcccagcgctctgcct

SEQ ID NO: 5188661 - DNA, 14 bp, Homo sapiens
agcccagcggccca

SEQ ID NO: 5188662 - DNA, 18 bp, Homo sapiens
agcccagcggcccaagag

SEQ ID NO: 5188663 - DNA, 16 bp, Homo sapiens
agcccagcgtcagaag

SEQ ID NO: 5188664 - DNA, 20 bp, Homo sapiens
agcccagcgtcagaagtcta

SEQ ID NO: 5188665 - DNA, 18 bp, Homo sapiens
agcccagctacattcctc

SEQ ID NO: 5188666 - DNA, 22 bp, Homo sapiens
agcccagctacattcctcagct

SEQ ID NO: 5188667 - DNA, 17 bp, Homo sapiens
agcccagctccactcag

SEQ ID NO: 5188668 - DNA, 20 bp, Homo sapiens
agcccagctccactcagggc

SEQ ID NO: 5188669 - DNA, 17 bp, Homo sapiens
agcccagctccagggcc

SEQ ID NO: 5188670 - DNA, 18 bp, Homo sapiens
agcccagctcctgaataa

SEQ ID NO: 5188671 - DNA, 12 bp, Homo sapiens
agcccagctctt

SEQ ID NO: 5188672 - DNA, 19 bp, Homo sapiens
agcccagctcttgctctct

SEQ ID NO: 5188673 - DNA, 20 bp, Homo sapiens
agcccagctgctctgcccag

SEQ ID NO: 5188674 - DNA, 21 bp, Homo sapiens
agcccagctggccggaaggag

SEQ ID NO: 5188675 - DNA, 17 bp, Homo sapiens
agcccagctgggtcagg

SEQ ID NO: 5188676 - DNA, 14 bp, Homo sapiens
agcccagcttcctg

SEQ ID NO: 5188677 - DNA, 23 bp, Homo sapiens
agcccagcttggccctttccttc

SEQ ID NO: 5188678 - DNA, 21 bp, Homo sapiens
agcccaggaaaaactggaagc

SEQ ID NO: 5188679 - DNA, 14 bp, Homo sapiens
agcccaggaaaggc

SEQ ID NO: 5188680 - DNA, 18 bp, Homo sapiens
agcccaggaaaggctcca

SEQ ID NO: 5188681 - DNA, 20 bp, Homo sapiens
agcccaggaaaggctccagg

SEQ ID NO: 5188682 - DNA, 23 bp, Homo sapiens
agcccaggaaaggctccaggagc

SEQ ID NO: 5188683 - DNA, 24 bp, Homo sapiens
agcccaggaatttgaagctgcagt

SEQ ID NO: 5188684 - DNA, 20 bp, Homo sapiens
agcccaggacactgcctttg

SEQ ID NO: 5188685 - DNA, 15 bp, Homo sapiens
agcccaggagagaga

SEQ ID NO: 5188686 - DNA, 16 bp, Homo sapiens
agcccaggagagagaa

SEQ ID NO: 5188687 - DNA, 18 bp, Homo sapiens
agcccaggagagagaaag

SEQ ID NO: 5188688 - DNA, 19 bp, Homo sapiens
agcccaggagagagaaagc

SEQ ID NO: 5188689 - DNA, 13 bp, Homo sapiens
agcccaggagcaa

SEQ ID NO: 5188690 - DNA, 12 bp, Homo sapiens
agcccaggagct

SEQ ID NO: 5188691 - DNA, 14 bp, Homo sapiens
agcccaggagctcc

SEQ ID NO: 5188692 - DNA, 16 bp, Homo sapiens
agcccaggaggacctg

SEQ ID NO: 5188693 - DNA, 17 bp, Homo sapiens
agcccaggaggactgcc

SEQ ID NO: 5188694 - DNA, 23 bp, Homo sapiens
agcccaggagggcatccatacca

SEQ ID NO: 5188695 - DNA, 15 bp, Homo sapiens
agcccaggagttcga

SEQ ID NO: 5188696 - DNA, 19 bp, Homo sapiens
agcccaggagtttgaggct

SEQ ID NO: 5188697 - DNA, 18 bp, Homo sapiens
agcccaggatatatttta

SEQ ID NO: 5188698 - DNA, 12 bp, Homo sapiens
agcccaggatct

SEQ ID NO: 5188699 - DNA, 13 bp, Homo sapiens
agcccaggatctc

SEQ ID NO: 5188700 - DNA, 18 bp, Homo sapiens
agcccaggcatctccttg

SEQ ID NO: 5188701 - DNA, 19 bp, Homo sapiens
agcccaggcatctccttgg

SEQ ID NO: 5188702 - DNA, 11 bp, Homo sapiens
agcccaggcca

SEQ ID NO: 5188703 - DNA, 13 bp, Homo sapiens
agcccaggccagg

SEQ ID NO: 5188704 - DNA, 14 bp, Homo sapiens
agcccaggccagga

SEQ ID NO: 5188705 - DNA, 15 bp, Homo sapiens
agcccaggccaggac

SEQ ID NO: 5188706 - DNA, 22 bp, Homo sapiens
agcccaggccaggactctgcag

SEQ ID NO: 5188707 - DNA, 13 bp, Homo sapiens
agcccaggccgtt

SEQ ID NO: 5188708 - DNA, 18 bp, Homo sapiens
agcccaggcctccagctc

SEQ ID NO: 5188709 - DNA, 21 bp, Homo sapiens
agcccaggcctcctacagctt

SEQ ID NO: 5188710 - DNA, 13 bp, Homo sapiens
agcccaggcctgg

SEQ ID NO: 5188711 - DNA, 15 bp, Homo sapiens
agcccaggcctggcc

SEQ ID NO: 5188712 - DNA, 17 bp, Homo sapiens
agcccaggcctggcctc

SEQ ID NO: 5188713 - DNA, 18 bp, Homo sapiens
agcccaggcctggcctcg

SEQ ID NO: 5188714 - DNA, 14 bp, Homo sapiens
agcccaggcctggt

SEQ ID NO: 5188715 - DNA, 15 bp, Homo sapiens
agcccaggcctggtg

SEQ ID NO: 5188716 - DNA, 23 bp, Homo sapiens
agcccaggctcggaggaccctgg

SEQ ID NO: 5188717 - DNA, 19 bp, Homo sapiens
agcccaggctgatgcttga

SEQ ID NO: 5188718 - DNA, 13 bp, Homo sapiens
agcccaggctgga

SEQ ID NO: 5188719 - DNA, 19 bp, Homo sapiens
agcccaggctggagatcct

SEQ ID NO: 5188720 - DNA, 20 bp, Homo sapiens
agcccaggctggagtgcaat

SEQ ID NO: 5188721 - DNA, 15 bp, Homo sapiens
agcccaggcttcctg

SEQ ID NO: 5188722 - DNA, 22 bp, Homo sapiens
agcccagggagcggaaagcagc

SEQ ID NO: 5188723 - DNA, 16 bp, Homo sapiens
agcccagggcaccatc

SEQ ID NO: 5188724 - DNA, 19 bp, Homo sapiens
agcccagggcatcttgctg

SEQ ID NO: 5188725 - DNA, 22 bp, Homo sapiens
agcccagggcatcttgctggct

SEQ ID NO: 5188726 - DNA, 13 bp, Homo sapiens
agcccagggcctg

SEQ ID NO: 5188727 - DNA, 14 bp, Homo sapiens
agcccagggcctgc

SEQ ID NO: 5188728 - DNA, 16 bp, Homo sapiens
agcccagggtgctggg

SEQ ID NO: 5188729 - DNA, 17 bp, Homo sapiens
agcccagggtgctggga

SEQ ID NO: 5188730 - DNA, 23 bp, Homo sapiens
agcccagggttcccccagccctg

SEQ ID NO: 5188731 - DNA, 12 bp, Homo sapiens
agattgcactgc

SEQ ID NO: 5188732 - DNA, 16 bp, Homo sapiens
agattgcagaaaattc

SEQ ID NO: 5188733 - DNA, 18 bp, Homo sapiens
agattgcagaaaattctg

SEQ ID NO: 5188734 - DNA, 20 bp, Homo sapiens
agattgcagaaaattctgtg

SEQ ID NO: 5188735 - DNA, 21 bp, Homo sapiens
agattgcagaaaattctgtgc

SEQ ID NO: 5188736 - DNA, 23 bp, Homo sapiens
agattgcatgtgactctgaagct

SEQ ID NO: 5188737 - DNA, 22 bp, Homo sapiens
agattgccccataacatagttt

SEQ ID NO: 5188738 - DNA, 16 bp, Homo sapiens
agattgcgccactgca

SEQ ID NO: 5188739 - DNA, 13 bp, Homo sapiens
agattgctaattg

SEQ ID NO: 5188740 - DNA, 19 bp, Homo sapiens
agattgctaattgctgttg

SEQ ID NO: 5188741 - DNA, 13 bp, Homo sapiens
agattgctgaaat

SEQ ID NO: 5188742 - DNA, 14 bp, Homo sapiens
agattgctgaaatt

SEQ ID NO: 5188743 - DNA, 22 bp, Homo sapiens
agattgctgaatcccatcaggc

SEQ ID NO: 5188744 - DNA, 21 bp, Homo sapiens
agattgctggaaaccaagtca

SEQ ID NO: 5188745 - DNA, 22 bp, Homo sapiens
agattgctggaaaccaagtcag

SEQ ID NO: 5188746 - DNA, 15 bp, Homo sapiens
agattgcttaaaata

SEQ ID NO: 5188747 - DNA, 16 bp, Homo sapiens
agattggaaaagggca

SEQ ID NO: 5188748 - DNA, 15 bp, Homo sapiens
agattggaaggagac

SEQ ID NO: 5188749 - DNA, 20 bp, Homo sapiens
agattggaaggagacacaga

SEQ ID NO: 5188750 - DNA, 17 bp, Homo sapiens
agattggagctgaagac

SEQ ID NO: 5188751 - DNA, 14 bp, Homo sapiens
agattggagtcaga

SEQ ID NO: 5188752 - DNA, 16 bp, Homo sapiens
agattggagtcagagg

SEQ ID NO: 5188753 - DNA, 22 bp, Homo sapiens
agattggcacccctttctagtt

SEQ ID NO: 5188754 - DNA, 21 bp, Homo sapiens
agattggccaattaaaaacga

SEQ ID NO: 5188755 - DNA, 22 bp, Homo sapiens
agattggctcacactgagaatg

SEQ ID NO: 5188756 - DNA, 17 bp, Homo sapiens
agattggcttgtctcac

SEQ ID NO: 5188757 - DNA, 18 bp, Homo sapiens
agattggctttgccttta

SEQ ID NO: 5188758 - DNA, 21 bp, Homo sapiens
agattgggactgagtgctgag

SEQ ID NO: 5188759 - DNA, 22 bp, Homo sapiens
agattgggagaagtggaaattt

SEQ ID NO: 5188760 - DNA, 20 bp, Homo sapiens
agattgggagacaattagca

SEQ ID NO: 5188761 - DNA, 18 bp, Homo sapiens
agattgggcggggcttct

SEQ ID NO: 5188762 - DNA, 16 bp, Homo sapiens
agattgggctggctct

SEQ ID NO: 5188763 - DNA, 22 bp, Homo sapiens
agattgggctggctctgaagcc

SEQ ID NO: 5188764 - DNA, 16 bp, Homo sapiens
agattgggggggcttg

SEQ ID NO: 5188765 - DNA, 21 bp, Homo sapiens
agattggtgggattttttgtt

SEQ ID NO: 5188766 - DNA, 19 bp, Homo sapiens
agattggtgtttttttcta

SEQ ID NO: 5188767 - DNA, 18 bp, Homo sapiens
agattggttcatgcctgg

SEQ ID NO: 5188768 - DNA, 20 bp, Homo sapiens
agattggttcatgcctgggg

SEQ ID NO: 5188769 - DNA, 16 bp, Homo sapiens
agattggttgcctctg

SEQ ID NO: 5188770 - DNA, 15 bp, Homo sapiens
agattggttttcctg

SEQ ID NO: 5188771 - DNA, 11 bp, Homo sapiens
agattgtaaac

SEQ ID NO: 5188772 - DNA, 22 bp, Homo sapiens
agattgtaaaccgctttggcct

SEQ ID NO: 5188773 - DNA, 12 bp, Homo sapiens
agattgtaattc

SEQ ID NO: 5188774 - DNA, 20 bp, Homo sapiens
agattgtaattcagaaaaca

SEQ ID NO: 5188775 - DNA, 13 bp, Homo sapiens
agattgtacattt

SEQ ID NO: 5188776 - DNA, 14 bp, Homo sapiens
agattgtacatttt

SEQ ID NO: 5188777 - DNA, 14 bp, Homo sapiens
agattgtactgttc

SEQ ID NO: 5188778 - DNA, 16 bp, Homo sapiens
agattgtatctcttaa

SEQ ID NO: 5188779 - DNA, 14 bp, Homo sapiens
agattgtatctgaa

SEQ ID NO: 5188780 - DNA, 15 bp, Homo sapiens
agattgtattgctgt

SEQ ID NO: 5188781 - DNA, 17 bp, Homo sapiens
agattgtccttttctcc

SEQ ID NO: 5188782 - DNA, 17 bp, Homo sapiens
agattgtcttaatttct

SEQ ID NO: 5188783 - DNA, 13 bp, Homo sapiens
agattgtcttgca

SEQ ID NO: 5188784 - DNA, 20 bp, Homo sapiens
agattgtgatcccttgagat

SEQ ID NO: 5188785 - DNA, 20 bp, Homo sapiens
agattgtgccactgctctcc

SEQ ID NO: 5188786 - DNA, 19 bp, Homo sapiens
agattgtggggagagaaat

SEQ ID NO: 5188787 - DNA, 18 bp, Homo sapiens
agattgtgggggaaaaat

SEQ ID NO: 5188788 - DNA, 13 bp, Homo sapiens
agattgtgtaaca

SEQ ID NO: 5188789 - DNA, 23 bp, Homo sapiens
agattgtgtacatagagcaatgt

SEQ ID NO: 5188790 - DNA, 14 bp, Homo sapiens
agattgttaaaata

SEQ ID NO: 5188791 - DNA, 15 bp, Homo sapiens
agattgttaaaataa

SEQ ID NO: 5188792 - DNA, 19 bp, Homo sapiens
agattgttaaattcaatgc

SEQ ID NO: 5188793 - DNA, 20 bp, Homo sapiens
agattgttaagggcattttt

SEQ ID NO: 5188794 - DNA, 21 bp, Homo sapiens
agattgttaattcctcagtta

SEQ ID NO: 5188795 - DNA, 13 bp, Homo sapiens
agattgttagata

SEQ ID NO: 5188796 - DNA, 16 bp, Homo sapiens
agattgttattaaatg

SEQ ID NO: 5188797 - DNA, 18 bp, Homo sapiens
agattgtttatctagatg

SEQ ID NO: 5188798 - DNA, 19 bp, Homo sapiens
agattgtttcctcttccaa

SEQ ID NO: 5188799 - DNA, 14 bp, Homo sapiens
agattgtttctata

SEQ ID NO: 5188800 - DNA, 13 bp, Homo sapiens
agattgttttcag

SEQ ID NO: 5188801 - DNA, 12 bp, Homo sapiens
agattgttttgc

SEQ ID NO: 5188802 - DNA, 16 bp, Homo sapiens
agattgttttgccact

SEQ ID NO: 5188803 - DNA, 20 bp, Homo sapiens
agatttaaaggcagacagtt

SEQ ID NO: 5188804 - DNA, 22 bp, Homo sapiens
agatttaaagtgccttatcaaa

SEQ ID NO: 5188805 - DNA, 12 bp, Homo sapiens
agatttaacaaa

SEQ ID NO: 5188806 - DNA, 21 bp, Homo sapiens
agatttaagccttgacacact

SEQ ID NO: 5188807 - DNA, 22 bp, Homo sapiens
agatttaagtgaatacattaac

SEQ ID NO: 5188808 - DNA, 18 bp, Homo sapiens
agatttaatattacagat

SEQ ID NO: 5188809 - DNA, 16 bp, Homo sapiens
agatttaatgatgctt

SEQ ID NO: 5188810 - DNA, 11 bp, Homo sapiens
agatttacatt

SEQ ID NO: 5188811 - DNA, 20 bp, Homo sapiens
agatttaccagggatgtaga

SEQ ID NO: 5188812 - DNA, 18 bp, Homo sapiens
agatttagggtactttta

SEQ ID NO: 5188813 - DNA, 19 bp, Homo sapiens
agatttagtgtaataagac

SEQ ID NO: 5188814 - DNA, 22 bp, Homo sapiens
agatttataaatgcactgtaat

SEQ ID NO: 5188815 - DNA, 17 bp, Homo sapiens
agatttatataaatgta

SEQ ID NO: 5188816 - DNA, 13 bp, Homo sapiens
agatttatcttta

SEQ ID NO: 5188817 - DNA, 17 bp, Homo sapiens
agatttatctttataca

SEQ ID NO: 5188818 - DNA, 19 bp, Homo sapiens
agatttattaaagaaaaaa

SEQ ID NO: 5188819 - DNA, 12 bp, Homo sapiens
agatttattaga

SEQ ID NO: 5188820 - DNA, 15 bp, Homo sapiens
agatttattcctttg

SEQ ID NO: 5188821 - DNA, 17 bp, Homo sapiens
agatttattcctttgtt

SEQ ID NO: 5188822 - DNA, 18 bp, Homo sapiens
agatttatttagctattt

SEQ ID NO: 5188823 - DNA, 18 bp, Homo sapiens
agatttatttttaatatg

SEQ ID NO: 5188824 - DNA, 21 bp, Homo sapiens
agatttatttttcagttccaa

SEQ ID NO: 5188825 - DNA, 21 bp, Homo sapiens
agatttcaaattaatctttct

SEQ ID NO: 5188826 - DNA, 17 bp, Homo sapiens
agatttcaagaaaaaat

SEQ ID NO: 5188827 - DNA, 19 bp, Homo sapiens
agatttcaagaaaaaataa

SEQ ID NO: 5188828 - DNA, 14 bp, Homo sapiens
agatttcaagagat

SEQ ID NO: 5188829 - DNA, 18 bp, Homo sapiens
agatttcacaggtcttgc

SEQ ID NO: 5188830 - DNA, 14 bp, Homo sapiens
agatttcactctcc

SEQ ID NO: 5188831 - DNA, 17 bp, Homo sapiens
agatttcactctccttg

SEQ ID NO: 5188832 - DNA, 19 bp, Homo sapiens
agatttcagaggctgcagg

SEQ ID NO: 5188833 - DNA, 17 bp, Homo sapiens
agatttcagggagacaa

SEQ ID NO: 5188834 - DNA, 14 bp, Homo sapiens
agatttcaggtgta

SEQ ID NO: 5188835 - DNA, 16 bp, Homo sapiens
agatttcagtaatgtc

SEQ ID NO: 5188836 - DNA, 17 bp, Homo sapiens
agatttcagtcttttcc

SEQ ID NO: 5188837 - DNA, 12 bp, Homo sapiens
agatttcatagt

SEQ ID NO: 5188838 - DNA, 23 bp, Homo sapiens
agatttcatatctaactttgtaa

SEQ ID NO: 5188839 - DNA, 13 bp, Homo sapiens
agatttcatctgc

SEQ ID NO: 5188840 - DNA, 15 bp, Homo sapiens
agatttcatctgctc

SEQ ID NO: 5188841 - DNA, 23 bp, Homo sapiens
agatttcatctgctctccttcct

SEQ ID NO: 5188842 - DNA, 18 bp, Homo sapiens
agatttccatataaatat

SEQ ID NO: 5188843 - DNA, 17 bp, Homo sapiens
agatttcctccatggtg

SEQ ID NO: 5188844 - DNA, 13 bp, Homo sapiens
agatttcctcctg

SEQ ID NO: 5188845 - DNA, 20 bp, Homo sapiens
agatttccttaaaatctcta

SEQ ID NO: 5188846 - DNA, 16 bp, Homo sapiens
agatttccttcttttt

SEQ ID NO: 5188847 - DNA, 21 bp, Homo sapiens
agatttccttctttttttctt

SEQ ID NO: 5188848 - DNA, 12 bp, Homo sapiens
agatttcctttg

SEQ ID NO: 5188849 - DNA, 14 bp, Homo sapiens
agatttctaagtta

SEQ ID NO: 5188850 - DNA, 18 bp, Homo sapiens
agatttctacactttata

SEQ ID NO: 5188851 - DNA, 13 bp, Homo sapiens
agatttctagaaa

SEQ ID NO: 5188852 - DNA, 14 bp, Homo sapiens
agatttctagcagt

SEQ ID NO: 5188853 - DNA, 14 bp, Homo sapiens
agatttctctttga

SEQ ID NO: 5188854 - DNA, 15 bp, Homo sapiens
agatttctctttgaa

SEQ ID NO: 5188855 - DNA, 15 bp, Homo sapiens
agatttctgacatca

SEQ ID NO: 5188856 - DNA, 19 bp, Homo sapiens
agatttctgattttatgta

SEQ ID NO: 5188857 - DNA, 22 bp, Homo sapiens
agatttctgattttatgtaaaa

SEQ ID NO: 5188858 - DNA, 13 bp, Homo sapiens
agatttctggttg

SEQ ID NO: 5188859 - DNA, 11 bp, Homo sapiens
agatttctgtt

SEQ ID NO: 5188860 - DNA, 12 bp, Homo sapiens
agatttctgttc

SEQ ID NO: 5188861 - DNA, 17 bp, Homo sapiens
agatttcttaaatcttt

SEQ ID NO: 5188862 - DNA, 18 bp, Homo sapiens
agatttcttaatgtctgt

SEQ ID NO: 5188863 - DNA, 23 bp, Homo sapiens
agatttcttaatgtctgtcagaa

SEQ ID NO: 5188864 - DNA, 13 bp, Homo sapiens
agatttcttttaa

SEQ ID NO: 5188865 - DNA, 20 bp, Homo sapiens
agatttcttttttatgtgat

SEQ ID NO: 5188866 - DNA, 17 bp, Homo sapiens
agatttgaaaaactttt

SEQ ID NO: 5188867 - DNA, 14 bp, Homo sapiens
agatttgaaaacaa

SEQ ID NO: 5188868 - DNA, 15 bp, Homo sapiens
agatttgaaaacaaa

SEQ ID NO: 5188869 - DNA, 20 bp, Homo sapiens
agatttgaaaacaaacttct

SEQ ID NO: 5188870 - DNA, 22 bp, Homo sapiens
agatttgaaaagaacagaagga

SEQ ID NO: 5188871 - DNA, 13 bp, Homo sapiens
agatttgaaaatt

SEQ ID NO: 5188872 - DNA, 16 bp, Homo sapiens
agatttgaaggtctgc

SEQ ID NO: 5188873 - DNA, 14 bp, Homo sapiens
agatttgaccaaat

SEQ ID NO: 5188874 - DNA, 12 bp, Homo sapiens
agatttgacctc

SEQ ID NO: 5188875 - DNA, 15 bp, Homo sapiens
agatttgacctcctc

SEQ ID NO: 5188876 - DNA, 21 bp, Homo sapiens
agatttgatatatgtatcttt

SEQ ID NO: 5188877 - DNA, 22 bp, Homo sapiens
agatttgctttaccttcctgat

SEQ ID NO: 5188878 - DNA, 15 bp, Homo sapiens
agatttggaaaattc

SEQ ID NO: 5188879 - DNA, 12 bp, Homo sapiens
agatttggaata

SEQ ID NO: 5188880 - DNA, 23 bp, Homo sapiens
agatttggagactttgttcctta

SEQ ID NO: 5188881 - DNA, 13 bp, Homo sapiens
agatttgggctgg

SEQ ID NO: 5188882 - DNA, 20 bp, Homo sapiens
agatttggtgaatttgaatc

SEQ ID NO: 5188883 - DNA, 13 bp, Homo sapiens
agatttgtaatta

SEQ ID NO: 5188884 - DNA, 16 bp, Homo sapiens
agatttgtacatatta

SEQ ID NO: 5188885 - DNA, 23 bp, Homo sapiens
agatttgtaggaaggtctcattc

SEQ ID NO: 5188886 - DNA, 20 bp, Homo sapiens
agatttgtatttatattaga

SEQ ID NO: 5188887 - DNA, 13 bp, Homo sapiens
agatttgtccttt

SEQ ID NO: 5188888 - DNA, 21 bp, Homo sapiens
agatttgtccttttatttctc

SEQ ID NO: 5188889 - DNA, 20 bp, Homo sapiens
agatttgtctacttgctcca

SEQ ID NO: 5188890 - DNA, 15 bp, Homo sapiens
agatttgtgaactca

SEQ ID NO: 5188891 - DNA, 22 bp, Homo sapiens
agatttgtgaactcagccaagc

SEQ ID NO: 5188892 - DNA, 18 bp, Homo sapiens
agatttgttactgtattt

SEQ ID NO: 5188893 - DNA, 17 bp, Homo sapiens
agatttgtttttaaact

SEQ ID NO: 5188894 - DNA, 20 bp, Homo sapiens
agatttgtttttaaactgta

SEQ ID NO: 5188895 - DNA, 21 bp, Homo sapiens
agatttgtttttaaactgtac

SEQ ID NO: 5188896 - DNA, 22 bp, Homo sapiens
agatttgtttttaaactgtaca

SEQ ID NO: 5188897 - DNA, 17 bp, Homo sapiens
agatttgtttttgtaga

SEQ ID NO: 5188898 - DNA, 13 bp, Homo sapiens
agattttaaattc

SEQ ID NO: 5188899 - DNA, 19 bp, Homo sapiens
agattttaagaatggtctc

SEQ ID NO: 5188900 - DNA, 18 bp, Homo sapiens
agattttaagtattgttt

SEQ ID NO: 5188901 - DNA, 19 bp, Homo sapiens
agattttaatcaagttgaa

SEQ ID NO: 5188902 - DNA, 19 bp, Homo sapiens
agattttaatttatttgtt

SEQ ID NO: 5188903 - DNA, 18 bp, Homo sapiens
agattttacaaaagatgt

SEQ ID NO: 5188904 - DNA, 13 bp, Homo sapiens
agattttacatga

SEQ ID NO: 5188905 - DNA, 14 bp, Homo sapiens
agattttactttaa

SEQ ID NO: 5188906 - DNA, 14 bp, Homo sapiens
agattttagactta

SEQ ID NO: 5188907 - DNA, 19 bp, Homo sapiens
agattttagcatgatgaaa

SEQ ID NO: 5188908 - DNA, 20 bp, Homo sapiens
agattttaggaaatgaatgt

SEQ ID NO: 5188909 - DNA, 15 bp, Homo sapiens
agattttaggtgttg

SEQ ID NO: 5188910 - DNA, 15 bp, Homo sapiens
agattttagttttat

SEQ ID NO: 5188911 - DNA, 17 bp, Homo sapiens
agcccaggtcagctgtt

SEQ ID NO: 5188912 - DNA, 14 bp, Homo sapiens
agcccaggtcccag

SEQ ID NO: 5188913 - DNA, 15 bp, Homo sapiens
agcccaggtcccagt

SEQ ID NO: 5188914 - DNA, 17 bp, Homo sapiens
agcccagtccctggagc

SEQ ID NO: 5188915 - DNA, 18 bp, Homo sapiens
agcccagtccctggagct

SEQ ID NO: 5188916 - DNA, 20 bp, Homo sapiens
agcccagtccctggagctgt

SEQ ID NO: 5188917 - DNA, 15 bp, Homo sapiens
agcccagtcgagacc

SEQ ID NO: 5188918 - DNA, 18 bp, Homo sapiens
agcccagtcgagacctca

SEQ ID NO: 5188919 - DNA, 17 bp, Homo sapiens
agcccagtgaagcctct

SEQ ID NO: 5188920 - DNA, 14 bp, Homo sapiens
agcccagtgacctg

SEQ ID NO: 5188921 - DNA, 16 bp, Homo sapiens
agcccagtgacctgac

SEQ ID NO: 5188922 - DNA, 18 bp, Homo sapiens
agcccagtgaccttactc

SEQ ID NO: 5188923 - DNA, 16 bp, Homo sapiens
agcccagtgctgctgt

SEQ ID NO: 5188924 - DNA, 14 bp, Homo sapiens
agcccagtgcttct

SEQ ID NO: 5188925 - DNA, 15 bp, Homo sapiens
agcccagtgggctgc

SEQ ID NO: 5188926 - DNA, 21 bp, Homo sapiens
agcccagtgggctgcacgctc

SEQ ID NO: 5188927 - DNA, 15 bp, Homo sapiens
agcccagtggtgagg

SEQ ID NO: 5188928 - DNA, 21 bp, Homo sapiens
agcccataaagtctgagaaat

SEQ ID NO: 5188929 - DNA, 23 bp, Homo sapiens
agcccataaagtctgagaaatag

SEQ ID NO: 5188930 - DNA, 21 bp, Homo sapiens
agcccataaggccagaaactc

SEQ ID NO: 5188931 - DNA, 15 bp, Homo sapiens
agcccatactcagcc

SEQ ID NO: 5188932 - DNA, 17 bp, Homo sapiens
agcccatactcagcctg

SEQ ID NO: 5188933 - DNA, 14 bp, Homo sapiens
agcccatcacctct

SEQ ID NO: 5188934 - DNA, 18 bp, Homo sapiens
agcccatccaaacactga

SEQ ID NO: 5188935 - DNA, 22 bp, Homo sapiens
agcccatccatagtaactgaca

SEQ ID NO: 5188936 - DNA, 23 bp, Homo sapiens
agcccatccattaggccagcaac

SEQ ID NO: 5188937 - DNA, 18 bp, Homo sapiens
agcccatcccctgcctct

SEQ ID NO: 5188938 - DNA, 17 bp, Homo sapiens
agcccatccctgcctgg

SEQ ID NO: 5188939 - DNA, 16 bp, Homo sapiens
agcccatcctgaccag

SEQ ID NO: 5188940 - DNA, 20 bp, Homo sapiens
agcccatctctccagagagc

SEQ ID NO: 5188941 - DNA, 17 bp, Homo sapiens
agcccatcttgcctcca

SEQ ID NO: 5188942 - DNA, 19 bp, Homo sapiens
agcccatgctggctggggc

SEQ ID NO: 5188943 - DNA, 17 bp, Homo sapiens
agcccatggacttcaca

SEQ ID NO: 5188944 - DNA, 15 bp, Homo sapiens
agcccatggaggcag

SEQ ID NO: 5188945 - DNA, 19 bp, Homo sapiens
agcccatggaggcagatgc

SEQ ID NO: 5188946 - DNA, 17 bp, Homo sapiens
agcccatggcccccaat

SEQ ID NO: 5188947 - DNA, 19 bp, Homo sapiens
agcccatggcccccaataa

SEQ ID NO: 5188948 - DNA, 19 bp, Homo sapiens
agcccatggccctcccagt

SEQ ID NO: 5188949 - DNA, 16 bp, Homo sapiens
agcccatggccctgtg

SEQ ID NO: 5188950 - DNA, 14 bp, Homo sapiens
agcccatgtcttct

SEQ ID NO: 5188951 - DNA, 17 bp, Homo sapiens
agcccatgtcttctgct

SEQ ID NO: 5188952 - DNA, 21 bp, Homo sapiens
agcccatgtggagtcagcctc

SEQ ID NO: 5188953 - DNA, 19 bp, Homo sapiens
agcccatgttctgccccca

SEQ ID NO: 5188954 - DNA, 23 bp, Homo sapiens
agcccatgttctgcccccagccc

SEQ ID NO: 5188955 - DNA, 17 bp, Homo sapiens
agcccattaatcttgat

SEQ ID NO: 5188956 - DNA, 14 bp, Homo sapiens
agcccattcattcc

SEQ ID NO: 5188957 - DNA, 14 bp, Homo sapiens
agcccattcccacc

SEQ ID NO: 5188958 - DNA, 15 bp, Homo sapiens
agcccattctctctc

SEQ ID NO: 5188959 - DNA, 16 bp, Homo sapiens
agcccattggccgagc

SEQ ID NO: 5188960 - DNA, 19 bp, Homo sapiens
agcccattggccgagctcc

SEQ ID NO: 5188961 - DNA, 21 bp, Homo sapiens
agcccattggccgagctcctg

SEQ ID NO: 5188962 - DNA, 16 bp, Homo sapiens
agcccattgtggccta

SEQ ID NO: 5188963 - DNA, 14 bp, Homo sapiens
agcccatttctcca

SEQ ID NO: 5188964 - DNA, 16 bp, Homo sapiens
agcccatttctccaga

SEQ ID NO: 5188965 - DNA, 19 bp, Homo sapiens
agcccatttctccagaacc

SEQ ID NO: 5188966 - DNA, 17 bp, Homo sapiens
agcccatttggagggcc

SEQ ID NO: 5188967 - DNA, 22 bp, Homo sapiens
agcccatttgggcagagaggct

SEQ ID NO: 5188968 - DNA, 19 bp, Homo sapiens
agcccattttatctttgaa

SEQ ID NO: 5188969 - DNA, 16 bp, Homo sapiens
agccccaaaactctcc

SEQ ID NO: 5188970 - DNA, 20 bp, Homo sapiens
agccccaaaactctcctctg

SEQ ID NO: 5188971 - DNA, 21 bp, Homo sapiens
agccccaaaactctcctctgc

SEQ ID NO: 5188972 - DNA, 22 bp, Homo sapiens
agccccaaaccagggtgcatgg

SEQ ID NO: 5188973 - DNA, 21 bp, Homo sapiens
agccccaaattgtcacctgct

SEQ ID NO: 5188974 - DNA, 15 bp, Homo sapiens
agccccaacaacttt

SEQ ID NO: 5188975 - DNA, 21 bp, Homo sapiens
agccccaacccaaacctggag

SEQ ID NO: 5188976 - DNA, 23 bp, Homo sapiens
agccccaacccaaacctggagat

SEQ ID NO: 5188977 - DNA, 15 bp, Homo sapiens
agccccaacctccca

SEQ ID NO: 5188978 - DNA, 20 bp, Homo sapiens
agccccaacgggaaaggaaa

SEQ ID NO: 5188979 - DNA, 16 bp, Homo sapiens
agccccaagaaggctg

SEQ ID NO: 5188980 - DNA, 17 bp, Homo sapiens
agccccaagaaggctgg

SEQ ID NO: 5188981 - DNA, 15 bp, Homo sapiens
agccccaagactctg

SEQ ID NO: 5188982 - DNA, 17 bp, Homo sapiens
agccccaagactctgct

SEQ ID NO: 5188983 - DNA, 18 bp, Homo sapiens
agccccaagactctgctc

SEQ ID NO: 5188984 - DNA, 20 bp, Homo sapiens
agccccaagactctgctctc

SEQ ID NO: 5188985 - DNA, 21 bp, Homo sapiens
agccccaagactctgctctcc

SEQ ID NO: 5188986 - DNA, 18 bp, Homo sapiens
agccccaagccatggtga

SEQ ID NO: 5188987 - DNA, 13 bp, Homo sapiens
agccccaagctgg

SEQ ID NO: 5188988 - DNA, 15 bp, Homo sapiens
agccccaagctgggc

SEQ ID NO: 5188989 - DNA, 19 bp, Homo sapiens
agccccaagctgggccgag

SEQ ID NO: 5188990 - DNA, 16 bp, Homo sapiens
agccccaagggctggg

SEQ ID NO: 5188991 - DNA, 14 bp, Homo sapiens
agccccaagtcctg

SEQ ID NO: 5188992 - DNA, 17 bp, Homo sapiens
agccccaatatggtggc

SEQ ID NO: 5188993 - DNA, 19 bp, Homo sapiens
agccccaatccagagaagc

SEQ ID NO: 5188994 - DNA, 13 bp, Homo sapiens
agccccacaccct

SEQ ID NO: 5188995 - DNA, 13 bp, Homo sapiens
agccccacagcac

SEQ ID NO: 5188996 - DNA, 17 bp, Homo sapiens
agccccacagcacccag

SEQ ID NO: 5188997 - DNA, 23 bp, Homo sapiens
agccccacagcacccaggctcca

SEQ ID NO: 5188998 - DNA, 17 bp, Homo sapiens
agccccacagcccacgt

SEQ ID NO: 5188999 - DNA, 18 bp, Homo sapiens
agccccacagcccacgtc

SEQ ID NO: 5189000 - DNA, 16 bp, Homo sapiens
agccccacccagaggt

SEQ ID NO: 5189001 - DNA, 15 bp, Homo sapiens
agccccacccaggag

SEQ ID NO: 5189002 - DNA, 20 bp, Homo sapiens
agccccacccaggagggagg

SEQ ID NO: 5189003 - DNA, 20 bp, Homo sapiens
agccccacccaggccaggca

SEQ ID NO: 5189004 - DNA, 11 bp, Homo sapiens
agccccacccc

SEQ ID NO: 5189005 - DNA, 23 bp, Homo sapiens
agccccaccccagggcagccagg

SEQ ID NO: 5189006 - DNA, 17 bp, Homo sapiens
agccccacccccagcca

SEQ ID NO: 5189007 - DNA, 22 bp, Homo sapiens
agccccacccccagccaggcta

SEQ ID NO: 5189008 - DNA, 20 bp, Homo sapiens
agccccacccctaagtgccc

SEQ ID NO: 5189009 - DNA, 19 bp, Homo sapiens
agccccaccctcagatgca

SEQ ID NO: 5189010 - DNA, 16 bp, Homo sapiens
agccccaccctggcct

SEQ ID NO: 5189011 - DNA, 23 bp, Homo sapiens
agccccacctctccaagtctctc

SEQ ID NO: 5189012 - DNA, 11 bp, Homo sapiens
agccccacctt

SEQ ID NO: 5189013 - DNA, 13 bp, Homo sapiens
agccccactcccg

SEQ ID NO: 5189014 - DNA, 16 bp, Homo sapiens
agccccactgccagca

SEQ ID NO: 5189015 - DNA, 18 bp, Homo sapiens
agccccactgccagcagc

SEQ ID NO: 5189016 - DNA, 19 bp, Homo sapiens
agccccactgccagcagca

SEQ ID NO: 5189017 - DNA, 14 bp, Homo sapiens
agccccactgccct

SEQ ID NO: 5189018 - DNA, 21 bp, Homo sapiens
agccccactgccctccagggc

SEQ ID NO: 5189019 - DNA, 22 bp, Homo sapiens
agccccactgccctccagggcc

SEQ ID NO: 5189020 - DNA, 23 bp, Homo sapiens
agccccactgccctccagggcca

SEQ ID NO: 5189021 - DNA, 13 bp, Homo sapiens
agccccacttacc

SEQ ID NO: 5189022 - DNA, 17 bp, Homo sapiens
agccccacttaccgcgt

SEQ ID NO: 5189023 - DNA, 17 bp, Homo sapiens
agccccacttcaccccc

SEQ ID NO: 5189024 - DNA, 18 bp, Homo sapiens
agccccacttcaccccca

SEQ ID NO: 5189025 - DNA, 16 bp, Homo sapiens
agccccagaaaatgaa

SEQ ID NO: 5189026 - DNA, 20 bp, Homo sapiens
agccccagagaaactgccac

SEQ ID NO: 5189027 - DNA, 16 bp, Homo sapiens
agccccagagagagga

SEQ ID NO: 5189028 - DNA, 19 bp, Homo sapiens
agccccagagatgccagcc

SEQ ID NO: 5189029 - DNA, 21 bp, Homo sapiens
agccccagagatgccagccct

SEQ ID NO: 5189030 - DNA, 21 bp, Homo sapiens
agccccagcaccaccaggtct

SEQ ID NO: 5189031 - DNA, 15 bp, Homo sapiens
agccccagcactaac

SEQ ID NO: 5189032 - DNA, 17 bp, Homo sapiens
agccccagcagccctca

SEQ ID NO: 5189033 - DNA, 18 bp, Homo sapiens
agccccagcagccctcaa

SEQ ID NO: 5189034 - DNA, 16 bp, Homo sapiens
agccccagccagccct

SEQ ID NO: 5189035 - DNA, 14 bp, Homo sapiens
agccccagccaggg

SEQ ID NO: 5189036 - DNA, 17 bp, Homo sapiens
agccccagcccagccca

SEQ ID NO: 5189037 - DNA, 12 bp, Homo sapiens
agccccagcccc

SEQ ID NO: 5189038 - DNA, 13 bp, Homo sapiens
agccccagccccg

SEQ ID NO: 5189039 - DNA, 12 bp, Homo sapiens
agccccagcctg

SEQ ID NO: 5189040 - DNA, 14 bp, Homo sapiens
agccccagcctgct

SEQ ID NO: 5189041 - DNA, 17 bp, Homo sapiens
agccccagcctgctagc

SEQ ID NO: 5189042 - DNA, 18 bp, Homo sapiens
agccccagcgggctggcg

SEQ ID NO: 5189043 - DNA, 13 bp, Homo sapiens
agccccagcttcc

SEQ ID NO: 5189044 - DNA, 13 bp, Homo sapiens
agccccagcttgg

SEQ ID NO: 5189045 - DNA, 11 bp, Homo sapiens
agccccaggac

SEQ ID NO: 5189046 - DNA, 11 bp, Homo sapiens
agccccaggca

SEQ ID NO: 5189047 - DNA, 13 bp, Homo sapiens
agccccaggcagg

SEQ ID NO: 5189048 - DNA, 11 bp, Homo sapiens
agccccaggcc

SEQ ID NO: 5189049 - DNA, 17 bp, Homo sapiens
agccccaggccagctgc

SEQ ID NO: 5189050 - DNA, 18 bp, Homo sapiens
agccccaggccagctgcg

SEQ ID NO: 5189051 - DNA, 16 bp, Homo sapiens
agccccaggcccgccc

SEQ ID NO: 5189052 - DNA, 16 bp, Homo sapiens
agccccaggcctctgt

SEQ ID NO: 5189053 - DNA, 14 bp, Homo sapiens
agccccaggcctgg

SEQ ID NO: 5189054 - DNA, 16 bp, Homo sapiens
agccccaggcctggcc

SEQ ID NO: 5189055 - DNA, 17 bp, Homo sapiens
agccccaggcctggcct

SEQ ID NO: 5189056 - DNA, 10 bp, Homo sapiens
agccccaggg

SEQ ID NO: 5189057 - DNA, 13 bp, Homo sapiens
agccccagggccc

SEQ ID NO: 5189058 - DNA, 19 bp, Homo sapiens
agccccagggccctgctca

SEQ ID NO: 5189059 - DNA, 20 bp, Homo sapiens
agccccagggccctgctcag

SEQ ID NO: 5189060 - DNA, 14 bp, Homo sapiens
agccccagggcctg

SEQ ID NO: 5189061 - DNA, 15 bp, Homo sapiens
agccccagggcctgg

SEQ ID NO: 5189062 - DNA, 16 bp, Homo sapiens
agccccaggggacaag

SEQ ID NO: 5189063 - DNA, 18 bp, Homo sapiens
agccccagggtcttccct

SEQ ID NO: 5189064 - DNA, 23 bp, Homo sapiens
agccccagggtcttccctacctc

SEQ ID NO: 5189065 - DNA, 20 bp, Homo sapiens
agccccagtcttccttgtct

SEQ ID NO: 5189066 - DNA, 21 bp, Homo sapiens
agccccagtcttccttgtctc

SEQ ID NO: 5189067 - DNA, 13 bp, Homo sapiens
agccccagtgccc

SEQ ID NO: 5189068 - DNA, 17 bp, Homo sapiens
agccccatccctgtcct

SEQ ID NO: 5189069 - DNA, 11 bp, Homo sapiens
agccccatcct

SEQ ID NO: 5189070 - DNA, 23 bp, Homo sapiens
agccccatcctctgtacagagcc

SEQ ID NO: 5189071 - DNA, 16 bp, Homo sapiens
agccccatcctgtgtt

SEQ ID NO: 5189072 - DNA, 21 bp, Homo sapiens
agccccatccttcccgcagca

SEQ ID NO: 5189073 - DNA, 21 bp, Homo sapiens
agccccatcgccccaactcca

SEQ ID NO: 5189074 - DNA, 18 bp, Homo sapiens
agccccatcgcctgggac

SEQ ID NO: 5189075 - DNA, 17 bp, Homo sapiens
agccccatcggccaaga

SEQ ID NO: 5189076 - DNA, 19 bp, Homo sapiens
agccccatctcatcctggc

SEQ ID NO: 5189077 - DNA, 20 bp, Homo sapiens
agccccatctcatcctggca

SEQ ID NO: 5189078 - DNA, 19 bp, Homo sapiens
agccccatctctcctgctc

SEQ ID NO: 5189079 - DNA, 22 bp, Homo sapiens
agccccatctctcctgctcacc

SEQ ID NO: 5189080 - DNA, 12 bp, Homo sapiens
agccccatctgt

SEQ ID NO: 5189081 - DNA, 13 bp, Homo sapiens
agccccatctgtc

SEQ ID NO: 5189082 - DNA, 14 bp, Homo sapiens
agccccatctgtgc

SEQ ID NO: 5189083 - DNA, 16 bp, Homo sapiens
agccccatctgtgcat

SEQ ID NO: 5189084 - DNA, 17 bp, Homo sapiens
agccccatctgtgcatt

SEQ ID NO: 5189085 - DNA, 23 bp, Homo sapiens
agccccatctgtgcattctcctg

SEQ ID NO: 5189086 - DNA, 20 bp, Homo sapiens
agccccatcttggtcctgtc

SEQ ID NO: 5189087 - DNA, 19 bp, Homo sapiens
agccccatgctggagcctg

SEQ ID NO: 5189088 - DNA, 20 bp, Homo sapiens
agccccatgctggagcctgt

SEQ ID NO: 5189089 - DNA, 21 bp, Homo sapiens
agccccatgctggagcctgtg

SEQ ID NO: 5189090 - DNA, 19 bp, Homo sapiens
agattttatacccttgact

SEQ ID NO: 5189091 - DNA, 19 bp, Homo sapiens
agattttatattttctatt

SEQ ID NO: 5189092 - DNA, 18 bp, Homo sapiens
agattttatgcacagcct

SEQ ID NO: 5189093 - DNA, 18 bp, Homo sapiens
agattttatgtgcttgaa

SEQ ID NO: 5189094 - DNA, 20 bp, Homo sapiens
agattttatgtgcttgaaga

SEQ ID NO: 5189095 - DNA, 19 bp, Homo sapiens
agattttatgtttaaaatg

SEQ ID NO: 5189096 - DNA, 14 bp, Homo sapiens
agattttattatgt

SEQ ID NO: 5189097 - DNA, 16 bp, Homo sapiens
agattttattatgtaa

SEQ ID NO: 5189098 - DNA, 17 bp, Homo sapiens
agattttattatgtaaa

SEQ ID NO: 5189099 - DNA, 18 bp, Homo sapiens
agattttattatgtaaat

SEQ ID NO: 5189100 - DNA, 19 bp, Homo sapiens
agattttattatgtaaatc

SEQ ID NO: 5189101 - DNA, 15 bp, Homo sapiens
agattttattgtata

SEQ ID NO: 5189102 - DNA, 20 bp, Homo sapiens
agattttatttatatcttta

SEQ ID NO: 5189103 - DNA, 16 bp, Homo sapiens
agattttatttatgcg

SEQ ID NO: 5189104 - DNA, 17 bp, Homo sapiens
agattttatttatgcgt

SEQ ID NO: 5189105 - DNA, 18 bp, Homo sapiens
agattttatttgtaattt

SEQ ID NO: 5189106 - DNA, 12 bp, Homo sapiens
agattttcacct

SEQ ID NO: 5189107 - DNA, 17 bp, Homo sapiens
agattttcagaaaatat

SEQ ID NO: 5189108 - DNA, 13 bp, Homo sapiens
agattttcagagg

SEQ ID NO: 5189109 - DNA, 19 bp, Homo sapiens
agattttcagcaaactctt

SEQ ID NO: 5189110 - DNA, 14 bp, Homo sapiens
agattttcatgcaa

SEQ ID NO: 5189111 - DNA, 20 bp, Homo sapiens
agattttcattgaggataaa

SEQ ID NO: 5189112 - DNA, 19 bp, Homo sapiens
agattttcattttagtgta

SEQ ID NO: 5189113 - DNA, 23 bp, Homo sapiens
agattttccacaagattcccaga

SEQ ID NO: 5189114 - DNA, 19 bp, Homo sapiens
agattttccattaactatt

SEQ ID NO: 5189115 - DNA, 14 bp, Homo sapiens
agattttcctattc

SEQ ID NO: 5189116 - DNA, 18 bp, Homo sapiens
agattttcctccattttt

SEQ ID NO: 5189117 - DNA, 23 bp, Homo sapiens
agattttcctccatttttatttc

SEQ ID NO: 5189118 - DNA, 11 bp, Homo sapiens
agattttcctt

SEQ ID NO: 5189119 - DNA, 19 bp, Homo sapiens
agattttccttttttatac

SEQ ID NO: 5189120 - DNA, 20 bp, Homo sapiens
agattttccttttttataca

SEQ ID NO: 5189121 - DNA, 20 bp, Homo sapiens
agattttctaagaaccaaaa

SEQ ID NO: 5189122 - DNA, 23 bp, Homo sapiens
agattttctaaggaatgcacaaa

SEQ ID NO: 5189123 - DNA, 20 bp, Homo sapiens
agattttctattatggaaat

SEQ ID NO: 5189124 - DNA, 20 bp, Homo sapiens
agattttctccacagtgttc

SEQ ID NO: 5189125 - DNA, 19 bp, Homo sapiens
agattttctgctactttgc

SEQ ID NO: 5189126 - DNA, 22 bp, Homo sapiens
agattttctgggcctaaaggat

SEQ ID NO: 5189127 - DNA, 12 bp, Homo sapiens
agattttctggt

SEQ ID NO: 5189128 - DNA, 16 bp, Homo sapiens
agattttctggttcta

SEQ ID NO: 5189129 - DNA, 18 bp, Homo sapiens
agattttctggttctaac

SEQ ID NO: 5189130 - DNA, 19 bp, Homo sapiens
agattttctgtaaatgaag

SEQ ID NO: 5189131 - DNA, 12 bp, Homo sapiens
agattttcttaa

SEQ ID NO: 5189132 - DNA, 17 bp, Homo sapiens
agattttctttaaaaga

SEQ ID NO: 5189133 - DNA, 18 bp, Homo sapiens
agattttctttaaaagaa

SEQ ID NO: 5189134 - DNA, 20 bp, Homo sapiens
agattttctttaaaagaatg

SEQ ID NO: 5189135 - DNA, 13 bp, Homo sapiens
agattttgaaaac

SEQ ID NO: 5189136 - DNA, 12 bp, Homo sapiens
agattttgaatg

SEQ ID NO: 5189137 - DNA, 19 bp, Homo sapiens
agattttgaggtaaagata

SEQ ID NO: 5189138 - DNA, 16 bp, Homo sapiens
agattttgataactgt

SEQ ID NO: 5189139 - DNA, 16 bp, Homo sapiens
agattttggtaatgat

SEQ ID NO: 5189140 - DNA, 15 bp, Homo sapiens
agattttgtatattt

SEQ ID NO: 5189141 - DNA, 21 bp, Homo sapiens
agattttgtatatttaggaaa

SEQ ID NO: 5189142 - DNA, 16 bp, Homo sapiens
agattttgtgaaattt

SEQ ID NO: 5189143 - DNA, 18 bp, Homo sapiens
agattttgtgaaatttca

SEQ ID NO: 5189144 - DNA, 22 bp, Homo sapiens
agattttgtgaaatttcatgaa

SEQ ID NO: 5189145 - DNA, 20 bp, Homo sapiens
agattttgtgcagttaatac

SEQ ID NO: 5189146 - DNA, 22 bp, Homo sapiens
agattttgtgtttattcttgat

SEQ ID NO: 5189147 - DNA, 12 bp, Homo sapiens
agattttgttgt

SEQ ID NO: 5189148 - DNA, 19 bp, Homo sapiens
agatttttaaaaaatattt

SEQ ID NO: 5189149 - DNA, 13 bp, Homo sapiens
agatttttaaagt

SEQ ID NO: 5189150 - DNA, 17 bp, Homo sapiens
agatttttaaattggag

SEQ ID NO: 5189151 - DNA, 13 bp, Homo sapiens
agatttttaagaa

SEQ ID NO: 5189152 - DNA, 13 bp, Homo sapiens
agatttttacaaa

SEQ ID NO: 5189153 - DNA, 20 bp, Homo sapiens
agatttttacactaatatat

SEQ ID NO: 5189154 - DNA, 13 bp, Homo sapiens
agatttttagatt

SEQ ID NO: 5189155 - DNA, 16 bp, Homo sapiens
agatttttagattcct

SEQ ID NO: 5189156 - DNA, 17 bp, Homo sapiens
agatttttatgttttct

SEQ ID NO: 5189157 - DNA, 13 bp, Homo sapiens
agatttttattta

SEQ ID NO: 5189158 - DNA, 20 bp, Homo sapiens
agatttttcatacttttctt

SEQ ID NO: 5189159 - DNA, 22 bp, Homo sapiens
agatttttcatacttttcttac

SEQ ID NO: 5189160 - DNA, 12 bp, Homo sapiens
agatttttcatg

SEQ ID NO: 5189161 - DNA, 14 bp, Homo sapiens
agatttttcatgta

SEQ ID NO: 5189162 - DNA, 13 bp, Homo sapiens
agatttttctcaa

SEQ ID NO: 5189163 - DNA, 22 bp, Homo sapiens
agatttttctgaagggcataca

SEQ ID NO: 5189164 - DNA, 21 bp, Homo sapiens
agatttttgaaaatcctgaat

SEQ ID NO: 5189165 - DNA, 14 bp, Homo sapiens
agatttttgattca

SEQ ID NO: 5189166 - DNA, 13 bp, Homo sapiens
agatttttgcaat

SEQ ID NO: 5189167 - DNA, 14 bp, Homo sapiens
agatttttgcaata

SEQ ID NO: 5189168 - DNA, 18 bp, Homo sapiens
agatttttgctcttctgt

SEQ ID NO: 5189169 - DNA, 19 bp, Homo sapiens
agatttttggtagtttctg

SEQ ID NO: 5189170 - DNA, 14 bp, Homo sapiens
agatttttggtttt

SEQ ID NO: 5189171 - DNA, 21 bp, Homo sapiens
agatttttggttttttgattt

SEQ ID NO: 5189172 - DNA, 16 bp, Homo sapiens
agattttttaaaaaaa

SEQ ID NO: 5189173 - DNA, 20 bp, Homo sapiens
agattttttaaaaaaaatgt

SEQ ID NO: 5189174 - DNA, 16 bp, Homo sapiens
agattttttaaaattt

SEQ ID NO: 5189175 - DNA, 13 bp, Homo sapiens
agattttttaata

SEQ ID NO: 5189176 - DNA, 14 bp, Homo sapiens
agattttttaataa

SEQ ID NO: 5189177 - DNA, 16 bp, Homo sapiens
agattttttaataatt

SEQ ID NO: 5189178 - DNA, 19 bp, Homo sapiens
agattttttcatttatacc

SEQ ID NO: 5189179 - DNA, 16 bp, Homo sapiens
agatttttttgtgtat

SEQ ID NO: 5189180 - DNA, 19 bp, Homo sapiens
agatttttttgttgtttgt

SEQ ID NO: 5189181 - DNA, 18 bp, Homo sapiens
agattttttttaaagttt

SEQ ID NO: 5189182 - DNA, 17 bp, Homo sapiens
agattttttttccgtgt

SEQ ID NO: 5189183 - DNA, 17 bp, Homo sapiens
agattttttttgtaact

SEQ ID NO: 5189184 - DNA, 17 bp, Homo sapiens
agatttttttttctctt

SEQ ID NO: 5189185 - DNA, 20 bp, Homo sapiens
agatttttttttctctttta

SEQ ID NO: 5189186 - DNA, 22 bp, Homo sapiens
agattttttttttaagtgacat

SEQ ID NO: 5189187 - DNA, 23 bp, Homo sapiens
agcaaaaaaaaaaaaaagcatct

SEQ ID NO: 5189188 - DNA, 15 bp, Homo sapiens
agcaaaaaaagttgt

SEQ ID NO: 5189189 - DNA, 20 bp, Homo sapiens
agcaaaaaaagttgtatgat

SEQ ID NO: 5189190 - DNA, 17 bp, Homo sapiens
agcaaaaaataaaataa

SEQ ID NO: 5189191 - DNA, 17 bp, Homo sapiens
agcaaaaaatacccttg

SEQ ID NO: 5189192 - DNA, 13 bp, Homo sapiens
agcaaaaaatgaa

SEQ ID NO: 5189193 - DNA, 14 bp, Homo sapiens
agcaaaaaatgaac

SEQ ID NO: 5189194 - DNA, 22 bp, Homo sapiens
agcaaaaagtggggcagagcct

SEQ ID NO: 5189195 - DNA, 23 bp, Homo sapiens
agcaaaaatattttatgatccag

SEQ ID NO: 5189196 - DNA, 17 bp, Homo sapiens
agcaaaaatctgagaaa

SEQ ID NO: 5189197 - DNA, 14 bp, Homo sapiens
agcaaaaatgctaa

SEQ ID NO: 5189198 - DNA, 20 bp, Homo sapiens
agcaaaaatgctaatattaa

SEQ ID NO: 5189199 - DNA, 14 bp, Homo sapiens
agcaaaaatgtttt

SEQ ID NO: 5189200 - DNA, 13 bp, Homo sapiens
agcaaaacaaaac

SEQ ID NO: 5189201 - DNA, 17 bp, Homo sapiens
agcaaaacaaattcaaa

SEQ ID NO: 5189202 - DNA, 18 bp, Homo sapiens
agcaaaacagattcaaag

SEQ ID NO: 5189203 - DNA, 17 bp, Homo sapiens
agcaaaacagttctcag

SEQ ID NO: 5189204 - DNA, 14 bp, Homo sapiens
agcaaaaccaaaga

SEQ ID NO: 5189205 - DNA, 18 bp, Homo sapiens
agcaaaaccattgcttca

SEQ ID NO: 5189206 - DNA, 22 bp, Homo sapiens
agcaaaaccattgcttcactac

SEQ ID NO: 5189207 - DNA, 22 bp, Homo sapiens
agcaaaacctgaggtttaccta

SEQ ID NO: 5189208 - DNA, 11 bp, Homo sapiens
agcaaaagaga

SEQ ID NO: 5189209 - DNA, 18 bp, Homo sapiens
agcaaaagagaaatacat

SEQ ID NO: 5189210 - DNA, 18 bp, Homo sapiens
agcaaaagatgcttctca

SEQ ID NO: 5189211 - DNA, 11 bp, Homo sapiens
agcaaaaggca

SEQ ID NO: 5189212 - DNA, 22 bp, Homo sapiens
agcaaaaggcagctcacccctg

SEQ ID NO: 5189213 - DNA, 12 bp, Homo sapiens
agcaaaaggcat

SEQ ID NO: 5189214 - DNA, 16 bp, Homo sapiens
agcaaaaggctgagaa

SEQ ID NO: 5189215 - DNA, 19 bp, Homo sapiens
agcaaaagttaatattcag

SEQ ID NO: 5189216 - DNA, 15 bp, Homo sapiens
agcaaaataaaacat

SEQ ID NO: 5189217 - DNA, 22 bp, Homo sapiens
agcaaaataacaaaaaagagaa

SEQ ID NO: 5189218 - DNA, 21 bp, Homo sapiens
agcaaaataaggaagagggct

SEQ ID NO: 5189219 - DNA, 12 bp, Homo sapiens
agcaaaatatat

SEQ ID NO: 5189220 - DNA, 13 bp, Homo sapiens
agcaaaatatatg

SEQ ID NO: 5189221 - DNA, 16 bp, Homo sapiens
agcaaaatatgcccct

SEQ ID NO: 5189222 - DNA, 17 bp, Homo sapiens
agcaaaatatgcccctt

SEQ ID NO: 5189223 - DNA, 20 bp, Homo sapiens
agcaaaatcaagcaagcctc

SEQ ID NO: 5189224 - DNA, 19 bp, Homo sapiens
agcaaaatccttacttcca

SEQ ID NO: 5189225 - DNA, 22 bp, Homo sapiens
agcaaaatccttacttccagca

SEQ ID NO: 5189226 - DNA, 21 bp, Homo sapiens
agcaaaatctaaaatgtttta

SEQ ID NO: 5189227 - DNA, 15 bp, Homo sapiens
agcaaaatctaccag

SEQ ID NO: 5189228 - DNA, 15 bp, Homo sapiens
agcaaaatctttttt

SEQ ID NO: 5189229 - DNA, 18 bp, Homo sapiens
agcaaaatgaaaagagaa

SEQ ID NO: 5189230 - DNA, 17 bp, Homo sapiens
agcaaaatgctcttgtc

SEQ ID NO: 5189231 - DNA, 16 bp, Homo sapiens
agcaaaatggaagcaa

SEQ ID NO: 5189232 - DNA, 19 bp, Homo sapiens
agcaaaatggaagcaaaga

SEQ ID NO: 5189233 - DNA, 15 bp, Homo sapiens
agcaaaatgtgaatg

SEQ ID NO: 5189234 - DNA, 15 bp, Homo sapiens
agcaaaattataaga

SEQ ID NO: 5189235 - DNA, 16 bp, Homo sapiens
agcaaaattataagaa

SEQ ID NO: 5189236 - DNA, 15 bp, Homo sapiens
agcaaaatttttaaa

SEQ ID NO: 5189237 - DNA, 12 bp, Homo sapiens
agcaaacaaata

SEQ ID NO: 5189238 - DNA, 15 bp, Homo sapiens
agcaaacaatggtgt

SEQ ID NO: 5189239 - DNA, 13 bp, Homo sapiens
agcaaacacacag

SEQ ID NO: 5189240 - DNA, 16 bp, Homo sapiens
agcaaacagaaaaaga

SEQ ID NO: 5189241 - DNA, 13 bp, Homo sapiens
agcaaacagagga

SEQ ID NO: 5189242 - DNA, 13 bp, Homo sapiens
agcaaacatcaaa

SEQ ID NO: 5189243 - DNA, 13 bp, Homo sapiens
agcaaaccaagag

SEQ ID NO: 5189244 - DNA, 14 bp, Homo sapiens
agcaaaccaagaga

SEQ ID NO: 5189245 - DNA, 15 bp, Homo sapiens
agcaaaccaagagat

SEQ ID NO: 5189246 - DNA, 19 bp, Homo sapiens
agcaaaccaagagattgct

SEQ ID NO: 5189247 - DNA, 21 bp, Homo sapiens
agcaaaccaagagattgctaa

SEQ ID NO: 5189248 - DNA, 12 bp, Homo sapiens
agcaaaccatta

SEQ ID NO: 5189249 - DNA, 19 bp, Homo sapiens
agcaaaccattatacctta

SEQ ID NO: 5189250 - DNA, 23 bp, Homo sapiens
agcaaaccatttttaaagtagaa

SEQ ID NO: 5189251 - DNA, 15 bp, Homo sapiens
agcaaacccaaagat

SEQ ID NO: 5189252 - DNA, 22 bp, Homo sapiens
agcaaacccaaagatgttaaca

SEQ ID NO: 5189253 - DNA, 14 bp, Homo sapiens
agcaaacccagagg

SEQ ID NO: 5189254 - DNA, 16 bp, Homo sapiens
agcaaaccctgtcaaa

SEQ ID NO: 5189255 - DNA, 21 bp, Homo sapiens
agcaaaccctgtcaaacatta

SEQ ID NO: 5189256 - DNA, 23 bp, Homo sapiens
agcaaacctaacaggagaaagga

SEQ ID NO: 5189257 - DNA, 19 bp, Homo sapiens
agcaaacgtctattttgta

SEQ ID NO: 5189258 - DNA, 13 bp, Homo sapiens
agcaaactatatt

SEQ ID NO: 5189259 - DNA, 13 bp, Homo sapiens
agcaaactctttt

SEQ ID NO: 5189260 - DNA, 17 bp, Homo sapiens
agcaaactcttttccca

SEQ ID NO: 5189261 - DNA, 22 bp, Homo sapiens
agcaaactgaaattagtgtttt

SEQ ID NO: 5189262 - DNA, 18 bp, Homo sapiens
agcaaactggttatttaa

SEQ ID NO: 5189263 - DNA, 19 bp, Homo sapiens
agcaaacttgttgaattta

SEQ ID NO: 5189264 - DNA, 13 bp, Homo sapiens
agcaaagacaaaa

SEQ ID NO: 5189265 - DNA, 19 bp, Homo sapiens
agcaaagacaaaagaaact

SEQ ID NO: 5189266 - DNA, 20 bp, Homo sapiens
agcaaagacaaaagaaactt

SEQ ID NO: 5189267 - DNA, 14 bp, Homo sapiens
agcaaagaggggcg

SEQ ID NO: 5189268 - DNA, 15 bp, Homo sapiens
agcaaagaggggcgc

SEQ ID NO: 5189269 - DNA, 12 bp, Homo sapiens
agcaaagatcaa

SEQ ID NO: 5189270 - DNA, 22 bp, Homo sapiens
agccccatgctggagcctgtgt

SEQ ID NO: 5189271 - DNA, 19 bp, Homo sapiens
agccccatgtgccttgtcc

SEQ ID NO: 5189272 - DNA, 14 bp, Homo sapiens
agccccattaactg

SEQ ID NO: 5189273 - DNA, 15 bp, Homo sapiens
agccccattaactgc

SEQ ID NO: 5189274 - DNA, 19 bp, Homo sapiens
agccccattcacggcctgg

SEQ ID NO: 5189275 - DNA, 20 bp, Homo sapiens
agccccattcacggcctggc

SEQ ID NO: 5189276 - DNA, 22 bp, Homo sapiens
agccccattcacggcctggcat

SEQ ID NO: 5189277 - DNA, 17 bp, Homo sapiens
agccccattctgcctgc

SEQ ID NO: 5189278 - DNA, 19 bp, Homo sapiens
agccccattctgcctgccc

SEQ ID NO: 5189279 - DNA, 17 bp, Homo sapiens
agcccccaacacaggca

SEQ ID NO: 5189280 - DNA, 12 bp, Homo sapiens
agcccccacagc

SEQ ID NO: 5189281 - DNA, 18 bp, Homo sapiens
agcccccacagccctgga

SEQ ID NO: 5189282 - DNA, 19 bp, Homo sapiens
agcccccacagtgctgtct

SEQ ID NO: 5189283 - DNA, 15 bp, Homo sapiens
agcccccaccagcag

SEQ ID NO: 5189284 - DNA, 22 bp, Homo sapiens
agcccccaccagcagcacaatt

SEQ ID NO: 5189285 - DNA, 13 bp, Homo sapiens
agcccccaccagg

SEQ ID NO: 5189286 - DNA, 16 bp, Homo sapiens
agcccccaccagggga

SEQ ID NO: 5189287 - DNA, 17 bp, Homo sapiens
agcccccacccatgcca

SEQ ID NO: 5189288 - DNA, 23 bp, Homo sapiens
agcccccacccatgccagcgcag

SEQ ID NO: 5189289 - DNA, 17 bp, Homo sapiens
agcccccaccccacgga

SEQ ID NO: 5189290 - DNA, 18 bp, Homo sapiens
agcccccaccctgttcct

SEQ ID NO: 5189291 - DNA, 23 bp, Homo sapiens
agcccccaccctgttcctgctgc

SEQ ID NO: 5189292 - DNA, 20 bp, Homo sapiens
agcccccacctccgccccag

SEQ ID NO: 5189293 - DNA, 22 bp, Homo sapiens
agcccccaccttgatcccaatc

SEQ ID NO: 5189294 - DNA, 12 bp, Homo sapiens
agcccccactga

SEQ ID NO: 5189295 - DNA, 13 bp, Homo sapiens
agcccccactgac

SEQ ID NO: 5189296 - DNA, 17 bp, Homo sapiens
agcccccacttctctcc

SEQ ID NO: 5189297 - DNA, 13 bp, Homo sapiens
agcccccagagcc

SEQ ID NO: 5189298 - DNA, 19 bp, Homo sapiens
agcccccagatagagctgg

SEQ ID NO: 5189299 - DNA, 21 bp, Homo sapiens
agcccccagatagagctgggt

SEQ ID NO: 5189300 - DNA, 23 bp, Homo sapiens
agcccccagatagagctgggtgg

SEQ ID NO: 5189301 - DNA, 17 bp, Homo sapiens
agcccccagcagaggca

SEQ ID NO: 5189302 - DNA, 23 bp, Homo sapiens
agcccccagcagaggcaggctgg

SEQ ID NO: 5189303 - DNA, 17 bp, Homo sapiens
agcccccagcccctccc

SEQ ID NO: 5189304 - DNA, 14 bp, Homo sapiens
agcccccagccctg

SEQ ID NO: 5189305 - DNA, 17 bp, Homo sapiens
agcccccagccctggga

SEQ ID NO: 5189306 - DNA, 22 bp, Homo sapiens
agcccccagccctgggaaccac

SEQ ID NO: 5189307 - DNA, 13 bp, Homo sapiens
agcccccagcctg

SEQ ID NO: 5189308 - DNA, 17 bp, Homo sapiens
agcccccagctcccacc

SEQ ID NO: 5189309 - DNA, 22 bp, Homo sapiens
agcccccagctcccacctcccc

SEQ ID NO: 5189310 - DNA, 12 bp, Homo sapiens
agcccccaggaa

SEQ ID NO: 5189311 - DNA, 13 bp, Homo sapiens
agcccccaggaag

SEQ ID NO: 5189312 - DNA, 16 bp, Homo sapiens
agcccccaggatctgg

SEQ ID NO: 5189313 - DNA, 15 bp, Homo sapiens
agcccccaggccagg

SEQ ID NO: 5189314 - DNA, 21 bp, Homo sapiens
agcccccagggcctccagggc

SEQ ID NO: 5189315 - DNA, 22 bp, Homo sapiens
agcccccatcacccaagccaca

SEQ ID NO: 5189316 - DNA, 23 bp, Homo sapiens
agccccccacctttctcgctgga

SEQ ID NO: 5189317 - DNA, 22 bp, Homo sapiens
agccccccagagagagctctgc

SEQ ID NO: 5189318 - DNA, 14 bp, Homo sapiens
agccccccagcact

SEQ ID NO: 5189319 - DNA, 18 bp, Homo sapiens
agccccccaggctgccca

SEQ ID NO: 5189320 - DNA, 22 bp, Homo sapiens
agccccccaggctgcccagagc

SEQ ID NO: 5189321 - DNA, 15 bp, Homo sapiens
agccccccatgcccc

SEQ ID NO: 5189322 - DNA, 16 bp, Homo sapiens
agcccccccacccacc

SEQ ID NO: 5189323 - DNA, 20 bp, Homo sapiens
agcccccccacccaccccca

SEQ ID NO: 5189324 - DNA, 16 bp, Homo sapiens
agcccccccctcaagg

SEQ ID NO: 5189325 - DNA, 21 bp, Homo sapiens
agcccccctagcaatacaggg

SEQ ID NO: 5189326 - DNA, 14 bp, Homo sapiens
agcccccctttggc

SEQ ID NO: 5189327 - DNA, 14 bp, Homo sapiens
agcccccgcccctc

SEQ ID NO: 5189328 - DNA, 15 bp, Homo sapiens
agcccccgggacacc

SEQ ID NO: 5189329 - DNA, 22 bp, Homo sapiens
agccccctcacagtattgctca

SEQ ID NO: 5189330 - DNA, 14 bp, Homo sapiens
agccccctcccacc

SEQ ID NO: 5189331 - DNA, 15 bp, Homo sapiens
agccccctcccaccg

SEQ ID NO: 5189332 - DNA, 13 bp, Homo sapiens
agccccctcctga

SEQ ID NO: 5189333 - DNA, 18 bp, Homo sapiens
agccccctcctgacccca

SEQ ID NO: 5189334 - DNA, 15 bp, Homo sapiens
agccccctctcctga

SEQ ID NO: 5189335 - DNA, 18 bp, Homo sapiens
agccccctctcctgaagc

SEQ ID NO: 5189336 - DNA, 15 bp, Homo sapiens
agccccctcttccct

SEQ ID NO: 5189337 - DNA, 15 bp, Homo sapiens
agccccctcttgaga

SEQ ID NO: 5189338 - DNA, 22 bp, Homo sapiens
agccccctgaccactcagagac

SEQ ID NO: 5189339 - DNA, 12 bp, Homo sapiens
agccccctgcac

SEQ ID NO: 5189340 - DNA, 16 bp, Homo sapiens
agccccctgccccgca

SEQ ID NO: 5189341 - DNA, 13 bp, Homo sapiens
agccccctgcttc

SEQ ID NO: 5189342 - DNA, 16 bp, Homo sapiens
agccccctgcttctcc

SEQ ID NO: 5189343 - DNA, 19 bp, Homo sapiens
agccccctggatgtcccct

SEQ ID NO: 5189344 - DNA, 20 bp, Homo sapiens
agccccctggatgtcccctg

SEQ ID NO: 5189345 - DNA, 11 bp, Homo sapiens
agccccctggc

SEQ ID NO: 5189346 - DNA, 12 bp, Homo sapiens
agccccctggcc

SEQ ID NO: 5189347 - DNA, 15 bp, Homo sapiens
agccccctggcccct

SEQ ID NO: 5189348 - DNA, 19 bp, Homo sapiens
agccccctggcctctgtgc

SEQ ID NO: 5189349 - DNA, 13 bp, Homo sapiens
agccccctggcgg

SEQ ID NO: 5189350 - DNA, 12 bp, Homo sapiens
agccccctggtc

SEQ ID NO: 5189351 - DNA, 18 bp, Homo sapiens
agccccctggtctttgag

SEQ ID NO: 5189352 - DNA, 22 bp, Homo sapiens
agccccctgtccttcccacggc

SEQ ID NO: 5189353 - DNA, 15 bp, Homo sapiens
agccccctgtgccca

SEQ ID NO: 5189354 - DNA, 16 bp, Homo sapiens
agcccccttctccatg

SEQ ID NO: 5189355 - DNA, 22 bp, Homo sapiens
agccccgactccagccagcgcc

SEQ ID NO: 5189356 - DNA, 23 bp, Homo sapiens
agccccgactccagccagcgcct

SEQ ID NO: 5189357 - DNA, 16 bp, Homo sapiens
agccccgagctgtccc

SEQ ID NO: 5189358 - DNA, 16 bp, Homo sapiens
agccccgaggccttct

SEQ ID NO: 5189359 - DNA, 22 bp, Homo sapiens
agccccgaggccttctctgaag

SEQ ID NO: 5189360 - DNA, 21 bp, Homo sapiens
agccccgatgattcttaacac

SEQ ID NO: 5189361 - DNA, 20 bp, Homo sapiens
agccccgcaaaacccactga

SEQ ID NO: 5189362 - DNA, 19 bp, Homo sapiens
agccccgccacgcttgtgt

SEQ ID NO: 5189363 - DNA, 17 bp, Homo sapiens
agccccgccccagccct

SEQ ID NO: 5189364 - DNA, 20 bp, Homo sapiens
agccccgccctcttcctgac

SEQ ID NO: 5189365 - DNA, 22 bp, Homo sapiens
agccccgccctcttcctgacga

SEQ ID NO: 5189366 - DNA, 14 bp, Homo sapiens
agccccgccgtgtc

SEQ ID NO: 5189367 - DNA, 14 bp, Homo sapiens
agccccgcctgtca

SEQ ID NO: 5189368 - DNA, 15 bp, Homo sapiens
agccccgcctgtcac

SEQ ID NO: 5189369 - DNA, 15 bp, Homo sapiens
agccccgcgcctcct

SEQ ID NO: 5189370 - DNA, 23 bp, Homo sapiens
agccccgcggatcaaccaggcag

SEQ ID NO: 5189371 - DNA, 15 bp, Homo sapiens
agccccgctcaggcc

SEQ ID NO: 5189372 - DNA, 22 bp, Homo sapiens
agccccgctcaggcctaggagg

SEQ ID NO: 5189373 - DNA, 16 bp, Homo sapiens
agccccgctcccacct

SEQ ID NO: 5189374 - DNA, 17 bp, Homo sapiens
agccccgctcccaccta

SEQ ID NO: 5189375 - DNA, 22 bp, Homo sapiens
agccccgctcccacctagtgcc

SEQ ID NO: 5189376 - DNA, 18 bp, Homo sapiens
agccccgctgagcttgga

SEQ ID NO: 5189377 - DNA, 14 bp, Homo sapiens
agccccggagcacc

SEQ ID NO: 5189378 - DNA, 14 bp, Homo sapiens
agccccggccctgg

SEQ ID NO: 5189379 - DNA, 17 bp, Homo sapiens
agccccgggcctgcctc

SEQ ID NO: 5189380 - DNA, 19 bp, Homo sapiens
agccccgggcctgcctctg

SEQ ID NO: 5189381 - DNA, 15 bp, Homo sapiens
agccccgggcttggc

SEQ ID NO: 5189382 - DNA, 19 bp, Homo sapiens
agccccggggccccctggt

SEQ ID NO: 5189383 - DNA, 19 bp, Homo sapiens
agccccggtggctgggcag

SEQ ID NO: 5189384 - DNA, 22 bp, Homo sapiens
agccccgtctgaccccagccca

SEQ ID NO: 5189385 - DNA, 15 bp, Homo sapiens
agccccgtctgccca

SEQ ID NO: 5189386 - DNA, 18 bp, Homo sapiens
agccccgtctgcccacca

SEQ ID NO: 5189387 - DNA, 15 bp, Homo sapiens
agccccgtgccagga

SEQ ID NO: 5189388 - DNA, 13 bp, Homo sapiens
agcccctaagtgc

SEQ ID NO: 5189389 - DNA, 15 bp, Homo sapiens
agcccctacccctgc

SEQ ID NO: 5189390 - DNA, 16 bp, Homo sapiens
agcccctacccctgcc

SEQ ID NO: 5189391 - DNA, 17 bp, Homo sapiens
agcccctacccctgccc

SEQ ID NO: 5189392 - DNA, 19 bp, Homo sapiens
agcccctacccctgccctg

SEQ ID NO: 5189393 - DNA, 16 bp, Homo sapiens
agcccctactgctgtg

SEQ ID NO: 5189394 - DNA, 17 bp, Homo sapiens
agcccctactgctgtga

SEQ ID NO: 5189395 - DNA, 14 bp, Homo sapiens
agcccctactgtgg

SEQ ID NO: 5189396 - DNA, 17 bp, Homo sapiens
agcccctactgtgggca

SEQ ID NO: 5189397 - DNA, 16 bp, Homo sapiens
agcccctagaaaccca

SEQ ID NO: 5189398 - DNA, 18 bp, Homo sapiens
agcccctagaaacccaag

SEQ ID NO: 5189399 - DNA, 20 bp, Homo sapiens
agcccctagatgaagaaaga

SEQ ID NO: 5189400 - DNA, 22 bp, Homo sapiens
agcccctagatgaagaaagaga

SEQ ID NO: 5189401 - DNA, 14 bp, Homo sapiens
agcccctagcccag

SEQ ID NO: 5189402 - DNA, 15 bp, Homo sapiens
agcccctagcccagg

SEQ ID NO: 5189403 - DNA, 11 bp, Homo sapiens
agcccctagga

SEQ ID NO: 5189404 - DNA, 18 bp, Homo sapiens
agcccctatagcactgag

SEQ ID NO: 5189405 - DNA, 19 bp, Homo sapiens
agcccctatagcactgagc

SEQ ID NO: 5189406 - DNA, 23 bp, Homo sapiens
agcccctatagcactgagctcac

SEQ ID NO: 5189407 - DNA, 15 bp, Homo sapiens
agcccctcacttcca

SEQ ID NO: 5189408 - DNA, 16 bp, Homo sapiens
agcccctcacttccag

SEQ ID NO: 5189409 - DNA, 12 bp, Homo sapiens
agcccctcagac

SEQ ID NO: 5189410 - DNA, 20 bp, Homo sapiens
agcccctcagacagccccct

SEQ ID NO: 5189411 - DNA, 14 bp, Homo sapiens
agcccctcagagaa

SEQ ID NO: 5189412 - DNA, 15 bp, Homo sapiens
agcccctcagagaat

SEQ ID NO: 5189413 - DNA, 21 bp, Homo sapiens
agcccctcagcccttgccccc

SEQ ID NO: 5189414 - DNA, 16 bp, Homo sapiens
agcccctccacgtgat

SEQ ID NO: 5189415 - DNA, 20 bp, Homo sapiens
agcccctcccaagctggctg

SEQ ID NO: 5189416 - DNA, 22 bp, Homo sapiens
agcccctcccaagctggctggg

SEQ ID NO: 5189417 - DNA, 14 bp, Homo sapiens
agcccctcccacca

SEQ ID NO: 5189418 - DNA, 17 bp, Homo sapiens
agcccctcccaccacag

SEQ ID NO: 5189419 - DNA, 12 bp, Homo sapiens
agcccctcccca

SEQ ID NO: 5189420 - DNA, 13 bp, Homo sapiens
agcccctccccag

SEQ ID NO: 5189421 - DNA, 14 bp, Homo sapiens
agcccctccccagc

SEQ ID NO: 5189422 - DNA, 13 bp, Homo sapiens
agcccctccccca

SEQ ID NO: 5189423 - DNA, 14 bp, Homo sapiens
agcccctccccgcc

SEQ ID NO: 5189424 - DNA, 20 bp, Homo sapiens
agcccctccccgcctcctcc

SEQ ID NO: 5189425 - DNA, 16 bp, Homo sapiens
agcccctccctcctct

SEQ ID NO: 5189426 - DNA, 13 bp, Homo sapiens
agcccctcctaac

SEQ ID NO: 5189427 - DNA, 20 bp, Homo sapiens
agcccctcctccagcccctg

SEQ ID NO: 5189428 - DNA, 21 bp, Homo sapiens
agcccctcctccagcccctgt

SEQ ID NO: 5189429 - DNA, 14 bp, Homo sapiens
agcccctcctcccc

SEQ ID NO: 5189430 - DNA, 19 bp, Homo sapiens
agcccctcctccccttcct

SEQ ID NO: 5189431 - DNA, 21 bp, Homo sapiens
agcccctcctccccttcctgc

SEQ ID NO: 5189432 - DNA, 16 bp, Homo sapiens
agcccctcctccctca

SEQ ID NO: 5189433 - DNA, 17 bp, Homo sapiens
agcccctcctccctcag

SEQ ID NO: 5189434 - DNA, 18 bp, Homo sapiens
agcccctcctccctcaga

SEQ ID NO: 5189435 - DNA, 21 bp, Homo sapiens
agcccctcctccctcagaccc

SEQ ID NO: 5189436 - DNA, 23 bp, Homo sapiens
agcccctcctccctcagacccag

SEQ ID NO: 5189437 - DNA, 13 bp, Homo sapiens
agcccctcctctg

SEQ ID NO: 5189438 - DNA, 23 bp, Homo sapiens
agcccctcctctgagcagcctct

SEQ ID NO: 5189439 - DNA, 18 bp, Homo sapiens
agcccctccttctcccct

SEQ ID NO: 5189440 - DNA, 20 bp, Homo sapiens
agcccctccttctcccctgc

SEQ ID NO: 5189441 - DNA, 16 bp, Homo sapiens
agcccctcgaggccta

SEQ ID NO: 5189442 - DNA, 20 bp, Homo sapiens
agcccctcgaggcctacaga

SEQ ID NO: 5189443 - DNA, 16 bp, Homo sapiens
agcccctcggctctgc

SEQ ID NO: 5189444 - DNA, 18 bp, Homo sapiens
agcccctcggctctggag

SEQ ID NO: 5189445 - DNA, 15 bp, Homo sapiens
agcccctctcccctc

SEQ ID NO: 5189446 - DNA, 19 bp, Homo sapiens
agcccctctcccctctctg

SEQ ID NO: 5189447 - DNA, 23 bp, Homo sapiens
agcccctctcccctctctgctcc

SEQ ID NO: 5189448 - DNA, 12 bp, Homo sapiens
agcccctctctt

SEQ ID NO: 5189449 - DNA, 14 bp, Homo sapiens
agcaaagatcaaaa

SEQ ID NO: 5189450 - DNA, 15 bp, Homo sapiens
agcaaagatcaaaat

SEQ ID NO: 5189451 - DNA, 12 bp, Homo sapiens
agcaaagatgca

SEQ ID NO: 5189452 - DNA, 13 bp, Homo sapiens
agcaaagatgcat

SEQ ID NO: 5189453 - DNA, 21 bp, Homo sapiens
agcaaagattaaatgtgtcat

SEQ ID NO: 5189454 - DNA, 14 bp, Homo sapiens
agcaaagatttcag

SEQ ID NO: 5189455 - DNA, 15 bp, Homo sapiens
agcaaagatttcagt

SEQ ID NO: 5189456 - DNA, 12 bp, Homo sapiens
agcaaagcacag

SEQ ID NO: 5189457 - DNA, 14 bp, Homo sapiens
agcaaagcacagag

SEQ ID NO: 5189458 - DNA, 22 bp, Homo sapiens
agcaaagcaccagcttctccag

SEQ ID NO: 5189459 - DNA, 19 bp, Homo sapiens
agcaaagcacccatttcaa

SEQ ID NO: 5189460 - DNA, 11 bp, Homo sapiens
agcaaagcatc

SEQ ID NO: 5189461 - DNA, 20 bp, Homo sapiens
agcaaagcatgccaatttct

SEQ ID NO: 5189462 - DNA, 21 bp, Homo sapiens
agcaaagccaccaagggcctc

SEQ ID NO: 5189463 - DNA, 13 bp, Homo sapiens
agcaaagccatat

SEQ ID NO: 5189464 - DNA, 23 bp, Homo sapiens
agcaaagccccatgctggagcct

SEQ ID NO: 5189465 - DNA, 19 bp, Homo sapiens
agcaaagcgcccacccagg

SEQ ID NO: 5189466 - DNA, 16 bp, Homo sapiens
agcaaagcgctaagta

SEQ ID NO: 5189467 - DNA, 22 bp, Homo sapiens
agcaaagcttggtgtcttggca

SEQ ID NO: 5189468 - DNA, 14 bp, Homo sapiens
agcaaaggaaacca

SEQ ID NO: 5189469 - DNA, 12 bp, Homo sapiens
agcaaaggaaga

SEQ ID NO: 5189470 - DNA, 18 bp, Homo sapiens
agcaaaggagacaaagca

SEQ ID NO: 5189471 - DNA, 22 bp, Homo sapiens
agcaaaggagacaaagcaggag

SEQ ID NO: 5189472 - DNA, 21 bp, Homo sapiens
agcaaaggagagtcctgggag

SEQ ID NO: 5189473 - DNA, 18 bp, Homo sapiens
agcaaaggatgtgttttc

SEQ ID NO: 5189474 - DNA, 19 bp, Homo sapiens
agcaaaggcagtcccggga

SEQ ID NO: 5189475 - DNA, 20 bp, Homo sapiens
agcaaaggcccatgccccct

SEQ ID NO: 5189476 - DNA, 18 bp, Homo sapiens
agcaaaggctccctcgcc

SEQ ID NO: 5189477 - DNA, 16 bp, Homo sapiens
agcaaaggggggaggt

SEQ ID NO: 5189478 - DNA, 21 bp, Homo sapiens
agcaaaggtgcactccagact

SEQ ID NO: 5189479 - DNA, 18 bp, Homo sapiens
agcaaagtcacttctcca

SEQ ID NO: 5189480 - DNA, 18 bp, Homo sapiens
agcaaagtcatgtcagaa

SEQ ID NO: 5189481 - DNA, 14 bp, Homo sapiens
agcaaagtctaaag

SEQ ID NO: 5189482 - DNA, 19 bp, Homo sapiens
agcaaagtgcccatggtgg

SEQ ID NO: 5189483 - DNA, 13 bp, Homo sapiens
agcaaagtgctgg

SEQ ID NO: 5189484 - DNA, 21 bp, Homo sapiens
agcaaagttatcttaaatatg

SEQ ID NO: 5189485 - DNA, 22 bp, Homo sapiens
agcaaagttatcttaaatatga

SEQ ID NO: 5189486 - DNA, 15 bp, Homo sapiens
agcaaagttttcaga

SEQ ID NO: 5189487 - DNA, 19 bp, Homo sapiens
agcaaataaactaggaaat

SEQ ID NO: 5189488 - DNA, 21 bp, Homo sapiens
agcaaataaatacgtgtcaaa

SEQ ID NO: 5189489 - DNA, 22 bp, Homo sapiens
agcaaataaatgccttccacct

SEQ ID NO: 5189490 - DNA, 15 bp, Homo sapiens
agcaaataagctcta

SEQ ID NO: 5189491 - DNA, 17 bp, Homo sapiens
agcaaatacaattcaca

SEQ ID NO: 5189492 - DNA, 11 bp, Homo sapiens
agcaaatacat

SEQ ID NO: 5189493 - DNA, 13 bp, Homo sapiens
agcaaataccaaa

SEQ ID NO: 5189494 - DNA, 14 bp, Homo sapiens
agcaaataccaaag

SEQ ID NO: 5189495 - DNA, 22 bp, Homo sapiens
agcaaatacttagcaaaaagtg

SEQ ID NO: 5189496 - DNA, 15 bp, Homo sapiens
agcaaatagcaaatg

SEQ ID NO: 5189497 - DNA, 24 bp, Homo sapiens
agcaaatataggtcctgtgttaaa

SEQ ID NO: 5189498 - DNA, 20 bp, Homo sapiens
agcaaatatataatgcaaca

SEQ ID NO: 5189499 - DNA, 21 bp, Homo sapiens
agcaaatatataatgcaacaa

SEQ ID NO: 5189500 - DNA, 15 bp, Homo sapiens
agcaaatatctaaat

SEQ ID NO: 5189501 - DNA, 21 bp, Homo sapiens
agcaaatcaccacaaactgta

SEQ ID NO: 5189502 - DNA, 15 bp, Homo sapiens
agcaaatcagaaaac

SEQ ID NO: 5189503 - DNA, 18 bp, Homo sapiens
agcaaatcagaaaaccca

SEQ ID NO: 5189504 - DNA, 16 bp, Homo sapiens
agcaaatcagaaactt

SEQ ID NO: 5189505 - DNA, 16 bp, Homo sapiens
agcaaatcagacacaa

SEQ ID NO: 5189506 - DNA, 20 bp, Homo sapiens
agcaaatcagtatattttct

SEQ ID NO: 5189507 - DNA, 22 bp, Homo sapiens
agcaaatcatttgtttaaaaag

SEQ ID NO: 5189508 - DNA, 12 bp, Homo sapiens
agcaaatccttt

SEQ ID NO: 5189509 - DNA, 20 bp, Homo sapiens
agcaaatcctttgtgaaaaa

SEQ ID NO: 5189510 - DNA, 15 bp, Homo sapiens
agcaaatcgaatgaa

SEQ ID NO: 5189511 - DNA, 15 bp, Homo sapiens
agcaaatctgccacc

SEQ ID NO: 5189512 - DNA, 19 bp, Homo sapiens
agcaaatctgtataaatgt

SEQ ID NO: 5189513 - DNA, 20 bp, Homo sapiens
agcaaatctttctgtaaaca

SEQ ID NO: 5189514 - DNA, 19 bp, Homo sapiens
agcaaatgaaggatgaagt

SEQ ID NO: 5189515 - DNA, 13 bp, Homo sapiens
agcaaatgcaaaa

SEQ ID NO: 5189516 - DNA, 19 bp, Homo sapiens
agcaaatgcttaaaacaag

SEQ ID NO: 5189517 - DNA, 17 bp, Homo sapiens
agcaaatgctttgtgac

SEQ ID NO: 5189518 - DNA, 21 bp, Homo sapiens
agcaaatggaaaatgtatatt

SEQ ID NO: 5189519 - DNA, 24 bp, Homo sapiens
agcaaatgggtgcccgtatccaga

SEQ ID NO: 5189520 - DNA, 16 bp, Homo sapiens
agcaaatgtggctcct

SEQ ID NO: 5189521 - DNA, 19 bp, Homo sapiens
agcaaatgttacatagtgt

SEQ ID NO: 5189522 - DNA, 20 bp, Homo sapiens
agcaaatgttacatagtgta

SEQ ID NO: 5189523 - DNA, 16 bp, Homo sapiens
agcaaatgtttactgt

SEQ ID NO: 5189524 - DNA, 16 bp, Homo sapiens
agcaaattaatgtgta

SEQ ID NO: 5189525 - DNA, 17 bp, Homo sapiens
agcaaattaatgtgtaa

SEQ ID NO: 5189526 - DNA, 18 bp, Homo sapiens
agcaaattaatgtgtaaa

SEQ ID NO: 5189527 - DNA, 19 bp, Homo sapiens
agcaaattaatgtgtaaaa

SEQ ID NO: 5189528 - DNA, 16 bp, Homo sapiens
agcaaattaattggca

SEQ ID NO: 5189529 - DNA, 19 bp, Homo sapiens
agcaaattaattggcagca

SEQ ID NO: 5189530 - DNA, 14 bp, Homo sapiens
agcaaattattttt

SEQ ID NO: 5189531 - DNA, 19 bp, Homo sapiens
agcaaattgctagtcaggg

SEQ ID NO: 5189532 - DNA, 15 bp, Homo sapiens
agcaaatttataatt

SEQ ID NO: 5189533 - DNA, 19 bp, Homo sapiens
agcaaatttataattttaa

SEQ ID NO: 5189534 - DNA, 21 bp, Homo sapiens
agcaaatttcatctttccaaa

SEQ ID NO: 5189535 - DNA, 21 bp, Homo sapiens
agcaaatttctagatatgaga

SEQ ID NO: 5189536 - DNA, 12 bp, Homo sapiens
agcaaatttggg

SEQ ID NO: 5189537 - DNA, 15 bp, Homo sapiens
agcaaattttggacc

SEQ ID NO: 5189538 - DNA, 20 bp, Homo sapiens
agcaacaaacctcactgaga

SEQ ID NO: 5189539 - DNA, 13 bp, Homo sapiens
agcaacaaagagc

SEQ ID NO: 5189540 - DNA, 20 bp, Homo sapiens
agcaacaaccttaaaggccg

SEQ ID NO: 5189541 - DNA, 18 bp, Homo sapiens
agcaacaactgtcagttc

SEQ ID NO: 5189542 - DNA, 14 bp, Homo sapiens
agcaacaacttact

SEQ ID NO: 5189543 - DNA, 18 bp, Homo sapiens
agcaacaagactgccagg

SEQ ID NO: 5189544 - DNA, 13 bp, Homo sapiens
agcaacaataaat

SEQ ID NO: 5189545 - DNA, 18 bp, Homo sapiens
agcaacaataaatagaca

SEQ ID NO: 5189546 - DNA, 22 bp, Homo sapiens
agcaacaataatgattttcttg

SEQ ID NO: 5189547 - DNA, 14 bp, Homo sapiens
agcaacaattttca

SEQ ID NO: 5189548 - DNA, 16 bp, Homo sapiens
agcaacaattttcaga

SEQ ID NO: 5189549 - DNA, 15 bp, Homo sapiens
agcaacacaaagctt

SEQ ID NO: 5189550 - DNA, 21 bp, Homo sapiens
agcaacacaaagcttttgcat

SEQ ID NO: 5189551 - DNA, 14 bp, Homo sapiens
agcaacacaagctg

SEQ ID NO: 5189552 - DNA, 21 bp, Homo sapiens
agcaacacaatgttattcgtt

SEQ ID NO: 5189553 - DNA, 17 bp, Homo sapiens
agcaacacagcctgggc

SEQ ID NO: 5189554 - DNA, 17 bp, Homo sapiens
agcaacacccaagtcca

SEQ ID NO: 5189555 - DNA, 19 bp, Homo sapiens
agcaacacccaagtccacc

SEQ ID NO: 5189556 - DNA, 14 bp, Homo sapiens
agcaacacgtcatt

SEQ ID NO: 5189557 - DNA, 18 bp, Homo sapiens
agcaacacgtcattgtgt

SEQ ID NO: 5189558 - DNA, 16 bp, Homo sapiens
agcaacagaaaaatgg

SEQ ID NO: 5189559 - DNA, 23 bp, Homo sapiens
agcaacagagtgagaccctgtct

SEQ ID NO: 5189560 - DNA, 16 bp, Homo sapiens
agcaacagatagatgt

SEQ ID NO: 5189561 - DNA, 17 bp, Homo sapiens
agcaacagcaagaaata

SEQ ID NO: 5189562 - DNA, 16 bp, Homo sapiens
agcaacagcactttct

SEQ ID NO: 5189563 - DNA, 14 bp, Homo sapiens
agcaacagctggac

SEQ ID NO: 5189564 - DNA, 15 bp, Homo sapiens
agcaacagctggaca

SEQ ID NO: 5189565 - DNA, 21 bp, Homo sapiens
agcaacaggaatcaagagctg

SEQ ID NO: 5189566 - DNA, 22 bp, Homo sapiens
agcaacaggaatcaagagctgc

SEQ ID NO: 5189567 - DNA, 23 bp, Homo sapiens
agcaacaggaatcaagagctgcc

SEQ ID NO: 5189568 - DNA, 17 bp, Homo sapiens
agcaacaggaatctcag

SEQ ID NO: 5189569 - DNA, 14 bp, Homo sapiens
agcaacaggaccag

SEQ ID NO: 5189570 - DNA, 18 bp, Homo sapiens
agcaacaggaccaggagc

SEQ ID NO: 5189571 - DNA, 20 bp, Homo sapiens
agcaacaggaccaggagcca

SEQ ID NO: 5189572 - DNA, 18 bp, Homo sapiens
agcaacaggttttataat

SEQ ID NO: 5189573 - DNA, 16 bp, Homo sapiens
agcaacatcagcttga

SEQ ID NO: 5189574 - DNA, 12 bp, Homo sapiens
agcaacatgaat

SEQ ID NO: 5189575 - DNA, 15 bp, Homo sapiens
agcaacatgcttcat

SEQ ID NO: 5189576 - DNA, 12 bp, Homo sapiens
agcaacatggct

SEQ ID NO: 5189577 - DNA, 13 bp, Homo sapiens
agcaacatggctt

SEQ ID NO: 5189578 - DNA, 14 bp, Homo sapiens
agcaacatggcttt

SEQ ID NO: 5189579 - DNA, 19 bp, Homo sapiens
agcaacattcgttctctaa

SEQ ID NO: 5189580 - DNA, 23 bp, Homo sapiens
agcaacattggcacatgccacct

SEQ ID NO: 5189581 - DNA, 13 bp, Homo sapiens
agcaacatttgta

SEQ ID NO: 5189582 - DNA, 20 bp, Homo sapiens
agcaacattttacccacaca

SEQ ID NO: 5189583 - DNA, 14 bp, Homo sapiens
agcaacattttatt

SEQ ID NO: 5189584 - DNA, 20 bp, Homo sapiens
agcaacattttcttgaattt

SEQ ID NO: 5189585 - DNA, 17 bp, Homo sapiens
agcaaccacactgcttg

SEQ ID NO: 5189586 - DNA, 22 bp, Homo sapiens
agcaaccacatttagaaatgtt

SEQ ID NO: 5189587 - DNA, 18 bp, Homo sapiens
agcaaccagagcactgta

SEQ ID NO: 5189588 - DNA, 15 bp, Homo sapiens
agcaaccatttgtaa

SEQ ID NO: 5189589 - DNA, 13 bp, Homo sapiens
agcaacccaaact

SEQ ID NO: 5189590 - DNA, 14 bp, Homo sapiens
agcaacccaaactg

SEQ ID NO: 5189591 - DNA, 18 bp, Homo sapiens
agcaacccctggacccca

SEQ ID NO: 5189592 - DNA, 19 bp, Homo sapiens
agcaacccctgtacccagc

SEQ ID NO: 5189593 - DNA, 16 bp, Homo sapiens
agcaaccctacagtat

SEQ ID NO: 5189594 - DNA, 22 bp, Homo sapiens
agcaaccctcctatcacctccc

SEQ ID NO: 5189595 - DNA, 16 bp, Homo sapiens
agcaaccctctgaaga

SEQ ID NO: 5189596 - DNA, 15 bp, Homo sapiens
agcaaccctgtgata

SEQ ID NO: 5189597 - DNA, 21 bp, Homo sapiens
agcaacccttcctgctgctgc

SEQ ID NO: 5189598 - DNA, 18 bp, Homo sapiens
agcaaccggtggatcctc

SEQ ID NO: 5189599 - DNA, 16 bp, Homo sapiens
agcaaccgtggccctt

SEQ ID NO: 5189600 - DNA, 21 bp, Homo sapiens
agcaaccgtggcccttcctgg

SEQ ID NO: 5189601 - DNA, 22 bp, Homo sapiens
agcaaccgtggcccttcctgga

SEQ ID NO: 5189602 - DNA, 19 bp, Homo sapiens
agcaacctactgtctaagc

SEQ ID NO: 5189603 - DNA, 22 bp, Homo sapiens
agcaacctatttgactgcttca

SEQ ID NO: 5189604 - DNA, 15 bp, Homo sapiens
agcaacctcagtaat

SEQ ID NO: 5189605 - DNA, 19 bp, Homo sapiens
agcaacctgggcatcttag

SEQ ID NO: 5189606 - DNA, 18 bp, Homo sapiens
agcaacctgggtccaaat

SEQ ID NO: 5189607 - DNA, 22 bp, Homo sapiens
agcaacctgggtccaaataaaa

SEQ ID NO: 5189608 - DNA, 19 bp, Homo sapiens
agcaaccttaaagcaataa

SEQ ID NO: 5189609 - DNA, 17 bp, Homo sapiens
agcaaccttcattttac

SEQ ID NO: 5189610 - DNA, 22 bp, Homo sapiens
agcaacctttcacctttgtgta

SEQ ID NO: 5189611 - DNA, 23 bp, Homo sapiens
agcaacctttttccctcttccca

SEQ ID NO: 5189612 - DNA, 19 bp, Homo sapiens
agcaacgatcacaaatgac

SEQ ID NO: 5189613 - DNA, 23 bp, Homo sapiens
agcaacgcaggcccccaggtgcc

SEQ ID NO: 5189614 - DNA, 14 bp, Homo sapiens
agcaacgccagtgg

SEQ ID NO: 5189615 - DNA, 14 bp, Homo sapiens
agcaacgcccctcc

SEQ ID NO: 5189616 - DNA, 16 bp, Homo sapiens
agcaacgcccctccaa

SEQ ID NO: 5189617 - DNA, 19 bp, Homo sapiens
agcaacgcccctccaaacc

SEQ ID NO: 5189618 - DNA, 18 bp, Homo sapiens
agcaacgcctgccttctg

SEQ ID NO: 5189619 - DNA, 22 bp, Homo sapiens
agcaacgcctgccttctgggca

SEQ ID NO: 5189620 - DNA, 18 bp, Homo sapiens
agcaacgctattccagct

SEQ ID NO: 5189621 - DNA, 18 bp, Homo sapiens
agcaacggcccatagcct

SEQ ID NO: 5189622 - DNA, 22 bp, Homo sapiens
agcaacggcccatagccttggg

SEQ ID NO: 5189623 - DNA, 20 bp, Homo sapiens
agcaacgtagcttctaccat

SEQ ID NO: 5189624 - DNA, 17 bp, Homo sapiens
agcaacgtgttaattat

SEQ ID NO: 5189625 - DNA, 21 bp, Homo sapiens
agcaactacagtctaaagctg

SEQ ID NO: 5189626 - DNA, 11 bp, Homo sapiens
agcaactattc

SEQ ID NO: 5189627 - DNA, 21 bp, Homo sapiens
agcccctctggattccctttt

SEQ ID NO: 5189628 - DNA, 16 bp, Homo sapiens
agcccctctggtcgct

SEQ ID NO: 5189629 - DNA, 20 bp, Homo sapiens
agcccctctggtcgctcctg

SEQ ID NO: 5189630 - DNA, 21 bp, Homo sapiens
agcccctctggtcgctcctgc

SEQ ID NO: 5189631 - DNA, 22 bp, Homo sapiens
agcccctcttcccttcctccat

SEQ ID NO: 5189632 - DNA, 17 bp, Homo sapiens
agcccctcttgcccccc

SEQ ID NO: 5189633 - DNA, 14 bp, Homo sapiens
agcccctgaaagcc

SEQ ID NO: 5189634 - DNA, 18 bp, Homo sapiens
agcccctgaaagcctcac

SEQ ID NO: 5189635 - DNA, 12 bp, Homo sapiens
agcccctgaccc

SEQ ID NO: 5189636 - DNA, 14 bp, Homo sapiens
agcccctgagagcc

SEQ ID NO: 5189637 - DNA, 15 bp, Homo sapiens
agcccctgagagcct

SEQ ID NO: 5189638 - DNA, 11 bp, Homo sapiens
agcccctgagt

SEQ ID NO: 5189639 - DNA, 19 bp, Homo sapiens
agcccctgagtccgcctgc

SEQ ID NO: 5189640 - DNA, 21 bp, Homo sapiens
agcccctgagtccgcctgcgc

SEQ ID NO: 5189641 - DNA, 16 bp, Homo sapiens
agcccctgatctctga

SEQ ID NO: 5189642 - DNA, 17 bp, Homo sapiens
agcccctgatctctgac

SEQ ID NO: 5189643 - DNA, 17 bp, Homo sapiens
agcccctgcagacgtct

SEQ ID NO: 5189644 - DNA, 18 bp, Homo sapiens
agcccctgcagacgtctg

SEQ ID NO: 5189645 - DNA, 13 bp, Homo sapiens
agcccctgcagat

SEQ ID NO: 5189646 - DNA, 11 bp, Homo sapiens
agcccctgccc

SEQ ID NO: 5189647 - DNA, 18 bp, Homo sapiens
agcccctgccccagccca

SEQ ID NO: 5189648 - DNA, 21 bp, Homo sapiens
agcccctgccccagcccaagt

SEQ ID NO: 5189649 - DNA, 13 bp, Homo sapiens
agcccctgcccct

SEQ ID NO: 5189650 - DNA, 18 bp, Homo sapiens
agcccctgcccctcatgc

SEQ ID NO: 5189651 - DNA, 19 bp, Homo sapiens
agcccctgcccctcatgcc

SEQ ID NO: 5189652 - DNA, 12 bp, Homo sapiens
agcccctgccct

SEQ ID NO: 5189653 - DNA, 16 bp, Homo sapiens
agcccctgccctgggg

SEQ ID NO: 5189654 - DNA, 15 bp, Homo sapiens
agcccctgcctgggt

SEQ ID NO: 5189655 - DNA, 13 bp, Homo sapiens
agcccctgctgct

SEQ ID NO: 5189656 - DNA, 12 bp, Homo sapiens
agcccctgctgg

SEQ ID NO: 5189657 - DNA, 16 bp, Homo sapiens
agcccctgctggctgg

SEQ ID NO: 5189658 - DNA, 18 bp, Homo sapiens
agcccctggacatgcctg

SEQ ID NO: 5189659 - DNA, 19 bp, Homo sapiens
agcccctggacatgcctgt

SEQ ID NO: 5189660 - DNA, 20 bp, Homo sapiens
agcccctggacatgcctgtc

SEQ ID NO: 5189661 - DNA, 22 bp, Homo sapiens
agcccctggacatgcctgtcct

SEQ ID NO: 5189662 - DNA, 24 bp, Homo sapiens
agcccctggacatgcctgtcctga

SEQ ID NO: 5189663 - DNA, 18 bp, Homo sapiens
agcccctggacccctggg

SEQ ID NO: 5189664 - DNA, 12 bp, Homo sapiens
agcccctggagc

SEQ ID NO: 5189665 - DNA, 19 bp, Homo sapiens
agcccctggatgcagcctc

SEQ ID NO: 5189666 - DNA, 22 bp, Homo sapiens
agcccctggatgcagcctcaca

SEQ ID NO: 5189667 - DNA, 16 bp, Homo sapiens
agcccctggcactgca

SEQ ID NO: 5189668 - DNA, 14 bp, Homo sapiens
agcccctgggacca

SEQ ID NO: 5189669 - DNA, 16 bp, Homo sapiens
agcccctgggcccagt

SEQ ID NO: 5189670 - DNA, 19 bp, Homo sapiens
agcccctgggcccttgtgc

SEQ ID NO: 5189671 - DNA, 13 bp, Homo sapiens
agcccctggggcc

SEQ ID NO: 5189672 - DNA, 16 bp, Homo sapiens
agcccctggggcccag

SEQ ID NO: 5189673 - DNA, 17 bp, Homo sapiens
agcccctggggcctaga

SEQ ID NO: 5189674 - DNA, 22 bp, Homo sapiens
agcccctggggcctagactctg

SEQ ID NO: 5189675 - DNA, 21 bp, Homo sapiens
agcccctggggtggccaccag

SEQ ID NO: 5189676 - DNA, 22 bp, Homo sapiens
agcccctggggtggccaccagt

SEQ ID NO: 5189677 - DNA, 15 bp, Homo sapiens
agcccctgtcatggt

SEQ ID NO: 5189678 - DNA, 12 bp, Homo sapiens
agcccctgtccc

SEQ ID NO: 5189679 - DNA, 13 bp, Homo sapiens
agcccctgtccca

SEQ ID NO: 5189680 - DNA, 22 bp, Homo sapiens
agcccctgtctagagagggagg

SEQ ID NO: 5189681 - DNA, 23 bp, Homo sapiens
agcccctgtctagagagggaggc

SEQ ID NO: 5189682 - DNA, 14 bp, Homo sapiens
agcccctgtggaga

SEQ ID NO: 5189683 - DNA, 11 bp, Homo sapiens
agcccctgtgt

SEQ ID NO: 5189684 - DNA, 13 bp, Homo sapiens
agcccctgtgttg

SEQ ID NO: 5189685 - DNA, 16 bp, Homo sapiens
agcccctgttttctgc

SEQ ID NO: 5189686 - DNA, 23 bp, Homo sapiens
agccccttactatgatctcagga

SEQ ID NO: 5189687 - DNA, 16 bp, Homo sapiens
agccccttagacagag

SEQ ID NO: 5189688 - DNA, 14 bp, Homo sapiens
agccccttcccctg

SEQ ID NO: 5189689 - DNA, 17 bp, Homo sapiens
agccccttcccctggga

SEQ ID NO: 5189690 - DNA, 13 bp, Homo sapiens
agccccttcccgg

SEQ ID NO: 5189691 - DNA, 15 bp, Homo sapiens
agccccttctcagaa

SEQ ID NO: 5189692 - DNA, 18 bp, Homo sapiens
agccccttctcagaatct

SEQ ID NO: 5189693 - DNA, 15 bp, Homo sapiens
agccccttctcccct

SEQ ID NO: 5189694 - DNA, 23 bp, Homo sapiens
agccccttctcccctccccgcct

SEQ ID NO: 5189695 - DNA, 14 bp, Homo sapiens
agccccttctgacc

SEQ ID NO: 5189696 - DNA, 19 bp, Homo sapiens
agccccttctgacccatgc

SEQ ID NO: 5189697 - DNA, 16 bp, Homo sapiens
agccccttctgctcag

SEQ ID NO: 5189698 - DNA, 22 bp, Homo sapiens
agccccttctgctcagctctgg

SEQ ID NO: 5189699 - DNA, 22 bp, Homo sapiens
agccccttctggccggtgctgg

SEQ ID NO: 5189700 - DNA, 18 bp, Homo sapiens
agccccttgctctcagct

SEQ ID NO: 5189701 - DNA, 21 bp, Homo sapiens
agccccttgcttctaagggat

SEQ ID NO: 5189702 - DNA, 22 bp, Homo sapiens
agccccttggattactttgttt

SEQ ID NO: 5189703 - DNA, 20 bp, Homo sapiens
agccccttggattcctgcac

SEQ ID NO: 5189704 - DNA, 21 bp, Homo sapiens
agcccctttcccttgtagctc

SEQ ID NO: 5189705 - DNA, 15 bp, Homo sapiens
agcccctttgcctct

SEQ ID NO: 5189706 - DNA, 17 bp, Homo sapiens
agcccctttgcctctgt

SEQ ID NO: 5189707 - DNA, 18 bp, Homo sapiens
agcccctttgcctctgtc

SEQ ID NO: 5189708 - DNA, 22 bp, Homo sapiens
agcccctttgcctgtcaagttg

SEQ ID NO: 5189709 - DNA, 17 bp, Homo sapiens
agccccttttctctgct

SEQ ID NO: 5189710 - DNA, 20 bp, Homo sapiens
agccccttttctctgctctt

SEQ ID NO: 5189711 - DNA, 21 bp, Homo sapiens
agcccgaacaccattgaggga

SEQ ID NO: 5189712 - DNA, 13 bp, Homo sapiens
agcccgacagtgc

SEQ ID NO: 5189713 - DNA, 15 bp, Homo sapiens
agcccgacagtgcca

SEQ ID NO: 5189714 - DNA, 17 bp, Homo sapiens
agcccgacagtgccatc

SEQ ID NO: 5189715 - DNA, 19 bp, Homo sapiens
agcccgaggcaccagtgtc

SEQ ID NO: 5189716 - DNA, 16 bp, Homo sapiens
agcccgatattctccc

SEQ ID NO: 5189717 - DNA, 17 bp, Homo sapiens
agcccgatattctccct

SEQ ID NO: 5189718 - DNA, 18 bp, Homo sapiens
agcccgatattctccctg

SEQ ID NO: 5189719 - DNA, 17 bp, Homo sapiens
agcccgatccacattgc

SEQ ID NO: 5189720 - DNA, 18 bp, Homo sapiens
agcccgatgtccctgtcc

SEQ ID NO: 5189721 - DNA, 19 bp, Homo sapiens
agcccgcaactctccagcc

SEQ ID NO: 5189722 - DNA, 15 bp, Homo sapiens
agcccgcacccccac

SEQ ID NO: 5189723 - DNA, 16 bp, Homo sapiens
agcccgcactgtccca

SEQ ID NO: 5189724 - DNA, 16 bp, Homo sapiens
agcccgcagaggtggg

SEQ ID NO: 5189725 - DNA, 19 bp, Homo sapiens
agcccgcagggccatgcag

SEQ ID NO: 5189726 - DNA, 20 bp, Homo sapiens
agcccgcagggccatgcaga

SEQ ID NO: 5189727 - DNA, 14 bp, Homo sapiens
agcccgcatcagct

SEQ ID NO: 5189728 - DNA, 12 bp, Homo sapiens
agcccgcatgca

SEQ ID NO: 5189729 - DNA, 16 bp, Homo sapiens
agcccgcatgcagcag

SEQ ID NO: 5189730 - DNA, 16 bp, Homo sapiens
agcccgcctccagcac

SEQ ID NO: 5189731 - DNA, 21 bp, Homo sapiens
agcccgcctgccgtgcatggc

SEQ ID NO: 5189732 - DNA, 13 bp, Homo sapiens
agcccgcggcctg

SEQ ID NO: 5189733 - DNA, 14 bp, Homo sapiens
agcccgcggcctgg

SEQ ID NO: 5189734 - DNA, 20 bp, Homo sapiens
agcccgcggggacattggga

SEQ ID NO: 5189735 - DNA, 17 bp, Homo sapiens
agcccgcgtgctggaga

SEQ ID NO: 5189736 - DNA, 21 bp, Homo sapiens
agcccgctaggctcgccttcc

SEQ ID NO: 5189737 - DNA, 22 bp, Homo sapiens
agcccgctcctgcccgcccagc

SEQ ID NO: 5189738 - DNA, 23 bp, Homo sapiens
agcccgcttgctcgcttgctgga

SEQ ID NO: 5189739 - DNA, 14 bp, Homo sapiens
agcccgcttggcca

SEQ ID NO: 5189740 - DNA, 21 bp, Homo sapiens
agcccgcttttgttcttcccc

SEQ ID NO: 5189741 - DNA, 20 bp, Homo sapiens
agcccggacggcgggtagga

SEQ ID NO: 5189742 - DNA, 18 bp, Homo sapiens
agcccggagctccggcct

SEQ ID NO: 5189743 - DNA, 19 bp, Homo sapiens
agcccggatgcccacccct

SEQ ID NO: 5189744 - DNA, 19 bp, Homo sapiens
agcccggcagtgcaccccc

SEQ ID NO: 5189745 - DNA, 15 bp, Homo sapiens
agcccggccaaggac

SEQ ID NO: 5189746 - DNA, 22 bp, Homo sapiens
agcccggccaaggacactgatg

SEQ ID NO: 5189747 - DNA, 20 bp, Homo sapiens
agcccggccccacctccctg

SEQ ID NO: 5189748 - DNA, 16 bp, Homo sapiens
agcccggccctccccc

SEQ ID NO: 5189749 - DNA, 21 bp, Homo sapiens
agcccggccctcccccagctc

SEQ ID NO: 5189750 - DNA, 11 bp, Homo sapiens
agcccggcctg

SEQ ID NO: 5189751 - DNA, 20 bp, Homo sapiens
agcccggcctgctcccagca

SEQ ID NO: 5189752 - DNA, 20 bp, Homo sapiens
agcccggcgccaccatcctg

SEQ ID NO: 5189753 - DNA, 21 bp, Homo sapiens
agcccggcgccaccatcctgc

SEQ ID NO: 5189754 - DNA, 22 bp, Homo sapiens
agcccggcgcccctgccacctc

SEQ ID NO: 5189755 - DNA, 21 bp, Homo sapiens
agcccggcggggaccttggtc

SEQ ID NO: 5189756 - DNA, 14 bp, Homo sapiens
agcccggctcctgg

SEQ ID NO: 5189757 - DNA, 16 bp, Homo sapiens
agcccggctcctggtc

SEQ ID NO: 5189758 - DNA, 18 bp, Homo sapiens
agcccggctcggcccagc

SEQ ID NO: 5189759 - DNA, 15 bp, Homo sapiens
agcccggctgctgct

SEQ ID NO: 5189760 - DNA, 15 bp, Homo sapiens
agcccggctggtttt

SEQ ID NO: 5189761 - DNA, 24 bp, Homo sapiens
agcccgggagatccgccctgggct

SEQ ID NO: 5189762 - DNA, 14 bp, Homo sapiens
agcccgggagccta

SEQ ID NO: 5189763 - DNA, 15 bp, Homo sapiens
agcccgggagcctag

SEQ ID NO: 5189764 - DNA, 15 bp, Homo sapiens
agcccgggctctgcc

SEQ ID NO: 5189765 - DNA, 16 bp, Homo sapiens
agcccgggctctgcct

SEQ ID NO: 5189766 - DNA, 18 bp, Homo sapiens
agcccgggctctgcctcc

SEQ ID NO: 5189767 - DNA, 19 bp, Homo sapiens
agcccggggcagagctcag

SEQ ID NO: 5189768 - DNA, 20 bp, Homo sapiens
agcccggggcagagctcaga

SEQ ID NO: 5189769 - DNA, 21 bp, Homo sapiens
agcccggggcagagctcagag

SEQ ID NO: 5189770 - DNA, 16 bp, Homo sapiens
agcccggggccagctt

SEQ ID NO: 5189771 - DNA, 21 bp, Homo sapiens
agcccgggtgtgcctgccctg

SEQ ID NO: 5189772 - DNA, 23 bp, Homo sapiens
agcccgggtgtgcctgccctgga

SEQ ID NO: 5189773 - DNA, 22 bp, Homo sapiens
agcccggtaagagcaaaagaat

SEQ ID NO: 5189774 - DNA, 13 bp, Homo sapiens
agcccggtgcagc

SEQ ID NO: 5189775 - DNA, 17 bp, Homo sapiens
agcccggtggcgtggca

SEQ ID NO: 5189776 - DNA, 20 bp, Homo sapiens
agcccggtgtgaggaggggc

SEQ ID NO: 5189777 - DNA, 19 bp, Homo sapiens
agcccgtcaggccacagcc

SEQ ID NO: 5189778 - DNA, 17 bp, Homo sapiens
agcccgtcatcttccct

SEQ ID NO: 5189779 - DNA, 16 bp, Homo sapiens
agcccgtcgcgctgga

SEQ ID NO: 5189780 - DNA, 14 bp, Homo sapiens
agcccgtctcagtg

SEQ ID NO: 5189781 - DNA, 15 bp, Homo sapiens
agcccgtctcagtgt

SEQ ID NO: 5189782 - DNA, 23 bp, Homo sapiens
agcccgtgatcccctgcttctgg

SEQ ID NO: 5189783 - DNA, 18 bp, Homo sapiens
agcccgtgccacccccag

SEQ ID NO: 5189784 - DNA, 23 bp, Homo sapiens
agcccgtgccacccccagccctg

SEQ ID NO: 5189785 - DNA, 14 bp, Homo sapiens
agcccgtgtcctgc

SEQ ID NO: 5189786 - DNA, 19 bp, Homo sapiens
agcccgtgtcctgccttga

SEQ ID NO: 5189787 - DNA, 16 bp, Homo sapiens
agcccgttagccccag

SEQ ID NO: 5189788 - DNA, 22 bp, Homo sapiens
agccctaaaattccactgcgtt

SEQ ID NO: 5189789 - DNA, 13 bp, Homo sapiens
agccctaaacatc

SEQ ID NO: 5189790 - DNA, 14 bp, Homo sapiens
agccctaaacatca

SEQ ID NO: 5189791 - DNA, 19 bp, Homo sapiens
agccctaagcctgtcccca

SEQ ID NO: 5189792 - DNA, 16 bp, Homo sapiens
agccctaaggatctct

SEQ ID NO: 5189793 - DNA, 17 bp, Homo sapiens
agccctaaggtcctaag

SEQ ID NO: 5189794 - DNA, 16 bp, Homo sapiens
agccctaagtggctgc

SEQ ID NO: 5189795 - DNA, 19 bp, Homo sapiens
agccctaagtggctgcctt

SEQ ID NO: 5189796 - DNA, 21 bp, Homo sapiens
agccctacatcttcagctccc

SEQ ID NO: 5189797 - DNA, 23 bp, Homo sapiens
agccctacatcttcagctcccat

SEQ ID NO: 5189798 - DNA, 16 bp, Homo sapiens
agccctacgatgggat

SEQ ID NO: 5189799 - DNA, 18 bp, Homo sapiens
agccctactccctgcaga

SEQ ID NO: 5189800 - DNA, 24 bp, Homo sapiens
agccctactccctgcagatgccac

SEQ ID NO: 5189801 - DNA, 14 bp, Homo sapiens
agccctactcctgc

SEQ ID NO: 5189802 - DNA, 23 bp, Homo sapiens
agccctactcggatggggcacgg

SEQ ID NO: 5189803 - DNA, 17 bp, Homo sapiens
agccctagactggtgct

SEQ ID NO: 5189804 - DNA, 16 bp, Homo sapiens
agccctagagcctgcc

SEQ ID NO: 5189805 - DNA, 20 bp, Homo sapiens
agcaactcttatttctttcc

SEQ ID NO: 5189806 - DNA, 20 bp, Homo sapiens
agcaactcttgattatccat

SEQ ID NO: 5189807 - DNA, 22 bp, Homo sapiens
agcaactgaacaaaagctcagg

SEQ ID NO: 5189808 - DNA, 14 bp, Homo sapiens
agcaactgaagaca

SEQ ID NO: 5189809 - DNA, 13 bp, Homo sapiens
agcaactgaataa

SEQ ID NO: 5189810 - DNA, 16 bp, Homo sapiens
agcaactgacctgagc

SEQ ID NO: 5189811 - DNA, 23 bp, Homo sapiens
agcaactgcccttccaggtgggt

SEQ ID NO: 5189812 - DNA, 16 bp, Homo sapiens
agcaactgctggggag

SEQ ID NO: 5189813 - DNA, 17 bp, Homo sapiens
agcaactgctggtgatt

SEQ ID NO: 5189814 - DNA, 20 bp, Homo sapiens
agcaactgtctatttctgct

SEQ ID NO: 5189815 - DNA, 11 bp, Homo sapiens
agcaactgtga

SEQ ID NO: 5189816 - DNA, 14 bp, Homo sapiens
agcaactgtgcagc

SEQ ID NO: 5189817 - DNA, 15 bp, Homo sapiens
agcaactgtgcagca

SEQ ID NO: 5189818 - DNA, 19 bp, Homo sapiens
agcaactgttagctgggaa

SEQ ID NO: 5189819 - DNA, 20 bp, Homo sapiens
agcaactgttatgaaataaa

SEQ ID NO: 5189820 - DNA, 21 bp, Homo sapiens
agcaactgttatgaaataaag

SEQ ID NO: 5189821 - DNA, 20 bp, Homo sapiens
agcaactgttggataataac

SEQ ID NO: 5189822 - DNA, 21 bp, Homo sapiens
agcaacttagaatagtttgaa

SEQ ID NO: 5189823 - DNA, 17 bp, Homo sapiens
agcaacttattttgctt

SEQ ID NO: 5189824 - DNA, 15 bp, Homo sapiens
agcaacttcatccca

SEQ ID NO: 5189825 - DNA, 16 bp, Homo sapiens
agcaacttcatcccag

SEQ ID NO: 5189826 - DNA, 19 bp, Homo sapiens
agcaacttcatcccagctg

SEQ ID NO: 5189827 - DNA, 21 bp, Homo sapiens
agcaacttcatcccagctgct

SEQ ID NO: 5189828 - DNA, 23 bp, Homo sapiens
agcaacttcatcccagctgctga

SEQ ID NO: 5189829 - DNA, 18 bp, Homo sapiens
agcaacttgatggaagga

SEQ ID NO: 5189830 - DNA, 13 bp, Homo sapiens
agcaactttctta

SEQ ID NO: 5189831 - DNA, 22 bp, Homo sapiens
agcaacttttccaacatacaat

SEQ ID NO: 5189832 - DNA, 16 bp, Homo sapiens
agcaacttttctcatg

SEQ ID NO: 5189833 - DNA, 20 bp, Homo sapiens
agcaacttttgtgtaatgaa

SEQ ID NO: 5189834 - DNA, 15 bp, Homo sapiens
agcaagaaagaaacc

SEQ ID NO: 5189835 - DNA, 14 bp, Homo sapiens
agcaagaagaaaat

SEQ ID NO: 5189836 - DNA, 15 bp, Homo sapiens
agcaagaagaattga

SEQ ID NO: 5189837 - DNA, 21 bp, Homo sapiens
agcaagaagatcctaaaacaa

SEQ ID NO: 5189838 - DNA, 20 bp, Homo sapiens
agcaagacaatgacactgga

SEQ ID NO: 5189839 - DNA, 23 bp, Homo sapiens
agcaagacagagacgcaggaatg

SEQ ID NO: 5189840 - DNA, 23 bp, Homo sapiens
agcaagacagctcttcttgaaaa

SEQ ID NO: 5189841 - DNA, 23 bp, Homo sapiens
agcaagaccatggggtggaagga

SEQ ID NO: 5189842 - DNA, 22 bp, Homo sapiens
agcaagacgctgtgctgccctg

SEQ ID NO: 5189843 - DNA, 19 bp, Homo sapiens
agcaagacgtcctggaatg

SEQ ID NO: 5189844 - DNA, 21 bp, Homo sapiens
agcaagactccatttcaaaaa

SEQ ID NO: 5189845 - DNA, 22 bp, Homo sapiens
agcaagactccatttcaaaaaa

SEQ ID NO: 5189846 - DNA, 19 bp, Homo sapiens
agcaagactctttcaaaaa

SEQ ID NO: 5189847 - DNA, 16 bp, Homo sapiens
agcaagactgttgctc

SEQ ID NO: 5189848 - DNA, 20 bp, Homo sapiens
agcaagactttataattcct

SEQ ID NO: 5189849 - DNA, 14 bp, Homo sapiens
agcaagagagaacc

SEQ ID NO: 5189850 - DNA, 23 bp, Homo sapiens
agcaagagagaacctaactgtat

SEQ ID NO: 5189851 - DNA, 12 bp, Homo sapiens
agcaagagagat

SEQ ID NO: 5189852 - DNA, 18 bp, Homo sapiens
agcaagagagcagcaagg

SEQ ID NO: 5189853 - DNA, 16 bp, Homo sapiens
agcaagagatattttg

SEQ ID NO: 5189854 - DNA, 24 bp, Homo sapiens
agcaagagatgagaaacaacagaa

SEQ ID NO: 5189855 - DNA, 14 bp, Homo sapiens
agcaagagccaggg

SEQ ID NO: 5189856 - DNA, 17 bp, Homo sapiens
agcaagagccaggggtg

SEQ ID NO: 5189857 - DNA, 22 bp, Homo sapiens
agcaagaggcaagctgaaattt

SEQ ID NO: 5189858 - DNA, 16 bp, Homo sapiens
agcaagagggaacaaa

SEQ ID NO: 5189859 - DNA, 19 bp, Homo sapiens
agcaagagggaacaaaact

SEQ ID NO: 5189860 - DNA, 17 bp, Homo sapiens
agcaagataaacattat

SEQ ID NO: 5189861 - DNA, 20 bp, Homo sapiens
agcaagatattgatcaaata

SEQ ID NO: 5189862 - DNA, 15 bp, Homo sapiens
agcaagatcgctgtg

SEQ ID NO: 5189863 - DNA, 16 bp, Homo sapiens
agcaagatcttgtctc

SEQ ID NO: 5189864 - DNA, 15 bp, Homo sapiens
agcaagatgttttgt

SEQ ID NO: 5189865 - DNA, 23 bp, Homo sapiens
agcaagatgttttgtataaaatc

SEQ ID NO: 5189866 - DNA, 15 bp, Homo sapiens
agcaagcaactaatt

SEQ ID NO: 5189867 - DNA, 23 bp, Homo sapiens
agcaagcaattctgccccacacc

SEQ ID NO: 5189868 - DNA, 16 bp, Homo sapiens
agcaagcacctgggtg

SEQ ID NO: 5189869 - DNA, 23 bp, Homo sapiens
agcaagcagtctaccctgtcctt

SEQ ID NO: 5189870 - DNA, 20 bp, Homo sapiens
agcaagcatttatgtttatt

SEQ ID NO: 5189871 - DNA, 12 bp, Homo sapiens
agcaagccagac

SEQ ID NO: 5189872 - DNA, 14 bp, Homo sapiens
agcaagccagacct

SEQ ID NO: 5189873 - DNA, 19 bp, Homo sapiens
agcaagccagtgtccttcg

SEQ ID NO: 5189874 - DNA, 13 bp, Homo sapiens
agcaagccatcat

SEQ ID NO: 5189875 - DNA, 15 bp, Homo sapiens
agcaagcccgtcatc

SEQ ID NO: 5189876 - DNA, 22 bp, Homo sapiens
agcaagccctgacccaataaag

SEQ ID NO: 5189877 - DNA, 16 bp, Homo sapiens
agcaagcctgaattgg

SEQ ID NO: 5189878 - DNA, 17 bp, Homo sapiens
agcaagcgaaagagcaa

SEQ ID NO: 5189879 - DNA, 16 bp, Homo sapiens
agcaagcggccacaag

SEQ ID NO: 5189880 - DNA, 20 bp, Homo sapiens
agcaagctcccaagggatgg

SEQ ID NO: 5189881 - DNA, 12 bp, Homo sapiens
agcaagctctgc

SEQ ID NO: 5189882 - DNA, 16 bp, Homo sapiens
agcaagctctgccctg

SEQ ID NO: 5189883 - DNA, 15 bp, Homo sapiens
agcaagctcttccct

SEQ ID NO: 5189884 - DNA, 15 bp, Homo sapiens
agcaagctcttctcc

SEQ ID NO: 5189885 - DNA, 19 bp, Homo sapiens
agcaagctgcccagccctg

SEQ ID NO: 5189886 - DNA, 20 bp, Homo sapiens
agcaagctgcccagccctgg

SEQ ID NO: 5189887 - DNA, 21 bp, Homo sapiens
agcaagctgcccagccctggc

SEQ ID NO: 5189888 - DNA, 16 bp, Homo sapiens
agcaagctggcctcta

SEQ ID NO: 5189889 - DNA, 11 bp, Homo sapiens
agcaagctgtg

SEQ ID NO: 5189890 - DNA, 13 bp, Homo sapiens
agcaagctgtgtt

SEQ ID NO: 5189891 - DNA, 16 bp, Homo sapiens
agcaagctgtgttact

SEQ ID NO: 5189892 - DNA, 23 bp, Homo sapiens
agcaagctgtgttacttgaagta

SEQ ID NO: 5189893 - DNA, 15 bp, Homo sapiens
agcaaggaaacatta

SEQ ID NO: 5189894 - DNA, 19 bp, Homo sapiens
agcaaggaaatgtcctgca

SEQ ID NO: 5189895 - DNA, 14 bp, Homo sapiens
agcaaggaaggaca

SEQ ID NO: 5189896 - DNA, 15 bp, Homo sapiens
agcaaggaaggacac

SEQ ID NO: 5189897 - DNA, 16 bp, Homo sapiens
agcaaggaaggtaaaa

SEQ ID NO: 5189898 - DNA, 22 bp, Homo sapiens
agcaaggaaggtaaaaagttaa

SEQ ID NO: 5189899 - DNA, 21 bp, Homo sapiens
agcaaggaagtaagggagtca

SEQ ID NO: 5189900 - DNA, 15 bp, Homo sapiens
agcaaggaatacaag

SEQ ID NO: 5189901 - DNA, 21 bp, Homo sapiens
agcaaggacattgccccaaga

SEQ ID NO: 5189902 - DNA, 17 bp, Homo sapiens
agcaaggaccagtgaga

SEQ ID NO: 5189903 - DNA, 17 bp, Homo sapiens
agcaaggaggctggctg

SEQ ID NO: 5189904 - DNA, 17 bp, Homo sapiens
agcaaggcaagaagtgg

SEQ ID NO: 5189905 - DNA, 19 bp, Homo sapiens
agcaaggcacaggctcctg

SEQ ID NO: 5189906 - DNA, 13 bp, Homo sapiens
agcaaggcacctg

SEQ ID NO: 5189907 - DNA, 13 bp, Homo sapiens
agcaaggcagaag

SEQ ID NO: 5189908 - DNA, 16 bp, Homo sapiens
agcaaggcaggttgga

SEQ ID NO: 5189909 - DNA, 9 bp, Homo sapiens
agcaaggcc

SEQ ID NO: 5189910 - DNA, 22 bp, Homo sapiens
agcaaggccacctcttcctggc

SEQ ID NO: 5189911 - DNA, 15 bp, Homo sapiens
agcaaggccagccct

SEQ ID NO: 5189912 - DNA, 16 bp, Homo sapiens
agcaaggccagggcac

SEQ ID NO: 5189913 - DNA, 18 bp, Homo sapiens
agcaaggccctgctgccc

SEQ ID NO: 5189914 - DNA, 23 bp, Homo sapiens
agcaaggccttggtggagcagcc

SEQ ID NO: 5189915 - DNA, 19 bp, Homo sapiens
agcaaggcgcctgccttgg

SEQ ID NO: 5189916 - DNA, 17 bp, Homo sapiens
agcaaggcgctaacttg

SEQ ID NO: 5189917 - DNA, 20 bp, Homo sapiens
agcaaggcgctaacttgctt

SEQ ID NO: 5189918 - DNA, 13 bp, Homo sapiens
agcaaggctgcta

SEQ ID NO: 5189919 - DNA, 20 bp, Homo sapiens
agcaaggctgctaagtggaa

SEQ ID NO: 5189920 - DNA, 22 bp, Homo sapiens
agcaaggctgctaagtggaaga

SEQ ID NO: 5189921 - DNA, 16 bp, Homo sapiens
agcaaggctgctgccg

SEQ ID NO: 5189922 - DNA, 13 bp, Homo sapiens
agcaaggctgggt

SEQ ID NO: 5189923 - DNA, 19 bp, Homo sapiens
agcaagggaccttcatgcc

SEQ ID NO: 5189924 - DNA, 20 bp, Homo sapiens
agcaagggagaaaagagaaa

SEQ ID NO: 5189925 - DNA, 16 bp, Homo sapiens
agcaagggctccagca

SEQ ID NO: 5189926 - DNA, 18 bp, Homo sapiens
agcaagggctccagcatc

SEQ ID NO: 5189927 - DNA, 20 bp, Homo sapiens
agcaagggctccagcatcca

SEQ ID NO: 5189928 - DNA, 13 bp, Homo sapiens
agcaagggggccc

SEQ ID NO: 5189929 - DNA, 22 bp, Homo sapiens
agcaagggtgatgggaaagcat

SEQ ID NO: 5189930 - DNA, 20 bp, Homo sapiens
agcaagggttccctcaagag

SEQ ID NO: 5189931 - DNA, 21 bp, Homo sapiens
agcaagggttggaggcaatgt

SEQ ID NO: 5189932 - DNA, 14 bp, Homo sapiens
agcaaggtctcaga

SEQ ID NO: 5189933 - DNA, 19 bp, Homo sapiens
agcaaggtgagaaatcaca

SEQ ID NO: 5189934 - DNA, 23 bp, Homo sapiens
agcaaggtgggggtcaggctaca

SEQ ID NO: 5189935 - DNA, 17 bp, Homo sapiens
agcaaggtgtccctgcc

SEQ ID NO: 5189936 - DNA, 19 bp, Homo sapiens
agcaaggtgtccctgcctt

SEQ ID NO: 5189937 - DNA, 16 bp, Homo sapiens
agcaaggtgtgaatga

SEQ ID NO: 5189938 - DNA, 17 bp, Homo sapiens
agcaaggtgtggaggct

SEQ ID NO: 5189939 - DNA, 13 bp, Homo sapiens
agcaagtaaaaag

SEQ ID NO: 5189940 - DNA, 19 bp, Homo sapiens
agcaagtaagaatggccaa

SEQ ID NO: 5189941 - DNA, 20 bp, Homo sapiens
agcaagtacagcggctcccc

SEQ ID NO: 5189942 - DNA, 18 bp, Homo sapiens
agcaagtatgaaccacat

SEQ ID NO: 5189943 - DNA, 17 bp, Homo sapiens
agcaagtatgctgtgga

SEQ ID NO: 5189944 - DNA, 22 bp, Homo sapiens
agcaagtcccttcagactggcc

SEQ ID NO: 5189945 - DNA, 18 bp, Homo sapiens
agcaagtcctcactcttc

SEQ ID NO: 5189946 - DNA, 20 bp, Homo sapiens
agcaagtccttaggctactg

SEQ ID NO: 5189947 - DNA, 13 bp, Homo sapiens
agcaagtctcttt

SEQ ID NO: 5189948 - DNA, 15 bp, Homo sapiens
agcaagtctgcaggt

SEQ ID NO: 5189949 - DNA, 14 bp, Homo sapiens
agcaagtgaatttt

SEQ ID NO: 5189950 - DNA, 20 bp, Homo sapiens
agcaagtgagaccctgtctc

SEQ ID NO: 5189951 - DNA, 13 bp, Homo sapiens
agcaagtgagagc

SEQ ID NO: 5189952 - DNA, 17 bp, Homo sapiens
agcaagtgagagctggg

SEQ ID NO: 5189953 - DNA, 12 bp, Homo sapiens
agcaagtgagca

SEQ ID NO: 5189954 - DNA, 20 bp, Homo sapiens
agcaagtgagcagatgggac

SEQ ID NO: 5189955 - DNA, 22 bp, Homo sapiens
agcaagtgcccagtggagcctg

SEQ ID NO: 5189956 - DNA, 14 bp, Homo sapiens
agcaagtgtacagt

SEQ ID NO: 5189957 - DNA, 18 bp, Homo sapiens
agcaagtgtacagtattt

SEQ ID NO: 5189958 - DNA, 23 bp, Homo sapiens
agcaagtgtgaatactgcttgaa

SEQ ID NO: 5189959 - DNA, 20 bp, Homo sapiens
agcaagttctagagaagagg

SEQ ID NO: 5189960 - DNA, 23 bp, Homo sapiens
agcaagttctagagaagaggctg

SEQ ID NO: 5189961 - DNA, 20 bp, Homo sapiens
agcaagttctgagagccagg

SEQ ID NO: 5189962 - DNA, 14 bp, Homo sapiens
agcaagtttaatca

SEQ ID NO: 5189963 - DNA, 21 bp, Homo sapiens
agcaagtttcatcagccctag

SEQ ID NO: 5189964 - DNA, 14 bp, Homo sapiens
agcaataaagaaga

SEQ ID NO: 5189965 - DNA, 18 bp, Homo sapiens
agcaataaagatttttca

SEQ ID NO: 5189966 - DNA, 15 bp, Homo sapiens
agcaataaatgcttt

SEQ ID NO: 5189967 - DNA, 19 bp, Homo sapiens
agcaataacactatattta

SEQ ID NO: 5189968 - DNA, 12 bp, Homo sapiens
agcaataacttc

SEQ ID NO: 5189969 - DNA, 21 bp, Homo sapiens
agcaataacttctatgttggt

SEQ ID NO: 5189970 - DNA, 22 bp, Homo sapiens
agcaataacttctatgttggtt

SEQ ID NO: 5189971 - DNA, 13 bp, Homo sapiens
agcaataagaaat

SEQ ID NO: 5189972 - DNA, 20 bp, Homo sapiens
agcaataagaaatgaacaaa

SEQ ID NO: 5189973 - DNA, 17 bp, Homo sapiens
agcaataagttcattaa

SEQ ID NO: 5189974 - DNA, 22 bp, Homo sapiens
agcaataagttcattaaacaga

SEQ ID NO: 5189975 - DNA, 17 bp, Homo sapiens
agcaataagttgaatga

SEQ ID NO: 5189976 - DNA, 13 bp, Homo sapiens
agcaataattagg

SEQ ID NO: 5189977 - DNA, 18 bp, Homo sapiens
agcaataattaggatcta

SEQ ID NO: 5189978 - DNA, 21 bp, Homo sapiens
agcaataattaggatctatgc

SEQ ID NO: 5189979 - DNA, 15 bp, Homo sapiens
agcaatacaacttta

SEQ ID NO: 5189980 - DNA, 14 bp, Homo sapiens
agcaatacagggag

SEQ ID NO: 5189981 - DNA, 17 bp, Homo sapiens
agcaataccctgtcttt

SEQ ID NO: 5189982 - DNA, 22 bp, Homo sapiens
agccctagaggcgagccaggca

SEQ ID NO: 5189983 - DNA, 16 bp, Homo sapiens
agccctagccctcagc

SEQ ID NO: 5189984 - DNA, 16 bp, Homo sapiens
agccctagcggctgct

SEQ ID NO: 5189985 - DNA, 22 bp, Homo sapiens
agccctagcggctgctccttca

SEQ ID NO: 5189986 - DNA, 16 bp, Homo sapiens
agccctagctgtccca

SEQ ID NO: 5189987 - DNA, 15 bp, Homo sapiens
agccctaggctaccc

SEQ ID NO: 5189988 - DNA, 16 bp, Homo sapiens
agccctagggtggaga

SEQ ID NO: 5189989 - DNA, 17 bp, Homo sapiens
agccctagggtggagag

SEQ ID NO: 5189990 - DNA, 18 bp, Homo sapiens
agccctagtagctggcgc

SEQ ID NO: 5189991 - DNA, 13 bp, Homo sapiens
agccctagtggga

SEQ ID NO: 5189992 - DNA, 19 bp, Homo sapiens
agccctagtgggagcccag

SEQ ID NO: 5189993 - DNA, 22 bp, Homo sapiens
agccctagtgggagcccagcac

SEQ ID NO: 5189994 - DNA, 19 bp, Homo sapiens
agccctatctatgtcctgg

SEQ ID NO: 5189995 - DNA, 13 bp, Homo sapiens
agccctatggatg

SEQ ID NO: 5189996 - DNA, 16 bp, Homo sapiens
agccctatggatgtgg

SEQ ID NO: 5189997 - DNA, 15 bp, Homo sapiens
agccctattgctgct

SEQ ID NO: 5189998 - DNA, 16 bp, Homo sapiens
agccctattgctgcta

SEQ ID NO: 5189999 - DNA, 16 bp, Homo sapiens
agccctatttcttgat

SEQ ID NO: 5190000 - DNA, 20 bp, Homo sapiens
agccctcaaagaagtcggaa

SEQ ID NO: 5190001 - DNA, 21 bp, Homo sapiens
agccctcaaagaagtcggaat

SEQ ID NO: 5190002 - DNA, 13 bp, Homo sapiens
agccctcaaagtg

SEQ ID NO: 5190003 - DNA, 18 bp, Homo sapiens
agccctcaacaggcccag

SEQ ID NO: 5190004 - DNA, 23 bp, Homo sapiens
agccctcacacaccctgtctgcc

SEQ ID NO: 5190005 - DNA, 14 bp, Homo sapiens
agccctcacctctg

SEQ ID NO: 5190006 - DNA, 13 bp, Homo sapiens
agccctcactgtc

SEQ ID NO: 5190007 - DNA, 10 bp, Homo sapiens
agccctcaga

SEQ ID NO: 5190008 - DNA, 14 bp, Homo sapiens
agccctcagaaccc

SEQ ID NO: 5190009 - DNA, 15 bp, Homo sapiens
agccctcagaaccct

SEQ ID NO: 5190010 - DNA, 15 bp, Homo sapiens
agccctcagaagaaa

SEQ ID NO: 5190011 - DNA, 22 bp, Homo sapiens
agccctcagacatttatatatt

SEQ ID NO: 5190012 - DNA, 18 bp, Homo sapiens
agccctcagatcccaggg

SEQ ID NO: 5190013 - DNA, 12 bp, Homo sapiens
agccctcaggcc

SEQ ID NO: 5190014 - DNA, 17 bp, Homo sapiens
agccctcaggccagtgc

SEQ ID NO: 5190015 - DNA, 19 bp, Homo sapiens
agccctcaggccagtgcca

SEQ ID NO: 5190016 - DNA, 20 bp, Homo sapiens
agccctcaggccagtgccag

SEQ ID NO: 5190017 - DNA, 14 bp, Homo sapiens
agccctcaggctcc

SEQ ID NO: 5190018 - DNA, 21 bp, Homo sapiens
agccctcaggctccccagaac

SEQ ID NO: 5190019 - DNA, 16 bp, Homo sapiens
agccctcagtcacccc

SEQ ID NO: 5190020 - DNA, 21 bp, Homo sapiens
agccctcagtcggggcaggcc

SEQ ID NO: 5190021 - DNA, 23 bp, Homo sapiens
agccctcagttccttcatttcca

SEQ ID NO: 5190022 - DNA, 23 bp, Homo sapiens
agccctcatgataatctgggcat

SEQ ID NO: 5190023 - DNA, 20 bp, Homo sapiens
agccctcatttttataacct

SEQ ID NO: 5190024 - DNA, 16 bp, Homo sapiens
agccctccacattttc

SEQ ID NO: 5190025 - DNA, 20 bp, Homo sapiens
agccctccactccagctctg

SEQ ID NO: 5190026 - DNA, 13 bp, Homo sapiens
agccctccagagc

SEQ ID NO: 5190027 - DNA, 18 bp, Homo sapiens
agccctccaggcctgcag

SEQ ID NO: 5190028 - DNA, 20 bp, Homo sapiens
agccctccaggcctgcaggg

SEQ ID NO: 5190029 - DNA, 21 bp, Homo sapiens
agccctccatctaaactgccc

SEQ ID NO: 5190030 - DNA, 23 bp, Homo sapiens
agccctccatctaaactgccccc

SEQ ID NO: 5190031 - DNA, 16 bp, Homo sapiens
agccctccatggcctg

SEQ ID NO: 5190032 - DNA, 21 bp, Homo sapiens
agccctccatggtcctgtctg

SEQ ID NO: 5190033 - DNA, 16 bp, Homo sapiens
agccctcccagctggt

SEQ ID NO: 5190034 - DNA, 11 bp, Homo sapiens
agccctcccca

SEQ ID NO: 5190035 - DNA, 16 bp, Homo sapiens
agccctccccacctgc

SEQ ID NO: 5190036 - DNA, 19 bp, Homo sapiens
agccctccccatggagcca

SEQ ID NO: 5190037 - DNA, 17 bp, Homo sapiens
agccctccccccagctc

SEQ ID NO: 5190038 - DNA, 18 bp, Homo sapiens
agccctccccccagctcc

SEQ ID NO: 5190039 - DNA, 19 bp, Homo sapiens
agccctccccccagctccc

SEQ ID NO: 5190040 - DNA, 14 bp, Homo sapiens
agccctccctatgt

SEQ ID NO: 5190041 - DNA, 16 bp, Homo sapiens
agccctccctcttccc

SEQ ID NO: 5190042 - DNA, 20 bp, Homo sapiens
agccctccctcttcccagca

SEQ ID NO: 5190043 - DNA, 21 bp, Homo sapiens
agccctccctcttcccagcac

SEQ ID NO: 5190044 - DNA, 22 bp, Homo sapiens
agccctccctgcccctcccttc

SEQ ID NO: 5190045 - DNA, 22 bp, Homo sapiens
agccctccctggcatgtcagag

SEQ ID NO: 5190046 - DNA, 20 bp, Homo sapiens
agccctccctgtcctcctcg

SEQ ID NO: 5190047 - DNA, 23 bp, Homo sapiens
agccctccgccattctcaagccc

SEQ ID NO: 5190048 - DNA, 15 bp, Homo sapiens
agccctccgccttca

SEQ ID NO: 5190049 - DNA, 14 bp, Homo sapiens
agccctcctacgca

SEQ ID NO: 5190050 - DNA, 12 bp, Homo sapiens
agccctcctccc

SEQ ID NO: 5190051 - DNA, 18 bp, Homo sapiens
agccctcctccccagagc

SEQ ID NO: 5190052 - DNA, 14 bp, Homo sapiens
agccctcctgagca

SEQ ID NO: 5190053 - DNA, 15 bp, Homo sapiens
agccctcctgagggc

SEQ ID NO: 5190054 - DNA, 16 bp, Homo sapiens
agccctcctgagggcc

SEQ ID NO: 5190055 - DNA, 12 bp, Homo sapiens
agccctccttcc

SEQ ID NO: 5190056 - DNA, 17 bp, Homo sapiens
agccctccttccacgga

SEQ ID NO: 5190057 - DNA, 19 bp, Homo sapiens
agccctccttcttgccctg

SEQ ID NO: 5190058 - DNA, 20 bp, Homo sapiens
agccctccttcttgccctga

SEQ ID NO: 5190059 - DNA, 22 bp, Homo sapiens
agccctccttcttgccctgagc

SEQ ID NO: 5190060 - DNA, 14 bp, Homo sapiens
agccctccttgcca

SEQ ID NO: 5190061 - DNA, 16 bp, Homo sapiens
agccctcctttggtta

SEQ ID NO: 5190062 - DNA, 20 bp, Homo sapiens
agccctcgaaccaaggcagc

SEQ ID NO: 5190063 - DNA, 24 bp, Homo sapiens
agccctcgaaccaaggcagcctcc

SEQ ID NO: 5190064 - DNA, 14 bp, Homo sapiens
agccctctagggca

SEQ ID NO: 5190065 - DNA, 17 bp, Homo sapiens
agccctctcactccagc

SEQ ID NO: 5190066 - DNA, 13 bp, Homo sapiens
agccctctcagat

SEQ ID NO: 5190067 - DNA, 23 bp, Homo sapiens
agccctctcatcgtcttttagtt

SEQ ID NO: 5190068 - DNA, 19 bp, Homo sapiens
agccctctccaaatcaagg

SEQ ID NO: 5190069 - DNA, 19 bp, Homo sapiens
agccctctccacccagagg

SEQ ID NO: 5190070 - DNA, 21 bp, Homo sapiens
agccctctccacccagaggtc

SEQ ID NO: 5190071 - DNA, 17 bp, Homo sapiens
agccctctccctcagtc

SEQ ID NO: 5190072 - DNA, 14 bp, Homo sapiens
agccctctcctccc

SEQ ID NO: 5190073 - DNA, 16 bp, Homo sapiens
agccctctctctcact

SEQ ID NO: 5190074 - DNA, 16 bp, Homo sapiens
agccctctgagccgcc

SEQ ID NO: 5190075 - DNA, 17 bp, Homo sapiens
agccctctgagccgcca

SEQ ID NO: 5190076 - DNA, 20 bp, Homo sapiens
agccctctgcctcctcccca

SEQ ID NO: 5190077 - DNA, 18 bp, Homo sapiens
agccctctgtggccagga

SEQ ID NO: 5190078 - DNA, 20 bp, Homo sapiens
agccctctgtggccaggagc

SEQ ID NO: 5190079 - DNA, 22 bp, Homo sapiens
agccctctgtggccaggagccc

SEQ ID NO: 5190080 - DNA, 16 bp, Homo sapiens
agccctcttcaggggt

SEQ ID NO: 5190081 - DNA, 20 bp, Homo sapiens
agccctcttcaggggtcacc

SEQ ID NO: 5190082 - DNA, 11 bp, Homo sapiens
agccctcttcc

SEQ ID NO: 5190083 - DNA, 19 bp, Homo sapiens
agccctctttaatgctgtc

SEQ ID NO: 5190084 - DNA, 14 bp, Homo sapiens
agccctctttctct

SEQ ID NO: 5190085 - DNA, 17 bp, Homo sapiens
agccctctttctctctg

SEQ ID NO: 5190086 - DNA, 22 bp, Homo sapiens
agccctctttctctctgtgtgg

SEQ ID NO: 5190087 - DNA, 18 bp, Homo sapiens
agccctgaacctttgtcc

SEQ ID NO: 5190088 - DNA, 17 bp, Homo sapiens
agccctgaatttcttct

SEQ ID NO: 5190089 - DNA, 18 bp, Homo sapiens
agccctgaatttcttctt

SEQ ID NO: 5190090 - DNA, 12 bp, Homo sapiens
agccctgacaac

SEQ ID NO: 5190091 - DNA, 11 bp, Homo sapiens
agccctgactc

SEQ ID NO: 5190092 - DNA, 19 bp, Homo sapiens
agccctgactcctggactc

SEQ ID NO: 5190093 - DNA, 16 bp, Homo sapiens
agccctgagactcccg

SEQ ID NO: 5190094 - DNA, 22 bp, Homo sapiens
agccctgagactcccgcctttg

SEQ ID NO: 5190095 - DNA, 12 bp, Homo sapiens
agccctgagccc

SEQ ID NO: 5190096 - DNA, 17 bp, Homo sapiens
agccctgagcctggcag

SEQ ID NO: 5190097 - DNA, 18 bp, Homo sapiens
agccctgagcctggcagg

SEQ ID NO: 5190098 - DNA, 18 bp, Homo sapiens
agccctgagctcaggctg

SEQ ID NO: 5190099 - DNA, 20 bp, Homo sapiens
agccctgagctcaggctgag

SEQ ID NO: 5190100 - DNA, 18 bp, Homo sapiens
agccctgaggacctctca

SEQ ID NO: 5190101 - DNA, 17 bp, Homo sapiens
agccctgaggaggcctt

SEQ ID NO: 5190102 - DNA, 16 bp, Homo sapiens
agccctgaggggctgg

SEQ ID NO: 5190103 - DNA, 20 bp, Homo sapiens
agccctgaggggctgggctg

SEQ ID NO: 5190104 - DNA, 13 bp, Homo sapiens
agccctgaggggt

SEQ ID NO: 5190105 - DNA, 21 bp, Homo sapiens
agccctgaggtgaaagggagc

SEQ ID NO: 5190106 - DNA, 16 bp, Homo sapiens
agccctgagtgtccca

SEQ ID NO: 5190107 - DNA, 18 bp, Homo sapiens
agccctgagttcctagcc

SEQ ID NO: 5190108 - DNA, 23 bp, Homo sapiens
agccctgagttcctagccaccgc

SEQ ID NO: 5190109 - DNA, 21 bp, Homo sapiens
agccctgattgcgcaaaactg

SEQ ID NO: 5190110 - DNA, 14 bp, Homo sapiens
agccctgcacgacc

SEQ ID NO: 5190111 - DNA, 18 bp, Homo sapiens
agccctgcacgacccctg

SEQ ID NO: 5190112 - DNA, 15 bp, Homo sapiens
agccctgcagagcac

SEQ ID NO: 5190113 - DNA, 15 bp, Homo sapiens
agccctgcagagggc

SEQ ID NO: 5190114 - DNA, 13 bp, Homo sapiens
agccctgcagtca

SEQ ID NO: 5190115 - DNA, 16 bp, Homo sapiens
agccctgcataatgtt

SEQ ID NO: 5190116 - DNA, 18 bp, Homo sapiens
agccctgcataatgttaa

SEQ ID NO: 5190117 - DNA, 12 bp, Homo sapiens
agccctgccagg

SEQ ID NO: 5190118 - DNA, 14 bp, Homo sapiens
agccctgcccaccc

SEQ ID NO: 5190119 - DNA, 12 bp, Homo sapiens
agccctgcccag

SEQ ID NO: 5190120 - DNA, 15 bp, Homo sapiens
agccctgcccagagt

SEQ ID NO: 5190121 - DNA, 11 bp, Homo sapiens
agccctgccct

SEQ ID NO: 5190122 - DNA, 12 bp, Homo sapiens
agccctgccctc

SEQ ID NO: 5190123 - DNA, 15 bp, Homo sapiens
agccctgccctcact

SEQ ID NO: 5190124 - DNA, 19 bp, Homo sapiens
agccctgccctcactccac

SEQ ID NO: 5190125 - DNA, 22 bp, Homo sapiens
agccctgccctcactccactcc

SEQ ID NO: 5190126 - DNA, 15 bp, Homo sapiens
agccctgccctccca

SEQ ID NO: 5190127 - DNA, 22 bp, Homo sapiens
agccctgccctcccaagtccca

SEQ ID NO: 5190128 - DNA, 13 bp, Homo sapiens
agccctgccctgc

SEQ ID NO: 5190129 - DNA, 15 bp, Homo sapiens
agccctgccctgcac

SEQ ID NO: 5190130 - DNA, 13 bp, Homo sapiens
agccctgcctgga

SEQ ID NO: 5190131 - DNA, 21 bp, Homo sapiens
agccctgcctggaggacctga

SEQ ID NO: 5190132 - DNA, 16 bp, Homo sapiens
agccctgcggagccgg

SEQ ID NO: 5190133 - DNA, 11 bp, Homo sapiens
agccctgctcc

SEQ ID NO: 5190134 - DNA, 18 bp, Homo sapiens
agccctgctccaactcca

SEQ ID NO: 5190135 - DNA, 19 bp, Homo sapiens
agccctgctccaactccat

SEQ ID NO: 5190136 - DNA, 14 bp, Homo sapiens
agccctgctccctg

SEQ ID NO: 5190137 - DNA, 16 bp, Homo sapiens
agccctgctccctgcc

SEQ ID NO: 5190138 - DNA, 20 bp, Homo sapiens
agccctgctccctgcctcct

SEQ ID NO: 5190139 - DNA, 21 bp, Homo sapiens
agccctgctccctgcctcctg

SEQ ID NO: 5190140 - DNA, 22 bp, Homo sapiens
agccctgctccctgcctcctgc

SEQ ID NO: 5190141 - DNA, 15 bp, Homo sapiens
agccctgctcttctc

SEQ ID NO: 5190142 - DNA, 21 bp, Homo sapiens
agccctgctcttctctcccca

SEQ ID NO: 5190143 - DNA, 18 bp, Homo sapiens
agccctgctgcttcctaa

SEQ ID NO: 5190144 - DNA, 19 bp, Homo sapiens
agccctgctgcttcctaac

SEQ ID NO: 5190145 - DNA, 12 bp, Homo sapiens
agccctgctggc

SEQ ID NO: 5190146 - DNA, 13 bp, Homo sapiens
agccctgctggcc

SEQ ID NO: 5190147 - DNA, 17 bp, Homo sapiens
agccctgctttgggctg

SEQ ID NO: 5190148 - DNA, 16 bp, Homo sapiens
agccctggaccccagg

SEQ ID NO: 5190149 - DNA, 18 bp, Homo sapiens
agccctggagagccccat

SEQ ID NO: 5190150 - DNA, 23 bp, Homo sapiens
agccctggagccaactgctgctt

SEQ ID NO: 5190151 - DNA, 13 bp, Homo sapiens
agccctggaggct

SEQ ID NO: 5190152 - DNA, 16 bp, Homo sapiens
agccctggaggctgga

SEQ ID NO: 5190153 - DNA, 18 bp, Homo sapiens
agccctggaggtgccagc

SEQ ID NO: 5190154 - DNA, 17 bp, Homo sapiens
agccctggatggcctct

SEQ ID NO: 5190155 - DNA, 20 bp, Homo sapiens
agccctggatggcctctggg

SEQ ID NO: 5190156 - DNA, 23 bp, Homo sapiens
agccctggatggcctctggggca

SEQ ID NO: 5190157 - DNA, 16 bp, Homo sapiens
agccctggatggtggc

SEQ ID NO: 5190158 - DNA, 18 bp, Homo sapiens
agccctggccaagctttg

SEQ ID NO: 5190159 - DNA, 16 bp, Homo sapiens
agccctggccagaggc

SEQ ID NO: 5190160 - DNA, 17 bp, Homo sapiens
agccctggccagaggct

SEQ ID NO: 5190161 - DNA, 19 bp, Homo sapiens
agcaataccctgtctttaa

SEQ ID NO: 5190162 - DNA, 17 bp, Homo sapiens
agcaatacgtttgtgca

SEQ ID NO: 5190163 - DNA, 20 bp, Homo sapiens
agcaatactgccgctgcccc

SEQ ID NO: 5190164 - DNA, 23 bp, Homo sapiens
agcaataggtagctggggagccc

SEQ ID NO: 5190165 - DNA, 22 bp, Homo sapiens
agcaataggtggaaagagaaat

SEQ ID NO: 5190166 - DNA, 18 bp, Homo sapiens
agcaataggtttgtaaaa

SEQ ID NO: 5190167 - DNA, 24 bp, Homo sapiens
agcaatatattaccagcaagaata

SEQ ID NO: 5190168 - DNA, 18 bp, Homo sapiens
agcaatatatttgtaggt

SEQ ID NO: 5190169 - DNA, 12 bp, Homo sapiens
agcaatatgcat

SEQ ID NO: 5190170 - DNA, 14 bp, Homo sapiens
agcaatattatact

SEQ ID NO: 5190171 - DNA, 14 bp, Homo sapiens
agcaatatttaaca

SEQ ID NO: 5190172 - DNA, 16 bp, Homo sapiens
agcaatatttaaggag

SEQ ID NO: 5190173 - DNA, 17 bp, Homo sapiens
agcaatatttaaggaga

SEQ ID NO: 5190174 - DNA, 12 bp, Homo sapiens
agcaatatttat

SEQ ID NO: 5190175 - DNA, 13 bp, Homo sapiens
agcaatattttgt

SEQ ID NO: 5190176 - DNA, 16 bp, Homo sapiens
agcaatcacaaaggct

SEQ ID NO: 5190177 - DNA, 16 bp, Homo sapiens
agcaatcactgggccc

SEQ ID NO: 5190178 - DNA, 17 bp, Homo sapiens
agcaatcactgggccca

SEQ ID NO: 5190179 - DNA, 18 bp, Homo sapiens
agcaatcactgggcccag

SEQ ID NO: 5190180 - DNA, 20 bp, Homo sapiens
agcaatcactgggcccagag

SEQ ID NO: 5190181 - DNA, 21 bp, Homo sapiens
agcaatcactgggcccagagg

SEQ ID NO: 5190182 - DNA, 21 bp, Homo sapiens
agcaatcagattttcctgtgg

SEQ ID NO: 5190183 - DNA, 14 bp, Homo sapiens
agcaatcagcaaac

SEQ ID NO: 5190184 - DNA, 19 bp, Homo sapiens
agcaatcagcaaacacaat

SEQ ID NO: 5190185 - DNA, 15 bp, Homo sapiens
agcaatcattttata

SEQ ID NO: 5190186 - DNA, 17 bp, Homo sapiens
agcaatccacctgcctt

SEQ ID NO: 5190187 - DNA, 18 bp, Homo sapiens
agcaatccacctgccttg

SEQ ID NO: 5190188 - DNA, 23 bp, Homo sapiens
agcaatccatgagatagctatta

SEQ ID NO: 5190189 - DNA, 17 bp, Homo sapiens
agcaatccatgttagtt

SEQ ID NO: 5190190 - DNA, 23 bp, Homo sapiens
agcaatccatgttagtttttact

SEQ ID NO: 5190191 - DNA, 21 bp, Homo sapiens
agcaatcctcctacctcagcc

SEQ ID NO: 5190192 - DNA, 16 bp, Homo sapiens
agcaatcctcctgcct

SEQ ID NO: 5190193 - DNA, 17 bp, Homo sapiens
agcaatcctcctgcctc

SEQ ID NO: 5190194 - DNA, 22 bp, Homo sapiens
agcaatcctcctgcctcagcct

SEQ ID NO: 5190195 - DNA, 18 bp, Homo sapiens
agcaatcgcatcccggct

SEQ ID NO: 5190196 - DNA, 17 bp, Homo sapiens
agcaatctccttactgt

SEQ ID NO: 5190197 - DNA, 19 bp, Homo sapiens
agcaatctccttactgtgt

SEQ ID NO: 5190198 - DNA, 15 bp, Homo sapiens
agcaatctgcctgta

SEQ ID NO: 5190199 - DNA, 15 bp, Homo sapiens
agcaatctggaagaa

SEQ ID NO: 5190200 - DNA, 16 bp, Homo sapiens
agcaatctgttgaaat

SEQ ID NO: 5190201 - DNA, 14 bp, Homo sapiens
agcaatcttgctgt

SEQ ID NO: 5190202 - DNA, 15 bp, Homo sapiens
agcaatcttgctgtg

SEQ ID NO: 5190203 - DNA, 18 bp, Homo sapiens
agcaatcttgctgtgaaa

SEQ ID NO: 5190204 - DNA, 17 bp, Homo sapiens
agcaatctttgaaataa

SEQ ID NO: 5190205 - DNA, 18 bp, Homo sapiens
agcaatgatgacccacta

SEQ ID NO: 5190206 - DNA, 23 bp, Homo sapiens
agcaatgatgtccagaagaatat

SEQ ID NO: 5190207 - DNA, 23 bp, Homo sapiens
agcaatgcaagaaaaaaacttac

SEQ ID NO: 5190208 - DNA, 15 bp, Homo sapiens
agcaatgcattctgg

SEQ ID NO: 5190209 - DNA, 20 bp, Homo sapiens
agcaatgccatttcagtggc

SEQ ID NO: 5190210 - DNA, 16 bp, Homo sapiens
agcaatgccccaaact

SEQ ID NO: 5190211 - DNA, 17 bp, Homo sapiens
agcaatgccccaaactt

SEQ ID NO: 5190212 - DNA, 22 bp, Homo sapiens
agcaatgccccaaactttctca

SEQ ID NO: 5190213 - DNA, 23 bp, Homo sapiens
agcaatgccccaaactttctcat

SEQ ID NO: 5190214 - DNA, 14 bp, Homo sapiens
agcaatgccctgcc

SEQ ID NO: 5190215 - DNA, 16 bp, Homo sapiens
agcaatgccctgcctt

SEQ ID NO: 5190216 - DNA, 23 bp, Homo sapiens
agcaatgccctgccttgctgcct

SEQ ID NO: 5190217 - DNA, 15 bp, Homo sapiens
agcaatgcctgccca

SEQ ID NO: 5190218 - DNA, 21 bp, Homo sapiens
agcaatgctgatgaatcactg

SEQ ID NO: 5190219 - DNA, 13 bp, Homo sapiens
agcaatgctgtga

SEQ ID NO: 5190220 - DNA, 15 bp, Homo sapiens
agcaatgctgttgga

SEQ ID NO: 5190221 - DNA, 16 bp, Homo sapiens
agcaatggatatttgt

SEQ ID NO: 5190222 - DNA, 14 bp, Homo sapiens
agcaatggccagag

SEQ ID NO: 5190223 - DNA, 22 bp, Homo sapiens
agcaatggccagagcctctggc

SEQ ID NO: 5190224 - DNA, 12 bp, Homo sapiens
agcaatgggact

SEQ ID NO: 5190225 - DNA, 17 bp, Homo sapiens
agcaatgggagggggct

SEQ ID NO: 5190226 - DNA, 22 bp, Homo sapiens
agcaatgggagggggctccatg

SEQ ID NO: 5190227 - DNA, 23 bp, Homo sapiens
agcaatgggagggggctccatgg

SEQ ID NO: 5190228 - DNA, 16 bp, Homo sapiens
agcaatgggggcctcc

SEQ ID NO: 5190229 - DNA, 23 bp, Homo sapiens
agcaatgggtcttagctctttct

SEQ ID NO: 5190230 - DNA, 19 bp, Homo sapiens
agcaatggtaactgcacct

SEQ ID NO: 5190231 - DNA, 15 bp, Homo sapiens
agcaatgtctgtgct

SEQ ID NO: 5190232 - DNA, 22 bp, Homo sapiens
agcaatgtgagtcccagagccc

SEQ ID NO: 5190233 - DNA, 17 bp, Homo sapiens
agcaatgttatcttggt

SEQ ID NO: 5190234 - DNA, 20 bp, Homo sapiens
agcaatgttccaggaatgaa

SEQ ID NO: 5190235 - DNA, 14 bp, Homo sapiens
agcaatgttggttt

SEQ ID NO: 5190236 - DNA, 15 bp, Homo sapiens
agcaatgttggtttt

SEQ ID NO: 5190237 - DNA, 22 bp, Homo sapiens
agcaatgttggttttttataaa

SEQ ID NO: 5190238 - DNA, 16 bp, Homo sapiens
agcaatgtttttctca

SEQ ID NO: 5190239 - DNA, 17 bp, Homo sapiens
agcaatgtttttctcaa

SEQ ID NO: 5190240 - DNA, 18 bp, Homo sapiens
agcaatgtttttctcaaa

SEQ ID NO: 5190241 - DNA, 15 bp, Homo sapiens
agcaattaaatgata

SEQ ID NO: 5190242 - DNA, 22 bp, Homo sapiens
agcaattaataatgtttataag

SEQ ID NO: 5190243 - DNA, 21 bp, Homo sapiens
agcaattacaacggagtcaaa

SEQ ID NO: 5190244 - DNA, 17 bp, Homo sapiens
agcaattactacaaatg

SEQ ID NO: 5190245 - DNA, 16 bp, Homo sapiens
agcaattcagacccct

SEQ ID NO: 5190246 - DNA, 19 bp, Homo sapiens
agcaattcatggttcaagt

SEQ ID NO: 5190247 - DNA, 20 bp, Homo sapiens
agcaattcatggttcaagta

SEQ ID NO: 5190248 - DNA, 21 bp, Homo sapiens
agcaattcatggttcaagtat

SEQ ID NO: 5190249 - DNA, 16 bp, Homo sapiens
agcaattcatttcact

SEQ ID NO: 5190250 - DNA, 19 bp, Homo sapiens
agcaattcatttcacttta

SEQ ID NO: 5190251 - DNA, 20 bp, Homo sapiens
agcaattcatttcactttaa

SEQ ID NO: 5190252 - DNA, 15 bp, Homo sapiens
agcaattccaacctt

SEQ ID NO: 5190253 - DNA, 16 bp, Homo sapiens
agcaattccaggctga

SEQ ID NO: 5190254 - DNA, 20 bp, Homo sapiens
agcaattccaggctgagcca

SEQ ID NO: 5190255 - DNA, 21 bp, Homo sapiens
agcaattccaggctgagccat

SEQ ID NO: 5190256 - DNA, 23 bp, Homo sapiens
agcaattccaggctgagccatga

SEQ ID NO: 5190257 - DNA, 23 bp, Homo sapiens
agcaattccatgctataaaaact

SEQ ID NO: 5190258 - DNA, 17 bp, Homo sapiens
agcaattcccaggtcat

SEQ ID NO: 5190259 - DNA, 15 bp, Homo sapiens
agcaattctcctgcc

SEQ ID NO: 5190260 - DNA, 16 bp, Homo sapiens
agcaattctctttctt

SEQ ID NO: 5190261 - DNA, 16 bp, Homo sapiens
agcaattctgactgtc

SEQ ID NO: 5190262 - DNA, 20 bp, Homo sapiens
agcaattgctgcatcttagt

SEQ ID NO: 5190263 - DNA, 13 bp, Homo sapiens
agcaattggctcc

SEQ ID NO: 5190264 - DNA, 13 bp, Homo sapiens
agcaatttaaatg

SEQ ID NO: 5190265 - DNA, 16 bp, Homo sapiens
agcaatttaaatgtta

SEQ ID NO: 5190266 - DNA, 17 bp, Homo sapiens
agcaatttaactagaca

SEQ ID NO: 5190267 - DNA, 19 bp, Homo sapiens
agcaatttaactagacaca

SEQ ID NO: 5190268 - DNA, 13 bp, Homo sapiens
agcaatttactga

SEQ ID NO: 5190269 - DNA, 22 bp, Homo sapiens
agcaatttactgatgagagaat

SEQ ID NO: 5190270 - DNA, 16 bp, Homo sapiens
agcaatttagacaaag

SEQ ID NO: 5190271 - DNA, 21 bp, Homo sapiens
agcaatttatatctttatgca

SEQ ID NO: 5190272 - DNA, 17 bp, Homo sapiens
agcaatttcagttttaa

SEQ ID NO: 5190273 - DNA, 22 bp, Homo sapiens
agcaatttccccctaaaccaac

SEQ ID NO: 5190274 - DNA, 21 bp, Homo sapiens
agcaatttcgccgttgaagag

SEQ ID NO: 5190275 - DNA, 13 bp, Homo sapiens
agcaatttgaaat

SEQ ID NO: 5190276 - DNA, 13 bp, Homo sapiens
agcaattttcctt

SEQ ID NO: 5190277 - DNA, 16 bp, Homo sapiens
agcaattttccttgaa

SEQ ID NO: 5190278 - DNA, 22 bp, Homo sapiens
agcaattttctttgtttctttt

SEQ ID NO: 5190279 - DNA, 18 bp, Homo sapiens
agcacaaaaaatttaaga

SEQ ID NO: 5190280 - DNA, 12 bp, Homo sapiens
agcacaaaattc

SEQ ID NO: 5190281 - DNA, 12 bp, Homo sapiens
agcacaaacaca

SEQ ID NO: 5190282 - DNA, 17 bp, Homo sapiens
agcacaaacacaaggtc

SEQ ID NO: 5190283 - DNA, 19 bp, Homo sapiens
agcacaaacacacctctgc

SEQ ID NO: 5190284 - DNA, 15 bp, Homo sapiens
agcacaaacattttt

SEQ ID NO: 5190285 - DNA, 18 bp, Homo sapiens
agcacaaaccctggggac

SEQ ID NO: 5190286 - DNA, 23 bp, Homo sapiens
agcacaaaccctggggactctgc

SEQ ID NO: 5190287 - DNA, 16 bp, Homo sapiens
agcacaaactgccatt

SEQ ID NO: 5190288 - DNA, 17 bp, Homo sapiens
agcacaaactgtcgtct

SEQ ID NO: 5190289 - DNA, 14 bp, Homo sapiens
agcacaaagaagaa

SEQ ID NO: 5190290 - DNA, 18 bp, Homo sapiens
agcacaaagaccctggct

SEQ ID NO: 5190291 - DNA, 15 bp, Homo sapiens
agcacaaagagggag

SEQ ID NO: 5190292 - DNA, 23 bp, Homo sapiens
agcacaaagataacgcaggagag

SEQ ID NO: 5190293 - DNA, 19 bp, Homo sapiens
agcacaaagcactggcctt

SEQ ID NO: 5190294 - DNA, 16 bp, Homo sapiens
agcacaaagctcaaga

SEQ ID NO: 5190295 - DNA, 19 bp, Homo sapiens
agcacaaagttctcagagc

SEQ ID NO: 5190296 - DNA, 22 bp, Homo sapiens
agcacaaagttctcagagctct

SEQ ID NO: 5190297 - DNA, 20 bp, Homo sapiens
agcacaaatttcatctccta

SEQ ID NO: 5190298 - DNA, 19 bp, Homo sapiens
agcacaacataatttttat

SEQ ID NO: 5190299 - DNA, 19 bp, Homo sapiens
agcacaaccatgttcttga

SEQ ID NO: 5190300 - DNA, 16 bp, Homo sapiens
agcacaacccaccaca

SEQ ID NO: 5190301 - DNA, 14 bp, Homo sapiens
agcacaacccccag

SEQ ID NO: 5190302 - DNA, 22 bp, Homo sapiens
agcacaacccccagctcccgct

SEQ ID NO: 5190303 - DNA, 18 bp, Homo sapiens
agcacaaccttttcctca

SEQ ID NO: 5190304 - DNA, 17 bp, Homo sapiens
agcacaactcagtctgt

SEQ ID NO: 5190305 - DNA, 14 bp, Homo sapiens
agcacaagaaactt

SEQ ID NO: 5190306 - DNA, 15 bp, Homo sapiens
agcacaagaaggcca

SEQ ID NO: 5190307 - DNA, 16 bp, Homo sapiens
agcacaagaaggccag

SEQ ID NO: 5190308 - DNA, 19 bp, Homo sapiens
agcacaagaaggccagccc

SEQ ID NO: 5190309 - DNA, 20 bp, Homo sapiens
agcacaagaaggccagccca

SEQ ID NO: 5190310 - DNA, 14 bp, Homo sapiens
agcacaagaagtgg

SEQ ID NO: 5190311 - DNA, 15 bp, Homo sapiens
agcacaagacacaga

SEQ ID NO: 5190312 - DNA, 16 bp, Homo sapiens
agcacaagactggccc

SEQ ID NO: 5190313 - DNA, 21 bp, Homo sapiens
agcacaagactggcccagtgc

SEQ ID NO: 5190314 - DNA, 23 bp, Homo sapiens
agcacaagcattccttagcagct

SEQ ID NO: 5190315 - DNA, 17 bp, Homo sapiens
agcacaaggagtgcccg

SEQ ID NO: 5190316 - DNA, 14 bp, Homo sapiens
agcacaagggcaca

SEQ ID NO: 5190317 - DNA, 21 bp, Homo sapiens
agcacaagggcacattgccca

SEQ ID NO: 5190318 - DNA, 16 bp, Homo sapiens
agcacaagtacttttg

SEQ ID NO: 5190319 - DNA, 21 bp, Homo sapiens
agcacaagtgtaatgaatacc

SEQ ID NO: 5190320 - DNA, 19 bp, Homo sapiens
agcacaagttatttaaatc

SEQ ID NO: 5190321 - DNA, 17 bp, Homo sapiens
agcacaataaatggctg

SEQ ID NO: 5190322 - DNA, 23 bp, Homo sapiens
agcacaataactagtaataccaa

SEQ ID NO: 5190323 - DNA, 21 bp, Homo sapiens
agcacaatattaagtgttgta

SEQ ID NO: 5190324 - DNA, 19 bp, Homo sapiens
agcacaatcactaaacttt

SEQ ID NO: 5190325 - DNA, 21 bp, Homo sapiens
agcacaatctgtaaattttta

SEQ ID NO: 5190326 - DNA, 22 bp, Homo sapiens
agcacaatggtcttacattgga

SEQ ID NO: 5190327 - DNA, 17 bp, Homo sapiens
agcacaatggtttcaaa

SEQ ID NO: 5190328 - DNA, 22 bp, Homo sapiens
agcacaatggtttcaaagaaag

SEQ ID NO: 5190329 - DNA, 11 bp, Homo sapiens
agcacaattaa

SEQ ID NO: 5190330 - DNA, 16 bp, Homo sapiens
agcacaattctgtccc

SEQ ID NO: 5190331 - DNA, 17 bp, Homo sapiens
agcacaattctgtccct

SEQ ID NO: 5190332 - DNA, 19 bp, Homo sapiens
agcacaattctgtccctgt

SEQ ID NO: 5190333 - DNA, 14 bp, Homo sapiens
agcacaattgatct

SEQ ID NO: 5190334 - DNA, 19 bp, Homo sapiens
agcacaatttgcactaaat

SEQ ID NO: 5190335 - DNA, 19 bp, Homo sapiens
agcacacacacacagtcct

SEQ ID NO: 5190336 - DNA, 12 bp, Homo sapiens
agcacacacagt

SEQ ID NO: 5190337 - DNA, 14 bp, Homo sapiens
agcacacacatctg

SEQ ID NO: 5190338 - DNA, 17 bp, Homo sapiens
agccctggccagccctt

SEQ ID NO: 5190339 - DNA, 20 bp, Homo sapiens
agccctggccagcccttcct

SEQ ID NO: 5190340 - DNA, 11 bp, Homo sapiens
agccctggccc

SEQ ID NO: 5190341 - DNA, 13 bp, Homo sapiens
agccctggcccac

SEQ ID NO: 5190342 - DNA, 22 bp, Homo sapiens
agccctggcccaccccccagcc

SEQ ID NO: 5190343 - DNA, 18 bp, Homo sapiens
agccctggcccagagctg

SEQ ID NO: 5190344 - DNA, 15 bp, Homo sapiens
agccctggcccaggt

SEQ ID NO: 5190345 - DNA, 18 bp, Homo sapiens
agccctggcccaggtgcc

SEQ ID NO: 5190346 - DNA, 17 bp, Homo sapiens
agccctggcccatcatg

SEQ ID NO: 5190347 - DNA, 18 bp, Homo sapiens
agccctggcccccacagc

SEQ ID NO: 5190348 - DNA, 18 bp, Homo sapiens
agccctggcccgcaagag

SEQ ID NO: 5190349 - DNA, 14 bp, Homo sapiens
agccctggccctgc

SEQ ID NO: 5190350 - DNA, 20 bp, Homo sapiens
agccctggccctgcccagcc

SEQ ID NO: 5190351 - DNA, 22 bp, Homo sapiens
agccctggccctgcccagccca

SEQ ID NO: 5190352 - DNA, 17 bp, Homo sapiens
agccctggcctggctgg

SEQ ID NO: 5190353 - DNA, 13 bp, Homo sapiens
agccctggctccc

SEQ ID NO: 5190354 - DNA, 12 bp, Homo sapiens
agccctggctct

SEQ ID NO: 5190355 - DNA, 13 bp, Homo sapiens
agccctggctctg

SEQ ID NO: 5190356 - DNA, 16 bp, Homo sapiens
agccctggctctgccc

SEQ ID NO: 5190357 - DNA, 18 bp, Homo sapiens
agccctggctctgcccct

SEQ ID NO: 5190358 - DNA, 22 bp, Homo sapiens
agccctggctctgcccctcagg

SEQ ID NO: 5190359 - DNA, 16 bp, Homo sapiens
agccctggctgaagga

SEQ ID NO: 5190360 - DNA, 14 bp, Homo sapiens
agccctggctgggt

SEQ ID NO: 5190361 - DNA, 12 bp, Homo sapiens
agccctggctgt

SEQ ID NO: 5190362 - DNA, 14 bp, Homo sapiens
agccctgggaacca

SEQ ID NO: 5190363 - DNA, 16 bp, Homo sapiens
agccctgggatcactg

SEQ ID NO: 5190364 - DNA, 12 bp, Homo sapiens
agccctgggcac

SEQ ID NO: 5190365 - DNA, 15 bp, Homo sapiens
agccctgggccaggg

SEQ ID NO: 5190366 - DNA, 17 bp, Homo sapiens
agccctgggccccacca

SEQ ID NO: 5190367 - DNA, 23 bp, Homo sapiens
agccctgggccccaccacctagg

SEQ ID NO: 5190368 - DNA, 17 bp, Homo sapiens
agccctgggcctgggga

SEQ ID NO: 5190369 - DNA, 11 bp, Homo sapiens
agccctgggct

SEQ ID NO: 5190370 - DNA, 15 bp, Homo sapiens
agccctgggcttggc

SEQ ID NO: 5190371 - DNA, 22 bp, Homo sapiens
agccctgggcttggctcttggc

SEQ ID NO: 5190372 - DNA, 18 bp, Homo sapiens
agccctggggcccctcga

SEQ ID NO: 5190373 - DNA, 23 bp, Homo sapiens
agccctgggggattcctgagctg

SEQ ID NO: 5190374 - DNA, 18 bp, Homo sapiens
agccctgggggccagctg

SEQ ID NO: 5190375 - DNA, 19 bp, Homo sapiens
agccctgggggccagctgg

SEQ ID NO: 5190376 - DNA, 21 bp, Homo sapiens
agccctgggggccagctggtg

SEQ ID NO: 5190377 - DNA, 23 bp, Homo sapiens
agccctgggggccagctggtgct

SEQ ID NO: 5190378 - DNA, 22 bp, Homo sapiens
agccctggggtatgagctgcca

SEQ ID NO: 5190379 - DNA, 22 bp, Homo sapiens
agccctggggtttccacacagg

SEQ ID NO: 5190380 - DNA, 23 bp, Homo sapiens
agccctgggtgacttcaggtgga

SEQ ID NO: 5190381 - DNA, 12 bp, Homo sapiens
agccctgggttt

SEQ ID NO: 5190382 - DNA, 17 bp, Homo sapiens
agccctggtctcagcag

SEQ ID NO: 5190383 - DNA, 22 bp, Homo sapiens
agccctggtgctacttgcttga

SEQ ID NO: 5190384 - DNA, 14 bp, Homo sapiens
agccctggtggcag

SEQ ID NO: 5190385 - DNA, 18 bp, Homo sapiens
agccctggttagctgaca

SEQ ID NO: 5190386 - DNA, 19 bp, Homo sapiens
agccctggttctccatccc

SEQ ID NO: 5190387 - DNA, 22 bp, Homo sapiens
agccctggttctggctgtggtc

SEQ ID NO: 5190388 - DNA, 24 bp, Homo sapiens
agccctgtacccaccccagcacag

SEQ ID NO: 5190389 - DNA, 19 bp, Homo sapiens
agccctgtcagtgcagccc

SEQ ID NO: 5190390 - DNA, 12 bp, Homo sapiens
agccctgtccct

SEQ ID NO: 5190391 - DNA, 14 bp, Homo sapiens
agccctgtcctggt

SEQ ID NO: 5190392 - DNA, 21 bp, Homo sapiens
agccctgtcctggtggtattt

SEQ ID NO: 5190393 - DNA, 12 bp, Homo sapiens
agccctgtcctt

SEQ ID NO: 5190394 - DNA, 23 bp, Homo sapiens
agccctgtcgagacacttgcctt

SEQ ID NO: 5190395 - DNA, 18 bp, Homo sapiens
agccctgtcgggctttgt

SEQ ID NO: 5190396 - DNA, 18 bp, Homo sapiens
agccctgtctcctctctc

SEQ ID NO: 5190397 - DNA, 22 bp, Homo sapiens
agccctgtctgctaggcgctgg

SEQ ID NO: 5190398 - DNA, 22 bp, Homo sapiens
agccctgtggatgagccctcag

SEQ ID NO: 5190399 - DNA, 23 bp, Homo sapiens
agccctgtggccgactctgcact

SEQ ID NO: 5190400 - DNA, 15 bp, Homo sapiens
agccctgtggccgcc

SEQ ID NO: 5190401 - DNA, 18 bp, Homo sapiens
agccctgtggccgccacc

SEQ ID NO: 5190402 - DNA, 12 bp, Homo sapiens
agccctgtgtct

SEQ ID NO: 5190403 - DNA, 17 bp, Homo sapiens
agccctgtgtctgtcac

SEQ ID NO: 5190404 - DNA, 18 bp, Homo sapiens
agccctgtgtctgtcaca

SEQ ID NO: 5190405 - DNA, 15 bp, Homo sapiens
agccctgttccgcct

SEQ ID NO: 5190406 - DNA, 19 bp, Homo sapiens
agccctgttccgcctcact

SEQ ID NO: 5190407 - DNA, 12 bp, Homo sapiens
agccctgttctc

SEQ ID NO: 5190408 - DNA, 19 bp, Homo sapiens
agccctgttgacctgcccg

SEQ ID NO: 5190409 - DNA, 14 bp, Homo sapiens
agccctgttgtgcc

SEQ ID NO: 5190410 - DNA, 21 bp, Homo sapiens
agccctgttgtgccacagagt

SEQ ID NO: 5190411 - DNA, 18 bp, Homo sapiens
agcccttagcacagagag

SEQ ID NO: 5190412 - DNA, 16 bp, Homo sapiens
agcccttagccttgct

SEQ ID NO: 5190413 - DNA, 20 bp, Homo sapiens
agcccttcaggaagcaggtg

SEQ ID NO: 5190414 - DNA, 16 bp, Homo sapiens
agcccttccagcctgg

SEQ ID NO: 5190415 - DNA, 19 bp, Homo sapiens
agcccttccagcctgggac

SEQ ID NO: 5190416 - DNA, 22 bp, Homo sapiens
agcccttccagcctgggacaca

SEQ ID NO: 5190417 - DNA, 19 bp, Homo sapiens
agcccttccatgtcgcctc

SEQ ID NO: 5190418 - DNA, 23 bp, Homo sapiens
agcccttccatgtcgcctctgca

SEQ ID NO: 5190419 - DNA, 13 bp, Homo sapiens
agcccttcccagg

SEQ ID NO: 5190420 - DNA, 15 bp, Homo sapiens
agcccttcccaggcc

SEQ ID NO: 5190421 - DNA, 19 bp, Homo sapiens
agcccttcccaggccagcg

SEQ ID NO: 5190422 - DNA, 14 bp, Homo sapiens
agcccttcccaggg

SEQ ID NO: 5190423 - DNA, 16 bp, Homo sapiens
agcccttcccagggca

SEQ ID NO: 5190424 - DNA, 18 bp, Homo sapiens
agcccttcccagggcacc

SEQ ID NO: 5190425 - DNA, 13 bp, Homo sapiens
agcccttccctgc

SEQ ID NO: 5190426 - DNA, 17 bp, Homo sapiens
agcccttccctggcccc

SEQ ID NO: 5190427 - DNA, 17 bp, Homo sapiens
agcccttcctccctgtc

SEQ ID NO: 5190428 - DNA, 16 bp, Homo sapiens
agcccttcctctgctc

SEQ ID NO: 5190429 - DNA, 19 bp, Homo sapiens
agcccttcctctgctcccc

SEQ ID NO: 5190430 - DNA, 20 bp, Homo sapiens
agcccttcctctgctccccc

SEQ ID NO: 5190431 - DNA, 12 bp, Homo sapiens
agcccttccttg

SEQ ID NO: 5190432 - DNA, 16 bp, Homo sapiens
agcccttcggtcacct

SEQ ID NO: 5190433 - DNA, 17 bp, Homo sapiens
agcccttcggtcacctg

SEQ ID NO: 5190434 - DNA, 19 bp, Homo sapiens
agcccttctatacccaccc

SEQ ID NO: 5190435 - DNA, 20 bp, Homo sapiens
agcccttctatacccaccca

SEQ ID NO: 5190436 - DNA, 22 bp, Homo sapiens
agcccttctatacccacccaga

SEQ ID NO: 5190437 - DNA, 12 bp, Homo sapiens
agcccttctctt

SEQ ID NO: 5190438 - DNA, 17 bp, Homo sapiens
agcccttctttccacag

SEQ ID NO: 5190439 - DNA, 19 bp, Homo sapiens
agcccttctttccacagaa

SEQ ID NO: 5190440 - DNA, 19 bp, Homo sapiens
agcccttgactgtacagag

SEQ ID NO: 5190441 - DNA, 17 bp, Homo sapiens
agcccttgagctcccca

SEQ ID NO: 5190442 - DNA, 13 bp, Homo sapiens
agcccttgaggga

SEQ ID NO: 5190443 - DNA, 13 bp, Homo sapiens
agcccttgcacag

SEQ ID NO: 5190444 - DNA, 19 bp, Homo sapiens
agcccttgcacaggccact

SEQ ID NO: 5190445 - DNA, 14 bp, Homo sapiens
agcccttgccccca

SEQ ID NO: 5190446 - DNA, 22 bp, Homo sapiens
agcccttgcccccatccctcgg

SEQ ID NO: 5190447 - DNA, 16 bp, Homo sapiens
agcccttgctctacct

SEQ ID NO: 5190448 - DNA, 17 bp, Homo sapiens
agcccttgctctacctg

SEQ ID NO: 5190449 - DNA, 18 bp, Homo sapiens
agcccttggaacaccctg

SEQ ID NO: 5190450 - DNA, 16 bp, Homo sapiens
agcccttggcttgtgt

SEQ ID NO: 5190451 - DNA, 12 bp, Homo sapiens
agcccttgggca

SEQ ID NO: 5190452 - DNA, 22 bp, Homo sapiens
agcccttgggcagttctcactc

SEQ ID NO: 5190453 - DNA, 18 bp, Homo sapiens
agcccttggttcctcccc

SEQ ID NO: 5190454 - DNA, 16 bp, Homo sapiens
agcccttgtgtgtgcc

SEQ ID NO: 5190455 - DNA, 18 bp, Homo sapiens
agcccttgtgtgtgccct

SEQ ID NO: 5190456 - DNA, 23 bp, Homo sapiens
agcccttgtgtgtgccctgggcc

SEQ ID NO: 5190457 - DNA, 11 bp, Homo sapiens
agccctttcca

SEQ ID NO: 5190458 - DNA, 17 bp, Homo sapiens
agccctttccccactca

SEQ ID NO: 5190459 - DNA, 18 bp, Homo sapiens
agccctttctgtgtgcac

SEQ ID NO: 5190460 - DNA, 12 bp, Homo sapiens
agccctttgctg

SEQ ID NO: 5190461 - DNA, 14 bp, Homo sapiens
agcccttttgtctc

SEQ ID NO: 5190462 - DNA, 15 bp, Homo sapiens
agcccttttgtctct

SEQ ID NO: 5190463 - DNA, 23 bp, Homo sapiens
agccgaactccaggctgggctga

SEQ ID NO: 5190464 - DNA, 14 bp, Homo sapiens
agccgaagcccagg

SEQ ID NO: 5190465 - DNA, 21 bp, Homo sapiens
agccgacaccttttttcaaca

SEQ ID NO: 5190466 - DNA, 20 bp, Homo sapiens
agccgaccctcctggccttc

SEQ ID NO: 5190467 - DNA, 14 bp, Homo sapiens
agccgacctcagcc

SEQ ID NO: 5190468 - DNA, 15 bp, Homo sapiens
agccgacctcagcct

SEQ ID NO: 5190469 - DNA, 16 bp, Homo sapiens
agccgacctcagcctt

SEQ ID NO: 5190470 - DNA, 15 bp, Homo sapiens
agccgaccttccctc

SEQ ID NO: 5190471 - DNA, 15 bp, Homo sapiens
agccgactctggccc

SEQ ID NO: 5190472 - DNA, 22 bp, Homo sapiens
agccgagactcgactctgtgcc

SEQ ID NO: 5190473 - DNA, 18 bp, Homo sapiens
agccgagagcctgctccc

SEQ ID NO: 5190474 - DNA, 20 bp, Homo sapiens
agccgagatcacgccactgc

SEQ ID NO: 5190475 - DNA, 19 bp, Homo sapiens
agccgagattgcgccactg

SEQ ID NO: 5190476 - DNA, 19 bp, Homo sapiens
agccgagattgcgccattg

SEQ ID NO: 5190477 - DNA, 13 bp, Homo sapiens
agccgagctctcc

SEQ ID NO: 5190478 - DNA, 18 bp, Homo sapiens
agccgagctctcctgggc

SEQ ID NO: 5190479 - DNA, 20 bp, Homo sapiens
agccgagctctcctgggcca

SEQ ID NO: 5190480 - DNA, 12 bp, Homo sapiens
agccgaggcctg

SEQ ID NO: 5190481 - DNA, 16 bp, Homo sapiens
agccgagggcgtcaga

SEQ ID NO: 5190482 - DNA, 19 bp, Homo sapiens
agccgagggcgtcagagag

SEQ ID NO: 5190483 - DNA, 19 bp, Homo sapiens
agccgaggggagagaggga

SEQ ID NO: 5190484 - DNA, 15 bp, Homo sapiens
agccgaggtccctgc

SEQ ID NO: 5190485 - DNA, 15 bp, Homo sapiens
agccgattcctccag

SEQ ID NO: 5190486 - DNA, 17 bp, Homo sapiens
agccgcaagctctcagc

SEQ ID NO: 5190487 - DNA, 18 bp, Homo sapiens
agccgcaagctctcagca

SEQ ID NO: 5190488 - DNA, 20 bp, Homo sapiens
agccgcaagctctcagcaag

SEQ ID NO: 5190489 - DNA, 21 bp, Homo sapiens
agccgcaatctggctcctcct

SEQ ID NO: 5190490 - DNA, 13 bp, Homo sapiens
agccgcacatctg

SEQ ID NO: 5190491 - DNA, 14 bp, Homo sapiens
agccgcaccctgca

SEQ ID NO: 5190492 - DNA, 19 bp, Homo sapiens
agccgcaccctgcacctgc

SEQ ID NO: 5190493 - DNA, 23 bp, Homo sapiens
agccgcaccctgcacctgctgcg

SEQ ID NO: 5190494 - DNA, 15 bp, Homo sapiens
agccgcaccctggct

SEQ ID NO: 5190495 - DNA, 17 bp, Homo sapiens
agccgcagacctggagc

SEQ ID NO: 5190496 - DNA, 21 bp, Homo sapiens
agccgcagagaaatgccccag

SEQ ID NO: 5190497 - DNA, 14 bp, Homo sapiens
agccgcagagcctg

SEQ ID NO: 5190498 - DNA, 12 bp, Homo sapiens
agccgcagaggc

SEQ ID NO: 5190499 - DNA, 14 bp, Homo sapiens
agccgcagcctccc

SEQ ID NO: 5190500 - DNA, 19 bp, Homo sapiens
agccgcagggacagaactg

SEQ ID NO: 5190501 - DNA, 22 bp, Homo sapiens
agccgccactcccgggccaaga

SEQ ID NO: 5190502 - DNA, 14 bp, Homo sapiens
agccgccaggaccg

SEQ ID NO: 5190503 - DNA, 22 bp, Homo sapiens
agccgccattgccaccaggaga

SEQ ID NO: 5190504 - DNA, 15 bp, Homo sapiens
agccgcccaaggcct

SEQ ID NO: 5190505 - DNA, 14 bp, Homo sapiens
agccgcccacttcc

SEQ ID NO: 5190506 - DNA, 19 bp, Homo sapiens
agccgcccagatcatgccg

SEQ ID NO: 5190507 - DNA, 13 bp, Homo sapiens
agccgccccagcc

SEQ ID NO: 5190508 - DNA, 21 bp, Homo sapiens
agccgccccgtgtccccccag

SEQ ID NO: 5190509 - DNA, 17 bp, Homo sapiens
agccgccgggcaggcct

SEQ ID NO: 5190510 - DNA, 14 bp, Homo sapiens
agccgcctccctta

SEQ ID NO: 5190511 - DNA, 23 bp, Homo sapiens
agccgcctcggagtgtggcctgg

SEQ ID NO: 5190512 - DNA, 22 bp, Homo sapiens
agccgcctgacgaaatggaaac

SEQ ID NO: 5190513 - DNA, 16 bp, Homo sapiens
agccgccttcacagca

SEQ ID NO: 5190514 - DNA, 17 bp, Homo sapiens
agccgccttcacagcag

SEQ ID NO: 5190515 - DNA, 14 bp, Homo sapiens
agccgcgctctgcc

SEQ ID NO: 5190516 - DNA, 16 bp, Homo sapiens
agccgcgctctgcccc

SEQ ID NO: 5190517 - DNA, 19 bp, Homo sapiens
agcacacacctatggctgg

SEQ ID NO: 5190518 - DNA, 23 bp, Homo sapiens
agcacacacctatggctggctgg

SEQ ID NO: 5190519 - DNA, 16 bp, Homo sapiens
agcacacaggcagcca

SEQ ID NO: 5190520 - DNA, 16 bp, Homo sapiens
agcacaccaagtggct

SEQ ID NO: 5190521 - DNA, 17 bp, Homo sapiens
agcacaccaagttatat

SEQ ID NO: 5190522 - DNA, 16 bp, Homo sapiens
agcacaccccaaggga

SEQ ID NO: 5190523 - DNA, 20 bp, Homo sapiens
agcacacctcagccccactg

SEQ ID NO: 5190524 - DNA, 14 bp, Homo sapiens
agcacacctctggg

SEQ ID NO: 5190525 - DNA, 11 bp, Homo sapiens
agcacacctgt

SEQ ID NO: 5190526 - DNA, 16 bp, Homo sapiens
agcacacggccctgcc

SEQ ID NO: 5190527 - DNA, 22 bp, Homo sapiens
agcacactgcacagggaaaatt

SEQ ID NO: 5190528 - DNA, 20 bp, Homo sapiens
agcacactgcagggctgctg

SEQ ID NO: 5190529 - DNA, 14 bp, Homo sapiens
agcacactgtagca

SEQ ID NO: 5190530 - DNA, 23 bp, Homo sapiens
agcacactgtgaaaatgtatttg

SEQ ID NO: 5190531 - DNA, 23 bp, Homo sapiens
agcacacttgacatcaactgcat

SEQ ID NO: 5190532 - DNA, 23 bp, Homo sapiens
agcacactttacacaagaatcta

SEQ ID NO: 5190533 - DNA, 14 bp, Homo sapiens
agcacagaatattt

SEQ ID NO: 5190534 - DNA, 12 bp, Homo sapiens
agcacagaatga

SEQ ID NO: 5190535 - DNA, 22 bp, Homo sapiens
agcacagacaattctaatggta

SEQ ID NO: 5190536 - DNA, 14 bp, Homo sapiens
agcacagaccctgc

SEQ ID NO: 5190537 - DNA, 16 bp, Homo sapiens
agcacagaccctgccc

SEQ ID NO: 5190538 - DNA, 18 bp, Homo sapiens
agcacagaccctgccctg

SEQ ID NO: 5190539 - DNA, 20 bp, Homo sapiens
agcacagaccctgccctgtg

SEQ ID NO: 5190540 - DNA, 18 bp, Homo sapiens
agcacagactgttccctc

SEQ ID NO: 5190541 - DNA, 15 bp, Homo sapiens
agcacagagaagaca

SEQ ID NO: 5190542 - DNA, 17 bp, Homo sapiens
agcacagagaagacaaa

SEQ ID NO: 5190543 - DNA, 20 bp, Homo sapiens
agcacagagagggggccacc

SEQ ID NO: 5190544 - DNA, 14 bp, Homo sapiens
agcacagagcctgg

SEQ ID NO: 5190545 - DNA, 17 bp, Homo sapiens
agcacagaggatttctt

SEQ ID NO: 5190546 - DNA, 14 bp, Homo sapiens
agcacagaggcctg

SEQ ID NO: 5190547 - DNA, 19 bp, Homo sapiens
agcacagataaaaagtgga

SEQ ID NO: 5190548 - DNA, 18 bp, Homo sapiens
agcacagatctaccttgg

SEQ ID NO: 5190549 - DNA, 16 bp, Homo sapiens
agcacagattttaatt

SEQ ID NO: 5190550 - DNA, 17 bp, Homo sapiens
agcacagattttaattg

SEQ ID NO: 5190551 - DNA, 15 bp, Homo sapiens
agcacagattttgaa

SEQ ID NO: 5190552 - DNA, 23 bp, Homo sapiens
agcacagcaaggaggctggctgg

SEQ ID NO: 5190553 - DNA, 24 bp, Homo sapiens
agcacagcaaggaggctggctggg

SEQ ID NO: 5190554 - DNA, 10 bp, Homo sapiens
agcacagcag

SEQ ID NO: 5190555 - DNA, 21 bp, Homo sapiens
agcacagcagcccctgcacaa

SEQ ID NO: 5190556 - DNA, 13 bp, Homo sapiens
agcacagcagcct

SEQ ID NO: 5190557 - DNA, 13 bp, Homo sapiens
agcacagccaaca

SEQ ID NO: 5190558 - DNA, 22 bp, Homo sapiens
agcacagccacctccgccagac

SEQ ID NO: 5190559 - DNA, 18 bp, Homo sapiens
agcacagccagacttgct

SEQ ID NO: 5190560 - DNA, 11 bp, Homo sapiens
agcacagccat

SEQ ID NO: 5190561 - DNA, 10 bp, Homo sapiens
agcacagccc

SEQ ID NO: 5190562 - DNA, 20 bp, Homo sapiens
agcacagcccagggcctgca

SEQ ID NO: 5190563 - DNA, 22 bp, Homo sapiens
agcacagcccctgctgtgtggg

SEQ ID NO: 5190564 - DNA, 13 bp, Homo sapiens
agcacagccctgg

SEQ ID NO: 5190565 - DNA, 16 bp, Homo sapiens
agcacagccctgggag

SEQ ID NO: 5190566 - DNA, 22 bp, Homo sapiens
agcacagcctcttagatgcagt

SEQ ID NO: 5190567 - DNA, 13 bp, Homo sapiens
agcacagcctggg

SEQ ID NO: 5190568 - DNA, 19 bp, Homo sapiens
agcacagctactcagatct

SEQ ID NO: 5190569 - DNA, 14 bp, Homo sapiens
agcacagctcctcc

SEQ ID NO: 5190570 - DNA, 19 bp, Homo sapiens
agcacagctgaggaccctc

SEQ ID NO: 5190571 - DNA, 16 bp, Homo sapiens
agcacagcttagattt

SEQ ID NO: 5190572 - DNA, 15 bp, Homo sapiens
agcacagcttcttct

SEQ ID NO: 5190573 - DNA, 18 bp, Homo sapiens
agcacagcttgacctgag

SEQ ID NO: 5190574 - DNA, 20 bp, Homo sapiens
agcacagcttgacctgaggc

SEQ ID NO: 5190575 - DNA, 15 bp, Homo sapiens
agcacagctttcctg

SEQ ID NO: 5190576 - DNA, 12 bp, Homo sapiens
agcacaggcagc

SEQ ID NO: 5190577 - DNA, 16 bp, Homo sapiens
agcacaggccagggga

SEQ ID NO: 5190578 - DNA, 16 bp, Homo sapiens
agcacaggctaatttt

SEQ ID NO: 5190579 - DNA, 19 bp, Homo sapiens
agcacaggctgagtgcagg

SEQ ID NO: 5190580 - DNA, 15 bp, Homo sapiens
agcacaggctggcag

SEQ ID NO: 5190581 - DNA, 22 bp, Homo sapiens
agcacagggacacaaagaggaa

SEQ ID NO: 5190582 - DNA, 19 bp, Homo sapiens
agcacagggcaggggtggt

SEQ ID NO: 5190583 - DNA, 16 bp, Homo sapiens
agcacaggggccccag

SEQ ID NO: 5190584 - DNA, 21 bp, Homo sapiens
agcacaggggccccagatctg

SEQ ID NO: 5190585 - DNA, 21 bp, Homo sapiens
agcacagggggattctgagca

SEQ ID NO: 5190586 - DNA, 22 bp, Homo sapiens
agcacagggggattctgagcag

SEQ ID NO: 5190587 - DNA, 13 bp, Homo sapiens
agcacaggtccaa

SEQ ID NO: 5190588 - DNA, 15 bp, Homo sapiens
agcacaggtccaagg

SEQ ID NO: 5190589 - DNA, 16 bp, Homo sapiens
agcacaggtcccacct

SEQ ID NO: 5190590 - DNA, 15 bp, Homo sapiens
agcacaggtgggctt

SEQ ID NO: 5190591 - DNA, 21 bp, Homo sapiens
agcacaggtgggcttcccagt

SEQ ID NO: 5190592 - DNA, 23 bp, Homo sapiens
agcacagtaggtcccggccagct

SEQ ID NO: 5190593 - DNA, 14 bp, Homo sapiens
agcacagtatttaa

SEQ ID NO: 5190594 - DNA, 16 bp, Homo sapiens
agcacagtatttaaca

SEQ ID NO: 5190595 - DNA, 17 bp, Homo sapiens
agcacagtatttaacat

SEQ ID NO: 5190596 - DNA, 15 bp, Homo sapiens
agcacagtgatcaag

SEQ ID NO: 5190597 - DNA, 16 bp, Homo sapiens
agcacagtggtggcag

SEQ ID NO: 5190598 - DNA, 19 bp, Homo sapiens
agcacagtggtggcagggc

SEQ ID NO: 5190599 - DNA, 12 bp, Homo sapiens
agcacagtgtgt

SEQ ID NO: 5190600 - DNA, 17 bp, Homo sapiens
agcacagtttgaacaaa

SEQ ID NO: 5190601 - DNA, 15 bp, Homo sapiens
agcacataactggat

SEQ ID NO: 5190602 - DNA, 20 bp, Homo sapiens
agcacataactggattttga

SEQ ID NO: 5190603 - DNA, 15 bp, Homo sapiens
agcacatacattaaa

SEQ ID NO: 5190604 - DNA, 17 bp, Homo sapiens
agcacatacattaaaac

SEQ ID NO: 5190605 - DNA, 21 bp, Homo sapiens
agcacatacattaaaactagg

SEQ ID NO: 5190606 - DNA, 20 bp, Homo sapiens
agcacatacggcagacctct

SEQ ID NO: 5190607 - DNA, 19 bp, Homo sapiens
agcacatactgtgttccaa

SEQ ID NO: 5190608 - DNA, 17 bp, Homo sapiens
agcacatagagcttttt

SEQ ID NO: 5190609 - DNA, 21 bp, Homo sapiens
agcacatagagctttttaata

SEQ ID NO: 5190610 - DNA, 14 bp, Homo sapiens
agcacatagccctg

SEQ ID NO: 5190611 - DNA, 15 bp, Homo sapiens
agcacatagcttgcc

SEQ ID NO: 5190612 - DNA, 21 bp, Homo sapiens
agcacatagtgtcctgcccac

SEQ ID NO: 5190613 - DNA, 18 bp, Homo sapiens
agcacatattagtgcagc

SEQ ID NO: 5190614 - DNA, 15 bp, Homo sapiens
agcacatatttcaca

SEQ ID NO: 5190615 - DNA, 23 bp, Homo sapiens
agcacatcactgagaagatggca

SEQ ID NO: 5190616 - DNA, 21 bp, Homo sapiens
agcacatcagtacttttctct

SEQ ID NO: 5190617 - DNA, 14 bp, Homo sapiens
agcacatcatggca

SEQ ID NO: 5190618 - DNA, 15 bp, Homo sapiens
agcacatcatggcag

SEQ ID NO: 5190619 - DNA, 15 bp, Homo sapiens
agcacatccacccag

SEQ ID NO: 5190620 - DNA, 14 bp, Homo sapiens
agcacatccaggca

SEQ ID NO: 5190621 - DNA, 15 bp, Homo sapiens
agcacatctcaacag

SEQ ID NO: 5190622 - DNA, 19 bp, Homo sapiens
agcacatctcaacaggcct

SEQ ID NO: 5190623 - DNA, 14 bp, Homo sapiens
agcacatctctctg

SEQ ID NO: 5190624 - DNA, 16 bp, Homo sapiens
agcacatctctctgcc

SEQ ID NO: 5190625 - DNA, 13 bp, Homo sapiens
agcacatcttttt

SEQ ID NO: 5190626 - DNA, 13 bp, Homo sapiens
agcacatgaataa

SEQ ID NO: 5190627 - DNA, 15 bp, Homo sapiens
agcacatgaataatt

SEQ ID NO: 5190628 - DNA, 14 bp, Homo sapiens
agcacatgatcatg

SEQ ID NO: 5190629 - DNA, 19 bp, Homo sapiens
agcacatgatcatgggaat

SEQ ID NO: 5190630 - DNA, 19 bp, Homo sapiens
agcacatgatttgggctct

SEQ ID NO: 5190631 - DNA, 16 bp, Homo sapiens
agcacatgattttctt

SEQ ID NO: 5190632 - DNA, 20 bp, Homo sapiens
agcacatgattttcttttgt

SEQ ID NO: 5190633 - DNA, 17 bp, Homo sapiens
agcacatgccagggaaa

SEQ ID NO: 5190634 - DNA, 14 bp, Homo sapiens
agcacatgcctctc

SEQ ID NO: 5190635 - DNA, 16 bp, Homo sapiens
agcacatgcctctctc

SEQ ID NO: 5190636 - DNA, 23 bp, Homo sapiens
agcacatgcctctctcaggccaa

SEQ ID NO: 5190637 - DNA, 21 bp, Homo sapiens
agcacatggccatagaggccc

SEQ ID NO: 5190638 - DNA, 23 bp, Homo sapiens
agcacatggccatagaggcccag

SEQ ID NO: 5190639 - DNA, 22 bp, Homo sapiens
agcacatggtttaaatatgaat

SEQ ID NO: 5190640 - DNA, 17 bp, Homo sapiens
agcacatgtctgtcctc

SEQ ID NO: 5190641 - DNA, 16 bp, Homo sapiens
agcacatgtgctgccc

SEQ ID NO: 5190642 - DNA, 21 bp, Homo sapiens
agcacatgttaccatgtctga

SEQ ID NO: 5190643 - DNA, 13 bp, Homo sapiens
agcacatgttcat

SEQ ID NO: 5190644 - DNA, 13 bp, Homo sapiens
agcacatttagtc

SEQ ID NO: 5190645 - DNA, 17 bp, Homo sapiens
agcaccaaaataagaaa

SEQ ID NO: 5190646 - DNA, 20 bp, Homo sapiens
agcaccaaaataagaaaaga

SEQ ID NO: 5190647 - DNA, 18 bp, Homo sapiens
agcaccaaatcaaaatct

SEQ ID NO: 5190648 - DNA, 22 bp, Homo sapiens
agcaccaaatcaaaatctctcc

SEQ ID NO: 5190649 - DNA, 17 bp, Homo sapiens
agcaccaacctccagac

SEQ ID NO: 5190650 - DNA, 19 bp, Homo sapiens
agcaccaacctccagactc

SEQ ID NO: 5190651 - DNA, 20 bp, Homo sapiens
agcaccaagcgtgattcctg

SEQ ID NO: 5190652 - DNA, 18 bp, Homo sapiens
agcaccaagctcaaagcg

SEQ ID NO: 5190653 - DNA, 18 bp, Homo sapiens
agcaccaagtacaaggac

SEQ ID NO: 5190654 - DNA, 16 bp, Homo sapiens
agcaccaatacaaatt

SEQ ID NO: 5190655 - DNA, 14 bp, Homo sapiens
agcaccacactggg

SEQ ID NO: 5190656 - DNA, 20 bp, Homo sapiens
agcaccacagccggtcagag

SEQ ID NO: 5190657 - DNA, 20 bp, Homo sapiens
agcaccacattgcctcattt

SEQ ID NO: 5190658 - DNA, 16 bp, Homo sapiens
agcaccaccagggctc

SEQ ID NO: 5190659 - DNA, 20 bp, Homo sapiens
agcaccaccatttaatttca

SEQ ID NO: 5190660 - DNA, 12 bp, Homo sapiens
agcaccacccta

SEQ ID NO: 5190661 - DNA, 18 bp, Homo sapiens
agcaccacctacacagga

SEQ ID NO: 5190662 - DNA, 16 bp, Homo sapiens
agcaccactctgggca

SEQ ID NO: 5190663 - DNA, 13 bp, Homo sapiens
agcaccagcagtg

SEQ ID NO: 5190664 - DNA, 15 bp, Homo sapiens
agcaccagcctgagc

SEQ ID NO: 5190665 - DNA, 16 bp, Homo sapiens
agcaccagcctgagcc

SEQ ID NO: 5190666 - DNA, 17 bp, Homo sapiens
agcaccagcctgagcca

SEQ ID NO: 5190667 - DNA, 16 bp, Homo sapiens
agcaccagctgcctct

SEQ ID NO: 5190668 - DNA, 11 bp, Homo sapiens
agcaccagctt

SEQ ID NO: 5190669 - DNA, 20 bp, Homo sapiens
agcaccagcttctccaggct

SEQ ID NO: 5190670 - DNA, 13 bp, Homo sapiens
agcaccagcttgc

SEQ ID NO: 5190671 - DNA, 19 bp, Homo sapiens
agcaccaggaagtgtttat

SEQ ID NO: 5190672 - DNA, 23 bp, Homo sapiens
agcaccaggcacgaacccacctg

SEQ ID NO: 5190673 - DNA, 15 bp, Homo sapiens
agcaccagggactat

SEQ ID NO: 5190674 - DNA, 13 bp, Homo sapiens
agcaccagggaga

SEQ ID NO: 5190675 - DNA, 14 bp, Homo sapiens
agcaccagggagag

SEQ ID NO: 5190676 - DNA, 22 bp, Homo sapiens
agcaccagtgggactgtggtga

SEQ ID NO: 5190677 - DNA, 15 bp, Homo sapiens
agcaccatcccctcc

SEQ ID NO: 5190678 - DNA, 19 bp, Homo sapiens
agcaccatccgccagggcc

SEQ ID NO: 5190679 - DNA, 17 bp, Homo sapiens
agcaccatggccttgat

SEQ ID NO: 5190680 - DNA, 16 bp, Homo sapiens
agcacccacccatgca

SEQ ID NO: 5190681 - DNA, 22 bp, Homo sapiens
agcacccactaccatacagaca

SEQ ID NO: 5190682 - DNA, 19 bp, Homo sapiens
agcacccagatcagactct

SEQ ID NO: 5190683 - DNA, 10 bp, Homo sapiens
agcacccagg

SEQ ID NO: 5190684 - DNA, 12 bp, Homo sapiens
agcacccaggct

SEQ ID NO: 5190685 - DNA, 18 bp, Homo sapiens
agcacccagtcctctgcc

SEQ ID NO: 5190686 - DNA, 17 bp, Homo sapiens
agcacccatatctgtgt

SEQ ID NO: 5190687 - DNA, 22 bp, Homo sapiens
agcacccatatctgtgtgccct

SEQ ID NO: 5190688 - DNA, 21 bp, Homo sapiens
agcacccatcatgccacaccg

SEQ ID NO: 5190689 - DNA, 20 bp, Homo sapiens
agcacccatgccccactctg

SEQ ID NO: 5190690 - DNA, 17 bp, Homo sapiens
agcaccccaccacacac

SEQ ID NO: 5190691 - DNA, 12 bp, Homo sapiens
agcaccccactc

SEQ ID NO: 5190692 - DNA, 15 bp, Homo sapiens
agcacccccaagcct

SEQ ID NO: 5190693 - DNA, 18 bp, Homo sapiens
agcacccccaagcctggg

SEQ ID NO: 5190694 - DNA, 11 bp, Homo sapiens
agcacccccac

SEQ ID NO: 5190695 - DNA, 13 bp, Homo sapiens
agcacccccaccc

SEQ ID NO: 5190696 - DNA, 18 bp, Homo sapiens
agcacccccagcctcccc

SEQ ID NO: 5190697 - DNA, 18 bp, Homo sapiens
agccgcgctctgcccctc

SEQ ID NO: 5190698 - DNA, 21 bp, Homo sapiens
agccgcgctttcccctcctcc

SEQ ID NO: 5190699 - DNA, 20 bp, Homo sapiens
agccgcggggaagctggctt

SEQ ID NO: 5190700 - DNA, 13 bp, Homo sapiens
agccgctccagag

SEQ ID NO: 5190701 - DNA, 23 bp, Homo sapiens
agccgctcccggttccctcccca

SEQ ID NO: 5190702 - DNA, 14 bp, Homo sapiens
agccgctcctgtct

SEQ ID NO: 5190703 - DNA, 21 bp, Homo sapiens
agccgctcctgtctgccagcc

SEQ ID NO: 5190704 - DNA, 15 bp, Homo sapiens
agccgctgagcgagg

SEQ ID NO: 5190705 - DNA, 12 bp, Homo sapiens
agccgctgcccg

SEQ ID NO: 5190706 - DNA, 12 bp, Homo sapiens
agccgctgctgg

SEQ ID NO: 5190707 - DNA, 18 bp, Homo sapiens
agccgcttatcctgtttt

SEQ ID NO: 5190708 - DNA, 16 bp, Homo sapiens
agccggaaggccgagg

SEQ ID NO: 5190709 - DNA, 19 bp, Homo sapiens
agccggacacttctcagga

SEQ ID NO: 5190710 - DNA, 23 bp, Homo sapiens
agccggacagctgcccagacaca

SEQ ID NO: 5190711 - DNA, 21 bp, Homo sapiens
agccggaccaagatgggcaca

SEQ ID NO: 5190712 - DNA, 22 bp, Homo sapiens
agccggaccaagatgggcacat

SEQ ID NO: 5190713 - DNA, 23 bp, Homo sapiens
agccggactttcggagttggggg

SEQ ID NO: 5190714 - DNA, 21 bp, Homo sapiens
agccggagcctccagctgccc

SEQ ID NO: 5190715 - DNA, 16 bp, Homo sapiens
agccggaggaggagat

SEQ ID NO: 5190716 - DNA, 20 bp, Homo sapiens
agccggagggacgcggagga

SEQ ID NO: 5190717 - DNA, 21 bp, Homo sapiens
agccggagtcactgcctggag

SEQ ID NO: 5190718 - DNA, 19 bp, Homo sapiens
agccggagtgacagagtaa

SEQ ID NO: 5190719 - DNA, 14 bp, Homo sapiens
agccggcacagggt

SEQ ID NO: 5190720 - DNA, 21 bp, Homo sapiens
agccggcatccttgcctgtct

SEQ ID NO: 5190721 - DNA, 14 bp, Homo sapiens
agccggcccaaccc

SEQ ID NO: 5190722 - DNA, 21 bp, Homo sapiens
agccggcccaacccaaccact

SEQ ID NO: 5190723 - DNA, 18 bp, Homo sapiens
agccggccgccttctccc

SEQ ID NO: 5190724 - DNA, 23 bp, Homo sapiens
agccggccgccttctcccctctc

SEQ ID NO: 5190725 - DNA, 22 bp, Homo sapiens
agccggcctctctggcctccca

SEQ ID NO: 5190726 - DNA, 18 bp, Homo sapiens
agccggcctgagaaacac

SEQ ID NO: 5190727 - DNA, 13 bp, Homo sapiens
agccgggaccctc

SEQ ID NO: 5190728 - DNA, 14 bp, Homo sapiens
agccgggagcctga

SEQ ID NO: 5190729 - DNA, 12 bp, Homo sapiens
agccgggcatgg

SEQ ID NO: 5190730 - DNA, 14 bp, Homo sapiens
agccgggcatggtg

SEQ ID NO: 5190731 - DNA, 17 bp, Homo sapiens
agccgggcccctgggct

SEQ ID NO: 5190732 - DNA, 13 bp, Homo sapiens
agccgggcctccc

SEQ ID NO: 5190733 - DNA, 19 bp, Homo sapiens
agccgggcctggggctcct

SEQ ID NO: 5190734 - DNA, 22 bp, Homo sapiens
agccgggcgtggtggcaggcac

SEQ ID NO: 5190735 - DNA, 23 bp, Homo sapiens
agccggggaagagatccaaagac

SEQ ID NO: 5190736 - DNA, 16 bp, Homo sapiens
agccggggagctgagg

SEQ ID NO: 5190737 - DNA, 18 bp, Homo sapiens
agccggggagctgagggg

SEQ ID NO: 5190738 - DNA, 21 bp, Homo sapiens
agccggggagtttctttcctg

SEQ ID NO: 5190739 - DNA, 18 bp, Homo sapiens
agccggggcctgcctagc

SEQ ID NO: 5190740 - DNA, 13 bp, Homo sapiens
agccgggggaggg

SEQ ID NO: 5190741 - DNA, 19 bp, Homo sapiens
agccgggggaggggccctc

SEQ ID NO: 5190742 - DNA, 13 bp, Homo sapiens
agccggggtgggg

SEQ ID NO: 5190743 - DNA, 21 bp, Homo sapiens
agccggggtggggtgcctgag

SEQ ID NO: 5190744 - DNA, 22 bp, Homo sapiens
agccggggtggggtgcctgagc

SEQ ID NO: 5190745 - DNA, 16 bp, Homo sapiens
agccggggtggggtgg

SEQ ID NO: 5190746 - DNA, 19 bp, Homo sapiens
agccggggtggggtggctg

SEQ ID NO: 5190747 - DNA, 17 bp, Homo sapiens
agccgggtacctcagtt

SEQ ID NO: 5190748 - DNA, 16 bp, Homo sapiens
agccgggtctgcctct

SEQ ID NO: 5190749 - DNA, 16 bp, Homo sapiens
agccgggtgtccccaa

SEQ ID NO: 5190750 - DNA, 18 bp, Homo sapiens
agccggtaactgtcctgt

SEQ ID NO: 5190751 - DNA, 21 bp, Homo sapiens
agccggtaactgtcctgtcct

SEQ ID NO: 5190752 - DNA, 22 bp, Homo sapiens
agccggtcagaggagcgcaggc

SEQ ID NO: 5190753 - DNA, 22 bp, Homo sapiens
agccggtgcctggcgcccctgc

SEQ ID NO: 5190754 - DNA, 14 bp, Homo sapiens
agccggtggtgccc

SEQ ID NO: 5190755 - DNA, 13 bp, Homo sapiens
agccggtgtccct

SEQ ID NO: 5190756 - DNA, 14 bp, Homo sapiens
agccggtgtccctg

SEQ ID NO: 5190757 - DNA, 13 bp, Homo sapiens
agccggttcctgt

SEQ ID NO: 5190758 - DNA, 19 bp, Homo sapiens
agccgtaatggggactctc

SEQ ID NO: 5190759 - DNA, 14 bp, Homo sapiens
agccgtactgtcta

SEQ ID NO: 5190760 - DNA, 15 bp, Homo sapiens
agccgtactgtctat

SEQ ID NO: 5190761 - DNA, 14 bp, Homo sapiens
agccgtaggaccca

SEQ ID NO: 5190762 - DNA, 15 bp, Homo sapiens
agccgtattttacat

SEQ ID NO: 5190763 - DNA, 14 bp, Homo sapiens
agccgtccatggca

SEQ ID NO: 5190764 - DNA, 19 bp, Homo sapiens
agccgtccatggcaccagc

SEQ ID NO: 5190765 - DNA, 22 bp, Homo sapiens
agccgtccatggcaccagcccc

SEQ ID NO: 5190766 - DNA, 20 bp, Homo sapiens
agccgtcccgcgttcaagac

SEQ ID NO: 5190767 - DNA, 23 bp, Homo sapiens
agccgtcctggcgcctggcagtc

SEQ ID NO: 5190768 - DNA, 17 bp, Homo sapiens
agccgtctgactccaga

SEQ ID NO: 5190769 - DNA, 17 bp, Homo sapiens
agccgtgaactgtgcat

SEQ ID NO: 5190770 - DNA, 13 bp, Homo sapiens
agccgtgagcatg

SEQ ID NO: 5190771 - DNA, 18 bp, Homo sapiens
agccgtgatgctcaggct

SEQ ID NO: 5190772 - DNA, 20 bp, Homo sapiens
agccgtgatgctcaggcttg

SEQ ID NO: 5190773 - DNA, 13 bp, Homo sapiens
agccgtgcaggac

SEQ ID NO: 5190774 - DNA, 14 bp, Homo sapiens
agccgtgcaggact

SEQ ID NO: 5190775 - DNA, 16 bp, Homo sapiens
agccgtgccctgcccc

SEQ ID NO: 5190776 - DNA, 17 bp, Homo sapiens
agccgtgccttcagctc

SEQ ID NO: 5190777 - DNA, 18 bp, Homo sapiens
agccgtgctcttttaaaa

SEQ ID NO: 5190778 - DNA, 22 bp, Homo sapiens
agccgtggcttcccgctcagcc

SEQ ID NO: 5190779 - DNA, 23 bp, Homo sapiens
agccgtggcttcccgctcagccc

SEQ ID NO: 5190780 - DNA, 19 bp, Homo sapiens
agccgtgtgggtggcgggt

SEQ ID NO: 5190781 - DNA, 16 bp, Homo sapiens
agccgtgtgtgcatgt

SEQ ID NO: 5190782 - DNA, 17 bp, Homo sapiens
agccgtgtgtgcatgtg

SEQ ID NO: 5190783 - DNA, 18 bp, Homo sapiens
agccgtgtgtgcatgtgc

SEQ ID NO: 5190784 - DNA, 23 bp, Homo sapiens
agccgtgtgtgcatgtgccgagg

SEQ ID NO: 5190785 - DNA, 18 bp, Homo sapiens
agccgttcctcctgcccg

SEQ ID NO: 5190786 - DNA, 22 bp, Homo sapiens
agccgttcctgggactgtcaga

SEQ ID NO: 5190787 - DNA, 16 bp, Homo sapiens
agccgttgaatctggg

SEQ ID NO: 5190788 - DNA, 19 bp, Homo sapiens
agccgttgaatctgggagg

SEQ ID NO: 5190789 - DNA, 23 bp, Homo sapiens
agccgtttgttccccaagacatt

SEQ ID NO: 5190790 - DNA, 13 bp, Homo sapiens
agcctaaaaataa

SEQ ID NO: 5190791 - DNA, 14 bp, Homo sapiens
agcctaaaaataaa

SEQ ID NO: 5190792 - DNA, 16 bp, Homo sapiens
agcctaaaaataaagc

SEQ ID NO: 5190793 - DNA, 16 bp, Homo sapiens
agcctaaaattaaata

SEQ ID NO: 5190794 - DNA, 20 bp, Homo sapiens
agcctaaacaacctggtgca

SEQ ID NO: 5190795 - DNA, 16 bp, Homo sapiens
agcctaaagaccattt

SEQ ID NO: 5190796 - DNA, 18 bp, Homo sapiens
agcctaaagaccatttaa

SEQ ID NO: 5190797 - DNA, 14 bp, Homo sapiens
agcctaaagggcag

SEQ ID NO: 5190798 - DNA, 20 bp, Homo sapiens
agcctaaagtacagcctgga

SEQ ID NO: 5190799 - DNA, 13 bp, Homo sapiens
agcctaaatttgt

SEQ ID NO: 5190800 - DNA, 21 bp, Homo sapiens
agcctaaatttgtgcttttta

SEQ ID NO: 5190801 - DNA, 17 bp, Homo sapiens
agcctaagaaaaaggaa

SEQ ID NO: 5190802 - DNA, 19 bp, Homo sapiens
agcctaagaagaaggccag

SEQ ID NO: 5190803 - DNA, 17 bp, Homo sapiens
agcctaagatatacttg

SEQ ID NO: 5190804 - DNA, 21 bp, Homo sapiens
agcctaagatatacttgtttt

SEQ ID NO: 5190805 - DNA, 18 bp, Homo sapiens
agcctaaggctcctgttt

SEQ ID NO: 5190806 - DNA, 17 bp, Homo sapiens
agcctaatattcatgct

SEQ ID NO: 5190807 - DNA, 12 bp, Homo sapiens
agcctaatcaca

SEQ ID NO: 5190808 - DNA, 23 bp, Homo sapiens
agcctaatgaaagggaaagtcag

SEQ ID NO: 5190809 - DNA, 18 bp, Homo sapiens
agcctaattataagaatt

SEQ ID NO: 5190810 - DNA, 22 bp, Homo sapiens
agcctaatttattggattccct

SEQ ID NO: 5190811 - DNA, 17 bp, Homo sapiens
agcctacagacatggaa

SEQ ID NO: 5190812 - DNA, 13 bp, Homo sapiens
agcctacagcagt

SEQ ID NO: 5190813 - DNA, 14 bp, Homo sapiens
agcctacaggcctc

SEQ ID NO: 5190814 - DNA, 19 bp, Homo sapiens
agcctacattttagtttct

SEQ ID NO: 5190815 - DNA, 19 bp, Homo sapiens
agcctacccctcctgcgct

SEQ ID NO: 5190816 - DNA, 22 bp, Homo sapiens
agcctacccttgtaccccatcc

SEQ ID NO: 5190817 - DNA, 23 bp, Homo sapiens
agcctacccttgtaccccatccc

SEQ ID NO: 5190818 - DNA, 22 bp, Homo sapiens
agcctaccggcaatttccggcc

SEQ ID NO: 5190819 - DNA, 20 bp, Homo sapiens
agcctaccgtatttcagcca

SEQ ID NO: 5190820 - DNA, 15 bp, Homo sapiens
agcctacctctgtct

SEQ ID NO: 5190821 - DNA, 17 bp, Homo sapiens
agcctacctctgtctga

SEQ ID NO: 5190822 - DNA, 18 bp, Homo sapiens
agcctacctctgtctgag

SEQ ID NO: 5190823 - DNA, 23 bp, Homo sapiens
agcctacctctgtctgagacagg

SEQ ID NO: 5190824 - DNA, 14 bp, Homo sapiens
agcctacctgtatg

SEQ ID NO: 5190825 - DNA, 21 bp, Homo sapiens
agcctactagggacctgggga

SEQ ID NO: 5190826 - DNA, 22 bp, Homo sapiens
agcctactagggacctggggaa

SEQ ID NO: 5190827 - DNA, 14 bp, Homo sapiens
agcctactctcctt

SEQ ID NO: 5190828 - DNA, 15 bp, Homo sapiens
agcctactgaaaatg

SEQ ID NO: 5190829 - DNA, 23 bp, Homo sapiens
agcctactgtactatttaaaatg

SEQ ID NO: 5190830 - DNA, 20 bp, Homo sapiens
agcctactgtctccttccca

SEQ ID NO: 5190831 - DNA, 21 bp, Homo sapiens
agcctactgtctccttcccac

SEQ ID NO: 5190832 - DNA, 20 bp, Homo sapiens
agcctagaacatccctgggc

SEQ ID NO: 5190833 - DNA, 19 bp, Homo sapiens
agcctagaagagcttctga

SEQ ID NO: 5190834 - DNA, 14 bp, Homo sapiens
agcctagaagctgg

SEQ ID NO: 5190835 - DNA, 20 bp, Homo sapiens
agcctagacaacctttctgt

SEQ ID NO: 5190836 - DNA, 12 bp, Homo sapiens
agcctagaggag

SEQ ID NO: 5190837 - DNA, 14 bp, Homo sapiens
agcctagaggagga

SEQ ID NO: 5190838 - DNA, 16 bp, Homo sapiens
agcctagatgttttat

SEQ ID NO: 5190839 - DNA, 17 bp, Homo sapiens
agcctagccacctccca

SEQ ID NO: 5190840 - DNA, 16 bp, Homo sapiens
agcctagccctgggac

SEQ ID NO: 5190841 - DNA, 16 bp, Homo sapiens
agcctagcccttgtcc

SEQ ID NO: 5190842 - DNA, 17 bp, Homo sapiens
agcctagcccttgtccc

SEQ ID NO: 5190843 - DNA, 18 bp, Homo sapiens
agcctagccgacctcagc

SEQ ID NO: 5190844 - DNA, 21 bp, Homo sapiens
agcctagccgacctcagcctt

SEQ ID NO: 5190845 - DNA, 17 bp, Homo sapiens
agcctagcctatgtctg

SEQ ID NO: 5190846 - DNA, 18 bp, Homo sapiens
agcctagcctatgtctgg

SEQ ID NO: 5190847 - DNA, 18 bp, Homo sapiens
agcctagcggagcccagc

SEQ ID NO: 5190848 - DNA, 22 bp, Homo sapiens
agcctagcggagcccagcctgg

SEQ ID NO: 5190849 - DNA, 17 bp, Homo sapiens
agcctagcgtggtggct

SEQ ID NO: 5190850 - DNA, 21 bp, Homo sapiens
agcctaggaccactcagcccc

SEQ ID NO: 5190851 - DNA, 22 bp, Homo sapiens
agcctaggaccactcagcccct

SEQ ID NO: 5190852 - DNA, 20 bp, Homo sapiens
agcctaggaccagttttgta

SEQ ID NO: 5190853 - DNA, 12 bp, Homo sapiens
agcctaggccag

SEQ ID NO: 5190854 - DNA, 22 bp, Homo sapiens
agcctaggcctagtcctgcgaa

SEQ ID NO: 5190855 - DNA, 20 bp, Homo sapiens
agcctaggggtcagggacca

SEQ ID NO: 5190856 - DNA, 23 bp, Homo sapiens
agcctaggggtcagggaccaagg

SEQ ID NO: 5190857 - DNA, 19 bp, Homo sapiens
agcctaggtggaggcaagt

SEQ ID NO: 5190858 - DNA, 21 bp, Homo sapiens
agcctagtaggagctgagctt

SEQ ID NO: 5190859 - DNA, 14 bp, Homo sapiens
agcctagtgaaggc

SEQ ID NO: 5190860 - DNA, 20 bp, Homo sapiens
agcctagtgaaggcttctct

SEQ ID NO: 5190861 - DNA, 18 bp, Homo sapiens
agcctagtggcttgtcct

SEQ ID NO: 5190862 - DNA, 15 bp, Homo sapiens
agcctagttcatcca

SEQ ID NO: 5190863 - DNA, 20 bp, Homo sapiens
agcctagttcatccaatcct

SEQ ID NO: 5190864 - DNA, 22 bp, Homo sapiens
agcctagttcatccaatcctca

SEQ ID NO: 5190865 - DNA, 22 bp, Homo sapiens
agcctataagaggaatttcttt

SEQ ID NO: 5190866 - DNA, 19 bp, Homo sapiens
agcctatacgtttctgtgg

SEQ ID NO: 5190867 - DNA, 21 bp, Homo sapiens
agcctatacgtttctgtggag

SEQ ID NO: 5190868 - DNA, 23 bp, Homo sapiens
agcctatagcagaagcacatttt

SEQ ID NO: 5190869 - DNA, 13 bp, Homo sapiens
agcctatagtaaa

SEQ ID NO: 5190870 - DNA, 16 bp, Homo sapiens
agcctatcaggtgccc

SEQ ID NO: 5190871 - DNA, 21 bp, Homo sapiens
agcctatcaggtgcccctctt

SEQ ID NO: 5190872 - DNA, 15 bp, Homo sapiens
agcctatctctcttc

SEQ ID NO: 5190873 - DNA, 19 bp, Homo sapiens
agcacccccagcctccccc

SEQ ID NO: 5190874 - DNA, 12 bp, Homo sapiens
agcaccccctca

SEQ ID NO: 5190875 - DNA, 13 bp, Homo sapiens
agcaccccctcat

SEQ ID NO: 5190876 - DNA, 20 bp, Homo sapiens
agcaccccctcattcccctc

SEQ ID NO: 5190877 - DNA, 18 bp, Homo sapiens
agcaccccctctcctgga

SEQ ID NO: 5190878 - DNA, 22 bp, Homo sapiens
agcaccccctctcctggagggc

SEQ ID NO: 5190879 - DNA, 13 bp, Homo sapiens
agcaccccctgct

SEQ ID NO: 5190880 - DNA, 22 bp, Homo sapiens
agcaccccctgctccaccagca

SEQ ID NO: 5190881 - DNA, 23 bp, Homo sapiens
agcaccccgcttttgcagcagag

SEQ ID NO: 5190882 - DNA, 15 bp, Homo sapiens
agcacccctctctgc

SEQ ID NO: 5190883 - DNA, 19 bp, Homo sapiens
agcacccctctctgcatct

SEQ ID NO: 5190884 - DNA, 12 bp, Homo sapiens
agcaccccttcc

SEQ ID NO: 5190885 - DNA, 17 bp, Homo sapiens
agcacccggtcagtcag

SEQ ID NO: 5190886 - DNA, 18 bp, Homo sapiens
agcacccgtggtgcatgg

SEQ ID NO: 5190887 - DNA, 19 bp, Homo sapiens
agcacccgtggtgcatggt

SEQ ID NO: 5190888 - DNA, 18 bp, Homo sapiens
agcacccgttcaccttct

SEQ ID NO: 5190889 - DNA, 16 bp, Homo sapiens
agcaccctaggcagcc

SEQ ID NO: 5190890 - DNA, 14 bp, Homo sapiens
agcaccctcccccg

SEQ ID NO: 5190891 - DNA, 13 bp, Homo sapiens
agcaccctctcct

SEQ ID NO: 5190892 - DNA, 21 bp, Homo sapiens
agcaccctgttccctctttct

SEQ ID NO: 5190893 - DNA, 21 bp, Homo sapiens
agcacccttgccatcccaagc

SEQ ID NO: 5190894 - DNA, 18 bp, Homo sapiens
agcacccttgcccggctg

SEQ ID NO: 5190895 - DNA, 17 bp, Homo sapiens
agcaccgaggggccttt

SEQ ID NO: 5190896 - DNA, 21 bp, Homo sapiens
agcaccgataataggtagcct

SEQ ID NO: 5190897 - DNA, 22 bp, Homo sapiens
agcaccgccggctttcagggca

SEQ ID NO: 5190898 - DNA, 21 bp, Homo sapiens
agcaccgcttttgttctcgca

SEQ ID NO: 5190899 - DNA, 23 bp, Homo sapiens
agcaccggaccagcctggcccac

SEQ ID NO: 5190900 - DNA, 23 bp, Homo sapiens
agcaccggggaacaatttctctg

SEQ ID NO: 5190901 - DNA, 17 bp, Homo sapiens
agcaccgggggagaggg

SEQ ID NO: 5190902 - DNA, 17 bp, Homo sapiens
agcaccgtgatggagag

SEQ ID NO: 5190903 - DNA, 16 bp, Homo sapiens
agcaccgtggtgtgag

SEQ ID NO: 5190904 - DNA, 20 bp, Homo sapiens
agcaccgtgtcaagctgctc

SEQ ID NO: 5190905 - DNA, 22 bp, Homo sapiens
agcaccgtgtcaagctgctctg

SEQ ID NO: 5190906 - DNA, 22 bp, Homo sapiens
agcaccgtgtcgggcaggtcag

SEQ ID NO: 5190907 - DNA, 16 bp, Homo sapiens
agcacctaaacttaca

SEQ ID NO: 5190908 - DNA, 21 bp, Homo sapiens
agcacctactatgtgctgggt

SEQ ID NO: 5190909 - DNA, 17 bp, Homo sapiens
agcacctagcctcgctc

SEQ ID NO: 5190910 - DNA, 20 bp, Homo sapiens
agcacctaggtggggcctgg

SEQ ID NO: 5190911 - DNA, 14 bp, Homo sapiens
agcacctcacctga

SEQ ID NO: 5190912 - DNA, 20 bp, Homo sapiens
agcacctcacctgagacctc

SEQ ID NO: 5190913 - DNA, 15 bp, Homo sapiens
agcacctcaggaccc

SEQ ID NO: 5190914 - DNA, 16 bp, Homo sapiens
agcacctccaaccaaa

SEQ ID NO: 5190915 - DNA, 17 bp, Homo sapiens
agcacctccaaccaaat

SEQ ID NO: 5190916 - DNA, 16 bp, Homo sapiens
agcacctccaggcctg

SEQ ID NO: 5190917 - DNA, 16 bp, Homo sapiens
agcacctccccagaca

SEQ ID NO: 5190918 - DNA, 23 bp, Homo sapiens
agcacctccccagacagggctcc

SEQ ID NO: 5190919 - DNA, 14 bp, Homo sapiens
agcacctcctcagc

SEQ ID NO: 5190920 - DNA, 12 bp, Homo sapiens
agcacctcctcc

SEQ ID NO: 5190921 - DNA, 17 bp, Homo sapiens
agcacctcctccgtggg

SEQ ID NO: 5190922 - DNA, 17 bp, Homo sapiens
agcacctcctctctgct

SEQ ID NO: 5190923 - DNA, 14 bp, Homo sapiens
agcacctcctgcct

SEQ ID NO: 5190924 - DNA, 19 bp, Homo sapiens
agcacctccttgtcacttt

SEQ ID NO: 5190925 - DNA, 21 bp, Homo sapiens
agcacctctcagcccctcaga

SEQ ID NO: 5190926 - DNA, 16 bp, Homo sapiens
agcacctgaacagttt

SEQ ID NO: 5190927 - DNA, 16 bp, Homo sapiens
agcacctgaaccactg

SEQ ID NO: 5190928 - DNA, 18 bp, Homo sapiens
agcacctgaaccactgtg

SEQ ID NO: 5190929 - DNA, 15 bp, Homo sapiens
agcacctgaacccca

SEQ ID NO: 5190930 - DNA, 21 bp, Homo sapiens
agcacctgaaccccatgggct

SEQ ID NO: 5190931 - DNA, 15 bp, Homo sapiens
agcacctgccaggga

SEQ ID NO: 5190932 - DNA, 15 bp, Homo sapiens
agcacctgccagggc

SEQ ID NO: 5190933 - DNA, 18 bp, Homo sapiens
agcacctgccagggcccg

SEQ ID NO: 5190934 - DNA, 15 bp, Homo sapiens
agcacctgccgacct

SEQ ID NO: 5190935 - DNA, 19 bp, Homo sapiens
agcacctgccgacctcgtc

SEQ ID NO: 5190936 - DNA, 20 bp, Homo sapiens
agcacctgccgacctcgtcc

SEQ ID NO: 5190937 - DNA, 13 bp, Homo sapiens
agcacctgctccc

SEQ ID NO: 5190938 - DNA, 15 bp, Homo sapiens
agcacctgctgtctg

SEQ ID NO: 5190939 - DNA, 18 bp, Homo sapiens
agcacctggaccccctgc

SEQ ID NO: 5190940 - DNA, 18 bp, Homo sapiens
agcacctgggccccactg

SEQ ID NO: 5190941 - DNA, 19 bp, Homo sapiens
agcacctgggccccactgg

SEQ ID NO: 5190942 - DNA, 21 bp, Homo sapiens
agcacctgggccccactggac

SEQ ID NO: 5190943 - DNA, 19 bp, Homo sapiens
agcacctgggctgaggagg

SEQ ID NO: 5190944 - DNA, 18 bp, Homo sapiens
agcacctgggtgtgctcc

SEQ ID NO: 5190945 - DNA, 13 bp, Homo sapiens
agcacctggtggg

SEQ ID NO: 5190946 - DNA, 14 bp, Homo sapiens
agcacctgtaagaa

SEQ ID NO: 5190947 - DNA, 13 bp, Homo sapiens
agcacctgtctgg

SEQ ID NO: 5190948 - DNA, 21 bp, Homo sapiens
agcacctgttgtgtgcctgac

SEQ ID NO: 5190949 - DNA, 22 bp, Homo sapiens
agcaccttaatattattggggt

SEQ ID NO: 5190950 - DNA, 19 bp, Homo sapiens
agcaccttagacagtccct

SEQ ID NO: 5190951 - DNA, 21 bp, Homo sapiens
agcaccttatctatgatgttt

SEQ ID NO: 5190952 - DNA, 22 bp, Homo sapiens
agcaccttcaagcgctccaggg

SEQ ID NO: 5190953 - DNA, 14 bp, Homo sapiens
agcaccttcagggc

SEQ ID NO: 5190954 - DNA, 16 bp, Homo sapiens
agcaccttcagggctg

SEQ ID NO: 5190955 - DNA, 17 bp, Homo sapiens
agcaccttcagggctga

SEQ ID NO: 5190956 - DNA, 22 bp, Homo sapiens
agcaccttcagggctgagttct

SEQ ID NO: 5190957 - DNA, 15 bp, Homo sapiens
agcaccttctttctg

SEQ ID NO: 5190958 - DNA, 21 bp, Homo sapiens
agcaccttctttctggactgg

SEQ ID NO: 5190959 - DNA, 20 bp, Homo sapiens
agcaccttggcccaggagct

SEQ ID NO: 5190960 - DNA, 24 bp, Homo sapiens
agcaccttggcccaggagctctgc

SEQ ID NO: 5190961 - DNA, 17 bp, Homo sapiens
agcaccttgtgcctggg

SEQ ID NO: 5190962 - DNA, 18 bp, Homo sapiens
agcaccttgtgcctgggg

SEQ ID NO: 5190963 - DNA, 19 bp, Homo sapiens
agcaccttgtgcctggggt

SEQ ID NO: 5190964 - DNA, 16 bp, Homo sapiens
agcacctttctctgag

SEQ ID NO: 5190965 - DNA, 23 bp, Homo sapiens
agcacctttgagccttggcccac

SEQ ID NO: 5190966 - DNA, 15 bp, Homo sapiens
agcacgatttctgtt

SEQ ID NO: 5190967 - DNA, 18 bp, Homo sapiens
agcacgcatgtccctcca

SEQ ID NO: 5190968 - DNA, 21 bp, Homo sapiens
agcacgcatgtccctccaagg

SEQ ID NO: 5190969 - DNA, 22 bp, Homo sapiens
agcacgcatgtccctccaaggc

SEQ ID NO: 5190970 - DNA, 21 bp, Homo sapiens
agcacgccgtaaccaggggct

SEQ ID NO: 5190971 - DNA, 17 bp, Homo sapiens
agcacgcctctccccac

SEQ ID NO: 5190972 - DNA, 19 bp, Homo sapiens
agcacgcctctccccacct

SEQ ID NO: 5190973 - DNA, 21 bp, Homo sapiens
agcacgcctctccccaccttc

SEQ ID NO: 5190974 - DNA, 14 bp, Homo sapiens
agcacgcctgccat

SEQ ID NO: 5190975 - DNA, 18 bp, Homo sapiens
agcacgcgacttctcagg

SEQ ID NO: 5190976 - DNA, 22 bp, Homo sapiens
agcacggagtgttggggctggg

SEQ ID NO: 5190977 - DNA, 23 bp, Homo sapiens
agcacggagtgttggggctgggg

SEQ ID NO: 5190978 - DNA, 15 bp, Homo sapiens
agcacggcccggccc

SEQ ID NO: 5190979 - DNA, 21 bp, Homo sapiens
agcacggcccggcccctcacc

SEQ ID NO: 5190980 - DNA, 22 bp, Homo sapiens
agcacggcccggcccctcaccc

SEQ ID NO: 5190981 - DNA, 23 bp, Homo sapiens
agcacggcccggcccctcaccct

SEQ ID NO: 5190982 - DNA, 15 bp, Homo sapiens
agcacggctctgtcc

SEQ ID NO: 5190983 - DNA, 21 bp, Homo sapiens
agcacggctctgtccccagcc

SEQ ID NO: 5190984 - DNA, 19 bp, Homo sapiens
agcacggtcccccaggagg

SEQ ID NO: 5190985 - DNA, 20 bp, Homo sapiens
agcacggtcccccaggaggc

SEQ ID NO: 5190986 - DNA, 18 bp, Homo sapiens
agcacggtggtgaggcag

SEQ ID NO: 5190987 - DNA, 14 bp, Homo sapiens
agcacggttgcctg

SEQ ID NO: 5190988 - DNA, 14 bp, Homo sapiens
agcacgtctcagag

SEQ ID NO: 5190989 - DNA, 13 bp, Homo sapiens
agcacgtggagat

SEQ ID NO: 5190990 - DNA, 18 bp, Homo sapiens
agcacgttcactagacta

SEQ ID NO: 5190991 - DNA, 18 bp, Homo sapiens
agcacgtttaaagttctg

SEQ ID NO: 5190992 - DNA, 20 bp, Homo sapiens
agcactaaaaagttgaacca

SEQ ID NO: 5190993 - DNA, 13 bp, Homo sapiens
agcactaaagcag

SEQ ID NO: 5190994 - DNA, 16 bp, Homo sapiens
agcactaaagcagtgg

SEQ ID NO: 5190995 - DNA, 17 bp, Homo sapiens
agcactaaagcagtgga

SEQ ID NO: 5190996 - DNA, 23 bp, Homo sapiens
agcactaaagcagtggacaccag

SEQ ID NO: 5190997 - DNA, 17 bp, Homo sapiens
agcactaaggccgtgtc

SEQ ID NO: 5190998 - DNA, 17 bp, Homo sapiens
agcactacataaactga

SEQ ID NO: 5190999 - DNA, 18 bp, Homo sapiens
agcactactaaaagttta

SEQ ID NO: 5191000 - DNA, 23 bp, Homo sapiens
agcactactaaaagtttagaact

SEQ ID NO: 5191001 - DNA, 15 bp, Homo sapiens
agcactactctacca

SEQ ID NO: 5191002 - DNA, 20 bp, Homo sapiens
agcactacttacttagagat

SEQ ID NO: 5191003 - DNA, 22 bp, Homo sapiens
agcactacttacttagagatgc

SEQ ID NO: 5191004 - DNA, 20 bp, Homo sapiens
agcactagaaattgggcagt

SEQ ID NO: 5191005 - DNA, 13 bp, Homo sapiens
agcactagaatga

SEQ ID NO: 5191006 - DNA, 16 bp, Homo sapiens
agcactagaatgagaa

SEQ ID NO: 5191007 - DNA, 13 bp, Homo sapiens
agcactagagaat

SEQ ID NO: 5191008 - DNA, 15 bp, Homo sapiens
agcactagagaatgc

SEQ ID NO: 5191009 - DNA, 16 bp, Homo sapiens
agcactagagaatgca

SEQ ID NO: 5191010 - DNA, 19 bp, Homo sapiens
agcactagagtcacccccc

SEQ ID NO: 5191011 - DNA, 16 bp, Homo sapiens
agcactagccaaacct

SEQ ID NO: 5191012 - DNA, 16 bp, Homo sapiens
agcactagtaaaggag

SEQ ID NO: 5191013 - DNA, 18 bp, Homo sapiens
agcactagtaaaggagga

SEQ ID NO: 5191014 - DNA, 15 bp, Homo sapiens
agcactagtttgatt

SEQ ID NO: 5191015 - DNA, 12 bp, Homo sapiens
agcactatgaca

SEQ ID NO: 5191016 - DNA, 13 bp, Homo sapiens
agcactattgttt

SEQ ID NO: 5191017 - DNA, 13 bp, Homo sapiens
agcactattttat

SEQ ID NO: 5191018 - DNA, 17 bp, Homo sapiens
agcactattttatattt

SEQ ID NO: 5191019 - DNA, 19 bp, Homo sapiens
agcactcaaacctggagct

SEQ ID NO: 5191020 - DNA, 20 bp, Homo sapiens
agcactcaaccaacctcccc

SEQ ID NO: 5191021 - DNA, 23 bp, Homo sapiens
agcactcaaccaacctccccgca

SEQ ID NO: 5191022 - DNA, 17 bp, Homo sapiens
agcactcagaaaagaaa

SEQ ID NO: 5191023 - DNA, 18 bp, Homo sapiens
agcactcaggctctccat

SEQ ID NO: 5191024 - DNA, 18 bp, Homo sapiens
agcactcattttctataa

SEQ ID NO: 5191025 - DNA, 13 bp, Homo sapiens
agcactcccaagt

SEQ ID NO: 5191026 - DNA, 19 bp, Homo sapiens
agcactcccaagtctacag

SEQ ID NO: 5191027 - DNA, 23 bp, Homo sapiens
agcactccccagagctgtgccag

SEQ ID NO: 5191028 - DNA, 22 bp, Homo sapiens
agcactccccttgccttcccct

SEQ ID NO: 5191029 - DNA, 18 bp, Homo sapiens
agcactcccgctgcacac

SEQ ID NO: 5191030 - DNA, 20 bp, Homo sapiens
agcactcccgctgcacacag

SEQ ID NO: 5191031 - DNA, 19 bp, Homo sapiens
agcactccgcatcacctca

SEQ ID NO: 5191032 - DNA, 16 bp, Homo sapiens
agcactcctcaagact

SEQ ID NO: 5191033 - DNA, 18 bp, Homo sapiens
agcactcctcaagacttt

SEQ ID NO: 5191034 - DNA, 14 bp, Homo sapiens
agcactcctctgtc

SEQ ID NO: 5191035 - DNA, 15 bp, Homo sapiens
agcactcctctgtct

SEQ ID NO: 5191036 - DNA, 19 bp, Homo sapiens
agcactcctctgtctctgc

SEQ ID NO: 5191037 - DNA, 19 bp, Homo sapiens
agcactcctgatttttatc

SEQ ID NO: 5191038 - DNA, 18 bp, Homo sapiens
agcactcgagaccatcct

SEQ ID NO: 5191039 - DNA, 21 bp, Homo sapiens
agcactcgagaccatcctggc

SEQ ID NO: 5191040 - DNA, 22 bp, Homo sapiens
agcactcgagaccatcctggcc

SEQ ID NO: 5191041 - DNA, 20 bp, Homo sapiens
agcactcgctagcagtggca

SEQ ID NO: 5191042 - DNA, 17 bp, Homo sapiens
agcactctaattagaga

SEQ ID NO: 5191043 - DNA, 20 bp, Homo sapiens
agcactctaattagagaact

SEQ ID NO: 5191044 - DNA, 14 bp, Homo sapiens
agcactctctaaat

SEQ ID NO: 5191045 - DNA, 15 bp, Homo sapiens
agcactctctaaatc

SEQ ID NO: 5191046 - DNA, 20 bp, Homo sapiens
agcactctctaaatcttcct

SEQ ID NO: 5191047 - DNA, 23 bp, Homo sapiens
agcactctctaaatcttccttgt

SEQ ID NO: 5191048 - DNA, 13 bp, Homo sapiens
agcactctctgca

SEQ ID NO: 5191049 - DNA, 17 bp, Homo sapiens
agcctatgagcatcctg

SEQ ID NO: 5191050 - DNA, 10 bp, Homo sapiens
agcctatgtc

SEQ ID NO: 5191051 - DNA, 13 bp, Homo sapiens
agcctatgtctgg

SEQ ID NO: 5191052 - DNA, 20 bp, Homo sapiens
agcctattagatgttttaca

SEQ ID NO: 5191053 - DNA, 17 bp, Homo sapiens
agcctattagctgggat

SEQ ID NO: 5191054 - DNA, 15 bp, Homo sapiens
agcctatttacctgc

SEQ ID NO: 5191055 - DNA, 20 bp, Homo sapiens
agcctatttacctgcaggct

SEQ ID NO: 5191056 - DNA, 21 bp, Homo sapiens
agcctatttacctgcaggctg

SEQ ID NO: 5191057 - DNA, 16 bp, Homo sapiens
agcctcaaaacgggtc

SEQ ID NO: 5191058 - DNA, 16 bp, Homo sapiens
agcctcaaatccagga

SEQ ID NO: 5191059 - DNA, 19 bp, Homo sapiens
agcctcaaatccaggaccc

SEQ ID NO: 5191060 - DNA, 21 bp, Homo sapiens
agcctcaaatccaggaccctg

SEQ ID NO: 5191061 - DNA, 18 bp, Homo sapiens
agcctcaacctccctggc

SEQ ID NO: 5191062 - DNA, 21 bp, Homo sapiens
agcctcaacctccctggctca

SEQ ID NO: 5191063 - DNA, 17 bp, Homo sapiens
agcctcaacctcctggg

SEQ ID NO: 5191064 - DNA, 20 bp, Homo sapiens
agcctcaacctcctgggttc

SEQ ID NO: 5191065 - DNA, 15 bp, Homo sapiens
agcctcaaggccctc

SEQ ID NO: 5191066 - DNA, 23 bp, Homo sapiens
agcctcaaggttttaggttctaa

SEQ ID NO: 5191067 - DNA, 18 bp, Homo sapiens
agcctcaataagccttgt

SEQ ID NO: 5191068 - DNA, 19 bp, Homo sapiens
agcctcaataagccttgtc

SEQ ID NO: 5191069 - DNA, 20 bp, Homo sapiens
agcctcaataagccttgtcg

SEQ ID NO: 5191070 - DNA, 17 bp, Homo sapiens
agcctcaattctccatt

SEQ ID NO: 5191071 - DNA, 15 bp, Homo sapiens
agcctcacagatgct

SEQ ID NO: 5191072 - DNA, 21 bp, Homo sapiens
agcctcacagatgctggcctc

SEQ ID NO: 5191073 - DNA, 23 bp, Homo sapiens
agcctcacagatgctggcctctt

SEQ ID NO: 5191074 - DNA, 18 bp, Homo sapiens
agcctcacagcagtgaga

SEQ ID NO: 5191075 - DNA, 21 bp, Homo sapiens
agcctcacgctcctttctgat

SEQ ID NO: 5191076 - DNA, 22 bp, Homo sapiens
agcctcacggagggccgtgtga

SEQ ID NO: 5191077 - DNA, 21 bp, Homo sapiens
agcctcacggggttggctgtt

SEQ ID NO: 5191078 - DNA, 23 bp, Homo sapiens
agcctcacgtatttcacagagca

SEQ ID NO: 5191079 - DNA, 17 bp, Homo sapiens
agcctcactgatatatt

SEQ ID NO: 5191080 - DNA, 23 bp, Homo sapiens
agcctcactggggcagacaataa

SEQ ID NO: 5191081 - DNA, 15 bp, Homo sapiens
agcctcacttccttt

SEQ ID NO: 5191082 - DNA, 21 bp, Homo sapiens
agcctcacttggtctgccagg

SEQ ID NO: 5191083 - DNA, 22 bp, Homo sapiens
agcctcacttttaatgaacaaa

SEQ ID NO: 5191084 - DNA, 14 bp, Homo sapiens
agcctcagaagcct

SEQ ID NO: 5191085 - DNA, 16 bp, Homo sapiens
agcctcagaagccttc

SEQ ID NO: 5191086 - DNA, 21 bp, Homo sapiens
agcctcagaagccttcttgct

SEQ ID NO: 5191087 - DNA, 22 bp, Homo sapiens
agcctcagaaggccccagagag

SEQ ID NO: 5191088 - DNA, 15 bp, Homo sapiens
agcctcagaccccag

SEQ ID NO: 5191089 - DNA, 17 bp, Homo sapiens
agcctcagaccccaggt

SEQ ID NO: 5191090 - DNA, 23 bp, Homo sapiens
agcctcagaccccaggtcagcat

SEQ ID NO: 5191091 - DNA, 15 bp, Homo sapiens
agcctcagagatctc

SEQ ID NO: 5191092 - DNA, 19 bp, Homo sapiens
agcctcagagatctccctt

SEQ ID NO: 5191093 - DNA, 17 bp, Homo sapiens
agcctcagaggagctct

SEQ ID NO: 5191094 - DNA, 20 bp, Homo sapiens
agcctcagaggccccttgct

SEQ ID NO: 5191095 - DNA, 16 bp, Homo sapiens
agcctcagagtcctgc

SEQ ID NO: 5191096 - DNA, 12 bp, Homo sapiens
agcctcagagtg

SEQ ID NO: 5191097 - DNA, 16 bp, Homo sapiens
agcctcagattccttc

SEQ ID NO: 5191098 - DNA, 23 bp, Homo sapiens
agcctcagcatcctggcacccgg

SEQ ID NO: 5191099 - DNA, 15 bp, Homo sapiens
agcctcagccactcc

SEQ ID NO: 5191100 - DNA, 16 bp, Homo sapiens
agcctcagccactccc

SEQ ID NO: 5191101 - DNA, 12 bp, Homo sapiens
agcctcagccat

SEQ ID NO: 5191102 - DNA, 15 bp, Homo sapiens
agcctcagccattca

SEQ ID NO: 5191103 - DNA, 13 bp, Homo sapiens
agcctcagcccaa

SEQ ID NO: 5191104 - DNA, 15 bp, Homo sapiens
agcctcagcccaact

SEQ ID NO: 5191105 - DNA, 18 bp, Homo sapiens
agcctcagcccaacttct

SEQ ID NO: 5191106 - DNA, 20 bp, Homo sapiens
agcctcagcccaacttctta

SEQ ID NO: 5191107 - DNA, 19 bp, Homo sapiens
agcctcagccccctgcttc

SEQ ID NO: 5191108 - DNA, 22 bp, Homo sapiens
agcctcagcgcggccctcccga

SEQ ID NO: 5191109 - DNA, 22 bp, Homo sapiens
agcctcagcggaccactcttct

SEQ ID NO: 5191110 - DNA, 13 bp, Homo sapiens
agcctcagctcag

SEQ ID NO: 5191111 - DNA, 17 bp, Homo sapiens
agcctcagctcagcctc

SEQ ID NO: 5191112 - DNA, 23 bp, Homo sapiens
agcctcaggcttgagggagggct

SEQ ID NO: 5191113 - DNA, 20 bp, Homo sapiens
agcctcaggggtctgagctc

SEQ ID NO: 5191114 - DNA, 23 bp, Homo sapiens
agcctcaggggtctgagctccag

SEQ ID NO: 5191115 - DNA, 24 bp, Homo sapiens
agcctcagtccctccctcctggct

SEQ ID NO: 5191116 - DNA, 20 bp, Homo sapiens
agcctcagtcctcccctcac

SEQ ID NO: 5191117 - DNA, 15 bp, Homo sapiens
agcctcagtgaaaca

SEQ ID NO: 5191118 - DNA, 19 bp, Homo sapiens
agcctcagtgcagccccct

SEQ ID NO: 5191119 - DNA, 14 bp, Homo sapiens
agcctcagtgccac

SEQ ID NO: 5191120 - DNA, 23 bp, Homo sapiens
agcctcagtgccacttgacattc

SEQ ID NO: 5191121 - DNA, 22 bp, Homo sapiens
agcctcatacctacatcagaca

SEQ ID NO: 5191122 - DNA, 19 bp, Homo sapiens
agcctcatactcctgggct

SEQ ID NO: 5191123 - DNA, 14 bp, Homo sapiens
agcctcatatttaa

SEQ ID NO: 5191124 - DNA, 15 bp, Homo sapiens
agcctcatatttaaa

SEQ ID NO: 5191125 - DNA, 17 bp, Homo sapiens
agcctcatatttaaaga

SEQ ID NO: 5191126 - DNA, 17 bp, Homo sapiens
agcctcatccagcctca

SEQ ID NO: 5191127 - DNA, 17 bp, Homo sapiens
agcctcatccgaggcag

SEQ ID NO: 5191128 - DNA, 22 bp, Homo sapiens
agcctcatcctccccaggaccc

SEQ ID NO: 5191129 - DNA, 12 bp, Homo sapiens
agcctcatctct

SEQ ID NO: 5191130 - DNA, 22 bp, Homo sapiens
agcctcatgccaaccctgggct

SEQ ID NO: 5191131 - DNA, 14 bp, Homo sapiens
agcctcatgctctg

SEQ ID NO: 5191132 - DNA, 15 bp, Homo sapiens
agcctcatgtccact

SEQ ID NO: 5191133 - DNA, 20 bp, Homo sapiens
agcctcatgttctcttccca

SEQ ID NO: 5191134 - DNA, 17 bp, Homo sapiens
agcctcatgttctgtgg

SEQ ID NO: 5191135 - DNA, 22 bp, Homo sapiens
agcctcattcactgtcctggct

SEQ ID NO: 5191136 - DNA, 19 bp, Homo sapiens
agcctcattctgaggcctg

SEQ ID NO: 5191137 - DNA, 15 bp, Homo sapiens
agcctcattgtgcca

SEQ ID NO: 5191138 - DNA, 18 bp, Homo sapiens
agcctcattgtgccaagc

SEQ ID NO: 5191139 - DNA, 23 bp, Homo sapiens
agcctccaaaaatggcagtgact

SEQ ID NO: 5191140 - DNA, 18 bp, Homo sapiens
agcctccaagggtttcga

SEQ ID NO: 5191141 - DNA, 21 bp, Homo sapiens
agcctccaatgcattggcctc

SEQ ID NO: 5191142 - DNA, 14 bp, Homo sapiens
agcctccaattttt

SEQ ID NO: 5191143 - DNA, 19 bp, Homo sapiens
agcctccacaccagctgct

SEQ ID NO: 5191144 - DNA, 22 bp, Homo sapiens
agcctccacaccagctgctgct

SEQ ID NO: 5191145 - DNA, 13 bp, Homo sapiens
agcctccacagcg

SEQ ID NO: 5191146 - DNA, 15 bp, Homo sapiens
agcctccacagcgag

SEQ ID NO: 5191147 - DNA, 22 bp, Homo sapiens
agcctccacagcgagggcagct

SEQ ID NO: 5191148 - DNA, 11 bp, Homo sapiens
agcctccacca

SEQ ID NO: 5191149 - DNA, 12 bp, Homo sapiens
agcctccacctg

SEQ ID NO: 5191150 - DNA, 18 bp, Homo sapiens
agcctccacctgcagccc

SEQ ID NO: 5191151 - DNA, 19 bp, Homo sapiens
agcctccacctgcagcccc

SEQ ID NO: 5191152 - DNA, 23 bp, Homo sapiens
agcctccacctgcagccccaggc

SEQ ID NO: 5191153 - DNA, 19 bp, Homo sapiens
agcctccaccttgctcttc

SEQ ID NO: 5191154 - DNA, 14 bp, Homo sapiens
agcctccacggaga

SEQ ID NO: 5191155 - DNA, 16 bp, Homo sapiens
agcctccactccctgt

SEQ ID NO: 5191156 - DNA, 14 bp, Homo sapiens
agcctccacttccc

SEQ ID NO: 5191157 - DNA, 23 bp, Homo sapiens
agcctccactttggatcaggaaa

SEQ ID NO: 5191158 - DNA, 16 bp, Homo sapiens
agcctccagagaagcc

SEQ ID NO: 5191159 - DNA, 16 bp, Homo sapiens
agcctccagagccagc

SEQ ID NO: 5191160 - DNA, 19 bp, Homo sapiens
agcctccagagccagcctg

SEQ ID NO: 5191161 - DNA, 24 bp, Homo sapiens
agcctccagagccagcctgggact

SEQ ID NO: 5191162 - DNA, 12 bp, Homo sapiens
agcctccagcct

SEQ ID NO: 5191163 - DNA, 14 bp, Homo sapiens
agcctccagcctct

SEQ ID NO: 5191164 - DNA, 15 bp, Homo sapiens
agcctccagcctctg

SEQ ID NO: 5191165 - DNA, 17 bp, Homo sapiens
agcctccagctgccccg

SEQ ID NO: 5191166 - DNA, 13 bp, Homo sapiens
agcctccagggca

SEQ ID NO: 5191167 - DNA, 16 bp, Homo sapiens
agcctccagggcattg

SEQ ID NO: 5191168 - DNA, 16 bp, Homo sapiens
agcctccagtccaagg

SEQ ID NO: 5191169 - DNA, 22 bp, Homo sapiens
agcctccagtccaaggaaacca

SEQ ID NO: 5191170 - DNA, 13 bp, Homo sapiens
agcctccagtctg

SEQ ID NO: 5191171 - DNA, 15 bp, Homo sapiens
agcctccagtctgct

SEQ ID NO: 5191172 - DNA, 20 bp, Homo sapiens
agcctccagtctgctctcag

SEQ ID NO: 5191173 - DNA, 21 bp, Homo sapiens
agcctccagtctgctctcagc

SEQ ID NO: 5191174 - DNA, 19 bp, Homo sapiens
agcctccagtgctggctgc

SEQ ID NO: 5191175 - DNA, 23 bp, Homo sapiens
agcctccagtgctggctgctggc

SEQ ID NO: 5191176 - DNA, 20 bp, Homo sapiens
agcctccagtgggaggacag

SEQ ID NO: 5191177 - DNA, 20 bp, Homo sapiens
agcctccatgctgcctccag

SEQ ID NO: 5191178 - DNA, 15 bp, Homo sapiens
agcctccatttagtt

SEQ ID NO: 5191179 - DNA, 17 bp, Homo sapiens
agcctccatttagttct

SEQ ID NO: 5191180 - DNA, 20 bp, Homo sapiens
agcctccatttagttctttg

SEQ ID NO: 5191181 - DNA, 19 bp, Homo sapiens
agcctccatttctggcttc

SEQ ID NO: 5191182 - DNA, 20 bp, Homo sapiens
agcctcccaaagtgctggga

SEQ ID NO: 5191183 - DNA, 17 bp, Homo sapiens
agcctcccaagtagctg

SEQ ID NO: 5191184 - DNA, 22 bp, Homo sapiens
agcctcccaagtagctgggatt

SEQ ID NO: 5191185 - DNA, 18 bp, Homo sapiens
agcctcccatccagggcc

SEQ ID NO: 5191186 - DNA, 16 bp, Homo sapiens
agcctccccacccagg

SEQ ID NO: 5191187 - DNA, 22 bp, Homo sapiens
agcctccccatctgtccagctg

SEQ ID NO: 5191188 - DNA, 12 bp, Homo sapiens
agcctcccccaa

SEQ ID NO: 5191189 - DNA, 15 bp, Homo sapiens
agcctcccccaaagc

SEQ ID NO: 5191190 - DNA, 17 bp, Homo sapiens
agcctcccccaggctgc

SEQ ID NO: 5191191 - DNA, 15 bp, Homo sapiens
agcctccccctcaga

SEQ ID NO: 5191192 - DNA, 18 bp, Homo sapiens
agcctccccctgctgctc

SEQ ID NO: 5191193 - DNA, 10 bp, Homo sapiens
agcctcccct

SEQ ID NO: 5191194 - DNA, 12 bp, Homo sapiens
agcctcccctcc

SEQ ID NO: 5191195 - DNA, 19 bp, Homo sapiens
agcctcccctgccagggca

SEQ ID NO: 5191196 - DNA, 13 bp, Homo sapiens
agcctccccttcc

SEQ ID NO: 5191197 - DNA, 16 bp, Homo sapiens
agcctccccttcccag

SEQ ID NO: 5191198 - DNA, 14 bp, Homo sapiens
agcctccccttctt

SEQ ID NO: 5191199 - DNA, 18 bp, Homo sapiens
agcctccccttcttcccg

SEQ ID NO: 5191200 - DNA, 18 bp, Homo sapiens
agcctcccgaatagctgg

SEQ ID NO: 5191201 - DNA, 19 bp, Homo sapiens
agcctcccgaatagctggg

SEQ ID NO: 5191202 - DNA, 22 bp, Homo sapiens
agcctcccgaatagctgggact

SEQ ID NO: 5191203 - DNA, 23 bp, Homo sapiens
agcctccctattttttttctgtt

SEQ ID NO: 5191204 - DNA, 18 bp, Homo sapiens
agcctccctcagccacgc

SEQ ID NO: 5191205 - DNA, 22 bp, Homo sapiens
agcctccctcagcccccaggat

SEQ ID NO: 5191206 - DNA, 21 bp, Homo sapiens
agcctccctcctcgtcccctg

SEQ ID NO: 5191207 - DNA, 11 bp, Homo sapiens
agcctccctct

SEQ ID NO: 5191208 - DNA, 12 bp, Homo sapiens
agcctccctctc

SEQ ID NO: 5191209 - DNA, 21 bp, Homo sapiens
agcctccctctcctctgtccc

SEQ ID NO: 5191210 - DNA, 14 bp, Homo sapiens
agcctccctctgac

SEQ ID NO: 5191211 - DNA, 17 bp, Homo sapiens
agcctccctgaagacca

SEQ ID NO: 5191212 - DNA, 20 bp, Homo sapiens
agcctccctgacgtctgcca

SEQ ID NO: 5191213 - DNA, 23 bp, Homo sapiens
agcctccctgacgtctgccacca

SEQ ID NO: 5191214 - DNA, 11 bp, Homo sapiens
agcctccctgc

SEQ ID NO: 5191215 - DNA, 15 bp, Homo sapiens
agcctccctgcacgg

SEQ ID NO: 5191216 - DNA, 16 bp, Homo sapiens
agcctccctgcagcca

SEQ ID NO: 5191217 - DNA, 12 bp, Homo sapiens
agcctccctgcc

SEQ ID NO: 5191218 - DNA, 14 bp, Homo sapiens
agcctccctgtcac

SEQ ID NO: 5191219 - DNA, 18 bp, Homo sapiens
agcctccctgtcggcctg

SEQ ID NO: 5191220 - DNA, 18 bp, Homo sapiens
agcctccctgtctccagc

SEQ ID NO: 5191221 - DNA, 19 bp, Homo sapiens
agcctccctgtctccagct

SEQ ID NO: 5191222 - DNA, 14 bp, Homo sapiens
agcctccctttgcc

SEQ ID NO: 5191223 - DNA, 15 bp, Homo sapiens
agcctccctttgcca

SEQ ID NO: 5191224 - DNA, 19 bp, Homo sapiens
agcctccctttgccagcca

SEQ ID NO: 5191225 - DNA, 18 bp, Homo sapiens
agcctccgacgctgcctc

SEQ ID NO: 5191226 - DNA, 16 bp, Homo sapiens
agcactctgccatcct

SEQ ID NO: 5191227 - DNA, 12 bp, Homo sapiens
agcactctggac

SEQ ID NO: 5191228 - DNA, 19 bp, Homo sapiens
agcactctggactccacga

SEQ ID NO: 5191229 - DNA, 15 bp, Homo sapiens
agcactctggggtgg

SEQ ID NO: 5191230 - DNA, 16 bp, Homo sapiens
agcactctggggtggg

SEQ ID NO: 5191231 - DNA, 24 bp, Homo sapiens
agcactctgtaaaacgcaccaatc

SEQ ID NO: 5191232 - DNA, 24 bp, Homo sapiens
agcactctgtaaaatgcaccaatc

SEQ ID NO: 5191233 - DNA, 11 bp, Homo sapiens
agcactgaaaa

SEQ ID NO: 5191234 - DNA, 20 bp, Homo sapiens
agcactgaaagtatgtttta

SEQ ID NO: 5191235 - DNA, 20 bp, Homo sapiens
agcactgaaccacattcagg

SEQ ID NO: 5191236 - DNA, 21 bp, Homo sapiens
agcactgaaccacattcaggg

SEQ ID NO: 5191237 - DNA, 18 bp, Homo sapiens
agcactgaacctgggaaa

SEQ ID NO: 5191238 - DNA, 14 bp, Homo sapiens
agcactgacagatt

SEQ ID NO: 5191239 - DNA, 17 bp, Homo sapiens
agcactgacttaaaacg

SEQ ID NO: 5191240 - DNA, 11 bp, Homo sapiens
agcactgagca

SEQ ID NO: 5191241 - DNA, 10 bp, Homo sapiens
agcactgagg

SEQ ID NO: 5191242 - DNA, 21 bp, Homo sapiens
agcactgaggaagaacggggc

SEQ ID NO: 5191243 - DNA, 14 bp, Homo sapiens
agcactgatgttgt

SEQ ID NO: 5191244 - DNA, 20 bp, Homo sapiens
agcactgcacactcagttct

SEQ ID NO: 5191245 - DNA, 12 bp, Homo sapiens
agcactgcacct

SEQ ID NO: 5191246 - DNA, 19 bp, Homo sapiens
agcactgcagatagccaga

SEQ ID NO: 5191247 - DNA, 16 bp, Homo sapiens
agcactgccaggaggg

SEQ ID NO: 5191248 - DNA, 17 bp, Homo sapiens
agcactgccaggaggga

SEQ ID NO: 5191249 - DNA, 19 bp, Homo sapiens
agcactgcccatcccaccc

SEQ ID NO: 5191250 - DNA, 20 bp, Homo sapiens
agcactgcccatcccacccc

SEQ ID NO: 5191251 - DNA, 21 bp, Homo sapiens
agcactgcccatcccacccca

SEQ ID NO: 5191252 - DNA, 17 bp, Homo sapiens
agcactgccccacatgc

SEQ ID NO: 5191253 - DNA, 16 bp, Homo sapiens
agcactgcctcctgtt

SEQ ID NO: 5191254 - DNA, 21 bp, Homo sapiens
agcactgcctcctgttttctc

SEQ ID NO: 5191255 - DNA, 19 bp, Homo sapiens
agcactgcctctatgccct

SEQ ID NO: 5191256 - DNA, 21 bp, Homo sapiens
agcactgcctctatgccctgc

SEQ ID NO: 5191257 - DNA, 24 bp, Homo sapiens
agcactgcctctatgccctgcaga

SEQ ID NO: 5191258 - DNA, 15 bp, Homo sapiens
agcactgcctgccaa

SEQ ID NO: 5191259 - DNA, 15 bp, Homo sapiens
agcactgcctgctcc

SEQ ID NO: 5191260 - DNA, 16 bp, Homo sapiens
agcactgcctgctccc

SEQ ID NO: 5191261 - DNA, 23 bp, Homo sapiens
agcactgctaggcgagtgccagg

SEQ ID NO: 5191262 - DNA, 12 bp, Homo sapiens
agcactggaggc

SEQ ID NO: 5191263 - DNA, 14 bp, Homo sapiens
agcactggaggcct

SEQ ID NO: 5191264 - DNA, 19 bp, Homo sapiens
agcactggaggggcccacc

SEQ ID NO: 5191265 - DNA, 22 bp, Homo sapiens
agcactggaggggcccacccac

SEQ ID NO: 5191266 - DNA, 23 bp, Homo sapiens
agcactggaggggcccacccaca

SEQ ID NO: 5191267 - DNA, 20 bp, Homo sapiens
agcactggattgtagaactt

SEQ ID NO: 5191268 - DNA, 21 bp, Homo sapiens
agcactggattgtagaacttg

SEQ ID NO: 5191269 - DNA, 23 bp, Homo sapiens
agcactggattgtagaacttgtt

SEQ ID NO: 5191270 - DNA, 15 bp, Homo sapiens
agcactggccagaga

SEQ ID NO: 5191271 - DNA, 17 bp, Homo sapiens
agcactggccagagagg

SEQ ID NO: 5191272 - DNA, 12 bp, Homo sapiens
agcactggcctg

SEQ ID NO: 5191273 - DNA, 15 bp, Homo sapiens
agcactggcctgcac

SEQ ID NO: 5191274 - DNA, 14 bp, Homo sapiens
agcactggccttgc

SEQ ID NO: 5191275 - DNA, 19 bp, Homo sapiens
agcactggctctctccagg

SEQ ID NO: 5191276 - DNA, 17 bp, Homo sapiens
agcactgggagaactaa

SEQ ID NO: 5191277 - DNA, 20 bp, Homo sapiens
agcactgggatcacaggtgt

SEQ ID NO: 5191278 - DNA, 15 bp, Homo sapiens
agcactggggtgggg

SEQ ID NO: 5191279 - DNA, 22 bp, Homo sapiens
agcactggggtgggggtggaat

SEQ ID NO: 5191280 - DNA, 23 bp, Homo sapiens
agcactgtatgtgttgcacgatg

SEQ ID NO: 5191281 - DNA, 15 bp, Homo sapiens
agcactgtcccttgc

SEQ ID NO: 5191282 - DNA, 15 bp, Homo sapiens
agcactgtgctaata

SEQ ID NO: 5191283 - DNA, 15 bp, Homo sapiens
agcactgtgctcagg

SEQ ID NO: 5191284 - DNA, 15 bp, Homo sapiens
agcactgttcacatc

SEQ ID NO: 5191285 - DNA, 17 bp, Homo sapiens
agcactgttgatgtatc

SEQ ID NO: 5191286 - DNA, 15 bp, Homo sapiens
agcactgttttctag

SEQ ID NO: 5191287 - DNA, 18 bp, Homo sapiens
agcactgttttctagtgt

SEQ ID NO: 5191288 - DNA, 22 bp, Homo sapiens
agcactgttttctagtgtatca

SEQ ID NO: 5191289 - DNA, 21 bp, Homo sapiens
agcactgtttttccatagttt

SEQ ID NO: 5191290 - DNA, 23 bp, Homo sapiens
agcactgtttttccatagttttg

SEQ ID NO: 5191291 - DNA, 13 bp, Homo sapiens
agcacttaaagtt

SEQ ID NO: 5191292 - DNA, 18 bp, Homo sapiens
agcacttaaattcctcaa

SEQ ID NO: 5191293 - DNA, 12 bp, Homo sapiens
agcacttaagag

SEQ ID NO: 5191294 - DNA, 14 bp, Homo sapiens
agcacttaagtgtt

SEQ ID NO: 5191295 - DNA, 18 bp, Homo sapiens
agcacttacgtaaaacat

SEQ ID NO: 5191296 - DNA, 16 bp, Homo sapiens
agcacttagacctgcc

SEQ ID NO: 5191297 - DNA, 23 bp, Homo sapiens
agcacttagacctgccagccact

SEQ ID NO: 5191298 - DNA, 16 bp, Homo sapiens
agcacttcaacctagt

SEQ ID NO: 5191299 - DNA, 20 bp, Homo sapiens
agcacttcacagctggaccc

SEQ ID NO: 5191300 - DNA, 21 bp, Homo sapiens
agcacttcagatcaagtgctt

SEQ ID NO: 5191301 - DNA, 15 bp, Homo sapiens
agcacttcaggaggc

SEQ ID NO: 5191302 - DNA, 16 bp, Homo sapiens
agcacttccaaaattc

SEQ ID NO: 5191303 - DNA, 16 bp, Homo sapiens
agcacttcccaggatc

SEQ ID NO: 5191304 - DNA, 16 bp, Homo sapiens
agcacttccttgccag

SEQ ID NO: 5191305 - DNA, 18 bp, Homo sapiens
agcacttccttgccagtc

SEQ ID NO: 5191306 - DNA, 17 bp, Homo sapiens
agcacttctaagttgag

SEQ ID NO: 5191307 - DNA, 20 bp, Homo sapiens
agcacttctaagttgagtat

SEQ ID NO: 5191308 - DNA, 12 bp, Homo sapiens
agcacttctaga

SEQ ID NO: 5191309 - DNA, 17 bp, Homo sapiens
agcacttctttcctctc

SEQ ID NO: 5191310 - DNA, 21 bp, Homo sapiens
agcacttcttttccaaaaata

SEQ ID NO: 5191311 - DNA, 23 bp, Homo sapiens
agcacttgaccttttcgacgctt

SEQ ID NO: 5191312 - DNA, 17 bp, Homo sapiens
agcacttgagctgtctg

SEQ ID NO: 5191313 - DNA, 22 bp, Homo sapiens
agcacttgagctgtctgaagcc

SEQ ID NO: 5191314 - DNA, 23 bp, Homo sapiens
agcacttgagctgtctgaagccc

SEQ ID NO: 5191315 - DNA, 22 bp, Homo sapiens
agcacttgcaaccgtctgttat

SEQ ID NO: 5191316 - DNA, 12 bp, Homo sapiens
agcacttgcctg

SEQ ID NO: 5191317 - DNA, 14 bp, Homo sapiens
agcacttgcctgga

SEQ ID NO: 5191318 - DNA, 15 bp, Homo sapiens
agcacttgcctggaa

SEQ ID NO: 5191319 - DNA, 18 bp, Homo sapiens
agcacttgcgtcctgcag

SEQ ID NO: 5191320 - DNA, 22 bp, Homo sapiens
agcacttgcgtcctgcagagga

SEQ ID NO: 5191321 - DNA, 19 bp, Homo sapiens
agcacttgctcaaaatctg

SEQ ID NO: 5191322 - DNA, 13 bp, Homo sapiens
agcacttgctgta

SEQ ID NO: 5191323 - DNA, 18 bp, Homo sapiens
agcacttgttccttctgc

SEQ ID NO: 5191324 - DNA, 21 bp, Homo sapiens
agcacttgttttaaaatgcag

SEQ ID NO: 5191325 - DNA, 17 bp, Homo sapiens
agcactttaaagaggct

SEQ ID NO: 5191326 - DNA, 18 bp, Homo sapiens
agcactttaaagaggctg

SEQ ID NO: 5191327 - DNA, 21 bp, Homo sapiens
agcactttaaagaggctgtgt

SEQ ID NO: 5191328 - DNA, 20 bp, Homo sapiens
agcactttaacacagtgtct

SEQ ID NO: 5191329 - DNA, 21 bp, Homo sapiens
agcactttaaccctctcttcc

SEQ ID NO: 5191330 - DNA, 17 bp, Homo sapiens
agcactttaccagaggc

SEQ ID NO: 5191331 - DNA, 14 bp, Homo sapiens
agcactttagaata

SEQ ID NO: 5191332 - DNA, 16 bp, Homo sapiens
agcactttcattgcca

SEQ ID NO: 5191333 - DNA, 19 bp, Homo sapiens
agcactttcattgccagtg

SEQ ID NO: 5191334 - DNA, 22 bp, Homo sapiens
agcactttcattgccagtgtct

SEQ ID NO: 5191335 - DNA, 20 bp, Homo sapiens
agcactttgaaaatatttct

SEQ ID NO: 5191336 - DNA, 21 bp, Homo sapiens
agcactttgaaaatatttcta

SEQ ID NO: 5191337 - DNA, 23 bp, Homo sapiens
agcactttgaaaatatttctatg

SEQ ID NO: 5191338 - DNA, 18 bp, Homo sapiens
agcactttgaaatacctc

SEQ ID NO: 5191339 - DNA, 16 bp, Homo sapiens
agcactttgggaagct

SEQ ID NO: 5191340 - DNA, 17 bp, Homo sapiens
agcactttgggaggcag

SEQ ID NO: 5191341 - DNA, 16 bp, Homo sapiens
agcactttgggaggcc

SEQ ID NO: 5191342 - DNA, 19 bp, Homo sapiens
agcactttgggaggccaag

SEQ ID NO: 5191343 - DNA, 20 bp, Homo sapiens
agcactttgggaggccaagg

SEQ ID NO: 5191344 - DNA, 21 bp, Homo sapiens
agcactttgggaggctgaagt

SEQ ID NO: 5191345 - DNA, 21 bp, Homo sapiens
agcactttgggaggctgaggc

SEQ ID NO: 5191346 - DNA, 18 bp, Homo sapiens
agcactttgggaggtcga

SEQ ID NO: 5191347 - DNA, 18 bp, Homo sapiens
agcacttttaaaaaaatt

SEQ ID NO: 5191348 - DNA, 16 bp, Homo sapiens
agcacttttgttattc

SEQ ID NO: 5191349 - DNA, 21 bp, Homo sapiens
agcacttttgttattccatca

SEQ ID NO: 5191350 - DNA, 13 bp, Homo sapiens
agcactttttcct

SEQ ID NO: 5191351 - DNA, 20 bp, Homo sapiens
agcactttttccttctgaaa

SEQ ID NO: 5191352 - DNA, 17 bp, Homo sapiens
agcactttttggctgac

SEQ ID NO: 5191353 - DNA, 16 bp, Homo sapiens
agcagaaaaacaggca

SEQ ID NO: 5191354 - DNA, 23 bp, Homo sapiens
agcagaaaaaggctgtgctgccc

SEQ ID NO: 5191355 - DNA, 16 bp, Homo sapiens
agcagaaaaattaaat

SEQ ID NO: 5191356 - DNA, 15 bp, Homo sapiens
agcagaaaacccttg

SEQ ID NO: 5191357 - DNA, 17 bp, Homo sapiens
agcagaaaagtgcttag

SEQ ID NO: 5191358 - DNA, 20 bp, Homo sapiens
agcagaaaagtgcttagaaa

SEQ ID NO: 5191359 - DNA, 13 bp, Homo sapiens
agcagaaacaaaa

SEQ ID NO: 5191360 - DNA, 20 bp, Homo sapiens
agcagaaacaaaatgaaaaa

SEQ ID NO: 5191361 - DNA, 22 bp, Homo sapiens
agcagaaagggccttgaatcct

SEQ ID NO: 5191362 - DNA, 21 bp, Homo sapiens
agcagaaagtaagcatttcca

SEQ ID NO: 5191363 - DNA, 22 bp, Homo sapiens
agcagaaagtgcctttatctca

SEQ ID NO: 5191364 - DNA, 21 bp, Homo sapiens
agcagaaagtgcctttcagga

SEQ ID NO: 5191365 - DNA, 18 bp, Homo sapiens
agcagaaatccaagcacc

SEQ ID NO: 5191366 - DNA, 15 bp, Homo sapiens
agcagaaatctagaa

SEQ ID NO: 5191367 - DNA, 15 bp, Homo sapiens
agcagaaatgccccc

SEQ ID NO: 5191368 - DNA, 20 bp, Homo sapiens
agcagaaatgcccccattct

SEQ ID NO: 5191369 - DNA, 19 bp, Homo sapiens
agcagaaatgccttaccct

SEQ ID NO: 5191370 - DNA, 22 bp, Homo sapiens
agcagaacaaactcagatctca

SEQ ID NO: 5191371 - DNA, 13 bp, Homo sapiens
agcagaacaaatg

SEQ ID NO: 5191372 - DNA, 16 bp, Homo sapiens
agcagaacaaatgtgt

SEQ ID NO: 5191373 - DNA, 12 bp, Homo sapiens
agcagaacactg

SEQ ID NO: 5191374 - DNA, 20 bp, Homo sapiens
agcagaacagatcttttact

SEQ ID NO: 5191375 - DNA, 16 bp, Homo sapiens
agcagaacctgcacac

SEQ ID NO: 5191376 - DNA, 18 bp, Homo sapiens
agcagaacctgcacacag

SEQ ID NO: 5191377 - DNA, 19 bp, Homo sapiens
agcagaacctgcacacagg

SEQ ID NO: 5191378 - DNA, 24 bp, Homo sapiens
agcagaacctgcacacaggacagc

SEQ ID NO: 5191379 - DNA, 16 bp, Homo sapiens
agcagaacctgtagga

SEQ ID NO: 5191380 - DNA, 22 bp, Homo sapiens
agcagaactgaagtgtgctgtg

SEQ ID NO: 5191381 - DNA, 23 bp, Homo sapiens
agcagaactgctatttttcatcc

SEQ ID NO: 5191382 - DNA, 20 bp, Homo sapiens
agcagaagacaaggcatgta

SEQ ID NO: 5191383 - DNA, 14 bp, Homo sapiens
agcagaagaccaga

SEQ ID NO: 5191384 - DNA, 17 bp, Homo sapiens
agcagaagagggaggct

SEQ ID NO: 5191385 - DNA, 13 bp, Homo sapiens
agcagaagccaaa

SEQ ID NO: 5191386 - DNA, 15 bp, Homo sapiens
agcagaaggaaggat

SEQ ID NO: 5191387 - DNA, 21 bp, Homo sapiens
agcagaaggaaggatgccact

SEQ ID NO: 5191388 - DNA, 23 bp, Homo sapiens
agcagaaggacaggtctctgaga

SEQ ID NO: 5191389 - DNA, 11 bp, Homo sapiens
agcagaaggag

SEQ ID NO: 5191390 - DNA, 16 bp, Homo sapiens
agcagaaggatttttt

SEQ ID NO: 5191391 - DNA, 14 bp, Homo sapiens
agcagaaggccttg

SEQ ID NO: 5191392 - DNA, 16 bp, Homo sapiens
agcagaagggggtggt

SEQ ID NO: 5191393 - DNA, 23 bp, Homo sapiens
agcagaagggggtggtgtctcca

SEQ ID NO: 5191394 - DNA, 14 bp, Homo sapiens
agcagaagtgacca

SEQ ID NO: 5191395 - DNA, 17 bp, Homo sapiens
agcagaagtgaccaaat

SEQ ID NO: 5191396 - DNA, 20 bp, Homo sapiens
agcagaagtggaatccagtg

SEQ ID NO: 5191397 - DNA, 16 bp, Homo sapiens
agcagaagtggagctg

SEQ ID NO: 5191398 - DNA, 11 bp, Homo sapiens
agcagaataaa

SEQ ID NO: 5191399 - DNA, 17 bp, Homo sapiens
agcagaataaagcaatt

SEQ ID NO: 5191400 - DNA, 18 bp, Homo sapiens
agcagaataaagcaattt

SEQ ID NO: 5191401 - DNA, 23 bp, Homo sapiens
agcagaataaagcaattttcctt

SEQ ID NO: 5191402 - DNA, 17 bp, Homo sapiens
agcagaataaatgtttt

SEQ ID NO: 5191403 - DNA, 18 bp, Homo sapiens
agcctccgagagggagag

SEQ ID NO: 5191404 - DNA, 17 bp, Homo sapiens
agcctccgccattccaa

SEQ ID NO: 5191405 - DNA, 17 bp, Homo sapiens
agcctccgcctcccggg

SEQ ID NO: 5191406 - DNA, 18 bp, Homo sapiens
agcctccgcctcccgggt

SEQ ID NO: 5191407 - DNA, 16 bp, Homo sapiens
agcctccgcttccctg

SEQ ID NO: 5191408 - DNA, 17 bp, Homo sapiens
agcctccgcttccctgg

SEQ ID NO: 5191409 - DNA, 22 bp, Homo sapiens
agcctccgggcgtgtgaagaac

SEQ ID NO: 5191410 - DNA, 22 bp, Homo sapiens
agcctccggggttcagcctcct

SEQ ID NO: 5191411 - DNA, 17 bp, Homo sapiens
agcctccgtatttcaga

SEQ ID NO: 5191412 - DNA, 16 bp, Homo sapiens
agcctccgtcaggaga

SEQ ID NO: 5191413 - DNA, 18 bp, Homo sapiens
agcctccgtggaacattc

SEQ ID NO: 5191414 - DNA, 20 bp, Homo sapiens
agcctccgtttatgggcctt

SEQ ID NO: 5191415 - DNA, 23 bp, Homo sapiens
agcctccgtttatgggccttgct

SEQ ID NO: 5191416 - DNA, 17 bp, Homo sapiens
agcctcctaggctccct

SEQ ID NO: 5191417 - DNA, 21 bp, Homo sapiens
agcctcctaggctccctgagg

SEQ ID NO: 5191418 - DNA, 21 bp, Homo sapiens
agcctcctcccaccaccctcc

SEQ ID NO: 5191419 - DNA, 19 bp, Homo sapiens
agcctcctcctgaccacgg

SEQ ID NO: 5191420 - DNA, 22 bp, Homo sapiens
agcctcctctgcttgcatcact

SEQ ID NO: 5191421 - DNA, 12 bp, Homo sapiens
agcctcctctgt

SEQ ID NO: 5191422 - DNA, 18 bp, Homo sapiens
agcctcctgaacagctgg

SEQ ID NO: 5191423 - DNA, 12 bp, Homo sapiens
agcctcctgacc

SEQ ID NO: 5191424 - DNA, 16 bp, Homo sapiens
agcctcctgacctgag

SEQ ID NO: 5191425 - DNA, 12 bp, Homo sapiens
agcctcctgagc

SEQ ID NO: 5191426 - DNA, 14 bp, Homo sapiens
agcctcctgagcct

SEQ ID NO: 5191427 - DNA, 18 bp, Homo sapiens
agcctcctgagcctgtgg

SEQ ID NO: 5191428 - DNA, 20 bp, Homo sapiens
agcctcctgagtagatggga

SEQ ID NO: 5191429 - DNA, 14 bp, Homo sapiens
agcctcctgcccag

SEQ ID NO: 5191430 - DNA, 18 bp, Homo sapiens
agcctcctgcccttacct

SEQ ID NO: 5191431 - DNA, 13 bp, Homo sapiens
agcctcctgctga

SEQ ID NO: 5191432 - DNA, 20 bp, Homo sapiens
agcctcctgtacctcagtgg

SEQ ID NO: 5191433 - DNA, 17 bp, Homo sapiens
agcctcctgtgcctggc

SEQ ID NO: 5191434 - DNA, 21 bp, Homo sapiens
agcctcctgtgcctggcccca

SEQ ID NO: 5191435 - DNA, 14 bp, Homo sapiens
agcctccttctttc

SEQ ID NO: 5191436 - DNA, 16 bp, Homo sapiens
agcctccttgcctgga

SEQ ID NO: 5191437 - DNA, 21 bp, Homo sapiens
agcctccttgctgaccccagg

SEQ ID NO: 5191438 - DNA, 13 bp, Homo sapiens
agcctccttgtgc

SEQ ID NO: 5191439 - DNA, 16 bp, Homo sapiens
agcctcctttctggct

SEQ ID NO: 5191440 - DNA, 19 bp, Homo sapiens
agcctcgacctccctggct

SEQ ID NO: 5191441 - DNA, 20 bp, Homo sapiens
agcctcgacctccctggctt

SEQ ID NO: 5191442 - DNA, 18 bp, Homo sapiens
agcctcgaggtgccttct

SEQ ID NO: 5191443 - DNA, 16 bp, Homo sapiens
agcctcgatgtcctcc

SEQ ID NO: 5191444 - DNA, 19 bp, Homo sapiens
agcctcgcaacccgtgcca

SEQ ID NO: 5191445 - DNA, 14 bp, Homo sapiens
agcctcgcccctcc

SEQ ID NO: 5191446 - DNA, 14 bp, Homo sapiens
agcctcgcccctgg

SEQ ID NO: 5191447 - DNA, 18 bp, Homo sapiens
agcctcgcccctggcaga

SEQ ID NO: 5191448 - DNA, 18 bp, Homo sapiens
agcctcgcctgtcacccc

SEQ ID NO: 5191449 - DNA, 19 bp, Homo sapiens
agcctcggggatggggagg

SEQ ID NO: 5191450 - DNA, 21 bp, Homo sapiens
agcctcggggatggggaggga

SEQ ID NO: 5191451 - DNA, 15 bp, Homo sapiens
agcctcggtggccat

SEQ ID NO: 5191452 - DNA, 15 bp, Homo sapiens
agcctcgtccaaggc

SEQ ID NO: 5191453 - DNA, 16 bp, Homo sapiens
agcctcgtccaaggca

SEQ ID NO: 5191454 - DNA, 14 bp, Homo sapiens
agcctcgtctttca

SEQ ID NO: 5191455 - DNA, 15 bp, Homo sapiens
agcctcgtgtccaga

SEQ ID NO: 5191456 - DNA, 15 bp, Homo sapiens
agcctcgtgtcctgc

SEQ ID NO: 5191457 - DNA, 17 bp, Homo sapiens
agcctcgtgtcctgcta

SEQ ID NO: 5191458 - DNA, 20 bp, Homo sapiens
agcctcgtgtcctgctagct

SEQ ID NO: 5191459 - DNA, 23 bp, Homo sapiens
agcctcgtgtcctgctagctgtc

SEQ ID NO: 5191460 - DNA, 15 bp, Homo sapiens
agcctcgttggagag

SEQ ID NO: 5191461 - DNA, 19 bp, Homo sapiens
agcctctagagcagactac

SEQ ID NO: 5191462 - DNA, 23 bp, Homo sapiens
agcctctagagcagactacagct

SEQ ID NO: 5191463 - DNA, 23 bp, Homo sapiens
agcctctagtgtaccaagtgctt

SEQ ID NO: 5191464 - DNA, 22 bp, Homo sapiens
agcctctatcctacaaggccta

SEQ ID NO: 5191465 - DNA, 18 bp, Homo sapiens
agcctctcagtgccctcc

SEQ ID NO: 5191466 - DNA, 14 bp, Homo sapiens
agcctctcatcccc

SEQ ID NO: 5191467 - DNA, 12 bp, Homo sapiens
agcctctccagg

SEQ ID NO: 5191468 - DNA, 11 bp, Homo sapiens
agcctctccca

SEQ ID NO: 5191469 - DNA, 13 bp, Homo sapiens
agcctctcccacc

SEQ ID NO: 5191470 - DNA, 17 bp, Homo sapiens
agcctctcccacccggc

SEQ ID NO: 5191471 - DNA, 18 bp, Homo sapiens
agcctctcccacccggcc

SEQ ID NO: 5191472 - DNA, 15 bp, Homo sapiens
agcctctccccgctc

SEQ ID NO: 5191473 - DNA, 19 bp, Homo sapiens
agcctctcccctgcctgcc

SEQ ID NO: 5191474 - DNA, 21 bp, Homo sapiens
agcctctcccggctgcctgcc

SEQ ID NO: 5191475 - DNA, 18 bp, Homo sapiens
agcctctccgactctgca

SEQ ID NO: 5191476 - DNA, 13 bp, Homo sapiens
agcctctccgccc

SEQ ID NO: 5191477 - DNA, 15 bp, Homo sapiens
agcctctccgcccac

SEQ ID NO: 5191478 - DNA, 17 bp, Homo sapiens
agcctctccgcccacgc

SEQ ID NO: 5191479 - DNA, 12 bp, Homo sapiens
agcctctcctcc

SEQ ID NO: 5191480 - DNA, 18 bp, Homo sapiens
agcctctcctccttgggc

SEQ ID NO: 5191481 - DNA, 22 bp, Homo sapiens
agcctctcctccttgggcaggg

SEQ ID NO: 5191482 - DNA, 19 bp, Homo sapiens
agcctctccttgcctggtg

SEQ ID NO: 5191483 - DNA, 17 bp, Homo sapiens
agcctctctcccagtct

SEQ ID NO: 5191484 - DNA, 18 bp, Homo sapiens
agcctctctcccagtcta

SEQ ID NO: 5191485 - DNA, 21 bp, Homo sapiens
agcctctctccttggccacag

SEQ ID NO: 5191486 - DNA, 15 bp, Homo sapiens
agcctctctctccct

SEQ ID NO: 5191487 - DNA, 18 bp, Homo sapiens
agcctctctctccctccc

SEQ ID NO: 5191488 - DNA, 12 bp, Homo sapiens
agcctctctggc

SEQ ID NO: 5191489 - DNA, 14 bp, Homo sapiens
agcctctctggctc

SEQ ID NO: 5191490 - DNA, 21 bp, Homo sapiens
agcctctctggctcagcccgg

SEQ ID NO: 5191491 - DNA, 15 bp, Homo sapiens
agcctctctggctgg

SEQ ID NO: 5191492 - DNA, 16 bp, Homo sapiens
agcctctctggctggt

SEQ ID NO: 5191493 - DNA, 19 bp, Homo sapiens
agcctctctggctggtctt

SEQ ID NO: 5191494 - DNA, 20 bp, Homo sapiens
agcctctctggctggtcttc

SEQ ID NO: 5191495 - DNA, 20 bp, Homo sapiens
agcctctcttcctatcccat

SEQ ID NO: 5191496 - DNA, 12 bp, Homo sapiens
agcctctctttg

SEQ ID NO: 5191497 - DNA, 15 bp, Homo sapiens
agcctctgacccctc

SEQ ID NO: 5191498 - DNA, 22 bp, Homo sapiens
agcctctgacccctcctcactg

SEQ ID NO: 5191499 - DNA, 13 bp, Homo sapiens
agcctctgactca

SEQ ID NO: 5191500 - DNA, 17 bp, Homo sapiens
agcctctgactcaccac

SEQ ID NO: 5191501 - DNA, 19 bp, Homo sapiens
agcctctgagatgctaatt

SEQ ID NO: 5191502 - DNA, 22 bp, Homo sapiens
agcctctgatcaaattggctac

SEQ ID NO: 5191503 - DNA, 17 bp, Homo sapiens
agcctctgcaactgcaa

SEQ ID NO: 5191504 - DNA, 10 bp, Homo sapiens
agcctctgcc

SEQ ID NO: 5191505 - DNA, 12 bp, Homo sapiens
agcctctgccac

SEQ ID NO: 5191506 - DNA, 17 bp, Homo sapiens
agcctctgccaggcctg

SEQ ID NO: 5191507 - DNA, 13 bp, Homo sapiens
agcctctgcccca

SEQ ID NO: 5191508 - DNA, 14 bp, Homo sapiens
agcctctgccccac

SEQ ID NO: 5191509 - DNA, 16 bp, Homo sapiens
agcctctgccccaccc

SEQ ID NO: 5191510 - DNA, 18 bp, Homo sapiens
agcctctgccctgcctcc

SEQ ID NO: 5191511 - DNA, 13 bp, Homo sapiens
agcctctgccgct

SEQ ID NO: 5191512 - DNA, 19 bp, Homo sapiens
agcctctgccgctgccatg

SEQ ID NO: 5191513 - DNA, 14 bp, Homo sapiens
agcctctgcctccc

SEQ ID NO: 5191514 - DNA, 18 bp, Homo sapiens
agcctctgcctgacagca

SEQ ID NO: 5191515 - DNA, 12 bp, Homo sapiens
agcctctgctct

SEQ ID NO: 5191516 - DNA, 13 bp, Homo sapiens
agcctctgctgcc

SEQ ID NO: 5191517 - DNA, 14 bp, Homo sapiens
agcctctgctgcca

SEQ ID NO: 5191518 - DNA, 14 bp, Homo sapiens
agcctctgctggag

SEQ ID NO: 5191519 - DNA, 12 bp, Homo sapiens
agcctctgcttc

SEQ ID NO: 5191520 - DNA, 12 bp, Homo sapiens
agcctctggaag

SEQ ID NO: 5191521 - DNA, 13 bp, Homo sapiens
agcctctggaatg

SEQ ID NO: 5191522 - DNA, 23 bp, Homo sapiens
agcctctggacagccagtgacct

SEQ ID NO: 5191523 - DNA, 14 bp, Homo sapiens
agcctctggatcta

SEQ ID NO: 5191524 - DNA, 12 bp, Homo sapiens
agcctctggccc

SEQ ID NO: 5191525 - DNA, 17 bp, Homo sapiens
agcctctggcccctcac

SEQ ID NO: 5191526 - DNA, 13 bp, Homo sapiens
agcctctggccgt

SEQ ID NO: 5191527 - DNA, 14 bp, Homo sapiens
agcctctggctaga

SEQ ID NO: 5191528 - DNA, 13 bp, Homo sapiens
agcctctggctcc

SEQ ID NO: 5191529 - DNA, 18 bp, Homo sapiens
agcctctggctccacacc

SEQ ID NO: 5191530 - DNA, 16 bp, Homo sapiens
agcctctgggccaaga

SEQ ID NO: 5191531 - DNA, 14 bp, Homo sapiens
agcctctgggttgt

SEQ ID NO: 5191532 - DNA, 13 bp, Homo sapiens
agcctctggtcct

SEQ ID NO: 5191533 - DNA, 11 bp, Homo sapiens
agcctctgtcc

SEQ ID NO: 5191534 - DNA, 23 bp, Homo sapiens
agcctctgtccctctttgcctgt

SEQ ID NO: 5191535 - DNA, 23 bp, Homo sapiens
agcctctgtcctggctgtgcaca

SEQ ID NO: 5191536 - DNA, 17 bp, Homo sapiens
agcctctgtctggcaat

SEQ ID NO: 5191537 - DNA, 13 bp, Homo sapiens
agcctctgtcttt

SEQ ID NO: 5191538 - DNA, 14 bp, Homo sapiens
agcctctgtgtcac

SEQ ID NO: 5191539 - DNA, 15 bp, Homo sapiens
agcctctgtgtcact

SEQ ID NO: 5191540 - DNA, 20 bp, Homo sapiens
agcctctgtgtcactggctg

SEQ ID NO: 5191541 - DNA, 14 bp, Homo sapiens
agcctctgttttga

SEQ ID NO: 5191542 - DNA, 20 bp, Homo sapiens
agcctcttaccttcccgcct

SEQ ID NO: 5191543 - DNA, 17 bp, Homo sapiens
agcctcttatcactggc

SEQ ID NO: 5191544 - DNA, 14 bp, Homo sapiens
agcctcttattcca

SEQ ID NO: 5191545 - DNA, 17 bp, Homo sapiens
agcctcttatttttcta

SEQ ID NO: 5191546 - DNA, 22 bp, Homo sapiens
agcctcttcaaaaagcagagtg

SEQ ID NO: 5191547 - DNA, 16 bp, Homo sapiens
agcctcttcagcccct

SEQ ID NO: 5191548 - DNA, 21 bp, Homo sapiens
agcctcttccattccctttct

SEQ ID NO: 5191549 - DNA, 15 bp, Homo sapiens
agcctcttctctgca

SEQ ID NO: 5191550 - DNA, 13 bp, Homo sapiens
agcctcttctgaa

SEQ ID NO: 5191551 - DNA, 14 bp, Homo sapiens
agcctcttctgcca

SEQ ID NO: 5191552 - DNA, 19 bp, Homo sapiens
agcctcttctgtcccaagt

SEQ ID NO: 5191553 - DNA, 13 bp, Homo sapiens
agcctcttgcccg

SEQ ID NO: 5191554 - DNA, 14 bp, Homo sapiens
agcctcttggggaa

SEQ ID NO: 5191555 - DNA, 14 bp, Homo sapiens
agcctcttgtgtaa

SEQ ID NO: 5191556 - DNA, 16 bp, Homo sapiens
agcctcttgttcttag

SEQ ID NO: 5191557 - DNA, 22 bp, Homo sapiens
agcctcttgttcttagggcttg

SEQ ID NO: 5191558 - DNA, 22 bp, Homo sapiens
agcctctttcctaacttccttt

SEQ ID NO: 5191559 - DNA, 16 bp, Homo sapiens
agcctctttgtaataa

SEQ ID NO: 5191560 - DNA, 18 bp, Homo sapiens
agcctctttgtaataaaa

SEQ ID NO: 5191561 - DNA, 20 bp, Homo sapiens
agcctcttttcaattatttc

SEQ ID NO: 5191562 - DNA, 21 bp, Homo sapiens
agcctcttttcaattatttca

SEQ ID NO: 5191563 - DNA, 17 bp, Homo sapiens
agcctctttttccttct

SEQ ID NO: 5191564 - DNA, 18 bp, Homo sapiens
agcctctttttccttctt

SEQ ID NO: 5191565 - DNA, 14 bp, Homo sapiens
agcctgaaaattcc

SEQ ID NO: 5191566 - DNA, 22 bp, Homo sapiens
agcctgaaagaggaatgaagta

SEQ ID NO: 5191567 - DNA, 23 bp, Homo sapiens
agcctgaaagatacaggggatca

SEQ ID NO: 5191568 - DNA, 21 bp, Homo sapiens
agcctgaaagtaatttcaaga

SEQ ID NO: 5191569 - DNA, 16 bp, Homo sapiens
agcctgaacagaagct

SEQ ID NO: 5191570 - DNA, 20 bp, Homo sapiens
agcctgaacatgacatttct

SEQ ID NO: 5191571 - DNA, 16 bp, Homo sapiens
agcctgaactgaggcc

SEQ ID NO: 5191572 - DNA, 18 bp, Homo sapiens
agcctgaagagtttgtaa

SEQ ID NO: 5191573 - DNA, 22 bp, Homo sapiens
agcctgaagatcagagctgcag

SEQ ID NO: 5191574 - DNA, 16 bp, Homo sapiens
agcctgaagctggcct

SEQ ID NO: 5191575 - DNA, 19 bp, Homo sapiens
agcctgaagctggcctgga

SEQ ID NO: 5191576 - DNA, 14 bp, Homo sapiens
agcctgaagggcct

SEQ ID NO: 5191577 - DNA, 19 bp, Homo sapiens
agcctgaagggcctcccag

SEQ ID NO: 5191578 - DNA, 22 bp, Homo sapiens
agcctgaaggggcgtctgttcc

SEQ ID NO: 5191579 - DNA, 16 bp, Homo sapiens
agcctgaataaaccaa

SEQ ID NO: 5191580 - DNA, 22 bp, Homo sapiens
agcctgaatttgggatggaagc

SEQ ID NO: 5191581 - DNA, 17 bp, Homo sapiens
agcctgacaagtgaagt

SEQ ID NO: 5191582 - DNA, 14 bp, Homo sapiens
agcctgacagccag

SEQ ID NO: 5191583 - DNA, 18 bp, Homo sapiens
agcctgacagccagaact

SEQ ID NO: 5191584 - DNA, 20 bp, Homo sapiens
agcagaataaatgttttaca

SEQ ID NO: 5191585 - DNA, 13 bp, Homo sapiens
agcagaatactgg

SEQ ID NO: 5191586 - DNA, 16 bp, Homo sapiens
agcagaatactggtct

SEQ ID NO: 5191587 - DNA, 18 bp, Homo sapiens
agcagaatactggtctca

SEQ ID NO: 5191588 - DNA, 12 bp, Homo sapiens
agcagaatgaag

SEQ ID NO: 5191589 - DNA, 17 bp, Homo sapiens
agcagaatgactctgga

SEQ ID NO: 5191590 - DNA, 13 bp, Homo sapiens
agcagaatgagat

SEQ ID NO: 5191591 - DNA, 15 bp, Homo sapiens
agcagaatgagatga

SEQ ID NO: 5191592 - DNA, 22 bp, Homo sapiens
agcagaatgagatgatttaatt

SEQ ID NO: 5191593 - DNA, 20 bp, Homo sapiens
agcagaatggagaaagtaag

SEQ ID NO: 5191594 - DNA, 16 bp, Homo sapiens
agcagaatggaggcag

SEQ ID NO: 5191595 - DNA, 18 bp, Homo sapiens
agcagaatggaggcaggg

SEQ ID NO: 5191596 - DNA, 21 bp, Homo sapiens
agcagaatggtgatcactcca

SEQ ID NO: 5191597 - DNA, 13 bp, Homo sapiens
agcagaatgtgat

SEQ ID NO: 5191598 - DNA, 19 bp, Homo sapiens
agcagaatgttgtacttga

SEQ ID NO: 5191599 - DNA, 20 bp, Homo sapiens
agcagaatgttgtacttgaa

SEQ ID NO: 5191600 - DNA, 21 bp, Homo sapiens
agcagaatgttgtacttgaaa

SEQ ID NO: 5191601 - DNA, 21 bp, Homo sapiens
agcagaattgcttgaacccag

SEQ ID NO: 5191602 - DNA, 14 bp, Homo sapiens
agcagaattggaaa

SEQ ID NO: 5191603 - DNA, 13 bp, Homo sapiens
agcagaattttaa

SEQ ID NO: 5191604 - DNA, 19 bp, Homo sapiens
agcagaattttaatgtgaa

SEQ ID NO: 5191605 - DNA, 22 bp, Homo sapiens
agcagacacacatgggcagccc

SEQ ID NO: 5191606 - DNA, 12 bp, Homo sapiens
agcagacacatg

SEQ ID NO: 5191607 - DNA, 18 bp, Homo sapiens
agcagacaccattcattc

SEQ ID NO: 5191608 - DNA, 12 bp, Homo sapiens
agcagacagaaa

SEQ ID NO: 5191609 - DNA, 14 bp, Homo sapiens
agcagacagaaact

SEQ ID NO: 5191610 - DNA, 16 bp, Homo sapiens
agcagacagaaactgg

SEQ ID NO: 5191611 - DNA, 16 bp, Homo sapiens
agcagacagaagtgta

SEQ ID NO: 5191612 - DNA, 15 bp, Homo sapiens
agcagacagagccag

SEQ ID NO: 5191613 - DNA, 17 bp, Homo sapiens
agcagacagagccagga

SEQ ID NO: 5191614 - DNA, 19 bp, Homo sapiens
agcagacagagccaggaga

SEQ ID NO: 5191615 - DNA, 12 bp, Homo sapiens
agcagacaggcc

SEQ ID NO: 5191616 - DNA, 20 bp, Homo sapiens
agcagacaggcctggccctg

SEQ ID NO: 5191617 - DNA, 16 bp, Homo sapiens
agcagacatttatctt

SEQ ID NO: 5191618 - DNA, 16 bp, Homo sapiens
agcagacattttcctc

SEQ ID NO: 5191619 - DNA, 13 bp, Homo sapiens
agcagaccagcac

SEQ ID NO: 5191620 - DNA, 16 bp, Homo sapiens
agcagaccagctttga

SEQ ID NO: 5191621 - DNA, 23 bp, Homo sapiens
agcagaccattggggctcccagc

SEQ ID NO: 5191622 - DNA, 22 bp, Homo sapiens
agcagacccatacctttccagg

SEQ ID NO: 5191623 - DNA, 22 bp, Homo sapiens
agcagacgatagttatctgttc

SEQ ID NO: 5191624 - DNA, 23 bp, Homo sapiens
agcagacgcagcagctgggaccc

SEQ ID NO: 5191625 - DNA, 18 bp, Homo sapiens
agcagacgtatattgtat

SEQ ID NO: 5191626 - DNA, 20 bp, Homo sapiens
agcagactcagctctgacat

SEQ ID NO: 5191627 - DNA, 23 bp, Homo sapiens
agcagactccagcccctggaccc

SEQ ID NO: 5191628 - DNA, 14 bp, Homo sapiens
agcagactcctgct

SEQ ID NO: 5191629 - DNA, 15 bp, Homo sapiens
agcagactcctgctc

SEQ ID NO: 5191630 - DNA, 16 bp, Homo sapiens
agcagactgatcagga

SEQ ID NO: 5191631 - DNA, 14 bp, Homo sapiens
agcagactggtgag

SEQ ID NO: 5191632 - DNA, 18 bp, Homo sapiens
agcagactggtttgcagt

SEQ ID NO: 5191633 - DNA, 22 bp, Homo sapiens
agcagactgtgtttcgtgaact

SEQ ID NO: 5191634 - DNA, 22 bp, Homo sapiens
agcagacttctcggaattcata

SEQ ID NO: 5191635 - DNA, 23 bp, Homo sapiens
agcagacttctcggaattcataa

SEQ ID NO: 5191636 - DNA, 20 bp, Homo sapiens
agcagagaagcctgtctgta

SEQ ID NO: 5191637 - DNA, 16 bp, Homo sapiens
agcagagaaggccagg

SEQ ID NO: 5191638 - DNA, 22 bp, Homo sapiens
agcagagaatgaaagggcccag

SEQ ID NO: 5191639 - DNA, 14 bp, Homo sapiens
agcagagaattctc

SEQ ID NO: 5191640 - DNA, 15 bp, Homo sapiens
agcagagacactaac

SEQ ID NO: 5191641 - DNA, 22 bp, Homo sapiens
agcagagaccggacaagagcct

SEQ ID NO: 5191642 - DNA, 14 bp, Homo sapiens
agcagagacctttg

SEQ ID NO: 5191643 - DNA, 17 bp, Homo sapiens
agcagagacggcagccc

SEQ ID NO: 5191644 - DNA, 18 bp, Homo sapiens
agcagagacggcagcccc

SEQ ID NO: 5191645 - DNA, 11 bp, Homo sapiens
agcagagagag

SEQ ID NO: 5191646 - DNA, 23 bp, Homo sapiens
agcagagagagagagagagaaag

SEQ ID NO: 5191647 - DNA, 19 bp, Homo sapiens
agcagagagagaggacaga

SEQ ID NO: 5191648 - DNA, 20 bp, Homo sapiens
agcagagagcaaaggagaaa

SEQ ID NO: 5191649 - DNA, 19 bp, Homo sapiens
agcagagagcattataatc

SEQ ID NO: 5191650 - DNA, 19 bp, Homo sapiens
agcagagcaaaatgctctt

SEQ ID NO: 5191651 - DNA, 18 bp, Homo sapiens
agcagagcaaatgaggga

SEQ ID NO: 5191652 - DNA, 21 bp, Homo sapiens
agcagagcattttttatgata

SEQ ID NO: 5191653 - DNA, 11 bp, Homo sapiens
agcagagccaa

SEQ ID NO: 5191654 - DNA, 14 bp, Homo sapiens
agcagagccaaggc

SEQ ID NO: 5191655 - DNA, 15 bp, Homo sapiens
agcagagccaaggcc

SEQ ID NO: 5191656 - DNA, 13 bp, Homo sapiens
agcagagccaggg

SEQ ID NO: 5191657 - DNA, 17 bp, Homo sapiens
agcagagccagggcagg

SEQ ID NO: 5191658 - DNA, 19 bp, Homo sapiens
agcagagccagggcagggc

SEQ ID NO: 5191659 - DNA, 22 bp, Homo sapiens
agcagagcccaccagccagccc

SEQ ID NO: 5191660 - DNA, 18 bp, Homo sapiens
agcagagcccccatggcc

SEQ ID NO: 5191661 - DNA, 16 bp, Homo sapiens
agcagagccgttcctg

SEQ ID NO: 5191662 - DNA, 20 bp, Homo sapiens
agcagagccgttcctgggac

SEQ ID NO: 5191663 - DNA, 16 bp, Homo sapiens
agcagagcctcctggg

SEQ ID NO: 5191664 - DNA, 22 bp, Homo sapiens
agcagagcctcctgggaacaca

SEQ ID NO: 5191665 - DNA, 15 bp, Homo sapiens
agcagagcctggggt

SEQ ID NO: 5191666 - DNA, 15 bp, Homo sapiens
agcagagcgcagccc

SEQ ID NO: 5191667 - DNA, 21 bp, Homo sapiens
agcagagctctcccctcctgc

SEQ ID NO: 5191668 - DNA, 19 bp, Homo sapiens
agcagagctgatggagaag

SEQ ID NO: 5191669 - DNA, 21 bp, Homo sapiens
agcagagctgatggagaagga

SEQ ID NO: 5191670 - DNA, 22 bp, Homo sapiens
agcagagctgatggagaaggaa

SEQ ID NO: 5191671 - DNA, 23 bp, Homo sapiens
agcagagctgatggagaaggaag

SEQ ID NO: 5191672 - DNA, 18 bp, Homo sapiens
agcagaggaaaaagaaaa

SEQ ID NO: 5191673 - DNA, 22 bp, Homo sapiens
agcagaggaaaaagaaaaacat

SEQ ID NO: 5191674 - DNA, 21 bp, Homo sapiens
agcagaggacagtctggagaa

SEQ ID NO: 5191675 - DNA, 13 bp, Homo sapiens
agcagaggaccag

SEQ ID NO: 5191676 - DNA, 17 bp, Homo sapiens
agcagaggaccagggcc

SEQ ID NO: 5191677 - DNA, 18 bp, Homo sapiens
agcagaggaccagggcct

SEQ ID NO: 5191678 - DNA, 17 bp, Homo sapiens
agcagaggagtccaggg

SEQ ID NO: 5191679 - DNA, 22 bp, Homo sapiens
agcagaggagtccagggcggga

SEQ ID NO: 5191680 - DNA, 14 bp, Homo sapiens
agcagaggcactgg

SEQ ID NO: 5191681 - DNA, 23 bp, Homo sapiens
agcagaggcaggaccagaaggca

SEQ ID NO: 5191682 - DNA, 16 bp, Homo sapiens
agcagaggcaggctgg

SEQ ID NO: 5191683 - DNA, 17 bp, Homo sapiens
agcagaggcaggctggg

SEQ ID NO: 5191684 - DNA, 18 bp, Homo sapiens
agcagaggcagtggccac

SEQ ID NO: 5191685 - DNA, 19 bp, Homo sapiens
agcagaggcagtggccacg

SEQ ID NO: 5191686 - DNA, 22 bp, Homo sapiens
agcagaggcgtactacccagct

SEQ ID NO: 5191687 - DNA, 19 bp, Homo sapiens
agcagaggctggcctcaga

SEQ ID NO: 5191688 - DNA, 20 bp, Homo sapiens
agcagagggacaaccagaag

SEQ ID NO: 5191689 - DNA, 17 bp, Homo sapiens
agcagagggaggaagat

SEQ ID NO: 5191690 - DNA, 16 bp, Homo sapiens
agcagagggcaggggt

SEQ ID NO: 5191691 - DNA, 13 bp, Homo sapiens
agcagaggggcca

SEQ ID NO: 5191692 - DNA, 14 bp, Homo sapiens
agcagaggggccag

SEQ ID NO: 5191693 - DNA, 14 bp, Homo sapiens
agcagaggggctga

SEQ ID NO: 5191694 - DNA, 14 bp, Homo sapiens
agcagagggggagt

SEQ ID NO: 5191695 - DNA, 13 bp, Homo sapiens
agcagaggtctcc

SEQ ID NO: 5191696 - DNA, 21 bp, Homo sapiens
agcagaggtgagaactcagaa

SEQ ID NO: 5191697 - DNA, 18 bp, Homo sapiens
agcagaggtttaaatgta

SEQ ID NO: 5191698 - DNA, 20 bp, Homo sapiens
agcagaggtttgctgacagg

SEQ ID NO: 5191699 - DNA, 22 bp, Homo sapiens
agcagagtaaaattacagaaga

SEQ ID NO: 5191700 - DNA, 23 bp, Homo sapiens
agcagagtaaaattacagaagaa

SEQ ID NO: 5191701 - DNA, 16 bp, Homo sapiens
agcagagtaacaggat

SEQ ID NO: 5191702 - DNA, 22 bp, Homo sapiens
agcagagtcaagctgatgaagt

SEQ ID NO: 5191703 - DNA, 14 bp, Homo sapiens
agcagagtctgggc

SEQ ID NO: 5191704 - DNA, 15 bp, Homo sapiens
agcagagtctgggcc

SEQ ID NO: 5191705 - DNA, 16 bp, Homo sapiens
agcagagtctgggcct

SEQ ID NO: 5191706 - DNA, 17 bp, Homo sapiens
agcagagtgaggatgtg

SEQ ID NO: 5191707 - DNA, 18 bp, Homo sapiens
agcagagtgcacagctgt

SEQ ID NO: 5191708 - DNA, 14 bp, Homo sapiens
agcagagtgctggc

SEQ ID NO: 5191709 - DNA, 17 bp, Homo sapiens
agcagagtgctggcact

SEQ ID NO: 5191710 - DNA, 17 bp, Homo sapiens
agcagagtggactgcat

SEQ ID NO: 5191711 - DNA, 20 bp, Homo sapiens
agcagagtggactgcattta

SEQ ID NO: 5191712 - DNA, 16 bp, Homo sapiens
agcagagtgggacttg

SEQ ID NO: 5191713 - DNA, 15 bp, Homo sapiens
agcagagttctttgc

SEQ ID NO: 5191714 - DNA, 23 bp, Homo sapiens
agcagagttctttgcaagcttat

SEQ ID NO: 5191715 - DNA, 12 bp, Homo sapiens
agcagagtttac

SEQ ID NO: 5191716 - DNA, 13 bp, Homo sapiens
agcagagttttca

SEQ ID NO: 5191717 - DNA, 18 bp, Homo sapiens
agcagataaagacagctg

SEQ ID NO: 5191718 - DNA, 12 bp, Homo sapiens
agcagataactt

SEQ ID NO: 5191719 - DNA, 20 bp, Homo sapiens
agcagatacatatgagtgtg

SEQ ID NO: 5191720 - DNA, 15 bp, Homo sapiens
agcagatactgctgt

SEQ ID NO: 5191721 - DNA, 15 bp, Homo sapiens
agcagatactgtctt

SEQ ID NO: 5191722 - DNA, 19 bp, Homo sapiens
agcagatccacctgcacaa

SEQ ID NO: 5191723 - DNA, 16 bp, Homo sapiens
agcagatcccagctca

SEQ ID NO: 5191724 - DNA, 16 bp, Homo sapiens
agcagatctcatctca

SEQ ID NO: 5191725 - DNA, 13 bp, Homo sapiens
agcagatgcaaag

SEQ ID NO: 5191726 - DNA, 21 bp, Homo sapiens
agcagatgcagagagccattt

SEQ ID NO: 5191727 - DNA, 17 bp, Homo sapiens
agcagatgccagtgaag

SEQ ID NO: 5191728 - DNA, 19 bp, Homo sapiens
agcagatggagaccccttg

SEQ ID NO: 5191729 - DNA, 19 bp, Homo sapiens
agcagatggtttccacatt

SEQ ID NO: 5191730 - DNA, 13 bp, Homo sapiens
agcagatgtttaa

SEQ ID NO: 5191731 - DNA, 15 bp, Homo sapiens
agcagattccacagg

SEQ ID NO: 5191732 - DNA, 16 bp, Homo sapiens
agcagattccacagga

SEQ ID NO: 5191733 - DNA, 14 bp, Homo sapiens
agcagattggaagg

SEQ ID NO: 5191734 - DNA, 15 bp, Homo sapiens
agcagattggaagga

SEQ ID NO: 5191735 - DNA, 19 bp, Homo sapiens
agcagattggaaggagaca

SEQ ID NO: 5191736 - DNA, 21 bp, Homo sapiens
agcagattggaaggagacaca

SEQ ID NO: 5191737 - DNA, 23 bp, Homo sapiens
agcagattggaaggagacacaga

SEQ ID NO: 5191738 - DNA, 20 bp, Homo sapiens
agcagattggagaaaccctt

SEQ ID NO: 5191739 - DNA, 13 bp, Homo sapiens
agcagattttaat

SEQ ID NO: 5191740 - DNA, 21 bp, Homo sapiens
agcagattttaattttgaata

SEQ ID NO: 5191741 - DNA, 17 bp, Homo sapiens
agcagattttaggaaat

SEQ ID NO: 5191742 - DNA, 20 bp, Homo sapiens
agcagattttaggaaatgaa

SEQ ID NO: 5191743 - DNA, 14 bp, Homo sapiens
agcagattttccta

SEQ ID NO: 5191744 - DNA, 15 bp, Homo sapiens
agcagcaaaaccaaa

SEQ ID NO: 5191745 - DNA, 20 bp, Homo sapiens
agcagcaaaaccaaactggg

SEQ ID NO: 5191746 - DNA, 16 bp, Homo sapiens
agcagcaaaatcctta

SEQ ID NO: 5191747 - DNA, 19 bp, Homo sapiens
agcagcaaataaacaacta

SEQ ID NO: 5191748 - DNA, 18 bp, Homo sapiens
agcagcaaatagcaaatg

SEQ ID NO: 5191749 - DNA, 16 bp, Homo sapiens
agcagcaactgaagac

SEQ ID NO: 5191750 - DNA, 17 bp, Homo sapiens
agcagcaacttgtccta

SEQ ID NO: 5191751 - DNA, 16 bp, Homo sapiens
agcagcaagaaaaaaa

SEQ ID NO: 5191752 - DNA, 21 bp, Homo sapiens
agcagcaagaaaaaaaaatgc

SEQ ID NO: 5191753 - DNA, 23 bp, Homo sapiens
agcagcaagaaaaaaaaatgcca

SEQ ID NO: 5191754 - DNA, 14 bp, Homo sapiens
agcagcaaggtggg

SEQ ID NO: 5191755 - DNA, 16 bp, Homo sapiens
agcagcaatattttgt

SEQ ID NO: 5191756 - DNA, 15 bp, Homo sapiens
agcagcacaaggaat

SEQ ID NO: 5191757 - DNA, 12 bp, Homo sapiens
agcagcacaatt

SEQ ID NO: 5191758 - DNA, 15 bp, Homo sapiens
agcagcacacctcag

SEQ ID NO: 5191759 - DNA, 20 bp, Homo sapiens
agcagcacacctcagcccca

SEQ ID NO: 5191760 - DNA, 20 bp, Homo sapiens
agcagcacatggtgttgtat

SEQ ID NO: 5191761 - DNA, 14 bp, Homo sapiens
agcagcacccaccc

SEQ ID NO: 5191762 - DNA, 22 bp, Homo sapiens
agcctgacatcaaaaaaggcag

SEQ ID NO: 5191763 - DNA, 24 bp, Homo sapiens
agcctgaccaaaagtgagatggga

SEQ ID NO: 5191764 - DNA, 18 bp, Homo sapiens
agcctgaccccaggcagc

SEQ ID NO: 5191765 - DNA, 18 bp, Homo sapiens
agcctgaccctcatcttt

SEQ ID NO: 5191766 - DNA, 19 bp, Homo sapiens
agcctgaccctcatctttc

SEQ ID NO: 5191767 - DNA, 14 bp, Homo sapiens
agcctgacctgaga

SEQ ID NO: 5191768 - DNA, 15 bp, Homo sapiens
agcctgacctgagac

SEQ ID NO: 5191769 - DNA, 16 bp, Homo sapiens
agcctgacctgagagt

SEQ ID NO: 5191770 - DNA, 21 bp, Homo sapiens
agcctgaccttccttcctgtt

SEQ ID NO: 5191771 - DNA, 21 bp, Homo sapiens
agcctgacgctcagccccagg

SEQ ID NO: 5191772 - DNA, 23 bp, Homo sapiens
agcctgacgctcagccccaggcc

SEQ ID NO: 5191773 - DNA, 11 bp, Homo sapiens
agcctgactgt

SEQ ID NO: 5191774 - DNA, 18 bp, Homo sapiens
agcctgactttctctcca

SEQ ID NO: 5191775 - DNA, 20 bp, Homo sapiens
agcctgactttggggacacc

SEQ ID NO: 5191776 - DNA, 16 bp, Homo sapiens
agcctgagactggaaa

SEQ ID NO: 5191777 - DNA, 12 bp, Homo sapiens
agcctgagagag

SEQ ID NO: 5191778 - DNA, 17 bp, Homo sapiens
agcctgagagctggccc

SEQ ID NO: 5191779 - DNA, 17 bp, Homo sapiens
agcctgagcaggcaggg

SEQ ID NO: 5191780 - DNA, 15 bp, Homo sapiens
agcctgagcagggcg

SEQ ID NO: 5191781 - DNA, 19 bp, Homo sapiens
agcctgagccacagtgggg

SEQ ID NO: 5191782 - DNA, 15 bp, Homo sapiens
agcctgagccttaga

SEQ ID NO: 5191783 - DNA, 22 bp, Homo sapiens
agcctgagccttagctcccagc

SEQ ID NO: 5191784 - DNA, 19 bp, Homo sapiens
agcctgagcgacagtgaga

SEQ ID NO: 5191785 - DNA, 12 bp, Homo sapiens
agcctgagctcc

SEQ ID NO: 5191786 - DNA, 13 bp, Homo sapiens
agcctgagctcca

SEQ ID NO: 5191787 - DNA, 15 bp, Homo sapiens
agcctgaggacagaa

SEQ ID NO: 5191788 - DNA, 23 bp, Homo sapiens
agcctgaggacagaaagaccctg

SEQ ID NO: 5191789 - DNA, 15 bp, Homo sapiens
agcctgaggcaggag

SEQ ID NO: 5191790 - DNA, 17 bp, Homo sapiens
agcctgaggctgagact

SEQ ID NO: 5191791 - DNA, 20 bp, Homo sapiens
agcctgagggaaaggccagc

SEQ ID NO: 5191792 - DNA, 15 bp, Homo sapiens
agcctgaggtcccct

SEQ ID NO: 5191793 - DNA, 17 bp, Homo sapiens
agcctgaggtgcccact

SEQ ID NO: 5191794 - DNA, 20 bp, Homo sapiens
agcctgaggtgcccactccg

SEQ ID NO: 5191795 - DNA, 23 bp, Homo sapiens
agcctgaggtgcccactccgcca

SEQ ID NO: 5191796 - DNA, 13 bp, Homo sapiens
agcctgagtagaa

SEQ ID NO: 5191797 - DNA, 17 bp, Homo sapiens
agcctgagtagaaaggc

SEQ ID NO: 5191798 - DNA, 22 bp, Homo sapiens
agcctgagtagaaaggccttta

SEQ ID NO: 5191799 - DNA, 18 bp, Homo sapiens
agcctgagtcagggccca

SEQ ID NO: 5191800 - DNA, 21 bp, Homo sapiens
agcctgagtcagggcccagag

SEQ ID NO: 5191801 - DNA, 15 bp, Homo sapiens
agcctgagtctcctg

SEQ ID NO: 5191802 - DNA, 13 bp, Homo sapiens
agcctgagtgaca

SEQ ID NO: 5191803 - DNA, 13 bp, Homo sapiens
agcctgagtggtg

SEQ ID NO: 5191804 - DNA, 23 bp, Homo sapiens
agcctgatactttagccatcata

SEQ ID NO: 5191805 - DNA, 18 bp, Homo sapiens
agcctgatcaggcttcct

SEQ ID NO: 5191806 - DNA, 20 bp, Homo sapiens
agcctgatcaggcttcctgg

SEQ ID NO: 5191807 - DNA, 14 bp, Homo sapiens
agcctgatccagcc

SEQ ID NO: 5191808 - DNA, 13 bp, Homo sapiens
agcctgatctctt

SEQ ID NO: 5191809 - DNA, 16 bp, Homo sapiens
agcctgatctcttcct

SEQ ID NO: 5191810 - DNA, 18 bp, Homo sapiens
agcctgatctttctagag

SEQ ID NO: 5191811 - DNA, 23 bp, Homo sapiens
agcctgatctttctagagccagc

SEQ ID NO: 5191812 - DNA, 20 bp, Homo sapiens
agcctgatctttgggcatca

SEQ ID NO: 5191813 - DNA, 18 bp, Homo sapiens
agcctgatgagattttta

SEQ ID NO: 5191814 - DNA, 19 bp, Homo sapiens
agcctgatgagatttttaa

SEQ ID NO: 5191815 - DNA, 15 bp, Homo sapiens
agcctgatggccaag

SEQ ID NO: 5191816 - DNA, 23 bp, Homo sapiens
agcctgatggccaagggggtgga

SEQ ID NO: 5191817 - DNA, 17 bp, Homo sapiens
agcctgcaaactcactg

SEQ ID NO: 5191818 - DNA, 22 bp, Homo sapiens
agcctgcacccctccggccccg

SEQ ID NO: 5191819 - DNA, 17 bp, Homo sapiens
agcctgcaccgccgcca

SEQ ID NO: 5191820 - DNA, 14 bp, Homo sapiens
agcctgcacctgcc

SEQ ID NO: 5191821 - DNA, 16 bp, Homo sapiens
agcctgcacggtgaat

SEQ ID NO: 5191822 - DNA, 20 bp, Homo sapiens
agcctgcacttgggggctca

SEQ ID NO: 5191823 - DNA, 14 bp, Homo sapiens
agcctgcagcagga

SEQ ID NO: 5191824 - DNA, 22 bp, Homo sapiens
agcctgcagcgagctgagatca

SEQ ID NO: 5191825 - DNA, 14 bp, Homo sapiens
agcctgcaggatct

SEQ ID NO: 5191826 - DNA, 22 bp, Homo sapiens
agcctgcaggatctcaccaggc

SEQ ID NO: 5191827 - DNA, 13 bp, Homo sapiens
agcctgcaggcag

SEQ ID NO: 5191828 - DNA, 18 bp, Homo sapiens
agcctgcagggtggtgct

SEQ ID NO: 5191829 - DNA, 19 bp, Homo sapiens
agcctgcagggtggtgctg

SEQ ID NO: 5191830 - DNA, 22 bp, Homo sapiens
agcctgcagggtggtgctggga

SEQ ID NO: 5191831 - DNA, 21 bp, Homo sapiens
agcctgcaggtccggggagga

SEQ ID NO: 5191832 - DNA, 13 bp, Homo sapiens
agcctgcatctgt

SEQ ID NO: 5191833 - DNA, 23 bp, Homo sapiens
agcctgccaaagtgcctgggaag

SEQ ID NO: 5191834 - DNA, 19 bp, Homo sapiens
agcctgccaggccctccag

SEQ ID NO: 5191835 - DNA, 23 bp, Homo sapiens
agcctgcccagccccctggtctt

SEQ ID NO: 5191836 - DNA, 22 bp, Homo sapiens
agcctgcccagttggaggagac

SEQ ID NO: 5191837 - DNA, 19 bp, Homo sapiens
agcctgccccagcgctgac

SEQ ID NO: 5191838 - DNA, 19 bp, Homo sapiens
agcctgccccagctgggct

SEQ ID NO: 5191839 - DNA, 20 bp, Homo sapiens
agcctgccccctatcttgtc

SEQ ID NO: 5191840 - DNA, 22 bp, Homo sapiens
agcctgccccctatcttgtcct

SEQ ID NO: 5191841 - DNA, 18 bp, Homo sapiens
agcctgccccggccactc

SEQ ID NO: 5191842 - DNA, 20 bp, Homo sapiens
agcctgccctcactccctct

SEQ ID NO: 5191843 - DNA, 22 bp, Homo sapiens
agcctgccctcactccctctgc

SEQ ID NO: 5191844 - DNA, 23 bp, Homo sapiens
agcctgccctcactccctctgca

SEQ ID NO: 5191845 - DNA, 15 bp, Homo sapiens
agcctgccgcccccg

SEQ ID NO: 5191846 - DNA, 16 bp, Homo sapiens
agcctgccgcccccgc

SEQ ID NO: 5191847 - DNA, 23 bp, Homo sapiens
agcctgccgcccccgcctgggca

SEQ ID NO: 5191848 - DNA, 23 bp, Homo sapiens
agcctgccgccgtctctgtcccg

SEQ ID NO: 5191849 - DNA, 21 bp, Homo sapiens
agcctgcctaaccaggcccag

SEQ ID NO: 5191850 - DNA, 12 bp, Homo sapiens
agcctgcctcac

SEQ ID NO: 5191851 - DNA, 14 bp, Homo sapiens
agcctgcctcaccc

SEQ ID NO: 5191852 - DNA, 17 bp, Homo sapiens
agcctgcctcacccaca

SEQ ID NO: 5191853 - DNA, 18 bp, Homo sapiens
agcctgcctcagtggcag

SEQ ID NO: 5191854 - DNA, 15 bp, Homo sapiens
agcctgcctcccaag

SEQ ID NO: 5191855 - DNA, 21 bp, Homo sapiens
agcctgcctccttcagtgaca

SEQ ID NO: 5191856 - DNA, 14 bp, Homo sapiens
agcctgcctctgcc

SEQ ID NO: 5191857 - DNA, 15 bp, Homo sapiens
agcctgcctctgcca

SEQ ID NO: 5191858 - DNA, 16 bp, Homo sapiens
agcctgcctctgccac

SEQ ID NO: 5191859 - DNA, 15 bp, Homo sapiens
agcctgcctgaagag

SEQ ID NO: 5191860 - DNA, 17 bp, Homo sapiens
agcctgcctgaagagag

SEQ ID NO: 5191861 - DNA, 18 bp, Homo sapiens
agcctgcctgaagagagg

SEQ ID NO: 5191862 - DNA, 21 bp, Homo sapiens
agcctgcctgaagagaggaaa

SEQ ID NO: 5191863 - DNA, 16 bp, Homo sapiens
agcctgcctgggagag

SEQ ID NO: 5191864 - DNA, 23 bp, Homo sapiens
agcctgccttgcccactcctgct

SEQ ID NO: 5191865 - DNA, 23 bp, Homo sapiens
agcctgcgctcggcaggaaggag

SEQ ID NO: 5191866 - DNA, 17 bp, Homo sapiens
agcctgcggcgccagcc

SEQ ID NO: 5191867 - DNA, 19 bp, Homo sapiens
agcctgcggcgccagcctc

SEQ ID NO: 5191868 - DNA, 16 bp, Homo sapiens
agcctgcggctgctgg

SEQ ID NO: 5191869 - DNA, 18 bp, Homo sapiens
agcctgcgtcatggctca

SEQ ID NO: 5191870 - DNA, 12 bp, Homo sapiens
agcctgctaagg

SEQ ID NO: 5191871 - DNA, 13 bp, Homo sapiens
agcctgctaagga

SEQ ID NO: 5191872 - DNA, 18 bp, Homo sapiens
agcctgctaaggaacaat

SEQ ID NO: 5191873 - DNA, 20 bp, Homo sapiens
agcctgctaaggaacaatgc

SEQ ID NO: 5191874 - DNA, 12 bp, Homo sapiens
agcctgctagct

SEQ ID NO: 5191875 - DNA, 10 bp, Homo sapiens
agcctgctca

SEQ ID NO: 5191876 - DNA, 15 bp, Homo sapiens
agcctgctccagctg

SEQ ID NO: 5191877 - DNA, 22 bp, Homo sapiens
agcctgctccagctgttcagct

SEQ ID NO: 5191878 - DNA, 14 bp, Homo sapiens
agcctgctccccca

SEQ ID NO: 5191879 - DNA, 15 bp, Homo sapiens
agcctgctcccccac

SEQ ID NO: 5191880 - DNA, 22 bp, Homo sapiens
agcctgctccttcccaggagtg

SEQ ID NO: 5191881 - DNA, 16 bp, Homo sapiens
agcctgctccttccct

SEQ ID NO: 5191882 - DNA, 17 bp, Homo sapiens
agcctgctccttccctt

SEQ ID NO: 5191883 - DNA, 13 bp, Homo sapiens
agcctgctctccc

SEQ ID NO: 5191884 - DNA, 17 bp, Homo sapiens
agcctgctctgccactg

SEQ ID NO: 5191885 - DNA, 13 bp, Homo sapiens
agcctgctctgga

SEQ ID NO: 5191886 - DNA, 11 bp, Homo sapiens
agcctgctgac

SEQ ID NO: 5191887 - DNA, 16 bp, Homo sapiens
agcctgctgagagccc

SEQ ID NO: 5191888 - DNA, 19 bp, Homo sapiens
agcctgctgagagccccca

SEQ ID NO: 5191889 - DNA, 17 bp, Homo sapiens
agcctgctgcccaggct

SEQ ID NO: 5191890 - DNA, 20 bp, Homo sapiens
agcctgctgcccaggctgtg

SEQ ID NO: 5191891 - DNA, 11 bp, Homo sapiens
agcctgctgga

SEQ ID NO: 5191892 - DNA, 16 bp, Homo sapiens
agcctgctggcagggc

SEQ ID NO: 5191893 - DNA, 21 bp, Homo sapiens
agcctgctggcagggccaggg

SEQ ID NO: 5191894 - DNA, 20 bp, Homo sapiens
agcctgctggtcacagcctc

SEQ ID NO: 5191895 - DNA, 21 bp, Homo sapiens
agcctgctgtgtccttcctcc

SEQ ID NO: 5191896 - DNA, 13 bp, Homo sapiens
agcctgcttccca

SEQ ID NO: 5191897 - DNA, 23 bp, Homo sapiens
agcctgcttcccacctccctgcc

SEQ ID NO: 5191898 - DNA, 18 bp, Homo sapiens
agcctgctttcctgcagc

SEQ ID NO: 5191899 - DNA, 20 bp, Homo sapiens
agcctgctttggcctttcct

SEQ ID NO: 5191900 - DNA, 14 bp, Homo sapiens
agcctgctttttaa

SEQ ID NO: 5191901 - DNA, 18 bp, Homo sapiens
agcctggaaacctgtctg

SEQ ID NO: 5191902 - DNA, 20 bp, Homo sapiens
agcctggaacatcatcaagg

SEQ ID NO: 5191903 - DNA, 21 bp, Homo sapiens
agcctggaacatcatcaaggc

SEQ ID NO: 5191904 - DNA, 11 bp, Homo sapiens
agcctggaagc

SEQ ID NO: 5191905 - DNA, 13 bp, Homo sapiens
agcctggaagcac

SEQ ID NO: 5191906 - DNA, 13 bp, Homo sapiens
agcctggaagcca

SEQ ID NO: 5191907 - DNA, 20 bp, Homo sapiens
agcctggaagggaagtgaga

SEQ ID NO: 5191908 - DNA, 18 bp, Homo sapiens
agcctggacacagtcagg

SEQ ID NO: 5191909 - DNA, 15 bp, Homo sapiens
agcctggacccccag

SEQ ID NO: 5191910 - DNA, 16 bp, Homo sapiens
agcctggacccccagc

SEQ ID NO: 5191911 - DNA, 18 bp, Homo sapiens
agcctggacccccagctt

SEQ ID NO: 5191912 - DNA, 17 bp, Homo sapiens
agcctggacctctgaca

SEQ ID NO: 5191913 - DNA, 21 bp, Homo sapiens
agcctggacctctgacagcag

SEQ ID NO: 5191914 - DNA, 22 bp, Homo sapiens
agcctggacctctgacagcagc

SEQ ID NO: 5191915 - DNA, 16 bp, Homo sapiens
agcctggacctgggtt

SEQ ID NO: 5191916 - DNA, 18 bp, Homo sapiens
agcctggacctgggttat

SEQ ID NO: 5191917 - DNA, 17 bp, Homo sapiens
agcctggacgcagccac

SEQ ID NO: 5191918 - DNA, 22 bp, Homo sapiens
agcctggactctaagctggagc

SEQ ID NO: 5191919 - DNA, 13 bp, Homo sapiens
agcctggactctg

SEQ ID NO: 5191920 - DNA, 17 bp, Homo sapiens
agcctggactctgcccc

SEQ ID NO: 5191921 - DNA, 18 bp, Homo sapiens
agcctggactgtttcata

SEQ ID NO: 5191922 - DNA, 11 bp, Homo sapiens
agcctggagaa

SEQ ID NO: 5191923 - DNA, 15 bp, Homo sapiens
agcctggagaggcct

SEQ ID NO: 5191924 - DNA, 11 bp, Homo sapiens
agcctggagcc

SEQ ID NO: 5191925 - DNA, 18 bp, Homo sapiens
agcctggagcccctgtgt

SEQ ID NO: 5191926 - DNA, 22 bp, Homo sapiens
agcctggagcccctgtgtggga

SEQ ID NO: 5191927 - DNA, 13 bp, Homo sapiens
agcctggagccgt

SEQ ID NO: 5191928 - DNA, 20 bp, Homo sapiens
agcctggagcggagcttgcc

SEQ ID NO: 5191929 - DNA, 19 bp, Homo sapiens
agcctggagggaagttggg

SEQ ID NO: 5191930 - DNA, 17 bp, Homo sapiens
agcctggagggatgcca

SEQ ID NO: 5191931 - DNA, 18 bp, Homo sapiens
agcctggagtaggcctgg

SEQ ID NO: 5191932 - DNA, 19 bp, Homo sapiens
agcctggagtaggcctggg

SEQ ID NO: 5191933 - DNA, 17 bp, Homo sapiens
agcctggatagccttga

SEQ ID NO: 5191934 - DNA, 16 bp, Homo sapiens
agcctggatggcccct

SEQ ID NO: 5191935 - DNA, 20 bp, Homo sapiens
agcctggatgtgggccaagt

SEQ ID NO: 5191936 - DNA, 16 bp, Homo sapiens
agcctggattccagca

SEQ ID NO: 5191937 - DNA, 19 bp, Homo sapiens
agcctggcaacagagcgag

SEQ ID NO: 5191938 - DNA, 12 bp, Homo sapiens
agcctggcaagg

SEQ ID NO: 5191939 - DNA, 21 bp, Homo sapiens
agcctggcaatttagcaaact

SEQ ID NO: 5191940 - DNA, 20 bp, Homo sapiens
agcagcaccgttctgtgcac

SEQ ID NO: 5191941 - DNA, 20 bp, Homo sapiens
agcagcacctcctcagcctg

SEQ ID NO: 5191942 - DNA, 14 bp, Homo sapiens
agcagcacctgccc

SEQ ID NO: 5191943 - DNA, 22 bp, Homo sapiens
agcagcacctgccctacctgcc

SEQ ID NO: 5191944 - DNA, 20 bp, Homo sapiens
agcagcacgattttgcacaa

SEQ ID NO: 5191945 - DNA, 22 bp, Homo sapiens
agcagcacgcatgtccctccaa

SEQ ID NO: 5191946 - DNA, 20 bp, Homo sapiens
agcagcacgccaaccccagc

SEQ ID NO: 5191947 - DNA, 24 bp, Homo sapiens
agcagcacgccaaccccagcagtc

SEQ ID NO: 5191948 - DNA, 22 bp, Homo sapiens
agcagcacgtcgccatccgtca

SEQ ID NO: 5191949 - DNA, 14 bp, Homo sapiens
agcagcacttataa

SEQ ID NO: 5191950 - DNA, 16 bp, Homo sapiens
agcagcagagaaccat

SEQ ID NO: 5191951 - DNA, 17 bp, Homo sapiens
agcagcagaggtgagaa

SEQ ID NO: 5191952 - DNA, 13 bp, Homo sapiens
agcagcagcagca

SEQ ID NO: 5191953 - DNA, 16 bp, Homo sapiens
agcagcagcagcagca

SEQ ID NO: 5191954 - DNA, 16 bp, Homo sapiens
agcagcagcaggtgat

SEQ ID NO: 5191955 - DNA, 18 bp, Homo sapiens
agcagcagccactgcaca

SEQ ID NO: 5191956 - DNA, 15 bp, Homo sapiens
agcagcagccagcac

SEQ ID NO: 5191957 - DNA, 15 bp, Homo sapiens
agcagcagcctactg

SEQ ID NO: 5191958 - DNA, 16 bp, Homo sapiens
agcagcagcctgcacc

SEQ ID NO: 5191959 - DNA, 17 bp, Homo sapiens
agcagcagcctgcacct

SEQ ID NO: 5191960 - DNA, 12 bp, Homo sapiens
agcagcagctca

SEQ ID NO: 5191961 - DNA, 20 bp, Homo sapiens
agcagcagctctgagccaga

SEQ ID NO: 5191962 - DNA, 23 bp, Homo sapiens
agcagcagctctgagccagatta

SEQ ID NO: 5191963 - DNA, 14 bp, Homo sapiens
agcagcaggaaggc

SEQ ID NO: 5191964 - DNA, 18 bp, Homo sapiens
agcagcaggaggggggag

SEQ ID NO: 5191965 - DNA, 21 bp, Homo sapiens
agcagcaggatgggctgagct

SEQ ID NO: 5191966 - DNA, 18 bp, Homo sapiens
agcagcaggcctctggga

SEQ ID NO: 5191967 - DNA, 20 bp, Homo sapiens
agcagcaggtagcctgctgg

SEQ ID NO: 5191968 - DNA, 15 bp, Homo sapiens
agcagcaggtctaga

SEQ ID NO: 5191969 - DNA, 13 bp, Homo sapiens
agcagcaggtgat

SEQ ID NO: 5191970 - DNA, 21 bp, Homo sapiens
agcagcaggtgctgtgcgcct

SEQ ID NO: 5191971 - DNA, 15 bp, Homo sapiens
agcagcagtttgtga

SEQ ID NO: 5191972 - DNA, 20 bp, Homo sapiens
agcagcagtttgtgatctgt

SEQ ID NO: 5191973 - DNA, 20 bp, Homo sapiens
agcagcatagaacaggacct

SEQ ID NO: 5191974 - DNA, 14 bp, Homo sapiens
agcagcatcattca

SEQ ID NO: 5191975 - DNA, 13 bp, Homo sapiens
agcagcatcccag

SEQ ID NO: 5191976 - DNA, 15 bp, Homo sapiens
agcagcatcccagcc

SEQ ID NO: 5191977 - DNA, 18 bp, Homo sapiens
agcagcatcccagccttg

SEQ ID NO: 5191978 - DNA, 19 bp, Homo sapiens
agcagcatcccagccttga

SEQ ID NO: 5191979 - DNA, 19 bp, Homo sapiens
agcagcatctctaccttct

SEQ ID NO: 5191980 - DNA, 18 bp, Homo sapiens
agcagcatctgctaataa

SEQ ID NO: 5191981 - DNA, 14 bp, Homo sapiens
agcagcatcttctg

SEQ ID NO: 5191982 - DNA, 16 bp, Homo sapiens
agcagcattcagcaca

SEQ ID NO: 5191983 - DNA, 18 bp, Homo sapiens
agcagcattcagcacacc

SEQ ID NO: 5191984 - DNA, 19 bp, Homo sapiens
agcagcattcagcacaccc

SEQ ID NO: 5191985 - DNA, 21 bp, Homo sapiens
agcagcattcagcacacccca

SEQ ID NO: 5191986 - DNA, 22 bp, Homo sapiens
agcagcattctggaggggagag

SEQ ID NO: 5191987 - DNA, 21 bp, Homo sapiens
agcagcatttttaattttcac

SEQ ID NO: 5191988 - DNA, 14 bp, Homo sapiens
agcagcatttttat

SEQ ID NO: 5191989 - DNA, 22 bp, Homo sapiens
agcagccaagctccttgggagg

SEQ ID NO: 5191990 - DNA, 20 bp, Homo sapiens
agcagccaagggatgaaaga

SEQ ID NO: 5191991 - DNA, 18 bp, Homo sapiens
agcagccacacttccttt

SEQ ID NO: 5191992 - DNA, 15 bp, Homo sapiens
agcagccacattcct

SEQ ID NO: 5191993 - DNA, 20 bp, Homo sapiens
agcagccaccccatgctggc

SEQ ID NO: 5191994 - DNA, 21 bp, Homo sapiens
agcagccactgcacaggagga

SEQ ID NO: 5191995 - DNA, 19 bp, Homo sapiens
agcagccagagctgtgcct

SEQ ID NO: 5191996 - DNA, 13 bp, Homo sapiens
agcagccagcacc

SEQ ID NO: 5191997 - DNA, 15 bp, Homo sapiens
agcagccagccagtc

SEQ ID NO: 5191998 - DNA, 15 bp, Homo sapiens
agcagccagccctgc

SEQ ID NO: 5191999 - DNA, 16 bp, Homo sapiens
agcagccagccctgcc

SEQ ID NO: 5192000 - DNA, 19 bp, Homo sapiens
agcagccagccctgcctgg

SEQ ID NO: 5192001 - DNA, 20 bp, Homo sapiens
agcagccagccctgcctgga

SEQ ID NO: 5192002 - DNA, 23 bp, Homo sapiens
agcagccagccctgcctggagga

SEQ ID NO: 5192003 - DNA, 16 bp, Homo sapiens
agcagccagctcctgg

SEQ ID NO: 5192004 - DNA, 15 bp, Homo sapiens
agcagccagctctca

SEQ ID NO: 5192005 - DNA, 16 bp, Homo sapiens
agcagccagctctcag

SEQ ID NO: 5192006 - DNA, 12 bp, Homo sapiens
agcagccaggac

SEQ ID NO: 5192007 - DNA, 14 bp, Homo sapiens
agcagccaggaccc

SEQ ID NO: 5192008 - DNA, 21 bp, Homo sapiens
agcagccaggacccgcctgct

SEQ ID NO: 5192009 - DNA, 14 bp, Homo sapiens
agcagccaggagag

SEQ ID NO: 5192010 - DNA, 14 bp, Homo sapiens
agcagccaggaggg

SEQ ID NO: 5192011 - DNA, 15 bp, Homo sapiens
agcagccaggaggga

SEQ ID NO: 5192012 - DNA, 19 bp, Homo sapiens
agcagccatcataggaagg

SEQ ID NO: 5192013 - DNA, 12 bp, Homo sapiens
agcagcccaaat

SEQ ID NO: 5192014 - DNA, 13 bp, Homo sapiens
agcagcccaagct

SEQ ID NO: 5192015 - DNA, 19 bp, Homo sapiens
agcagcccaagcttccctc

SEQ ID NO: 5192016 - DNA, 12 bp, Homo sapiens
agcagcccaccc

SEQ ID NO: 5192017 - DNA, 16 bp, Homo sapiens
agcagcccaccctgct

SEQ ID NO: 5192018 - DNA, 15 bp, Homo sapiens
agcagcccacctgct

SEQ ID NO: 5192019 - DNA, 12 bp, Homo sapiens
agcagcccagca

SEQ ID NO: 5192020 - DNA, 11 bp, Homo sapiens
agcagcccagg

SEQ ID NO: 5192021 - DNA, 15 bp, Homo sapiens
agcagccccaggaga

SEQ ID NO: 5192022 - DNA, 22 bp, Homo sapiens
agcagcccccaaagagctgtgg

SEQ ID NO: 5192023 - DNA, 19 bp, Homo sapiens
agcagcccccgggccgctg

SEQ ID NO: 5192024 - DNA, 19 bp, Homo sapiens
agcagccccgtctgcccac

SEQ ID NO: 5192025 - DNA, 13 bp, Homo sapiens
agcagcccctccc

SEQ ID NO: 5192026 - DNA, 17 bp, Homo sapiens
agcagcccctcgaggcc

SEQ ID NO: 5192027 - DNA, 18 bp, Homo sapiens
agcagcccctcgaggcct

SEQ ID NO: 5192028 - DNA, 14 bp, Homo sapiens
agcagcccctgaga

SEQ ID NO: 5192029 - DNA, 21 bp, Homo sapiens
agcagcccgctgagtggactg

SEQ ID NO: 5192030 - DNA, 14 bp, Homo sapiens
agcagccctaagga

SEQ ID NO: 5192031 - DNA, 17 bp, Homo sapiens
agcagccctagcggctg

SEQ ID NO: 5192032 - DNA, 19 bp, Homo sapiens
agcagccctagcggctgct

SEQ ID NO: 5192033 - DNA, 17 bp, Homo sapiens
agcagccctcaacaggc

SEQ ID NO: 5192034 - DNA, 12 bp, Homo sapiens
agcagccctcct

SEQ ID NO: 5192035 - DNA, 12 bp, Homo sapiens
agcagccctctg

SEQ ID NO: 5192036 - DNA, 14 bp, Homo sapiens
agcagccctgcccc

SEQ ID NO: 5192037 - DNA, 11 bp, Homo sapiens
agcagccctgg

SEQ ID NO: 5192038 - DNA, 16 bp, Homo sapiens
agcagccctggagtca

SEQ ID NO: 5192039 - DNA, 19 bp, Homo sapiens
agcagccctggagtcatgc

SEQ ID NO: 5192040 - DNA, 12 bp, Homo sapiens
agcagcccttgc

SEQ ID NO: 5192041 - DNA, 13 bp, Homo sapiens
agcagcccttgct

SEQ ID NO: 5192042 - DNA, 12 bp, Homo sapiens
agcagcccttgt

SEQ ID NO: 5192043 - DNA, 20 bp, Homo sapiens
agcagccgccttaagctgat

SEQ ID NO: 5192044 - DNA, 21 bp, Homo sapiens
agcagccggaatagagcctcg

SEQ ID NO: 5192045 - DNA, 18 bp, Homo sapiens
agcagccgtttctccttg

SEQ ID NO: 5192046 - DNA, 16 bp, Homo sapiens
agcagcctccaagaaa

SEQ ID NO: 5192047 - DNA, 17 bp, Homo sapiens
agcagcctccactgtgt

SEQ ID NO: 5192048 - DNA, 21 bp, Homo sapiens
agcagcctccagtgctggctg

SEQ ID NO: 5192049 - DNA, 14 bp, Homo sapiens
agcagcctccctgt

SEQ ID NO: 5192050 - DNA, 24 bp, Homo sapiens
agcagcctccctgtcactcagctg

SEQ ID NO: 5192051 - DNA, 17 bp, Homo sapiens
agcagcctcgcccctgg

SEQ ID NO: 5192052 - DNA, 23 bp, Homo sapiens
agcagcctcgcccctggcagaga

SEQ ID NO: 5192053 - DNA, 13 bp, Homo sapiens
agcagcctcgtgg

SEQ ID NO: 5192054 - DNA, 24 bp, Homo sapiens
agcagcctcgtggagctcgcccct

SEQ ID NO: 5192055 - DNA, 14 bp, Homo sapiens
agcagcctctgaag

SEQ ID NO: 5192056 - DNA, 19 bp, Homo sapiens
agcagcctctgatctgtgc

SEQ ID NO: 5192057 - DNA, 14 bp, Homo sapiens
agcagcctctgcca

SEQ ID NO: 5192058 - DNA, 16 bp, Homo sapiens
agcagcctctgccagg

SEQ ID NO: 5192059 - DNA, 13 bp, Homo sapiens
agcagcctctgga

SEQ ID NO: 5192060 - DNA, 14 bp, Homo sapiens
agcagcctctggac

SEQ ID NO: 5192061 - DNA, 22 bp, Homo sapiens
agcagcctctggacagccagtg

SEQ ID NO: 5192062 - DNA, 20 bp, Homo sapiens
agcagcctgcacctgccccg

SEQ ID NO: 5192063 - DNA, 13 bp, Homo sapiens
agcagcctgccag

SEQ ID NO: 5192064 - DNA, 15 bp, Homo sapiens
agcagcctgccagca

SEQ ID NO: 5192065 - DNA, 13 bp, Homo sapiens
agcagcctggcca

SEQ ID NO: 5192066 - DNA, 13 bp, Homo sapiens
agcagcctggctc

SEQ ID NO: 5192067 - DNA, 15 bp, Homo sapiens
agcagcctggctccc

SEQ ID NO: 5192068 - DNA, 21 bp, Homo sapiens
agcagcctggctcccctgggg

SEQ ID NO: 5192069 - DNA, 13 bp, Homo sapiens
agcagcctgtgag

SEQ ID NO: 5192070 - DNA, 13 bp, Homo sapiens
agcagcctgtggc

SEQ ID NO: 5192071 - DNA, 14 bp, Homo sapiens
agcagcctgtggca

SEQ ID NO: 5192072 - DNA, 14 bp, Homo sapiens
agcagcctgttttc

SEQ ID NO: 5192073 - DNA, 12 bp, Homo sapiens
agcagccttcca

SEQ ID NO: 5192074 - DNA, 14 bp, Homo sapiens
agcagccttccagt

SEQ ID NO: 5192075 - DNA, 18 bp, Homo sapiens
agcagccttccagtggct

SEQ ID NO: 5192076 - DNA, 20 bp, Homo sapiens
agcagccttccagtggcttc

SEQ ID NO: 5192077 - DNA, 18 bp, Homo sapiens
agcagcctttaatgcatc

SEQ ID NO: 5192078 - DNA, 11 bp, Homo sapiens
agcagcctttc

SEQ ID NO: 5192079 - DNA, 14 bp, Homo sapiens
agcagcctttctgt

SEQ ID NO: 5192080 - DNA, 18 bp, Homo sapiens
agcagcgaccgccccctc

SEQ ID NO: 5192081 - DNA, 15 bp, Homo sapiens
agcagcgcagccgag

SEQ ID NO: 5192082 - DNA, 13 bp, Homo sapiens
agcagcgcccagg

SEQ ID NO: 5192083 - DNA, 23 bp, Homo sapiens
agcagcgcccaggcctgctggca

SEQ ID NO: 5192084 - DNA, 15 bp, Homo sapiens
agcagcgcgcaggcc

SEQ ID NO: 5192085 - DNA, 17 bp, Homo sapiens
agcagcgctcggcccgg

SEQ ID NO: 5192086 - DNA, 19 bp, Homo sapiens
agcagcgctcggcccggag

SEQ ID NO: 5192087 - DNA, 20 bp, Homo sapiens
agcagcgctcggcccggagc

SEQ ID NO: 5192088 - DNA, 21 bp, Homo sapiens
agcagcgctcggcccggagca

SEQ ID NO: 5192089 - DNA, 15 bp, Homo sapiens
agcagcggacttcaa

SEQ ID NO: 5192090 - DNA, 19 bp, Homo sapiens
agcagcggattgctctgga

SEQ ID NO: 5192091 - DNA, 18 bp, Homo sapiens
agcagcggctctggtcct

SEQ ID NO: 5192092 - DNA, 23 bp, Homo sapiens
agcagcggctctggtcctcggag

SEQ ID NO: 5192093 - DNA, 15 bp, Homo sapiens
agcagcgggagctag

SEQ ID NO: 5192094 - DNA, 22 bp, Homo sapiens
agcagcggtttggggagcagag

SEQ ID NO: 5192095 - DNA, 20 bp, Homo sapiens
agcagctaaaccaaggactg

SEQ ID NO: 5192096 - DNA, 16 bp, Homo sapiens
agcagctactgtaact

SEQ ID NO: 5192097 - DNA, 20 bp, Homo sapiens
agcagctactgtaacttttt

SEQ ID NO: 5192098 - DNA, 20 bp, Homo sapiens
agcagctagaaaacattttt

SEQ ID NO: 5192099 - DNA, 17 bp, Homo sapiens
agcagctagaaagagaa

SEQ ID NO: 5192100 - DNA, 21 bp, Homo sapiens
agcagctagaaagagaaaaag

SEQ ID NO: 5192101 - DNA, 17 bp, Homo sapiens
agcagctagctgctttt

SEQ ID NO: 5192102 - DNA, 15 bp, Homo sapiens
agcagctcaaaggca

SEQ ID NO: 5192103 - DNA, 19 bp, Homo sapiens
agcagctcagcctcccccc

SEQ ID NO: 5192104 - DNA, 13 bp, Homo sapiens
agcagctcaggcg

SEQ ID NO: 5192105 - DNA, 17 bp, Homo sapiens
agcagctcaggcgcagc

SEQ ID NO: 5192106 - DNA, 18 bp, Homo sapiens
agcagctcaggcgcagcc

SEQ ID NO: 5192107 - DNA, 23 bp, Homo sapiens
agcagctccaacctggaggctgg

SEQ ID NO: 5192108 - DNA, 13 bp, Homo sapiens
agcagctccccag

SEQ ID NO: 5192109 - DNA, 16 bp, Homo sapiens
agcagctccccaggag

SEQ ID NO: 5192110 - DNA, 16 bp, Homo sapiens
agcagctccgcctggc

SEQ ID NO: 5192111 - DNA, 17 bp, Homo sapiens
agcagctccgcctggca

SEQ ID NO: 5192112 - DNA, 21 bp, Homo sapiens
agcagctctgagccagattac

SEQ ID NO: 5192113 - DNA, 12 bp, Homo sapiens
agcagctctgcc

SEQ ID NO: 5192114 - DNA, 13 bp, Homo sapiens
agcagctctgcct

SEQ ID NO: 5192115 - DNA, 14 bp, Homo sapiens
agcagctctgcctt

SEQ ID NO: 5192116 - DNA, 15 bp, Homo sapiens
agcagctctgccttc

SEQ ID NO: 5192117 - DNA, 23 bp, Homo sapiens
agcagctctgtccccaccccatg

SEQ ID NO: 5192118 - DNA, 23 bp, Homo sapiens
agcagctcttgctaatcagtgtc

SEQ ID NO: 5192119 - DNA, 18 bp, Homo sapiens
agcagctgaagaaaaaat

SEQ ID NO: 5192120 - DNA, 13 bp, Homo sapiens
agcagctgaaggg

SEQ ID NO: 5192121 - DNA, 12 bp, Homo sapiens
agcctggcaccc

SEQ ID NO: 5192122 - DNA, 14 bp, Homo sapiens
agcctggcacccac

SEQ ID NO: 5192123 - DNA, 16 bp, Homo sapiens
agcctggcatctgtgc

SEQ ID NO: 5192124 - DNA, 14 bp, Homo sapiens
agcctggccaacat

SEQ ID NO: 5192125 - DNA, 19 bp, Homo sapiens
agcctggccaacatggtga

SEQ ID NO: 5192126 - DNA, 21 bp, Homo sapiens
agcctggccaccagccatcct

SEQ ID NO: 5192127 - DNA, 12 bp, Homo sapiens
agcctggccaga

SEQ ID NO: 5192128 - DNA, 16 bp, Homo sapiens
agcctggccagacaca

SEQ ID NO: 5192129 - DNA, 17 bp, Homo sapiens
agcctggccagcctaca

SEQ ID NO: 5192130 - DNA, 16 bp, Homo sapiens
agcctggccaggcagg

SEQ ID NO: 5192131 - DNA, 18 bp, Homo sapiens
agcctggccaggcaggga

SEQ ID NO: 5192132 - DNA, 20 bp, Homo sapiens
agcctggccatcatggcgaa

SEQ ID NO: 5192133 - DNA, 17 bp, Homo sapiens
agcctggcccagctccc

SEQ ID NO: 5192134 - DNA, 16 bp, Homo sapiens
agcctggcccatagaa

SEQ ID NO: 5192135 - DNA, 12 bp, Homo sapiens
agcctggcccca

SEQ ID NO: 5192136 - DNA, 18 bp, Homo sapiens
agcctggccccaggcccc

SEQ ID NO: 5192137 - DNA, 21 bp, Homo sapiens
agcctggccccaggccccaga

SEQ ID NO: 5192138 - DNA, 12 bp, Homo sapiens
agcctggccctt

SEQ ID NO: 5192139 - DNA, 13 bp, Homo sapiens
agcctggcctccc

SEQ ID NO: 5192140 - DNA, 16 bp, Homo sapiens
agcctggcctcctgcc

SEQ ID NO: 5192141 - DNA, 21 bp, Homo sapiens
agcctggcggggcaggaggcc

SEQ ID NO: 5192142 - DNA, 23 bp, Homo sapiens
agcctggcggggcaggaggcctg

SEQ ID NO: 5192143 - DNA, 16 bp, Homo sapiens
agcctggctaacatgg

SEQ ID NO: 5192144 - DNA, 11 bp, Homo sapiens
agcctggctcc

SEQ ID NO: 5192145 - DNA, 12 bp, Homo sapiens
agcctggctccc

SEQ ID NO: 5192146 - DNA, 19 bp, Homo sapiens
agcctggctcccaggacac

SEQ ID NO: 5192147 - DNA, 12 bp, Homo sapiens
agcctggctctg

SEQ ID NO: 5192148 - DNA, 21 bp, Homo sapiens
agcctggctggagagctgcta

SEQ ID NO: 5192149 - DNA, 13 bp, Homo sapiens
agcctggctgtca

SEQ ID NO: 5192150 - DNA, 23 bp, Homo sapiens
agcctggctgtccaaccagactt

SEQ ID NO: 5192151 - DNA, 18 bp, Homo sapiens
agcctggcttagaaggca

SEQ ID NO: 5192152 - DNA, 11 bp, Homo sapiens
agcctggcttc

SEQ ID NO: 5192153 - DNA, 17 bp, Homo sapiens
agcctggcttcaaattg

SEQ ID NO: 5192154 - DNA, 19 bp, Homo sapiens
agcctggcttctggagccc

SEQ ID NO: 5192155 - DNA, 20 bp, Homo sapiens
agcctggcttctggagccct

SEQ ID NO: 5192156 - DNA, 17 bp, Homo sapiens
agcctgggacacacaca

SEQ ID NO: 5192157 - DNA, 14 bp, Homo sapiens
agcctgggaccagg

SEQ ID NO: 5192158 - DNA, 16 bp, Homo sapiens
agcctgggaccagggc

SEQ ID NO: 5192159 - DNA, 18 bp, Homo sapiens
agcctgggactcccagtg

SEQ ID NO: 5192160 - DNA, 15 bp, Homo sapiens
agcctgggagcccag

SEQ ID NO: 5192161 - DNA, 14 bp, Homo sapiens
agcctgggaggcac

SEQ ID NO: 5192162 - DNA, 15 bp, Homo sapiens
agcctgggaggcaca

SEQ ID NO: 5192163 - DNA, 18 bp, Homo sapiens
agcctgggaggcacagca

SEQ ID NO: 5192164 - DNA, 20 bp, Homo sapiens
agcctgggaggtcaaggctg

SEQ ID NO: 5192165 - DNA, 15 bp, Homo sapiens
agcctgggcaacaga

SEQ ID NO: 5192166 - DNA, 18 bp, Homo sapiens
agcctgggcaacagagca

SEQ ID NO: 5192167 - DNA, 13 bp, Homo sapiens
agcctgggcagca

SEQ ID NO: 5192168 - DNA, 21 bp, Homo sapiens
agcctgggcagcacctccggg

SEQ ID NO: 5192169 - DNA, 19 bp, Homo sapiens
agcctgggcagccaggctg

SEQ ID NO: 5192170 - DNA, 14 bp, Homo sapiens
agcctgggccactg

SEQ ID NO: 5192171 - DNA, 18 bp, Homo sapiens
agcctgggccactggcat

SEQ ID NO: 5192172 - DNA, 12 bp, Homo sapiens
agcctgggccag

SEQ ID NO: 5192173 - DNA, 15 bp, Homo sapiens
agcctgggccagaga

SEQ ID NO: 5192174 - DNA, 17 bp, Homo sapiens
agcctgggcccatctcc

SEQ ID NO: 5192175 - DNA, 12 bp, Homo sapiens
agcctgggcccc

SEQ ID NO: 5192176 - DNA, 16 bp, Homo sapiens
agcctgggcccctcag

SEQ ID NO: 5192177 - DNA, 21 bp, Homo sapiens
agcctgggcctatggagagcc

SEQ ID NO: 5192178 - DNA, 23 bp, Homo sapiens
agcctgggcctatggagagccct

SEQ ID NO: 5192179 - DNA, 24 bp, Homo sapiens
agcctgggcctatggagagccctg

SEQ ID NO: 5192180 - DNA, 14 bp, Homo sapiens
agcctgggcctcct

SEQ ID NO: 5192181 - DNA, 21 bp, Homo sapiens
agcctgggcctcctcctagct

SEQ ID NO: 5192182 - DNA, 22 bp, Homo sapiens
agcctgggcgtacagagcacat

SEQ ID NO: 5192183 - DNA, 18 bp, Homo sapiens
agcctgggctcactgtgc

SEQ ID NO: 5192184 - DNA, 16 bp, Homo sapiens
agcctgggctcctcca

SEQ ID NO: 5192185 - DNA, 22 bp, Homo sapiens
agcctgggcttgagctgcagaa

SEQ ID NO: 5192186 - DNA, 19 bp, Homo sapiens
agcctggggcactcctcct

SEQ ID NO: 5192187 - DNA, 17 bp, Homo sapiens
agcctggggcctgggga

SEQ ID NO: 5192188 - DNA, 11 bp, Homo sapiens
agcctggggct

SEQ ID NO: 5192189 - DNA, 21 bp, Homo sapiens
agcctggggctccctctctgg

SEQ ID NO: 5192190 - DNA, 16 bp, Homo sapiens
agcctggggctctaac

SEQ ID NO: 5192191 - DNA, 23 bp, Homo sapiens
agcctggggctctaacgcctgag

SEQ ID NO: 5192192 - DNA, 17 bp, Homo sapiens
agcctggggctgaggct

SEQ ID NO: 5192193 - DNA, 20 bp, Homo sapiens
agcctgggggacagagcaag

SEQ ID NO: 5192194 - DNA, 13 bp, Homo sapiens
agcctgggggcca

SEQ ID NO: 5192195 - DNA, 15 bp, Homo sapiens
agcctgggggcctgg

SEQ ID NO: 5192196 - DNA, 23 bp, Homo sapiens
agcctgggggcctggctggctga

SEQ ID NO: 5192197 - DNA, 16 bp, Homo sapiens
agcctgggggctcctc

SEQ ID NO: 5192198 - DNA, 19 bp, Homo sapiens
agcctggggtggggtcatg

SEQ ID NO: 5192199 - DNA, 22 bp, Homo sapiens
agcctggggttgtccccgctgg

SEQ ID NO: 5192200 - DNA, 17 bp, Homo sapiens
agcctgggtaggaaaat

SEQ ID NO: 5192201 - DNA, 21 bp, Homo sapiens
agcctgggtcacagagtgaga

SEQ ID NO: 5192202 - DNA, 22 bp, Homo sapiens
agcctgggtctggatgggagga

SEQ ID NO: 5192203 - DNA, 17 bp, Homo sapiens
agcctgggtgacagagc

SEQ ID NO: 5192204 - DNA, 22 bp, Homo sapiens
agcctgggtgacagagcaagtg

SEQ ID NO: 5192205 - DNA, 18 bp, Homo sapiens
agcctgggtgacagagcg

SEQ ID NO: 5192206 - DNA, 23 bp, Homo sapiens
agcctgggtgagaatcctgcctc

SEQ ID NO: 5192207 - DNA, 16 bp, Homo sapiens
agcctggtagagacta

SEQ ID NO: 5192208 - DNA, 20 bp, Homo sapiens
agcctggtcagcccaaacca

SEQ ID NO: 5192209 - DNA, 15 bp, Homo sapiens
agcctggtccttccc

SEQ ID NO: 5192210 - DNA, 16 bp, Homo sapiens
agcctggtccttccct

SEQ ID NO: 5192211 - DNA, 17 bp, Homo sapiens
agcctggtctgtgcatt

SEQ ID NO: 5192212 - DNA, 17 bp, Homo sapiens
agcctggtgacaggcag

SEQ ID NO: 5192213 - DNA, 18 bp, Homo sapiens
agcctggtgacaggcaga

SEQ ID NO: 5192214 - DNA, 14 bp, Homo sapiens
agcctggtgctgct

SEQ ID NO: 5192215 - DNA, 15 bp, Homo sapiens
agcctggtgctgctg

SEQ ID NO: 5192216 - DNA, 16 bp, Homo sapiens
agcctggtggcccagc

SEQ ID NO: 5192217 - DNA, 11 bp, Homo sapiens
agcctggtggg

SEQ ID NO: 5192218 - DNA, 16 bp, Homo sapiens
agcctggtgggcctcc

SEQ ID NO: 5192219 - DNA, 21 bp, Homo sapiens
agcctggtgggcctcctctgt

SEQ ID NO: 5192220 - DNA, 22 bp, Homo sapiens
agcctggtgggcctcctctgtc

SEQ ID NO: 5192221 - DNA, 24 bp, Homo sapiens
agcctggttcagaataaattgatc

SEQ ID NO: 5192222 - DNA, 17 bp, Homo sapiens
agcctggttcagacaca

SEQ ID NO: 5192223 - DNA, 21 bp, Homo sapiens
agcctggttccctctttcctg

SEQ ID NO: 5192224 - DNA, 15 bp, Homo sapiens
agcctggtttctggg

SEQ ID NO: 5192225 - DNA, 22 bp, Homo sapiens
agcctggtttctgggtgctaga

SEQ ID NO: 5192226 - DNA, 13 bp, Homo sapiens
agcctggtttttc

SEQ ID NO: 5192227 - DNA, 16 bp, Homo sapiens
agcctggtttttctca

SEQ ID NO: 5192228 - DNA, 18 bp, Homo sapiens
agcctggtttttctcaat

SEQ ID NO: 5192229 - DNA, 22 bp, Homo sapiens
agcctgtaaactttatcactta

SEQ ID NO: 5192230 - DNA, 17 bp, Homo sapiens
agcctgtaagcctgcaa

SEQ ID NO: 5192231 - DNA, 19 bp, Homo sapiens
agcctgtagggaactttct

SEQ ID NO: 5192232 - DNA, 21 bp, Homo sapiens
agcctgtatgtggtgtggggc

SEQ ID NO: 5192233 - DNA, 19 bp, Homo sapiens
agcctgtcaccagagcttc

SEQ ID NO: 5192234 - DNA, 20 bp, Homo sapiens
agcctgtcacccagctcctc

SEQ ID NO: 5192235 - DNA, 16 bp, Homo sapiens
agcctgtcatccttgg

SEQ ID NO: 5192236 - DNA, 18 bp, Homo sapiens
agcctgtccaacatggtg

SEQ ID NO: 5192237 - DNA, 19 bp, Homo sapiens
agcctgtccaacatggtga

SEQ ID NO: 5192238 - DNA, 22 bp, Homo sapiens
agcctgtccaatttctgctgta

SEQ ID NO: 5192239 - DNA, 12 bp, Homo sapiens
agcctgtcccag

SEQ ID NO: 5192240 - DNA, 15 bp, Homo sapiens
agcctgtcccaggac

SEQ ID NO: 5192241 - DNA, 18 bp, Homo sapiens
agcctgtcccaggactca

SEQ ID NO: 5192242 - DNA, 16 bp, Homo sapiens
agcctgtccccagacc

SEQ ID NO: 5192243 - DNA, 19 bp, Homo sapiens
agcctgtccccgccttccc

SEQ ID NO: 5192244 - DNA, 14 bp, Homo sapiens
agcctgtcctgcct

SEQ ID NO: 5192245 - DNA, 14 bp, Homo sapiens
agcctgtcctggta

SEQ ID NO: 5192246 - DNA, 21 bp, Homo sapiens
agcctgtctctccttgttgcc

SEQ ID NO: 5192247 - DNA, 15 bp, Homo sapiens
agcctgtctctttcc

SEQ ID NO: 5192248 - DNA, 17 bp, Homo sapiens
agcctgtctctttccac

SEQ ID NO: 5192249 - DNA, 19 bp, Homo sapiens
agcctgtcttcagatcctg

SEQ ID NO: 5192250 - DNA, 23 bp, Homo sapiens
agcctgtcttcagatcctgctgc

SEQ ID NO: 5192251 - DNA, 22 bp, Homo sapiens
agcctgtgacataccccctccc

SEQ ID NO: 5192252 - DNA, 21 bp, Homo sapiens
agcctgtgagggagtgcagaa

SEQ ID NO: 5192253 - DNA, 21 bp, Homo sapiens
agcctgtgattaacttgctta

SEQ ID NO: 5192254 - DNA, 15 bp, Homo sapiens
agcctgtgcagcctt

SEQ ID NO: 5192255 - DNA, 11 bp, Homo sapiens
agcctgtgcca

SEQ ID NO: 5192256 - DNA, 14 bp, Homo sapiens
agcctgtgccagca

SEQ ID NO: 5192257 - DNA, 17 bp, Homo sapiens
agcctgtgccagcacct

SEQ ID NO: 5192258 - DNA, 22 bp, Homo sapiens
agcctgtgcccatatggtcatc

SEQ ID NO: 5192259 - DNA, 18 bp, Homo sapiens
agcctgtgcctcccagct

SEQ ID NO: 5192260 - DNA, 23 bp, Homo sapiens
agcctgtgcgtcccagctgaagg

SEQ ID NO: 5192261 - DNA, 16 bp, Homo sapiens
agcctgtgctgtggca

SEQ ID NO: 5192262 - DNA, 17 bp, Homo sapiens
agcctgtgctgtggcat

SEQ ID NO: 5192263 - DNA, 16 bp, Homo sapiens
agcctgtggatgatca

SEQ ID NO: 5192264 - DNA, 20 bp, Homo sapiens
agcctgtggatgatcaatcc

SEQ ID NO: 5192265 - DNA, 23 bp, Homo sapiens
agcctgtggcagtaaagagaaac

SEQ ID NO: 5192266 - DNA, 15 bp, Homo sapiens
agcctgtggcctcag

SEQ ID NO: 5192267 - DNA, 18 bp, Homo sapiens
agcctgtggcctcagcat

SEQ ID NO: 5192268 - DNA, 17 bp, Homo sapiens
agcctgtggcctttgca

SEQ ID NO: 5192269 - DNA, 17 bp, Homo sapiens
agcctgtggcggtgcct

SEQ ID NO: 5192270 - DNA, 11 bp, Homo sapiens
agcctgtggct

SEQ ID NO: 5192271 - DNA, 22 bp, Homo sapiens
agcctgtggctgtggagacaat

SEQ ID NO: 5192272 - DNA, 23 bp, Homo sapiens
agcctgtggcttggagtggccaa

SEQ ID NO: 5192273 - DNA, 14 bp, Homo sapiens
agcctgtgggagaa

SEQ ID NO: 5192274 - DNA, 16 bp, Homo sapiens
agcctgtgggagaagg

SEQ ID NO: 5192275 - DNA, 17 bp, Homo sapiens
agcctgtgggagaaggg

SEQ ID NO: 5192276 - DNA, 17 bp, Homo sapiens
agcctgtgggagtagaa

SEQ ID NO: 5192277 - DNA, 18 bp, Homo sapiens
agcctgtgggagtagaaa

SEQ ID NO: 5192278 - DNA, 14 bp, Homo sapiens
agcctgtgggcagc

SEQ ID NO: 5192279 - DNA, 21 bp, Homo sapiens
agcctgtgggcagcatgccca

SEQ ID NO: 5192280 - DNA, 22 bp, Homo sapiens
agcctgtgggcagcatgcccag

SEQ ID NO: 5192281 - DNA, 13 bp, Homo sapiens
agcctgtgggtcc

SEQ ID NO: 5192282 - DNA, 15 bp, Homo sapiens
agcctgtgtaacagc

SEQ ID NO: 5192283 - DNA, 17 bp, Homo sapiens
agcctgtgtaacagctc

SEQ ID NO: 5192284 - DNA, 19 bp, Homo sapiens
agcctgtgtaacagctcct

SEQ ID NO: 5192285 - DNA, 21 bp, Homo sapiens
agcctgtgtaacagctccttg

SEQ ID NO: 5192286 - DNA, 13 bp, Homo sapiens
agcctgtgtcctg

SEQ ID NO: 5192287 - DNA, 16 bp, Homo sapiens
agcctgtgtctttaaa

SEQ ID NO: 5192288 - DNA, 23 bp, Homo sapiens
agcctgtgtctttaaatgctgct

SEQ ID NO: 5192289 - DNA, 17 bp, Homo sapiens
agcctgtgttactgatt

SEQ ID NO: 5192290 - DNA, 22 bp, Homo sapiens
agcctgtgttagtgtctgtcca

SEQ ID NO: 5192291 - DNA, 17 bp, Homo sapiens
agcctgttacaggaatg

SEQ ID NO: 5192292 - DNA, 22 bp, Homo sapiens
agcctgttccataggaaggctg

SEQ ID NO: 5192293 - DNA, 14 bp, Homo sapiens
agcctgttcccctc

SEQ ID NO: 5192294 - DNA, 20 bp, Homo sapiens
agcctgttcccctcactgga

SEQ ID NO: 5192295 - DNA, 14 bp, Homo sapiens
agcctgttccttcc

SEQ ID NO: 5192296 - DNA, 18 bp, Homo sapiens
agcctgttccttcctgca

SEQ ID NO: 5192297 - DNA, 19 bp, Homo sapiens
agcctgttccttcctgcag

SEQ ID NO: 5192298 - DNA, 20 bp, Homo sapiens
agcctgttccttcctgcaga

SEQ ID NO: 5192299 - DNA, 19 bp, Homo sapiens
agcagctgaagtctctttt

SEQ ID NO: 5192300 - DNA, 19 bp, Homo sapiens
agcagctgactttcaaagt

SEQ ID NO: 5192301 - DNA, 11 bp, Homo sapiens
agcagctgagc

SEQ ID NO: 5192302 - DNA, 16 bp, Homo sapiens
agcagctgatgctgta

SEQ ID NO: 5192303 - DNA, 13 bp, Homo sapiens
agcagctgcattt

SEQ ID NO: 5192304 - DNA, 16 bp, Homo sapiens
agcagctgcgggtctg

SEQ ID NO: 5192305 - DNA, 21 bp, Homo sapiens
agcagctgcgggtctgaagga

SEQ ID NO: 5192306 - DNA, 12 bp, Homo sapiens
agcagctggact

SEQ ID NO: 5192307 - DNA, 11 bp, Homo sapiens
agcagctggcc

SEQ ID NO: 5192308 - DNA, 12 bp, Homo sapiens
agcagctggcct

SEQ ID NO: 5192309 - DNA, 12 bp, Homo sapiens
agcagctgggca

SEQ ID NO: 5192310 - DNA, 15 bp, Homo sapiens
agcagctgggcactg

SEQ ID NO: 5192311 - DNA, 20 bp, Homo sapiens
agcagctgggccggccagcc

SEQ ID NO: 5192312 - DNA, 17 bp, Homo sapiens
agcagctggtcagtctt

SEQ ID NO: 5192313 - DNA, 21 bp, Homo sapiens
agcagctggtcagtctttgct

SEQ ID NO: 5192314 - DNA, 23 bp, Homo sapiens
agcagctggtgccccacctgcct

SEQ ID NO: 5192315 - DNA, 17 bp, Homo sapiens
agcagcttaagtccagc

SEQ ID NO: 5192316 - DNA, 15 bp, Homo sapiens
agcagcttattgttt

SEQ ID NO: 5192317 - DNA, 15 bp, Homo sapiens
agcagcttcaccaga

SEQ ID NO: 5192318 - DNA, 14 bp, Homo sapiens
agcagcttccagat

SEQ ID NO: 5192319 - DNA, 14 bp, Homo sapiens
agcagcttccttct

SEQ ID NO: 5192320 - DNA, 18 bp, Homo sapiens
agcagcttccttctggga

SEQ ID NO: 5192321 - DNA, 21 bp, Homo sapiens
agcagcttccttctgggactg

SEQ ID NO: 5192322 - DNA, 20 bp, Homo sapiens
agcagcttctgccacttccc

SEQ ID NO: 5192323 - DNA, 22 bp, Homo sapiens
agcagcttctgccacttcccag

SEQ ID NO: 5192324 - DNA, 14 bp, Homo sapiens
agcagcttcttggg

SEQ ID NO: 5192325 - DNA, 15 bp, Homo sapiens
agcagcttcttgggc

SEQ ID NO: 5192326 - DNA, 18 bp, Homo sapiens
agcagcttcttgggctga

SEQ ID NO: 5192327 - DNA, 20 bp, Homo sapiens
agcagcttcttgggctgagt

SEQ ID NO: 5192328 - DNA, 23 bp, Homo sapiens
agcagcttcttgggctgagtgca

SEQ ID NO: 5192329 - DNA, 18 bp, Homo sapiens
agcagcttcttttgtctc

SEQ ID NO: 5192330 - DNA, 21 bp, Homo sapiens
agcagcttgaatggtttttct

SEQ ID NO: 5192331 - DNA, 17 bp, Homo sapiens
agcagcttgctgcaccc

SEQ ID NO: 5192332 - DNA, 16 bp, Homo sapiens
agcagcttggctgagc

SEQ ID NO: 5192333 - DNA, 16 bp, Homo sapiens
agcagctttaaacaaa

SEQ ID NO: 5192334 - DNA, 22 bp, Homo sapiens
agcagctttaaactcagggaca

SEQ ID NO: 5192335 - DNA, 21 bp, Homo sapiens
agcagcttttggtctccttgg

SEQ ID NO: 5192336 - DNA, 22 bp, Homo sapiens
agcagcttttggtctccttggg

SEQ ID NO: 5192337 - DNA, 21 bp, Homo sapiens
agcagctttttattccctgcc

SEQ ID NO: 5192338 - DNA, 11 bp, Homo sapiens
agcaggaaaaa

SEQ ID NO: 5192339 - DNA, 15 bp, Homo sapiens
agcaggaaaaaagga

SEQ ID NO: 5192340 - DNA, 15 bp, Homo sapiens
agcaggaaatgaaaa

SEQ ID NO: 5192341 - DNA, 23 bp, Homo sapiens
agcaggaaatgaaaatgtcttgt

SEQ ID NO: 5192342 - DNA, 18 bp, Homo sapiens
agcaggaaattcagccca

SEQ ID NO: 5192343 - DNA, 22 bp, Homo sapiens
agcaggaaattcagcccaccag

SEQ ID NO: 5192344 - DNA, 17 bp, Homo sapiens
agcaggaacagagactc

SEQ ID NO: 5192345 - DNA, 17 bp, Homo sapiens
agcaggaagcaaggcca

SEQ ID NO: 5192346 - DNA, 21 bp, Homo sapiens
agcaggaagcaaggccagccc

SEQ ID NO: 5192347 - DNA, 18 bp, Homo sapiens
agcaggaagccaggctga

SEQ ID NO: 5192348 - DNA, 15 bp, Homo sapiens
agcaggaagctcaga

SEQ ID NO: 5192349 - DNA, 22 bp, Homo sapiens
agcaggaaggacaggaagctgg

SEQ ID NO: 5192350 - DNA, 15 bp, Homo sapiens
agcaggaaggcccct

SEQ ID NO: 5192351 - DNA, 10 bp, Homo sapiens
agcaggaata

SEQ ID NO: 5192352 - DNA, 14 bp, Homo sapiens
agcaggaataaaga

SEQ ID NO: 5192353 - DNA, 15 bp, Homo sapiens
agcaggaataaagac

SEQ ID NO: 5192354 - DNA, 20 bp, Homo sapiens
agcaggaatatatgtgtgcc

SEQ ID NO: 5192355 - DNA, 17 bp, Homo sapiens
agcaggaatgggaagga

SEQ ID NO: 5192356 - DNA, 15 bp, Homo sapiens
agcaggacccagtgg

SEQ ID NO: 5192357 - DNA, 17 bp, Homo sapiens
agcaggacctcccttcc

SEQ ID NO: 5192358 - DNA, 22 bp, Homo sapiens
agcaggacctcccttccgaccc

SEQ ID NO: 5192359 - DNA, 13 bp, Homo sapiens
agcaggacctctg

SEQ ID NO: 5192360 - DNA, 16 bp, Homo sapiens
agcaggacctggcatc

SEQ ID NO: 5192361 - DNA, 16 bp, Homo sapiens
agcaggacctgtgctt

SEQ ID NO: 5192362 - DNA, 19 bp, Homo sapiens
agcaggacctgtgctttga

SEQ ID NO: 5192363 - DNA, 13 bp, Homo sapiens
agcaggactccca

SEQ ID NO: 5192364 - DNA, 23 bp, Homo sapiens
agcaggactgaattgtccccagt

SEQ ID NO: 5192365 - DNA, 12 bp, Homo sapiens
agcaggactgag

SEQ ID NO: 5192366 - DNA, 16 bp, Homo sapiens
agcaggactgatgtct

SEQ ID NO: 5192367 - DNA, 15 bp, Homo sapiens
agcaggactgtgcct

SEQ ID NO: 5192368 - DNA, 15 bp, Homo sapiens
agcaggactgtggga

SEQ ID NO: 5192369 - DNA, 22 bp, Homo sapiens
agcaggacttgctaaagcactt

SEQ ID NO: 5192370 - DNA, 22 bp, Homo sapiens
agcaggagacgacaggcgagag

SEQ ID NO: 5192371 - DNA, 18 bp, Homo sapiens
agcaggagagactgagca

SEQ ID NO: 5192372 - DNA, 16 bp, Homo sapiens
agcaggagaggagagc

SEQ ID NO: 5192373 - DNA, 20 bp, Homo sapiens
agcaggagaggagagccaga

SEQ ID NO: 5192374 - DNA, 21 bp, Homo sapiens
agcaggagaggagagccagag

SEQ ID NO: 5192375 - DNA, 23 bp, Homo sapiens
agcaggagattgagaaggagaga

SEQ ID NO: 5192376 - DNA, 17 bp, Homo sapiens
agcaggagcagaaagat

SEQ ID NO: 5192377 - DNA, 14 bp, Homo sapiens
agcaggagcagctg

SEQ ID NO: 5192378 - DNA, 15 bp, Homo sapiens
agcaggagcagctgt

SEQ ID NO: 5192379 - DNA, 15 bp, Homo sapiens
agcaggagcatggcc

SEQ ID NO: 5192380 - DNA, 19 bp, Homo sapiens
agcaggagccccgccacag

SEQ ID NO: 5192381 - DNA, 14 bp, Homo sapiens
agcaggagcttggg

SEQ ID NO: 5192382 - DNA, 15 bp, Homo sapiens
agcaggagcttgggt

SEQ ID NO: 5192383 - DNA, 15 bp, Homo sapiens
agcaggaggagtgga

SEQ ID NO: 5192384 - DNA, 13 bp, Homo sapiens
agcaggaggcaca

SEQ ID NO: 5192385 - DNA, 14 bp, Homo sapiens
agcaggaggccaat

SEQ ID NO: 5192386 - DNA, 15 bp, Homo sapiens
agcaggaggccaata

SEQ ID NO: 5192387 - DNA, 15 bp, Homo sapiens
agcaggaggccaggc

SEQ ID NO: 5192388 - DNA, 23 bp, Homo sapiens
agcaggaggcccctggcccagcg

SEQ ID NO: 5192389 - DNA, 21 bp, Homo sapiens
agcaggaggcccttgtcgtgg

SEQ ID NO: 5192390 - DNA, 21 bp, Homo sapiens
agcaggaggctttctgggctc

SEQ ID NO: 5192391 - DNA, 21 bp, Homo sapiens
agcaggagggactctgtctgg

SEQ ID NO: 5192392 - DNA, 16 bp, Homo sapiens
agcaggaggtgcctga

SEQ ID NO: 5192393 - DNA, 20 bp, Homo sapiens
agcaggagtggtgcagacag

SEQ ID NO: 5192394 - DNA, 19 bp, Homo sapiens
agcaggatcgaagggtttt

SEQ ID NO: 5192395 - DNA, 23 bp, Homo sapiens
agcaggatgaattttctgcagct

SEQ ID NO: 5192396 - DNA, 23 bp, Homo sapiens
agcaggatgggctgagctagcct

SEQ ID NO: 5192397 - DNA, 20 bp, Homo sapiens
agcaggcaaaaaagggacag

SEQ ID NO: 5192398 - DNA, 22 bp, Homo sapiens
agcaggcaaaaaagggacagca

SEQ ID NO: 5192399 - DNA, 19 bp, Homo sapiens
agcaggcaatgctgtactt

SEQ ID NO: 5192400 - DNA, 13 bp, Homo sapiens
agcaggcacagga

SEQ ID NO: 5192401 - DNA, 14 bp, Homo sapiens
agcaggcacatgga

SEQ ID NO: 5192402 - DNA, 18 bp, Homo sapiens
agcaggcaccagcagcag

SEQ ID NO: 5192403 - DNA, 20 bp, Homo sapiens
agcaggcaccagcagcagaa

SEQ ID NO: 5192404 - DNA, 23 bp, Homo sapiens
agcaggcaccgccacgtcccagc

SEQ ID NO: 5192405 - DNA, 13 bp, Homo sapiens
agcaggcactgta

SEQ ID NO: 5192406 - DNA, 16 bp, Homo sapiens
agcaggcagaggagag

SEQ ID NO: 5192407 - DNA, 18 bp, Homo sapiens
agcaggcagaggagagta

SEQ ID NO: 5192408 - DNA, 12 bp, Homo sapiens
agcaggcagcca

SEQ ID NO: 5192409 - DNA, 13 bp, Homo sapiens
agcaggcagcctt

SEQ ID NO: 5192410 - DNA, 20 bp, Homo sapiens
agcaggcaggcactgtggcc

SEQ ID NO: 5192411 - DNA, 13 bp, Homo sapiens
agcaggcagggca

SEQ ID NO: 5192412 - DNA, 23 bp, Homo sapiens
agcaggcagggctgggccaggtc

SEQ ID NO: 5192413 - DNA, 16 bp, Homo sapiens
agcaggccaaggtctg

SEQ ID NO: 5192414 - DNA, 17 bp, Homo sapiens
agcaggccaaggtctga

SEQ ID NO: 5192415 - DNA, 23 bp, Homo sapiens
agcaggccacacttcaaactact

SEQ ID NO: 5192416 - DNA, 15 bp, Homo sapiens
agcaggccactagtg

SEQ ID NO: 5192417 - DNA, 17 bp, Homo sapiens
agcaggccactagtgac

SEQ ID NO: 5192418 - DNA, 19 bp, Homo sapiens
agcaggccactagtgacag

SEQ ID NO: 5192419 - DNA, 16 bp, Homo sapiens
agcaggccagagaaag

SEQ ID NO: 5192420 - DNA, 22 bp, Homo sapiens
agcaggccattggctactgact

SEQ ID NO: 5192421 - DNA, 17 bp, Homo sapiens
agcaggcccacctacct

SEQ ID NO: 5192422 - DNA, 23 bp, Homo sapiens
agcaggcccacctaccttcaaag

SEQ ID NO: 5192423 - DNA, 11 bp, Homo sapiens
agcaggcccag

SEQ ID NO: 5192424 - DNA, 13 bp, Homo sapiens
agcaggcccagca

SEQ ID NO: 5192425 - DNA, 19 bp, Homo sapiens
agcaggcccagcatgcagg

SEQ ID NO: 5192426 - DNA, 17 bp, Homo sapiens
agcaggccccctaggat

SEQ ID NO: 5192427 - DNA, 15 bp, Homo sapiens
agcaggcccgacaga

SEQ ID NO: 5192428 - DNA, 19 bp, Homo sapiens
agcaggcccgacagagaga

SEQ ID NO: 5192429 - DNA, 19 bp, Homo sapiens
agcaggccctgggcctcca

SEQ ID NO: 5192430 - DNA, 15 bp, Homo sapiens
agcaggccggaacca

SEQ ID NO: 5192431 - DNA, 17 bp, Homo sapiens
agcaggcctctgggacc

SEQ ID NO: 5192432 - DNA, 19 bp, Homo sapiens
agcaggcctctggttgcct

SEQ ID NO: 5192433 - DNA, 22 bp, Homo sapiens
agcaggccttagtacggctgct

SEQ ID NO: 5192434 - DNA, 23 bp, Homo sapiens
agcaggccttagtacggctgctg

SEQ ID NO: 5192435 - DNA, 13 bp, Homo sapiens
agcaggccttgcg

SEQ ID NO: 5192436 - DNA, 21 bp, Homo sapiens
agcaggccttgcgctgttgcg

SEQ ID NO: 5192437 - DNA, 21 bp, Homo sapiens
agcaggcggtggggagagatg

SEQ ID NO: 5192438 - DNA, 16 bp, Homo sapiens
agcaggctacactgac

SEQ ID NO: 5192439 - DNA, 22 bp, Homo sapiens
agcaggctacactgacactggt

SEQ ID NO: 5192440 - DNA, 17 bp, Homo sapiens
agcaggctactgggacc

SEQ ID NO: 5192441 - DNA, 17 bp, Homo sapiens
agcaggctactgtcagc

SEQ ID NO: 5192442 - DNA, 19 bp, Homo sapiens
agcaggctactgtcagctc

SEQ ID NO: 5192443 - DNA, 16 bp, Homo sapiens
agcaggctcaggcaca

SEQ ID NO: 5192444 - DNA, 13 bp, Homo sapiens
agcaggctcctca

SEQ ID NO: 5192445 - DNA, 16 bp, Homo sapiens
agcaggctcctcagcc

SEQ ID NO: 5192446 - DNA, 17 bp, Homo sapiens
agcaggctctcaggcca

SEQ ID NO: 5192447 - DNA, 23 bp, Homo sapiens
agcaggctctcaggccagctgct

SEQ ID NO: 5192448 - DNA, 18 bp, Homo sapiens
agcaggctgcagcaggca

SEQ ID NO: 5192449 - DNA, 20 bp, Homo sapiens
agcaggctgcagcaggcaga

SEQ ID NO: 5192450 - DNA, 20 bp, Homo sapiens
agcaggctgccagtgcctgg

SEQ ID NO: 5192451 - DNA, 22 bp, Homo sapiens
agcaggctgccagtgcctgggt

SEQ ID NO: 5192452 - DNA, 20 bp, Homo sapiens
agcaggctggcagctctcca

SEQ ID NO: 5192453 - DNA, 24 bp, Homo sapiens
agcaggctggcagctctccagtca

SEQ ID NO: 5192454 - DNA, 15 bp, Homo sapiens
agcaggctggtttgc

SEQ ID NO: 5192455 - DNA, 14 bp, Homo sapiens
agcaggctgttcca

SEQ ID NO: 5192456 - DNA, 21 bp, Homo sapiens
agcaggctttgtgagagagga

SEQ ID NO: 5192457 - DNA, 22 bp, Homo sapiens
agcaggctttgtgagagaggac

SEQ ID NO: 5192458 - DNA, 13 bp, Homo sapiens
agcagggaaacag

SEQ ID NO: 5192459 - DNA, 15 bp, Homo sapiens
agcagggaaggcctg

SEQ ID NO: 5192460 - DNA, 13 bp, Homo sapiens
agcagggaaggtg

SEQ ID NO: 5192461 - DNA, 19 bp, Homo sapiens
agcagggaattcctggggt

SEQ ID NO: 5192462 - DNA, 16 bp, Homo sapiens
agcagggaatttctat

SEQ ID NO: 5192463 - DNA, 16 bp, Homo sapiens
agcagggactgtaaac

SEQ ID NO: 5192464 - DNA, 19 bp, Homo sapiens
agcagggagagctcaccat

SEQ ID NO: 5192465 - DNA, 20 bp, Homo sapiens
agcagggagggcttctgcca

SEQ ID NO: 5192466 - DNA, 17 bp, Homo sapiens
agcagggatgccctgga

SEQ ID NO: 5192467 - DNA, 22 bp, Homo sapiens
agcagggatgccctggaggtgg

SEQ ID NO: 5192468 - DNA, 19 bp, Homo sapiens
agcagggattaacctctgc

SEQ ID NO: 5192469 - DNA, 20 bp, Homo sapiens
agcagggattaacctctgca

SEQ ID NO: 5192470 - DNA, 21 bp, Homo sapiens
agcagggattaacctctgcac

SEQ ID NO: 5192471 - DNA, 14 bp, Homo sapiens
agcagggcagcagg

SEQ ID NO: 5192472 - DNA, 14 bp, Homo sapiens
agcagggcaggccc

SEQ ID NO: 5192473 - DNA, 21 bp, Homo sapiens
agcagggcataggaagaaaat

SEQ ID NO: 5192474 - DNA, 20 bp, Homo sapiens
agcagggccaaagcacagct

SEQ ID NO: 5192475 - DNA, 13 bp, Homo sapiens
agcagggccctca

SEQ ID NO: 5192476 - DNA, 17 bp, Homo sapiens
agcagggccctcagagg

SEQ ID NO: 5192477 - DNA, 21 bp, Homo sapiens
agcctgttccttcctgcagac

SEQ ID NO: 5192478 - DNA, 23 bp, Homo sapiens
agcctgttccttcctgcagacct

SEQ ID NO: 5192479 - DNA, 21 bp, Homo sapiens
agcctgttgaaggactacagg

SEQ ID NO: 5192480 - DNA, 14 bp, Homo sapiens
agcctgttgagact

SEQ ID NO: 5192481 - DNA, 22 bp, Homo sapiens
agcctgttgcccctgcctccca

SEQ ID NO: 5192482 - DNA, 22 bp, Homo sapiens
agcctgttgggatcgcattgca

SEQ ID NO: 5192483 - DNA, 14 bp, Homo sapiens
agcctgtttcttcc

SEQ ID NO: 5192484 - DNA, 23 bp, Homo sapiens
agcctgtttcttcctgttaatgt

SEQ ID NO: 5192485 - DNA, 20 bp, Homo sapiens
agcctgtttgggaggctgga

SEQ ID NO: 5192486 - DNA, 13 bp, Homo sapiens
agccttaaaaata

SEQ ID NO: 5192487 - DNA, 15 bp, Homo sapiens
agccttaaaatgcat

SEQ ID NO: 5192488 - DNA, 19 bp, Homo sapiens
agccttaaactgtacagaa

SEQ ID NO: 5192489 - DNA, 17 bp, Homo sapiens
agccttaaagacaaaaa

SEQ ID NO: 5192490 - DNA, 22 bp, Homo sapiens
agccttaaagacaaaaatcctt

SEQ ID NO: 5192491 - DNA, 16 bp, Homo sapiens
agccttaaatttttgt

SEQ ID NO: 5192492 - DNA, 22 bp, Homo sapiens
agccttaaatttttgtcatttt

SEQ ID NO: 5192493 - DNA, 22 bp, Homo sapiens
agccttaacttcttaaaccatt

SEQ ID NO: 5192494 - DNA, 15 bp, Homo sapiens
agccttaagcaaatt

SEQ ID NO: 5192495 - DNA, 19 bp, Homo sapiens
agccttaagcacaattaat

SEQ ID NO: 5192496 - DNA, 21 bp, Homo sapiens
agccttaaggtagaaggcaca

SEQ ID NO: 5192497 - DNA, 22 bp, Homo sapiens
agccttaagtcttactgttttg

SEQ ID NO: 5192498 - DNA, 12 bp, Homo sapiens
agccttaataaa

SEQ ID NO: 5192499 - DNA, 14 bp, Homo sapiens
agccttaatagact

SEQ ID NO: 5192500 - DNA, 18 bp, Homo sapiens
agccttaatcaggtcctc

SEQ ID NO: 5192501 - DNA, 17 bp, Homo sapiens
agccttaatggatgctc

SEQ ID NO: 5192502 - DNA, 18 bp, Homo sapiens
agccttaatttgcacagt

SEQ ID NO: 5192503 - DNA, 20 bp, Homo sapiens
agccttacagttatcctgca

SEQ ID NO: 5192504 - DNA, 21 bp, Homo sapiens
agccttacagttatcctgcaa

SEQ ID NO: 5192505 - DNA, 16 bp, Homo sapiens
agccttactcacctct

SEQ ID NO: 5192506 - DNA, 21 bp, Homo sapiens
agccttacttcaaagtgcctg

SEQ ID NO: 5192507 - DNA, 20 bp, Homo sapiens
agccttagaagtcacacagt

SEQ ID NO: 5192508 - DNA, 22 bp, Homo sapiens
agccttagacgaagaagctggc

SEQ ID NO: 5192509 - DNA, 19 bp, Homo sapiens
agccttagagcatctctgc

SEQ ID NO: 5192510 - DNA, 20 bp, Homo sapiens
agccttagagcatctctgcc

SEQ ID NO: 5192511 - DNA, 14 bp, Homo sapiens
agccttagagctct

SEQ ID NO: 5192512 - DNA, 22 bp, Homo sapiens
agccttagaggtatgtcagaaa

SEQ ID NO: 5192513 - DNA, 17 bp, Homo sapiens
agccttagcagccctgg

SEQ ID NO: 5192514 - DNA, 20 bp, Homo sapiens
agccttagcccggatgccca

SEQ ID NO: 5192515 - DNA, 23 bp, Homo sapiens
agccttagcccggatgcccaccc

SEQ ID NO: 5192516 - DNA, 16 bp, Homo sapiens
agccttagctcccagc

SEQ ID NO: 5192517 - DNA, 20 bp, Homo sapiens
agccttagctctcccaactc

SEQ ID NO: 5192518 - DNA, 20 bp, Homo sapiens
agccttagctgccagtgctg

SEQ ID NO: 5192519 - DNA, 14 bp, Homo sapiens
agccttagggaagc

SEQ ID NO: 5192520 - DNA, 15 bp, Homo sapiens
agccttagggaagct

SEQ ID NO: 5192521 - DNA, 18 bp, Homo sapiens
agccttataaaccaatct

SEQ ID NO: 5192522 - DNA, 14 bp, Homo sapiens
agccttatcaagtg

SEQ ID NO: 5192523 - DNA, 18 bp, Homo sapiens
agccttatcaagtgtctt

SEQ ID NO: 5192524 - DNA, 15 bp, Homo sapiens
agccttatccagcat

SEQ ID NO: 5192525 - DNA, 14 bp, Homo sapiens
agccttatcctctg

SEQ ID NO: 5192526 - DNA, 16 bp, Homo sapiens
agccttatgaaaatta

SEQ ID NO: 5192527 - DNA, 20 bp, Homo sapiens
agccttatgaaaattatact

SEQ ID NO: 5192528 - DNA, 13 bp, Homo sapiens
agccttatgtgga

SEQ ID NO: 5192529 - DNA, 14 bp, Homo sapiens
agccttatgtgtta

SEQ ID NO: 5192530 - DNA, 16 bp, Homo sapiens
agccttatgtgttaca

SEQ ID NO: 5192531 - DNA, 18 bp, Homo sapiens
agccttatgtgttacatt

SEQ ID NO: 5192532 - DNA, 13 bp, Homo sapiens
agccttattaaaa

SEQ ID NO: 5192533 - DNA, 19 bp, Homo sapiens
agccttattcaccttttta

SEQ ID NO: 5192534 - DNA, 21 bp, Homo sapiens
agccttattcacctttttaat

SEQ ID NO: 5192535 - DNA, 17 bp, Homo sapiens
agccttattctaaggtg

SEQ ID NO: 5192536 - DNA, 21 bp, Homo sapiens
agccttatttacctagtgcaa

SEQ ID NO: 5192537 - DNA, 16 bp, Homo sapiens
agccttcaagctctga

SEQ ID NO: 5192538 - DNA, 18 bp, Homo sapiens
agccttcaagctctgagg

SEQ ID NO: 5192539 - DNA, 20 bp, Homo sapiens
agccttcaagctctgaggga

SEQ ID NO: 5192540 - DNA, 13 bp, Homo sapiens
agccttcaagtgc

SEQ ID NO: 5192541 - DNA, 23 bp, Homo sapiens
agccttcaatcaacatctcttga

SEQ ID NO: 5192542 - DNA, 16 bp, Homo sapiens
agccttcacatgaaat

SEQ ID NO: 5192543 - DNA, 13 bp, Homo sapiens
agccttcactgga

SEQ ID NO: 5192544 - DNA, 18 bp, Homo sapiens
agccttcagcagcagctc

SEQ ID NO: 5192545 - DNA, 19 bp, Homo sapiens
agccttcagcagcagctca

SEQ ID NO: 5192546 - DNA, 15 bp, Homo sapiens
agccttcaggccagc

SEQ ID NO: 5192547 - DNA, 17 bp, Homo sapiens
agccttcagtcagggtt

SEQ ID NO: 5192548 - DNA, 17 bp, Homo sapiens
agccttcatcagaactc

SEQ ID NO: 5192549 - DNA, 17 bp, Homo sapiens
agccttcatttgcaatt

SEQ ID NO: 5192550 - DNA, 18 bp, Homo sapiens
agccttccaacatttctt

SEQ ID NO: 5192551 - DNA, 18 bp, Homo sapiens
agccttccaactagctgg

SEQ ID NO: 5192552 - DNA, 16 bp, Homo sapiens
agccttccacactcac

SEQ ID NO: 5192553 - DNA, 13 bp, Homo sapiens
agccttccaccca

SEQ ID NO: 5192554 - DNA, 18 bp, Homo sapiens
agccttccaccggcactc

SEQ ID NO: 5192555 - DNA, 11 bp, Homo sapiens
agccttccagg

SEQ ID NO: 5192556 - DNA, 17 bp, Homo sapiens
agccttccaggggtggg

SEQ ID NO: 5192557 - DNA, 23 bp, Homo sapiens
agccttccagtggcttctcccaa

SEQ ID NO: 5192558 - DNA, 12 bp, Homo sapiens
agccttcccatt

SEQ ID NO: 5192559 - DNA, 15 bp, Homo sapiens
agccttccccagctc

SEQ ID NO: 5192560 - DNA, 19 bp, Homo sapiens
agccttccccagctccagc

SEQ ID NO: 5192561 - DNA, 13 bp, Homo sapiens
agccttcccccag

SEQ ID NO: 5192562 - DNA, 21 bp, Homo sapiens
agccttccccttatcctccct

SEQ ID NO: 5192563 - DNA, 20 bp, Homo sapiens
agccttccccttgcccaggg

SEQ ID NO: 5192564 - DNA, 16 bp, Homo sapiens
agccttccctctgcat

SEQ ID NO: 5192565 - DNA, 19 bp, Homo sapiens
agccttcctccatggccca

SEQ ID NO: 5192566 - DNA, 14 bp, Homo sapiens
agccttcctctgca

SEQ ID NO: 5192567 - DNA, 17 bp, Homo sapiens
agccttcctctgcagct

SEQ ID NO: 5192568 - DNA, 19 bp, Homo sapiens
agccttcctctgcagctga

SEQ ID NO: 5192569 - DNA, 22 bp, Homo sapiens
agccttcctctgcagctgacct

SEQ ID NO: 5192570 - DNA, 17 bp, Homo sapiens
agccttccttctgctcc

SEQ ID NO: 5192571 - DNA, 22 bp, Homo sapiens
agccttccttctgctcccaccc

SEQ ID NO: 5192572 - DNA, 17 bp, Homo sapiens
agccttcgtgtggctcc

SEQ ID NO: 5192573 - DNA, 22 bp, Homo sapiens
agccttcgtgtggctcctggta

SEQ ID NO: 5192574 - DNA, 17 bp, Homo sapiens
agccttctaaattccca

SEQ ID NO: 5192575 - DNA, 18 bp, Homo sapiens
agccttctaaattcccaa

SEQ ID NO: 5192576 - DNA, 19 bp, Homo sapiens
agccttctaaattcccaaa

SEQ ID NO: 5192577 - DNA, 15 bp, Homo sapiens
agccttctcacccca

SEQ ID NO: 5192578 - DNA, 19 bp, Homo sapiens
agccttctcaccccaggat

SEQ ID NO: 5192579 - DNA, 12 bp, Homo sapiens
agccttctccct

SEQ ID NO: 5192580 - DNA, 16 bp, Homo sapiens
agccttctccctagct

SEQ ID NO: 5192581 - DNA, 14 bp, Homo sapiens
agccttctcctccc

SEQ ID NO: 5192582 - DNA, 16 bp, Homo sapiens
agccttctcctcccaa

SEQ ID NO: 5192583 - DNA, 17 bp, Homo sapiens
agccttctcctcccaag

SEQ ID NO: 5192584 - DNA, 11 bp, Homo sapiens
agccttctctc

SEQ ID NO: 5192585 - DNA, 15 bp, Homo sapiens
agccttctctctctg

SEQ ID NO: 5192586 - DNA, 16 bp, Homo sapiens
agccttctctctctgg

SEQ ID NO: 5192587 - DNA, 12 bp, Homo sapiens
agccttctctgt

SEQ ID NO: 5192588 - DNA, 14 bp, Homo sapiens
agccttctctgttc

SEQ ID NO: 5192589 - DNA, 20 bp, Homo sapiens
agccttctctgttcatttcc

SEQ ID NO: 5192590 - DNA, 16 bp, Homo sapiens
agccttctgcagcagg

SEQ ID NO: 5192591 - DNA, 19 bp, Homo sapiens
agccttctgccaccagccc

SEQ ID NO: 5192592 - DNA, 22 bp, Homo sapiens
agccttctgccaccagcccctc

SEQ ID NO: 5192593 - DNA, 15 bp, Homo sapiens
agccttctgtaggaa

SEQ ID NO: 5192594 - DNA, 22 bp, Homo sapiens
agccttcttatatctgaagatt

SEQ ID NO: 5192595 - DNA, 18 bp, Homo sapiens
agccttcttccatcccag

SEQ ID NO: 5192596 - DNA, 22 bp, Homo sapiens
agccttcttccatcccaggaca

SEQ ID NO: 5192597 - DNA, 16 bp, Homo sapiens
agccttcttctgccac

SEQ ID NO: 5192598 - DNA, 21 bp, Homo sapiens
agccttcttctgccacttctg

SEQ ID NO: 5192599 - DNA, 19 bp, Homo sapiens
agccttcttgctgcccaca

SEQ ID NO: 5192600 - DNA, 15 bp, Homo sapiens
agccttctttgcttg

SEQ ID NO: 5192601 - DNA, 19 bp, Homo sapiens
agccttctttgcttgcctc

SEQ ID NO: 5192602 - DNA, 23 bp, Homo sapiens
agccttctttgcttgcctctctg

SEQ ID NO: 5192603 - DNA, 16 bp, Homo sapiens
agccttctttttctgg

SEQ ID NO: 5192604 - DNA, 20 bp, Homo sapiens
agccttctttttctggactc

SEQ ID NO: 5192605 - DNA, 15 bp, Homo sapiens
agccttgaaaacaaa

SEQ ID NO: 5192606 - DNA, 21 bp, Homo sapiens
agccttgaaaacaaacaaatc

SEQ ID NO: 5192607 - DNA, 14 bp, Homo sapiens
agccttgaactctg

SEQ ID NO: 5192608 - DNA, 18 bp, Homo sapiens
agccttgaactctgggct

SEQ ID NO: 5192609 - DNA, 23 bp, Homo sapiens
agccttgaagaaaatgactttat

SEQ ID NO: 5192610 - DNA, 15 bp, Homo sapiens
agccttgacacactg

SEQ ID NO: 5192611 - DNA, 18 bp, Homo sapiens
agccttgaccattctcca

SEQ ID NO: 5192612 - DNA, 19 bp, Homo sapiens
agccttgaccattctccac

SEQ ID NO: 5192613 - DNA, 21 bp, Homo sapiens
agccttgaccattctccacct

SEQ ID NO: 5192614 - DNA, 17 bp, Homo sapiens
agccttgagccctggct

SEQ ID NO: 5192615 - DNA, 19 bp, Homo sapiens
agccttgagccctggctgt

SEQ ID NO: 5192616 - DNA, 20 bp, Homo sapiens
agccttgataatacttgacc

SEQ ID NO: 5192617 - DNA, 19 bp, Homo sapiens
agccttgattggtgttgcc

SEQ ID NO: 5192618 - DNA, 19 bp, Homo sapiens
agccttgcaacccaaggtg

SEQ ID NO: 5192619 - DNA, 13 bp, Homo sapiens
agccttgcacacc

SEQ ID NO: 5192620 - DNA, 21 bp, Homo sapiens
agccttgcacacccactgccc

SEQ ID NO: 5192621 - DNA, 18 bp, Homo sapiens
agccttgcagcggctcct

SEQ ID NO: 5192622 - DNA, 18 bp, Homo sapiens
agccttgcatcaagggct

SEQ ID NO: 5192623 - DNA, 15 bp, Homo sapiens
agccttgccagagat

SEQ ID NO: 5192624 - DNA, 14 bp, Homo sapiens
agccttgcccagct

SEQ ID NO: 5192625 - DNA, 21 bp, Homo sapiens
agccttgcctaaatttaatgc

SEQ ID NO: 5192626 - DNA, 18 bp, Homo sapiens
agccttgcgctgtcccag

SEQ ID NO: 5192627 - DNA, 19 bp, Homo sapiens
agccttgcgctgtcccagg

SEQ ID NO: 5192628 - DNA, 20 bp, Homo sapiens
agccttgctctcttcaataa

SEQ ID NO: 5192629 - DNA, 21 bp, Homo sapiens
agccttgctgacctcccagcc

SEQ ID NO: 5192630 - DNA, 13 bp, Homo sapiens
agccttgctgcca

SEQ ID NO: 5192631 - DNA, 12 bp, Homo sapiens
agccttgctgct

SEQ ID NO: 5192632 - DNA, 14 bp, Homo sapiens
agccttgctgctct

SEQ ID NO: 5192633 - DNA, 18 bp, Homo sapiens
agccttgctgctctgcgt

SEQ ID NO: 5192634 - DNA, 18 bp, Homo sapiens
agccttgctgtagagact

SEQ ID NO: 5192635 - DNA, 19 bp, Homo sapiens
agccttgctgtagagactt

SEQ ID NO: 5192636 - DNA, 16 bp, Homo sapiens
agccttggatgtatat

SEQ ID NO: 5192637 - DNA, 17 bp, Homo sapiens
agccttggcccacactg

SEQ ID NO: 5192638 - DNA, 22 bp, Homo sapiens
agccttggcctgacctggcaca

SEQ ID NO: 5192639 - DNA, 19 bp, Homo sapiens
agccttggctcgttctctt

SEQ ID NO: 5192640 - DNA, 23 bp, Homo sapiens
agccttgggaacatgcgtgtgac

SEQ ID NO: 5192641 - DNA, 16 bp, Homo sapiens
agccttgggacccctg

SEQ ID NO: 5192642 - DNA, 17 bp, Homo sapiens
agccttgggagccactg

SEQ ID NO: 5192643 - DNA, 20 bp, Homo sapiens
agccttgggagccactgcca

SEQ ID NO: 5192644 - DNA, 23 bp, Homo sapiens
agccttgggagccactgccactc

SEQ ID NO: 5192645 - DNA, 13 bp, Homo sapiens
agccttggggcat

SEQ ID NO: 5192646 - DNA, 22 bp, Homo sapiens
agccttggggggtgggggctgt

SEQ ID NO: 5192647 - DNA, 19 bp, Homo sapiens
agccttggggttggacatc

SEQ ID NO: 5192648 - DNA, 22 bp, Homo sapiens
agccttgggttccaaccaggca

SEQ ID NO: 5192649 - DNA, 19 bp, Homo sapiens
agccttggtgggggagcct

SEQ ID NO: 5192650 - DNA, 17 bp, Homo sapiens
agccttggtgtccacct

SEQ ID NO: 5192651 - DNA, 23 bp, Homo sapiens
agccttggttggacctattgcca

SEQ ID NO: 5192652 - DNA, 22 bp, Homo sapiens
agccttgtaaatgggaaaatat

SEQ ID NO: 5192653 - DNA, 16 bp, Homo sapiens
agccttgtaattctaa

SEQ ID NO: 5192654 - DNA, 14 bp, Homo sapiens
agcagggcggctgc

SEQ ID NO: 5192655 - DNA, 17 bp, Homo sapiens
agcagggcgggccagga

SEQ ID NO: 5192656 - DNA, 20 bp, Homo sapiens
agcagggcgggccaggagaa

SEQ ID NO: 5192657 - DNA, 22 bp, Homo sapiens
agcagggctaaataaagaggag

SEQ ID NO: 5192658 - DNA, 13 bp, Homo sapiens
agcagggctcagc

SEQ ID NO: 5192659 - DNA, 14 bp, Homo sapiens
agcagggctcagcg

SEQ ID NO: 5192660 - DNA, 23 bp, Homo sapiens
agcagggctctgccccagaggcc

SEQ ID NO: 5192661 - DNA, 20 bp, Homo sapiens
agcagggctgggcctgcgag

SEQ ID NO: 5192662 - DNA, 15 bp, Homo sapiens
agcagggctgggcgc

SEQ ID NO: 5192663 - DNA, 13 bp, Homo sapiens
agcagggctgtgt

SEQ ID NO: 5192664 - DNA, 18 bp, Homo sapiens
agcaggggaacaaaataa

SEQ ID NO: 5192665 - DNA, 22 bp, Homo sapiens
agcaggggaattccctccccct

SEQ ID NO: 5192666 - DNA, 13 bp, Homo sapiens
agcaggggagaag

SEQ ID NO: 5192667 - DNA, 15 bp, Homo sapiens
agcaggggcaccttc

SEQ ID NO: 5192668 - DNA, 11 bp, Homo sapiens
agcaggggcag

SEQ ID NO: 5192669 - DNA, 15 bp, Homo sapiens
agcaggggcaggcgc

SEQ ID NO: 5192670 - DNA, 16 bp, Homo sapiens
agcaggggccaagcag

SEQ ID NO: 5192671 - DNA, 14 bp, Homo sapiens
agcaggggcccctg

SEQ ID NO: 5192672 - DNA, 15 bp, Homo sapiens
agcaggggctgctgg

SEQ ID NO: 5192673 - DNA, 20 bp, Homo sapiens
agcagggggagaaacccttc

SEQ ID NO: 5192674 - DNA, 21 bp, Homo sapiens
agcagggggggaaatgcattt

SEQ ID NO: 5192675 - DNA, 23 bp, Homo sapiens
agcaggggggttgggttccagac

SEQ ID NO: 5192676 - DNA, 21 bp, Homo sapiens
agcaggggtggggggtgcagg

SEQ ID NO: 5192677 - DNA, 21 bp, Homo sapiens
agcaggggtgtgatgtaccag

SEQ ID NO: 5192678 - DNA, 21 bp, Homo sapiens
agcaggggttggtcaaggcca

SEQ ID NO: 5192679 - DNA, 17 bp, Homo sapiens
agcagggtaccctttgg

SEQ ID NO: 5192680 - DNA, 21 bp, Homo sapiens
agcagggtaccctttggggag

SEQ ID NO: 5192681 - DNA, 22 bp, Homo sapiens
agcagggtaccctttggggagc

SEQ ID NO: 5192682 - DNA, 15 bp, Homo sapiens
agcagggtccacagc

SEQ ID NO: 5192683 - DNA, 19 bp, Homo sapiens
agcagggtccacagctgga

SEQ ID NO: 5192684 - DNA, 22 bp, Homo sapiens
agcagggtccacagctggaaag

SEQ ID NO: 5192685 - DNA, 18 bp, Homo sapiens
agcagggtcgggaaaggc

SEQ ID NO: 5192686 - DNA, 16 bp, Homo sapiens
agcagggtctgggcag

SEQ ID NO: 5192687 - DNA, 14 bp, Homo sapiens
agcagggtctttgt

SEQ ID NO: 5192688 - DNA, 19 bp, Homo sapiens
agcagggtctttgtgtgct

SEQ ID NO: 5192689 - DNA, 16 bp, Homo sapiens
agcagggtcttttcat

SEQ ID NO: 5192690 - DNA, 20 bp, Homo sapiens
agcagggtcttttcatctgg

SEQ ID NO: 5192691 - DNA, 23 bp, Homo sapiens
agcagggtcttttcatctgggaa

SEQ ID NO: 5192692 - DNA, 15 bp, Homo sapiens
agcagggtgctgtgg

SEQ ID NO: 5192693 - DNA, 15 bp, Homo sapiens
agcagggtggggtct

SEQ ID NO: 5192694 - DNA, 16 bp, Homo sapiens
agcagggtggggtctg

SEQ ID NO: 5192695 - DNA, 14 bp, Homo sapiens
agcaggtaagagct

SEQ ID NO: 5192696 - DNA, 19 bp, Homo sapiens
agcaggtacatttctgatt

SEQ ID NO: 5192697 - DNA, 21 bp, Homo sapiens
agcaggtacatttctgattct

SEQ ID NO: 5192698 - DNA, 19 bp, Homo sapiens
agcaggtaggggcacagtg

SEQ ID NO: 5192699 - DNA, 20 bp, Homo sapiens
agcaggtagtgggtgaatgt

SEQ ID NO: 5192700 - DNA, 23 bp, Homo sapiens
agcaggtagtgggtgaatgtgtg

SEQ ID NO: 5192701 - DNA, 15 bp, Homo sapiens
agcaggtcacactgg

SEQ ID NO: 5192702 - DNA, 14 bp, Homo sapiens
agcaggtctctggc

SEQ ID NO: 5192703 - DNA, 17 bp, Homo sapiens
agcaggtctctggcaga

SEQ ID NO: 5192704 - DNA, 18 bp, Homo sapiens
agcaggtctctggcagag

SEQ ID NO: 5192705 - DNA, 21 bp, Homo sapiens
agcaggtctctggcagagaag

SEQ ID NO: 5192706 - DNA, 16 bp, Homo sapiens
agcaggtctgcaggcc

SEQ ID NO: 5192707 - DNA, 19 bp, Homo sapiens
agcaggtctgcaggccacc

SEQ ID NO: 5192708 - DNA, 20 bp, Homo sapiens
agcaggtctgcaggccacca

SEQ ID NO: 5192709 - DNA, 19 bp, Homo sapiens
agcaggtgactgtgctgtg

SEQ ID NO: 5192710 - DNA, 23 bp, Homo sapiens
agcaggtgattggaccaggccat

SEQ ID NO: 5192711 - DNA, 16 bp, Homo sapiens
agcaggtgcaagagac

SEQ ID NO: 5192712 - DNA, 18 bp, Homo sapiens
agcaggtgcccccaggtg

SEQ ID NO: 5192713 - DNA, 14 bp, Homo sapiens
agcaggtgctacaa

SEQ ID NO: 5192714 - DNA, 18 bp, Homo sapiens
agcaggtgctgctaccct

SEQ ID NO: 5192715 - DNA, 15 bp, Homo sapiens
agcaggtgctgggct

SEQ ID NO: 5192716 - DNA, 14 bp, Homo sapiens
agcaggtggcttgt

SEQ ID NO: 5192717 - DNA, 17 bp, Homo sapiens
agcaggtgggaaatggt

SEQ ID NO: 5192718 - DNA, 13 bp, Homo sapiens
agcaggtggggag

SEQ ID NO: 5192719 - DNA, 16 bp, Homo sapiens
agcaggtgtcctttcc

SEQ ID NO: 5192720 - DNA, 16 bp, Homo sapiens
agcaggtgtggtggct

SEQ ID NO: 5192721 - DNA, 19 bp, Homo sapiens
agcaggtgtggtggctcat

SEQ ID NO: 5192722 - DNA, 22 bp, Homo sapiens
agcaggtgtggtggctcatggc

SEQ ID NO: 5192723 - DNA, 15 bp, Homo sapiens
agcaggttaaatgtt

SEQ ID NO: 5192724 - DNA, 20 bp, Homo sapiens
agcaggttaaatgttttgta

SEQ ID NO: 5192725 - DNA, 22 bp, Homo sapiens
agcaggttaaatgttttgtaaa

SEQ ID NO: 5192726 - DNA, 14 bp, Homo sapiens
agcaggttagagaa

SEQ ID NO: 5192727 - DNA, 18 bp, Homo sapiens
agcaggttcccaagctca

SEQ ID NO: 5192728 - DNA, 14 bp, Homo sapiens
agcaggttcttgat

SEQ ID NO: 5192729 - DNA, 16 bp, Homo sapiens
agcaggttcttgatgt

SEQ ID NO: 5192730 - DNA, 17 bp, Homo sapiens
agcaggttgcttcaaga

SEQ ID NO: 5192731 - DNA, 20 bp, Homo sapiens
agcaggttggcttttttccc

SEQ ID NO: 5192732 - DNA, 20 bp, Homo sapiens
agcaggtttgttttcagcac

SEQ ID NO: 5192733 - DNA, 15 bp, Homo sapiens
agcagtaaaaactgt

SEQ ID NO: 5192734 - DNA, 19 bp, Homo sapiens
agcagtaaaagataaattt

SEQ ID NO: 5192735 - DNA, 21 bp, Homo sapiens
agcagtaaaagatgaagtttt

SEQ ID NO: 5192736 - DNA, 19 bp, Homo sapiens
agcagtaaactttctctgc

SEQ ID NO: 5192737 - DNA, 16 bp, Homo sapiens
agcagtaaatgtatat

SEQ ID NO: 5192738 - DNA, 15 bp, Homo sapiens
agcagtaagggaaca

SEQ ID NO: 5192739 - DNA, 12 bp, Homo sapiens
agcagtacatct

SEQ ID NO: 5192740 - DNA, 19 bp, Homo sapiens
agcagtacatcttgtgcat

SEQ ID NO: 5192741 - DNA, 15 bp, Homo sapiens
agcagtacatgggaa

SEQ ID NO: 5192742 - DNA, 20 bp, Homo sapiens
agcagtacttgctcaataaa

SEQ ID NO: 5192743 - DNA, 21 bp, Homo sapiens
agcagtagaaataatatgcat

SEQ ID NO: 5192744 - DNA, 22 bp, Homo sapiens
agcagtagaaataatatgcatt

SEQ ID NO: 5192745 - DNA, 14 bp, Homo sapiens
agcagtagacattt

SEQ ID NO: 5192746 - DNA, 20 bp, Homo sapiens
agcagtagacattttaacaa

SEQ ID NO: 5192747 - DNA, 22 bp, Homo sapiens
agcagtaggatattggcatttg

SEQ ID NO: 5192748 - DNA, 23 bp, Homo sapiens
agcagtaggatattggcatttgt

SEQ ID NO: 5192749 - DNA, 15 bp, Homo sapiens
agcagtatatgttaa

SEQ ID NO: 5192750 - DNA, 11 bp, Homo sapiens
agcagtatttt

SEQ ID NO: 5192751 - DNA, 12 bp, Homo sapiens
agcagtattttt

SEQ ID NO: 5192752 - DNA, 11 bp, Homo sapiens
agcagtcacaa

SEQ ID NO: 5192753 - DNA, 12 bp, Homo sapiens
agcagtcacagg

SEQ ID NO: 5192754 - DNA, 17 bp, Homo sapiens
agcagtcacaggcccag

SEQ ID NO: 5192755 - DNA, 19 bp, Homo sapiens
agcagtcacaggcccagga

SEQ ID NO: 5192756 - DNA, 23 bp, Homo sapiens
agcagtcacaggcccaggaaggc

SEQ ID NO: 5192757 - DNA, 21 bp, Homo sapiens
agcagtcacaggtcttttctt

SEQ ID NO: 5192758 - DNA, 22 bp, Homo sapiens
agcagtcactttgcttaagatg

SEQ ID NO: 5192759 - DNA, 17 bp, Homo sapiens
agcagtcagagtccagt

SEQ ID NO: 5192760 - DNA, 19 bp, Homo sapiens
agcagtcagagtccagtgc

SEQ ID NO: 5192761 - DNA, 13 bp, Homo sapiens
agcagtcagccct

SEQ ID NO: 5192762 - DNA, 15 bp, Homo sapiens
agcagtcagccctta

SEQ ID NO: 5192763 - DNA, 17 bp, Homo sapiens
agcagtcaggaaagaga

SEQ ID NO: 5192764 - DNA, 18 bp, Homo sapiens
agcagtcaggaaagagaa

SEQ ID NO: 5192765 - DNA, 15 bp, Homo sapiens
agcagtccatgcatg

SEQ ID NO: 5192766 - DNA, 15 bp, Homo sapiens
agcagtcccattcat

SEQ ID NO: 5192767 - DNA, 23 bp, Homo sapiens
agcagtcgcctgcctgcagcagg

SEQ ID NO: 5192768 - DNA, 14 bp, Homo sapiens
agcagtcgtgcctg

SEQ ID NO: 5192769 - DNA, 17 bp, Homo sapiens
agcagtcgtgcctgtgt

SEQ ID NO: 5192770 - DNA, 19 bp, Homo sapiens
agcagtcgtgcctgtgtcc

SEQ ID NO: 5192771 - DNA, 12 bp, Homo sapiens
agcagtctaaat

SEQ ID NO: 5192772 - DNA, 14 bp, Homo sapiens
agcagtctaaattt

SEQ ID NO: 5192773 - DNA, 16 bp, Homo sapiens
agcagtctaaattttc

SEQ ID NO: 5192774 - DNA, 20 bp, Homo sapiens
agcagtctaaattttctaaa

SEQ ID NO: 5192775 - DNA, 21 bp, Homo sapiens
agcagtctaaattttctaaat

SEQ ID NO: 5192776 - DNA, 15 bp, Homo sapiens
agcagtctaatctag

SEQ ID NO: 5192777 - DNA, 19 bp, Homo sapiens
agcagtctccttcagcacg

SEQ ID NO: 5192778 - DNA, 20 bp, Homo sapiens
agcagtctctgccttgcctt

SEQ ID NO: 5192779 - DNA, 19 bp, Homo sapiens
agcagtcttatgcttccag

SEQ ID NO: 5192780 - DNA, 20 bp, Homo sapiens
agcagtcttatgcttccaga

SEQ ID NO: 5192781 - DNA, 20 bp, Homo sapiens
agcagtgaatgattcagtgt

SEQ ID NO: 5192782 - DNA, 20 bp, Homo sapiens
agcagtgaatgctagacaga

SEQ ID NO: 5192783 - DNA, 16 bp, Homo sapiens
agcagtgagaaaaagc

SEQ ID NO: 5192784 - DNA, 21 bp, Homo sapiens
agcagtgagaaaaagctcctg

SEQ ID NO: 5192785 - DNA, 16 bp, Homo sapiens
agcagtgagagcagat

SEQ ID NO: 5192786 - DNA, 15 bp, Homo sapiens
agcagtgagcagggt

SEQ ID NO: 5192787 - DNA, 24 bp, Homo sapiens
agcagtgagtattggaagacttgg

SEQ ID NO: 5192788 - DNA, 14 bp, Homo sapiens
agcagtgagtgacc

SEQ ID NO: 5192789 - DNA, 15 bp, Homo sapiens
agcagtgattctctc

SEQ ID NO: 5192790 - DNA, 21 bp, Homo sapiens
agcagtgattgaagtatctgt

SEQ ID NO: 5192791 - DNA, 19 bp, Homo sapiens
agcagtgattgtcttaata

SEQ ID NO: 5192792 - DNA, 23 bp, Homo sapiens
agcagtgcacatttcatagtttc

SEQ ID NO: 5192793 - DNA, 13 bp, Homo sapiens
agcagtgcatgct

SEQ ID NO: 5192794 - DNA, 16 bp, Homo sapiens
agcagtgcatgctgtc

SEQ ID NO: 5192795 - DNA, 23 bp, Homo sapiens
agcagtgccaatcgggcagaagt

SEQ ID NO: 5192796 - DNA, 16 bp, Homo sapiens
agcagtgcccaggtgg

SEQ ID NO: 5192797 - DNA, 15 bp, Homo sapiens
agcagtgcctcgagg

SEQ ID NO: 5192798 - DNA, 14 bp, Homo sapiens
agcagtgctgggcc

SEQ ID NO: 5192799 - DNA, 15 bp, Homo sapiens
agcagtgctgggccc

SEQ ID NO: 5192800 - DNA, 16 bp, Homo sapiens
agcagtgctgggccca

SEQ ID NO: 5192801 - DNA, 20 bp, Homo sapiens
agcagtgctgggcccagccg

SEQ ID NO: 5192802 - DNA, 17 bp, Homo sapiens
agcagtggagagtgttc

SEQ ID NO: 5192803 - DNA, 16 bp, Homo sapiens
agcagtggagcccagg

SEQ ID NO: 5192804 - DNA, 16 bp, Homo sapiens
agcagtggatgttagc

SEQ ID NO: 5192805 - DNA, 14 bp, Homo sapiens
agcagtggcaaaat

SEQ ID NO: 5192806 - DNA, 22 bp, Homo sapiens
agcagtggcaggcagaggccca

SEQ ID NO: 5192807 - DNA, 19 bp, Homo sapiens
agcagtggccatcatcctc

SEQ ID NO: 5192808 - DNA, 20 bp, Homo sapiens
agcagtggccgggctgggga

SEQ ID NO: 5192809 - DNA, 23 bp, Homo sapiens
agcagtggcctacaaatcagtaa

SEQ ID NO: 5192810 - DNA, 20 bp, Homo sapiens
agcagtggcctttgcaattg

SEQ ID NO: 5192811 - DNA, 22 bp, Homo sapiens
agcagtggcctttttctgagat

SEQ ID NO: 5192812 - DNA, 11 bp, Homo sapiens
agcagtggctg

SEQ ID NO: 5192813 - DNA, 19 bp, Homo sapiens
agcagtggctggtccaggg

SEQ ID NO: 5192814 - DNA, 15 bp, Homo sapiens
agcagtgggcaggtg

SEQ ID NO: 5192815 - DNA, 19 bp, Homo sapiens
agcagtgggcaggtggccg

SEQ ID NO: 5192816 - DNA, 21 bp, Homo sapiens
agcagtgggcaggtggccgcc

SEQ ID NO: 5192817 - DNA, 21 bp, Homo sapiens
agcagtggggtaggctgctgc

SEQ ID NO: 5192818 - DNA, 15 bp, Homo sapiens
agcagtgtcatcaga

SEQ ID NO: 5192819 - DNA, 13 bp, Homo sapiens
agcagtgtcccct

SEQ ID NO: 5192820 - DNA, 15 bp, Homo sapiens
agcagtgtcccctgc

SEQ ID NO: 5192821 - DNA, 19 bp, Homo sapiens
agcagtgtcccctgcccca

SEQ ID NO: 5192822 - DNA, 23 bp, Homo sapiens
agcagtgtcctgtgctttctgca

SEQ ID NO: 5192823 - DNA, 14 bp, Homo sapiens
agcagtgtctctca

SEQ ID NO: 5192824 - DNA, 19 bp, Homo sapiens
agcagtgtgaagtacaata

SEQ ID NO: 5192825 - DNA, 17 bp, Homo sapiens
agcagtgtgagggtgca

SEQ ID NO: 5192826 - DNA, 16 bp, Homo sapiens
agcagtgtgtctcctg

SEQ ID NO: 5192827 - DNA, 22 bp, Homo sapiens
agcagtgtgtctcctgcatgca

SEQ ID NO: 5192828 - DNA, 20 bp, Homo sapiens
agcagtgttacttgcaggta

SEQ ID NO: 5192829 - DNA, 14 bp, Homo sapiens
agcagtgttctcac

SEQ ID NO: 5192830 - DNA, 20 bp, Homo sapiens
agcagtgttctctctgaatg

SEQ ID NO: 5192831 - DNA, 15 bp, Homo sapiens
agcagtgttgctcag

SEQ ID NO: 5192832 - DNA, 19 bp, Homo sapiens
agccttgtacagtctgctc

SEQ ID NO: 5192833 - DNA, 14 bp, Homo sapiens
agccttgtcagtgt

SEQ ID NO: 5192834 - DNA, 15 bp, Homo sapiens
agccttgtccccctc

SEQ ID NO: 5192835 - DNA, 15 bp, Homo sapiens
agccttgtgccctgc

SEQ ID NO: 5192836 - DNA, 17 bp, Homo sapiens
agccttgtgccctgccc

SEQ ID NO: 5192837 - DNA, 20 bp, Homo sapiens
agccttgtgccctgccccca

SEQ ID NO: 5192838 - DNA, 21 bp, Homo sapiens
agccttgtgccctgcccccat

SEQ ID NO: 5192839 - DNA, 21 bp, Homo sapiens
agccttgtgggtgtgagcagc

SEQ ID NO: 5192840 - DNA, 20 bp, Homo sapiens
agccttgtgtatatttgtat

SEQ ID NO: 5192841 - DNA, 16 bp, Homo sapiens
agccttgtgtctacag

SEQ ID NO: 5192842 - DNA, 17 bp, Homo sapiens
agccttgtgtctacaga

SEQ ID NO: 5192843 - DNA, 15 bp, Homo sapiens
agccttgtttctgat

SEQ ID NO: 5192844 - DNA, 21 bp, Homo sapiens
agcctttaaattgttcctctt

SEQ ID NO: 5192845 - DNA, 13 bp, Homo sapiens
agcctttaatgca

SEQ ID NO: 5192846 - DNA, 15 bp, Homo sapiens
agcctttaatgcatc

SEQ ID NO: 5192847 - DNA, 13 bp, Homo sapiens
agcctttcatttt

SEQ ID NO: 5192848 - DNA, 15 bp, Homo sapiens
agcctttccagcctc

SEQ ID NO: 5192849 - DNA, 23 bp, Homo sapiens
agcctttccataaggaatgtagc

SEQ ID NO: 5192850 - DNA, 14 bp, Homo sapiens
agcctttcctcggt

SEQ ID NO: 5192851 - DNA, 21 bp, Homo sapiens
agcctttctccagcccatgct

SEQ ID NO: 5192852 - DNA, 23 bp, Homo sapiens
agcctttctgtatcaagcccctg

SEQ ID NO: 5192853 - DNA, 12 bp, Homo sapiens
agcctttcttcc

SEQ ID NO: 5192854 - DNA, 13 bp, Homo sapiens
agcctttcttcct

SEQ ID NO: 5192855 - DNA, 14 bp, Homo sapiens
agcctttgaatgta

SEQ ID NO: 5192856 - DNA, 16 bp, Homo sapiens
agcctttgaatgtaac

SEQ ID NO: 5192857 - DNA, 19 bp, Homo sapiens
agcctttgaatgtaaccaa

SEQ ID NO: 5192858 - DNA, 12 bp, Homo sapiens
agcctttgacct

SEQ ID NO: 5192859 - DNA, 18 bp, Homo sapiens
agcctttgacctgttcag

SEQ ID NO: 5192860 - DNA, 20 bp, Homo sapiens
agcctttgcccaaaactgtc

SEQ ID NO: 5192861 - DNA, 16 bp, Homo sapiens
agcctttgccctgtca

SEQ ID NO: 5192862 - DNA, 13 bp, Homo sapiens
agcctttgccttt

SEQ ID NO: 5192863 - DNA, 14 bp, Homo sapiens
agcctttgctccct

SEQ ID NO: 5192864 - DNA, 17 bp, Homo sapiens
agcctttgctccctccc

SEQ ID NO: 5192865 - DNA, 17 bp, Homo sapiens
agcctttggccttggct

SEQ ID NO: 5192866 - DNA, 21 bp, Homo sapiens
agcctttggctctggagacag

SEQ ID NO: 5192867 - DNA, 17 bp, Homo sapiens
agcctttgggaaatgct

SEQ ID NO: 5192868 - DNA, 22 bp, Homo sapiens
agcctttgggtcctgggcaggt

SEQ ID NO: 5192869 - DNA, 18 bp, Homo sapiens
agcctttggttctggcca

SEQ ID NO: 5192870 - DNA, 22 bp, Homo sapiens
agcctttgtgctttttgtcatg

SEQ ID NO: 5192871 - DNA, 23 bp, Homo sapiens
agcctttgtggtttagttataaa

SEQ ID NO: 5192872 - DNA, 14 bp, Homo sapiens
agccttttatctgc

SEQ ID NO: 5192873 - DNA, 18 bp, Homo sapiens
agccttttatgtattttc

SEQ ID NO: 5192874 - DNA, 17 bp, Homo sapiens
agccttttattaacata

SEQ ID NO: 5192875 - DNA, 17 bp, Homo sapiens
agccttttcacccttct

SEQ ID NO: 5192876 - DNA, 23 bp, Homo sapiens
agccttttccctctttggctccc

SEQ ID NO: 5192877 - DNA, 15 bp, Homo sapiens
agccttttcctgagg

SEQ ID NO: 5192878 - DNA, 14 bp, Homo sapiens
agccttttcttata

SEQ ID NO: 5192879 - DNA, 19 bp, Homo sapiens
agccttttgcaaatagtag

SEQ ID NO: 5192880 - DNA, 14 bp, Homo sapiens
agccttttgctctc

SEQ ID NO: 5192881 - DNA, 13 bp, Homo sapiens
agccttttgtaac

SEQ ID NO: 5192882 - DNA, 17 bp, Homo sapiens
agcctttttaaaacaca

SEQ ID NO: 5192883 - DNA, 18 bp, Homo sapiens
agcctttttaaaacacat

SEQ ID NO: 5192884 - DNA, 15 bp, Homo sapiens
agcctttttacctgg

SEQ ID NO: 5192885 - DNA, 16 bp, Homo sapiens
agcctttttctaggcc

SEQ ID NO: 5192886 - DNA, 14 bp, Homo sapiens
agcctttttgaaag

SEQ ID NO: 5192887 - DNA, 17 bp, Homo sapiens
agcctttttgtaattta

SEQ ID NO: 5192888 - DNA, 21 bp, Homo sapiens
agccttttttccccagacttg

SEQ ID NO: 5192889 - DNA, 20 bp, Homo sapiens
agcctttttttaggccacat

SEQ ID NO: 5192890 - DNA, 22 bp, Homo sapiens
agcgaaaatgtattattgtaaa

SEQ ID NO: 5192891 - DNA, 13 bp, Homo sapiens
agcgaaactccat

SEQ ID NO: 5192892 - DNA, 12 bp, Homo sapiens
agcgaaagagca

SEQ ID NO: 5192893 - DNA, 15 bp, Homo sapiens
agcgaacaaccacag

SEQ ID NO: 5192894 - DNA, 16 bp, Homo sapiens
agcgaacatcttcata

SEQ ID NO: 5192895 - DNA, 17 bp, Homo sapiens
agcgaacatcttcatat

SEQ ID NO: 5192896 - DNA, 18 bp, Homo sapiens
agcgaacgtatttctcca

SEQ ID NO: 5192897 - DNA, 23 bp, Homo sapiens
agcgaacttcacataggaaggga

SEQ ID NO: 5192898 - DNA, 18 bp, Homo sapiens
agcgaagacccggccagg

SEQ ID NO: 5192899 - DNA, 17 bp, Homo sapiens
agcgaagcccccactac

SEQ ID NO: 5192900 - DNA, 18 bp, Homo sapiens
agcgaagcccccactact

SEQ ID NO: 5192901 - DNA, 16 bp, Homo sapiens
agcgaagccttctgca

SEQ ID NO: 5192902 - DNA, 15 bp, Homo sapiens
agcgaaggaacctct

SEQ ID NO: 5192903 - DNA, 17 bp, Homo sapiens
agcgaaggaacctctcg

SEQ ID NO: 5192904 - DNA, 17 bp, Homo sapiens
agcgaagtagcttgctc

SEQ ID NO: 5192905 - DNA, 16 bp, Homo sapiens
agcgaattcagaaaga

SEQ ID NO: 5192906 - DNA, 17 bp, Homo sapiens
agcgacaacagattgga

SEQ ID NO: 5192907 - DNA, 16 bp, Homo sapiens
agcgacacaggctgcc

SEQ ID NO: 5192908 - DNA, 23 bp, Homo sapiens
agcgacagaaaacctcaagggct

SEQ ID NO: 5192909 - DNA, 11 bp, Homo sapiens
agcgacagatt

SEQ ID NO: 5192910 - DNA, 15 bp, Homo sapiens
agcgacagtgagact

SEQ ID NO: 5192911 - DNA, 21 bp, Homo sapiens
agcgacatagcccatccctgc

SEQ ID NO: 5192912 - DNA, 13 bp, Homo sapiens
agcgaccaaggat

SEQ ID NO: 5192913 - DNA, 19 bp, Homo sapiens
agcgaccacccctgcctcc

SEQ ID NO: 5192914 - DNA, 13 bp, Homo sapiens
agcgaccagcagg

SEQ ID NO: 5192915 - DNA, 15 bp, Homo sapiens
agcgaccagcaggct

SEQ ID NO: 5192916 - DNA, 16 bp, Homo sapiens
agcgaccagcaggctc

SEQ ID NO: 5192917 - DNA, 18 bp, Homo sapiens
agcgaccagcaggctcct

SEQ ID NO: 5192918 - DNA, 19 bp, Homo sapiens
agcgaccagcaggctcctc

SEQ ID NO: 5192919 - DNA, 12 bp, Homo sapiens
agcgaccctggc

SEQ ID NO: 5192920 - DNA, 17 bp, Homo sapiens
agcgaccctggctctgc

SEQ ID NO: 5192921 - DNA, 17 bp, Homo sapiens
agcgacctctctgcctc

SEQ ID NO: 5192922 - DNA, 19 bp, Homo sapiens
agcgacctctctgcctctc

SEQ ID NO: 5192923 - DNA, 17 bp, Homo sapiens
agcgacgctcccctgag

SEQ ID NO: 5192924 - DNA, 20 bp, Homo sapiens
agcgactccgttggccactc

SEQ ID NO: 5192925 - DNA, 13 bp, Homo sapiens
agcgactctcctg

SEQ ID NO: 5192926 - DNA, 20 bp, Homo sapiens
agcgactctcctgcctcagc

SEQ ID NO: 5192927 - DNA, 22 bp, Homo sapiens
agcgactctcctgcctcagcct

SEQ ID NO: 5192928 - DNA, 19 bp, Homo sapiens
agcgactggatgctcgcca

SEQ ID NO: 5192929 - DNA, 12 bp, Homo sapiens
agcgagaccctt

SEQ ID NO: 5192930 - DNA, 17 bp, Homo sapiens
agcgagactccatctct

SEQ ID NO: 5192931 - DNA, 15 bp, Homo sapiens
agcgagactttgtcc

SEQ ID NO: 5192932 - DNA, 15 bp, Homo sapiens
agcgagcaagccggc

SEQ ID NO: 5192933 - DNA, 22 bp, Homo sapiens
agcgagcccctcggctctggag

SEQ ID NO: 5192934 - DNA, 13 bp, Homo sapiens
agcgagccctggt

SEQ ID NO: 5192935 - DNA, 15 bp, Homo sapiens
agcgaggaaaaacaa

SEQ ID NO: 5192936 - DNA, 17 bp, Homo sapiens
agcgaggaaaaacaaca

SEQ ID NO: 5192937 - DNA, 20 bp, Homo sapiens
agcgaggaaaaacaacaaat

SEQ ID NO: 5192938 - DNA, 19 bp, Homo sapiens
agcgaggaaaggattttac

SEQ ID NO: 5192939 - DNA, 20 bp, Homo sapiens
agcgaggagatgctccttgg

SEQ ID NO: 5192940 - DNA, 21 bp, Homo sapiens
agcgaggaggcgcggcctccc

SEQ ID NO: 5192941 - DNA, 19 bp, Homo sapiens
agcgaggaggctccagagg

SEQ ID NO: 5192942 - DNA, 15 bp, Homo sapiens
agcgaggcgaggctg

SEQ ID NO: 5192943 - DNA, 23 bp, Homo sapiens
agcgaggcgaggctgcctctggg

SEQ ID NO: 5192944 - DNA, 17 bp, Homo sapiens
agcgaggctctaaccac

SEQ ID NO: 5192945 - DNA, 15 bp, Homo sapiens
agcgagggcagctgc

SEQ ID NO: 5192946 - DNA, 16 bp, Homo sapiens
agcgagggcagctgct

SEQ ID NO: 5192947 - DNA, 17 bp, Homo sapiens
agcgagggcagctgcta

SEQ ID NO: 5192948 - DNA, 20 bp, Homo sapiens
agcgaggtgggagaggcctc

SEQ ID NO: 5192949 - DNA, 17 bp, Homo sapiens
agcgagtaaagtctggg

SEQ ID NO: 5192950 - DNA, 19 bp, Homo sapiens
agcgagtaccccagccact

SEQ ID NO: 5192951 - DNA, 22 bp, Homo sapiens
agcgagtcatttcgttccctga

SEQ ID NO: 5192952 - DNA, 16 bp, Homo sapiens
agcgagtgcatgggct

SEQ ID NO: 5192953 - DNA, 17 bp, Homo sapiens
agcgagtgctctcactg

SEQ ID NO: 5192954 - DNA, 19 bp, Homo sapiens
agcgagtggagtctgccac

SEQ ID NO: 5192955 - DNA, 19 bp, Homo sapiens
agcgagttggtcaccgctc

SEQ ID NO: 5192956 - DNA, 19 bp, Homo sapiens
agcgatccctcccctcagc

SEQ ID NO: 5192957 - DNA, 16 bp, Homo sapiens
agcgatcctccttcct

SEQ ID NO: 5192958 - DNA, 16 bp, Homo sapiens
agcgatcgctcccctg

SEQ ID NO: 5192959 - DNA, 17 bp, Homo sapiens
agcgatctctcctggcc

SEQ ID NO: 5192960 - DNA, 19 bp, Homo sapiens
agcgatctctcctggccta

SEQ ID NO: 5192961 - DNA, 13 bp, Homo sapiens
agcgatggcaggc

SEQ ID NO: 5192962 - DNA, 16 bp, Homo sapiens
agcgatggcaggcctg

SEQ ID NO: 5192963 - DNA, 17 bp, Homo sapiens
agcgatggcaggcctga

SEQ ID NO: 5192964 - DNA, 21 bp, Homo sapiens
agcgatggcaggcctgaccca

SEQ ID NO: 5192965 - DNA, 18 bp, Homo sapiens
agcgatgggcccctggcc

SEQ ID NO: 5192966 - DNA, 21 bp, Homo sapiens
agcgatggtgctgcccaggcc

SEQ ID NO: 5192967 - DNA, 14 bp, Homo sapiens
agcgatgtgcagga

SEQ ID NO: 5192968 - DNA, 15 bp, Homo sapiens
agcgatgtgcaggaa

SEQ ID NO: 5192969 - DNA, 17 bp, Homo sapiens
agcgatgtgcaggaaga

SEQ ID NO: 5192970 - DNA, 14 bp, Homo sapiens
agcgatgtgttctt

SEQ ID NO: 5192971 - DNA, 19 bp, Homo sapiens
agcgattattatctaaagt

SEQ ID NO: 5192972 - DNA, 19 bp, Homo sapiens
agcgattccctctcccagg

SEQ ID NO: 5192973 - DNA, 21 bp, Homo sapiens
agcgattctcccgcctcagcc

SEQ ID NO: 5192974 - DNA, 22 bp, Homo sapiens
agcgattctcccgcctcagcct

SEQ ID NO: 5192975 - DNA, 23 bp, Homo sapiens
agcgattctcccgcctcagcctc

SEQ ID NO: 5192976 - DNA, 16 bp, Homo sapiens
agcgattctcctgcct

SEQ ID NO: 5192977 - DNA, 20 bp, Homo sapiens
agcgattctcctgcctcagc

SEQ ID NO: 5192978 - DNA, 24 bp, Homo sapiens
agcgattctcctgcctcagcctcc

SEQ ID NO: 5192979 - DNA, 17 bp, Homo sapiens
agcgattcttctgcttc

SEQ ID NO: 5192980 - DNA, 19 bp, Homo sapiens
agcgattcttctgcttcag

SEQ ID NO: 5192981 - DNA, 21 bp, Homo sapiens
agcgattgattgatgtacaga

SEQ ID NO: 5192982 - DNA, 15 bp, Homo sapiens
agcgatttgaaacac

SEQ ID NO: 5192983 - DNA, 21 bp, Homo sapiens
agcgcaaagtgctagccactg

SEQ ID NO: 5192984 - DNA, 18 bp, Homo sapiens
agcgcacccagagaaaat

SEQ ID NO: 5192985 - DNA, 12 bp, Homo sapiens
agcgcacctgcc

SEQ ID NO: 5192986 - DNA, 14 bp, Homo sapiens
agcgcacctgcccc

SEQ ID NO: 5192987 - DNA, 19 bp, Homo sapiens
agcgcacctgccccctggt

SEQ ID NO: 5192988 - DNA, 15 bp, Homo sapiens
agcgcacctgcttcc

SEQ ID NO: 5192989 - DNA, 19 bp, Homo sapiens
agcgcacgcgcgcacacac

SEQ ID NO: 5192990 - DNA, 17 bp, Homo sapiens
agcgcagagtagctgct

SEQ ID NO: 5192991 - DNA, 14 bp, Homo sapiens
agcgcagcccccac

SEQ ID NO: 5192992 - DNA, 21 bp, Homo sapiens
agcgcagccgccgggcaggcc

SEQ ID NO: 5192993 - DNA, 13 bp, Homo sapiens
agcgcagcgcctc

SEQ ID NO: 5192994 - DNA, 12 bp, Homo sapiens
agcgcaggctgc

SEQ ID NO: 5192995 - DNA, 13 bp, Homo sapiens
agcgcaggctgca

SEQ ID NO: 5192996 - DNA, 18 bp, Homo sapiens
agcgcaggctgcagagcc

SEQ ID NO: 5192997 - DNA, 19 bp, Homo sapiens
agcgcagggaggatgccac

SEQ ID NO: 5192998 - DNA, 18 bp, Homo sapiens
agcgcagggctggcacgt

SEQ ID NO: 5192999 - DNA, 20 bp, Homo sapiens
agcgcatggcgccccgggcc

SEQ ID NO: 5193000 - DNA, 14 bp, Homo sapiens
agcgcatgtgtgca

SEQ ID NO: 5193001 - DNA, 20 bp, Homo sapiens
agcgcatgtgtgcatgtgct

SEQ ID NO: 5193002 - DNA, 22 bp, Homo sapiens
agcgcatgtgtgcatgtgctgt

SEQ ID NO: 5193003 - DNA, 21 bp, Homo sapiens
agcgcatttgatttctccagg

SEQ ID NO: 5193004 - DNA, 13 bp, Homo sapiens
agcgccacccagt

SEQ ID NO: 5193005 - DNA, 13 bp, Homo sapiens
agcgccagcctca

SEQ ID NO: 5193006 - DNA, 19 bp, Homo sapiens
agcgccaggaagccagagc

SEQ ID NO: 5193007 - DNA, 20 bp, Homo sapiens
agcgccaggaagccagagcc

SEQ ID NO: 5193008 - DNA, 15 bp, Homo sapiens
agcgccaggctggag

SEQ ID NO: 5193009 - DNA, 16 bp, Homo sapiens
agcgccaggctggaga

SEQ ID NO: 5193010 - DNA, 22 bp, Homo sapiens
agcgccagtgtaatcccccagg

SEQ ID NO: 5193011 - DNA, 17 bp, Homo sapiens
agcagtgttgctcagct

SEQ ID NO: 5193012 - DNA, 14 bp, Homo sapiens
agcagtgtttaaaa

SEQ ID NO: 5193013 - DNA, 15 bp, Homo sapiens
agcagtgtttaaaaa

SEQ ID NO: 5193014 - DNA, 17 bp, Homo sapiens
agcagtgtttaaaaaat

SEQ ID NO: 5193015 - DNA, 19 bp, Homo sapiens
agcagttaatttatatatt

SEQ ID NO: 5193016 - DNA, 19 bp, Homo sapiens
agcagttaccgaggagcta

SEQ ID NO: 5193017 - DNA, 13 bp, Homo sapiens
agcagttactgtg

SEQ ID NO: 5193018 - DNA, 23 bp, Homo sapiens
agcagttagttagttagttactc

SEQ ID NO: 5193019 - DNA, 21 bp, Homo sapiens
agcagttatggtgatgactta

SEQ ID NO: 5193020 - DNA, 22 bp, Homo sapiens
agcagttattcccttacctgaa

SEQ ID NO: 5193021 - DNA, 22 bp, Homo sapiens
agcagttcaataatccatgaaa

SEQ ID NO: 5193022 - DNA, 22 bp, Homo sapiens
agcagttcacctatttcaaaaa

SEQ ID NO: 5193023 - DNA, 20 bp, Homo sapiens
agcagttcagagctgccctc

SEQ ID NO: 5193024 - DNA, 23 bp, Homo sapiens
agcagttcagagctgccctctcc

SEQ ID NO: 5193025 - DNA, 13 bp, Homo sapiens
agcagttcatgtc

SEQ ID NO: 5193026 - DNA, 14 bp, Homo sapiens
agcagttctcccac

SEQ ID NO: 5193027 - DNA, 20 bp, Homo sapiens
agcagttctcctgcctcagc

SEQ ID NO: 5193028 - DNA, 12 bp, Homo sapiens
agcagttctgat

SEQ ID NO: 5193029 - DNA, 17 bp, Homo sapiens
agcagttctgcagagga

SEQ ID NO: 5193030 - DNA, 12 bp, Homo sapiens
agcagttctgtt

SEQ ID NO: 5193031 - DNA, 21 bp, Homo sapiens
agcagttgcaataaactcagt

SEQ ID NO: 5193032 - DNA, 18 bp, Homo sapiens
agcagttgcaatgatcag

SEQ ID NO: 5193033 - DNA, 22 bp, Homo sapiens
agcagttgctagcaacaactta

SEQ ID NO: 5193034 - DNA, 17 bp, Homo sapiens
agcagttgctcacatgt

SEQ ID NO: 5193035 - DNA, 16 bp, Homo sapiens
agcagttgctggtaaa

SEQ ID NO: 5193036 - DNA, 17 bp, Homo sapiens
agcagttggcctgtgct

SEQ ID NO: 5193037 - DNA, 21 bp, Homo sapiens
agcagttggcctgtgcttgga

SEQ ID NO: 5193038 - DNA, 15 bp, Homo sapiens
agcagttggggccct

SEQ ID NO: 5193039 - DNA, 22 bp, Homo sapiens
agcagttggggccctcttgcca

SEQ ID NO: 5193040 - DNA, 17 bp, Homo sapiens
agcagttgttattacat

SEQ ID NO: 5193041 - DNA, 13 bp, Homo sapiens
agcagtttattat

SEQ ID NO: 5193042 - DNA, 13 bp, Homo sapiens
agcagtttcaata

SEQ ID NO: 5193043 - DNA, 12 bp, Homo sapiens
agcagtttcctc

SEQ ID NO: 5193044 - DNA, 15 bp, Homo sapiens
agcagtttgaaattg

SEQ ID NO: 5193045 - DNA, 16 bp, Homo sapiens
agcagtttggggcagg

SEQ ID NO: 5193046 - DNA, 23 bp, Homo sapiens
agcagtttggtttctagcatgaa

SEQ ID NO: 5193047 - DNA, 14 bp, Homo sapiens
agcagtttgtgaat

SEQ ID NO: 5193048 - DNA, 17 bp, Homo sapiens
agcagtttgtgatctgt

SEQ ID NO: 5193049 - DNA, 19 bp, Homo sapiens
agcagttttccaggaggcc

SEQ ID NO: 5193050 - DNA, 18 bp, Homo sapiens
agcagttttgtaaatgta

SEQ ID NO: 5193051 - DNA, 16 bp, Homo sapiens
agcagtttttccccct

SEQ ID NO: 5193052 - DNA, 14 bp, Homo sapiens
agcagtttttgaaa

SEQ ID NO: 5193053 - DNA, 23 bp, Homo sapiens
agcataaaaattagccaagtgtg

SEQ ID NO: 5193054 - DNA, 15 bp, Homo sapiens
agcataaaacctaaa

SEQ ID NO: 5193055 - DNA, 17 bp, Homo sapiens
agcataaaagatgaaag

SEQ ID NO: 5193056 - DNA, 20 bp, Homo sapiens
agcataaaatggaataacat

SEQ ID NO: 5193057 - DNA, 14 bp, Homo sapiens
agcataaatttaat

SEQ ID NO: 5193058 - DNA, 20 bp, Homo sapiens
agcataacaaggtccaagat

SEQ ID NO: 5193059 - DNA, 17 bp, Homo sapiens
agcataactaggattat

SEQ ID NO: 5193060 - DNA, 16 bp, Homo sapiens
agcataactgtagctc

SEQ ID NO: 5193061 - DNA, 22 bp, Homo sapiens
agcataactgtagctcaagttt

SEQ ID NO: 5193062 - DNA, 23 bp, Homo sapiens
agcataagtttctgggacctcag

SEQ ID NO: 5193063 - DNA, 22 bp, Homo sapiens
agcataattccgaaacaaaact

SEQ ID NO: 5193064 - DNA, 16 bp, Homo sapiens
agcataatttaaaaat

SEQ ID NO: 5193065 - DNA, 22 bp, Homo sapiens
agcataatttaaaaatatattt

SEQ ID NO: 5193066 - DNA, 15 bp, Homo sapiens
agcataatttgttta

SEQ ID NO: 5193067 - DNA, 20 bp, Homo sapiens
agcataatttgtttaaaatt

SEQ ID NO: 5193068 - DNA, 20 bp, Homo sapiens
agcataattttgtgttgtac

SEQ ID NO: 5193069 - DNA, 23 bp, Homo sapiens
agcataattttgtgttgtacaat

SEQ ID NO: 5193070 - DNA, 15 bp, Homo sapiens
agcatacaaaaatat

SEQ ID NO: 5193071 - DNA, 15 bp, Homo sapiens
agcatacaaaataaa

SEQ ID NO: 5193072 - DNA, 18 bp, Homo sapiens
agcatacaccaaacattt

SEQ ID NO: 5193073 - DNA, 19 bp, Homo sapiens
agcatacaccaaacatttc

SEQ ID NO: 5193074 - DNA, 22 bp, Homo sapiens
agcatacaccaaacatttctgt

SEQ ID NO: 5193075 - DNA, 14 bp, Homo sapiens
agcatacattcaga

SEQ ID NO: 5193076 - DNA, 13 bp, Homo sapiens
agcataccaacac

SEQ ID NO: 5193077 - DNA, 22 bp, Homo sapiens
agcataccagtactcagtatag

SEQ ID NO: 5193078 - DNA, 22 bp, Homo sapiens
agcataccagttcttgcaataa

SEQ ID NO: 5193079 - DNA, 18 bp, Homo sapiens
agcataccttggactgac

SEQ ID NO: 5193080 - DNA, 18 bp, Homo sapiens
agcatacgtacacatttt

SEQ ID NO: 5193081 - DNA, 21 bp, Homo sapiens
agcatacgtacacattttatt

SEQ ID NO: 5193082 - DNA, 16 bp, Homo sapiens
agcatactagaatcag

SEQ ID NO: 5193083 - DNA, 20 bp, Homo sapiens
agcatactgatgagacaaca

SEQ ID NO: 5193084 - DNA, 13 bp, Homo sapiens
agcatacttcaaa

SEQ ID NO: 5193085 - DNA, 13 bp, Homo sapiens
agcatactttgta

SEQ ID NO: 5193086 - DNA, 20 bp, Homo sapiens
agcatagaaaccactagaaa

SEQ ID NO: 5193087 - DNA, 21 bp, Homo sapiens
agcatagaaggaagtgtgttt

SEQ ID NO: 5193088 - DNA, 17 bp, Homo sapiens
agcatagagaacaaagt

SEQ ID NO: 5193089 - DNA, 14 bp, Homo sapiens
agcatagatgtttt

SEQ ID NO: 5193090 - DNA, 20 bp, Homo sapiens
agcatagcagaggggccagg

SEQ ID NO: 5193091 - DNA, 23 bp, Homo sapiens
agcatagccagcattcagcacac

SEQ ID NO: 5193092 - DNA, 21 bp, Homo sapiens
agcataggaggggtctggaca

SEQ ID NO: 5193093 - DNA, 18 bp, Homo sapiens
agcatagtactggcacaa

SEQ ID NO: 5193094 - DNA, 15 bp, Homo sapiens
agcatagttctgcaa

SEQ ID NO: 5193095 - DNA, 21 bp, Homo sapiens
agcatagttctgcaataacag

SEQ ID NO: 5193096 - DNA, 22 bp, Homo sapiens
agcatagttctgcaataacagt

SEQ ID NO: 5193097 - DNA, 12 bp, Homo sapiens
agcatataaatg

SEQ ID NO: 5193098 - DNA, 12 bp, Homo sapiens
agcatatactgg

SEQ ID NO: 5193099 - DNA, 17 bp, Homo sapiens
agcatatagaatatatt

SEQ ID NO: 5193100 - DNA, 15 bp, Homo sapiens
agcatatagattgtc

SEQ ID NO: 5193101 - DNA, 12 bp, Homo sapiens
agcatatataaa

SEQ ID NO: 5193102 - DNA, 14 bp, Homo sapiens
agcatatatataaa

SEQ ID NO: 5193103 - DNA, 19 bp, Homo sapiens
agcatatattcatacctgt

SEQ ID NO: 5193104 - DNA, 15 bp, Homo sapiens
agcatatatttttat

SEQ ID NO: 5193105 - DNA, 20 bp, Homo sapiens
agcatatcgtaaagctgttc

SEQ ID NO: 5193106 - DNA, 22 bp, Homo sapiens
agcatatcgtaaagctgttcaa

SEQ ID NO: 5193107 - DNA, 22 bp, Homo sapiens
agcatatcgtttaattttaaga

SEQ ID NO: 5193108 - DNA, 13 bp, Homo sapiens
agcatatctgcct

SEQ ID NO: 5193109 - DNA, 22 bp, Homo sapiens
agcatatctgcctttattgtgt

SEQ ID NO: 5193110 - DNA, 18 bp, Homo sapiens
agcatatctggtatatgt

SEQ ID NO: 5193111 - DNA, 17 bp, Homo sapiens
agcatatgacaaatgtt

SEQ ID NO: 5193112 - DNA, 21 bp, Homo sapiens
agcatatgacaaatgtttcta

SEQ ID NO: 5193113 - DNA, 16 bp, Homo sapiens
agcatatgagtttcat

SEQ ID NO: 5193114 - DNA, 19 bp, Homo sapiens
agcatatgatttcttgctt

SEQ ID NO: 5193115 - DNA, 20 bp, Homo sapiens
agcatatgcctacttgtaat

SEQ ID NO: 5193116 - DNA, 21 bp, Homo sapiens
agcatatggagtgcctgtaca

SEQ ID NO: 5193117 - DNA, 17 bp, Homo sapiens
agcatatgttagcatta

SEQ ID NO: 5193118 - DNA, 17 bp, Homo sapiens
agcatattcaggaagct

SEQ ID NO: 5193119 - DNA, 21 bp, Homo sapiens
agcatattcttttctgcaaaa

SEQ ID NO: 5193120 - DNA, 21 bp, Homo sapiens
agcatatttgccaataaagct

SEQ ID NO: 5193121 - DNA, 14 bp, Homo sapiens
agcatattttctta

SEQ ID NO: 5193122 - DNA, 20 bp, Homo sapiens
agcatattttcttactttta

SEQ ID NO: 5193123 - DNA, 21 bp, Homo sapiens
agcatattttcttacttttat

SEQ ID NO: 5193124 - DNA, 14 bp, Homo sapiens
agcatcaaaataca

SEQ ID NO: 5193125 - DNA, 17 bp, Homo sapiens
agcatcaaaatatttca

SEQ ID NO: 5193126 - DNA, 14 bp, Homo sapiens
agcatcaaacatga

SEQ ID NO: 5193127 - DNA, 13 bp, Homo sapiens
agcatcaagccac

SEQ ID NO: 5193128 - DNA, 21 bp, Homo sapiens
agcatcaagccccacagttct

SEQ ID NO: 5193129 - DNA, 14 bp, Homo sapiens
agcatcacagaatg

SEQ ID NO: 5193130 - DNA, 20 bp, Homo sapiens
agcatcacatgaacttgtaa

SEQ ID NO: 5193131 - DNA, 19 bp, Homo sapiens
agcatcacctcaggccagg

SEQ ID NO: 5193132 - DNA, 20 bp, Homo sapiens
agcatcacctcaggccaggt

SEQ ID NO: 5193133 - DNA, 15 bp, Homo sapiens
agcatcaccttccta

SEQ ID NO: 5193134 - DNA, 22 bp, Homo sapiens
agcatcactccccaaggaagag

SEQ ID NO: 5193135 - DNA, 16 bp, Homo sapiens
agcatcactgatggga

SEQ ID NO: 5193136 - DNA, 20 bp, Homo sapiens
agcatcactgatgggaataa

SEQ ID NO: 5193137 - DNA, 13 bp, Homo sapiens
agcatcactgccc

SEQ ID NO: 5193138 - DNA, 13 bp, Homo sapiens
agcatcactgcct

SEQ ID NO: 5193139 - DNA, 18 bp, Homo sapiens
agcatcactgccttggcc

SEQ ID NO: 5193140 - DNA, 19 bp, Homo sapiens
agcatcactgccttggccc

SEQ ID NO: 5193141 - DNA, 22 bp, Homo sapiens
agcatcacttaaaacacgtttt

SEQ ID NO: 5193142 - DNA, 23 bp, Homo sapiens
agcatcacttaggagaagtcttc

SEQ ID NO: 5193143 - DNA, 17 bp, Homo sapiens
agcatcacttgggatta

SEQ ID NO: 5193144 - DNA, 18 bp, Homo sapiens
agcatcagagcccttttg

SEQ ID NO: 5193145 - DNA, 18 bp, Homo sapiens
agcatcaggccaggccct

SEQ ID NO: 5193146 - DNA, 17 bp, Homo sapiens
agcatcagggggaagaa

SEQ ID NO: 5193147 - DNA, 18 bp, Homo sapiens
agcatcagtagctgagtg

SEQ ID NO: 5193148 - DNA, 19 bp, Homo sapiens
agcatcatgcctctgaggc

SEQ ID NO: 5193149 - DNA, 21 bp, Homo sapiens
agcatcatgcctctgaggcca

SEQ ID NO: 5193150 - DNA, 19 bp, Homo sapiens
agcatcatggatcaaccaa

SEQ ID NO: 5193151 - DNA, 22 bp, Homo sapiens
agcatcattacaatacagtatt

SEQ ID NO: 5193152 - DNA, 18 bp, Homo sapiens
agcatcattatttatgta

SEQ ID NO: 5193153 - DNA, 14 bp, Homo sapiens
agcatcattgtaaa

SEQ ID NO: 5193154 - DNA, 12 bp, Homo sapiens
agcatcattgtc

SEQ ID NO: 5193155 - DNA, 14 bp, Homo sapiens
agcatcattgtccc

SEQ ID NO: 5193156 - DNA, 22 bp, Homo sapiens
agcatcattttgcattcaaatt

SEQ ID NO: 5193157 - DNA, 16 bp, Homo sapiens
agcatccacctccttc

SEQ ID NO: 5193158 - DNA, 20 bp, Homo sapiens
agcatccacctccttctctg

SEQ ID NO: 5193159 - DNA, 18 bp, Homo sapiens
agcatccaccttggctct

SEQ ID NO: 5193160 - DNA, 13 bp, Homo sapiens
agcatccagcctg

SEQ ID NO: 5193161 - DNA, 14 bp, Homo sapiens
agcatccaggctgg

SEQ ID NO: 5193162 - DNA, 17 bp, Homo sapiens
agcatccaggctggcca

SEQ ID NO: 5193163 - DNA, 16 bp, Homo sapiens
agcatccagtgtgaga

SEQ ID NO: 5193164 - DNA, 21 bp, Homo sapiens
agcatccagtgtgagatactg

SEQ ID NO: 5193165 - DNA, 23 bp, Homo sapiens
agcatccatcaatacctgtacta

SEQ ID NO: 5193166 - DNA, 21 bp, Homo sapiens
agcatccatggatgcagaaat

SEQ ID NO: 5193167 - DNA, 24 bp, Homo sapiens
agcatccatgtgtggactcaagtc

SEQ ID NO: 5193168 - DNA, 14 bp, Homo sapiens
agcatccattaatt

SEQ ID NO: 5193169 - DNA, 23 bp, Homo sapiens
agcatcccaaagtgctgggatta

SEQ ID NO: 5193170 - DNA, 13 bp, Homo sapiens
agcatcccaagat

SEQ ID NO: 5193171 - DNA, 20 bp, Homo sapiens
agcatcccatctcagaagat

SEQ ID NO: 5193172 - DNA, 19 bp, Homo sapiens
agcatccccaaaacaaagt

SEQ ID NO: 5193173 - DNA, 16 bp, Homo sapiens
agcatcccccaaagtt

SEQ ID NO: 5193174 - DNA, 14 bp, Homo sapiens
agcatcccctgtga

SEQ ID NO: 5193175 - DNA, 17 bp, Homo sapiens
agcatccccttgaactc

SEQ ID NO: 5193176 - DNA, 21 bp, Homo sapiens
agcatcccgcgcgcccttcct

SEQ ID NO: 5193177 - DNA, 20 bp, Homo sapiens
agcatcccggaggaaatctg

SEQ ID NO: 5193178 - DNA, 12 bp, Homo sapiens
agcatccctgga

SEQ ID NO: 5193179 - DNA, 13 bp, Homo sapiens
agcatccctggag

SEQ ID NO: 5193180 - DNA, 20 bp, Homo sapiens
agcatcccttcccacatgcc

SEQ ID NO: 5193181 - DNA, 21 bp, Homo sapiens
agcatcccttgaccaggcctg

SEQ ID NO: 5193182 - DNA, 22 bp, Homo sapiens
agcatcccttgaccaggcctgg

SEQ ID NO: 5193183 - DNA, 16 bp, Homo sapiens
agcatccgcaggtgct

SEQ ID NO: 5193184 - DNA, 15 bp, Homo sapiens
agcatcctaagaaat

SEQ ID NO: 5193185 - DNA, 21 bp, Homo sapiens
agcatcctaagaaatatgtga

SEQ ID NO: 5193186 - DNA, 15 bp, Homo sapiens
agcatcctcagaagc

SEQ ID NO: 5193187 - DNA, 17 bp, Homo sapiens
agcatcctccccaccag

SEQ ID NO: 5193188 - DNA, 21 bp, Homo sapiens
agcgccatgtgtgtcagccca

SEQ ID NO: 5193189 - DNA, 16 bp, Homo sapiens
agcgcccccaggcctg

SEQ ID NO: 5193190 - DNA, 20 bp, Homo sapiens
agcgcccccaggcctgccct

SEQ ID NO: 5193191 - DNA, 17 bp, Homo sapiens
agcgcccccatctgtct

SEQ ID NO: 5193192 - DNA, 19 bp, Homo sapiens
agcgcccccatctgtcttc

SEQ ID NO: 5193193 - DNA, 14 bp, Homo sapiens
agcgcccccgagcc

SEQ ID NO: 5193194 - DNA, 17 bp, Homo sapiens
agcgcccccgagccctg

SEQ ID NO: 5193195 - DNA, 20 bp, Homo sapiens
agcgccccgcccccacccct

SEQ ID NO: 5193196 - DNA, 15 bp, Homo sapiens
agcgcccgaggccag

SEQ ID NO: 5193197 - DNA, 18 bp, Homo sapiens
agcgccctctacctccta

SEQ ID NO: 5193198 - DNA, 12 bp, Homo sapiens
agcgccctgcag

SEQ ID NO: 5193199 - DNA, 19 bp, Homo sapiens
agcgccctgcagaccctgc

SEQ ID NO: 5193200 - DNA, 23 bp, Homo sapiens
agcgccctgcagaccctgccctt

SEQ ID NO: 5193201 - DNA, 13 bp, Homo sapiens
agcgccctgcagg

SEQ ID NO: 5193202 - DNA, 21 bp, Homo sapiens
agcgccctggagtcccctggg

SEQ ID NO: 5193203 - DNA, 20 bp, Homo sapiens
agcgccctggcccccacatg

SEQ ID NO: 5193204 - DNA, 17 bp, Homo sapiens
agcgcccttcctctcca

SEQ ID NO: 5193205 - DNA, 23 bp, Homo sapiens
agcgccgtgagttctcagggctc

SEQ ID NO: 5193206 - DNA, 15 bp, Homo sapiens
agcgccgtgctgtaa

SEQ ID NO: 5193207 - DNA, 21 bp, Homo sapiens
agcgcctagtggggtctccct

SEQ ID NO: 5193208 - DNA, 22 bp, Homo sapiens
agcgcctagtggggtctccctc

SEQ ID NO: 5193209 - DNA, 23 bp, Homo sapiens
agcgcctagtggggtctccctct

SEQ ID NO: 5193210 - DNA, 19 bp, Homo sapiens
agcgcctcacctgcatcct

SEQ ID NO: 5193211 - DNA, 20 bp, Homo sapiens
agcgcctcagttacacagga

SEQ ID NO: 5193212 - DNA, 13 bp, Homo sapiens
agcgcctccaccc

SEQ ID NO: 5193213 - DNA, 22 bp, Homo sapiens
agcgcctccaccctgccctgct

SEQ ID NO: 5193214 - DNA, 20 bp, Homo sapiens
agcgcctccctccaccccag

SEQ ID NO: 5193215 - DNA, 21 bp, Homo sapiens
agcgcctccctccaccccagg

SEQ ID NO: 5193216 - DNA, 13 bp, Homo sapiens
agcgcctcctgga

SEQ ID NO: 5193217 - DNA, 14 bp, Homo sapiens
agcgcctcctggac

SEQ ID NO: 5193218 - DNA, 22 bp, Homo sapiens
agcgcctcctggacctgaaggc

SEQ ID NO: 5193219 - DNA, 16 bp, Homo sapiens
agcgcctcttcctctg

SEQ ID NO: 5193220 - DNA, 17 bp, Homo sapiens
agcgcctcttcctctgg

SEQ ID NO: 5193221 - DNA, 19 bp, Homo sapiens
agcgcctcttcctctgggc

SEQ ID NO: 5193222 - DNA, 23 bp, Homo sapiens
agcgcctcttcctctgggcagcg

SEQ ID NO: 5193223 - DNA, 12 bp, Homo sapiens
agcgcctgcccc

SEQ ID NO: 5193224 - DNA, 15 bp, Homo sapiens
agcgcctgcccctcc

SEQ ID NO: 5193225 - DNA, 18 bp, Homo sapiens
agcgcctgcccctcccag

SEQ ID NO: 5193226 - DNA, 19 bp, Homo sapiens
agcgcctgcccctcccaga

SEQ ID NO: 5193227 - DNA, 18 bp, Homo sapiens
agcgcctgccctccctgg

SEQ ID NO: 5193228 - DNA, 11 bp, Homo sapiens
agcgcctggcc

SEQ ID NO: 5193229 - DNA, 21 bp, Homo sapiens
agcgcctggctgctgcttctt

SEQ ID NO: 5193230 - DNA, 14 bp, Homo sapiens
agcgcctgtcccct

SEQ ID NO: 5193231 - DNA, 16 bp, Homo sapiens
agcgcctgtcccctca

SEQ ID NO: 5193232 - DNA, 18 bp, Homo sapiens
agcgcctgtcccctcaca

SEQ ID NO: 5193233 - DNA, 20 bp, Homo sapiens
agcgcctgtcccctcacaga

SEQ ID NO: 5193234 - DNA, 11 bp, Homo sapiens
agcgccttggt

SEQ ID NO: 5193235 - DNA, 17 bp, Homo sapiens
agcgcctttcccaactc

SEQ ID NO: 5193236 - DNA, 20 bp, Homo sapiens
agcgcctttcccaactctag

SEQ ID NO: 5193237 - DNA, 22 bp, Homo sapiens
agcgcgccactcgcttccccca

SEQ ID NO: 5193238 - DNA, 15 bp, Homo sapiens
agcgcgcccctagcc

SEQ ID NO: 5193239 - DNA, 17 bp, Homo sapiens
agcgcggacatcccctg

SEQ ID NO: 5193240 - DNA, 19 bp, Homo sapiens
agcgcggacatcccctgct

SEQ ID NO: 5193241 - DNA, 17 bp, Homo sapiens
agcgcggacgtgctggg

SEQ ID NO: 5193242 - DNA, 17 bp, Homo sapiens
agcgcggctggctctgt

SEQ ID NO: 5193243 - DNA, 18 bp, Homo sapiens
agcgcggcttggccgcca

SEQ ID NO: 5193244 - DNA, 13 bp, Homo sapiens
agcgcgggagaga

SEQ ID NO: 5193245 - DNA, 19 bp, Homo sapiens
agcgcgggcggaggcggct

SEQ ID NO: 5193246 - DNA, 22 bp, Homo sapiens
agcgcgttgtgtatattacacc

SEQ ID NO: 5193247 - DNA, 18 bp, Homo sapiens
agcgctaagtaaaaatat

SEQ ID NO: 5193248 - DNA, 20 bp, Homo sapiens
agcgctaagtaaaaatatta

SEQ ID NO: 5193249 - DNA, 20 bp, Homo sapiens
agcgctagaggaagcagcca

SEQ ID NO: 5193250 - DNA, 23 bp, Homo sapiens
agcgctagtgccttgcccacagg

SEQ ID NO: 5193251 - DNA, 15 bp, Homo sapiens
agcgctatccacaga

SEQ ID NO: 5193252 - DNA, 13 bp, Homo sapiens
agcgctatctccc

SEQ ID NO: 5193253 - DNA, 18 bp, Homo sapiens
agcgctatctccctgcct

SEQ ID NO: 5193254 - DNA, 17 bp, Homo sapiens
agcgctatcttcacata

SEQ ID NO: 5193255 - DNA, 18 bp, Homo sapiens
agcgctatcttcacatag

SEQ ID NO: 5193256 - DNA, 14 bp, Homo sapiens
agcgctcccagcct

SEQ ID NO: 5193257 - DNA, 17 bp, Homo sapiens
agcgctcccagcctgcc

SEQ ID NO: 5193258 - DNA, 19 bp, Homo sapiens
agcgctcccagcctgccct

SEQ ID NO: 5193259 - DNA, 13 bp, Homo sapiens
agcgctcctcctg

SEQ ID NO: 5193260 - DNA, 14 bp, Homo sapiens
agcgctcctcctgt

SEQ ID NO: 5193261 - DNA, 16 bp, Homo sapiens
agcgctcctcctgtgt

SEQ ID NO: 5193262 - DNA, 19 bp, Homo sapiens
agcgctcctcctgtgtgac

SEQ ID NO: 5193263 - DNA, 20 bp, Homo sapiens
agcgctcctgccgcagagct

SEQ ID NO: 5193264 - DNA, 12 bp, Homo sapiens
agcgctcgccac

SEQ ID NO: 5193265 - DNA, 15 bp, Homo sapiens
agcgctcgccacgct

SEQ ID NO: 5193266 - DNA, 16 bp, Homo sapiens
agcgctcgccacgctc

SEQ ID NO: 5193267 - DNA, 22 bp, Homo sapiens
agcgctcgccacgctcagtgcc

SEQ ID NO: 5193268 - DNA, 15 bp, Homo sapiens
agcgctcgccccgca

SEQ ID NO: 5193269 - DNA, 18 bp, Homo sapiens
agcgctcggcccggagca

SEQ ID NO: 5193270 - DNA, 12 bp, Homo sapiens
agcgctctcctg

SEQ ID NO: 5193271 - DNA, 15 bp, Homo sapiens
agcgctctggacaga

SEQ ID NO: 5193272 - DNA, 12 bp, Homo sapiens
agcgctgcccac

SEQ ID NO: 5193273 - DNA, 16 bp, Homo sapiens
agcgctgcccacacca

SEQ ID NO: 5193274 - DNA, 11 bp, Homo sapiens
agcgctgccct

SEQ ID NO: 5193275 - DNA, 12 bp, Homo sapiens
agcgctgccctg

SEQ ID NO: 5193276 - DNA, 14 bp, Homo sapiens
agcgctgccctgtg

SEQ ID NO: 5193277 - DNA, 17 bp, Homo sapiens
agcgctgccctgtgaga

SEQ ID NO: 5193278 - DNA, 21 bp, Homo sapiens
agcgctgccctgtgagagcca

SEQ ID NO: 5193279 - DNA, 19 bp, Homo sapiens
agcgctgccgcaccccaga

SEQ ID NO: 5193280 - DNA, 20 bp, Homo sapiens
agcgctggcagcgctcctgg

SEQ ID NO: 5193281 - DNA, 13 bp, Homo sapiens
agcgctggcctct

SEQ ID NO: 5193282 - DNA, 13 bp, Homo sapiens
agcgctggctcag

SEQ ID NO: 5193283 - DNA, 18 bp, Homo sapiens
agcgctggctcaggaaga

SEQ ID NO: 5193284 - DNA, 19 bp, Homo sapiens
agcgctggctccctgggca

SEQ ID NO: 5193285 - DNA, 22 bp, Homo sapiens
agcgctggctccctgggcagtg

SEQ ID NO: 5193286 - DNA, 19 bp, Homo sapiens
agcgctggtcccctccctc

SEQ ID NO: 5193287 - DNA, 16 bp, Homo sapiens
agcgctgtcaggattg

SEQ ID NO: 5193288 - DNA, 17 bp, Homo sapiens
agcgctgtgagatggat

SEQ ID NO: 5193289 - DNA, 18 bp, Homo sapiens
agcgctgtgagatggatg

SEQ ID NO: 5193290 - DNA, 18 bp, Homo sapiens
agcgctgtggactgtcct

SEQ ID NO: 5193291 - DNA, 15 bp, Homo sapiens
agcgctgttgatccc

SEQ ID NO: 5193292 - DNA, 15 bp, Homo sapiens
agcgctgtttccttg

SEQ ID NO: 5193293 - DNA, 15 bp, Homo sapiens
agcgcttaaaaaaac

SEQ ID NO: 5193294 - DNA, 21 bp, Homo sapiens
agcgcttctttctgactctaa

SEQ ID NO: 5193295 - DNA, 22 bp, Homo sapiens
agcgcttgggcgccgtgctggg

SEQ ID NO: 5193296 - DNA, 21 bp, Homo sapiens
agcgctttctggaaaagagga

SEQ ID NO: 5193297 - DNA, 15 bp, Homo sapiens
agcggaaaagttgtc

SEQ ID NO: 5193298 - DNA, 16 bp, Homo sapiens
agcggaaacaggtgtg

SEQ ID NO: 5193299 - DNA, 19 bp, Homo sapiens
agcggaaacaggtgtgtgt

SEQ ID NO: 5193300 - DNA, 13 bp, Homo sapiens
agcggaaagcagc

SEQ ID NO: 5193301 - DNA, 17 bp, Homo sapiens
agcggaaagcagctcaa

SEQ ID NO: 5193302 - DNA, 23 bp, Homo sapiens
agcggaaagcagctcaaaggcac

SEQ ID NO: 5193303 - DNA, 17 bp, Homo sapiens
agcggaacaaggagtca

SEQ ID NO: 5193304 - DNA, 22 bp, Homo sapiens
agcggaacaaggagtcagacat

SEQ ID NO: 5193305 - DNA, 19 bp, Homo sapiens
agcggaacatgtgcttcat

SEQ ID NO: 5193306 - DNA, 23 bp, Homo sapiens
agcggaagggactctgggctgtg

SEQ ID NO: 5193307 - DNA, 21 bp, Homo sapiens
agcggaataaactagagaagg

SEQ ID NO: 5193308 - DNA, 17 bp, Homo sapiens
agcggacagtggcagga

SEQ ID NO: 5193309 - DNA, 14 bp, Homo sapiens
agcggaccactctt

SEQ ID NO: 5193310 - DNA, 16 bp, Homo sapiens
agcggagaaaggaagg

SEQ ID NO: 5193311 - DNA, 16 bp, Homo sapiens
agcggagagagccaag

SEQ ID NO: 5193312 - DNA, 22 bp, Homo sapiens
agcggagcccgatattctccct

SEQ ID NO: 5193313 - DNA, 23 bp, Homo sapiens
agcggagcccgatattctccctg

SEQ ID NO: 5193314 - DNA, 15 bp, Homo sapiens
agcggagcttgcctg

SEQ ID NO: 5193315 - DNA, 20 bp, Homo sapiens
agcggagcttgcctgcctgc

SEQ ID NO: 5193316 - DNA, 18 bp, Homo sapiens
agcggatgattcttcaag

SEQ ID NO: 5193317 - DNA, 19 bp, Homo sapiens
agcggatgctccatttcaa

SEQ ID NO: 5193318 - DNA, 20 bp, Homo sapiens
agcggatgctggccacagaa

SEQ ID NO: 5193319 - DNA, 20 bp, Homo sapiens
agcggcaaacctttccccct

SEQ ID NO: 5193320 - DNA, 16 bp, Homo sapiens
agcggcaccctggtct

SEQ ID NO: 5193321 - DNA, 20 bp, Homo sapiens
agcggcagagcaattccagg

SEQ ID NO: 5193322 - DNA, 21 bp, Homo sapiens
agcggcagagcaattccaggc

SEQ ID NO: 5193323 - DNA, 14 bp, Homo sapiens
agcggcagatgggg

SEQ ID NO: 5193324 - DNA, 16 bp, Homo sapiens
agcggccccgcacccc

SEQ ID NO: 5193325 - DNA, 17 bp, Homo sapiens
agcggccccgcacccct

SEQ ID NO: 5193326 - DNA, 19 bp, Homo sapiens
agcggccccgcacccctcc

SEQ ID NO: 5193327 - DNA, 18 bp, Homo sapiens
agcggccccgcggagccc

SEQ ID NO: 5193328 - DNA, 14 bp, Homo sapiens
agcggcccctccca

SEQ ID NO: 5193329 - DNA, 18 bp, Homo sapiens
agcggcccctcccacaca

SEQ ID NO: 5193330 - DNA, 15 bp, Homo sapiens
agcggcccggcccac

SEQ ID NO: 5193331 - DNA, 22 bp, Homo sapiens
agcggcccggcccacgcagagc

SEQ ID NO: 5193332 - DNA, 16 bp, Homo sapiens
agcggccctcccaggc

SEQ ID NO: 5193333 - DNA, 17 bp, Homo sapiens
agcggccctcccaggcg

SEQ ID NO: 5193334 - DNA, 11 bp, Homo sapiens
agcggccctgg

SEQ ID NO: 5193335 - DNA, 16 bp, Homo sapiens
agcggccctggaggat

SEQ ID NO: 5193336 - DNA, 23 bp, Homo sapiens
agcggccgatgggagtctccctc

SEQ ID NO: 5193337 - DNA, 16 bp, Homo sapiens
agcggccgcagagact

SEQ ID NO: 5193338 - DNA, 17 bp, Homo sapiens
agcggccgcagagactg

SEQ ID NO: 5193339 - DNA, 14 bp, Homo sapiens
agcggccgcctgtc

SEQ ID NO: 5193340 - DNA, 16 bp, Homo sapiens
agcggccgcctgtcct

SEQ ID NO: 5193341 - DNA, 22 bp, Homo sapiens
agcggccggccagcccctggcc

SEQ ID NO: 5193342 - DNA, 12 bp, Homo sapiens
agcggcctgggg

SEQ ID NO: 5193343 - DNA, 15 bp, Homo sapiens
agcggcgaccgccct

SEQ ID NO: 5193344 - DNA, 18 bp, Homo sapiens
agcggcgaccgccctccg

SEQ ID NO: 5193345 - DNA, 18 bp, Homo sapiens
agcggcgcagagccctcc

SEQ ID NO: 5193346 - DNA, 19 bp, Homo sapiens
agcggcgcagagccctcca

SEQ ID NO: 5193347 - DNA, 14 bp, Homo sapiens
agcggctacaaagc

SEQ ID NO: 5193348 - DNA, 19 bp, Homo sapiens
agcggctcaagcccaggag

SEQ ID NO: 5193349 - DNA, 15 bp, Homo sapiens
agcggctcccctctg

SEQ ID NO: 5193350 - DNA, 17 bp, Homo sapiens
agcggctcccctctgct

SEQ ID NO: 5193351 - DNA, 13 bp, Homo sapiens
agcggctcctcgc

SEQ ID NO: 5193352 - DNA, 15 bp, Homo sapiens
agcggctcctcgccc

SEQ ID NO: 5193353 - DNA, 21 bp, Homo sapiens
agcggctcctcgcccccacca

SEQ ID NO: 5193354 - DNA, 20 bp, Homo sapiens
agcggctctaaacctcaggc

SEQ ID NO: 5193355 - DNA, 21 bp, Homo sapiens
agcggctctaaacctcaggcc

SEQ ID NO: 5193356 - DNA, 21 bp, Homo sapiens
agcggctgaggacggggcaga

SEQ ID NO: 5193357 - DNA, 21 bp, Homo sapiens
agcggctgagtcatgatctcc

SEQ ID NO: 5193358 - DNA, 12 bp, Homo sapiens
agcggctgcctc

SEQ ID NO: 5193359 - DNA, 16 bp, Homo sapiens
agcggctgcctcctga

SEQ ID NO: 5193360 - DNA, 11 bp, Homo sapiens
agcggctgctc

SEQ ID NO: 5193361 - DNA, 16 bp, Homo sapiens
agcggctgctcaagcc

SEQ ID NO: 5193362 - DNA, 21 bp, Homo sapiens
agcggctgctcgcccaggaag

SEQ ID NO: 5193363 - DNA, 13 bp, Homo sapiens
agcggctggcagc

SEQ ID NO: 5193364 - DNA, 15 bp, Homo sapiens
agcggctgttccccc

SEQ ID NO: 5193365 - DNA, 14 bp, Homo sapiens
agcggctgtttact

SEQ ID NO: 5193366 - DNA, 20 bp, Homo sapiens
agcgggaatggcagctgcca

SEQ ID NO: 5193367 - DNA, 15 bp, Homo sapiens
agcatcctcctcctg

SEQ ID NO: 5193368 - DNA, 13 bp, Homo sapiens
agcatcctgagcc

SEQ ID NO: 5193369 - DNA, 17 bp, Homo sapiens
agcatcctgagccccgc

SEQ ID NO: 5193370 - DNA, 20 bp, Homo sapiens
agcatcctgataccattcta

SEQ ID NO: 5193371 - DNA, 21 bp, Homo sapiens
agcatcctgcccgagggcagc

SEQ ID NO: 5193372 - DNA, 22 bp, Homo sapiens
agcatcctgcccgagggcagcc

SEQ ID NO: 5193373 - DNA, 21 bp, Homo sapiens
agcatcctgccttagagccag

SEQ ID NO: 5193374 - DNA, 12 bp, Homo sapiens
agcatcctgctt

SEQ ID NO: 5193375 - DNA, 13 bp, Homo sapiens
agcatcctggaaa

SEQ ID NO: 5193376 - DNA, 20 bp, Homo sapiens
agcatcctggaaatttgtgt

SEQ ID NO: 5193377 - DNA, 15 bp, Homo sapiens
agcatcctggaatat

SEQ ID NO: 5193378 - DNA, 14 bp, Homo sapiens
agcatcctggcacc

SEQ ID NO: 5193379 - DNA, 14 bp, Homo sapiens
agcatcctggcagg

SEQ ID NO: 5193380 - DNA, 13 bp, Homo sapiens
agcatccttggca

SEQ ID NO: 5193381 - DNA, 15 bp, Homo sapiens
agcatccttggcagt

SEQ ID NO: 5193382 - DNA, 15 bp, Homo sapiens
agcatcggcctaggg

SEQ ID NO: 5193383 - DNA, 19 bp, Homo sapiens
agcatcgggagcacccaga

SEQ ID NO: 5193384 - DNA, 20 bp, Homo sapiens
agcatcgggagcacccagag

SEQ ID NO: 5193385 - DNA, 17 bp, Homo sapiens
agcatcgggggcctgca

SEQ ID NO: 5193386 - DNA, 19 bp, Homo sapiens
agcatcggtcatgtgtgta

SEQ ID NO: 5193387 - DNA, 14 bp, Homo sapiens
agcatctaaacttt

SEQ ID NO: 5193388 - DNA, 14 bp, Homo sapiens
agcatctaatgaat

SEQ ID NO: 5193389 - DNA, 20 bp, Homo sapiens
agcatctactctaaagaaaa

SEQ ID NO: 5193390 - DNA, 15 bp, Homo sapiens
agcatctacttcagg

SEQ ID NO: 5193391 - DNA, 15 bp, Homo sapiens
agcatctcaaatgtt

SEQ ID NO: 5193392 - DNA, 17 bp, Homo sapiens
agcatctcaaatgtttt

SEQ ID NO: 5193393 - DNA, 12 bp, Homo sapiens
agcatctcactt

SEQ ID NO: 5193394 - DNA, 14 bp, Homo sapiens
agcatctcagagtc

SEQ ID NO: 5193395 - DNA, 15 bp, Homo sapiens
agcatctcaggaggg

SEQ ID NO: 5193396 - DNA, 18 bp, Homo sapiens
agcatctcagtggtgtgt

SEQ ID NO: 5193397 - DNA, 16 bp, Homo sapiens
agcatctccaagcagc

SEQ ID NO: 5193398 - DNA, 23 bp, Homo sapiens
agcatctcctgaggatcagaaag

SEQ ID NO: 5193399 - DNA, 14 bp, Homo sapiens
agcatctctacctt

SEQ ID NO: 5193400 - DNA, 18 bp, Homo sapiens
agcatctctaccttctcc

SEQ ID NO: 5193401 - DNA, 23 bp, Homo sapiens
agcatctctaccttctccccagc

SEQ ID NO: 5193402 - DNA, 12 bp, Homo sapiens
agcatctgacca

SEQ ID NO: 5193403 - DNA, 13 bp, Homo sapiens
agcatctgaccat

SEQ ID NO: 5193404 - DNA, 17 bp, Homo sapiens
agcatctgaccatctgt

SEQ ID NO: 5193405 - DNA, 18 bp, Homo sapiens
agcatctgaccatctgtg

SEQ ID NO: 5193406 - DNA, 19 bp, Homo sapiens
agcatctgaccatctgtga

SEQ ID NO: 5193407 - DNA, 20 bp, Homo sapiens
agcatctgaccatctgtgac

SEQ ID NO: 5193408 - DNA, 17 bp, Homo sapiens
agcatctgcaacaaaaa

SEQ ID NO: 5193409 - DNA, 17 bp, Homo sapiens
agcatctgcattgccca

SEQ ID NO: 5193410 - DNA, 13 bp, Homo sapiens
agcatctgcccca

SEQ ID NO: 5193411 - DNA, 17 bp, Homo sapiens
agcatctgccccaggta

SEQ ID NO: 5193412 - DNA, 20 bp, Homo sapiens
agcatctgcctctattcaat

SEQ ID NO: 5193413 - DNA, 18 bp, Homo sapiens
agcatctgctcttctctt

SEQ ID NO: 5193414 - DNA, 23 bp, Homo sapiens
agcatctggaagatcattttgaa

SEQ ID NO: 5193415 - DNA, 18 bp, Homo sapiens
agcatctggctctaattc

SEQ ID NO: 5193416 - DNA, 14 bp, Homo sapiens
agcatctggctgtc

SEQ ID NO: 5193417 - DNA, 15 bp, Homo sapiens
agcatctggtcttgt

SEQ ID NO: 5193418 - DNA, 12 bp, Homo sapiens
agcatctgtaca

SEQ ID NO: 5193419 - DNA, 21 bp, Homo sapiens
agcatctgtcccactgggaca

SEQ ID NO: 5193420 - DNA, 17 bp, Homo sapiens
agcatcttccagaagtg

SEQ ID NO: 5193421 - DNA, 22 bp, Homo sapiens
agcatcttccagaagtgtgatt

SEQ ID NO: 5193422 - DNA, 23 bp, Homo sapiens
agcatcttccagaagtgtgattg

SEQ ID NO: 5193423 - DNA, 15 bp, Homo sapiens
agcatcttcctctgc

SEQ ID NO: 5193424 - DNA, 19 bp, Homo sapiens
agcatcttgcatccaaacc

SEQ ID NO: 5193425 - DNA, 15 bp, Homo sapiens
agcatcttgcattat

SEQ ID NO: 5193426 - DNA, 15 bp, Homo sapiens
agcatcttgccagcc

SEQ ID NO: 5193427 - DNA, 18 bp, Homo sapiens
agcatcttgccagcctca

SEQ ID NO: 5193428 - DNA, 21 bp, Homo sapiens
agcatcttgggggggtggccg

SEQ ID NO: 5193429 - DNA, 19 bp, Homo sapiens
agcatcttgtcaagaaata

SEQ ID NO: 5193430 - DNA, 15 bp, Homo sapiens
agcatctttcatatg

SEQ ID NO: 5193431 - DNA, 19 bp, Homo sapiens
agcatcttttccatcctga

SEQ ID NO: 5193432 - DNA, 15 bp, Homo sapiens
agcatcttttcctcc

SEQ ID NO: 5193433 - DNA, 21 bp, Homo sapiens
agcatgaaaggtaatctgaaa

SEQ ID NO: 5193434 - DNA, 22 bp, Homo sapiens
agcatgaaatgtgaatttttat

SEQ ID NO: 5193435 - DNA, 16 bp, Homo sapiens
agcatgaacagtgcac

SEQ ID NO: 5193436 - DNA, 15 bp, Homo sapiens
agcatgaagacagag

SEQ ID NO: 5193437 - DNA, 23 bp, Homo sapiens
agcatgaagtcttaaggacaaag

SEQ ID NO: 5193438 - DNA, 15 bp, Homo sapiens
agcatgaataaaaca

SEQ ID NO: 5193439 - DNA, 20 bp, Homo sapiens
agcatgaataaaacactcat

SEQ ID NO: 5193440 - DNA, 15 bp, Homo sapiens
agcatgaataaaatt

SEQ ID NO: 5193441 - DNA, 16 bp, Homo sapiens
agcatgaataaaatta

SEQ ID NO: 5193442 - DNA, 20 bp, Homo sapiens
agcatgaataaaattaggtt

SEQ ID NO: 5193443 - DNA, 18 bp, Homo sapiens
agcatgaatatttcttaa

SEQ ID NO: 5193444 - DNA, 15 bp, Homo sapiens
agcatgaattggaac

SEQ ID NO: 5193445 - DNA, 16 bp, Homo sapiens
agcatgaattggaact

SEQ ID NO: 5193446 - DNA, 23 bp, Homo sapiens
agcatgacaaaagtgacagatgt

SEQ ID NO: 5193447 - DNA, 15 bp, Homo sapiens
agcatgacaactttt

SEQ ID NO: 5193448 - DNA, 19 bp, Homo sapiens
agcatgacaacttttaaag

SEQ ID NO: 5193449 - DNA, 17 bp, Homo sapiens
agcatgacaagccccag

SEQ ID NO: 5193450 - DNA, 18 bp, Homo sapiens
agcatgacaagccccagg

SEQ ID NO: 5193451 - DNA, 15 bp, Homo sapiens
agcatgacagcctgc

SEQ ID NO: 5193452 - DNA, 16 bp, Homo sapiens
agcatgacataacagt

SEQ ID NO: 5193453 - DNA, 18 bp, Homo sapiens
agcatgacctgtgaccag

SEQ ID NO: 5193454 - DNA, 14 bp, Homo sapiens
agcatgactatgta

SEQ ID NO: 5193455 - DNA, 23 bp, Homo sapiens
agcatgactatgtatttttctat

SEQ ID NO: 5193456 - DNA, 16 bp, Homo sapiens
agcatgactggacagc

SEQ ID NO: 5193457 - DNA, 21 bp, Homo sapiens
agcatgactggacagcggttg

SEQ ID NO: 5193458 - DNA, 16 bp, Homo sapiens
agcatgactttcctta

SEQ ID NO: 5193459 - DNA, 19 bp, Homo sapiens
agcatgagagaattgtatc

SEQ ID NO: 5193460 - DNA, 14 bp, Homo sapiens
agcatgagattgta

SEQ ID NO: 5193461 - DNA, 21 bp, Homo sapiens
agcatgagattgtacattttt

SEQ ID NO: 5193462 - DNA, 18 bp, Homo sapiens
agcatgaggtatctaagg

SEQ ID NO: 5193463 - DNA, 20 bp, Homo sapiens
agcatgagttatctgatttt

SEQ ID NO: 5193464 - DNA, 17 bp, Homo sapiens
agcatgatattgttctc

SEQ ID NO: 5193465 - DNA, 18 bp, Homo sapiens
agcatgatattgttctcc

SEQ ID NO: 5193466 - DNA, 17 bp, Homo sapiens
agcatgatctgaaaaat

SEQ ID NO: 5193467 - DNA, 15 bp, Homo sapiens
agcatgatcttgtta

SEQ ID NO: 5193468 - DNA, 20 bp, Homo sapiens
agcatgatgggaaaatattt

SEQ ID NO: 5193469 - DNA, 22 bp, Homo sapiens
agcatgatgggaggtgtgccag

SEQ ID NO: 5193470 - DNA, 19 bp, Homo sapiens
agcatgcaagcttggtcaa

SEQ ID NO: 5193471 - DNA, 14 bp, Homo sapiens
agcatgcacaaagt

SEQ ID NO: 5193472 - DNA, 21 bp, Homo sapiens
agcatgcacaaagtgtattca

SEQ ID NO: 5193473 - DNA, 16 bp, Homo sapiens
agcatgcacagctgct

SEQ ID NO: 5193474 - DNA, 17 bp, Homo sapiens
agcatgcacagctgctt

SEQ ID NO: 5193475 - DNA, 20 bp, Homo sapiens
agcatgcacagctgcttgtc

SEQ ID NO: 5193476 - DNA, 15 bp, Homo sapiens
agcatgcattgaaaa

SEQ ID NO: 5193477 - DNA, 16 bp, Homo sapiens
agcatgcatttagcat

SEQ ID NO: 5193478 - DNA, 19 bp, Homo sapiens
agcatgcatttagcatgag

SEQ ID NO: 5193479 - DNA, 19 bp, Homo sapiens
agcatgccaacaagaatgc

SEQ ID NO: 5193480 - DNA, 17 bp, Homo sapiens
agcatgcccaaatataa

SEQ ID NO: 5193481 - DNA, 15 bp, Homo sapiens
agcatgccctgagct

SEQ ID NO: 5193482 - DNA, 21 bp, Homo sapiens
agcatgcctccaaaaattcac

SEQ ID NO: 5193483 - DNA, 15 bp, Homo sapiens
agcatgcgcagaggc

SEQ ID NO: 5193484 - DNA, 16 bp, Homo sapiens
agcatgcggagccagc

SEQ ID NO: 5193485 - DNA, 16 bp, Homo sapiens
agcatgctcagtattg

SEQ ID NO: 5193486 - DNA, 17 bp, Homo sapiens
agcatgctcagtattga

SEQ ID NO: 5193487 - DNA, 15 bp, Homo sapiens
agcatgctccctcat

SEQ ID NO: 5193488 - DNA, 14 bp, Homo sapiens
agcatgctgcctga

SEQ ID NO: 5193489 - DNA, 21 bp, Homo sapiens
agcatgctgtgattgtgccta

SEQ ID NO: 5193490 - DNA, 15 bp, Homo sapiens
agcatgcttcccaga

SEQ ID NO: 5193491 - DNA, 21 bp, Homo sapiens
agcatgcttccctgcagctga

SEQ ID NO: 5193492 - DNA, 15 bp, Homo sapiens
agcatgcttcctttc

SEQ ID NO: 5193493 - DNA, 17 bp, Homo sapiens
agcatgcttcctttctc

SEQ ID NO: 5193494 - DNA, 20 bp, Homo sapiens
agcatgcttcctttctctcc

SEQ ID NO: 5193495 - DNA, 21 bp, Homo sapiens
agcatgcttcctttctctcct

SEQ ID NO: 5193496 - DNA, 22 bp, Homo sapiens
agcatgcttcctttctctcctg

SEQ ID NO: 5193497 - DNA, 14 bp, Homo sapiens
agcatgcttgggct

SEQ ID NO: 5193498 - DNA, 15 bp, Homo sapiens
agcatgcttgggctg

SEQ ID NO: 5193499 - DNA, 14 bp, Homo sapiens
agcatgctttgctg

SEQ ID NO: 5193500 - DNA, 15 bp, Homo sapiens
agcatggaaaaatgg

SEQ ID NO: 5193501 - DNA, 16 bp, Homo sapiens
agcatggaaaaatggt

SEQ ID NO: 5193502 - DNA, 19 bp, Homo sapiens
agcatggaaaaatggttga

SEQ ID NO: 5193503 - DNA, 20 bp, Homo sapiens
agcatggaaaaatggttgat

SEQ ID NO: 5193504 - DNA, 18 bp, Homo sapiens
agcatggaaaatcagtga

SEQ ID NO: 5193505 - DNA, 14 bp, Homo sapiens
agcatggacagtgt

SEQ ID NO: 5193506 - DNA, 14 bp, Homo sapiens
agcatggacattta

SEQ ID NO: 5193507 - DNA, 16 bp, Homo sapiens
agcatggactctgggt

SEQ ID NO: 5193508 - DNA, 13 bp, Homo sapiens
agcatggagacag

SEQ ID NO: 5193509 - DNA, 14 bp, Homo sapiens
agcatggagacagc

SEQ ID NO: 5193510 - DNA, 17 bp, Homo sapiens
agcatggagacagcagt

SEQ ID NO: 5193511 - DNA, 15 bp, Homo sapiens
agcatggagagcctc

SEQ ID NO: 5193512 - DNA, 22 bp, Homo sapiens
agcatggagagcctcttagtga

SEQ ID NO: 5193513 - DNA, 17 bp, Homo sapiens
agcatggagagtggcat

SEQ ID NO: 5193514 - DNA, 13 bp, Homo sapiens
agcatggagctgg

SEQ ID NO: 5193515 - DNA, 16 bp, Homo sapiens
agcatggagctgtcac

SEQ ID NO: 5193516 - DNA, 19 bp, Homo sapiens
agcatggagctgtcacctc

SEQ ID NO: 5193517 - DNA, 22 bp, Homo sapiens
agcatggatgaaacctttgagt

SEQ ID NO: 5193518 - DNA, 14 bp, Homo sapiens
agcatggatgcatt

SEQ ID NO: 5193519 - DNA, 17 bp, Homo sapiens
agcatggatgcatttca

SEQ ID NO: 5193520 - DNA, 18 bp, Homo sapiens
agcatggatgcatttcaa

SEQ ID NO: 5193521 - DNA, 20 bp, Homo sapiens
agcatggatgcatttcaaat

SEQ ID NO: 5193522 - DNA, 21 bp, Homo sapiens
agcatggatgcatttcaaatg

SEQ ID NO: 5193523 - DNA, 20 bp, Homo sapiens
agcatggcactccctccagc

SEQ ID NO: 5193524 - DNA, 23 bp, Homo sapiens
agcatggcactccctccagcaca

SEQ ID NO: 5193525 - DNA, 18 bp, Homo sapiens
agcatggcatatttttca

SEQ ID NO: 5193526 - DNA, 19 bp, Homo sapiens
agcatggcatatttttcac

SEQ ID NO: 5193527 - DNA, 22 bp, Homo sapiens
agcatggcatatttttcacata

SEQ ID NO: 5193528 - DNA, 22 bp, Homo sapiens
agcatggccctgctgcccctcc

SEQ ID NO: 5193529 - DNA, 21 bp, Homo sapiens
agcatggctgtctgcacagag

SEQ ID NO: 5193530 - DNA, 16 bp, Homo sapiens
agcatggctgtgagga

SEQ ID NO: 5193531 - DNA, 20 bp, Homo sapiens
agcatgggaatacaaaaggt

SEQ ID NO: 5193532 - DNA, 21 bp, Homo sapiens
agcatgggactgtgcctttgg

SEQ ID NO: 5193533 - DNA, 14 bp, Homo sapiens
agcatgggcctggc

SEQ ID NO: 5193534 - DNA, 13 bp, Homo sapiens
agcatggggccag

SEQ ID NO: 5193535 - DNA, 17 bp, Homo sapiens
agcatgggggctgccag

SEQ ID NO: 5193536 - DNA, 15 bp, Homo sapiens
agcatggggtcagcc

SEQ ID NO: 5193537 - DNA, 18 bp, Homo sapiens
agcatggggtcagcccca

SEQ ID NO: 5193538 - DNA, 22 bp, Homo sapiens
agcatggggtcagccccaaggg

SEQ ID NO: 5193539 - DNA, 15 bp, Homo sapiens
agcatggggttttta

SEQ ID NO: 5193540 - DNA, 19 bp, Homo sapiens
agcatgggtccaagagaca

SEQ ID NO: 5193541 - DNA, 21 bp, Homo sapiens
agcatgggtccaagagacatg

SEQ ID NO: 5193542 - DNA, 16 bp, Homo sapiens
agcatgggtccagaag

SEQ ID NO: 5193543 - DNA, 17 bp, Homo sapiens
agcatgggtccagaaga

SEQ ID NO: 5193544 - DNA, 17 bp, Homo sapiens
agcatgggtgtgccctt

SEQ ID NO: 5193545 - DNA, 16 bp, Homo sapiens
agcatggtagtggcaa

SEQ ID NO: 5193546 - DNA, 13 bp, Homo sapiens
agcgggactcagt

SEQ ID NO: 5193547 - DNA, 15 bp, Homo sapiens
agcgggaggcagcgc

SEQ ID NO: 5193548 - DNA, 21 bp, Homo sapiens
agcgggagggagtctcaggag

SEQ ID NO: 5193549 - DNA, 23 bp, Homo sapiens
agcgggagtctcctcactgccac

SEQ ID NO: 5193550 - DNA, 16 bp, Homo sapiens
agcgggagtgtggggg

SEQ ID NO: 5193551 - DNA, 11 bp, Homo sapiens
agcgggcacag

SEQ ID NO: 5193552 - DNA, 14 bp, Homo sapiens
agcgggcagatggg

SEQ ID NO: 5193553 - DNA, 12 bp, Homo sapiens
agcgggcagggc

SEQ ID NO: 5193554 - DNA, 19 bp, Homo sapiens
agcgggcaggttctgcctg

SEQ ID NO: 5193555 - DNA, 16 bp, Homo sapiens
agcgggccaggcaggc

SEQ ID NO: 5193556 - DNA, 17 bp, Homo sapiens
agcgggccctctgccga

SEQ ID NO: 5193557 - DNA, 13 bp, Homo sapiens
agcgggcggaggg

SEQ ID NO: 5193558 - DNA, 21 bp, Homo sapiens
agcgggctcgaagaaaataat

SEQ ID NO: 5193559 - DNA, 15 bp, Homo sapiens
agcgggctgtgcccg

SEQ ID NO: 5193560 - DNA, 18 bp, Homo sapiens
agcgggctgtgcccggcc

SEQ ID NO: 5193561 - DNA, 15 bp, Homo sapiens
agcggggacagctcc

SEQ ID NO: 5193562 - DNA, 17 bp, Homo sapiens
agcggggacagctcctt

SEQ ID NO: 5193563 - DNA, 17 bp, Homo sapiens
agcggggcagcggggct

SEQ ID NO: 5193564 - DNA, 19 bp, Homo sapiens
agcggggcagcggggctgg

SEQ ID NO: 5193565 - DNA, 20 bp, Homo sapiens
agcggggcagcggggctggc

SEQ ID NO: 5193566 - DNA, 14 bp, Homo sapiens
agcggggctggcca

SEQ ID NO: 5193567 - DNA, 12 bp, Homo sapiens
agcggggcttct

SEQ ID NO: 5193568 - DNA, 16 bp, Homo sapiens
agcgggggccttgaag

SEQ ID NO: 5193569 - DNA, 19 bp, Homo sapiens
agcgggggcggcccagcct

SEQ ID NO: 5193570 - DNA, 14 bp, Homo sapiens
agcggggggagggt

SEQ ID NO: 5193571 - DNA, 11 bp, Homo sapiens
agcgggtgggg

SEQ ID NO: 5193572 - DNA, 21 bp, Homo sapiens
agcgggtggtggctctggaca

SEQ ID NO: 5193573 - DNA, 15 bp, Homo sapiens
agcggtatctctggc

SEQ ID NO: 5193574 - DNA, 17 bp, Homo sapiens
agcggtcagactggagg

SEQ ID NO: 5193575 - DNA, 22 bp, Homo sapiens
agcggtccatgggtctggcctg

SEQ ID NO: 5193576 - DNA, 12 bp, Homo sapiens
agcggtccctgc

SEQ ID NO: 5193577 - DNA, 13 bp, Homo sapiens
agcggtctcaggc

SEQ ID NO: 5193578 - DNA, 22 bp, Homo sapiens
agcggtctcaggctggtgggag

SEQ ID NO: 5193579 - DNA, 22 bp, Homo sapiens
agcggtgctgtcctcaggtggc

SEQ ID NO: 5193580 - DNA, 23 bp, Homo sapiens
agcggtggaggaaggctctgtca

SEQ ID NO: 5193581 - DNA, 15 bp, Homo sapiens
agcggtggccccgag

SEQ ID NO: 5193582 - DNA, 21 bp, Homo sapiens
agcggtggccctgtccctccc

SEQ ID NO: 5193583 - DNA, 14 bp, Homo sapiens
agcggtgggaagga

SEQ ID NO: 5193584 - DNA, 16 bp, Homo sapiens
agcggtggtttgtaat

SEQ ID NO: 5193585 - DNA, 16 bp, Homo sapiens
agcggttcctgtgcag

SEQ ID NO: 5193586 - DNA, 14 bp, Homo sapiens
agcggtttcctggt

SEQ ID NO: 5193587 - DNA, 22 bp, Homo sapiens
agcggtttggggagcagagaca

SEQ ID NO: 5193588 - DNA, 21 bp, Homo sapiens
agcgtacatacggttctgtta

SEQ ID NO: 5193589 - DNA, 18 bp, Homo sapiens
agcgtactcatcatcaac

SEQ ID NO: 5193590 - DNA, 23 bp, Homo sapiens
agcgtagctaagtgaaaaggtca

SEQ ID NO: 5193591 - DNA, 17 bp, Homo sapiens
agcgtagtgcagcaggg

SEQ ID NO: 5193592 - DNA, 19 bp, Homo sapiens
agcgtcaaagaaaatgcct

SEQ ID NO: 5193593 - DNA, 23 bp, Homo sapiens
agcgtcactccagtgctcagctg

SEQ ID NO: 5193594 - DNA, 15 bp, Homo sapiens
agcgtcacttctcct

SEQ ID NO: 5193595 - DNA, 16 bp, Homo sapiens
agcgtcacttctcctg

SEQ ID NO: 5193596 - DNA, 21 bp, Homo sapiens
agcgtcagaagtctagtttta

SEQ ID NO: 5193597 - DNA, 15 bp, Homo sapiens
agcgtcagtttcact

SEQ ID NO: 5193598 - DNA, 15 bp, Homo sapiens
agcgtccagaaatgg

SEQ ID NO: 5193599 - DNA, 14 bp, Homo sapiens
agcgtccaggtgat

SEQ ID NO: 5193600 - DNA, 20 bp, Homo sapiens
agcgtccaggtgatccccca

SEQ ID NO: 5193601 - DNA, 15 bp, Homo sapiens
agcgtccatttctta

SEQ ID NO: 5193602 - DNA, 19 bp, Homo sapiens
agcgtcccagtctctggca

SEQ ID NO: 5193603 - DNA, 17 bp, Homo sapiens
agcgtccctagcagtga

SEQ ID NO: 5193604 - DNA, 13 bp, Homo sapiens
agcgtcctcagca

SEQ ID NO: 5193605 - DNA, 19 bp, Homo sapiens
agcgtcctcagcaccccac

SEQ ID NO: 5193606 - DNA, 17 bp, Homo sapiens
agcgtcctcctctgtga

SEQ ID NO: 5193607 - DNA, 13 bp, Homo sapiens
agcgtcctgccct

SEQ ID NO: 5193608 - DNA, 15 bp, Homo sapiens
agcgtccttggctgc

SEQ ID NO: 5193609 - DNA, 14 bp, Homo sapiens
agcgtctcccttgg

SEQ ID NO: 5193610 - DNA, 16 bp, Homo sapiens
agcgtctcccttggcc

SEQ ID NO: 5193611 - DNA, 19 bp, Homo sapiens
agcgtctcccttggccacg

SEQ ID NO: 5193612 - DNA, 15 bp, Homo sapiens
agcgtctcggccctt

SEQ ID NO: 5193613 - DNA, 14 bp, Homo sapiens
agcgtctgcagggt

SEQ ID NO: 5193614 - DNA, 22 bp, Homo sapiens
agcgtctgcagggtgacgcctg

SEQ ID NO: 5193615 - DNA, 21 bp, Homo sapiens
agcgtctgctcataggacctg

SEQ ID NO: 5193616 - DNA, 22 bp, Homo sapiens
agcgtctgctcataggacctgc

SEQ ID NO: 5193617 - DNA, 19 bp, Homo sapiens
agcgtctgggcaagaggaa

SEQ ID NO: 5193618 - DNA, 14 bp, Homo sapiens
agcgtcttgctctg

SEQ ID NO: 5193619 - DNA, 15 bp, Homo sapiens
agcgtctttaagaga

SEQ ID NO: 5193620 - DNA, 18 bp, Homo sapiens
agcgtctttaagagactc

SEQ ID NO: 5193621 - DNA, 19 bp, Homo sapiens
agcgtctttaagagactca

SEQ ID NO: 5193622 - DNA, 20 bp, Homo sapiens
agcgtctttaagagactcac

SEQ ID NO: 5193623 - DNA, 12 bp, Homo sapiens
agcgtgaaggac

SEQ ID NO: 5193624 - DNA, 16 bp, Homo sapiens
agcgtgagccactgca

SEQ ID NO: 5193625 - DNA, 15 bp, Homo sapiens
agcgtgcaccccgcc

SEQ ID NO: 5193626 - DNA, 23 bp, Homo sapiens
agcgtgcaccccgccggaggaag

SEQ ID NO: 5193627 - DNA, 14 bp, Homo sapiens
agcgtgccgagcca

SEQ ID NO: 5193628 - DNA, 13 bp, Homo sapiens
agcgtgcggggcc

SEQ ID NO: 5193629 - DNA, 16 bp, Homo sapiens
agcgtgcgtctgtgtg

SEQ ID NO: 5193630 - DNA, 15 bp, Homo sapiens
agcgtgctgacatca

SEQ ID NO: 5193631 - DNA, 19 bp, Homo sapiens
agcgtggaagggggaggag

SEQ ID NO: 5193632 - DNA, 14 bp, Homo sapiens
agcgtggactctgc

SEQ ID NO: 5193633 - DNA, 15 bp, Homo sapiens
agcgtggcccaggcc

SEQ ID NO: 5193634 - DNA, 16 bp, Homo sapiens
agcgtggcccaggccg

SEQ ID NO: 5193635 - DNA, 12 bp, Homo sapiens
agcgtggccttg

SEQ ID NO: 5193636 - DNA, 17 bp, Homo sapiens
agcgtggccttgggagg

SEQ ID NO: 5193637 - DNA, 24 bp, Homo sapiens
agcgtggcgcagtggccctgagca

SEQ ID NO: 5193638 - DNA, 13 bp, Homo sapiens
agcgtggcttaga

SEQ ID NO: 5193639 - DNA, 19 bp, Homo sapiens
agcgtgtactaccccagaa

SEQ ID NO: 5193640 - DNA, 21 bp, Homo sapiens
agcgtgtcctatccccggacg

SEQ ID NO: 5193641 - DNA, 15 bp, Homo sapiens
agcgtgtgccaggca

SEQ ID NO: 5193642 - DNA, 16 bp, Homo sapiens
agcgtgtgccaggcag

SEQ ID NO: 5193643 - DNA, 13 bp, Homo sapiens
agcgtgtgtatcc

SEQ ID NO: 5193644 - DNA, 14 bp, Homo sapiens
agcgtgttctcagc

SEQ ID NO: 5193645 - DNA, 18 bp, Homo sapiens
agcgtgtttacatgtgta

SEQ ID NO: 5193646 - DNA, 15 bp, Homo sapiens
agcgttaagggcaga

SEQ ID NO: 5193647 - DNA, 16 bp, Homo sapiens
agcgttagaggggcca

SEQ ID NO: 5193648 - DNA, 15 bp, Homo sapiens
agcgttcccttctcc

SEQ ID NO: 5193649 - DNA, 21 bp, Homo sapiens
agcgttcccttctcccccttg

SEQ ID NO: 5193650 - DNA, 18 bp, Homo sapiens
agcgttcctggccttctg

SEQ ID NO: 5193651 - DNA, 13 bp, Homo sapiens
agcgttctggact

SEQ ID NO: 5193652 - DNA, 17 bp, Homo sapiens
agcgttcttcaggagat

SEQ ID NO: 5193653 - DNA, 12 bp, Homo sapiens
agcgttcttgta

SEQ ID NO: 5193654 - DNA, 16 bp, Homo sapiens
agcgtttacatattta

SEQ ID NO: 5193655 - DNA, 23 bp, Homo sapiens
agcgtttagtttctagaggcctc

SEQ ID NO: 5193656 - DNA, 18 bp, Homo sapiens
agcgtttgctgtgccagg

SEQ ID NO: 5193657 - DNA, 13 bp, Homo sapiens
agcgttttgcaag

SEQ ID NO: 5193658 - DNA, 18 bp, Homo sapiens
agcgttttgttgagcatg

SEQ ID NO: 5193659 - DNA, 11 bp, Homo sapiens
agcgtttttta

SEQ ID NO: 5193660 - DNA, 17 bp, Homo sapiens
agcgttttttaaatgta

SEQ ID NO: 5193661 - DNA, 15 bp, Homo sapiens
agctaaaaaggccct

SEQ ID NO: 5193662 - DNA, 12 bp, Homo sapiens
agctaaaaatat

SEQ ID NO: 5193663 - DNA, 20 bp, Homo sapiens
agctaaaagcatggccctgc

SEQ ID NO: 5193664 - DNA, 15 bp, Homo sapiens
agctaaaaggaaaag

SEQ ID NO: 5193665 - DNA, 12 bp, Homo sapiens
agctaaaataaa

SEQ ID NO: 5193666 - DNA, 19 bp, Homo sapiens
agctaaaataaagaaatag

SEQ ID NO: 5193667 - DNA, 14 bp, Homo sapiens
agctaaaatatata

SEQ ID NO: 5193668 - DNA, 15 bp, Homo sapiens
agctaaaatgatttt

SEQ ID NO: 5193669 - DNA, 13 bp, Homo sapiens
agctaaaatgtta

SEQ ID NO: 5193670 - DNA, 11 bp, Homo sapiens
agctaaaccaa

SEQ ID NO: 5193671 - DNA, 19 bp, Homo sapiens
agctaaaccaagaaggaga

SEQ ID NO: 5193672 - DNA, 21 bp, Homo sapiens
agctaaaccaagaaggagacc

SEQ ID NO: 5193673 - DNA, 17 bp, Homo sapiens
agctaaaccaaggactg

SEQ ID NO: 5193674 - DNA, 18 bp, Homo sapiens
agctaaaccaaggactga

SEQ ID NO: 5193675 - DNA, 23 bp, Homo sapiens
agctaaagaaactgcttacagtt

SEQ ID NO: 5193676 - DNA, 15 bp, Homo sapiens
agctaaagaggctga

SEQ ID NO: 5193677 - DNA, 21 bp, Homo sapiens
agctaaagtgcaagactgaat

SEQ ID NO: 5193678 - DNA, 17 bp, Homo sapiens
agctaaatcatttgaga

SEQ ID NO: 5193679 - DNA, 13 bp, Homo sapiens
agctaaatccttt

SEQ ID NO: 5193680 - DNA, 20 bp, Homo sapiens
agctaaatgaccatccagta

SEQ ID NO: 5193681 - DNA, 13 bp, Homo sapiens
agctaaatgcttc

SEQ ID NO: 5193682 - DNA, 15 bp, Homo sapiens
agctaaatgtaactt

SEQ ID NO: 5193683 - DNA, 22 bp, Homo sapiens
agctaaatgtaacttattccaa

SEQ ID NO: 5193684 - DNA, 22 bp, Homo sapiens
agctaaattgaatacacaaatt

SEQ ID NO: 5193685 - DNA, 16 bp, Homo sapiens
agctaacacacagctc

SEQ ID NO: 5193686 - DNA, 17 bp, Homo sapiens
agctaacacacagctcc

SEQ ID NO: 5193687 - DNA, 16 bp, Homo sapiens
agctaacagggaaggc

SEQ ID NO: 5193688 - DNA, 21 bp, Homo sapiens
agctaacagggaaggcaggca

SEQ ID NO: 5193689 - DNA, 14 bp, Homo sapiens
agctaacagtgaag

SEQ ID NO: 5193690 - DNA, 13 bp, Homo sapiens
agctaacatcttt

SEQ ID NO: 5193691 - DNA, 22 bp, Homo sapiens
agctaacattttaaataaaaga

SEQ ID NO: 5193692 - DNA, 23 bp, Homo sapiens
agctaaccagttaccacacatct

SEQ ID NO: 5193693 - DNA, 14 bp, Homo sapiens
agctaagaaaagat

SEQ ID NO: 5193694 - DNA, 13 bp, Homo sapiens
agctaagaaataa

SEQ ID NO: 5193695 - DNA, 12 bp, Homo sapiens
agctaagcacag

SEQ ID NO: 5193696 - DNA, 20 bp, Homo sapiens
agctaagcagaataatggaa

SEQ ID NO: 5193697 - DNA, 16 bp, Homo sapiens
agctaagcattttctc

SEQ ID NO: 5193698 - DNA, 17 bp, Homo sapiens
agctaagctaggaatga

SEQ ID NO: 5193699 - DNA, 18 bp, Homo sapiens
agctaagctaggaatgaa

SEQ ID NO: 5193700 - DNA, 16 bp, Homo sapiens
agctaaggacatttcc

SEQ ID NO: 5193701 - DNA, 23 bp, Homo sapiens
agctaaggaggggaaaaaaatgt

SEQ ID NO: 5193702 - DNA, 21 bp, Homo sapiens
agctaaggccaatgggctaga

SEQ ID NO: 5193703 - DNA, 14 bp, Homo sapiens
agctaaggccagct

SEQ ID NO: 5193704 - DNA, 10 bp, Homo sapiens
agctaaggct

SEQ ID NO: 5193705 - DNA, 21 bp, Homo sapiens
agctaaggctcgagttaaaac

SEQ ID NO: 5193706 - DNA, 13 bp, Homo sapiens
agctaaggctcta

SEQ ID NO: 5193707 - DNA, 22 bp, Homo sapiens
agctaagggtgggtgctcagaa

SEQ ID NO: 5193708 - DNA, 16 bp, Homo sapiens
agctaaggtctataaa

SEQ ID NO: 5193709 - DNA, 22 bp, Homo sapiens
agctaagtaaaaatatgtcatc

SEQ ID NO: 5193710 - DNA, 17 bp, Homo sapiens
agctaagtcttgtctca

SEQ ID NO: 5193711 - DNA, 19 bp, Homo sapiens
agctaataaaaagcttttg

SEQ ID NO: 5193712 - DNA, 21 bp, Homo sapiens
agctaataaaaagcttttgtc

SEQ ID NO: 5193713 - DNA, 20 bp, Homo sapiens
agctaataaaagtcagagct

SEQ ID NO: 5193714 - DNA, 16 bp, Homo sapiens
agctaataaaatatca

SEQ ID NO: 5193715 - DNA, 16 bp, Homo sapiens
agctaataaaccagat

SEQ ID NO: 5193716 - DNA, 18 bp, Homo sapiens
agctaataacatgtgaaa

SEQ ID NO: 5193717 - DNA, 13 bp, Homo sapiens
agctaataataaa

SEQ ID NO: 5193718 - DNA, 17 bp, Homo sapiens
agctaataataaatgca

SEQ ID NO: 5193719 - DNA, 19 bp, Homo sapiens
agctaataataaatgcata

SEQ ID NO: 5193720 - DNA, 23 bp, Homo sapiens
agctaataataaatgcatagagc

SEQ ID NO: 5193721 - DNA, 12 bp, Homo sapiens
agctaataatga

SEQ ID NO: 5193722 - DNA, 15 bp, Homo sapiens
agctaataatgttaa

SEQ ID NO: 5193723 - DNA, 22 bp, Homo sapiens
agctaataattcttcacctaag

SEQ ID NO: 5193724 - DNA, 14 bp, Homo sapiens
agctaatacaaaac

SEQ ID NO: 5193725 - DNA, 15 bp, Homo sapiens
agctaatactaatag

SEQ ID NO: 5193726 - DNA, 16 bp, Homo sapiens
agctaatctgaccgtt

SEQ ID NO: 5193727 - DNA, 21 bp, Homo sapiens
agcatggtcacaagcacaaag

SEQ ID NO: 5193728 - DNA, 23 bp, Homo sapiens
agcatggtcccacatccctgggc

SEQ ID NO: 5193729 - DNA, 16 bp, Homo sapiens
agcatggtccctgcct

SEQ ID NO: 5193730 - DNA, 17 bp, Homo sapiens
agcatggtgcatgccgc

SEQ ID NO: 5193731 - DNA, 14 bp, Homo sapiens
agcatggtgtcagt

SEQ ID NO: 5193732 - DNA, 23 bp, Homo sapiens
agcatggttccaattttttttaa

SEQ ID NO: 5193733 - DNA, 23 bp, Homo sapiens
agcatggttgcagataaactgat

SEQ ID NO: 5193734 - DNA, 19 bp, Homo sapiens
agcatgtaacttatattaa

SEQ ID NO: 5193735 - DNA, 12 bp, Homo sapiens
agcatgtagctc

SEQ ID NO: 5193736 - DNA, 21 bp, Homo sapiens
agcatgtatgtctgcaggtgt

SEQ ID NO: 5193737 - DNA, 23 bp, Homo sapiens
agcatgtcaattcataaaaacaa

SEQ ID NO: 5193738 - DNA, 16 bp, Homo sapiens
agcatgtcactaaagc

SEQ ID NO: 5193739 - DNA, 23 bp, Homo sapiens
agcatgtccaacatggtaattca

SEQ ID NO: 5193740 - DNA, 23 bp, Homo sapiens
agcatgtcctaatgcttgctgct

SEQ ID NO: 5193741 - DNA, 15 bp, Homo sapiens
agcatgtctactgct

SEQ ID NO: 5193742 - DNA, 17 bp, Homo sapiens
agcatgtctctctgcca

SEQ ID NO: 5193743 - DNA, 18 bp, Homo sapiens
agcatgtctctctgccaa

SEQ ID NO: 5193744 - DNA, 15 bp, Homo sapiens
agcatgtctctgctt

SEQ ID NO: 5193745 - DNA, 23 bp, Homo sapiens
agcatgtctctgcttccatggct

SEQ ID NO: 5193746 - DNA, 16 bp, Homo sapiens
agcatgtcttatttaa

SEQ ID NO: 5193747 - DNA, 14 bp, Homo sapiens
agcatgtgccaaga

SEQ ID NO: 5193748 - DNA, 17 bp, Homo sapiens
agcatgtgccctcctga

SEQ ID NO: 5193749 - DNA, 18 bp, Homo sapiens
agcatgtgccttaatgct

SEQ ID NO: 5193750 - DNA, 12 bp, Homo sapiens
agcatgtggcat

SEQ ID NO: 5193751 - DNA, 15 bp, Homo sapiens
agcatgtggggaagc

SEQ ID NO: 5193752 - DNA, 15 bp, Homo sapiens
agcatgtgtcagagt

SEQ ID NO: 5193753 - DNA, 17 bp, Homo sapiens
agcatgtgtcagagtgt

SEQ ID NO: 5193754 - DNA, 15 bp, Homo sapiens
agcatgtgtgtgtct

SEQ ID NO: 5193755 - DNA, 18 bp, Homo sapiens
agcatgtgtgtgtctcta

SEQ ID NO: 5193756 - DNA, 19 bp, Homo sapiens
agcatgtgttgcagctgtc

SEQ ID NO: 5193757 - DNA, 12 bp, Homo sapiens
agcatgttactg

SEQ ID NO: 5193758 - DNA, 22 bp, Homo sapiens
agcatgttcctccttttcttca

SEQ ID NO: 5193759 - DNA, 22 bp, Homo sapiens
agcatgttcgtattacaagaga

SEQ ID NO: 5193760 - DNA, 19 bp, Homo sapiens
agcatgttgagccaggcct

SEQ ID NO: 5193761 - DNA, 21 bp, Homo sapiens
agcatgttgagccaggcctgg

SEQ ID NO: 5193762 - DNA, 15 bp, Homo sapiens
agcatgtttgctgaa

SEQ ID NO: 5193763 - DNA, 17 bp, Homo sapiens
agcatgtttgctgaaca

SEQ ID NO: 5193764 - DNA, 22 bp, Homo sapiens
agcatgtttggcctatttcatt

SEQ ID NO: 5193765 - DNA, 16 bp, Homo sapiens
agcatgttttctgctt

SEQ ID NO: 5193766 - DNA, 22 bp, Homo sapiens
agcatgttttctgctttaaatt

SEQ ID NO: 5193767 - DNA, 14 bp, Homo sapiens
agcatgttttgcat

SEQ ID NO: 5193768 - DNA, 15 bp, Homo sapiens
agcatgttttgtata

SEQ ID NO: 5193769 - DNA, 16 bp, Homo sapiens
agcatgttttgtatac

SEQ ID NO: 5193770 - DNA, 18 bp, Homo sapiens
agcattaaaaataaaagt

SEQ ID NO: 5193771 - DNA, 16 bp, Homo sapiens
agcattaaaataacta

SEQ ID NO: 5193772 - DNA, 17 bp, Homo sapiens
agcattaaaataactat

SEQ ID NO: 5193773 - DNA, 18 bp, Homo sapiens
agcattaaaataactatc

SEQ ID NO: 5193774 - DNA, 15 bp, Homo sapiens
agcattaactaaatg

SEQ ID NO: 5193775 - DNA, 19 bp, Homo sapiens
agcattaactaaatgctca

SEQ ID NO: 5193776 - DNA, 15 bp, Homo sapiens
agcattaagcccaat

SEQ ID NO: 5193777 - DNA, 17 bp, Homo sapiens
agcattaaggtatttcg

SEQ ID NO: 5193778 - DNA, 15 bp, Homo sapiens
agcattaataaaact

SEQ ID NO: 5193779 - DNA, 23 bp, Homo sapiens
agcattaataaaactgtgcatct

SEQ ID NO: 5193780 - DNA, 15 bp, Homo sapiens
agcattacaaattgc

SEQ ID NO: 5193781 - DNA, 13 bp, Homo sapiens
agcattacattat

SEQ ID NO: 5193782 - DNA, 14 bp, Homo sapiens
agcattacattatt

SEQ ID NO: 5193783 - DNA, 17 bp, Homo sapiens
agcattacattattaaa

SEQ ID NO: 5193784 - DNA, 15 bp, Homo sapiens
agcattacctaattt

SEQ ID NO: 5193785 - DNA, 17 bp, Homo sapiens
agcattactcttgtaag

SEQ ID NO: 5193786 - DNA, 18 bp, Homo sapiens
agcattactcttgtaaga

SEQ ID NO: 5193787 - DNA, 19 bp, Homo sapiens
agcattactcttgtaagat

SEQ ID NO: 5193788 - DNA, 21 bp, Homo sapiens
agcattactcttgtaagattt

SEQ ID NO: 5193789 - DNA, 13 bp, Homo sapiens
agcattactcttt

SEQ ID NO: 5193790 - DNA, 21 bp, Homo sapiens
agcattactttgtagatgtat

SEQ ID NO: 5193791 - DNA, 20 bp, Homo sapiens
agcattagatagtcatgctg

SEQ ID NO: 5193792 - DNA, 17 bp, Homo sapiens
agcattagatttctcat

SEQ ID NO: 5193793 - DNA, 17 bp, Homo sapiens
agcattagcacatattt

SEQ ID NO: 5193794 - DNA, 15 bp, Homo sapiens
agcattagctttaat

SEQ ID NO: 5193795 - DNA, 22 bp, Homo sapiens
agcattagttggagctagaaaa

SEQ ID NO: 5193796 - DNA, 23 bp, Homo sapiens
agcattagttggagctagaaaat

SEQ ID NO: 5193797 - DNA, 14 bp, Homo sapiens
agcattatcttatc

SEQ ID NO: 5193798 - DNA, 19 bp, Homo sapiens
agcattatgatgtgggtca

SEQ ID NO: 5193799 - DNA, 17 bp, Homo sapiens
agcattattcttcagaa

SEQ ID NO: 5193800 - DNA, 15 bp, Homo sapiens
agcattcaaaatagt

SEQ ID NO: 5193801 - DNA, 23 bp, Homo sapiens
agcattcaaatgaagattcagca

SEQ ID NO: 5193802 - DNA, 17 bp, Homo sapiens
agcattcagaagaaaaa

SEQ ID NO: 5193803 - DNA, 14 bp, Homo sapiens
agcattcagagagc

SEQ ID NO: 5193804 - DNA, 15 bp, Homo sapiens
agcattcagagagca

SEQ ID NO: 5193805 - DNA, 13 bp, Homo sapiens
agcattcagcaca

SEQ ID NO: 5193806 - DNA, 21 bp, Homo sapiens
agcattcagcacaccccaagg

SEQ ID NO: 5193807 - DNA, 20 bp, Homo sapiens
agcattcatttgttttttca

SEQ ID NO: 5193808 - DNA, 21 bp, Homo sapiens
agcattccacactgcagggag

SEQ ID NO: 5193809 - DNA, 13 bp, Homo sapiens
agcattccagact

SEQ ID NO: 5193810 - DNA, 18 bp, Homo sapiens
agcattccagacttcaaa

SEQ ID NO: 5193811 - DNA, 20 bp, Homo sapiens
agcattccagacttcaaaaa

SEQ ID NO: 5193812 - DNA, 16 bp, Homo sapiens
agcattccagcccctc

SEQ ID NO: 5193813 - DNA, 19 bp, Homo sapiens
agcattccagcccctctgg

SEQ ID NO: 5193814 - DNA, 13 bp, Homo sapiens
agcattccagctc

SEQ ID NO: 5193815 - DNA, 15 bp, Homo sapiens
agcattccagctctg

SEQ ID NO: 5193816 - DNA, 19 bp, Homo sapiens
agcattccagctctgcccc

SEQ ID NO: 5193817 - DNA, 12 bp, Homo sapiens
agcattccagta

SEQ ID NO: 5193818 - DNA, 13 bp, Homo sapiens
agcattccagtaa

SEQ ID NO: 5193819 - DNA, 17 bp, Homo sapiens
agcattccagtaacttt

SEQ ID NO: 5193820 - DNA, 19 bp, Homo sapiens
agcattcccaattatcaaa

SEQ ID NO: 5193821 - DNA, 19 bp, Homo sapiens
agcattcccaccaacaaaa

SEQ ID NO: 5193822 - DNA, 20 bp, Homo sapiens
agcattcccaccaacaaaat

SEQ ID NO: 5193823 - DNA, 19 bp, Homo sapiens
agcattcccaggtaggcca

SEQ ID NO: 5193824 - DNA, 22 bp, Homo sapiens
agcattccctacagcctagggc

SEQ ID NO: 5193825 - DNA, 21 bp, Homo sapiens
agcattcctcaggaaggacat

SEQ ID NO: 5193826 - DNA, 18 bp, Homo sapiens
agcattccttagcagctc

SEQ ID NO: 5193827 - DNA, 15 bp, Homo sapiens
agcattccttctttg

SEQ ID NO: 5193828 - DNA, 17 bp, Homo sapiens
agcattccttctttgat

SEQ ID NO: 5193829 - DNA, 18 bp, Homo sapiens
agcattccttctttgata

SEQ ID NO: 5193830 - DNA, 22 bp, Homo sapiens
agcattccttctttgataatgt

SEQ ID NO: 5193831 - DNA, 23 bp, Homo sapiens
agcattccttctttgataatgtt

SEQ ID NO: 5193832 - DNA, 14 bp, Homo sapiens
agcattccttttga

SEQ ID NO: 5193833 - DNA, 19 bp, Homo sapiens
agcattcgagacagaacct

SEQ ID NO: 5193834 - DNA, 20 bp, Homo sapiens
agcattctcactcctacctg

SEQ ID NO: 5193835 - DNA, 14 bp, Homo sapiens
agcattctcagcca

SEQ ID NO: 5193836 - DNA, 22 bp, Homo sapiens
agcattctcattggaaatttag

SEQ ID NO: 5193837 - DNA, 18 bp, Homo sapiens
agcattctgagctgggct

SEQ ID NO: 5193838 - DNA, 15 bp, Homo sapiens
agcattctgcctgcc

SEQ ID NO: 5193839 - DNA, 16 bp, Homo sapiens
agcattctgcctgcct

SEQ ID NO: 5193840 - DNA, 21 bp, Homo sapiens
agcattctgcctgcctgggaa

SEQ ID NO: 5193841 - DNA, 17 bp, Homo sapiens
agcattctggaggggag

SEQ ID NO: 5193842 - DNA, 18 bp, Homo sapiens
agcattctggaggggaga

SEQ ID NO: 5193843 - DNA, 13 bp, Homo sapiens
agcattctggggt

SEQ ID NO: 5193844 - DNA, 21 bp, Homo sapiens
agcattcttagactagttgaa

SEQ ID NO: 5193845 - DNA, 16 bp, Homo sapiens
agcattcttgtcacaa

SEQ ID NO: 5193846 - DNA, 19 bp, Homo sapiens
agcattcttgtcacaataa

SEQ ID NO: 5193847 - DNA, 20 bp, Homo sapiens
agcattcttgtcacaataaa

SEQ ID NO: 5193848 - DNA, 19 bp, Homo sapiens
agcattctttggagttaaa

SEQ ID NO: 5193849 - DNA, 19 bp, Homo sapiens
agcattgaaataataatat

SEQ ID NO: 5193850 - DNA, 15 bp, Homo sapiens
agcattgaaattata

SEQ ID NO: 5193851 - DNA, 13 bp, Homo sapiens
agcattgaagaga

SEQ ID NO: 5193852 - DNA, 23 bp, Homo sapiens
agcattgaagtatggtgtgttca

SEQ ID NO: 5193853 - DNA, 15 bp, Homo sapiens
agcattgaatggcta

SEQ ID NO: 5193854 - DNA, 15 bp, Homo sapiens
agcattgataatctt

SEQ ID NO: 5193855 - DNA, 17 bp, Homo sapiens
agcattgataatcttca

SEQ ID NO: 5193856 - DNA, 15 bp, Homo sapiens
agcattgatatttgt

SEQ ID NO: 5193857 - DNA, 19 bp, Homo sapiens
agcattgatatttgtgcat

SEQ ID NO: 5193858 - DNA, 12 bp, Homo sapiens
agcattgcctgg

SEQ ID NO: 5193859 - DNA, 22 bp, Homo sapiens
agcattgctcaagaggaaaatc

SEQ ID NO: 5193860 - DNA, 15 bp, Homo sapiens
agcattgctggactc

SEQ ID NO: 5193861 - DNA, 14 bp, Homo sapiens
agcattgctggttc

SEQ ID NO: 5193862 - DNA, 23 bp, Homo sapiens
agcattgctggttctatttaatg

SEQ ID NO: 5193863 - DNA, 11 bp, Homo sapiens
agcattgcttt

SEQ ID NO: 5193864 - DNA, 12 bp, Homo sapiens
agcattgctttc

SEQ ID NO: 5193865 - DNA, 23 bp, Homo sapiens
agcattggatacagcagtagaca

SEQ ID NO: 5193866 - DNA, 18 bp, Homo sapiens
agcattgtaaatgtgctt

SEQ ID NO: 5193867 - DNA, 19 bp, Homo sapiens
agcattgtcagcctgaaga

SEQ ID NO: 5193868 - DNA, 21 bp, Homo sapiens
agcattgtctcgtgtacagct

SEQ ID NO: 5193869 - DNA, 13 bp, Homo sapiens
agcattgtctctc

SEQ ID NO: 5193870 - DNA, 18 bp, Homo sapiens
agcattgtcttaattttt

SEQ ID NO: 5193871 - DNA, 22 bp, Homo sapiens
agcattgtcttgttctgtccct

SEQ ID NO: 5193872 - DNA, 17 bp, Homo sapiens
agcattgtctttgctgt

SEQ ID NO: 5193873 - DNA, 18 bp, Homo sapiens
agcattgtctttgctgta

SEQ ID NO: 5193874 - DNA, 20 bp, Homo sapiens
agcattgtggctgtcagcag

SEQ ID NO: 5193875 - DNA, 21 bp, Homo sapiens
agcattgtggctgtcagcagg

SEQ ID NO: 5193876 - DNA, 14 bp, Homo sapiens
agcattgttccaca

SEQ ID NO: 5193877 - DNA, 15 bp, Homo sapiens
agcattgttccacac

SEQ ID NO: 5193878 - DNA, 18 bp, Homo sapiens
agcattgttgagctgtca

SEQ ID NO: 5193879 - DNA, 15 bp, Homo sapiens
agcattgtttgctta

SEQ ID NO: 5193880 - DNA, 22 bp, Homo sapiens
agcattgtttgcttattgttcc

SEQ ID NO: 5193881 - DNA, 23 bp, Homo sapiens
agcattgtttgcttattgttcca

SEQ ID NO: 5193882 - DNA, 18 bp, Homo sapiens
agcattgtttgtgatatt

SEQ ID NO: 5193883 - DNA, 22 bp, Homo sapiens
agcatttaatggcagctagtgc

SEQ ID NO: 5193884 - DNA, 16 bp, Homo sapiens
agcatttacagaaatg

SEQ ID NO: 5193885 - DNA, 19 bp, Homo sapiens
agcatttaccaacatgtat

SEQ ID NO: 5193886 - DNA, 21 bp, Homo sapiens
agcatttaccaacatgtatct

SEQ ID NO: 5193887 - DNA, 15 bp, Homo sapiens
agcatttactttgaa

SEQ ID NO: 5193888 - DNA, 17 bp, Homo sapiens
agcatttactttgaatt

SEQ ID NO: 5193889 - DNA, 22 bp, Homo sapiens
agcatttagaacgagcctggaa

SEQ ID NO: 5193890 - DNA, 20 bp, Homo sapiens
agcatttagagcttttcaga

SEQ ID NO: 5193891 - DNA, 22 bp, Homo sapiens
agcatttagatgtataggttga

SEQ ID NO: 5193892 - DNA, 22 bp, Homo sapiens
agcatttagtgaagttgtgcaa

SEQ ID NO: 5193893 - DNA, 22 bp, Homo sapiens
agcatttagttacaacctgaag

SEQ ID NO: 5193894 - DNA, 14 bp, Homo sapiens
agcatttataaatt

SEQ ID NO: 5193895 - DNA, 18 bp, Homo sapiens
agcatttatgtagacatt

SEQ ID NO: 5193896 - DNA, 16 bp, Homo sapiens
agcatttatttctctg

SEQ ID NO: 5193897 - DNA, 21 bp, Homo sapiens
agcatttcaaagccctgcctc

SEQ ID NO: 5193898 - DNA, 18 bp, Homo sapiens
agcatttcatgaaaaagc

SEQ ID NO: 5193899 - DNA, 13 bp, Homo sapiens
agcatttcattct

SEQ ID NO: 5193900 - DNA, 21 bp, Homo sapiens
agcatttcattcttctctagc

SEQ ID NO: 5193901 - DNA, 18 bp, Homo sapiens
agcatttccaacaccaca

SEQ ID NO: 5193902 - DNA, 23 bp, Homo sapiens
agcatttccaacaccacagacac

SEQ ID NO: 5193903 - DNA, 15 bp, Homo sapiens
agcatttccttccag

SEQ ID NO: 5193904 - DNA, 16 bp, Homo sapiens
agctaatctttaatat

SEQ ID NO: 5193905 - DNA, 15 bp, Homo sapiens
agctaatgaaattga

SEQ ID NO: 5193906 - DNA, 17 bp, Homo sapiens
agctaatgaaattgaga

SEQ ID NO: 5193907 - DNA, 14 bp, Homo sapiens
agctaatgaccaac

SEQ ID NO: 5193908 - DNA, 22 bp, Homo sapiens
agctaatgaccaacctgtttct

SEQ ID NO: 5193909 - DNA, 17 bp, Homo sapiens
agctaatggaaaatgat

SEQ ID NO: 5193910 - DNA, 23 bp, Homo sapiens
agctaatgtaataactgtgaagt

SEQ ID NO: 5193911 - DNA, 24 bp, Homo sapiens
agctaatgtgcagggatattgcct

SEQ ID NO: 5193912 - DNA, 19 bp, Homo sapiens
agctaattaaggtttgccc

SEQ ID NO: 5193913 - DNA, 19 bp, Homo sapiens
agctaattctttgacctgt

SEQ ID NO: 5193914 - DNA, 13 bp, Homo sapiens
agctaatttactg

SEQ ID NO: 5193915 - DNA, 16 bp, Homo sapiens
agctaatttatagcaa

SEQ ID NO: 5193916 - DNA, 15 bp, Homo sapiens
agctaatttgtgaaa

SEQ ID NO: 5193917 - DNA, 16 bp, Homo sapiens
agctaatttgtgaaag

SEQ ID NO: 5193918 - DNA, 17 bp, Homo sapiens
agctaattttcatattt

SEQ ID NO: 5193919 - DNA, 14 bp, Homo sapiens
agctaatttttgta

SEQ ID NO: 5193920 - DNA, 17 bp, Homo sapiens
agctaatttttgtattt

SEQ ID NO: 5193921 - DNA, 15 bp, Homo sapiens
agctacaacagcctc

SEQ ID NO: 5193922 - DNA, 16 bp, Homo sapiens
agctacaacagcctca

SEQ ID NO: 5193923 - DNA, 17 bp, Homo sapiens
agctacaaccctaccct

SEQ ID NO: 5193924 - DNA, 19 bp, Homo sapiens
agctacaaccctaccctgg

SEQ ID NO: 5193925 - DNA, 20 bp, Homo sapiens
agctacaaccctaccctggc

SEQ ID NO: 5193926 - DNA, 17 bp, Homo sapiens
agctacaatattctctc

SEQ ID NO: 5193927 - DNA, 19 bp, Homo sapiens
agctacaatttgtttttgc

SEQ ID NO: 5193928 - DNA, 21 bp, Homo sapiens
agctacacctttctcctttgt

SEQ ID NO: 5193929 - DNA, 20 bp, Homo sapiens
agctacactattgcattgtt

SEQ ID NO: 5193930 - DNA, 15 bp, Homo sapiens
agctacagagaaacc

SEQ ID NO: 5193931 - DNA, 16 bp, Homo sapiens
agctacagagaaacca

SEQ ID NO: 5193932 - DNA, 19 bp, Homo sapiens
agctacagagaaaccagct

SEQ ID NO: 5193933 - DNA, 23 bp, Homo sapiens
agctacagagccgagcaatattt

SEQ ID NO: 5193934 - DNA, 22 bp, Homo sapiens
agctacaggaagcaccccatgc

SEQ ID NO: 5193935 - DNA, 15 bp, Homo sapiens
agctacaggacaaag

SEQ ID NO: 5193936 - DNA, 18 bp, Homo sapiens
agctacaggggaggctga

SEQ ID NO: 5193937 - DNA, 14 bp, Homo sapiens
agctacaggttaca

SEQ ID NO: 5193938 - DNA, 19 bp, Homo sapiens
agctacaggttacaacaga

SEQ ID NO: 5193939 - DNA, 21 bp, Homo sapiens
agctacaggttacaacagatt

SEQ ID NO: 5193940 - DNA, 22 bp, Homo sapiens
agctacaggttacaacagattt

SEQ ID NO: 5193941 - DNA, 18 bp, Homo sapiens
agctacagtgcatagttg

SEQ ID NO: 5193942 - DNA, 12 bp, Homo sapiens
agctacagttgt

SEQ ID NO: 5193943 - DNA, 17 bp, Homo sapiens
agctacatatgtaggaa

SEQ ID NO: 5193944 - DNA, 15 bp, Homo sapiens
agctacatgttcttt

SEQ ID NO: 5193945 - DNA, 24 bp, Homo sapiens
agctacattcctcagctgccaagc

SEQ ID NO: 5193946 - DNA, 14 bp, Homo sapiens
agctaccatgttaa

SEQ ID NO: 5193947 - DNA, 13 bp, Homo sapiens
agctaccatttca

SEQ ID NO: 5193948 - DNA, 18 bp, Homo sapiens
agctaccattttacattt

SEQ ID NO: 5193949 - DNA, 16 bp, Homo sapiens
agctacccaaaagaga

SEQ ID NO: 5193950 - DNA, 17 bp, Homo sapiens
agctacccactatcctt

SEQ ID NO: 5193951 - DNA, 20 bp, Homo sapiens
agctacccaggaggctgagg

SEQ ID NO: 5193952 - DNA, 22 bp, Homo sapiens
agctacccaggaggctgaggtg

SEQ ID NO: 5193953 - DNA, 21 bp, Homo sapiens
agctacccctcaaactgcaca

SEQ ID NO: 5193954 - DNA, 18 bp, Homo sapiens
agctacccctgcagctgg

SEQ ID NO: 5193955 - DNA, 16 bp, Homo sapiens
agctaccccttctttg

SEQ ID NO: 5193956 - DNA, 23 bp, Homo sapiens
agctaccccttgtgggcaaaggc

SEQ ID NO: 5193957 - DNA, 17 bp, Homo sapiens
agctacccgcagagttc

SEQ ID NO: 5193958 - DNA, 16 bp, Homo sapiens
agctaccctcagcctc

SEQ ID NO: 5193959 - DNA, 18 bp, Homo sapiens
agctaccctcagcctcca

SEQ ID NO: 5193960 - DNA, 21 bp, Homo sapiens
agctaccctcagcctccaatg

SEQ ID NO: 5193961 - DNA, 21 bp, Homo sapiens
agctaccctttttctccagct

SEQ ID NO: 5193962 - DNA, 19 bp, Homo sapiens
agctaccggaaggagggga

SEQ ID NO: 5193963 - DNA, 19 bp, Homo sapiens
agctaccgtggatctcctt

SEQ ID NO: 5193964 - DNA, 23 bp, Homo sapiens
agctacctacatgctgaaaaata

SEQ ID NO: 5193965 - DNA, 16 bp, Homo sapiens
agctacctcaaacttc

SEQ ID NO: 5193966 - DNA, 23 bp, Homo sapiens
agctacctcaaccaatgccaaaa

SEQ ID NO: 5193967 - DNA, 20 bp, Homo sapiens
agctacctgtgtggacagga

SEQ ID NO: 5193968 - DNA, 20 bp, Homo sapiens
agctaccttttttttacgga

SEQ ID NO: 5193969 - DNA, 21 bp, Homo sapiens
agctaccttttttttacggaa

SEQ ID NO: 5193970 - DNA, 22 bp, Homo sapiens
agctacgtggcactatattctg

SEQ ID NO: 5193971 - DNA, 16 bp, Homo sapiens
agctactaaaatcagt

SEQ ID NO: 5193972 - DNA, 22 bp, Homo sapiens
agctactaacctggagacagta

SEQ ID NO: 5193973 - DNA, 18 bp, Homo sapiens
agctactaatgatgtttt

SEQ ID NO: 5193974 - DNA, 21 bp, Homo sapiens
agctactagagatattcttat

SEQ ID NO: 5193975 - DNA, 17 bp, Homo sapiens
agctactagcaaaataa

SEQ ID NO: 5193976 - DNA, 18 bp, Homo sapiens
agctactagggaggctga

SEQ ID NO: 5193977 - DNA, 17 bp, Homo sapiens
agctactataaatatac

SEQ ID NO: 5193978 - DNA, 19 bp, Homo sapiens
agctactataaatatacat

SEQ ID NO: 5193979 - DNA, 17 bp, Homo sapiens
agctactattttggaaa

SEQ ID NO: 5193980 - DNA, 19 bp, Homo sapiens
agctactcagaagcctgag

SEQ ID NO: 5193981 - DNA, 21 bp, Homo sapiens
agctactcagaagcctgaggc

SEQ ID NO: 5193982 - DNA, 18 bp, Homo sapiens
agctactcaggaggctga

SEQ ID NO: 5193983 - DNA, 22 bp, Homo sapiens
agctactcaggaggctgagaca

SEQ ID NO: 5193984 - DNA, 19 bp, Homo sapiens
agctactccggaggctgag

SEQ ID NO: 5193985 - DNA, 23 bp, Homo sapiens
agctactcgatagcctgaggtgg

SEQ ID NO: 5193986 - DNA, 19 bp, Homo sapiens
agctactcgggaagctgag

SEQ ID NO: 5193987 - DNA, 23 bp, Homo sapiens
agctactcgggaggctgaggcac

SEQ ID NO: 5193988 - DNA, 16 bp, Homo sapiens
agctactctagttctg

SEQ ID NO: 5193989 - DNA, 17 bp, Homo sapiens
agctactctagttctgt

SEQ ID NO: 5193990 - DNA, 19 bp, Homo sapiens
agctactctcttgccagca

SEQ ID NO: 5193991 - DNA, 14 bp, Homo sapiens
agctactctgatcc

SEQ ID NO: 5193992 - DNA, 20 bp, Homo sapiens
agctactctgatccctctgg

SEQ ID NO: 5193993 - DNA, 14 bp, Homo sapiens
agctactctgtcca

SEQ ID NO: 5193994 - DNA, 17 bp, Homo sapiens
agctactctgtccaggc

SEQ ID NO: 5193995 - DNA, 20 bp, Homo sapiens
agctactctgtccaggccac

SEQ ID NO: 5193996 - DNA, 21 bp, Homo sapiens
agctactgaatttattgccgc

SEQ ID NO: 5193997 - DNA, 18 bp, Homo sapiens
agctactgagaacataaa

SEQ ID NO: 5193998 - DNA, 15 bp, Homo sapiens
agctactgagacttg

SEQ ID NO: 5193999 - DNA, 13 bp, Homo sapiens
agctactgccatc

SEQ ID NO: 5194000 - DNA, 18 bp, Homo sapiens
agctactggattcttatt

SEQ ID NO: 5194001 - DNA, 17 bp, Homo sapiens
agctactggggaggctg

SEQ ID NO: 5194002 - DNA, 20 bp, Homo sapiens
agctactggggaggctgagg

SEQ ID NO: 5194003 - DNA, 14 bp, Homo sapiens
agctactgtaactt

SEQ ID NO: 5194004 - DNA, 20 bp, Homo sapiens
agctactgtaacttttttaa

SEQ ID NO: 5194005 - DNA, 14 bp, Homo sapiens
agctactgtagttg

SEQ ID NO: 5194006 - DNA, 20 bp, Homo sapiens
agctactgtgtgtgtgaatg

SEQ ID NO: 5194007 - DNA, 23 bp, Homo sapiens
agctactgtgtgtgtgaatgaac

SEQ ID NO: 5194008 - DNA, 18 bp, Homo sapiens
agctacttagctggccaa

SEQ ID NO: 5194009 - DNA, 15 bp, Homo sapiens
agctacttcctcctc

SEQ ID NO: 5194010 - DNA, 16 bp, Homo sapiens
agctacttcctcctcc

SEQ ID NO: 5194011 - DNA, 21 bp, Homo sapiens
agctacttctgggaaaaacaa

SEQ ID NO: 5194012 - DNA, 15 bp, Homo sapiens
agctacttggcaggc

SEQ ID NO: 5194013 - DNA, 16 bp, Homo sapiens
agctacttggcaggct

SEQ ID NO: 5194014 - DNA, 18 bp, Homo sapiens
agctacttggcaggctga

SEQ ID NO: 5194015 - DNA, 19 bp, Homo sapiens
agctacttggcaggctgag

SEQ ID NO: 5194016 - DNA, 17 bp, Homo sapiens
agctacttgggaggctg

SEQ ID NO: 5194017 - DNA, 18 bp, Homo sapiens
agctacttgggaggttga

SEQ ID NO: 5194018 - DNA, 19 bp, Homo sapiens
agctacttgggccatagct

SEQ ID NO: 5194019 - DNA, 13 bp, Homo sapiens
agctactttccat

SEQ ID NO: 5194020 - DNA, 21 bp, Homo sapiens
agctactttccatttggtatt

SEQ ID NO: 5194021 - DNA, 15 bp, Homo sapiens
agctactttggcatt

SEQ ID NO: 5194022 - DNA, 22 bp, Homo sapiens
agctagaaaatgaactgtatat

SEQ ID NO: 5194023 - DNA, 21 bp, Homo sapiens
agctagaaagagaaaaagccc

SEQ ID NO: 5194024 - DNA, 15 bp, Homo sapiens
agctagaaagtggca

SEQ ID NO: 5194025 - DNA, 15 bp, Homo sapiens
agctagaaatatgat

SEQ ID NO: 5194026 - DNA, 11 bp, Homo sapiens
agctagaaatg

SEQ ID NO: 5194027 - DNA, 16 bp, Homo sapiens
agctagaacctggagg

SEQ ID NO: 5194028 - DNA, 14 bp, Homo sapiens
agctagaaggccac

SEQ ID NO: 5194029 - DNA, 16 bp, Homo sapiens
agctagaatatcctat

SEQ ID NO: 5194030 - DNA, 12 bp, Homo sapiens
agctagaatcca

SEQ ID NO: 5194031 - DNA, 13 bp, Homo sapiens
agctagaatccac

SEQ ID NO: 5194032 - DNA, 13 bp, Homo sapiens
agctagaatttct

SEQ ID NO: 5194033 - DNA, 17 bp, Homo sapiens
agctagacacatgaagg

SEQ ID NO: 5194034 - DNA, 16 bp, Homo sapiens
agctagacccaaccct

SEQ ID NO: 5194035 - DNA, 16 bp, Homo sapiens
agctagactaggagac

SEQ ID NO: 5194036 - DNA, 17 bp, Homo sapiens
agctagactaggagacc

SEQ ID NO: 5194037 - DNA, 17 bp, Homo sapiens
agctagactggagtgag

SEQ ID NO: 5194038 - DNA, 21 bp, Homo sapiens
agctagactggagtgaggctt

SEQ ID NO: 5194039 - DNA, 21 bp, Homo sapiens
agctagactggtgactgattc

SEQ ID NO: 5194040 - DNA, 17 bp, Homo sapiens
agctagactgtgtctga

SEQ ID NO: 5194041 - DNA, 16 bp, Homo sapiens
agctagagagaaaaag

SEQ ID NO: 5194042 - DNA, 15 bp, Homo sapiens
agctagagcttcaag

SEQ ID NO: 5194043 - DNA, 20 bp, Homo sapiens
agctagagcttccactgtca

SEQ ID NO: 5194044 - DNA, 12 bp, Homo sapiens
agctagaggaac

SEQ ID NO: 5194045 - DNA, 20 bp, Homo sapiens
agctagaggaaccaaccccc

SEQ ID NO: 5194046 - DNA, 21 bp, Homo sapiens
agctagaggaataaagctgtg

SEQ ID NO: 5194047 - DNA, 22 bp, Homo sapiens
agctagaggagattgctctggg

SEQ ID NO: 5194048 - DNA, 15 bp, Homo sapiens
agctagaggccacct

SEQ ID NO: 5194049 - DNA, 17 bp, Homo sapiens
agctagatactggaaac

SEQ ID NO: 5194050 - DNA, 16 bp, Homo sapiens
agctagatatgcctta

SEQ ID NO: 5194051 - DNA, 17 bp, Homo sapiens
agctagccagaggactg

SEQ ID NO: 5194052 - DNA, 13 bp, Homo sapiens
agctagccagcca

SEQ ID NO: 5194053 - DNA, 13 bp, Homo sapiens
agctagcctccag

SEQ ID NO: 5194054 - DNA, 15 bp, Homo sapiens
agctagcctgaagga

SEQ ID NO: 5194055 - DNA, 15 bp, Homo sapiens
agctagcgatttcag

SEQ ID NO: 5194056 - DNA, 16 bp, Homo sapiens
agctagcgctgccgca

SEQ ID NO: 5194057 - DNA, 18 bp, Homo sapiens
agctagcgtgtgccaggc

SEQ ID NO: 5194058 - DNA, 15 bp, Homo sapiens
agctagctagcgcac

SEQ ID NO: 5194059 - DNA, 15 bp, Homo sapiens
agctagctatttcta

SEQ ID NO: 5194060 - DNA, 15 bp, Homo sapiens
agctagctcaactag

SEQ ID NO: 5194061 - DNA, 16 bp, Homo sapiens
agctagctcaactagt

SEQ ID NO: 5194062 - DNA, 16 bp, Homo sapiens
agctagctcccctcct

SEQ ID NO: 5194063 - DNA, 17 bp, Homo sapiens
agctagctcccctcctc

SEQ ID NO: 5194064 - DNA, 18 bp, Homo sapiens
agctagctcccctcctct

SEQ ID NO: 5194065 - DNA, 21 bp, Homo sapiens
agctagctcccctcctctccc

SEQ ID NO: 5194066 - DNA, 23 bp, Homo sapiens
agctagctctttggtctattttc

SEQ ID NO: 5194067 - DNA, 14 bp, Homo sapiens
agctagctgctttt

SEQ ID NO: 5194068 - DNA, 16 bp, Homo sapiens
agctagcttttaggaa

SEQ ID NO: 5194069 - DNA, 15 bp, Homo sapiens
agctaggaacaaatc

SEQ ID NO: 5194070 - DNA, 21 bp, Homo sapiens
agctaggaacaaatcttcctg

SEQ ID NO: 5194071 - DNA, 16 bp, Homo sapiens
agctaggaaccctgga

SEQ ID NO: 5194072 - DNA, 17 bp, Homo sapiens
agctaggaaccctggag

SEQ ID NO: 5194073 - DNA, 12 bp, Homo sapiens
agctaggaatga

SEQ ID NO: 5194074 - DNA, 18 bp, Homo sapiens
agctaggaattgtgttta

SEQ ID NO: 5194075 - DNA, 15 bp, Homo sapiens
agctaggagaagggc

SEQ ID NO: 5194076 - DNA, 17 bp, Homo sapiens
agctaggagaagggctg

SEQ ID NO: 5194077 - DNA, 16 bp, Homo sapiens
agctaggagcaaagcc

SEQ ID NO: 5194078 - DNA, 19 bp, Homo sapiens
agctaggatggttctgtga

SEQ ID NO: 5194079 - DNA, 15 bp, Homo sapiens
agctaggcagggagg

SEQ ID NO: 5194080 - DNA, 16 bp, Homo sapiens
agctaggcagggaggg

SEQ ID NO: 5194081 - DNA, 12 bp, Homo sapiens
agctaggcatgg

SEQ ID NO: 5194082 - DNA, 18 bp, Homo sapiens
agcatttctagtcccttc

SEQ ID NO: 5194083 - DNA, 18 bp, Homo sapiens
agcatttctcatcagtag

SEQ ID NO: 5194084 - DNA, 20 bp, Homo sapiens
agcatttcttttctggccaa

SEQ ID NO: 5194085 - DNA, 11 bp, Homo sapiens
agcatttgaat

SEQ ID NO: 5194086 - DNA, 20 bp, Homo sapiens
agcatttgaatactcctgtt

SEQ ID NO: 5194087 - DNA, 14 bp, Homo sapiens
agcatttgacacac

SEQ ID NO: 5194088 - DNA, 16 bp, Homo sapiens
agcatttgactttctg

SEQ ID NO: 5194089 - DNA, 16 bp, Homo sapiens
agcatttgataatgat

SEQ ID NO: 5194090 - DNA, 22 bp, Homo sapiens
agcatttgataatgataaaaca

SEQ ID NO: 5194091 - DNA, 19 bp, Homo sapiens
agcatttgattaacatttg

SEQ ID NO: 5194092 - DNA, 17 bp, Homo sapiens
agcatttgcacctctgt

SEQ ID NO: 5194093 - DNA, 20 bp, Homo sapiens
agcatttgccctgtggattc

SEQ ID NO: 5194094 - DNA, 14 bp, Homo sapiens
agcatttgctgcat

SEQ ID NO: 5194095 - DNA, 15 bp, Homo sapiens
agcatttgctgcatg

SEQ ID NO: 5194096 - DNA, 16 bp, Homo sapiens
agcatttgctttcctc

SEQ ID NO: 5194097 - DNA, 14 bp, Homo sapiens
agcatttggaagga

SEQ ID NO: 5194098 - DNA, 19 bp, Homo sapiens
agcatttggtgcctatttg

SEQ ID NO: 5194099 - DNA, 23 bp, Homo sapiens
agcatttggtggcctaatttaca

SEQ ID NO: 5194100 - DNA, 15 bp, Homo sapiens
agcatttgtattatt

SEQ ID NO: 5194101 - DNA, 16 bp, Homo sapiens
agcatttgtcaacaaa

SEQ ID NO: 5194102 - DNA, 18 bp, Homo sapiens
agcatttgttctttgcca

SEQ ID NO: 5194103 - DNA, 14 bp, Homo sapiens
agcatttgtttcta

SEQ ID NO: 5194104 - DNA, 14 bp, Homo sapiens
agcatttgttttag

SEQ ID NO: 5194105 - DNA, 18 bp, Homo sapiens
agcattttaaggttctca

SEQ ID NO: 5194106 - DNA, 20 bp, Homo sapiens
agcattttaatagtttctaa

SEQ ID NO: 5194107 - DNA, 19 bp, Homo sapiens
agcattttactacttgtta

SEQ ID NO: 5194108 - DNA, 18 bp, Homo sapiens
agcattttactgtctgta

SEQ ID NO: 5194109 - DNA, 14 bp, Homo sapiens
agcattttataaat

SEQ ID NO: 5194110 - DNA, 20 bp, Homo sapiens
agcattttattactgtaata

SEQ ID NO: 5194111 - DNA, 22 bp, Homo sapiens
agcattttccacgctgatgttt

SEQ ID NO: 5194112 - DNA, 20 bp, Homo sapiens
agcattttcctgtttactga

SEQ ID NO: 5194113 - DNA, 13 bp, Homo sapiens
agcattttctcct

SEQ ID NO: 5194114 - DNA, 15 bp, Homo sapiens
agcattttctgcatc

SEQ ID NO: 5194115 - DNA, 19 bp, Homo sapiens
agcattttctgcatctcca

SEQ ID NO: 5194116 - DNA, 14 bp, Homo sapiens
agcattttgaaaca

SEQ ID NO: 5194117 - DNA, 15 bp, Homo sapiens
agcattttgagaggc

SEQ ID NO: 5194118 - DNA, 16 bp, Homo sapiens
agcattttgagaggct

SEQ ID NO: 5194119 - DNA, 18 bp, Homo sapiens
agcattttgagaggctga

SEQ ID NO: 5194120 - DNA, 13 bp, Homo sapiens
agcattttgtaat

SEQ ID NO: 5194121 - DNA, 15 bp, Homo sapiens
agcattttgtatttg

SEQ ID NO: 5194122 - DNA, 14 bp, Homo sapiens
agcattttgtgtct

SEQ ID NO: 5194123 - DNA, 23 bp, Homo sapiens
agcattttgtgtcttaagaaaaa

SEQ ID NO: 5194124 - DNA, 21 bp, Homo sapiens
agcatttttaattttcacaaa

SEQ ID NO: 5194125 - DNA, 16 bp, Homo sapiens
agcatttttataaact

SEQ ID NO: 5194126 - DNA, 16 bp, Homo sapiens
agcatttttatgcaga

SEQ ID NO: 5194127 - DNA, 18 bp, Homo sapiens
agcatttttatgcagaca

SEQ ID NO: 5194128 - DNA, 21 bp, Homo sapiens
agcatttttattatatttatg

SEQ ID NO: 5194129 - DNA, 17 bp, Homo sapiens
agcatttttatttcaga

SEQ ID NO: 5194130 - DNA, 14 bp, Homo sapiens
agcatttttcagag

SEQ ID NO: 5194131 - DNA, 18 bp, Homo sapiens
agcatttttccatctgtg

SEQ ID NO: 5194132 - DNA, 19 bp, Homo sapiens
agcatttttctaataggta

SEQ ID NO: 5194133 - DNA, 16 bp, Homo sapiens
agcatttttgatttat

SEQ ID NO: 5194134 - DNA, 15 bp, Homo sapiens
agcattttttaaaaa

SEQ ID NO: 5194135 - DNA, 14 bp, Homo sapiens
agcattttttatca

SEQ ID NO: 5194136 - DNA, 20 bp, Homo sapiens
agcattttttatcaggcagg

SEQ ID NO: 5194137 - DNA, 23 bp, Homo sapiens
agcatttttttaaaagaagcttt

SEQ ID NO: 5194138 - DNA, 20 bp, Homo sapiens
agccaaaaacaataaacgaa

SEQ ID NO: 5194139 - DNA, 23 bp, Homo sapiens
agccaaaaaggcaaataatggaa

SEQ ID NO: 5194140 - DNA, 23 bp, Homo sapiens
agccaaaaggattcctctttgtt

SEQ ID NO: 5194141 - DNA, 13 bp, Homo sapiens
agccaaaagtaag

SEQ ID NO: 5194142 - DNA, 17 bp, Homo sapiens
agccaaaagtccctccc

SEQ ID NO: 5194143 - DNA, 12 bp, Homo sapiens
agccaaaatcat

SEQ ID NO: 5194144 - DNA, 17 bp, Homo sapiens
agccaaaatgactttga

SEQ ID NO: 5194145 - DNA, 20 bp, Homo sapiens
agccaaaatgactttgaact

SEQ ID NO: 5194146 - DNA, 17 bp, Homo sapiens
agccaaaattaaggtgt

SEQ ID NO: 5194147 - DNA, 18 bp, Homo sapiens
agccaaaattaaggtgtt

SEQ ID NO: 5194148 - DNA, 14 bp, Homo sapiens
agccaaacaaaact

SEQ ID NO: 5194149 - DNA, 15 bp, Homo sapiens
agccaaacaagcctt

SEQ ID NO: 5194150 - DNA, 18 bp, Homo sapiens
agccaaacacacagaagg

SEQ ID NO: 5194151 - DNA, 14 bp, Homo sapiens
agccaaacacactg

SEQ ID NO: 5194152 - DNA, 16 bp, Homo sapiens
agccaaacaccacttt

SEQ ID NO: 5194153 - DNA, 13 bp, Homo sapiens
agccaaacaggag

SEQ ID NO: 5194154 - DNA, 18 bp, Homo sapiens
agccaaacattcttattt

SEQ ID NO: 5194155 - DNA, 12 bp, Homo sapiens
agccaaaccagg

SEQ ID NO: 5194156 - DNA, 19 bp, Homo sapiens
agccaaacccatgaggcaa

SEQ ID NO: 5194157 - DNA, 13 bp, Homo sapiens
agccaaacccttg

SEQ ID NO: 5194158 - DNA, 15 bp, Homo sapiens
agccaaacctcacca

SEQ ID NO: 5194159 - DNA, 16 bp, Homo sapiens
agccaaacctctgtga

SEQ ID NO: 5194160 - DNA, 14 bp, Homo sapiens
agccaaagaaactc

SEQ ID NO: 5194161 - DNA, 17 bp, Homo sapiens
agccaaagaaatgaaca

SEQ ID NO: 5194162 - DNA, 18 bp, Homo sapiens
agccaaagaaatgaacat

SEQ ID NO: 5194163 - DNA, 19 bp, Homo sapiens
agccaaagaaatgggcctg

SEQ ID NO: 5194164 - DNA, 23 bp, Homo sapiens
agccaaagaaatgggcctgcctg

SEQ ID NO: 5194165 - DNA, 17 bp, Homo sapiens
agccaaagaaatttcaa

SEQ ID NO: 5194166 - DNA, 20 bp, Homo sapiens
agccaaagaaatttcaacag

SEQ ID NO: 5194167 - DNA, 17 bp, Homo sapiens
agccaaagagaaaagat

SEQ ID NO: 5194168 - DNA, 20 bp, Homo sapiens
agccaaagagaaaagattaa

SEQ ID NO: 5194169 - DNA, 13 bp, Homo sapiens
agccaaagagctc

SEQ ID NO: 5194170 - DNA, 11 bp, Homo sapiens
agccaaagagg

SEQ ID NO: 5194171 - DNA, 15 bp, Homo sapiens
agccaaagataatct

SEQ ID NO: 5194172 - DNA, 15 bp, Homo sapiens
agccaaagccagagt

SEQ ID NO: 5194173 - DNA, 13 bp, Homo sapiens
agccaaagccagg

SEQ ID NO: 5194174 - DNA, 16 bp, Homo sapiens
agccaaagctaggcct

SEQ ID NO: 5194175 - DNA, 20 bp, Homo sapiens
agccaaagctaggcctggcc

SEQ ID NO: 5194176 - DNA, 17 bp, Homo sapiens
agccaaaggcagctaag

SEQ ID NO: 5194177 - DNA, 19 bp, Homo sapiens
agccaaagggaaatatgct

SEQ ID NO: 5194178 - DNA, 13 bp, Homo sapiens
agccaaaggtcta

SEQ ID NO: 5194179 - DNA, 16 bp, Homo sapiens
agccaaagttaaatgt

SEQ ID NO: 5194180 - DNA, 22 bp, Homo sapiens
agccaaatctgacctaaaagtt

SEQ ID NO: 5194181 - DNA, 14 bp, Homo sapiens
agccaaatgaaact

SEQ ID NO: 5194182 - DNA, 19 bp, Homo sapiens
agccaaatgaccgagccct

SEQ ID NO: 5194183 - DNA, 20 bp, Homo sapiens
agccaaatgacttcatttct

SEQ ID NO: 5194184 - DNA, 20 bp, Homo sapiens
agccaaatgcagggagggga

SEQ ID NO: 5194185 - DNA, 22 bp, Homo sapiens
agccaaatgcagggaggggagg

SEQ ID NO: 5194186 - DNA, 15 bp, Homo sapiens
agccaaatggtttaa

SEQ ID NO: 5194187 - DNA, 19 bp, Homo sapiens
agccaaattgcagaagaaa

SEQ ID NO: 5194188 - DNA, 13 bp, Homo sapiens
agccaaatttata

SEQ ID NO: 5194189 - DNA, 13 bp, Homo sapiens
agccaaatttcct

SEQ ID NO: 5194190 - DNA, 15 bp, Homo sapiens
agccaaatttctttt

SEQ ID NO: 5194191 - DNA, 11 bp, Homo sapiens
agccaacaacc

SEQ ID NO: 5194192 - DNA, 19 bp, Homo sapiens
agccaacaactctgccttt

SEQ ID NO: 5194193 - DNA, 20 bp, Homo sapiens
agccaacaactctgccttta

SEQ ID NO: 5194194 - DNA, 16 bp, Homo sapiens
agccaacaagaccgcc

SEQ ID NO: 5194195 - DNA, 18 bp, Homo sapiens
agccaacacgcacctgcc

SEQ ID NO: 5194196 - DNA, 23 bp, Homo sapiens
agccaacaggtaaacacataaat

SEQ ID NO: 5194197 - DNA, 16 bp, Homo sapiens
agccaacccctgtgga

SEQ ID NO: 5194198 - DNA, 17 bp, Homo sapiens
agccaaccctggaaaag

SEQ ID NO: 5194199 - DNA, 14 bp, Homo sapiens
agccaacctggact

SEQ ID NO: 5194200 - DNA, 19 bp, Homo sapiens
agccaacctggacttcctg

SEQ ID NO: 5194201 - DNA, 20 bp, Homo sapiens
agccaacctggacttcctgt

SEQ ID NO: 5194202 - DNA, 21 bp, Homo sapiens
agccaacctggacttcctgtc

SEQ ID NO: 5194203 - DNA, 23 bp, Homo sapiens
agccaaccttcaaagaaacttga

SEQ ID NO: 5194204 - DNA, 15 bp, Homo sapiens
agccaaccttgctct

SEQ ID NO: 5194205 - DNA, 15 bp, Homo sapiens
agccaacgagacaca

SEQ ID NO: 5194206 - DNA, 16 bp, Homo sapiens
agccaacgagacacat

SEQ ID NO: 5194207 - DNA, 21 bp, Homo sapiens
agccaacgagacacattgcct

SEQ ID NO: 5194208 - DNA, 22 bp, Homo sapiens
agccaacgagacacattgcctt

SEQ ID NO: 5194209 - DNA, 20 bp, Homo sapiens
agccaacgagattgctggaa

SEQ ID NO: 5194210 - DNA, 20 bp, Homo sapiens
agccaactatgattattaac

SEQ ID NO: 5194211 - DNA, 17 bp, Homo sapiens
agccaactatggcctgt

SEQ ID NO: 5194212 - DNA, 14 bp, Homo sapiens
agccaactcctcct

SEQ ID NO: 5194213 - DNA, 17 bp, Homo sapiens
agccaactgtttccctg

SEQ ID NO: 5194214 - DNA, 18 bp, Homo sapiens
agccaactgtttccctgc

SEQ ID NO: 5194215 - DNA, 22 bp, Homo sapiens
agccaactgtttccctgctgaa

SEQ ID NO: 5194216 - DNA, 21 bp, Homo sapiens
agccaacttaaacctgtgctt

SEQ ID NO: 5194217 - DNA, 17 bp, Homo sapiens
agccaacttgatgtgaa

SEQ ID NO: 5194218 - DNA, 14 bp, Homo sapiens
agccaacttggctt

SEQ ID NO: 5194219 - DNA, 20 bp, Homo sapiens
agccaagaaacactgcctgc

SEQ ID NO: 5194220 - DNA, 21 bp, Homo sapiens
agccaagaaacactgcctgcc

SEQ ID NO: 5194221 - DNA, 16 bp, Homo sapiens
agccaagaaagatgta

SEQ ID NO: 5194222 - DNA, 16 bp, Homo sapiens
agccaagaagcctgca

SEQ ID NO: 5194223 - DNA, 21 bp, Homo sapiens
agccaagaagtgaggcctggg

SEQ ID NO: 5194224 - DNA, 20 bp, Homo sapiens
agccaagaccatctctccct

SEQ ID NO: 5194225 - DNA, 18 bp, Homo sapiens
agccaagacggaggaggg

SEQ ID NO: 5194226 - DNA, 16 bp, Homo sapiens
agccaagagctcttca

SEQ ID NO: 5194227 - DNA, 17 bp, Homo sapiens
agccaagagctcttcat

SEQ ID NO: 5194228 - DNA, 22 bp, Homo sapiens
agccaagagctcttcatctgct

SEQ ID NO: 5194229 - DNA, 19 bp, Homo sapiens
agccaagatcgcaccactg

SEQ ID NO: 5194230 - DNA, 19 bp, Homo sapiens
agccaagattgcgccactg

SEQ ID NO: 5194231 - DNA, 14 bp, Homo sapiens
agccaagcaaatgc

SEQ ID NO: 5194232 - DNA, 21 bp, Homo sapiens
agccaagcaaatgcctgccaa

SEQ ID NO: 5194233 - DNA, 14 bp, Homo sapiens
agccaagcacagtg

SEQ ID NO: 5194234 - DNA, 15 bp, Homo sapiens
agccaagcactgctc

SEQ ID NO: 5194235 - DNA, 17 bp, Homo sapiens
agccaagcactgctcac

SEQ ID NO: 5194236 - DNA, 13 bp, Homo sapiens
agccaagcagcca

SEQ ID NO: 5194237 - DNA, 16 bp, Homo sapiens
agccaagcagccaagc

SEQ ID NO: 5194238 - DNA, 19 bp, Homo sapiens
agccaagccctaagcctgt

SEQ ID NO: 5194239 - DNA, 22 bp, Homo sapiens
agccaagccctaagcctgtccc

SEQ ID NO: 5194240 - DNA, 15 bp, Homo sapiens
agccaagcctggagt

SEQ ID NO: 5194241 - DNA, 23 bp, Homo sapiens
agccaagcctggagtaggcctgg

SEQ ID NO: 5194242 - DNA, 20 bp, Homo sapiens
agccaagctaatgtggtagt

SEQ ID NO: 5194243 - DNA, 16 bp, Homo sapiens
agccaagctccctgga

SEQ ID NO: 5194244 - DNA, 15 bp, Homo sapiens
agccaagctctgcag

SEQ ID NO: 5194245 - DNA, 14 bp, Homo sapiens
agccaagctgcaca

SEQ ID NO: 5194246 - DNA, 14 bp, Homo sapiens
agccaagctggcac

SEQ ID NO: 5194247 - DNA, 18 bp, Homo sapiens
agccaagctggcacaaaa

SEQ ID NO: 5194248 - DNA, 20 bp, Homo sapiens
agccaagctggcacaaaaga

SEQ ID NO: 5194249 - DNA, 17 bp, Homo sapiens
agccaagcttgttatca

SEQ ID NO: 5194250 - DNA, 21 bp, Homo sapiens
agccaagcttgttatcagctt

SEQ ID NO: 5194251 - DNA, 15 bp, Homo sapiens
agccaagctttaaat

SEQ ID NO: 5194252 - DNA, 22 bp, Homo sapiens
agccaagctttaaattatgtga

SEQ ID NO: 5194253 - DNA, 23 bp, Homo sapiens
agccaaggaatgtgtccaagaca

SEQ ID NO: 5194254 - DNA, 21 bp, Homo sapiens
agccaaggacagggctggctc

SEQ ID NO: 5194255 - DNA, 22 bp, Homo sapiens
agccaaggaggaaatgtggaaa

SEQ ID NO: 5194256 - DNA, 16 bp, Homo sapiens
agccaaggaggcctgg

SEQ ID NO: 5194257 - DNA, 14 bp, Homo sapiens
agccaaggagtcag

SEQ ID NO: 5194258 - DNA, 19 bp, Homo sapiens
agccaaggcagcgacccca

SEQ ID NO: 5194259 - DNA, 23 bp, Homo sapiens
agccaaggccaaaggaagcacat

SEQ ID NO: 5194260 - DNA, 13 bp, Homo sapiens
agccaaggccacc

SEQ ID NO: 5194261 - DNA, 17 bp, Homo sapiens
agctaggccccagaggc

SEQ ID NO: 5194262 - DNA, 20 bp, Homo sapiens
agctaggccccagaggccct

SEQ ID NO: 5194263 - DNA, 21 bp, Homo sapiens
agctaggccccagaggccctg

SEQ ID NO: 5194264 - DNA, 14 bp, Homo sapiens
agctaggcctggcc

SEQ ID NO: 5194265 - DNA, 21 bp, Homo sapiens
agctaggcctggccagatgca

SEQ ID NO: 5194266 - DNA, 16 bp, Homo sapiens
agctaggctgagatgc

SEQ ID NO: 5194267 - DNA, 17 bp, Homo sapiens
agctaggctgagatgca

SEQ ID NO: 5194268 - DNA, 19 bp, Homo sapiens
agctaggcttaaacctgga

SEQ ID NO: 5194269 - DNA, 19 bp, Homo sapiens
agctagggctgctgcttct

SEQ ID NO: 5194270 - DNA, 24 bp, Homo sapiens
agctagggctgctgcttctgctcc

SEQ ID NO: 5194271 - DNA, 22 bp, Homo sapiens
agctaggggggtcagccagccc

SEQ ID NO: 5194272 - DNA, 19 bp, Homo sapiens
agctaggtgacatatacat

SEQ ID NO: 5194273 - DNA, 17 bp, Homo sapiens
agctaggttgtcctatt

SEQ ID NO: 5194274 - DNA, 18 bp, Homo sapiens
agctagtacctatatgct

SEQ ID NO: 5194275 - DNA, 19 bp, Homo sapiens
agctagtagcaatgtgcct

SEQ ID NO: 5194276 - DNA, 19 bp, Homo sapiens
agctagtaggaatgtacat

SEQ ID NO: 5194277 - DNA, 13 bp, Homo sapiens
agctagtatcttc

SEQ ID NO: 5194278 - DNA, 21 bp, Homo sapiens
agctagtgaagaccagagcag

SEQ ID NO: 5194279 - DNA, 14 bp, Homo sapiens
agctagtgacagcc

SEQ ID NO: 5194280 - DNA, 21 bp, Homo sapiens
agctagtgacccacatgccat

SEQ ID NO: 5194281 - DNA, 12 bp, Homo sapiens
agctagtgattt

SEQ ID NO: 5194282 - DNA, 13 bp, Homo sapiens
agctagtgattta

SEQ ID NO: 5194283 - DNA, 14 bp, Homo sapiens
agctagtgatttac

SEQ ID NO: 5194284 - DNA, 20 bp, Homo sapiens
agctagtgccaaataattga

SEQ ID NO: 5194285 - DNA, 17 bp, Homo sapiens
agctagtgcctttagag

SEQ ID NO: 5194286 - DNA, 16 bp, Homo sapiens
agctagtgtacctcct

SEQ ID NO: 5194287 - DNA, 17 bp, Homo sapiens
agctagtgtctcctctc

SEQ ID NO: 5194288 - DNA, 19 bp, Homo sapiens
agctagtgtctcctctctg

SEQ ID NO: 5194289 - DNA, 18 bp, Homo sapiens
agctagtgttaatccaga

SEQ ID NO: 5194290 - DNA, 20 bp, Homo sapiens
agctagtgttaatccagaga

SEQ ID NO: 5194291 - DNA, 18 bp, Homo sapiens
agctagttagagactcgc

SEQ ID NO: 5194292 - DNA, 19 bp, Homo sapiens
agctagttagctcacaagc

SEQ ID NO: 5194293 - DNA, 16 bp, Homo sapiens
agctagttctcagctt

SEQ ID NO: 5194294 - DNA, 15 bp, Homo sapiens
agctagttggggagc

SEQ ID NO: 5194295 - DNA, 17 bp, Homo sapiens
agctagttggttgaatt

SEQ ID NO: 5194296 - DNA, 18 bp, Homo sapiens
agctagtttaaaattatt

SEQ ID NO: 5194297 - DNA, 20 bp, Homo sapiens
agctagtttaaaattattaa

SEQ ID NO: 5194298 - DNA, 17 bp, Homo sapiens
agctagtttgctttttg

SEQ ID NO: 5194299 - DNA, 22 bp, Homo sapiens
agctagttttattcttggtttt

SEQ ID NO: 5194300 - DNA, 15 bp, Homo sapiens
agctataaaagccca

SEQ ID NO: 5194301 - DNA, 18 bp, Homo sapiens
agctataaaatgaataca

SEQ ID NO: 5194302 - DNA, 22 bp, Homo sapiens
agctataaagcagtatttttct

SEQ ID NO: 5194303 - DNA, 17 bp, Homo sapiens
agctataaagtatatat

SEQ ID NO: 5194304 - DNA, 17 bp, Homo sapiens
agctataacaactctat

SEQ ID NO: 5194305 - DNA, 19 bp, Homo sapiens
agctataacaactctattt

SEQ ID NO: 5194306 - DNA, 19 bp, Homo sapiens
agctataacatatttattg

SEQ ID NO: 5194307 - DNA, 12 bp, Homo sapiens
agctataacatt

SEQ ID NO: 5194308 - DNA, 13 bp, Homo sapiens
agctataagagaa

SEQ ID NO: 5194309 - DNA, 22 bp, Homo sapiens
agctatacctcattcacagctc

SEQ ID NO: 5194310 - DNA, 16 bp, Homo sapiens
agctatacctgtgcct

SEQ ID NO: 5194311 - DNA, 17 bp, Homo sapiens
agctatagacccgagga

SEQ ID NO: 5194312 - DNA, 19 bp, Homo sapiens
agctatagacccgaggaaa

SEQ ID NO: 5194313 - DNA, 13 bp, Homo sapiens
agctataggaaat

SEQ ID NO: 5194314 - DNA, 15 bp, Homo sapiens
agctatagtgaagaa

SEQ ID NO: 5194315 - DNA, 19 bp, Homo sapiens
agctatagttgcagcccaa

SEQ ID NO: 5194316 - DNA, 11 bp, Homo sapiens
agctatataag

SEQ ID NO: 5194317 - DNA, 21 bp, Homo sapiens
agctatatatatatatatatg

SEQ ID NO: 5194318 - DNA, 17 bp, Homo sapiens
agctatatatttaggaa

SEQ ID NO: 5194319 - DNA, 15 bp, Homo sapiens
agctatatccatgta

SEQ ID NO: 5194320 - DNA, 17 bp, Homo sapiens
agctatatccatgtact

SEQ ID NO: 5194321 - DNA, 14 bp, Homo sapiens
agctatatgcattt

SEQ ID NO: 5194322 - DNA, 17 bp, Homo sapiens
agctatcaagtgtgctt

SEQ ID NO: 5194323 - DNA, 22 bp, Homo sapiens
agctatcaagtgtgctttagct

SEQ ID NO: 5194324 - DNA, 14 bp, Homo sapiens
agctatcaggaaca

SEQ ID NO: 5194325 - DNA, 16 bp, Homo sapiens
agctatcagtgctttg

SEQ ID NO: 5194326 - DNA, 20 bp, Homo sapiens
agctatcattgcttcctcct

SEQ ID NO: 5194327 - DNA, 21 bp, Homo sapiens
agctatccagtgacttgttct

SEQ ID NO: 5194328 - DNA, 15 bp, Homo sapiens
agctatcctggctct

SEQ ID NO: 5194329 - DNA, 16 bp, Homo sapiens
agctatcctttcaaac

SEQ ID NO: 5194330 - DNA, 17 bp, Homo sapiens
agctatcgaacttcaca

SEQ ID NO: 5194331 - DNA, 15 bp, Homo sapiens
agctatctaaagttt

SEQ ID NO: 5194332 - DNA, 15 bp, Homo sapiens
agctatctgcctgac

SEQ ID NO: 5194333 - DNA, 18 bp, Homo sapiens
agctatctgtcatctctc

SEQ ID NO: 5194334 - DNA, 23 bp, Homo sapiens
agctatcttaggtggagctactc

SEQ ID NO: 5194335 - DNA, 16 bp, Homo sapiens
agctatgacttaacat

SEQ ID NO: 5194336 - DNA, 14 bp, Homo sapiens
agctatgagcccag

SEQ ID NO: 5194337 - DNA, 16 bp, Homo sapiens
agctatgagcccagca

SEQ ID NO: 5194338 - DNA, 18 bp, Homo sapiens
agctatgatatgtgcttg

SEQ ID NO: 5194339 - DNA, 19 bp, Homo sapiens
agctatgatatgtgcttgt

SEQ ID NO: 5194340 - DNA, 19 bp, Homo sapiens
agctatgattatgccactg

SEQ ID NO: 5194341 - DNA, 16 bp, Homo sapiens
agctatgcacaccaaa

SEQ ID NO: 5194342 - DNA, 22 bp, Homo sapiens
agctatgcacaccaaattgctg

SEQ ID NO: 5194343 - DNA, 18 bp, Homo sapiens
agctatgcgcaatgtggc

SEQ ID NO: 5194344 - DNA, 21 bp, Homo sapiens
agctatgctagaggcttttat

SEQ ID NO: 5194345 - DNA, 15 bp, Homo sapiens
agctatgctgtatct

SEQ ID NO: 5194346 - DNA, 22 bp, Homo sapiens
agctatgctgtatctgtgcttt

SEQ ID NO: 5194347 - DNA, 17 bp, Homo sapiens
agctatgggagccccag

SEQ ID NO: 5194348 - DNA, 22 bp, Homo sapiens
agctatgggagccccagggtct

SEQ ID NO: 5194349 - DNA, 16 bp, Homo sapiens
agctatgtaaatgacc

SEQ ID NO: 5194350 - DNA, 15 bp, Homo sapiens
agctatgtctctagc

SEQ ID NO: 5194351 - DNA, 20 bp, Homo sapiens
agctatgttatattgaaaaa

SEQ ID NO: 5194352 - DNA, 22 bp, Homo sapiens
agctatgttatattgaaaaaat

SEQ ID NO: 5194353 - DNA, 16 bp, Homo sapiens
agctatgttccctcca

SEQ ID NO: 5194354 - DNA, 19 bp, Homo sapiens
agctatgttccctccagca

SEQ ID NO: 5194355 - DNA, 22 bp, Homo sapiens
agctatgtttttaaagtgtaca

SEQ ID NO: 5194356 - DNA, 13 bp, Homo sapiens
agctattaaaatg

SEQ ID NO: 5194357 - DNA, 23 bp, Homo sapiens
agctattacttggcaaattctga

SEQ ID NO: 5194358 - DNA, 15 bp, Homo sapiens
agctattagcaactg

SEQ ID NO: 5194359 - DNA, 20 bp, Homo sapiens
agctattagccaggatcatg

SEQ ID NO: 5194360 - DNA, 19 bp, Homo sapiens
agctattagcggctcctcg

SEQ ID NO: 5194361 - DNA, 17 bp, Homo sapiens
agctattcccttctgat

SEQ ID NO: 5194362 - DNA, 18 bp, Homo sapiens
agctattcctttcccttc

SEQ ID NO: 5194363 - DNA, 19 bp, Homo sapiens
agctattcctttcccttcc

SEQ ID NO: 5194364 - DNA, 21 bp, Homo sapiens
agctattcctttcccttcctc

SEQ ID NO: 5194365 - DNA, 19 bp, Homo sapiens
agctattctcatgcctcag

SEQ ID NO: 5194366 - DNA, 17 bp, Homo sapiens
agctattgcaaatgagg

SEQ ID NO: 5194367 - DNA, 14 bp, Homo sapiens
agctattgcatgta

SEQ ID NO: 5194368 - DNA, 21 bp, Homo sapiens
agctattgcatgtaaaatgca

SEQ ID NO: 5194369 - DNA, 21 bp, Homo sapiens
agctattggcctcccaaaaga

SEQ ID NO: 5194370 - DNA, 12 bp, Homo sapiens
agctatttaata

SEQ ID NO: 5194371 - DNA, 23 bp, Homo sapiens
agctatttaatatctggcactgt

SEQ ID NO: 5194372 - DNA, 16 bp, Homo sapiens
agctatttagtgatat

SEQ ID NO: 5194373 - DNA, 17 bp, Homo sapiens
agctatttagtgatata

SEQ ID NO: 5194374 - DNA, 20 bp, Homo sapiens
agctatttatccctttcctg

SEQ ID NO: 5194375 - DNA, 22 bp, Homo sapiens
agctatttatgtaaaatcaata

SEQ ID NO: 5194376 - DNA, 21 bp, Homo sapiens
agctatttatttatttattga

SEQ ID NO: 5194377 - DNA, 16 bp, Homo sapiens
agctatttcagcctcc

SEQ ID NO: 5194378 - DNA, 19 bp, Homo sapiens
agctatttcccttttctgt

SEQ ID NO: 5194379 - DNA, 21 bp, Homo sapiens
agctatttccttccagccttt

SEQ ID NO: 5194380 - DNA, 15 bp, Homo sapiens
agctatttctctgga

SEQ ID NO: 5194381 - DNA, 17 bp, Homo sapiens
agctatttgatgtaata

SEQ ID NO: 5194382 - DNA, 15 bp, Homo sapiens
agctattttagaaag

SEQ ID NO: 5194383 - DNA, 16 bp, Homo sapiens
agctattttagaaagc

SEQ ID NO: 5194384 - DNA, 21 bp, Homo sapiens
agctattttccaggcttctgc

SEQ ID NO: 5194385 - DNA, 22 bp, Homo sapiens
agctattttcttacagtggagt

SEQ ID NO: 5194386 - DNA, 21 bp, Homo sapiens
agctatttttactagaacaca

SEQ ID NO: 5194387 - DNA, 14 bp, Homo sapiens
agctatttttatac

SEQ ID NO: 5194388 - DNA, 16 bp, Homo sapiens
agctatttttatacac

SEQ ID NO: 5194389 - DNA, 13 bp, Homo sapiens
agctatttttcta

SEQ ID NO: 5194390 - DNA, 14 bp, Homo sapiens
agctatttttctaa

SEQ ID NO: 5194391 - DNA, 23 bp, Homo sapiens
agctatttttcttgttgcatctt

SEQ ID NO: 5194392 - DNA, 18 bp, Homo sapiens
agctcaaaaatactcttg

SEQ ID NO: 5194393 - DNA, 13 bp, Homo sapiens
agctcaaaggcac

SEQ ID NO: 5194394 - DNA, 15 bp, Homo sapiens
agctcaaaggcacag

SEQ ID NO: 5194395 - DNA, 14 bp, Homo sapiens
agctcaaaggtttg

SEQ ID NO: 5194396 - DNA, 12 bp, Homo sapiens
agctcaaatgaa

SEQ ID NO: 5194397 - DNA, 17 bp, Homo sapiens
agctcaaatgaaatgta

SEQ ID NO: 5194398 - DNA, 23 bp, Homo sapiens
agctcaaatgtatatttaacttc

SEQ ID NO: 5194399 - DNA, 23 bp, Homo sapiens
agctcaactagtggggtttcctg

SEQ ID NO: 5194400 - DNA, 18 bp, Homo sapiens
agctcaactcacagcttc

SEQ ID NO: 5194401 - DNA, 19 bp, Homo sapiens
agctcaactcacagcttct

SEQ ID NO: 5194402 - DNA, 13 bp, Homo sapiens
agctcaactcggg

SEQ ID NO: 5194403 - DNA, 23 bp, Homo sapiens
agctcaactctcttattgcctca

SEQ ID NO: 5194404 - DNA, 12 bp, Homo sapiens
agctcaactgtt

SEQ ID NO: 5194405 - DNA, 15 bp, Homo sapiens
agctcaactttctgt

SEQ ID NO: 5194406 - DNA, 20 bp, Homo sapiens
agctcaagatgacagctctt

SEQ ID NO: 5194407 - DNA, 22 bp, Homo sapiens
agctcaagcccttggggagggg

SEQ ID NO: 5194408 - DNA, 16 bp, Homo sapiens
agctcaagccgtggcc

SEQ ID NO: 5194409 - DNA, 18 bp, Homo sapiens
agctcaagccgtggccgg

SEQ ID NO: 5194410 - DNA, 18 bp, Homo sapiens
agctcaaggcaatgggct

SEQ ID NO: 5194411 - DNA, 21 bp, Homo sapiens
agctcaagggaccctgggtgg

SEQ ID NO: 5194412 - DNA, 17 bp, Homo sapiens
agctcaagggctggcac

SEQ ID NO: 5194413 - DNA, 21 bp, Homo sapiens
agctcaaggtcaatgacaccc

SEQ ID NO: 5194414 - DNA, 18 bp, Homo sapiens
agctcaagtcttccctga

SEQ ID NO: 5194415 - DNA, 18 bp, Homo sapiens
agctcaagtttaaaagcc

SEQ ID NO: 5194416 - DNA, 13 bp, Homo sapiens
agctcaataggag

SEQ ID NO: 5194417 - DNA, 18 bp, Homo sapiens
agctcaatcacactggaa

SEQ ID NO: 5194418 - DNA, 14 bp, Homo sapiens
agctcaatctctgc

SEQ ID NO: 5194419 - DNA, 15 bp, Homo sapiens
agctcaatctctgca

SEQ ID NO: 5194420 - DNA, 12 bp, Homo sapiens
agctcaatgagc

SEQ ID NO: 5194421 - DNA, 17 bp, Homo sapiens
agctcaatgagcatgtt

SEQ ID NO: 5194422 - DNA, 13 bp, Homo sapiens
agctcaatgcagt

SEQ ID NO: 5194423 - DNA, 15 bp, Homo sapiens
agctcacaagcccag

SEQ ID NO: 5194424 - DNA, 16 bp, Homo sapiens
agctcacaagcccagg

SEQ ID NO: 5194425 - DNA, 18 bp, Homo sapiens
agctcacaagcccaggct

SEQ ID NO: 5194426 - DNA, 21 bp, Homo sapiens
agctcacaagcccaggctgga

SEQ ID NO: 5194427 - DNA, 14 bp, Homo sapiens
agctcacaaggcag

SEQ ID NO: 5194428 - DNA, 18 bp, Homo sapiens
agctcacaaggcagcaag

SEQ ID NO: 5194429 - DNA, 14 bp, Homo sapiens
agctcacacatcct

SEQ ID NO: 5194430 - DNA, 17 bp, Homo sapiens
agctcacaccctacctt

SEQ ID NO: 5194431 - DNA, 17 bp, Homo sapiens
agctcacaccgcaccgg

SEQ ID NO: 5194432 - DNA, 16 bp, Homo sapiens
agctcacacctgtcct

SEQ ID NO: 5194433 - DNA, 21 bp, Homo sapiens
agctcacacctgtccttctca

SEQ ID NO: 5194434 - DNA, 17 bp, Homo sapiens
agctcacactgatgggc

SEQ ID NO: 5194435 - DNA, 20 bp, Homo sapiens
agctcacactgatgggctgg

SEQ ID NO: 5194436 - DNA, 15 bp, Homo sapiens
agctcacagcacatt

SEQ ID NO: 5194437 - DNA, 17 bp, Homo sapiens
agctcacagcacatttg

SEQ ID NO: 5194438 - DNA, 23 bp, Homo sapiens
agctcacagttcctcgccctggg

SEQ ID NO: 5194439 - DNA, 23 bp, Homo sapiens
agccaaggccctgagttggcagt

SEQ ID NO: 5194440 - DNA, 13 bp, Homo sapiens
agccaaggctccc

SEQ ID NO: 5194441 - DNA, 16 bp, Homo sapiens
agccaaggctctgttt

SEQ ID NO: 5194442 - DNA, 20 bp, Homo sapiens
agccaagggaaaggggtgct

SEQ ID NO: 5194443 - DNA, 23 bp, Homo sapiens
agccaagggaaaggggtgctttt

SEQ ID NO: 5194444 - DNA, 16 bp, Homo sapiens
agccaagggacacagg

SEQ ID NO: 5194445 - DNA, 18 bp, Homo sapiens
agccaagggatggacatc

SEQ ID NO: 5194446 - DNA, 22 bp, Homo sapiens
agccaagggatggacatcttgt

SEQ ID NO: 5194447 - DNA, 14 bp, Homo sapiens
agccaagggggcag

SEQ ID NO: 5194448 - DNA, 16 bp, Homo sapiens
agccaaggtctgaacc

SEQ ID NO: 5194449 - DNA, 20 bp, Homo sapiens
agccaaggtgctaaaaggaa

SEQ ID NO: 5194450 - DNA, 14 bp, Homo sapiens
agccaagtagcctc

SEQ ID NO: 5194451 - DNA, 20 bp, Homo sapiens
agccaagtagcctctcctgt

SEQ ID NO: 5194452 - DNA, 16 bp, Homo sapiens
agccaagtcctccctc

SEQ ID NO: 5194453 - DNA, 23 bp, Homo sapiens
agccaagtgtggtagagtgtgcc

SEQ ID NO: 5194454 - DNA, 17 bp, Homo sapiens
agccaagttatacccaa

SEQ ID NO: 5194455 - DNA, 19 bp, Homo sapiens
agccaagttatattgaata

SEQ ID NO: 5194456 - DNA, 17 bp, Homo sapiens
agccaataaagctcaca

SEQ ID NO: 5194457 - DNA, 18 bp, Homo sapiens
agccaataaagctcacac

SEQ ID NO: 5194458 - DNA, 13 bp, Homo sapiens
agccaataaataa

SEQ ID NO: 5194459 - DNA, 17 bp, Homo sapiens
agccaataaataatatt

SEQ ID NO: 5194460 - DNA, 18 bp, Homo sapiens
agccaataacacacagct

SEQ ID NO: 5194461 - DNA, 19 bp, Homo sapiens
agccaatatttactcatca

SEQ ID NO: 5194462 - DNA, 13 bp, Homo sapiens
agccaatatttta

SEQ ID NO: 5194463 - DNA, 13 bp, Homo sapiens
agccaatcccctc

SEQ ID NO: 5194464 - DNA, 18 bp, Homo sapiens
agccaatcccctccttgg

SEQ ID NO: 5194465 - DNA, 20 bp, Homo sapiens
agccaatctggacacttctt

SEQ ID NO: 5194466 - DNA, 19 bp, Homo sapiens
agccaatgaacagctcctc

SEQ ID NO: 5194467 - DNA, 22 bp, Homo sapiens
agccaatggcccggcccctcct

SEQ ID NO: 5194468 - DNA, 23 bp, Homo sapiens
agccaatggcccggcccctcctg

SEQ ID NO: 5194469 - DNA, 14 bp, Homo sapiens
agccaatgttttcc

SEQ ID NO: 5194470 - DNA, 15 bp, Homo sapiens
agccaatttcaaaga

SEQ ID NO: 5194471 - DNA, 16 bp, Homo sapiens
agccaatttcaaagaa

SEQ ID NO: 5194472 - DNA, 14 bp, Homo sapiens
agccaatttttctg

SEQ ID NO: 5194473 - DNA, 16 bp, Homo sapiens
agccaatttttctgca

SEQ ID NO: 5194474 - DNA, 20 bp, Homo sapiens
agccaatttttctgcactga

SEQ ID NO: 5194475 - DNA, 19 bp, Homo sapiens
agccacaaaataaatgttg

SEQ ID NO: 5194476 - DNA, 17 bp, Homo sapiens
agccacaaagcccccca

SEQ ID NO: 5194477 - DNA, 14 bp, Homo sapiens
agccacaaatgcct

SEQ ID NO: 5194478 - DNA, 16 bp, Homo sapiens
agccacaaatgccttg

SEQ ID NO: 5194479 - DNA, 19 bp, Homo sapiens
agccacaagaaatttgatt

SEQ ID NO: 5194480 - DNA, 14 bp, Homo sapiens
agccacaagctgca

SEQ ID NO: 5194481 - DNA, 19 bp, Homo sapiens
agccacaagctgcactgtg

SEQ ID NO: 5194482 - DNA, 17 bp, Homo sapiens
agccacaaggctggcca

SEQ ID NO: 5194483 - DNA, 18 bp, Homo sapiens
agccacaaggctggccag

SEQ ID NO: 5194484 - DNA, 19 bp, Homo sapiens
agccacaaggctggccagc

SEQ ID NO: 5194485 - DNA, 20 bp, Homo sapiens
agccacaaggctggccagca

SEQ ID NO: 5194486 - DNA, 15 bp, Homo sapiens
agccacaagtcttcc

SEQ ID NO: 5194487 - DNA, 21 bp, Homo sapiens
agccacaattatataaatcat

SEQ ID NO: 5194488 - DNA, 13 bp, Homo sapiens
agccacacacaca

SEQ ID NO: 5194489 - DNA, 21 bp, Homo sapiens
agccacacacacagaaaatat

SEQ ID NO: 5194490 - DNA, 22 bp, Homo sapiens
agccacacacacagaaaatata

SEQ ID NO: 5194491 - DNA, 22 bp, Homo sapiens
agccacacagagcctgcctcag

SEQ ID NO: 5194492 - DNA, 11 bp, Homo sapiens
agccacacagc

SEQ ID NO: 5194493 - DNA, 13 bp, Homo sapiens
agccacacagccc

SEQ ID NO: 5194494 - DNA, 16 bp, Homo sapiens
agccacacagcccaga

SEQ ID NO: 5194495 - DNA, 15 bp, Homo sapiens
agccacacagtggcc

SEQ ID NO: 5194496 - DNA, 21 bp, Homo sapiens
agccacacagtggccggggct

SEQ ID NO: 5194497 - DNA, 13 bp, Homo sapiens
agccacaccagga

SEQ ID NO: 5194498 - DNA, 14 bp, Homo sapiens
agccacaccaggat

SEQ ID NO: 5194499 - DNA, 17 bp, Homo sapiens
agccacaccgctggctc

SEQ ID NO: 5194500 - DNA, 19 bp, Homo sapiens
agccacaccgtggcagctt

SEQ ID NO: 5194501 - DNA, 12 bp, Homo sapiens
agccacacgcag

SEQ ID NO: 5194502 - DNA, 13 bp, Homo sapiens
agccacactgggc

SEQ ID NO: 5194503 - DNA, 23 bp, Homo sapiens
agccacacttctcaggacacagg

SEQ ID NO: 5194504 - DNA, 19 bp, Homo sapiens
agccacagaagccaggagc

SEQ ID NO: 5194505 - DNA, 22 bp, Homo sapiens
agccacagaagccaggagcaaa

SEQ ID NO: 5194506 - DNA, 18 bp, Homo sapiens
agccacagacccctggga

SEQ ID NO: 5194507 - DNA, 22 bp, Homo sapiens
agccacagacccctgggagctt

SEQ ID NO: 5194508 - DNA, 13 bp, Homo sapiens
agccacagcagag

SEQ ID NO: 5194509 - DNA, 15 bp, Homo sapiens
agccacagcagagca

SEQ ID NO: 5194510 - DNA, 20 bp, Homo sapiens
agccacagcagcatttttat

SEQ ID NO: 5194511 - DNA, 13 bp, Homo sapiens
agccacagcccag

SEQ ID NO: 5194512 - DNA, 19 bp, Homo sapiens
agccacagcccaggcctcc

SEQ ID NO: 5194513 - DNA, 15 bp, Homo sapiens
agccacagccgtgct

SEQ ID NO: 5194514 - DNA, 13 bp, Homo sapiens
agccacagctggt

SEQ ID NO: 5194515 - DNA, 13 bp, Homo sapiens
agccacaggaagg

SEQ ID NO: 5194516 - DNA, 13 bp, Homo sapiens
agccacaggacca

SEQ ID NO: 5194517 - DNA, 14 bp, Homo sapiens
agccacaggaccac

SEQ ID NO: 5194518 - DNA, 16 bp, Homo sapiens
agccacaggaccacct

SEQ ID NO: 5194519 - DNA, 22 bp, Homo sapiens
agccacaggactgagccctctc

SEQ ID NO: 5194520 - DNA, 16 bp, Homo sapiens
agccacaggagccctg

SEQ ID NO: 5194521 - DNA, 17 bp, Homo sapiens
agccacaggagccctgc

SEQ ID NO: 5194522 - DNA, 17 bp, Homo sapiens
agccacaggccctggct

SEQ ID NO: 5194523 - DNA, 16 bp, Homo sapiens
agccacaggcctggcc

SEQ ID NO: 5194524 - DNA, 17 bp, Homo sapiens
agccacaggcctggcct

SEQ ID NO: 5194525 - DNA, 18 bp, Homo sapiens
agccacaggcctggcctc

SEQ ID NO: 5194526 - DNA, 13 bp, Homo sapiens
agccacagggagc

SEQ ID NO: 5194527 - DNA, 17 bp, Homo sapiens
agccacagggagccaca

SEQ ID NO: 5194528 - DNA, 19 bp, Homo sapiens
agccacagggtctgcctcc

SEQ ID NO: 5194529 - DNA, 20 bp, Homo sapiens
agccacagggtctgcctcca

SEQ ID NO: 5194530 - DNA, 14 bp, Homo sapiens
agccacagtacata

SEQ ID NO: 5194531 - DNA, 17 bp, Homo sapiens
agccacagtcactggat

SEQ ID NO: 5194532 - DNA, 20 bp, Homo sapiens
agccacagtgagggagatcc

SEQ ID NO: 5194533 - DNA, 22 bp, Homo sapiens
agccacagtgagggagatccca

SEQ ID NO: 5194534 - DNA, 20 bp, Homo sapiens
agccacagtggggcccatgg

SEQ ID NO: 5194535 - DNA, 18 bp, Homo sapiens
agccacatactttacagt

SEQ ID NO: 5194536 - DNA, 11 bp, Homo sapiens
agccacatccc

SEQ ID NO: 5194537 - DNA, 15 bp, Homo sapiens
agccacatcttgctc

SEQ ID NO: 5194538 - DNA, 15 bp, Homo sapiens
agccacatgccccag

SEQ ID NO: 5194539 - DNA, 22 bp, Homo sapiens
agccacatgccccaggctctcg

SEQ ID NO: 5194540 - DNA, 12 bp, Homo sapiens
agccacatggcc

SEQ ID NO: 5194541 - DNA, 22 bp, Homo sapiens
agccacatggccccatcccagt

SEQ ID NO: 5194542 - DNA, 21 bp, Homo sapiens
agccacatgggaaacttccaa

SEQ ID NO: 5194543 - DNA, 14 bp, Homo sapiens
agccacattcctga

SEQ ID NO: 5194544 - DNA, 13 bp, Homo sapiens
agccaccaactct

SEQ ID NO: 5194545 - DNA, 16 bp, Homo sapiens
agccaccaactcttgc

SEQ ID NO: 5194546 - DNA, 15 bp, Homo sapiens
agccaccaaggctgc

SEQ ID NO: 5194547 - DNA, 17 bp, Homo sapiens
agccaccaaggctgcct

SEQ ID NO: 5194548 - DNA, 16 bp, Homo sapiens
agccaccacacccagc

SEQ ID NO: 5194549 - DNA, 14 bp, Homo sapiens
agccaccaccactg

SEQ ID NO: 5194550 - DNA, 16 bp, Homo sapiens
agccaccaccactgtc

SEQ ID NO: 5194551 - DNA, 12 bp, Homo sapiens
agccaccaccca

SEQ ID NO: 5194552 - DNA, 13 bp, Homo sapiens
agccaccaccctc

SEQ ID NO: 5194553 - DNA, 15 bp, Homo sapiens
agccaccaccctcag

SEQ ID NO: 5194554 - DNA, 16 bp, Homo sapiens
agccaccaccctcagg

SEQ ID NO: 5194555 - DNA, 13 bp, Homo sapiens
agccaccacctgg

SEQ ID NO: 5194556 - DNA, 22 bp, Homo sapiens
agccaccacgccctgcctactc

SEQ ID NO: 5194557 - DNA, 15 bp, Homo sapiens
agccaccactcagtg

SEQ ID NO: 5194558 - DNA, 15 bp, Homo sapiens
agccaccactcctgc

SEQ ID NO: 5194559 - DNA, 18 bp, Homo sapiens
agccaccactcctgcctg

SEQ ID NO: 5194560 - DNA, 21 bp, Homo sapiens
agccaccagacttggcctcca

SEQ ID NO: 5194561 - DNA, 22 bp, Homo sapiens
agccaccagatgtgacagtgtt

SEQ ID NO: 5194562 - DNA, 18 bp, Homo sapiens
agccaccagtggacctag

SEQ ID NO: 5194563 - DNA, 12 bp, Homo sapiens
agccaccagtgt

SEQ ID NO: 5194564 - DNA, 17 bp, Homo sapiens
agccaccatctttgcag

SEQ ID NO: 5194565 - DNA, 16 bp, Homo sapiens
agccaccatgcctggc

SEQ ID NO: 5194566 - DNA, 23 bp, Homo sapiens
agccaccatgcctggcccggata

SEQ ID NO: 5194567 - DNA, 23 bp, Homo sapiens
agccaccatgcttgcctgaagct

SEQ ID NO: 5194568 - DNA, 20 bp, Homo sapiens
agccacccaagcctgctggc

SEQ ID NO: 5194569 - DNA, 14 bp, Homo sapiens
agccacccagccag

SEQ ID NO: 5194570 - DNA, 16 bp, Homo sapiens
agccacccagccagga

SEQ ID NO: 5194571 - DNA, 19 bp, Homo sapiens
agccacccagccaggaggg

SEQ ID NO: 5194572 - DNA, 21 bp, Homo sapiens
agccacccaggccactgacct

SEQ ID NO: 5194573 - DNA, 18 bp, Homo sapiens
agccaccccagaaatggt

SEQ ID NO: 5194574 - DNA, 20 bp, Homo sapiens
agccaccccagaaatggtga

SEQ ID NO: 5194575 - DNA, 17 bp, Homo sapiens
agccaccccatgagctc

SEQ ID NO: 5194576 - DNA, 22 bp, Homo sapiens
agccacccccaggcatctgtta

SEQ ID NO: 5194577 - DNA, 19 bp, Homo sapiens
agccaccccgggctctctg

SEQ ID NO: 5194578 - DNA, 16 bp, Homo sapiens
agccacccctcctcta

SEQ ID NO: 5194579 - DNA, 22 bp, Homo sapiens
agccacccctcctctagctctg

SEQ ID NO: 5194580 - DNA, 22 bp, Homo sapiens
agccacccctgccactcaccct

SEQ ID NO: 5194581 - DNA, 19 bp, Homo sapiens
agccacccggatctccagg

SEQ ID NO: 5194582 - DNA, 22 bp, Homo sapiens
agccacccggatctccaggccc

SEQ ID NO: 5194583 - DNA, 19 bp, Homo sapiens
agccacccgtggggtgctg

SEQ ID NO: 5194584 - DNA, 21 bp, Homo sapiens
agccacccgtggggtgctgcc

SEQ ID NO: 5194585 - DNA, 17 bp, Homo sapiens
agccaccctcccagctc

SEQ ID NO: 5194586 - DNA, 19 bp, Homo sapiens
agccaccctcccagctctg

SEQ ID NO: 5194587 - DNA, 21 bp, Homo sapiens
agccaccctgaggagtctgag

SEQ ID NO: 5194588 - DNA, 22 bp, Homo sapiens
agccaccctgaggagtctgagg

SEQ ID NO: 5194589 - DNA, 15 bp, Homo sapiens
agccaccctgccatg

SEQ ID NO: 5194590 - DNA, 17 bp, Homo sapiens
agccaccctgccatgga

SEQ ID NO: 5194591 - DNA, 14 bp, Homo sapiens
agccaccctgggct

SEQ ID NO: 5194592 - DNA, 15 bp, Homo sapiens
agccacccttccctg

SEQ ID NO: 5194593 - DNA, 16 bp, Homo sapiens
agccacccttccctgc

SEQ ID NO: 5194594 - DNA, 19 bp, Homo sapiens
agccacccttggtctcatg

SEQ ID NO: 5194595 - DNA, 21 bp, Homo sapiens
agccaccgaagccgcctgtgg

SEQ ID NO: 5194596 - DNA, 13 bp, Homo sapiens
agccaccgcagct

SEQ ID NO: 5194597 - DNA, 14 bp, Homo sapiens
agccaccgcagctg

SEQ ID NO: 5194598 - DNA, 15 bp, Homo sapiens
agccaccgcagctgc

SEQ ID NO: 5194599 - DNA, 16 bp, Homo sapiens
agccaccgcagctgct

SEQ ID NO: 5194600 - DNA, 20 bp, Homo sapiens
agccaccgcagctgctgcca

SEQ ID NO: 5194601 - DNA, 14 bp, Homo sapiens
agccaccgctgcca

SEQ ID NO: 5194602 - DNA, 20 bp, Homo sapiens
agccaccgtctacagatggc

SEQ ID NO: 5194603 - DNA, 15 bp, Homo sapiens
agccaccgtgcctgg

SEQ ID NO: 5194604 - DNA, 17 bp, Homo sapiens
agccaccgtgcctggcc

SEQ ID NO: 5194605 - DNA, 18 bp, Homo sapiens
agccaccgtgcctggcca

SEQ ID NO: 5194606 - DNA, 21 bp, Homo sapiens
agccacctaaacggttcagtt

SEQ ID NO: 5194607 - DNA, 14 bp, Homo sapiens
agccacctcatccc

SEQ ID NO: 5194608 - DNA, 20 bp, Homo sapiens
agccacctccacccccaaga

SEQ ID NO: 5194609 - DNA, 13 bp, Homo sapiens
agccacctcccac

SEQ ID NO: 5194610 - DNA, 18 bp, Homo sapiens
agccacctcccaccccac

SEQ ID NO: 5194611 - DNA, 14 bp, Homo sapiens
agccacctccgcca

SEQ ID NO: 5194612 - DNA, 17 bp, Homo sapiens
agccacctccgccagac

SEQ ID NO: 5194613 - DNA, 13 bp, Homo sapiens
agccacctccttg

SEQ ID NO: 5194614 - DNA, 12 bp, Homo sapiens
agccacctctcc

SEQ ID NO: 5194615 - DNA, 14 bp, Homo sapiens
agccacctctccct

SEQ ID NO: 5194616 - DNA, 17 bp, Homo sapiens
agccacctctctgcctg

SEQ ID NO: 5194617 - DNA, 14 bp, Homo sapiens
agccacctctcttt

SEQ ID NO: 5194618 - DNA, 18 bp, Homo sapiens
agccacctctctttttca

SEQ ID NO: 5194619 - DNA, 19 bp, Homo sapiens
agctcacatccagccttgg

SEQ ID NO: 5194620 - DNA, 22 bp, Homo sapiens
agctcaccagccccagtgccca

SEQ ID NO: 5194621 - DNA, 15 bp, Homo sapiens
agctcaccaggcctg

SEQ ID NO: 5194622 - DNA, 17 bp, Homo sapiens
agctcaccaggcctggc

SEQ ID NO: 5194623 - DNA, 18 bp, Homo sapiens
agctcaccaggcctggcc

SEQ ID NO: 5194624 - DNA, 19 bp, Homo sapiens
agctcaccaggcctggcct

SEQ ID NO: 5194625 - DNA, 12 bp, Homo sapiens
agctcaccatgg

SEQ ID NO: 5194626 - DNA, 17 bp, Homo sapiens
agctcacccaataaaca

SEQ ID NO: 5194627 - DNA, 18 bp, Homo sapiens
agctcacccctgggcagg

SEQ ID NO: 5194628 - DNA, 12 bp, Homo sapiens
agctcaccctgc

SEQ ID NO: 5194629 - DNA, 14 bp, Homo sapiens
agctcaccctgccc

SEQ ID NO: 5194630 - DNA, 15 bp, Homo sapiens
agctcaccctgcccg

SEQ ID NO: 5194631 - DNA, 20 bp, Homo sapiens
agctcaccctgcccgctccc

SEQ ID NO: 5194632 - DNA, 15 bp, Homo sapiens
agctcacctctccct

SEQ ID NO: 5194633 - DNA, 16 bp, Homo sapiens
agctcacctgttgctt

SEQ ID NO: 5194634 - DNA, 16 bp, Homo sapiens
agctcacggcagcctc

SEQ ID NO: 5194635 - DNA, 16 bp, Homo sapiens
agctcacgtaatgcat

SEQ ID NO: 5194636 - DNA, 20 bp, Homo sapiens
agctcacgtcctgagaaagc

SEQ ID NO: 5194637 - DNA, 15 bp, Homo sapiens
agctcactgagctgg

SEQ ID NO: 5194638 - DNA, 16 bp, Homo sapiens
agctcactgcaacctc

SEQ ID NO: 5194639 - DNA, 13 bp, Homo sapiens
agctcactgcagc

SEQ ID NO: 5194640 - DNA, 17 bp, Homo sapiens
agctcactggtttacaa

SEQ ID NO: 5194641 - DNA, 16 bp, Homo sapiens
agctcagaaggctctt

SEQ ID NO: 5194642 - DNA, 19 bp, Homo sapiens
agctcagaaggctcttctg

SEQ ID NO: 5194643 - DNA, 21 bp, Homo sapiens
agctcagaatagatctgatgg

SEQ ID NO: 5194644 - DNA, 22 bp, Homo sapiens
agctcagaatccaagtgaacac

SEQ ID NO: 5194645 - DNA, 20 bp, Homo sapiens
agctcagacatctactacag

SEQ ID NO: 5194646 - DNA, 18 bp, Homo sapiens
agctcagacccccactct

SEQ ID NO: 5194647 - DNA, 23 bp, Homo sapiens
agctcagacttgccaggctccct

SEQ ID NO: 5194648 - DNA, 18 bp, Homo sapiens
agctcagaggcccaggaa

SEQ ID NO: 5194649 - DNA, 22 bp, Homo sapiens
agctcagaggcgcactgtgacc

SEQ ID NO: 5194650 - DNA, 17 bp, Homo sapiens
agctcagcacagcctca

SEQ ID NO: 5194651 - DNA, 15 bp, Homo sapiens
agctcagcagttcac

SEQ ID NO: 5194652 - DNA, 17 bp, Homo sapiens
agctcagcagttcactt

SEQ ID NO: 5194653 - DNA, 22 bp, Homo sapiens
agctcagcccacccccctcatt

SEQ ID NO: 5194654 - DNA, 19 bp, Homo sapiens
agctcagccccaactcttt

SEQ ID NO: 5194655 - DNA, 13 bp, Homo sapiens
agctcagccccag

SEQ ID NO: 5194656 - DNA, 18 bp, Homo sapiens
agctcagccccagcccag

SEQ ID NO: 5194657 - DNA, 22 bp, Homo sapiens
agctcagccccgagctgtcccc

SEQ ID NO: 5194658 - DNA, 17 bp, Homo sapiens
agctcagccccggccac

SEQ ID NO: 5194659 - DNA, 21 bp, Homo sapiens
agctcagccctggcctggctg

SEQ ID NO: 5194660 - DNA, 18 bp, Homo sapiens
agctcagccttctcctcc

SEQ ID NO: 5194661 - DNA, 12 bp, Homo sapiens
agctcagcgcca

SEQ ID NO: 5194662 - DNA, 21 bp, Homo sapiens
agctcagctactgatttttgt

SEQ ID NO: 5194663 - DNA, 15 bp, Homo sapiens
agctcagctctgctt

SEQ ID NO: 5194664 - DNA, 23 bp, Homo sapiens
agctcagctgagcatggagacag

SEQ ID NO: 5194665 - DNA, 19 bp, Homo sapiens
agctcagctgcattccgca

SEQ ID NO: 5194666 - DNA, 13 bp, Homo sapiens
agctcagctgggc

SEQ ID NO: 5194667 - DNA, 14 bp, Homo sapiens
agctcagctgggcc

SEQ ID NO: 5194668 - DNA, 16 bp, Homo sapiens
agctcagcttcttcct

SEQ ID NO: 5194669 - DNA, 19 bp, Homo sapiens
agctcagctttctgaggcc

SEQ ID NO: 5194670 - DNA, 20 bp, Homo sapiens
agctcaggaagaagagatgc

SEQ ID NO: 5194671 - DNA, 11 bp, Homo sapiens
agctcaggaat

SEQ ID NO: 5194672 - DNA, 19 bp, Homo sapiens
agctcaggaattccctgga

SEQ ID NO: 5194673 - DNA, 12 bp, Homo sapiens
agctcaggagaa

SEQ ID NO: 5194674 - DNA, 14 bp, Homo sapiens
agctcaggagaagg

SEQ ID NO: 5194675 - DNA, 20 bp, Homo sapiens
agctcaggaggcgaataaat

SEQ ID NO: 5194676 - DNA, 23 bp, Homo sapiens
agctcaggaggcgaataaatgtt

SEQ ID NO: 5194677 - DNA, 15 bp, Homo sapiens
agctcaggaggcgcc

SEQ ID NO: 5194678 - DNA, 22 bp, Homo sapiens
agctcaggagtttgagaccagg

SEQ ID NO: 5194679 - DNA, 23 bp, Homo sapiens
agctcaggagtttgagaccaggc

SEQ ID NO: 5194680 - DNA, 13 bp, Homo sapiens
agctcaggatctc

SEQ ID NO: 5194681 - DNA, 13 bp, Homo sapiens
agctcaggatggc

SEQ ID NO: 5194682 - DNA, 22 bp, Homo sapiens
agctcaggcagcgttagggctg

SEQ ID NO: 5194683 - DNA, 14 bp, Homo sapiens
agctcaggcagctc

SEQ ID NO: 5194684 - DNA, 15 bp, Homo sapiens
agctcaggcagctcg

SEQ ID NO: 5194685 - DNA, 20 bp, Homo sapiens
agctcagggcagctgtgctg

SEQ ID NO: 5194686 - DNA, 19 bp, Homo sapiens
agctcagggccctgtgcca

SEQ ID NO: 5194687 - DNA, 13 bp, Homo sapiens
agctcagggcctg

SEQ ID NO: 5194688 - DNA, 17 bp, Homo sapiens
agctcagggcctggctc

SEQ ID NO: 5194689 - DNA, 23 bp, Homo sapiens
agctcagggctggattggcaggt

SEQ ID NO: 5194690 - DNA, 14 bp, Homo sapiens
agctcagggcttca

SEQ ID NO: 5194691 - DNA, 19 bp, Homo sapiens
agctcaggggacactggcc

SEQ ID NO: 5194692 - DNA, 16 bp, Homo sapiens
agctcaggggcagctc

SEQ ID NO: 5194693 - DNA, 17 bp, Homo sapiens
agctcaggggcagctca

SEQ ID NO: 5194694 - DNA, 19 bp, Homo sapiens
agctcagggtttcggaaat

SEQ ID NO: 5194695 - DNA, 13 bp, Homo sapiens
agctcaggtgcct

SEQ ID NO: 5194696 - DNA, 16 bp, Homo sapiens
agctcaggtgcctttg

SEQ ID NO: 5194697 - DNA, 16 bp, Homo sapiens
agctcaggtggggagt

SEQ ID NO: 5194698 - DNA, 17 bp, Homo sapiens
agctcaggtgtccctgc

SEQ ID NO: 5194699 - DNA, 20 bp, Homo sapiens
agctcaggtgtccctgcact

SEQ ID NO: 5194700 - DNA, 16 bp, Homo sapiens
agctcaggttccctgc

SEQ ID NO: 5194701 - DNA, 21 bp, Homo sapiens
agctcaggttccctgccacac

SEQ ID NO: 5194702 - DNA, 20 bp, Homo sapiens
agctcaggtttgtcctggtc

SEQ ID NO: 5194703 - DNA, 19 bp, Homo sapiens
agctcagtaacataactgc

SEQ ID NO: 5194704 - DNA, 16 bp, Homo sapiens
agctcagtacagggca

SEQ ID NO: 5194705 - DNA, 20 bp, Homo sapiens
agctcagtcccacagcccct

SEQ ID NO: 5194706 - DNA, 21 bp, Homo sapiens
agctcagtcccatcagagagc

SEQ ID NO: 5194707 - DNA, 14 bp, Homo sapiens
agctcagtgccaaa

SEQ ID NO: 5194708 - DNA, 19 bp, Homo sapiens
agctcagtgccacaaagct

SEQ ID NO: 5194709 - DNA, 20 bp, Homo sapiens
agctcagtgccacaaagctc

SEQ ID NO: 5194710 - DNA, 14 bp, Homo sapiens
agctcagtgctctc

SEQ ID NO: 5194711 - DNA, 13 bp, Homo sapiens
agctcagtggcaa

SEQ ID NO: 5194712 - DNA, 19 bp, Homo sapiens
agctcagtttatccaaggt

SEQ ID NO: 5194713 - DNA, 16 bp, Homo sapiens
agctcagtttggctgt

SEQ ID NO: 5194714 - DNA, 21 bp, Homo sapiens
agctcataaactgccaagagc

SEQ ID NO: 5194715 - DNA, 18 bp, Homo sapiens
agctcataagagccacag

SEQ ID NO: 5194716 - DNA, 21 bp, Homo sapiens
agctcatacaaaataaatggt

SEQ ID NO: 5194717 - DNA, 15 bp, Homo sapiens
agctcatagcacatg

SEQ ID NO: 5194718 - DNA, 18 bp, Homo sapiens
agctcatcactgtgcctt

SEQ ID NO: 5194719 - DNA, 19 bp, Homo sapiens
agctcatccctctcaccca

SEQ ID NO: 5194720 - DNA, 17 bp, Homo sapiens
agctcatctccaaggat

SEQ ID NO: 5194721 - DNA, 23 bp, Homo sapiens
agctcatctccaaggatcctctc

SEQ ID NO: 5194722 - DNA, 14 bp, Homo sapiens
agctcatctctgtc

SEQ ID NO: 5194723 - DNA, 16 bp, Homo sapiens
agctcatctgcaaaag

SEQ ID NO: 5194724 - DNA, 16 bp, Homo sapiens
agctcatcttcactgc

SEQ ID NO: 5194725 - DNA, 19 bp, Homo sapiens
agctcatgtagcaatcaga

SEQ ID NO: 5194726 - DNA, 19 bp, Homo sapiens
agctcatgtaggtgagcct

SEQ ID NO: 5194727 - DNA, 22 bp, Homo sapiens
agctcatgtaggtgagcctggg

SEQ ID NO: 5194728 - DNA, 17 bp, Homo sapiens
agctcatgtcattatga

SEQ ID NO: 5194729 - DNA, 16 bp, Homo sapiens
agctcatgttttctat

SEQ ID NO: 5194730 - DNA, 16 bp, Homo sapiens
agctcatgtttttaac

SEQ ID NO: 5194731 - DNA, 21 bp, Homo sapiens
agctcattataatgtcattaa

SEQ ID NO: 5194732 - DNA, 15 bp, Homo sapiens
agctcattatgaaaa

SEQ ID NO: 5194733 - DNA, 14 bp, Homo sapiens
agctcattcatttt

SEQ ID NO: 5194734 - DNA, 17 bp, Homo sapiens
agctcattcattttata

SEQ ID NO: 5194735 - DNA, 22 bp, Homo sapiens
agctcattcattttatattgaa

SEQ ID NO: 5194736 - DNA, 21 bp, Homo sapiens
agctcattctccttgtgttac

SEQ ID NO: 5194737 - DNA, 18 bp, Homo sapiens
agctcatttaatcccagg

SEQ ID NO: 5194738 - DNA, 22 bp, Homo sapiens
agctcatttaatcccaggaaag

SEQ ID NO: 5194739 - DNA, 12 bp, Homo sapiens
agctcatttcac

SEQ ID NO: 5194740 - DNA, 21 bp, Homo sapiens
agctcatttcggggtcaggtg

SEQ ID NO: 5194741 - DNA, 18 bp, Homo sapiens
agctcatttggggaccac

SEQ ID NO: 5194742 - DNA, 14 bp, Homo sapiens
agctccaacctgca

SEQ ID NO: 5194743 - DNA, 18 bp, Homo sapiens
agctccaacctgcaaaga

SEQ ID NO: 5194744 - DNA, 19 bp, Homo sapiens
agctccaacctggaggctg

SEQ ID NO: 5194745 - DNA, 22 bp, Homo sapiens
agctccaacctggaggctggac

SEQ ID NO: 5194746 - DNA, 23 bp, Homo sapiens
agctccaacctggaggctggacc

SEQ ID NO: 5194747 - DNA, 18 bp, Homo sapiens
agctccaagaatttctag

SEQ ID NO: 5194748 - DNA, 18 bp, Homo sapiens
agctccaagctcccaggc

SEQ ID NO: 5194749 - DNA, 21 bp, Homo sapiens
agctccaagctgttaaagata

SEQ ID NO: 5194750 - DNA, 12 bp, Homo sapiens
agctccacacgc

SEQ ID NO: 5194751 - DNA, 15 bp, Homo sapiens
agctccacacgcccc

SEQ ID NO: 5194752 - DNA, 16 bp, Homo sapiens
agctccacagaagaca

SEQ ID NO: 5194753 - DNA, 20 bp, Homo sapiens
agctccacagggtgggatga

SEQ ID NO: 5194754 - DNA, 17 bp, Homo sapiens
agctccaccactgtgca

SEQ ID NO: 5194755 - DNA, 14 bp, Homo sapiens
agctccacctctgg

SEQ ID NO: 5194756 - DNA, 19 bp, Homo sapiens
agctccacggtgcgtggct

SEQ ID NO: 5194757 - DNA, 22 bp, Homo sapiens
agctccacggtgcgtggctgtg

SEQ ID NO: 5194758 - DNA, 13 bp, Homo sapiens
agctccactcagg

SEQ ID NO: 5194759 - DNA, 15 bp, Homo sapiens
agctccactcagggc

SEQ ID NO: 5194760 - DNA, 18 bp, Homo sapiens
agctccactcagggctgg

SEQ ID NO: 5194761 - DNA, 23 bp, Homo sapiens
agctccactcagggctggcccgg

SEQ ID NO: 5194762 - DNA, 16 bp, Homo sapiens
agctccactctgaagt

SEQ ID NO: 5194763 - DNA, 18 bp, Homo sapiens
agctccactctgcttctc

SEQ ID NO: 5194764 - DNA, 19 bp, Homo sapiens
agctccactctgcttctct

SEQ ID NO: 5194765 - DNA, 20 bp, Homo sapiens
agctccactggcctgcccgt

SEQ ID NO: 5194766 - DNA, 18 bp, Homo sapiens
agctccactgtcaccctc

SEQ ID NO: 5194767 - DNA, 16 bp, Homo sapiens
agctccagacccccag

SEQ ID NO: 5194768 - DNA, 23 bp, Homo sapiens
agctccagacccccagcaaccct

SEQ ID NO: 5194769 - DNA, 13 bp, Homo sapiens
agctccagagcaa

SEQ ID NO: 5194770 - DNA, 15 bp, Homo sapiens
agctccagatgtttc

SEQ ID NO: 5194771 - DNA, 16 bp, Homo sapiens
agctccagatgtttct

SEQ ID NO: 5194772 - DNA, 12 bp, Homo sapiens
agctccagccac

SEQ ID NO: 5194773 - DNA, 11 bp, Homo sapiens
agctccagccc

SEQ ID NO: 5194774 - DNA, 21 bp, Homo sapiens
agctccagcccctttccaaaa

SEQ ID NO: 5194775 - DNA, 14 bp, Homo sapiens
agctccagcctgac

SEQ ID NO: 5194776 - DNA, 14 bp, Homo sapiens
agctccagctttct

SEQ ID NO: 5194777 - DNA, 12 bp, Homo sapiens
agctccaggcag

SEQ ID NO: 5194778 - DNA, 16 bp, Homo sapiens
agctccaggcccaccg

SEQ ID NO: 5194779 - DNA, 21 bp, Homo sapiens
agctccagggaatccaagcct

SEQ ID NO: 5194780 - DNA, 15 bp, Homo sapiens
agctccaggggccct

SEQ ID NO: 5194781 - DNA, 13 bp, Homo sapiens
agctccagtagct

SEQ ID NO: 5194782 - DNA, 21 bp, Homo sapiens
agctccagtgctttatccaca

SEQ ID NO: 5194783 - DNA, 20 bp, Homo sapiens
agctccagtggaagaagaaa

SEQ ID NO: 5194784 - DNA, 14 bp, Homo sapiens
agctccagtgtcct

SEQ ID NO: 5194785 - DNA, 15 bp, Homo sapiens
agctccagtgtcctg

SEQ ID NO: 5194786 - DNA, 18 bp, Homo sapiens
agctccagtgtcctgagc

SEQ ID NO: 5194787 - DNA, 21 bp, Homo sapiens
agctccagtgtcctgagctca

SEQ ID NO: 5194788 - DNA, 23 bp, Homo sapiens
agctccagtgtcctgagctcagc

SEQ ID NO: 5194789 - DNA, 13 bp, Homo sapiens
agctccagttcga

SEQ ID NO: 5194790 - DNA, 20 bp, Homo sapiens
agctccataagcaagtgagc

SEQ ID NO: 5194791 - DNA, 18 bp, Homo sapiens
agctccataattgcaagg

SEQ ID NO: 5194792 - DNA, 18 bp, Homo sapiens
agctccatacacacgctg

SEQ ID NO: 5194793 - DNA, 19 bp, Homo sapiens
agctccatacacacgctgc

SEQ ID NO: 5194794 - DNA, 20 bp, Homo sapiens
agctccatacacacgctgcc

SEQ ID NO: 5194795 - DNA, 22 bp, Homo sapiens
agctccatacacacgctgcctt

SEQ ID NO: 5194796 - DNA, 14 bp, Homo sapiens
agctccatacttct

SEQ ID NO: 5194797 - DNA, 11 bp, Homo sapiens
agccacctgca

SEQ ID NO: 5194798 - DNA, 12 bp, Homo sapiens
agccacctgcaa

SEQ ID NO: 5194799 - DNA, 13 bp, Homo sapiens
agccacctgcaag

SEQ ID NO: 5194800 - DNA, 11 bp, Homo sapiens
agccacctgct

SEQ ID NO: 5194801 - DNA, 14 bp, Homo sapiens
agccacctgctgcg

SEQ ID NO: 5194802 - DNA, 18 bp, Homo sapiens
agccacctgggaacacag

SEQ ID NO: 5194803 - DNA, 19 bp, Homo sapiens
agccacctgggaacacagt

SEQ ID NO: 5194804 - DNA, 12 bp, Homo sapiens
agccacctgggc

SEQ ID NO: 5194805 - DNA, 19 bp, Homo sapiens
agccacctgtcccacctca

SEQ ID NO: 5194806 - DNA, 13 bp, Homo sapiens
agccaccttcctg

SEQ ID NO: 5194807 - DNA, 14 bp, Homo sapiens
agccaccttcctga

SEQ ID NO: 5194808 - DNA, 13 bp, Homo sapiens
agccaccttgatt

SEQ ID NO: 5194809 - DNA, 17 bp, Homo sapiens
agccaccttgattttct

SEQ ID NO: 5194810 - DNA, 22 bp, Homo sapiens
agccaccttttgggaatgtttt

SEQ ID NO: 5194811 - DNA, 23 bp, Homo sapiens
agccaccttttgggaatgtttta

SEQ ID NO: 5194812 - DNA, 15 bp, Homo sapiens
agccacgaccagccc

SEQ ID NO: 5194813 - DNA, 23 bp, Homo sapiens
agccacgaccagccccttcctgg

SEQ ID NO: 5194814 - DNA, 17 bp, Homo sapiens
agccacgattggagaat

SEQ ID NO: 5194815 - DNA, 13 bp, Homo sapiens
agccacgccctcc

SEQ ID NO: 5194816 - DNA, 22 bp, Homo sapiens
agccacgcctatgccctgccct

SEQ ID NO: 5194817 - DNA, 23 bp, Homo sapiens
agccacgcctctctcagcccagg

SEQ ID NO: 5194818 - DNA, 20 bp, Homo sapiens
agccacgctggccttcgtct

SEQ ID NO: 5194819 - DNA, 15 bp, Homo sapiens
agccacgctgtcctc

SEQ ID NO: 5194820 - DNA, 20 bp, Homo sapiens
agccacgctgtcctctcgag

SEQ ID NO: 5194821 - DNA, 13 bp, Homo sapiens
agccacggaaaca

SEQ ID NO: 5194822 - DNA, 17 bp, Homo sapiens
agccacggaaacataga

SEQ ID NO: 5194823 - DNA, 21 bp, Homo sapiens
agccacggaccgcatcctcca

SEQ ID NO: 5194824 - DNA, 19 bp, Homo sapiens
agccacggagggaggcacc

SEQ ID NO: 5194825 - DNA, 22 bp, Homo sapiens
agccacggagggaggcaccatg

SEQ ID NO: 5194826 - DNA, 16 bp, Homo sapiens
agccacggccaggcca

SEQ ID NO: 5194827 - DNA, 17 bp, Homo sapiens
agccacggccaggccag

SEQ ID NO: 5194828 - DNA, 18 bp, Homo sapiens
agccacgtgctggagagt

SEQ ID NO: 5194829 - DNA, 19 bp, Homo sapiens
agccactaaccttgcctgg

SEQ ID NO: 5194830 - DNA, 13 bp, Homo sapiens
agccactaactag

SEQ ID NO: 5194831 - DNA, 19 bp, Homo sapiens
agccactaagaacccctct

SEQ ID NO: 5194832 - DNA, 22 bp, Homo sapiens
agccactaagaacccctctgct

SEQ ID NO: 5194833 - DNA, 22 bp, Homo sapiens
agccactagactcttcactgtt

SEQ ID NO: 5194834 - DNA, 14 bp, Homo sapiens
agccactccaagcc

SEQ ID NO: 5194835 - DNA, 18 bp, Homo sapiens
agccactccaagccccct

SEQ ID NO: 5194836 - DNA, 11 bp, Homo sapiens
agccactcccc

SEQ ID NO: 5194837 - DNA, 17 bp, Homo sapiens
agccactccccggcatg

SEQ ID NO: 5194838 - DNA, 14 bp, Homo sapiens
agccactccctccc

SEQ ID NO: 5194839 - DNA, 17 bp, Homo sapiens
agccactccctcccaga

SEQ ID NO: 5194840 - DNA, 15 bp, Homo sapiens
agccactcctctgac

SEQ ID NO: 5194841 - DNA, 16 bp, Homo sapiens
agccactctctgccca

SEQ ID NO: 5194842 - DNA, 17 bp, Homo sapiens
agccactctctgcccac

SEQ ID NO: 5194843 - DNA, 19 bp, Homo sapiens
agccactctcttccctttc

SEQ ID NO: 5194844 - DNA, 12 bp, Homo sapiens
agccactgaagc

SEQ ID NO: 5194845 - DNA, 13 bp, Homo sapiens
agccactgaagta

SEQ ID NO: 5194846 - DNA, 13 bp, Homo sapiens
agccactgcaccg

SEQ ID NO: 5194847 - DNA, 14 bp, Homo sapiens
agccactgcagcac

SEQ ID NO: 5194848 - DNA, 22 bp, Homo sapiens
agccactgccactccagtcctg

SEQ ID NO: 5194849 - DNA, 15 bp, Homo sapiens
agccactgcctctcc

SEQ ID NO: 5194850 - DNA, 17 bp, Homo sapiens
agccactgcctctccct

SEQ ID NO: 5194851 - DNA, 21 bp, Homo sapiens
agccactgcgcccggccacat

SEQ ID NO: 5194852 - DNA, 13 bp, Homo sapiens
agccactggaaat

SEQ ID NO: 5194853 - DNA, 18 bp, Homo sapiens
agccactggaaggagcac

SEQ ID NO: 5194854 - DNA, 19 bp, Homo sapiens
agccactggaaggagcaca

SEQ ID NO: 5194855 - DNA, 11 bp, Homo sapiens
agccactggca

SEQ ID NO: 5194856 - DNA, 13 bp, Homo sapiens
agccactggcata

SEQ ID NO: 5194857 - DNA, 20 bp, Homo sapiens
agccactggggtgggagggg

SEQ ID NO: 5194858 - DNA, 22 bp, Homo sapiens
agccactggggtgggagggggc

SEQ ID NO: 5194859 - DNA, 12 bp, Homo sapiens
agccactgtcac

SEQ ID NO: 5194860 - DNA, 15 bp, Homo sapiens
agccactgtcacagg

SEQ ID NO: 5194861 - DNA, 16 bp, Homo sapiens
agccactgtcacaggc

SEQ ID NO: 5194862 - DNA, 17 bp, Homo sapiens
agccactgtcacaggca

SEQ ID NO: 5194863 - DNA, 16 bp, Homo sapiens
agccactgtgcccagc

SEQ ID NO: 5194864 - DNA, 18 bp, Homo sapiens
agccactgtgcttggcca

SEQ ID NO: 5194865 - DNA, 17 bp, Homo sapiens
agccacttaaaatgttc

SEQ ID NO: 5194866 - DNA, 15 bp, Homo sapiens
agccacttaccttca

SEQ ID NO: 5194867 - DNA, 21 bp, Homo sapiens
agccacttaccttcaataaag

SEQ ID NO: 5194868 - DNA, 22 bp, Homo sapiens
agccacttaccttcaataaagt

SEQ ID NO: 5194869 - DNA, 14 bp, Homo sapiens
agccacttaggaca

SEQ ID NO: 5194870 - DNA, 19 bp, Homo sapiens
agccacttatttccatgga

SEQ ID NO: 5194871 - DNA, 21 bp, Homo sapiens
agccacttctggcttcagccc

SEQ ID NO: 5194872 - DNA, 22 bp, Homo sapiens
agccacttgcctgtgctacaat

SEQ ID NO: 5194873 - DNA, 18 bp, Homo sapiens
agccactttcaagctgca

SEQ ID NO: 5194874 - DNA, 19 bp, Homo sapiens
agccagaaataaagttggt

SEQ ID NO: 5194875 - DNA, 20 bp, Homo sapiens
agccagaaatgggcagttct

SEQ ID NO: 5194876 - DNA, 21 bp, Homo sapiens
agccagaacgtggctctgctg

SEQ ID NO: 5194877 - DNA, 22 bp, Homo sapiens
agccagaacgtggctctgctgg

SEQ ID NO: 5194878 - DNA, 16 bp, Homo sapiens
agccagaactctgtgt

SEQ ID NO: 5194879 - DNA, 18 bp, Homo sapiens
agccagaagcctctgcct

SEQ ID NO: 5194880 - DNA, 14 bp, Homo sapiens
agccagaaggaaaa

SEQ ID NO: 5194881 - DNA, 22 bp, Homo sapiens
agccagaaggggcacgcctgcc

SEQ ID NO: 5194882 - DNA, 23 bp, Homo sapiens
agccagaaggggcacgcctgccc

SEQ ID NO: 5194883 - DNA, 21 bp, Homo sapiens
agccagaatcagcacagataa

SEQ ID NO: 5194884 - DNA, 19 bp, Homo sapiens
agccagaatctcattactg

SEQ ID NO: 5194885 - DNA, 23 bp, Homo sapiens
agccagaatgtttcctgtggaaa

SEQ ID NO: 5194886 - DNA, 21 bp, Homo sapiens
agccagaattctaccctggaa

SEQ ID NO: 5194887 - DNA, 20 bp, Homo sapiens
agccagacaaaatttgagaa

SEQ ID NO: 5194888 - DNA, 14 bp, Homo sapiens
agccagacaacttc

SEQ ID NO: 5194889 - DNA, 14 bp, Homo sapiens
agccagacacgttc

SEQ ID NO: 5194890 - DNA, 14 bp, Homo sapiens
agccagacactctg

SEQ ID NO: 5194891 - DNA, 19 bp, Homo sapiens
agccagacactctgctctg

SEQ ID NO: 5194892 - DNA, 21 bp, Homo sapiens
agccagacagcaacggggagg

SEQ ID NO: 5194893 - DNA, 15 bp, Homo sapiens
agccagacagcccca

SEQ ID NO: 5194894 - DNA, 15 bp, Homo sapiens
agccagaccagatta

SEQ ID NO: 5194895 - DNA, 19 bp, Homo sapiens
agccagacctattcctcct

SEQ ID NO: 5194896 - DNA, 20 bp, Homo sapiens
agccagacctattcctcctg

SEQ ID NO: 5194897 - DNA, 13 bp, Homo sapiens
agccagactctgc

SEQ ID NO: 5194898 - DNA, 16 bp, Homo sapiens
agccagactctggtct

SEQ ID NO: 5194899 - DNA, 15 bp, Homo sapiens
agccagactctgtct

SEQ ID NO: 5194900 - DNA, 18 bp, Homo sapiens
agccagactgtccaggga

SEQ ID NO: 5194901 - DNA, 11 bp, Homo sapiens
agccagagaag

SEQ ID NO: 5194902 - DNA, 18 bp, Homo sapiens
agccagagaagtgacagg

SEQ ID NO: 5194903 - DNA, 20 bp, Homo sapiens
agccagagacagaggatgtg

SEQ ID NO: 5194904 - DNA, 12 bp, Homo sapiens
agccagagagga

SEQ ID NO: 5194905 - DNA, 15 bp, Homo sapiens
agccagagaggagca

SEQ ID NO: 5194906 - DNA, 15 bp, Homo sapiens
agccagagccccaag

SEQ ID NO: 5194907 - DNA, 16 bp, Homo sapiens
agccagagccccaagc

SEQ ID NO: 5194908 - DNA, 17 bp, Homo sapiens
agccagagcccttcact

SEQ ID NO: 5194909 - DNA, 18 bp, Homo sapiens
agccagagccgcaccctg

SEQ ID NO: 5194910 - DNA, 19 bp, Homo sapiens
agccagagccgcaccctgg

SEQ ID NO: 5194911 - DNA, 21 bp, Homo sapiens
agccagagccgcaccctggct

SEQ ID NO: 5194912 - DNA, 20 bp, Homo sapiens
agccagagctgggtggggac

SEQ ID NO: 5194913 - DNA, 14 bp, Homo sapiens
agccagagctgtgc

SEQ ID NO: 5194914 - DNA, 20 bp, Homo sapiens
agccagaggaaccagcactc

SEQ ID NO: 5194915 - DNA, 17 bp, Homo sapiens
agccagaggagagagga

SEQ ID NO: 5194916 - DNA, 17 bp, Homo sapiens
agccagaggagggcaga

SEQ ID NO: 5194917 - DNA, 18 bp, Homo sapiens
agccagaggagggcagag

SEQ ID NO: 5194918 - DNA, 15 bp, Homo sapiens
agccagaggccagga

SEQ ID NO: 5194919 - DNA, 14 bp, Homo sapiens
agccagaggctggg

SEQ ID NO: 5194920 - DNA, 13 bp, Homo sapiens
agccagaggtgga

SEQ ID NO: 5194921 - DNA, 10 bp, Homo sapiens
agccagagtc

SEQ ID NO: 5194922 - DNA, 13 bp, Homo sapiens
agccagagtggcc

SEQ ID NO: 5194923 - DNA, 15 bp, Homo sapiens
agccagagtgtatta

SEQ ID NO: 5194924 - DNA, 14 bp, Homo sapiens
agccagagttaggt

SEQ ID NO: 5194925 - DNA, 20 bp, Homo sapiens
agccagagttgttctcaggg

SEQ ID NO: 5194926 - DNA, 18 bp, Homo sapiens
agccagagtttgcctccc

SEQ ID NO: 5194927 - DNA, 20 bp, Homo sapiens
agccagagtttgcctccctg

SEQ ID NO: 5194928 - DNA, 21 bp, Homo sapiens
agccagagtttgcctccctgc

SEQ ID NO: 5194929 - DNA, 23 bp, Homo sapiens
agccagagtttttaaagccttct

SEQ ID NO: 5194930 - DNA, 14 bp, Homo sapiens
agccagatccaccc

SEQ ID NO: 5194931 - DNA, 14 bp, Homo sapiens
agccagatcctctt

SEQ ID NO: 5194932 - DNA, 20 bp, Homo sapiens
agccagatgacagggagctg

SEQ ID NO: 5194933 - DNA, 15 bp, Homo sapiens
agccagatgcaggac

SEQ ID NO: 5194934 - DNA, 19 bp, Homo sapiens
agccagatgcaggacagga

SEQ ID NO: 5194935 - DNA, 22 bp, Homo sapiens
agccagatgcaggacaggaggc

SEQ ID NO: 5194936 - DNA, 16 bp, Homo sapiens
agccagatgcctcccc

SEQ ID NO: 5194937 - DNA, 17 bp, Homo sapiens
agccagatgcctcccca

SEQ ID NO: 5194938 - DNA, 14 bp, Homo sapiens
agccagattacagg

SEQ ID NO: 5194939 - DNA, 19 bp, Homo sapiens
agccagattaggcctggag

SEQ ID NO: 5194940 - DNA, 14 bp, Homo sapiens
agccagattctctt

SEQ ID NO: 5194941 - DNA, 14 bp, Homo sapiens
agccagatttcact

SEQ ID NO: 5194942 - DNA, 18 bp, Homo sapiens
agccagatttgtcttttt

SEQ ID NO: 5194943 - DNA, 19 bp, Homo sapiens
agccagattttcctgaaaa

SEQ ID NO: 5194944 - DNA, 18 bp, Homo sapiens
agccagcaaagcctccag

SEQ ID NO: 5194945 - DNA, 22 bp, Homo sapiens
agccagcaaagcctccagcatc

SEQ ID NO: 5194946 - DNA, 22 bp, Homo sapiens
agccagcaagagggaacaaaac

SEQ ID NO: 5194947 - DNA, 18 bp, Homo sapiens
agccagcacacagggcag

SEQ ID NO: 5194948 - DNA, 19 bp, Homo sapiens
agccagcacacagggcagt

SEQ ID NO: 5194949 - DNA, 21 bp, Homo sapiens
agccagcaccgccggctttca

SEQ ID NO: 5194950 - DNA, 16 bp, Homo sapiens
agccagcaccggacca

SEQ ID NO: 5194951 - DNA, 21 bp, Homo sapiens
agccagcaccggaccagcctg

SEQ ID NO: 5194952 - DNA, 24 bp, Homo sapiens
agccagcaccggaccagcctggcc

SEQ ID NO: 5194953 - DNA, 20 bp, Homo sapiens
agccagcacttgtccagctg

SEQ ID NO: 5194954 - DNA, 21 bp, Homo sapiens
agccagcacttgtccagctga

SEQ ID NO: 5194955 - DNA, 22 bp, Homo sapiens
agccagcagacattgtcagcaa

SEQ ID NO: 5194956 - DNA, 18 bp, Homo sapiens
agccagcagcaaaaacta

SEQ ID NO: 5194957 - DNA, 16 bp, Homo sapiens
agccagcagcagccca

SEQ ID NO: 5194958 - DNA, 13 bp, Homo sapiens
agccagcagccag

SEQ ID NO: 5194959 - DNA, 23 bp, Homo sapiens
agccagcagctgaagtctctttt

SEQ ID NO: 5194960 - DNA, 17 bp, Homo sapiens
agccagcaggctctcag

SEQ ID NO: 5194961 - DNA, 21 bp, Homo sapiens
agccagcaggctctcaggcca

SEQ ID NO: 5194962 - DNA, 20 bp, Homo sapiens
agccagcaggttctctcctg

SEQ ID NO: 5194963 - DNA, 21 bp, Homo sapiens
agccagcaggttctctcctgt

SEQ ID NO: 5194964 - DNA, 22 bp, Homo sapiens
agccagcagttcagagctgccc

SEQ ID NO: 5194965 - DNA, 15 bp, Homo sapiens
agccagcattcagca

SEQ ID NO: 5194966 - DNA, 20 bp, Homo sapiens
agccagcattcagcacacac

SEQ ID NO: 5194967 - DNA, 23 bp, Homo sapiens
agccagccacagacccctgggag

SEQ ID NO: 5194968 - DNA, 13 bp, Homo sapiens
agccagccacccc

SEQ ID NO: 5194969 - DNA, 18 bp, Homo sapiens
agccagccaccctaactg

SEQ ID NO: 5194970 - DNA, 11 bp, Homo sapiens
agccagccact

SEQ ID NO: 5194971 - DNA, 12 bp, Homo sapiens
agccagccagga

SEQ ID NO: 5194972 - DNA, 20 bp, Homo sapiens
agccagccaggaactggctc

SEQ ID NO: 5194973 - DNA, 21 bp, Homo sapiens
agccagccatcggaagagagg

SEQ ID NO: 5194974 - DNA, 23 bp, Homo sapiens
agccagccatcggaagagagggc

SEQ ID NO: 5194975 - DNA, 20 bp, Homo sapiens
agccagcccaaaccttgggc

SEQ ID NO: 5194976 - DNA, 22 bp, Homo sapiens
agctccatgtgcatataaaggt

SEQ ID NO: 5194977 - DNA, 18 bp, Homo sapiens
agctccatgttctcccaa

SEQ ID NO: 5194978 - DNA, 19 bp, Homo sapiens
agctccatgttctcccaaa

SEQ ID NO: 5194979 - DNA, 17 bp, Homo sapiens
agctccatgtttagaaa

SEQ ID NO: 5194980 - DNA, 13 bp, Homo sapiens
agctccattttct

SEQ ID NO: 5194981 - DNA, 23 bp, Homo sapiens
agctcccaagagcttccagagct

SEQ ID NO: 5194982 - DNA, 22 bp, Homo sapiens
agctcccaagggatggtgccct

SEQ ID NO: 5194983 - DNA, 23 bp, Homo sapiens
agctcccaagggatggtgccctg

SEQ ID NO: 5194984 - DNA, 16 bp, Homo sapiens
agctcccacaagcctg

SEQ ID NO: 5194985 - DNA, 17 bp, Homo sapiens
agctcccacaagcctga

SEQ ID NO: 5194986 - DNA, 19 bp, Homo sapiens
agctcccacaagcctgagg

SEQ ID NO: 5194987 - DNA, 18 bp, Homo sapiens
agctcccacacccacctc

SEQ ID NO: 5194988 - DNA, 23 bp, Homo sapiens
agctcccacacccacctctgcca

SEQ ID NO: 5194989 - DNA, 23 bp, Homo sapiens
agctcccaccccacccccttcag

SEQ ID NO: 5194990 - DNA, 11 bp, Homo sapiens
agctcccacct

SEQ ID NO: 5194991 - DNA, 14 bp, Homo sapiens
agctcccacctccc

SEQ ID NO: 5194992 - DNA, 18 bp, Homo sapiens
agctcccacctcccttcc

SEQ ID NO: 5194993 - DNA, 17 bp, Homo sapiens
agctcccacttctgcca

SEQ ID NO: 5194994 - DNA, 16 bp, Homo sapiens
agctcccagatgctgg

SEQ ID NO: 5194995 - DNA, 13 bp, Homo sapiens
agctcccaggcat

SEQ ID NO: 5194996 - DNA, 16 bp, Homo sapiens
agctcccagggtggac

SEQ ID NO: 5194997 - DNA, 15 bp, Homo sapiens
agctcccaggtgcag

SEQ ID NO: 5194998 - DNA, 20 bp, Homo sapiens
agctcccaggtgcagccaga

SEQ ID NO: 5194999 - DNA, 13 bp, Homo sapiens
agctcccattcta

SEQ ID NO: 5195000 - DNA, 16 bp, Homo sapiens
agctcccatttctact

SEQ ID NO: 5195001 - DNA, 17 bp, Homo sapiens
agctcccatttctactc

SEQ ID NO: 5195002 - DNA, 16 bp, Homo sapiens
agctccccaactccct

SEQ ID NO: 5195003 - DNA, 20 bp, Homo sapiens
agctccccaccaccccagct

SEQ ID NO: 5195004 - DNA, 21 bp, Homo sapiens
agctccccaccaccccagctg

SEQ ID NO: 5195005 - DNA, 14 bp, Homo sapiens
agctccccagatct

SEQ ID NO: 5195006 - DNA, 13 bp, Homo sapiens
agctccccaggac

SEQ ID NO: 5195007 - DNA, 23 bp, Homo sapiens
agctccccaggactcaccctcat

SEQ ID NO: 5195008 - DNA, 15 bp, Homo sapiens
agctccccaggagct

SEQ ID NO: 5195009 - DNA, 18 bp, Homo sapiens
agctcccccactcctccc

SEQ ID NO: 5195010 - DNA, 18 bp, Homo sapiens
agctcccccaggcagaaa

SEQ ID NO: 5195011 - DNA, 14 bp, Homo sapiens
agctcccccaggct

SEQ ID NO: 5195012 - DNA, 15 bp, Homo sapiens
agctcccccaggctg

SEQ ID NO: 5195013 - DNA, 14 bp, Homo sapiens
agctccccccacct

SEQ ID NO: 5195014 - DNA, 23 bp, Homo sapiens
agctccccctcccccactgccat

SEQ ID NO: 5195015 - DNA, 21 bp, Homo sapiens
agctccccctgtcccctcagc

SEQ ID NO: 5195016 - DNA, 23 bp, Homo sapiens
agctccccctgtcccctcagctc

SEQ ID NO: 5195017 - DNA, 22 bp, Homo sapiens
agctcccccttgcccgccagcc

SEQ ID NO: 5195018 - DNA, 21 bp, Homo sapiens
agctccccgcttctgcctgca

SEQ ID NO: 5195019 - DNA, 18 bp, Homo sapiens
agctcccctccacagctg

SEQ ID NO: 5195020 - DNA, 20 bp, Homo sapiens
agctcccctccacagctgca

SEQ ID NO: 5195021 - DNA, 18 bp, Homo sapiens
agctcccctccccaactg

SEQ ID NO: 5195022 - DNA, 14 bp, Homo sapiens
agctcccctgcctt

SEQ ID NO: 5195023 - DNA, 20 bp, Homo sapiens
agctcccctggagccagcag

SEQ ID NO: 5195024 - DNA, 23 bp, Homo sapiens
agctcccctggagccagcagggc

SEQ ID NO: 5195025 - DNA, 16 bp, Homo sapiens
agctcccctggctggc

SEQ ID NO: 5195026 - DNA, 20 bp, Homo sapiens
agctcccctggctggctcct

SEQ ID NO: 5195027 - DNA, 21 bp, Homo sapiens
agctcccctggctggctccta

SEQ ID NO: 5195028 - DNA, 23 bp, Homo sapiens
agctcccctggctggctcctagg

SEQ ID NO: 5195029 - DNA, 21 bp, Homo sapiens
agctcccgtgtaaataattta

SEQ ID NO: 5195030 - DNA, 11 bp, Homo sapiens
agctccctccc

SEQ ID NO: 5195031 - DNA, 12 bp, Homo sapiens
agctccctcccc

SEQ ID NO: 5195032 - DNA, 13 bp, Homo sapiens
agctccctcccct

SEQ ID NO: 5195033 - DNA, 14 bp, Homo sapiens
agctccctcccgca

SEQ ID NO: 5195034 - DNA, 12 bp, Homo sapiens
agctccctcctc

SEQ ID NO: 5195035 - DNA, 15 bp, Homo sapiens
agctccctcctcagg

SEQ ID NO: 5195036 - DNA, 14 bp, Homo sapiens
agctccctcctccc

SEQ ID NO: 5195037 - DNA, 16 bp, Homo sapiens
agctccctcctcccat

SEQ ID NO: 5195038 - DNA, 18 bp, Homo sapiens
agctccctcctcccatct

SEQ ID NO: 5195039 - DNA, 22 bp, Homo sapiens
agctccctcgtcttcagctgca

SEQ ID NO: 5195040 - DNA, 14 bp, Homo sapiens
agctccctctgcct

SEQ ID NO: 5195041 - DNA, 16 bp, Homo sapiens
agctccctgaccccct

SEQ ID NO: 5195042 - DNA, 17 bp, Homo sapiens
agctccctgaccccctg

SEQ ID NO: 5195043 - DNA, 18 bp, Homo sapiens
agctccctgaccccctgt

SEQ ID NO: 5195044 - DNA, 14 bp, Homo sapiens
agctccctgcaccg

SEQ ID NO: 5195045 - DNA, 20 bp, Homo sapiens
agctccctgcaccgccgcag

SEQ ID NO: 5195046 - DNA, 13 bp, Homo sapiens
agctccctggagc

SEQ ID NO: 5195047 - DNA, 15 bp, Homo sapiens
agctccctggagccc

SEQ ID NO: 5195048 - DNA, 20 bp, Homo sapiens
agctccctggcttctgtggg

SEQ ID NO: 5195049 - DNA, 21 bp, Homo sapiens
agctccctgtgcccccagggt

SEQ ID NO: 5195050 - DNA, 21 bp, Homo sapiens
agctcccttcccctgcctggt

SEQ ID NO: 5195051 - DNA, 15 bp, Homo sapiens
agctcccttgagctg

SEQ ID NO: 5195052 - DNA, 16 bp, Homo sapiens
agctccctttctcagg

SEQ ID NO: 5195053 - DNA, 16 bp, Homo sapiens
agctccctttttgaat

SEQ ID NO: 5195054 - DNA, 21 bp, Homo sapiens
agctccctttttgaattgtgt

SEQ ID NO: 5195055 - DNA, 17 bp, Homo sapiens
agctccgacctctctca

SEQ ID NO: 5195056 - DNA, 22 bp, Homo sapiens
agctccgacctctctcagcccc

SEQ ID NO: 5195057 - DNA, 17 bp, Homo sapiens
agctccgatgcccgccc

SEQ ID NO: 5195058 - DNA, 15 bp, Homo sapiens
agctccgcaggactt

SEQ ID NO: 5195059 - DNA, 23 bp, Homo sapiens
agctccgcaggacttccccggag

SEQ ID NO: 5195060 - DNA, 16 bp, Homo sapiens
agctccgcctctgtcc

SEQ ID NO: 5195061 - DNA, 22 bp, Homo sapiens
agctccgctaagacctccccac

SEQ ID NO: 5195062 - DNA, 20 bp, Homo sapiens
agctccgctttctacccagc

SEQ ID NO: 5195063 - DNA, 21 bp, Homo sapiens
agctccgctttctacccagcg

SEQ ID NO: 5195064 - DNA, 21 bp, Homo sapiens
agctccggagggggtcctcct

SEQ ID NO: 5195065 - DNA, 18 bp, Homo sapiens
agctccggcctgctgtca

SEQ ID NO: 5195066 - DNA, 18 bp, Homo sapiens
agctccgggatcagcaac

SEQ ID NO: 5195067 - DNA, 17 bp, Homo sapiens
agctccgggggtacagc

SEQ ID NO: 5195068 - DNA, 16 bp, Homo sapiens
agctccgtgtttctct

SEQ ID NO: 5195069 - DNA, 17 bp, Homo sapiens
agctccgtgtttctcta

SEQ ID NO: 5195070 - DNA, 15 bp, Homo sapiens
agctcctaaattata

SEQ ID NO: 5195071 - DNA, 15 bp, Homo sapiens
agctcctagcagaga

SEQ ID NO: 5195072 - DNA, 14 bp, Homo sapiens
agctcctattaaat

SEQ ID NO: 5195073 - DNA, 15 bp, Homo sapiens
agctcctattaaatt

SEQ ID NO: 5195074 - DNA, 15 bp, Homo sapiens
agctcctattagaaa

SEQ ID NO: 5195075 - DNA, 13 bp, Homo sapiens
agctcctcacata

SEQ ID NO: 5195076 - DNA, 21 bp, Homo sapiens
agctcctcacccagggccccc

SEQ ID NO: 5195077 - DNA, 16 bp, Homo sapiens
agctcctcactcacct

SEQ ID NO: 5195078 - DNA, 15 bp, Homo sapiens
agctcctcactgtgg

SEQ ID NO: 5195079 - DNA, 19 bp, Homo sapiens
agctcctcatccagggctc

SEQ ID NO: 5195080 - DNA, 14 bp, Homo sapiens
agctcctccagccc

SEQ ID NO: 5195081 - DNA, 16 bp, Homo sapiens
agctcctccagccctg

SEQ ID NO: 5195082 - DNA, 18 bp, Homo sapiens
agctcctccagccctgcc

SEQ ID NO: 5195083 - DNA, 12 bp, Homo sapiens
agctcctcccct

SEQ ID NO: 5195084 - DNA, 15 bp, Homo sapiens
agctcctcccctgcc

SEQ ID NO: 5195085 - DNA, 19 bp, Homo sapiens
agctcctcccctgccgcct

SEQ ID NO: 5195086 - DNA, 23 bp, Homo sapiens
agctcctcccctgccgcctcccg

SEQ ID NO: 5195087 - DNA, 17 bp, Homo sapiens
agctcctcccctggagg

SEQ ID NO: 5195088 - DNA, 14 bp, Homo sapiens
agctcctccctcca

SEQ ID NO: 5195089 - DNA, 22 bp, Homo sapiens
agctcctccctccagctgcgac

SEQ ID NO: 5195090 - DNA, 23 bp, Homo sapiens
agctcctccctccagctgcgact

SEQ ID NO: 5195091 - DNA, 20 bp, Homo sapiens
agctcctccctgtgccccca

SEQ ID NO: 5195092 - DNA, 22 bp, Homo sapiens
agctcctccctgtgcccccagc

SEQ ID NO: 5195093 - DNA, 23 bp, Homo sapiens
agctcctccctgtgcccccagcc

SEQ ID NO: 5195094 - DNA, 12 bp, Homo sapiens
agctcctccctt

SEQ ID NO: 5195095 - DNA, 22 bp, Homo sapiens
agctcctccgtgcttcctcagt

SEQ ID NO: 5195096 - DNA, 14 bp, Homo sapiens
agctcctcctccct

SEQ ID NO: 5195097 - DNA, 15 bp, Homo sapiens
agctcctcctccctg

SEQ ID NO: 5195098 - DNA, 17 bp, Homo sapiens
agctcctcctccctgca

SEQ ID NO: 5195099 - DNA, 21 bp, Homo sapiens
agctcctcctcttggagctga

SEQ ID NO: 5195100 - DNA, 21 bp, Homo sapiens
agctcctccttgtcttggcag

SEQ ID NO: 5195101 - DNA, 17 bp, Homo sapiens
agctcctcgagggcagg

SEQ ID NO: 5195102 - DNA, 22 bp, Homo sapiens
agctcctcgctgcgtctccatc

SEQ ID NO: 5195103 - DNA, 17 bp, Homo sapiens
agctcctcgtctttgaa

SEQ ID NO: 5195104 - DNA, 13 bp, Homo sapiens
agctcctctaggg

SEQ ID NO: 5195105 - DNA, 20 bp, Homo sapiens
agctcctctaggggcagcct

SEQ ID NO: 5195106 - DNA, 13 bp, Homo sapiens
agctcctctccag

SEQ ID NO: 5195107 - DNA, 17 bp, Homo sapiens
agctcctctccagacac

SEQ ID NO: 5195108 - DNA, 16 bp, Homo sapiens
agctcctctccccagc

SEQ ID NO: 5195109 - DNA, 22 bp, Homo sapiens
agctcctctccccagcccagag

SEQ ID NO: 5195110 - DNA, 13 bp, Homo sapiens
agctcctctcctg

SEQ ID NO: 5195111 - DNA, 15 bp, Homo sapiens
agctcctctcctgga

SEQ ID NO: 5195112 - DNA, 16 bp, Homo sapiens
agctcctctcctggag

SEQ ID NO: 5195113 - DNA, 13 bp, Homo sapiens
agctcctctcctt

SEQ ID NO: 5195114 - DNA, 15 bp, Homo sapiens
agctcctctctgaag

SEQ ID NO: 5195115 - DNA, 16 bp, Homo sapiens
agctcctctctgaagc

SEQ ID NO: 5195116 - DNA, 20 bp, Homo sapiens
agctcctctgggcaggacct

SEQ ID NO: 5195117 - DNA, 18 bp, Homo sapiens
agctcctctgtctcgagc

SEQ ID NO: 5195118 - DNA, 20 bp, Homo sapiens
agctcctcttaccgtagcct

SEQ ID NO: 5195119 - DNA, 13 bp, Homo sapiens
agctcctcttcct

SEQ ID NO: 5195120 - DNA, 15 bp, Homo sapiens
agctcctgaataaag

SEQ ID NO: 5195121 - DNA, 13 bp, Homo sapiens
agctcctgaccaa

SEQ ID NO: 5195122 - DNA, 15 bp, Homo sapiens
agctcctgaccagtt

SEQ ID NO: 5195123 - DNA, 16 bp, Homo sapiens
agctcctgaccagttg

SEQ ID NO: 5195124 - DNA, 12 bp, Homo sapiens
agctcctgacct

SEQ ID NO: 5195125 - DNA, 21 bp, Homo sapiens
agctcctgaccttgggtcctg

SEQ ID NO: 5195126 - DNA, 14 bp, Homo sapiens
agctcctgagtagc

SEQ ID NO: 5195127 - DNA, 19 bp, Homo sapiens
agctcctgagtagctgggc

SEQ ID NO: 5195128 - DNA, 20 bp, Homo sapiens
agctcctgagtagctgggcc

SEQ ID NO: 5195129 - DNA, 22 bp, Homo sapiens
agctcctgagtagctgggcctg

SEQ ID NO: 5195130 - DNA, 23 bp, Homo sapiens
agctcctgagtagctgggcctgt

SEQ ID NO: 5195131 - DNA, 14 bp, Homo sapiens
agctcctgccaggg

SEQ ID NO: 5195132 - DNA, 12 bp, Homo sapiens
agctcctgcccc

SEQ ID NO: 5195133 - DNA, 19 bp, Homo sapiens
agctcctgctgcggaggag

SEQ ID NO: 5195134 - DNA, 22 bp, Homo sapiens
agctcctgctgcggaggagctg

SEQ ID NO: 5195135 - DNA, 21 bp, Homo sapiens
agctcctgctggggggcaggg

SEQ ID NO: 5195136 - DNA, 13 bp, Homo sapiens
agctcctggaagc

SEQ ID NO: 5195137 - DNA, 13 bp, Homo sapiens
agctcctgggacc

SEQ ID NO: 5195138 - DNA, 19 bp, Homo sapiens
agctcctgggacccttggc

SEQ ID NO: 5195139 - DNA, 20 bp, Homo sapiens
agctcctggggagctcctgg

SEQ ID NO: 5195140 - DNA, 16 bp, Homo sapiens
agctcctgtcccctgc

SEQ ID NO: 5195141 - DNA, 15 bp, Homo sapiens
agctcctgtccctac

SEQ ID NO: 5195142 - DNA, 18 bp, Homo sapiens
agctcctgtccctaccca

SEQ ID NO: 5195143 - DNA, 21 bp, Homo sapiens
agctcctgtccctacccactc

SEQ ID NO: 5195144 - DNA, 12 bp, Homo sapiens
agctcctgtcct

SEQ ID NO: 5195145 - DNA, 15 bp, Homo sapiens
agctcctgtcctccc

SEQ ID NO: 5195146 - DNA, 17 bp, Homo sapiens
agctcctgtcctcccat

SEQ ID NO: 5195147 - DNA, 12 bp, Homo sapiens
agctcctgtggc

SEQ ID NO: 5195148 - DNA, 13 bp, Homo sapiens
agctcctgtggcc

SEQ ID NO: 5195149 - DNA, 13 bp, Homo sapiens
agctcctgtttgg

SEQ ID NO: 5195150 - DNA, 17 bp, Homo sapiens
agctccttaaggctctt

SEQ ID NO: 5195151 - DNA, 18 bp, Homo sapiens
agctccttactctgagga

SEQ ID NO: 5195152 - DNA, 12 bp, Homo sapiens
agctccttcagt

SEQ ID NO: 5195153 - DNA, 17 bp, Homo sapiens
agctccttcatgctttt

SEQ ID NO: 5195154 - DNA, 21 bp, Homo sapiens
agctccttcatgcttttctca

SEQ ID NO: 5195155 - DNA, 13 bp, Homo sapiens
agccagcccacat

SEQ ID NO: 5195156 - DNA, 12 bp, Homo sapiens
agccagcccagc

SEQ ID NO: 5195157 - DNA, 17 bp, Homo sapiens
agccagcccagcccagc

SEQ ID NO: 5195158 - DNA, 18 bp, Homo sapiens
agccagcccagcccagct

SEQ ID NO: 5195159 - DNA, 23 bp, Homo sapiens
agccagcccatggcccccaataa

SEQ ID NO: 5195160 - DNA, 20 bp, Homo sapiens
agccagccccctccagctca

SEQ ID NO: 5195161 - DNA, 22 bp, Homo sapiens
agccagccccctccagctcatg

SEQ ID NO: 5195162 - DNA, 16 bp, Homo sapiens
agccagcccctcttcc

SEQ ID NO: 5195163 - DNA, 12 bp, Homo sapiens
agccagcccgtg

SEQ ID NO: 5195164 - DNA, 22 bp, Homo sapiens
agccagccctccctgtcctcct

SEQ ID NO: 5195165 - DNA, 19 bp, Homo sapiens
agccagccctgcctggagg

SEQ ID NO: 5195166 - DNA, 24 bp, Homo sapiens
agccagccctgcctggaggacctg

SEQ ID NO: 5195167 - DNA, 19 bp, Homo sapiens
agccagccctggaggctgg

SEQ ID NO: 5195168 - DNA, 22 bp, Homo sapiens
agccagccctggaggctggatg

SEQ ID NO: 5195169 - DNA, 18 bp, Homo sapiens
agccagccctggcttcca

SEQ ID NO: 5195170 - DNA, 19 bp, Homo sapiens
agccagccctggcttccaa

SEQ ID NO: 5195171 - DNA, 19 bp, Homo sapiens
agccagcccttccctggcc

SEQ ID NO: 5195172 - DNA, 21 bp, Homo sapiens
agccagcccttccctggcccc

SEQ ID NO: 5195173 - DNA, 14 bp, Homo sapiens
agccagccgccctg

SEQ ID NO: 5195174 - DNA, 21 bp, Homo sapiens
agccagccgccctgggctgtc

SEQ ID NO: 5195175 - DNA, 18 bp, Homo sapiens
agccagccggtgcctggc

SEQ ID NO: 5195176 - DNA, 18 bp, Homo sapiens
agccagcctgaccttcct

SEQ ID NO: 5195177 - DNA, 18 bp, Homo sapiens
agccagcctgcttcccac

SEQ ID NO: 5195178 - DNA, 20 bp, Homo sapiens
agccagcctgcttcccacaa

SEQ ID NO: 5195179 - DNA, 17 bp, Homo sapiens
agccagcctggctggga

SEQ ID NO: 5195180 - DNA, 13 bp, Homo sapiens
agccagccttccc

SEQ ID NO: 5195181 - DNA, 23 bp, Homo sapiens
agccagccttcttccatcccagg

SEQ ID NO: 5195182 - DNA, 14 bp, Homo sapiens
agccagcgcctccc

SEQ ID NO: 5195183 - DNA, 18 bp, Homo sapiens
agccagcgcctccctcca

SEQ ID NO: 5195184 - DNA, 21 bp, Homo sapiens
agccagcgcctccctccaccc

SEQ ID NO: 5195185 - DNA, 15 bp, Homo sapiens
agccagcgcctgccc

SEQ ID NO: 5195186 - DNA, 16 bp, Homo sapiens
agccagcgcctgcccg

SEQ ID NO: 5195187 - DNA, 17 bp, Homo sapiens
agccagcgcctgcccga

SEQ ID NO: 5195188 - DNA, 19 bp, Homo sapiens
agccagcgcctgcccgaga

SEQ ID NO: 5195189 - DNA, 18 bp, Homo sapiens
agccagctacaggcttga

SEQ ID NO: 5195190 - DNA, 21 bp, Homo sapiens
agccagctcacagtgctgtgt

SEQ ID NO: 5195191 - DNA, 20 bp, Homo sapiens
agccagctcatttggttcag

SEQ ID NO: 5195192 - DNA, 13 bp, Homo sapiens
agccagctcccag

SEQ ID NO: 5195193 - DNA, 14 bp, Homo sapiens
agccagctccctct

SEQ ID NO: 5195194 - DNA, 21 bp, Homo sapiens
agccagctccctgaatctgac

SEQ ID NO: 5195195 - DNA, 14 bp, Homo sapiens
agccagctcctgca

SEQ ID NO: 5195196 - DNA, 15 bp, Homo sapiens
agccagctcctgcac

SEQ ID NO: 5195197 - DNA, 19 bp, Homo sapiens
agccagctcctgggcagct

SEQ ID NO: 5195198 - DNA, 22 bp, Homo sapiens
agccagctcctttcccttttcc

SEQ ID NO: 5195199 - DNA, 18 bp, Homo sapiens
agccagctctaggcttca

SEQ ID NO: 5195200 - DNA, 14 bp, Homo sapiens
agccagctctcagc

SEQ ID NO: 5195201 - DNA, 15 bp, Homo sapiens
agccagctctcagcc

SEQ ID NO: 5195202 - DNA, 15 bp, Homo sapiens
agccagctctctcta

SEQ ID NO: 5195203 - DNA, 13 bp, Homo sapiens
agccagctctgag

SEQ ID NO: 5195204 - DNA, 14 bp, Homo sapiens
agccagctgcagaa

SEQ ID NO: 5195205 - DNA, 19 bp, Homo sapiens
agccagctgcagctgggct

SEQ ID NO: 5195206 - DNA, 18 bp, Homo sapiens
agccagctgcaggaatca

SEQ ID NO: 5195207 - DNA, 13 bp, Homo sapiens
agccagctgcccc

SEQ ID NO: 5195208 - DNA, 20 bp, Homo sapiens
agccagctgcccccagagcc

SEQ ID NO: 5195209 - DNA, 13 bp, Homo sapiens
agccagctgccta

SEQ ID NO: 5195210 - DNA, 22 bp, Homo sapiens
agccagctgcctaggtccccca

SEQ ID NO: 5195211 - DNA, 16 bp, Homo sapiens
agccagctgctcccca

SEQ ID NO: 5195212 - DNA, 14 bp, Homo sapiens
agccagctgcttga

SEQ ID NO: 5195213 - DNA, 15 bp, Homo sapiens
agccagctggacttc

SEQ ID NO: 5195214 - DNA, 13 bp, Homo sapiens
agccagcttagca

SEQ ID NO: 5195215 - DNA, 17 bp, Homo sapiens
agccagcttcctgtgca

SEQ ID NO: 5195216 - DNA, 20 bp, Homo sapiens
agccagcttcctgtgcagaa

SEQ ID NO: 5195217 - DNA, 12 bp, Homo sapiens
agccagcttggg

SEQ ID NO: 5195218 - DNA, 12 bp, Homo sapiens
agccagcttgtt

SEQ ID NO: 5195219 - DNA, 20 bp, Homo sapiens
agccagcttgtttacatgct

SEQ ID NO: 5195220 - DNA, 14 bp, Homo sapiens
agccagctttccct

SEQ ID NO: 5195221 - DNA, 18 bp, Homo sapiens
agccagctttccctgcct

SEQ ID NO: 5195222 - DNA, 23 bp, Homo sapiens
agccaggaaaccctcttcttccc

SEQ ID NO: 5195223 - DNA, 18 bp, Homo sapiens
agccaggaacagggacca

SEQ ID NO: 5195224 - DNA, 22 bp, Homo sapiens
agccaggaacagggaccagctc

SEQ ID NO: 5195225 - DNA, 16 bp, Homo sapiens
agccaggaactggctc

SEQ ID NO: 5195226 - DNA, 19 bp, Homo sapiens
agccaggaactggctcctt

SEQ ID NO: 5195227 - DNA, 22 bp, Homo sapiens
agccaggaagatcccccagaaa

SEQ ID NO: 5195228 - DNA, 20 bp, Homo sapiens
agccaggaagtacttccacc

SEQ ID NO: 5195229 - DNA, 19 bp, Homo sapiens
agccaggaatttcccagga

SEQ ID NO: 5195230 - DNA, 21 bp, Homo sapiens
agccaggaatttcccaggacc

SEQ ID NO: 5195231 - DNA, 22 bp, Homo sapiens
agccaggaatttcccaggaccc

SEQ ID NO: 5195232 - DNA, 22 bp, Homo sapiens
agccaggacccgcctgctccca

SEQ ID NO: 5195233 - DNA, 13 bp, Homo sapiens
agccaggactccc

SEQ ID NO: 5195234 - DNA, 16 bp, Homo sapiens
agccaggactcccaga

SEQ ID NO: 5195235 - DNA, 21 bp, Homo sapiens
agccaggactcccagaacctc

SEQ ID NO: 5195236 - DNA, 23 bp, Homo sapiens
agccaggactcccagaacctcta

SEQ ID NO: 5195237 - DNA, 13 bp, Homo sapiens
agccaggactcct

SEQ ID NO: 5195238 - DNA, 23 bp, Homo sapiens
agccaggagaagacccctgccca

SEQ ID NO: 5195239 - DNA, 13 bp, Homo sapiens
agccaggagaagc

SEQ ID NO: 5195240 - DNA, 14 bp, Homo sapiens
agccaggagaagct

SEQ ID NO: 5195241 - DNA, 11 bp, Homo sapiens
agccaggagac

SEQ ID NO: 5195242 - DNA, 20 bp, Homo sapiens
agccaggagacctgctctcc

SEQ ID NO: 5195243 - DNA, 22 bp, Homo sapiens
agccaggagcaaatgtttctgc

SEQ ID NO: 5195244 - DNA, 19 bp, Homo sapiens
agccaggagcctcctgacc

SEQ ID NO: 5195245 - DNA, 20 bp, Homo sapiens
agccaggagcctcctgaccc

SEQ ID NO: 5195246 - DNA, 18 bp, Homo sapiens
agccaggagcgcatctca

SEQ ID NO: 5195247 - DNA, 14 bp, Homo sapiens
agccaggagctggg

SEQ ID NO: 5195248 - DNA, 18 bp, Homo sapiens
agccaggagctgggcaga

SEQ ID NO: 5195249 - DNA, 17 bp, Homo sapiens
agccaggagctgtcacc

SEQ ID NO: 5195250 - DNA, 16 bp, Homo sapiens
agccaggaggagagga

SEQ ID NO: 5195251 - DNA, 21 bp, Homo sapiens
agccaggaggagaggaaagga

SEQ ID NO: 5195252 - DNA, 12 bp, Homo sapiens
agccaggaggga

SEQ ID NO: 5195253 - DNA, 23 bp, Homo sapiens
agccaggagtaagacaagtggga

SEQ ID NO: 5195254 - DNA, 14 bp, Homo sapiens
agccaggagtctgt

SEQ ID NO: 5195255 - DNA, 20 bp, Homo sapiens
agccaggagtgcccccggga

SEQ ID NO: 5195256 - DNA, 16 bp, Homo sapiens
agccaggatgcccaga

SEQ ID NO: 5195257 - DNA, 18 bp, Homo sapiens
agccaggatgcccagatg

SEQ ID NO: 5195258 - DNA, 19 bp, Homo sapiens
agccaggatgcccagatga

SEQ ID NO: 5195259 - DNA, 16 bp, Homo sapiens
agccaggatggtctcg

SEQ ID NO: 5195260 - DNA, 17 bp, Homo sapiens
agccaggatggtctgga

SEQ ID NO: 5195261 - DNA, 22 bp, Homo sapiens
agccaggcaacttcagtcctgg

SEQ ID NO: 5195262 - DNA, 12 bp, Homo sapiens
agccaggcacac

SEQ ID NO: 5195263 - DNA, 17 bp, Homo sapiens
agccaggcacacactgt

SEQ ID NO: 5195264 - DNA, 13 bp, Homo sapiens
agccaggcagagg

SEQ ID NO: 5195265 - DNA, 18 bp, Homo sapiens
agccaggccaacagcacc

SEQ ID NO: 5195266 - DNA, 15 bp, Homo sapiens
agccaggccaactgc

SEQ ID NO: 5195267 - DNA, 15 bp, Homo sapiens
agccaggccactggc

SEQ ID NO: 5195268 - DNA, 15 bp, Homo sapiens
agccaggccaggaga

SEQ ID NO: 5195269 - DNA, 13 bp, Homo sapiens
agccaggcccagc

SEQ ID NO: 5195270 - DNA, 20 bp, Homo sapiens
agccaggccccaccccttcc

SEQ ID NO: 5195271 - DNA, 11 bp, Homo sapiens
agccaggcctc

SEQ ID NO: 5195272 - DNA, 19 bp, Homo sapiens
agccaggcctcgcctgccc

SEQ ID NO: 5195273 - DNA, 21 bp, Homo sapiens
agccaggcctcgcctgccctc

SEQ ID NO: 5195274 - DNA, 22 bp, Homo sapiens
agccaggcctcgcctgccctcc

SEQ ID NO: 5195275 - DNA, 12 bp, Homo sapiens
agccaggcctgg

SEQ ID NO: 5195276 - DNA, 15 bp, Homo sapiens
agccaggcctggctg

SEQ ID NO: 5195277 - DNA, 17 bp, Homo sapiens
agccaggcctggctgga

SEQ ID NO: 5195278 - DNA, 22 bp, Homo sapiens
agccaggcctgggtctgtgtct

SEQ ID NO: 5195279 - DNA, 19 bp, Homo sapiens
agccaggcgctagcacagc

SEQ ID NO: 5195280 - DNA, 23 bp, Homo sapiens
agccaggcgctagcacagctccc

SEQ ID NO: 5195281 - DNA, 13 bp, Homo sapiens
agccaggcgggct

SEQ ID NO: 5195282 - DNA, 19 bp, Homo sapiens
agccaggcgggctcaagga

SEQ ID NO: 5195283 - DNA, 20 bp, Homo sapiens
agccaggctagctggagcct

SEQ ID NO: 5195284 - DNA, 15 bp, Homo sapiens
agccaggctctgcct

SEQ ID NO: 5195285 - DNA, 17 bp, Homo sapiens
agccaggctctgtgctg

SEQ ID NO: 5195286 - DNA, 22 bp, Homo sapiens
agccaggctgagtgagccacag

SEQ ID NO: 5195287 - DNA, 15 bp, Homo sapiens
agccaggctgggccg

SEQ ID NO: 5195288 - DNA, 16 bp, Homo sapiens
agccaggcttttctca

SEQ ID NO: 5195289 - DNA, 21 bp, Homo sapiens
agccagggaaagactggcaag

SEQ ID NO: 5195290 - DNA, 13 bp, Homo sapiens
agccagggaacag

SEQ ID NO: 5195291 - DNA, 19 bp, Homo sapiens
agccagggaacagccccag

SEQ ID NO: 5195292 - DNA, 20 bp, Homo sapiens
agccagggaacagccccagg

SEQ ID NO: 5195293 - DNA, 16 bp, Homo sapiens
agccagggacccccag

SEQ ID NO: 5195294 - DNA, 17 bp, Homo sapiens
agccagggacccccaga

SEQ ID NO: 5195295 - DNA, 18 bp, Homo sapiens
agccagggacccccagaa

SEQ ID NO: 5195296 - DNA, 20 bp, Homo sapiens
agccagggactaagcagccc

SEQ ID NO: 5195297 - DNA, 14 bp, Homo sapiens
agccagggagcccg

SEQ ID NO: 5195298 - DNA, 21 bp, Homo sapiens
agccagggatggggccacagc

SEQ ID NO: 5195299 - DNA, 16 bp, Homo sapiens
agccagggcaagagag

SEQ ID NO: 5195300 - DNA, 17 bp, Homo sapiens
agccagggcagaggaat

SEQ ID NO: 5195301 - DNA, 13 bp, Homo sapiens
agccagggcaggg

SEQ ID NO: 5195302 - DNA, 18 bp, Homo sapiens
agccagggcagggcgagc

SEQ ID NO: 5195303 - DNA, 22 bp, Homo sapiens
agccagggcagggcgagctgca

SEQ ID NO: 5195304 - DNA, 17 bp, Homo sapiens
agccagggccaggggtc

SEQ ID NO: 5195305 - DNA, 14 bp, Homo sapiens
agccagggcccaga

SEQ ID NO: 5195306 - DNA, 20 bp, Homo sapiens
agccagggcccagagccctt

SEQ ID NO: 5195307 - DNA, 19 bp, Homo sapiens
agccagggcccctggatct

SEQ ID NO: 5195308 - DNA, 19 bp, Homo sapiens
agccagggcccgggaagca

SEQ ID NO: 5195309 - DNA, 23 bp, Homo sapiens
agccagggctatgggagcagctt

SEQ ID NO: 5195310 - DNA, 14 bp, Homo sapiens
agccagggctggag

SEQ ID NO: 5195311 - DNA, 17 bp, Homo sapiens
agccagggctggggttg

SEQ ID NO: 5195312 - DNA, 17 bp, Homo sapiens
agccaggggagcagagg

SEQ ID NO: 5195313 - DNA, 14 bp, Homo sapiens
agccaggggctgct

SEQ ID NO: 5195314 - DNA, 21 bp, Homo sapiens
agccagggggactagcccctg

SEQ ID NO: 5195315 - DNA, 21 bp, Homo sapiens
agccagggggagctgggcctg

SEQ ID NO: 5195316 - DNA, 17 bp, Homo sapiens
agccaggggtggggatg

SEQ ID NO: 5195317 - DNA, 19 bp, Homo sapiens
agccaggggtgtcccagtc

SEQ ID NO: 5195318 - DNA, 20 bp, Homo sapiens
agccaggggtgtcccagtcc

SEQ ID NO: 5195319 - DNA, 14 bp, Homo sapiens
agccagggtctcca

SEQ ID NO: 5195320 - DNA, 20 bp, Homo sapiens
agccagggtctctccctcag

SEQ ID NO: 5195321 - DNA, 17 bp, Homo sapiens
agccagggttccagaca

SEQ ID NO: 5195322 - DNA, 15 bp, Homo sapiens
agccaggtacaggag

SEQ ID NO: 5195323 - DNA, 21 bp, Homo sapiens
agccaggtacaggagaggcag

SEQ ID NO: 5195324 - DNA, 22 bp, Homo sapiens
agccaggtacaggagaggcagc

SEQ ID NO: 5195325 - DNA, 20 bp, Homo sapiens
agccaggtaccttctcacct

SEQ ID NO: 5195326 - DNA, 16 bp, Homo sapiens
agccaggtctgactcc

SEQ ID NO: 5195327 - DNA, 19 bp, Homo sapiens
agccaggtctgactccaaa

SEQ ID NO: 5195328 - DNA, 23 bp, Homo sapiens
agccaggtctgactccaaagctg

SEQ ID NO: 5195329 - DNA, 13 bp, Homo sapiens
agccaggtgcctt

SEQ ID NO: 5195330 - DNA, 16 bp, Homo sapiens
agccaggtgccttgga

SEQ ID NO: 5195331 - DNA, 21 bp, Homo sapiens
agccaggtggcacctgcagcg

SEQ ID NO: 5195332 - DNA, 14 bp, Homo sapiens
agccaggtgtcctg

SEQ ID NO: 5195333 - DNA, 22 bp, Homo sapiens
agctccttcatgcttttctcat

SEQ ID NO: 5195334 - DNA, 19 bp, Homo sapiens
agctccttcctagccttgc

SEQ ID NO: 5195335 - DNA, 13 bp, Homo sapiens
agctccttcctgt

SEQ ID NO: 5195336 - DNA, 13 bp, Homo sapiens
agctccttctgtc

SEQ ID NO: 5195337 - DNA, 16 bp, Homo sapiens
agctccttctgtccta

SEQ ID NO: 5195338 - DNA, 23 bp, Homo sapiens
agctccttctgtcctactctgtg

SEQ ID NO: 5195339 - DNA, 21 bp, Homo sapiens
agctccttgagggcaagagcc

SEQ ID NO: 5195340 - DNA, 19 bp, Homo sapiens
agctccttgagtaaaaagg

SEQ ID NO: 5195341 - DNA, 12 bp, Homo sapiens
agctccttggag

SEQ ID NO: 5195342 - DNA, 18 bp, Homo sapiens
agctccttgggaggaagc

SEQ ID NO: 5195343 - DNA, 20 bp, Homo sapiens
agctccttgggaggccccac

SEQ ID NO: 5195344 - DNA, 21 bp, Homo sapiens
agctccttggttccctcttcc

SEQ ID NO: 5195345 - DNA, 15 bp, Homo sapiens
agctccttggttttg

SEQ ID NO: 5195346 - DNA, 22 bp, Homo sapiens
agctcctttgggcttcagctgc

SEQ ID NO: 5195347 - DNA, 18 bp, Homo sapiens
agctccttttccagagca

SEQ ID NO: 5195348 - DNA, 19 bp, Homo sapiens
agctccttttccagagcat

SEQ ID NO: 5195349 - DNA, 15 bp, Homo sapiens
agctccttttctgtg

SEQ ID NO: 5195350 - DNA, 13 bp, Homo sapiens
agctccttttgtc

SEQ ID NO: 5195351 - DNA, 18 bp, Homo sapiens
agctccttttgtccccag

SEQ ID NO: 5195352 - DNA, 20 bp, Homo sapiens
agctcgagcaaaattcaaaa

SEQ ID NO: 5195353 - DNA, 20 bp, Homo sapiens
agctcgagcatgccctgagc

SEQ ID NO: 5195354 - DNA, 21 bp, Homo sapiens
agctcgcacccccctgttcta

SEQ ID NO: 5195355 - DNA, 13 bp, Homo sapiens
agctcgcagcccc

SEQ ID NO: 5195356 - DNA, 13 bp, Homo sapiens
agctcgccccacc

SEQ ID NO: 5195357 - DNA, 17 bp, Homo sapiens
agctcgccccacctcca

SEQ ID NO: 5195358 - DNA, 16 bp, Homo sapiens
agctcgcccctcccct

SEQ ID NO: 5195359 - DNA, 21 bp, Homo sapiens
agctcgcccctcccctcagcc

SEQ ID NO: 5195360 - DNA, 23 bp, Homo sapiens
agctcgcccctcccctcagcctg

SEQ ID NO: 5195361 - DNA, 14 bp, Homo sapiens
agctcgcggggcag

SEQ ID NO: 5195362 - DNA, 13 bp, Homo sapiens
agctcgctaaagt

SEQ ID NO: 5195363 - DNA, 18 bp, Homo sapiens
agctcgctggctttctct

SEQ ID NO: 5195364 - DNA, 15 bp, Homo sapiens
agctcggatcacatg

SEQ ID NO: 5195365 - DNA, 16 bp, Homo sapiens
agctcggatcacatga

SEQ ID NO: 5195366 - DNA, 17 bp, Homo sapiens
agctcggggggctctgc

SEQ ID NO: 5195367 - DNA, 15 bp, Homo sapiens
agctcggggtccacc

SEQ ID NO: 5195368 - DNA, 12 bp, Homo sapiens
agctcggtggac

SEQ ID NO: 5195369 - DNA, 15 bp, Homo sapiens
agctcggtggaccca

SEQ ID NO: 5195370 - DNA, 20 bp, Homo sapiens
agctcggtggacccagggat

SEQ ID NO: 5195371 - DNA, 14 bp, Homo sapiens
agctcgtagaaaca

SEQ ID NO: 5195372 - DNA, 17 bp, Homo sapiens
agctcgtcctcactggt

SEQ ID NO: 5195373 - DNA, 17 bp, Homo sapiens
agctcgtgtgcttagaa

SEQ ID NO: 5195374 - DNA, 18 bp, Homo sapiens
agctcgtgtgcttagaaa

SEQ ID NO: 5195375 - DNA, 13 bp, Homo sapiens
agctcgtgtgtcc

SEQ ID NO: 5195376 - DNA, 23 bp, Homo sapiens
agctcgtgtgtcctcatggagaa

SEQ ID NO: 5195377 - DNA, 19 bp, Homo sapiens
agctcgtttttcagcaccc

SEQ ID NO: 5195378 - DNA, 16 bp, Homo sapiens
agctctaagagcaatt

SEQ ID NO: 5195379 - DNA, 17 bp, Homo sapiens
agctctaaggtaacaaa

SEQ ID NO: 5195380 - DNA, 15 bp, Homo sapiens
agctctaataagttt

SEQ ID NO: 5195381 - DNA, 16 bp, Homo sapiens
agctctaataagtttg

SEQ ID NO: 5195382 - DNA, 21 bp, Homo sapiens
agctctaatagagtcacagct

SEQ ID NO: 5195383 - DNA, 17 bp, Homo sapiens
agctctaatgtttgcat

SEQ ID NO: 5195384 - DNA, 22 bp, Homo sapiens
agctctaatgtttgcatataag

SEQ ID NO: 5195385 - DNA, 15 bp, Homo sapiens
agctctacattctgc

SEQ ID NO: 5195386 - DNA, 18 bp, Homo sapiens
agctctacattctgctct

SEQ ID NO: 5195387 - DNA, 19 bp, Homo sapiens
agctctacattctgctctg

SEQ ID NO: 5195388 - DNA, 15 bp, Homo sapiens
agctctacccagggc

SEQ ID NO: 5195389 - DNA, 17 bp, Homo sapiens
agctctacccagggcct

SEQ ID NO: 5195390 - DNA, 20 bp, Homo sapiens
agctctacccagggcctgca

SEQ ID NO: 5195391 - DNA, 21 bp, Homo sapiens
agctctacccagggcctgcag

SEQ ID NO: 5195392 - DNA, 14 bp, Homo sapiens
agctctaccctgca

SEQ ID NO: 5195393 - DNA, 15 bp, Homo sapiens
agctctaccctgctc

SEQ ID NO: 5195394 - DNA, 19 bp, Homo sapiens
agctctaccctgctccctg

SEQ ID NO: 5195395 - DNA, 15 bp, Homo sapiens
agctctagaatctgc

SEQ ID NO: 5195396 - DNA, 20 bp, Homo sapiens
agctctagataaaactttct

SEQ ID NO: 5195397 - DNA, 19 bp, Homo sapiens
agctctagcctctggactg

SEQ ID NO: 5195398 - DNA, 19 bp, Homo sapiens
agctctagtcctttataag

SEQ ID NO: 5195399 - DNA, 14 bp, Homo sapiens
agctctagttcaaa

SEQ ID NO: 5195400 - DNA, 19 bp, Homo sapiens
agctctagttttcagcctt

SEQ ID NO: 5195401 - DNA, 21 bp, Homo sapiens
agctctatgtcaattgatatt

SEQ ID NO: 5195402 - DNA, 22 bp, Homo sapiens
agctctatgtcaattgatattt

SEQ ID NO: 5195403 - DNA, 18 bp, Homo sapiens
agctctattgatactctt

SEQ ID NO: 5195404 - DNA, 18 bp, Homo sapiens
agctctcaaatgtgtgtt

SEQ ID NO: 5195405 - DNA, 21 bp, Homo sapiens
agctctcaagtcaaggaagct

SEQ ID NO: 5195406 - DNA, 20 bp, Homo sapiens
agctctcacccataataaag

SEQ ID NO: 5195407 - DNA, 13 bp, Homo sapiens
agctctcagcaag

SEQ ID NO: 5195408 - DNA, 17 bp, Homo sapiens
agctctcagcaagtgcc

SEQ ID NO: 5195409 - DNA, 19 bp, Homo sapiens
agctctcagcaagtgccca

SEQ ID NO: 5195410 - DNA, 22 bp, Homo sapiens
agctctcagcaagtgcccagtg

SEQ ID NO: 5195411 - DNA, 20 bp, Homo sapiens
agctctcaggccgagagcct

SEQ ID NO: 5195412 - DNA, 13 bp, Homo sapiens
agctctcagggct

SEQ ID NO: 5195413 - DNA, 13 bp, Homo sapiens
agctctcatagct

SEQ ID NO: 5195414 - DNA, 15 bp, Homo sapiens
agctctccaggccag

SEQ ID NO: 5195415 - DNA, 18 bp, Homo sapiens
agctctccccaggcattt

SEQ ID NO: 5195416 - DNA, 15 bp, Homo sapiens
agctctcccctcctg

SEQ ID NO: 5195417 - DNA, 19 bp, Homo sapiens
agctctcccctcctgctgg

SEQ ID NO: 5195418 - DNA, 21 bp, Homo sapiens
agctctcccctcctgctgggc

SEQ ID NO: 5195419 - DNA, 22 bp, Homo sapiens
agctctcccctcctgctgggcg

SEQ ID NO: 5195420 - DNA, 12 bp, Homo sapiens
agctctcccctg

SEQ ID NO: 5195421 - DNA, 13 bp, Homo sapiens
agctctcccctgc

SEQ ID NO: 5195422 - DNA, 19 bp, Homo sapiens
agctctcccctgcgcaggc

SEQ ID NO: 5195423 - DNA, 20 bp, Homo sapiens
agctctcccctgcgcaggcc

SEQ ID NO: 5195424 - DNA, 23 bp, Homo sapiens
agctctcccctgcgcaggccctc

SEQ ID NO: 5195425 - DNA, 13 bp, Homo sapiens
agctctccctcac

SEQ ID NO: 5195426 - DNA, 17 bp, Homo sapiens
agctctccctctggccc

SEQ ID NO: 5195427 - DNA, 22 bp, Homo sapiens
agctctccctctggccctgcct

SEQ ID NO: 5195428 - DNA, 23 bp, Homo sapiens
agctctccctctggccctgcctt

SEQ ID NO: 5195429 - DNA, 16 bp, Homo sapiens
agctctcccttgttta

SEQ ID NO: 5195430 - DNA, 18 bp, Homo sapiens
agctctcccttgtttact

SEQ ID NO: 5195431 - DNA, 16 bp, Homo sapiens
agctctccgagctctg

SEQ ID NO: 5195432 - DNA, 18 bp, Homo sapiens
agctctccgagctctggt

SEQ ID NO: 5195433 - DNA, 21 bp, Homo sapiens
agctctccgagctctggtgct

SEQ ID NO: 5195434 - DNA, 19 bp, Homo sapiens
agctctcctccagccctgg

SEQ ID NO: 5195435 - DNA, 21 bp, Homo sapiens
agctctcctccagccctgggc

SEQ ID NO: 5195436 - DNA, 23 bp, Homo sapiens
agctctcctccagccctgggcac

SEQ ID NO: 5195437 - DNA, 14 bp, Homo sapiens
agctctcctgactt

SEQ ID NO: 5195438 - DNA, 15 bp, Homo sapiens
agctctcctgctgca

SEQ ID NO: 5195439 - DNA, 15 bp, Homo sapiens
agctctcctgggcca

SEQ ID NO: 5195440 - DNA, 17 bp, Homo sapiens
agctctcggaactgcat

SEQ ID NO: 5195441 - DNA, 20 bp, Homo sapiens
agctctcggaactgcatgct

SEQ ID NO: 5195442 - DNA, 23 bp, Homo sapiens
agctctcggaactgcatgctgct

SEQ ID NO: 5195443 - DNA, 21 bp, Homo sapiens
agctctcgggactagctgcct

SEQ ID NO: 5195444 - DNA, 17 bp, Homo sapiens
agctctcgttctccttc

SEQ ID NO: 5195445 - DNA, 19 bp, Homo sapiens
agctctcgttctccttccc

SEQ ID NO: 5195446 - DNA, 19 bp, Homo sapiens
agctctctaggcctctcca

SEQ ID NO: 5195447 - DNA, 15 bp, Homo sapiens
agctctctctcctgg

SEQ ID NO: 5195448 - DNA, 11 bp, Homo sapiens
agctctctgac

SEQ ID NO: 5195449 - DNA, 21 bp, Homo sapiens
agctctctgacgcttgtgaca

SEQ ID NO: 5195450 - DNA, 18 bp, Homo sapiens
agctctctgactgctttg

SEQ ID NO: 5195451 - DNA, 21 bp, Homo sapiens
agctctctgctgagcagccca

SEQ ID NO: 5195452 - DNA, 18 bp, Homo sapiens
agctctctgggacctcct

SEQ ID NO: 5195453 - DNA, 17 bp, Homo sapiens
agctctctgtataaaca

SEQ ID NO: 5195454 - DNA, 14 bp, Homo sapiens
agctctgaaaacaa

SEQ ID NO: 5195455 - DNA, 18 bp, Homo sapiens
agctctgaacaaacactg

SEQ ID NO: 5195456 - DNA, 22 bp, Homo sapiens
agctctgaagaactctctggaa

SEQ ID NO: 5195457 - DNA, 19 bp, Homo sapiens
agctctgaagggaggggaa

SEQ ID NO: 5195458 - DNA, 21 bp, Homo sapiens
agctctgaagggaggggaaga

SEQ ID NO: 5195459 - DNA, 23 bp, Homo sapiens
agctctgaagtcacatcacagga

SEQ ID NO: 5195460 - DNA, 16 bp, Homo sapiens
agctctgacctgcccc

SEQ ID NO: 5195461 - DNA, 16 bp, Homo sapiens
agctctgagacagcag

SEQ ID NO: 5195462 - DNA, 21 bp, Homo sapiens
agctctgagacccttttctca

SEQ ID NO: 5195463 - DNA, 17 bp, Homo sapiens
agctctgagaggccctg

SEQ ID NO: 5195464 - DNA, 18 bp, Homo sapiens
agctctgagaggccctgg

SEQ ID NO: 5195465 - DNA, 11 bp, Homo sapiens
agctctgagcc

SEQ ID NO: 5195466 - DNA, 14 bp, Homo sapiens
agctctgagccaga

SEQ ID NO: 5195467 - DNA, 16 bp, Homo sapiens
agctctgagccagatt

SEQ ID NO: 5195468 - DNA, 19 bp, Homo sapiens
agctctgagccagattaca

SEQ ID NO: 5195469 - DNA, 17 bp, Homo sapiens
agctctgagccctcctt

SEQ ID NO: 5195470 - DNA, 13 bp, Homo sapiens
agctctgagctgt

SEQ ID NO: 5195471 - DNA, 20 bp, Homo sapiens
agctctgaggactgcaccat

SEQ ID NO: 5195472 - DNA, 15 bp, Homo sapiens
agctctgagggaaag

SEQ ID NO: 5195473 - DNA, 17 bp, Homo sapiens
agctctgaggggagggg

SEQ ID NO: 5195474 - DNA, 18 bp, Homo sapiens
agctctgaggggaggggg

SEQ ID NO: 5195475 - DNA, 17 bp, Homo sapiens
agctctgatctgaggct

SEQ ID NO: 5195476 - DNA, 15 bp, Homo sapiens
agctctgcagcaata

SEQ ID NO: 5195477 - DNA, 21 bp, Homo sapiens
agctctgcagcaatattctga

SEQ ID NO: 5195478 - DNA, 14 bp, Homo sapiens
agctctgcagccca

SEQ ID NO: 5195479 - DNA, 23 bp, Homo sapiens
agctctgcaggcttaataaaaat

SEQ ID NO: 5195480 - DNA, 14 bp, Homo sapiens
agctctgcataaga

SEQ ID NO: 5195481 - DNA, 16 bp, Homo sapiens
agctctgcatgtgtgt

SEQ ID NO: 5195482 - DNA, 15 bp, Homo sapiens
agctctgcccccgcg

SEQ ID NO: 5195483 - DNA, 12 bp, Homo sapiens
agctctgcccct

SEQ ID NO: 5195484 - DNA, 13 bp, Homo sapiens
agctctgcccctt

SEQ ID NO: 5195485 - DNA, 15 bp, Homo sapiens
agctctgccctggct

SEQ ID NO: 5195486 - DNA, 17 bp, Homo sapiens
agctctgccctggctgt

SEQ ID NO: 5195487 - DNA, 21 bp, Homo sapiens
agctctgccctggctgtgggt

SEQ ID NO: 5195488 - DNA, 14 bp, Homo sapiens
agctctgccgtctc

SEQ ID NO: 5195489 - DNA, 11 bp, Homo sapiens
agctctgcctc

SEQ ID NO: 5195490 - DNA, 15 bp, Homo sapiens
agctctgcctcaact

SEQ ID NO: 5195491 - DNA, 17 bp, Homo sapiens
agctctgcgccaggcag

SEQ ID NO: 5195492 - DNA, 23 bp, Homo sapiens
agctctgcgtcggtcctggtgcc

SEQ ID NO: 5195493 - DNA, 22 bp, Homo sapiens
agctctgctcctctccccagca

SEQ ID NO: 5195494 - DNA, 11 bp, Homo sapiens
agctctgctgc

SEQ ID NO: 5195495 - DNA, 14 bp, Homo sapiens
agctctgctgctga

SEQ ID NO: 5195496 - DNA, 15 bp, Homo sapiens
agctctgctgctgat

SEQ ID NO: 5195497 - DNA, 14 bp, Homo sapiens
agctctgctggaag

SEQ ID NO: 5195498 - DNA, 23 bp, Homo sapiens
agctctgctggaagaactgcatg

SEQ ID NO: 5195499 - DNA, 15 bp, Homo sapiens
agctctgcttgccga

SEQ ID NO: 5195500 - DNA, 14 bp, Homo sapiens
agctctggaattgt

SEQ ID NO: 5195501 - DNA, 21 bp, Homo sapiens
agctctggacagccccaccct

SEQ ID NO: 5195502 - DNA, 23 bp, Homo sapiens
agctctggacgtgaaatacttcg

SEQ ID NO: 5195503 - DNA, 11 bp, Homo sapiens
agctctggaga

SEQ ID NO: 5195504 - DNA, 18 bp, Homo sapiens
agctctggagccacctgt

SEQ ID NO: 5195505 - DNA, 12 bp, Homo sapiens
agctctggaggg

SEQ ID NO: 5195506 - DNA, 16 bp, Homo sapiens
agctctggaggggagg

SEQ ID NO: 5195507 - DNA, 18 bp, Homo sapiens
agctctggaggggagggg

SEQ ID NO: 5195508 - DNA, 19 bp, Homo sapiens
agctctggaggtgctgctc

SEQ ID NO: 5195509 - DNA, 21 bp, Homo sapiens
agctctggaggtgctgctcta

SEQ ID NO: 5195510 - DNA, 13 bp, Homo sapiens
agctctggccaca

SEQ ID NO: 5195511 - DNA, 22 bp, Homo sapiens
agctctggccacaacagggcat

SEQ ID NO: 5195512 - DNA, 21 bp, Homo sapiens
agccaggttctcattaggttt

SEQ ID NO: 5195513 - DNA, 22 bp, Homo sapiens
agccaggttctcattaggtttt

SEQ ID NO: 5195514 - DNA, 16 bp, Homo sapiens
agccagtaaacagagg

SEQ ID NO: 5195515 - DNA, 18 bp, Homo sapiens
agccagtaaacagaggag

SEQ ID NO: 5195516 - DNA, 21 bp, Homo sapiens
agccagtaaatgggggtgcat

SEQ ID NO: 5195517 - DNA, 19 bp, Homo sapiens
agccagtaaggcagctctg

SEQ ID NO: 5195518 - DNA, 17 bp, Homo sapiens
agccagtcatcatctct

SEQ ID NO: 5195519 - DNA, 19 bp, Homo sapiens
agccagtcatcatctcttg

SEQ ID NO: 5195520 - DNA, 21 bp, Homo sapiens
agccagtcatggaatcttgct

SEQ ID NO: 5195521 - DNA, 22 bp, Homo sapiens
agccagtcatggaatcttgctg

SEQ ID NO: 5195522 - DNA, 15 bp, Homo sapiens
agccagtctcagaga

SEQ ID NO: 5195523 - DNA, 19 bp, Homo sapiens
agccagtctcagagaccag

SEQ ID NO: 5195524 - DNA, 21 bp, Homo sapiens
agccagtctcagagaccagca

SEQ ID NO: 5195525 - DNA, 22 bp, Homo sapiens
agccagtctcagagaccagcac

SEQ ID NO: 5195526 - DNA, 19 bp, Homo sapiens
agccagtcttgcctaggcc

SEQ ID NO: 5195527 - DNA, 14 bp, Homo sapiens
agccagtgaaacac

SEQ ID NO: 5195528 - DNA, 15 bp, Homo sapiens
agccagtgaaacact

SEQ ID NO: 5195529 - DNA, 14 bp, Homo sapiens
agccagtgaacata

SEQ ID NO: 5195530 - DNA, 23 bp, Homo sapiens
agccagtgaacataattcttatt

SEQ ID NO: 5195531 - DNA, 18 bp, Homo sapiens
agccagtgaaggagccac

SEQ ID NO: 5195532 - DNA, 15 bp, Homo sapiens
agccagtgacactaa

SEQ ID NO: 5195533 - DNA, 15 bp, Homo sapiens
agccagtgactccag

SEQ ID NO: 5195534 - DNA, 19 bp, Homo sapiens
agccagtgactccaggaga

SEQ ID NO: 5195535 - DNA, 14 bp, Homo sapiens
agccagtgactttt

SEQ ID NO: 5195536 - DNA, 15 bp, Homo sapiens
agccagtgctgtctg

SEQ ID NO: 5195537 - DNA, 21 bp, Homo sapiens
agccagtggagctggtctgcc

SEQ ID NO: 5195538 - DNA, 16 bp, Homo sapiens
agccagtggcacagga

SEQ ID NO: 5195539 - DNA, 19 bp, Homo sapiens
agccagtggcacaggagac

SEQ ID NO: 5195540 - DNA, 18 bp, Homo sapiens
agccagtggcgggtgatg

SEQ ID NO: 5195541 - DNA, 21 bp, Homo sapiens
agccagtgggccagccacaga

SEQ ID NO: 5195542 - DNA, 14 bp, Homo sapiens
agccagtgtctagg

SEQ ID NO: 5195543 - DNA, 19 bp, Homo sapiens
agccagtgtgcccaaaagc

SEQ ID NO: 5195544 - DNA, 20 bp, Homo sapiens
agccagtgtgcccaaaagcc

SEQ ID NO: 5195545 - DNA, 17 bp, Homo sapiens
agccagttaaggaaaga

SEQ ID NO: 5195546 - DNA, 19 bp, Homo sapiens
agccagttcagtacctgga

SEQ ID NO: 5195547 - DNA, 23 bp, Homo sapiens
agccagttctggggcccgcctgc

SEQ ID NO: 5195548 - DNA, 14 bp, Homo sapiens
agccagttcttaag

SEQ ID NO: 5195549 - DNA, 23 bp, Homo sapiens
agccagttgcttcttcagctgac

SEQ ID NO: 5195550 - DNA, 23 bp, Homo sapiens
agccagttggcttctgtgcctga

SEQ ID NO: 5195551 - DNA, 13 bp, Homo sapiens
agccagttggtgg

SEQ ID NO: 5195552 - DNA, 22 bp, Homo sapiens
agccagttggtggggccaggcc

SEQ ID NO: 5195553 - DNA, 20 bp, Homo sapiens
agccagtttagagaaataca

SEQ ID NO: 5195554 - DNA, 23 bp, Homo sapiens
agccagtttgggtaaaatacttt

SEQ ID NO: 5195555 - DNA, 17 bp, Homo sapiens
agccataaaagcattgt

SEQ ID NO: 5195556 - DNA, 20 bp, Homo sapiens
agccataaaagcattgtctc

SEQ ID NO: 5195557 - DNA, 13 bp, Homo sapiens
agccataaatgat

SEQ ID NO: 5195558 - DNA, 15 bp, Homo sapiens
agccataacgtgccc

SEQ ID NO: 5195559 - DNA, 17 bp, Homo sapiens
agccataacgtgccccc

SEQ ID NO: 5195560 - DNA, 18 bp, Homo sapiens
agccataacgtgccccca

SEQ ID NO: 5195561 - DNA, 22 bp, Homo sapiens
agccataacgtgcccccagagt

SEQ ID NO: 5195562 - DNA, 13 bp, Homo sapiens
agccataataaaa

SEQ ID NO: 5195563 - DNA, 15 bp, Homo sapiens
agccataataataat

SEQ ID NO: 5195564 - DNA, 12 bp, Homo sapiens
agccataatttt

SEQ ID NO: 5195565 - DNA, 23 bp, Homo sapiens
agccatacataaaagaaataaac

SEQ ID NO: 5195566 - DNA, 22 bp, Homo sapiens
agccatactgcgtccaccctga

SEQ ID NO: 5195567 - DNA, 16 bp, Homo sapiens
agccatacttatctct

SEQ ID NO: 5195568 - DNA, 17 bp, Homo sapiens
agccatagacctacaga

SEQ ID NO: 5195569 - DNA, 18 bp, Homo sapiens
agccatagagcctgaaat

SEQ ID NO: 5195570 - DNA, 16 bp, Homo sapiens
agccatagccccaggc

SEQ ID NO: 5195571 - DNA, 17 bp, Homo sapiens
agccataggcccaggat

SEQ ID NO: 5195572 - DNA, 23 bp, Homo sapiens
agccatagggggctgcacgggat

SEQ ID NO: 5195573 - DNA, 15 bp, Homo sapiens
agccataggtgcagt

SEQ ID NO: 5195574 - DNA, 21 bp, Homo sapiens
agccatagtttgggtattttt

SEQ ID NO: 5195575 - DNA, 19 bp, Homo sapiens
agccatatatgaccagaag

SEQ ID NO: 5195576 - DNA, 15 bp, Homo sapiens
agccatatcaccagt

SEQ ID NO: 5195577 - DNA, 16 bp, Homo sapiens
agccatatcaccagtc

SEQ ID NO: 5195578 - DNA, 11 bp, Homo sapiens
agccatatcta

SEQ ID NO: 5195579 - DNA, 21 bp, Homo sapiens
agccatatctagtcaataact

SEQ ID NO: 5195580 - DNA, 23 bp, Homo sapiens
agccatatgacaatttcaaaatg

SEQ ID NO: 5195581 - DNA, 14 bp, Homo sapiens
agccatattccagc

SEQ ID NO: 5195582 - DNA, 19 bp, Homo sapiens
agccatattccagcagtga

SEQ ID NO: 5195583 - DNA, 20 bp, Homo sapiens
agccatattctaaattcact

SEQ ID NO: 5195584 - DNA, 14 bp, Homo sapiens
agccatatttgtaa

SEQ ID NO: 5195585 - DNA, 21 bp, Homo sapiens
agccatatttttttctgtaaa

SEQ ID NO: 5195586 - DNA, 16 bp, Homo sapiens
agccatcaagcacttc

SEQ ID NO: 5195587 - DNA, 23 bp, Homo sapiens
agccatcacaaggggaacgcaga

SEQ ID NO: 5195588 - DNA, 13 bp, Homo sapiens
agccatcaccctc

SEQ ID NO: 5195589 - DNA, 17 bp, Homo sapiens
agccatcaccctcaccc

SEQ ID NO: 5195590 - DNA, 21 bp, Homo sapiens
agccatcacctcagatggcag

SEQ ID NO: 5195591 - DNA, 17 bp, Homo sapiens
agccatcacttctcccc

SEQ ID NO: 5195592 - DNA, 12 bp, Homo sapiens
agccatcatgta

SEQ ID NO: 5195593 - DNA, 18 bp, Homo sapiens
agccatcatgtgcctgga

SEQ ID NO: 5195594 - DNA, 19 bp, Homo sapiens
agccatcatgtgcctggaa

SEQ ID NO: 5195595 - DNA, 16 bp, Homo sapiens
agccatccaccctgag

SEQ ID NO: 5195596 - DNA, 19 bp, Homo sapiens
agccatcccagccttggca

SEQ ID NO: 5195597 - DNA, 18 bp, Homo sapiens
agccatccccagggccca

SEQ ID NO: 5195598 - DNA, 20 bp, Homo sapiens
agccatcccgcttagcctgc

SEQ ID NO: 5195599 - DNA, 22 bp, Homo sapiens
agccatcccttcggagccaaca

SEQ ID NO: 5195600 - DNA, 15 bp, Homo sapiens
agccatcccttgggg

SEQ ID NO: 5195601 - DNA, 18 bp, Homo sapiens
agccatcccttggggaag

SEQ ID NO: 5195602 - DNA, 19 bp, Homo sapiens
agccatcccttggggaagg

SEQ ID NO: 5195603 - DNA, 16 bp, Homo sapiens
agccatcctccctcca

SEQ ID NO: 5195604 - DNA, 22 bp, Homo sapiens
agccatcctccctccacctcaa

SEQ ID NO: 5195605 - DNA, 23 bp, Homo sapiens
agccatcctccctccacctcaag

SEQ ID NO: 5195606 - DNA, 15 bp, Homo sapiens
agccatcgactcctg

SEQ ID NO: 5195607 - DNA, 15 bp, Homo sapiens
agccatcggaagaga

SEQ ID NO: 5195608 - DNA, 22 bp, Homo sapiens
agccatcggaagagagggctga

SEQ ID NO: 5195609 - DNA, 19 bp, Homo sapiens
agccatctaatgcttgttt

SEQ ID NO: 5195610 - DNA, 17 bp, Homo sapiens
agccatctccgtggcca

SEQ ID NO: 5195611 - DNA, 23 bp, Homo sapiens
agccatctgaagccacctctctg

SEQ ID NO: 5195612 - DNA, 16 bp, Homo sapiens
agccatctgcccaggg

SEQ ID NO: 5195613 - DNA, 14 bp, Homo sapiens
agccatcttcccgc

SEQ ID NO: 5195614 - DNA, 22 bp, Homo sapiens
agccatcttcccgcctcagcct

SEQ ID NO: 5195615 - DNA, 14 bp, Homo sapiens
agccatcttggcag

SEQ ID NO: 5195616 - DNA, 15 bp, Homo sapiens
agccatcttggtaaa

SEQ ID NO: 5195617 - DNA, 19 bp, Homo sapiens
agccatcttggtaaatttc

SEQ ID NO: 5195618 - DNA, 23 bp, Homo sapiens
agccatgaagcattaaaatgcat

SEQ ID NO: 5195619 - DNA, 21 bp, Homo sapiens
agccatgagatgatacatcca

SEQ ID NO: 5195620 - DNA, 19 bp, Homo sapiens
agccatgaggagcgtggac

SEQ ID NO: 5195621 - DNA, 20 bp, Homo sapiens
agccatgaggagcgtggact

SEQ ID NO: 5195622 - DNA, 14 bp, Homo sapiens
agccatgaggaggc

SEQ ID NO: 5195623 - DNA, 17 bp, Homo sapiens
agccatgaggaggcaga

SEQ ID NO: 5195624 - DNA, 19 bp, Homo sapiens
agccatgaggagttgctgt

SEQ ID NO: 5195625 - DNA, 23 bp, Homo sapiens
agccatgagttccagaaagtaaa

SEQ ID NO: 5195626 - DNA, 22 bp, Homo sapiens
agccatgatctgcaggggtctg

SEQ ID NO: 5195627 - DNA, 23 bp, Homo sapiens
agccatgatctgcaggggtctgg

SEQ ID NO: 5195628 - DNA, 14 bp, Homo sapiens
agccatgatggcaa

SEQ ID NO: 5195629 - DNA, 18 bp, Homo sapiens
agccatgatttcccactg

SEQ ID NO: 5195630 - DNA, 22 bp, Homo sapiens
agccatgatttcccactgcact

SEQ ID NO: 5195631 - DNA, 19 bp, Homo sapiens
agccatgatttgtcccagc

SEQ ID NO: 5195632 - DNA, 21 bp, Homo sapiens
agccatgatttgtcccagcct

SEQ ID NO: 5195633 - DNA, 23 bp, Homo sapiens
agccatgatttgtcccagcctgg

SEQ ID NO: 5195634 - DNA, 16 bp, Homo sapiens
agccatgattttctaa

SEQ ID NO: 5195635 - DNA, 14 bp, Homo sapiens
agccatgccagctg

SEQ ID NO: 5195636 - DNA, 16 bp, Homo sapiens
agccatgccagctggc

SEQ ID NO: 5195637 - DNA, 21 bp, Homo sapiens
agccatgccagctggcctttg

SEQ ID NO: 5195638 - DNA, 21 bp, Homo sapiens
agccatgccgtctgccggacc

SEQ ID NO: 5195639 - DNA, 16 bp, Homo sapiens
agccatgcctccctgg

SEQ ID NO: 5195640 - DNA, 12 bp, Homo sapiens
agccatggaagg

SEQ ID NO: 5195641 - DNA, 19 bp, Homo sapiens
agccatggaaggtgccaga

SEQ ID NO: 5195642 - DNA, 21 bp, Homo sapiens
agccatggcaggacagctcct

SEQ ID NO: 5195643 - DNA, 15 bp, Homo sapiens
agccatggcatgctc

SEQ ID NO: 5195644 - DNA, 14 bp, Homo sapiens
agccatggctcagg

SEQ ID NO: 5195645 - DNA, 18 bp, Homo sapiens
agccatgggaaatgagcc

SEQ ID NO: 5195646 - DNA, 12 bp, Homo sapiens
agccatgggacc

SEQ ID NO: 5195647 - DNA, 15 bp, Homo sapiens
agccatgggaccaaa

SEQ ID NO: 5195648 - DNA, 18 bp, Homo sapiens
agccatgggacctcctcc

SEQ ID NO: 5195649 - DNA, 18 bp, Homo sapiens
agccatgggccctctgag

SEQ ID NO: 5195650 - DNA, 19 bp, Homo sapiens
agccatgggccctctgagc

SEQ ID NO: 5195651 - DNA, 15 bp, Homo sapiens
agccatgggcctggg

SEQ ID NO: 5195652 - DNA, 18 bp, Homo sapiens
agccatggtgaactgata

SEQ ID NO: 5195653 - DNA, 17 bp, Homo sapiens
agccatggtgacacaca

SEQ ID NO: 5195654 - DNA, 18 bp, Homo sapiens
agccatggtgacacacag

SEQ ID NO: 5195655 - DNA, 19 bp, Homo sapiens
agccatggtgacacacagc

SEQ ID NO: 5195656 - DNA, 17 bp, Homo sapiens
agccatgtagccaccca

SEQ ID NO: 5195657 - DNA, 15 bp, Homo sapiens
agccatgtataaatg

SEQ ID NO: 5195658 - DNA, 18 bp, Homo sapiens
agccatgtataaatgtga

SEQ ID NO: 5195659 - DNA, 22 bp, Homo sapiens
agccatgtataaccaagtgtgc

SEQ ID NO: 5195660 - DNA, 18 bp, Homo sapiens
agccatgtatttcaggga

SEQ ID NO: 5195661 - DNA, 19 bp, Homo sapiens
agccatgtatttcagggac

SEQ ID NO: 5195662 - DNA, 20 bp, Homo sapiens
agccatgtctacaaaagcaa

SEQ ID NO: 5195663 - DNA, 14 bp, Homo sapiens
agccatgtctgcat

SEQ ID NO: 5195664 - DNA, 15 bp, Homo sapiens
agccatgtctgcatt

SEQ ID NO: 5195665 - DNA, 15 bp, Homo sapiens
agccatgtcttctcc

SEQ ID NO: 5195666 - DNA, 23 bp, Homo sapiens
agccatgtgctgcgtgcctgtgg

SEQ ID NO: 5195667 - DNA, 16 bp, Homo sapiens
agccatgtgtcatgta

SEQ ID NO: 5195668 - DNA, 17 bp, Homo sapiens
agccatgtttaagattt

SEQ ID NO: 5195669 - DNA, 22 bp, Homo sapiens
agccatgtttattacagtataa

SEQ ID NO: 5195670 - DNA, 20 bp, Homo sapiens
agccattaaaataaaacaag

SEQ ID NO: 5195671 - DNA, 22 bp, Homo sapiens
agccattaaaataaaacaagcc

SEQ ID NO: 5195672 - DNA, 14 bp, Homo sapiens
agccattcactgcc

SEQ ID NO: 5195673 - DNA, 22 bp, Homo sapiens
agccattcatctgggctggcag

SEQ ID NO: 5195674 - DNA, 15 bp, Homo sapiens
agccattcatttaca

SEQ ID NO: 5195675 - DNA, 22 bp, Homo sapiens
agccattctctacccatcctta

SEQ ID NO: 5195676 - DNA, 14 bp, Homo sapiens
agccattctgcctc

SEQ ID NO: 5195677 - DNA, 17 bp, Homo sapiens
agccattctggcacttt

SEQ ID NO: 5195678 - DNA, 13 bp, Homo sapiens
agccattctgtgt

SEQ ID NO: 5195679 - DNA, 12 bp, Homo sapiens
agccattctttt

SEQ ID NO: 5195680 - DNA, 13 bp, Homo sapiens
agccattctttta

SEQ ID NO: 5195681 - DNA, 15 bp, Homo sapiens
agccattgaacagct

SEQ ID NO: 5195682 - DNA, 22 bp, Homo sapiens
agccattgaacagctgtgagcc

SEQ ID NO: 5195683 - DNA, 15 bp, Homo sapiens
agccattgaccaccc

SEQ ID NO: 5195684 - DNA, 18 bp, Homo sapiens
agccattgcggccccagg

SEQ ID NO: 5195685 - DNA, 20 bp, Homo sapiens
agccattgcggccccaggag

SEQ ID NO: 5195686 - DNA, 18 bp, Homo sapiens
agccattgcttctccctc

SEQ ID NO: 5195687 - DNA, 20 bp, Homo sapiens
agccattgcttctccctcac

SEQ ID NO: 5195688 - DNA, 12 bp, Homo sapiens
agctctggctca

SEQ ID NO: 5195689 - DNA, 18 bp, Homo sapiens
agctctggctctgcctca

SEQ ID NO: 5195690 - DNA, 16 bp, Homo sapiens
agctctggctgaaccc

SEQ ID NO: 5195691 - DNA, 17 bp, Homo sapiens
agctctggctgaaccct

SEQ ID NO: 5195692 - DNA, 19 bp, Homo sapiens
agctctggctgaaccctgt

SEQ ID NO: 5195693 - DNA, 12 bp, Homo sapiens
agctctggcttt

SEQ ID NO: 5195694 - DNA, 21 bp, Homo sapiens
agctctggctttcgtgttttt

SEQ ID NO: 5195695 - DNA, 15 bp, Homo sapiens
agctctgggagagga

SEQ ID NO: 5195696 - DNA, 18 bp, Homo sapiens
agctctgggagaggattt

SEQ ID NO: 5195697 - DNA, 15 bp, Homo sapiens
agctctgggcctctt

SEQ ID NO: 5195698 - DNA, 16 bp, Homo sapiens
agctctgggcctcttt

SEQ ID NO: 5195699 - DNA, 19 bp, Homo sapiens
agctctggggacagcttcc

SEQ ID NO: 5195700 - DNA, 20 bp, Homo sapiens
agctctggggacagcttcct

SEQ ID NO: 5195701 - DNA, 22 bp, Homo sapiens
agctctggggacagcttcctca

SEQ ID NO: 5195702 - DNA, 20 bp, Homo sapiens
agctctggggatgggtgggg

SEQ ID NO: 5195703 - DNA, 19 bp, Homo sapiens
agctctgggggactccttc

SEQ ID NO: 5195704 - DNA, 15 bp, Homo sapiens
agctctggggggcag

SEQ ID NO: 5195705 - DNA, 22 bp, Homo sapiens
agctctggggtgggcagttttt

SEQ ID NO: 5195706 - DNA, 16 bp, Homo sapiens
agctctggtgctttag

SEQ ID NO: 5195707 - DNA, 13 bp, Homo sapiens
agctctggtggga

SEQ ID NO: 5195708 - DNA, 18 bp, Homo sapiens
agctctggtgggaggccc

SEQ ID NO: 5195709 - DNA, 16 bp, Homo sapiens
agctctgtaacttaca

SEQ ID NO: 5195710 - DNA, 15 bp, Homo sapiens
agctctgtagcctgg

SEQ ID NO: 5195711 - DNA, 17 bp, Homo sapiens
agctctgtagcctggtc

SEQ ID NO: 5195712 - DNA, 18 bp, Homo sapiens
agctctgtagcctggtct

SEQ ID NO: 5195713 - DNA, 20 bp, Homo sapiens
agctctgtagcctggtctgt

SEQ ID NO: 5195714 - DNA, 23 bp, Homo sapiens
agctctgtagcctggtctgtgca

SEQ ID NO: 5195715 - DNA, 19 bp, Homo sapiens
agctctgtcaccctggcca

SEQ ID NO: 5195716 - DNA, 21 bp, Homo sapiens
agctctgtcaccctggccacc

SEQ ID NO: 5195717 - DNA, 12 bp, Homo sapiens
agctctgtccac

SEQ ID NO: 5195718 - DNA, 16 bp, Homo sapiens
agctctgtcctctgtc

SEQ ID NO: 5195719 - DNA, 14 bp, Homo sapiens
agctctgtcctggg

SEQ ID NO: 5195720 - DNA, 16 bp, Homo sapiens
agctctgtcctgggag

SEQ ID NO: 5195721 - DNA, 23 bp, Homo sapiens
agctctgtcctgggagtgagctg

SEQ ID NO: 5195722 - DNA, 21 bp, Homo sapiens
agctctgtcgtggtagcagat

SEQ ID NO: 5195723 - DNA, 15 bp, Homo sapiens
agctctgtctgctca

SEQ ID NO: 5195724 - DNA, 17 bp, Homo sapiens
agctctgtctgctcaat

SEQ ID NO: 5195725 - DNA, 14 bp, Homo sapiens
agctctgtggcctg

SEQ ID NO: 5195726 - DNA, 15 bp, Homo sapiens
agctctgtggcctgt

SEQ ID NO: 5195727 - DNA, 16 bp, Homo sapiens
agctctgtggcctgtg

SEQ ID NO: 5195728 - DNA, 16 bp, Homo sapiens
agctctgtgggaaaaa

SEQ ID NO: 5195729 - DNA, 17 bp, Homo sapiens
agctctgtgggaaaaaa

SEQ ID NO: 5195730 - DNA, 21 bp, Homo sapiens
agctctgtgggaaaaaagaaa

SEQ ID NO: 5195731 - DNA, 13 bp, Homo sapiens
agctctgtgggcc

SEQ ID NO: 5195732 - DNA, 15 bp, Homo sapiens
agctctgtgggccct

SEQ ID NO: 5195733 - DNA, 22 bp, Homo sapiens
agctctgtgggccctaccctcc

SEQ ID NO: 5195734 - DNA, 17 bp, Homo sapiens
agctctgttcttcctca

SEQ ID NO: 5195735 - DNA, 19 bp, Homo sapiens
agctctgttcttcctcagc

SEQ ID NO: 5195736 - DNA, 20 bp, Homo sapiens
agctcttaattgttcatttt

SEQ ID NO: 5195737 - DNA, 15 bp, Homo sapiens
agctcttaccaaaac

SEQ ID NO: 5195738 - DNA, 16 bp, Homo sapiens
agctcttaccaaaaca

SEQ ID NO: 5195739 - DNA, 17 bp, Homo sapiens
agctcttagactcgcct

SEQ ID NO: 5195740 - DNA, 16 bp, Homo sapiens
agctcttagtcctccc

SEQ ID NO: 5195741 - DNA, 20 bp, Homo sapiens
agctcttagtcctccctgct

SEQ ID NO: 5195742 - DNA, 20 bp, Homo sapiens
agctcttcaatagctaagca

SEQ ID NO: 5195743 - DNA, 15 bp, Homo sapiens
agctcttcactcagc

SEQ ID NO: 5195744 - DNA, 19 bp, Homo sapiens
agctcttcactcagccaca

SEQ ID NO: 5195745 - DNA, 19 bp, Homo sapiens
agctcttcacttcctccag

SEQ ID NO: 5195746 - DNA, 15 bp, Homo sapiens
agctcttcaggcctc

SEQ ID NO: 5195747 - DNA, 18 bp, Homo sapiens
agctcttcaggcctccct

SEQ ID NO: 5195748 - DNA, 17 bp, Homo sapiens
agctcttcatctgccca

SEQ ID NO: 5195749 - DNA, 13 bp, Homo sapiens
agctcttcatgtt

SEQ ID NO: 5195750 - DNA, 16 bp, Homo sapiens
agctcttcattccatt

SEQ ID NO: 5195751 - DNA, 16 bp, Homo sapiens
agctcttcccctttcc

SEQ ID NO: 5195752 - DNA, 12 bp, Homo sapiens
agctcttccctt

SEQ ID NO: 5195753 - DNA, 23 bp, Homo sapiens
agctcttcccttgctcatgagct

SEQ ID NO: 5195754 - DNA, 16 bp, Homo sapiens
agctcttcctccccag

SEQ ID NO: 5195755 - DNA, 21 bp, Homo sapiens
agctcttccttactcccaggc

SEQ ID NO: 5195756 - DNA, 22 bp, Homo sapiens
agctcttccttactcccaggca

SEQ ID NO: 5195757 - DNA, 14 bp, Homo sapiens
agctcttctattta

SEQ ID NO: 5195758 - DNA, 18 bp, Homo sapiens
agctcttctatttaaaaa

SEQ ID NO: 5195759 - DNA, 19 bp, Homo sapiens
agctcttctatttaaaaaa

SEQ ID NO: 5195760 - DNA, 20 bp, Homo sapiens
agctcttctatttaaaaaat

SEQ ID NO: 5195761 - DNA, 18 bp, Homo sapiens
agctcttctcagtgtctg

SEQ ID NO: 5195762 - DNA, 15 bp, Homo sapiens
agctcttctccaggc

SEQ ID NO: 5195763 - DNA, 16 bp, Homo sapiens
agctcttctccccagg

SEQ ID NO: 5195764 - DNA, 23 bp, Homo sapiens
agctcttctgccggccctggggc

SEQ ID NO: 5195765 - DNA, 15 bp, Homo sapiens
agctcttctggagtt

SEQ ID NO: 5195766 - DNA, 21 bp, Homo sapiens
agctcttctggagtttctcta

SEQ ID NO: 5195767 - DNA, 14 bp, Homo sapiens
agctcttctgggca

SEQ ID NO: 5195768 - DNA, 15 bp, Homo sapiens
agctcttctgggcag

SEQ ID NO: 5195769 - DNA, 14 bp, Homo sapiens
agctcttctgtgcc

SEQ ID NO: 5195770 - DNA, 23 bp, Homo sapiens
agctcttctgtgccctggctcca

SEQ ID NO: 5195771 - DNA, 18 bp, Homo sapiens
agctcttcttaaagtatt

SEQ ID NO: 5195772 - DNA, 21 bp, Homo sapiens
agctcttgaaatatgtagtat

SEQ ID NO: 5195773 - DNA, 19 bp, Homo sapiens
agctcttgaagacactgaa

SEQ ID NO: 5195774 - DNA, 20 bp, Homo sapiens
agctcttgacagaaagcagt

SEQ ID NO: 5195775 - DNA, 23 bp, Homo sapiens
agctcttgacagaaagcagttct

SEQ ID NO: 5195776 - DNA, 20 bp, Homo sapiens
agctcttgccccactccctg

SEQ ID NO: 5195777 - DNA, 15 bp, Homo sapiens
agctcttgcccttcc

SEQ ID NO: 5195778 - DNA, 16 bp, Homo sapiens
agctcttgcccttccc

SEQ ID NO: 5195779 - DNA, 19 bp, Homo sapiens
agctcttgcccttccctgt

SEQ ID NO: 5195780 - DNA, 20 bp, Homo sapiens
agctcttgctaatcagtgtc

SEQ ID NO: 5195781 - DNA, 23 bp, Homo sapiens
agctcttgctaatcagtgtctca

SEQ ID NO: 5195782 - DNA, 20 bp, Homo sapiens
agctcttgctatctctcaag

SEQ ID NO: 5195783 - DNA, 21 bp, Homo sapiens
agctcttggacaacagctctc

SEQ ID NO: 5195784 - DNA, 15 bp, Homo sapiens
agctcttggagctgt

SEQ ID NO: 5195785 - DNA, 18 bp, Homo sapiens
agctcttggcaggagtgg

SEQ ID NO: 5195786 - DNA, 19 bp, Homo sapiens
agctcttggcattttcctc

SEQ ID NO: 5195787 - DNA, 13 bp, Homo sapiens
agctcttggcctt

SEQ ID NO: 5195788 - DNA, 15 bp, Homo sapiens
agctcttgggcctga

SEQ ID NO: 5195789 - DNA, 22 bp, Homo sapiens
agctcttgggcctgacctccag

SEQ ID NO: 5195790 - DNA, 17 bp, Homo sapiens
agctcttgggtcagaga

SEQ ID NO: 5195791 - DNA, 18 bp, Homo sapiens
agctcttgggtcagagaa

SEQ ID NO: 5195792 - DNA, 18 bp, Homo sapiens
agctcttggtgggcccag

SEQ ID NO: 5195793 - DNA, 16 bp, Homo sapiens
agctcttgtacagaca

SEQ ID NO: 5195794 - DNA, 19 bp, Homo sapiens
agctcttgtgttcagaaga

SEQ ID NO: 5195795 - DNA, 18 bp, Homo sapiens
agctcttgttgagccgtg

SEQ ID NO: 5195796 - DNA, 18 bp, Homo sapiens
agctcttgtttctgttta

SEQ ID NO: 5195797 - DNA, 14 bp, Homo sapiens
agctctttccaaat

SEQ ID NO: 5195798 - DNA, 21 bp, Homo sapiens
agctctttccaaattaaaaca

SEQ ID NO: 5195799 - DNA, 22 bp, Homo sapiens
agctctttccaaattaaaacaa

SEQ ID NO: 5195800 - DNA, 13 bp, Homo sapiens
agctctttcctcc

SEQ ID NO: 5195801 - DNA, 22 bp, Homo sapiens
agctctttcctccttccatgga

SEQ ID NO: 5195802 - DNA, 23 bp, Homo sapiens
agctctttcctccttccatggaa

SEQ ID NO: 5195803 - DNA, 17 bp, Homo sapiens
agctctttcttctttga

SEQ ID NO: 5195804 - DNA, 14 bp, Homo sapiens
agctctttgagata

SEQ ID NO: 5195805 - DNA, 23 bp, Homo sapiens
agctctttgagataatacattcc

SEQ ID NO: 5195806 - DNA, 21 bp, Homo sapiens
agctctttgggcctctcctgc

SEQ ID NO: 5195807 - DNA, 16 bp, Homo sapiens
agctctttggtgccag

SEQ ID NO: 5195808 - DNA, 14 bp, Homo sapiens
agctctttgtcagg

SEQ ID NO: 5195809 - DNA, 17 bp, Homo sapiens
agctctttgtcagggag

SEQ ID NO: 5195810 - DNA, 22 bp, Homo sapiens
agctctttgtctcaccagctca

SEQ ID NO: 5195811 - DNA, 15 bp, Homo sapiens
agctcttttcctaga

SEQ ID NO: 5195812 - DNA, 17 bp, Homo sapiens
agctctttttgtgaagt

SEQ ID NO: 5195813 - DNA, 21 bp, Homo sapiens
agctcttttttgtttgtttct

SEQ ID NO: 5195814 - DNA, 22 bp, Homo sapiens
agctcttttttgtttgtttctt

SEQ ID NO: 5195815 - DNA, 23 bp, Homo sapiens
agctcttttttgtttgtttcttt

SEQ ID NO: 5195816 - DNA, 18 bp, Homo sapiens
agctgaaaaaactatatt

SEQ ID NO: 5195817 - DNA, 22 bp, Homo sapiens
agctgaaaacctaagtccttta

SEQ ID NO: 5195818 - DNA, 19 bp, Homo sapiens
agctgaaaactaatgtact

SEQ ID NO: 5195819 - DNA, 23 bp, Homo sapiens
agctgaaaactaatgtactgtac

SEQ ID NO: 5195820 - DNA, 12 bp, Homo sapiens
agctgaaaaggg

SEQ ID NO: 5195821 - DNA, 20 bp, Homo sapiens
agctgaaaatataaaacaaa

SEQ ID NO: 5195822 - DNA, 18 bp, Homo sapiens
agctgaaaattaaatttt

SEQ ID NO: 5195823 - DNA, 19 bp, Homo sapiens
agctgaaaattaaatttta

SEQ ID NO: 5195824 - DNA, 22 bp, Homo sapiens
agctgaaacattccgaagaggg

SEQ ID NO: 5195825 - DNA, 19 bp, Homo sapiens
agctgaaattcaccaagaa

SEQ ID NO: 5195826 - DNA, 14 bp, Homo sapiens
agctgaaattgggt

SEQ ID NO: 5195827 - DNA, 17 bp, Homo sapiens
agctgaaattttagaaa

SEQ ID NO: 5195828 - DNA, 22 bp, Homo sapiens
agctgaacagatgacccctgcc

SEQ ID NO: 5195829 - DNA, 13 bp, Homo sapiens
agctgaaccacag

SEQ ID NO: 5195830 - DNA, 19 bp, Homo sapiens
agctgaacccattttgagt

SEQ ID NO: 5195831 - DNA, 14 bp, Homo sapiens
agctgaaccttgag

SEQ ID NO: 5195832 - DNA, 20 bp, Homo sapiens
agctgaaccttgaggggcta

SEQ ID NO: 5195833 - DNA, 12 bp, Homo sapiens
agctgaagaact

SEQ ID NO: 5195834 - DNA, 13 bp, Homo sapiens
agctgaagacaaa

SEQ ID NO: 5195835 - DNA, 14 bp, Homo sapiens
agctgaagacaaac

SEQ ID NO: 5195836 - DNA, 16 bp, Homo sapiens
agctgaagaccatgga

SEQ ID NO: 5195837 - DNA, 14 bp, Homo sapiens
agctgaagagcaag

SEQ ID NO: 5195838 - DNA, 16 bp, Homo sapiens
agctgaagatccccaa

SEQ ID NO: 5195839 - DNA, 17 bp, Homo sapiens
agctgaagatccccaac

SEQ ID NO: 5195840 - DNA, 21 bp, Homo sapiens
agctgaagatccccattcttt

SEQ ID NO: 5195841 - DNA, 16 bp, Homo sapiens
agctgaagcccccctt

SEQ ID NO: 5195842 - DNA, 14 bp, Homo sapiens
agctgaagcctgga

SEQ ID NO: 5195843 - DNA, 18 bp, Homo sapiens
agctgaagcctggacgca

SEQ ID NO: 5195844 - DNA, 20 bp, Homo sapiens
agctgaagcctggacgcagc

SEQ ID NO: 5195845 - DNA, 23 bp, Homo sapiens
agctgaagcctggacgcagccac

SEQ ID NO: 5195846 - DNA, 18 bp, Homo sapiens
agctgaagtcaaaatatg

SEQ ID NO: 5195847 - DNA, 16 bp, Homo sapiens
agctgaagtgaaggag

SEQ ID NO: 5195848 - DNA, 18 bp, Homo sapiens
agctgaagtgaaggagaa

SEQ ID NO: 5195849 - DNA, 13 bp, Homo sapiens
agctgaagttact

SEQ ID NO: 5195850 - DNA, 20 bp, Homo sapiens
agctgaataacctgcacagg

SEQ ID NO: 5195851 - DNA, 16 bp, Homo sapiens
agctgaatagagggag

SEQ ID NO: 5195852 - DNA, 13 bp, Homo sapiens
agctgaatgtcaa

SEQ ID NO: 5195853 - DNA, 15 bp, Homo sapiens
agctgaatgtttttc

SEQ ID NO: 5195854 - DNA, 20 bp, Homo sapiens
agctgaatgtttttctaaag

SEQ ID NO: 5195855 - DNA, 14 bp, Homo sapiens
agctgaattatatt

SEQ ID NO: 5195856 - DNA, 20 bp, Homo sapiens
agctgaattgagcctaaaaa

SEQ ID NO: 5195857 - DNA, 16 bp, Homo sapiens
agctgaattttctgga

SEQ ID NO: 5195858 - DNA, 23 bp, Homo sapiens
agctgacacaaacctgcctgggt

SEQ ID NO: 5195859 - DNA, 12 bp, Homo sapiens
agctgacacaga

SEQ ID NO: 5195860 - DNA, 20 bp, Homo sapiens
agctgacacataatttgaat

SEQ ID NO: 5195861 - DNA, 15 bp, Homo sapiens
agctgacagtcagct

SEQ ID NO: 5195862 - DNA, 13 bp, Homo sapiens
agctgacagtcct

SEQ ID NO: 5195863 - DNA, 19 bp, Homo sapiens
agctgaccagccgtgagca

SEQ ID NO: 5195864 - DNA, 16 bp, Homo sapiens
agctgacccagcccct

SEQ ID NO: 5195865 - DNA, 18 bp, Homo sapiens
agctgacccggcctctct

SEQ ID NO: 5195866 - DNA, 14 bp, Homo sapiens
agccattggagagc

SEQ ID NO: 5195867 - DNA, 12 bp, Homo sapiens
agccattgtctt

SEQ ID NO: 5195868 - DNA, 21 bp, Homo sapiens
agccatttaactggagctccg

SEQ ID NO: 5195869 - DNA, 12 bp, Homo sapiens
agccatttaatt

SEQ ID NO: 5195870 - DNA, 18 bp, Homo sapiens
agccatttactttgcaag

SEQ ID NO: 5195871 - DNA, 18 bp, Homo sapiens
agccatttaggcaaataa

SEQ ID NO: 5195872 - DNA, 19 bp, Homo sapiens
agccatttccatggctctg

SEQ ID NO: 5195873 - DNA, 13 bp, Homo sapiens
agccatttccccc

SEQ ID NO: 5195874 - DNA, 16 bp, Homo sapiens
agccatttccccctcc

SEQ ID NO: 5195875 - DNA, 18 bp, Homo sapiens
agccatttccccctcctc

SEQ ID NO: 5195876 - DNA, 11 bp, Homo sapiens
agccatttctc

SEQ ID NO: 5195877 - DNA, 16 bp, Homo sapiens
agccatttctccatgg

SEQ ID NO: 5195878 - DNA, 14 bp, Homo sapiens
agccatttcttgtt

SEQ ID NO: 5195879 - DNA, 14 bp, Homo sapiens
agccatttgccatc

SEQ ID NO: 5195880 - DNA, 17 bp, Homo sapiens
agccatttgttggggca

SEQ ID NO: 5195881 - DNA, 13 bp, Homo sapiens
agccattttccaa

SEQ ID NO: 5195882 - DNA, 20 bp, Homo sapiens
agccattttggggggccccc

SEQ ID NO: 5195883 - DNA, 16 bp, Homo sapiens
agccattttgtgaatg

SEQ ID NO: 5195884 - DNA, 19 bp, Homo sapiens
agccattttgtgaatggat

SEQ ID NO: 5195885 - DNA, 19 bp, Homo sapiens
agccatttttcaaagcaat

SEQ ID NO: 5195886 - DNA, 20 bp, Homo sapiens
agccatttttcaaagcaatt

SEQ ID NO: 5195887 - DNA, 21 bp, Homo sapiens
agcccaaacctgggaaggcca

SEQ ID NO: 5195888 - DNA, 22 bp, Homo sapiens
agcccaaacctgggaaggccag

SEQ ID NO: 5195889 - DNA, 20 bp, Homo sapiens
agcccaaaccttgggccctg

SEQ ID NO: 5195890 - DNA, 13 bp, Homo sapiens
agcccaaagaagg

SEQ ID NO: 5195891 - DNA, 14 bp, Homo sapiens
agcccaaagaagga

SEQ ID NO: 5195892 - DNA, 21 bp, Homo sapiens
agcccaaagcctgaggacaga

SEQ ID NO: 5195893 - DNA, 19 bp, Homo sapiens
agcccaaagctgcaggtgc

SEQ ID NO: 5195894 - DNA, 16 bp, Homo sapiens
agcccaaagctggagc

SEQ ID NO: 5195895 - DNA, 20 bp, Homo sapiens
agcccaaagctggagccaat

SEQ ID NO: 5195896 - DNA, 16 bp, Homo sapiens
agcccaaagctgttgg

SEQ ID NO: 5195897 - DNA, 19 bp, Homo sapiens
agcccaacacacactcggg

SEQ ID NO: 5195898 - DNA, 21 bp, Homo sapiens
agcccaacatggggcccctct

SEQ ID NO: 5195899 - DNA, 17 bp, Homo sapiens
agcccaaccaggccctg

SEQ ID NO: 5195900 - DNA, 20 bp, Homo sapiens
agcccaaccaggccctgcca

SEQ ID NO: 5195901 - DNA, 13 bp, Homo sapiens
agcccaaccggga

SEQ ID NO: 5195902 - DNA, 19 bp, Homo sapiens
agcccaacttccagaggac

SEQ ID NO: 5195903 - DNA, 13 bp, Homo sapiens
agcccaagacacc

SEQ ID NO: 5195904 - DNA, 14 bp, Homo sapiens
agcccaagaggact

SEQ ID NO: 5195905 - DNA, 18 bp, Homo sapiens
agcccaagaggtctgagc

SEQ ID NO: 5195906 - DNA, 20 bp, Homo sapiens
agcccaagaggtctgagccc

SEQ ID NO: 5195907 - DNA, 21 bp, Homo sapiens
agcccaagaggtctgagccct

SEQ ID NO: 5195908 - DNA, 22 bp, Homo sapiens
agcccaagaggtctgagccctg

SEQ ID NO: 5195909 - DNA, 14 bp, Homo sapiens
agcccaagattctt

SEQ ID NO: 5195910 - DNA, 18 bp, Homo sapiens
agcccaagcatcactgcc

SEQ ID NO: 5195911 - DNA, 15 bp, Homo sapiens
agcccaagctaagct

SEQ ID NO: 5195912 - DNA, 22 bp, Homo sapiens
agcccaagctaagctgcaggca

SEQ ID NO: 5195913 - DNA, 16 bp, Homo sapiens
agcccaagcttccctc

SEQ ID NO: 5195914 - DNA, 16 bp, Homo sapiens
agcccaagggatctgg

SEQ ID NO: 5195915 - DNA, 21 bp, Homo sapiens
agcccaagggatctggtccta

SEQ ID NO: 5195916 - DNA, 24 bp, Homo sapiens
agcccaaggtgctgatgtcaaagt

SEQ ID NO: 5195917 - DNA, 10 bp, Homo sapiens
agcccaagtc

SEQ ID NO: 5195918 - DNA, 14 bp, Homo sapiens
agcccaagtccaaa

SEQ ID NO: 5195919 - DNA, 18 bp, Homo sapiens
agcccaagtgaggcagcc

SEQ ID NO: 5195920 - DNA, 13 bp, Homo sapiens
agcccaagtgcca

SEQ ID NO: 5195921 - DNA, 14 bp, Homo sapiens
agcccaagtgccat

SEQ ID NO: 5195922 - DNA, 18 bp, Homo sapiens
agcccaagtgccatccca

SEQ ID NO: 5195923 - DNA, 21 bp, Homo sapiens
agcccaagtgccatcccacat

SEQ ID NO: 5195924 - DNA, 20 bp, Homo sapiens
agcccaagttatctttccct

SEQ ID NO: 5195925 - DNA, 21 bp, Homo sapiens
agcccaagttcatgcagctgt

SEQ ID NO: 5195926 - DNA, 23 bp, Homo sapiens
agcccaagttcatgcagctgtgg

SEQ ID NO: 5195927 - DNA, 12 bp, Homo sapiens
agcccaataaag

SEQ ID NO: 5195928 - DNA, 18 bp, Homo sapiens
agcccaatgcatagagcc

SEQ ID NO: 5195929 - DNA, 23 bp, Homo sapiens
agcccaatgcatagagccctggc

SEQ ID NO: 5195930 - DNA, 15 bp, Homo sapiens
agcccaatggagaaa

SEQ ID NO: 5195931 - DNA, 18 bp, Homo sapiens
agcccaatggagaaatga

SEQ ID NO: 5195932 - DNA, 17 bp, Homo sapiens
agcccacaaagccttat

SEQ ID NO: 5195933 - DNA, 23 bp, Homo sapiens
agcccacaccatctggcccaggc

SEQ ID NO: 5195934 - DNA, 14 bp, Homo sapiens
agcccacacccctc

SEQ ID NO: 5195935 - DNA, 15 bp, Homo sapiens
agcccacacccctcc

SEQ ID NO: 5195936 - DNA, 15 bp, Homo sapiens
agcccacactatgca

SEQ ID NO: 5195937 - DNA, 19 bp, Homo sapiens
agcccacactatgcacaga

SEQ ID NO: 5195938 - DNA, 21 bp, Homo sapiens
agcccacactatgcacagagc

SEQ ID NO: 5195939 - DNA, 12 bp, Homo sapiens
agcccacagagc

SEQ ID NO: 5195940 - DNA, 14 bp, Homo sapiens
agcccacagagcct

SEQ ID NO: 5195941 - DNA, 15 bp, Homo sapiens
agcccacagagcctg

SEQ ID NO: 5195942 - DNA, 21 bp, Homo sapiens
agcccacagaggacagtgctg

SEQ ID NO: 5195943 - DNA, 12 bp, Homo sapiens
agcccacagcac

SEQ ID NO: 5195944 - DNA, 14 bp, Homo sapiens
agcccacagcgagc

SEQ ID NO: 5195945 - DNA, 18 bp, Homo sapiens
agcccacagcgagcctgt

SEQ ID NO: 5195946 - DNA, 20 bp, Homo sapiens
agcccacagcgagcctgtgc

SEQ ID NO: 5195947 - DNA, 23 bp, Homo sapiens
agcccacagcgagcctgtgcctt

SEQ ID NO: 5195948 - DNA, 16 bp, Homo sapiens
agcccacagtatattt

SEQ ID NO: 5195949 - DNA, 20 bp, Homo sapiens
agcccacagtatattttatt

SEQ ID NO: 5195950 - DNA, 15 bp, Homo sapiens
agcccacagtgctca

SEQ ID NO: 5195951 - DNA, 21 bp, Homo sapiens
agcccacatggccgggccctc

SEQ ID NO: 5195952 - DNA, 14 bp, Homo sapiens
agcccaccaccctg

SEQ ID NO: 5195953 - DNA, 15 bp, Homo sapiens
agcccaccagccacc

SEQ ID NO: 5195954 - DNA, 15 bp, Homo sapiens
agcccaccagccagc

SEQ ID NO: 5195955 - DNA, 16 bp, Homo sapiens
agcccaccagccagcc

SEQ ID NO: 5195956 - DNA, 18 bp, Homo sapiens
agcccaccagccagccct

SEQ ID NO: 5195957 - DNA, 11 bp, Homo sapiens
agcccaccagg

SEQ ID NO: 5195958 - DNA, 19 bp, Homo sapiens
agcccaccaggagcacctg

SEQ ID NO: 5195959 - DNA, 19 bp, Homo sapiens
agcccaccagggacacctc

SEQ ID NO: 5195960 - DNA, 19 bp, Homo sapiens
agcccaccaggtgtcagga

SEQ ID NO: 5195961 - DNA, 12 bp, Homo sapiens
agcccacccagc

SEQ ID NO: 5195962 - DNA, 22 bp, Homo sapiens
agcccacccccctccccaactc

SEQ ID NO: 5195963 - DNA, 22 bp, Homo sapiens
agcccaccccctttgactctgg

SEQ ID NO: 5195964 - DNA, 23 bp, Homo sapiens
agcccacccgccccagagactgc

SEQ ID NO: 5195965 - DNA, 15 bp, Homo sapiens
agcccaccctcctgt

SEQ ID NO: 5195966 - DNA, 16 bp, Homo sapiens
agcccaccctcctgtc

SEQ ID NO: 5195967 - DNA, 17 bp, Homo sapiens
agcccaccctcctgtct

SEQ ID NO: 5195968 - DNA, 18 bp, Homo sapiens
agcccaccctcctgtctt

SEQ ID NO: 5195969 - DNA, 21 bp, Homo sapiens
agcccaccctcctgtcttccc

SEQ ID NO: 5195970 - DNA, 23 bp, Homo sapiens
agcccaccctcctgtcttcccag

SEQ ID NO: 5195971 - DNA, 14 bp, Homo sapiens
agcccaccctctgt

SEQ ID NO: 5195972 - DNA, 19 bp, Homo sapiens
agcccaccctctgtgagcc

SEQ ID NO: 5195973 - DNA, 23 bp, Homo sapiens
agcccaccctgcacctcattcca

SEQ ID NO: 5195974 - DNA, 16 bp, Homo sapiens
agcccaccctgctgcc

SEQ ID NO: 5195975 - DNA, 17 bp, Homo sapiens
agcccacctcggccctc

SEQ ID NO: 5195976 - DNA, 23 bp, Homo sapiens
agcccacctcggccctccctgcg

SEQ ID NO: 5195977 - DNA, 14 bp, Homo sapiens
agcccacctgaaag

SEQ ID NO: 5195978 - DNA, 20 bp, Homo sapiens
agcccacctgaaagcctgtc

SEQ ID NO: 5195979 - DNA, 21 bp, Homo sapiens
agcccacctgaaagcctgtct

SEQ ID NO: 5195980 - DNA, 14 bp, Homo sapiens
agcccacctgcacc

SEQ ID NO: 5195981 - DNA, 15 bp, Homo sapiens
agcccacctgcaccc

SEQ ID NO: 5195982 - DNA, 14 bp, Homo sapiens
agcccacctgctcc

SEQ ID NO: 5195983 - DNA, 21 bp, Homo sapiens
agcccacctgctcccaggccc

SEQ ID NO: 5195984 - DNA, 13 bp, Homo sapiens
agcccacctgctg

SEQ ID NO: 5195985 - DNA, 15 bp, Homo sapiens
agcccacctgctgcc

SEQ ID NO: 5195986 - DNA, 22 bp, Homo sapiens
agcccacctgctgcccgtgagg

SEQ ID NO: 5195987 - DNA, 14 bp, Homo sapiens
agcccacctgggct

SEQ ID NO: 5195988 - DNA, 16 bp, Homo sapiens
agcccaccttggctca

SEQ ID NO: 5195989 - DNA, 19 bp, Homo sapiens
agcccacgacactgcagcc

SEQ ID NO: 5195990 - DNA, 14 bp, Homo sapiens
agcccacgccccca

SEQ ID NO: 5195991 - DNA, 19 bp, Homo sapiens
agcccacgcccccactggt

SEQ ID NO: 5195992 - DNA, 20 bp, Homo sapiens
agcccacgcccccactggtg

SEQ ID NO: 5195993 - DNA, 23 bp, Homo sapiens
agcccacgcccgactagcaggca

SEQ ID NO: 5195994 - DNA, 17 bp, Homo sapiens
agcccacggggatcaca

SEQ ID NO: 5195995 - DNA, 20 bp, Homo sapiens
agcccacggggatcacagcg

SEQ ID NO: 5195996 - DNA, 16 bp, Homo sapiens
agcccacggggcaaag

SEQ ID NO: 5195997 - DNA, 22 bp, Homo sapiens
agcccacggggcaaagctgctg

SEQ ID NO: 5195998 - DNA, 23 bp, Homo sapiens
agcccacggggcaaagctgctgg

SEQ ID NO: 5195999 - DNA, 17 bp, Homo sapiens
agcccacggtctggagg

SEQ ID NO: 5196000 - DNA, 16 bp, Homo sapiens
agcccacgtcacgtgt

SEQ ID NO: 5196001 - DNA, 15 bp, Homo sapiens
agcccacgtcctgtc

SEQ ID NO: 5196002 - DNA, 17 bp, Homo sapiens
agcccacgtcctgtcag

SEQ ID NO: 5196003 - DNA, 16 bp, Homo sapiens
agcccactccatctgg

SEQ ID NO: 5196004 - DNA, 12 bp, Homo sapiens
agcccactcccc

SEQ ID NO: 5196005 - DNA, 13 bp, Homo sapiens
agcccactccctg

SEQ ID NO: 5196006 - DNA, 17 bp, Homo sapiens
agcccactccctgccta

SEQ ID NO: 5196007 - DNA, 14 bp, Homo sapiens
agcccactgcctcc

SEQ ID NO: 5196008 - DNA, 18 bp, Homo sapiens
agcccactgcctcctccc

SEQ ID NO: 5196009 - DNA, 14 bp, Homo sapiens
agcccactggatca

SEQ ID NO: 5196010 - DNA, 20 bp, Homo sapiens
agcccactggatcagaaaga

SEQ ID NO: 5196011 - DNA, 16 bp, Homo sapiens
agcccactgggccctg

SEQ ID NO: 5196012 - DNA, 18 bp, Homo sapiens
agcccactgtcctgggcc

SEQ ID NO: 5196013 - DNA, 20 bp, Homo sapiens
agcccactgtcctgggcctg

SEQ ID NO: 5196014 - DNA, 23 bp, Homo sapiens
agcccactgtcctgggcctgcag

SEQ ID NO: 5196015 - DNA, 13 bp, Homo sapiens
agcccactgtgga

SEQ ID NO: 5196016 - DNA, 13 bp, Homo sapiens
agcccacttctgc

SEQ ID NO: 5196017 - DNA, 22 bp, Homo sapiens
agcccacttctgccatattctg

SEQ ID NO: 5196018 - DNA, 19 bp, Homo sapiens
agcccagaaaacctccagt

SEQ ID NO: 5196019 - DNA, 20 bp, Homo sapiens
agcccagaacgggcctcccc

SEQ ID NO: 5196020 - DNA, 13 bp, Homo sapiens
agcccagaaggcc

SEQ ID NO: 5196021 - DNA, 17 bp, Homo sapiens
agcccagaatccccaag

SEQ ID NO: 5196022 - DNA, 15 bp, Homo sapiens
agcccagacacagaa

SEQ ID NO: 5196023 - DNA, 14 bp, Homo sapiens
agcccagactctga

SEQ ID NO: 5196024 - DNA, 22 bp, Homo sapiens
agcccagactttagtgccctgc

SEQ ID NO: 5196025 - DNA, 11 bp, Homo sapiens
agcccagagaa

SEQ ID NO: 5196026 - DNA, 14 bp, Homo sapiens
agcccagagaacag

SEQ ID NO: 5196027 - DNA, 18 bp, Homo sapiens
agcccagagagaccctgc

SEQ ID NO: 5196028 - DNA, 14 bp, Homo sapiens
agcccagagccacc

SEQ ID NO: 5196029 - DNA, 13 bp, Homo sapiens
agcccagagggcc

SEQ ID NO: 5196030 - DNA, 21 bp, Homo sapiens
agcccagagggtctgggggca

SEQ ID NO: 5196031 - DNA, 15 bp, Homo sapiens
agcccagaggtaaca

SEQ ID NO: 5196032 - DNA, 16 bp, Homo sapiens
agcccagaggtaacag

SEQ ID NO: 5196033 - DNA, 17 bp, Homo sapiens
agcccagatcagctcct

SEQ ID NO: 5196034 - DNA, 16 bp, Homo sapiens
agcccagatcccaaga

SEQ ID NO: 5196035 - DNA, 17 bp, Homo sapiens
agcccagatcccaagag

SEQ ID NO: 5196036 - DNA, 20 bp, Homo sapiens
agcccagatggctccctggg

SEQ ID NO: 5196037 - DNA, 12 bp, Homo sapiens
agcccagcacac

SEQ ID NO: 5196038 - DNA, 11 bp, Homo sapiens
agcccagcacc

SEQ ID NO: 5196039 - DNA, 12 bp, Homo sapiens
agcccagcacct

SEQ ID NO: 5196040 - DNA, 24 bp, Homo sapiens
agcccagcactgtgaagacccagc

SEQ ID NO: 5196041 - DNA, 11 bp, Homo sapiens
agcccagcaga

SEQ ID NO: 5196042 - DNA, 20 bp, Homo sapiens
agcccagcagggcctcaaag

SEQ ID NO: 5196043 - DNA, 11 bp, Homo sapiens
agcccagccag

SEQ ID NO: 5196044 - DNA, 15 bp, Homo sapiens
agcccagccagaaag

SEQ ID NO: 5196045 - DNA, 12 bp, Homo sapiens
agcccagccagg

SEQ ID NO: 5196046 - DNA, 20 bp, Homo sapiens
agctgacccggcctctctgc

SEQ ID NO: 5196047 - DNA, 15 bp, Homo sapiens
agctgacctctgttg

SEQ ID NO: 5196048 - DNA, 17 bp, Homo sapiens
agctgacctctgttgtc

SEQ ID NO: 5196049 - DNA, 15 bp, Homo sapiens
agctgacgaggctgg

SEQ ID NO: 5196050 - DNA, 16 bp, Homo sapiens
agctgacgaggctggg

SEQ ID NO: 5196051 - DNA, 19 bp, Homo sapiens
agctgacgaggctgggcca

SEQ ID NO: 5196052 - DNA, 20 bp, Homo sapiens
agctgacgaggctgggccaa

SEQ ID NO: 5196053 - DNA, 18 bp, Homo sapiens
agctgacgccaataataa

SEQ ID NO: 5196054 - DNA, 17 bp, Homo sapiens
agctgacgggaggcccc

SEQ ID NO: 5196055 - DNA, 17 bp, Homo sapiens
agctgacggtttctccc

SEQ ID NO: 5196056 - DNA, 23 bp, Homo sapiens
agctgacggtttctccccggaca

SEQ ID NO: 5196057 - DNA, 15 bp, Homo sapiens
agctgactgaatgca

SEQ ID NO: 5196058 - DNA, 13 bp, Homo sapiens
agctgactgtggc

SEQ ID NO: 5196059 - DNA, 14 bp, Homo sapiens
agctgactgtggcc

SEQ ID NO: 5196060 - DNA, 21 bp, Homo sapiens
agctgactgttggctctctga

SEQ ID NO: 5196061 - DNA, 20 bp, Homo sapiens
agctgactgttttttttgca

SEQ ID NO: 5196062 - DNA, 21 bp, Homo sapiens
agctgactgttttttttgcag

SEQ ID NO: 5196063 - DNA, 16 bp, Homo sapiens
agctgacttggcactt

SEQ ID NO: 5196064 - DNA, 16 bp, Homo sapiens
agctgacttggctggt

SEQ ID NO: 5196065 - DNA, 22 bp, Homo sapiens
agctgacttggctggtgtggta

SEQ ID NO: 5196066 - DNA, 16 bp, Homo sapiens
agctgactttcatttg

SEQ ID NO: 5196067 - DNA, 21 bp, Homo sapiens
agctgacttttctgtccgagc

SEQ ID NO: 5196068 - DNA, 16 bp, Homo sapiens
agctgagaactcctga

SEQ ID NO: 5196069 - DNA, 17 bp, Homo sapiens
agctgagaagaagctga

SEQ ID NO: 5196070 - DNA, 19 bp, Homo sapiens
agctgagaagaagctgagg

SEQ ID NO: 5196071 - DNA, 18 bp, Homo sapiens
agctgagaagaggaggag

SEQ ID NO: 5196072 - DNA, 17 bp, Homo sapiens
agctgagaatagaagga

SEQ ID NO: 5196073 - DNA, 18 bp, Homo sapiens
agctgagaatagaaggaa

SEQ ID NO: 5196074 - DNA, 18 bp, Homo sapiens
agctgagaccctcgccac

SEQ ID NO: 5196075 - DNA, 17 bp, Homo sapiens
agctgagagaccctggc

SEQ ID NO: 5196076 - DNA, 19 bp, Homo sapiens
agctgagagaccctggcct

SEQ ID NO: 5196077 - DNA, 22 bp, Homo sapiens
agctgagagaccctggcctcaa

SEQ ID NO: 5196078 - DNA, 12 bp, Homo sapiens
agctgagaggaa

SEQ ID NO: 5196079 - DNA, 15 bp, Homo sapiens
agctgagaggaagat

SEQ ID NO: 5196080 - DNA, 19 bp, Homo sapiens
agctgagaggaagatgaag

SEQ ID NO: 5196081 - DNA, 16 bp, Homo sapiens
agctgagagtctgaaa

SEQ ID NO: 5196082 - DNA, 17 bp, Homo sapiens
agctgagagtctgaaag

SEQ ID NO: 5196083 - DNA, 23 bp, Homo sapiens
agctgagatgaaccctggcattt

SEQ ID NO: 5196084 - DNA, 17 bp, Homo sapiens
agctgagatggagtcct

SEQ ID NO: 5196085 - DNA, 22 bp, Homo sapiens
agctgagatggagtcctcgact

SEQ ID NO: 5196086 - DNA, 21 bp, Homo sapiens
agctgagcacttagcaggcac

SEQ ID NO: 5196087 - DNA, 17 bp, Homo sapiens
agctgagcagcctctgg

SEQ ID NO: 5196088 - DNA, 16 bp, Homo sapiens
agctgagcaggcccga

SEQ ID NO: 5196089 - DNA, 22 bp, Homo sapiens
agctgagcaggcccgacagaga

SEQ ID NO: 5196090 - DNA, 13 bp, Homo sapiens
agctgagcagggc

SEQ ID NO: 5196091 - DNA, 15 bp, Homo sapiens
agctgagcagggccg

SEQ ID NO: 5196092 - DNA, 13 bp, Homo sapiens
agctgagcatgga

SEQ ID NO: 5196093 - DNA, 21 bp, Homo sapiens
agctgagcatggagacagcag

SEQ ID NO: 5196094 - DNA, 15 bp, Homo sapiens
agctgagccagttgt

SEQ ID NO: 5196095 - DNA, 15 bp, Homo sapiens
agctgagccctgggg

SEQ ID NO: 5196096 - DNA, 16 bp, Homo sapiens
agctgagccctgggga

SEQ ID NO: 5196097 - DNA, 17 bp, Homo sapiens
agctgagccctggggac

SEQ ID NO: 5196098 - DNA, 21 bp, Homo sapiens
agctgagccctggggactgtt

SEQ ID NO: 5196099 - DNA, 21 bp, Homo sapiens
agctgagcctgcagggaagcc

SEQ ID NO: 5196100 - DNA, 23 bp, Homo sapiens
agctgagcctgcagggaagcccc

SEQ ID NO: 5196101 - DNA, 14 bp, Homo sapiens
agctgagcgccagg

SEQ ID NO: 5196102 - DNA, 16 bp, Homo sapiens
agctgagctacctggg

SEQ ID NO: 5196103 - DNA, 22 bp, Homo sapiens
agctgagctcacaaggcagcaa

SEQ ID NO: 5196104 - DNA, 18 bp, Homo sapiens
agctgagctggaaggggc

SEQ ID NO: 5196105 - DNA, 14 bp, Homo sapiens
agctgagctggcct

SEQ ID NO: 5196106 - DNA, 16 bp, Homo sapiens
agctgagcttagctct

SEQ ID NO: 5196107 - DNA, 19 bp, Homo sapiens
agctgaggaacaggttcct

SEQ ID NO: 5196108 - DNA, 16 bp, Homo sapiens
agctgaggaccctcag

SEQ ID NO: 5196109 - DNA, 17 bp, Homo sapiens
agctgaggaccctcagc

SEQ ID NO: 5196110 - DNA, 21 bp, Homo sapiens
agctgaggaccctcagcccca

SEQ ID NO: 5196111 - DNA, 22 bp, Homo sapiens
agctgaggaccctcagccccag

SEQ ID NO: 5196112 - DNA, 16 bp, Homo sapiens
agctgaggactctgca

SEQ ID NO: 5196113 - DNA, 18 bp, Homo sapiens
agctgaggactctgcaag

SEQ ID NO: 5196114 - DNA, 14 bp, Homo sapiens
agctgaggagccct

SEQ ID NO: 5196115 - DNA, 16 bp, Homo sapiens
agctgaggcagcagtg

SEQ ID NO: 5196116 - DNA, 17 bp, Homo sapiens
agctgaggcagcagtgt

SEQ ID NO: 5196117 - DNA, 12 bp, Homo sapiens
agctgaggccca

SEQ ID NO: 5196118 - DNA, 17 bp, Homo sapiens
agctgaggcccatggcc

SEQ ID NO: 5196119 - DNA, 19 bp, Homo sapiens
agctgaggcccatggccac

SEQ ID NO: 5196120 - DNA, 12 bp, Homo sapiens
agctgaggccta

SEQ ID NO: 5196121 - DNA, 18 bp, Homo sapiens
agctgaggctgagaaagc

SEQ ID NO: 5196122 - DNA, 13 bp, Homo sapiens
agctgaggctgct

SEQ ID NO: 5196123 - DNA, 18 bp, Homo sapiens
agctgaggctgctgccag

SEQ ID NO: 5196124 - DNA, 20 bp, Homo sapiens
agctgagggagggagccatg

SEQ ID NO: 5196125 - DNA, 22 bp, Homo sapiens
agctgagggccctgtggagtcc

SEQ ID NO: 5196126 - DNA, 10 bp, Homo sapiens
agctgagggg

SEQ ID NO: 5196127 - DNA, 15 bp, Homo sapiens
agctgaggggacggg

SEQ ID NO: 5196128 - DNA, 16 bp, Homo sapiens
agctgaggggcagggc

SEQ ID NO: 5196129 - DNA, 16 bp, Homo sapiens
agctgaggtgcccagg

SEQ ID NO: 5196130 - DNA, 19 bp, Homo sapiens
agctgaggtgcccaggaga

SEQ ID NO: 5196131 - DNA, 16 bp, Homo sapiens
agctgaggtttcaccc

SEQ ID NO: 5196132 - DNA, 20 bp, Homo sapiens
agctgagtactcaggccact

SEQ ID NO: 5196133 - DNA, 22 bp, Homo sapiens
agctgagtattaaaatgtatgc

SEQ ID NO: 5196134 - DNA, 17 bp, Homo sapiens
agctgagtcacctcctc

SEQ ID NO: 5196135 - DNA, 18 bp, Homo sapiens
agctgagtcacctcctcc

SEQ ID NO: 5196136 - DNA, 19 bp, Homo sapiens
agctgagtcacctcctcca

SEQ ID NO: 5196137 - DNA, 20 bp, Homo sapiens
agctgagtcacctcctccac

SEQ ID NO: 5196138 - DNA, 17 bp, Homo sapiens
agctgagtcggctgggc

SEQ ID NO: 5196139 - DNA, 19 bp, Homo sapiens
agctgagtctgaattctgc

SEQ ID NO: 5196140 - DNA, 15 bp, Homo sapiens
agctgagtgaaaaat

SEQ ID NO: 5196141 - DNA, 13 bp, Homo sapiens
agctgagtggcag

SEQ ID NO: 5196142 - DNA, 14 bp, Homo sapiens
agctgagtggccag

SEQ ID NO: 5196143 - DNA, 17 bp, Homo sapiens
agctgagtggccagcca

SEQ ID NO: 5196144 - DNA, 14 bp, Homo sapiens
agctgagtgggaac

SEQ ID NO: 5196145 - DNA, 20 bp, Homo sapiens
agctgagttccttataagaa

SEQ ID NO: 5196146 - DNA, 21 bp, Homo sapiens
agctgatacaaattgcagact

SEQ ID NO: 5196147 - DNA, 20 bp, Homo sapiens
agctgatacttcatttaaaa

SEQ ID NO: 5196148 - DNA, 21 bp, Homo sapiens
agctgatacttcatttaaaaa

SEQ ID NO: 5196149 - DNA, 21 bp, Homo sapiens
agctgatagaagaaggactga

SEQ ID NO: 5196150 - DNA, 23 bp, Homo sapiens
agctgatagtgtttcgttaagca

SEQ ID NO: 5196151 - DNA, 17 bp, Homo sapiens
agctgatataaattctg

SEQ ID NO: 5196152 - DNA, 19 bp, Homo sapiens
agctgatataaattctgtg

SEQ ID NO: 5196153 - DNA, 21 bp, Homo sapiens
agctgatatgtcagtccctgg

SEQ ID NO: 5196154 - DNA, 18 bp, Homo sapiens
agctgatattatttcttc

SEQ ID NO: 5196155 - DNA, 19 bp, Homo sapiens
agctgatattatttcttct

SEQ ID NO: 5196156 - DNA, 21 bp, Homo sapiens
agctgatattatttcttctct

SEQ ID NO: 5196157 - DNA, 14 bp, Homo sapiens
agctgatcagaatt

SEQ ID NO: 5196158 - DNA, 13 bp, Homo sapiens
agctgatccagag

SEQ ID NO: 5196159 - DNA, 19 bp, Homo sapiens
agctgatccataggactac

SEQ ID NO: 5196160 - DNA, 11 bp, Homo sapiens
agctgatgaaa

SEQ ID NO: 5196161 - DNA, 20 bp, Homo sapiens
agctgatgaacttattctgt

SEQ ID NO: 5196162 - DNA, 15 bp, Homo sapiens
agctgatgatgtctc

SEQ ID NO: 5196163 - DNA, 20 bp, Homo sapiens
agctgatgatgtctcttgta

SEQ ID NO: 5196164 - DNA, 22 bp, Homo sapiens
agctgatgccctataacccctg

SEQ ID NO: 5196165 - DNA, 20 bp, Homo sapiens
agctgatgcctccttggcca

SEQ ID NO: 5196166 - DNA, 22 bp, Homo sapiens
agctgatgcctgaatgtatcct

SEQ ID NO: 5196167 - DNA, 15 bp, Homo sapiens
agctgatggagaagg

SEQ ID NO: 5196168 - DNA, 19 bp, Homo sapiens
agctgatggagaaggaagg

SEQ ID NO: 5196169 - DNA, 13 bp, Homo sapiens
agctgatggcagc

SEQ ID NO: 5196170 - DNA, 15 bp, Homo sapiens
agctgatggcagctg

SEQ ID NO: 5196171 - DNA, 20 bp, Homo sapiens
agctgatgtgttgccacttt

SEQ ID NO: 5196172 - DNA, 21 bp, Homo sapiens
agctgatgttggaagagaaag

SEQ ID NO: 5196173 - DNA, 21 bp, Homo sapiens
agctgattactgtcaataaac

SEQ ID NO: 5196174 - DNA, 18 bp, Homo sapiens
agctgattccagaacaaa

SEQ ID NO: 5196175 - DNA, 15 bp, Homo sapiens
agctgattcccagag

SEQ ID NO: 5196176 - DNA, 19 bp, Homo sapiens
agctgattgcagaaaggag

SEQ ID NO: 5196177 - DNA, 18 bp, Homo sapiens
agctgatttccaggcccc

SEQ ID NO: 5196178 - DNA, 19 bp, Homo sapiens
agctgatttccaggcccct

SEQ ID NO: 5196179 - DNA, 21 bp, Homo sapiens
agctgatttccaggcccctga

SEQ ID NO: 5196180 - DNA, 23 bp, Homo sapiens
agctgatttcccttttttcttcc

SEQ ID NO: 5196181 - DNA, 21 bp, Homo sapiens
agctgatttggtcaccttcct

SEQ ID NO: 5196182 - DNA, 14 bp, Homo sapiens
agctgattttaaca

SEQ ID NO: 5196183 - DNA, 20 bp, Homo sapiens
agctgattttaacaataact

SEQ ID NO: 5196184 - DNA, 18 bp, Homo sapiens
agctgcaaaaataatcat

SEQ ID NO: 5196185 - DNA, 18 bp, Homo sapiens
agctgcaaaaattatata

SEQ ID NO: 5196186 - DNA, 17 bp, Homo sapiens
agctgcaagccagggat

SEQ ID NO: 5196187 - DNA, 18 bp, Homo sapiens
agctgcaagtgacatctc

SEQ ID NO: 5196188 - DNA, 11 bp, Homo sapiens
agctgcacaca

SEQ ID NO: 5196189 - DNA, 20 bp, Homo sapiens
agctgcacacacctgggtgg

SEQ ID NO: 5196190 - DNA, 14 bp, Homo sapiens
agctgcacagcaaa

SEQ ID NO: 5196191 - DNA, 19 bp, Homo sapiens
agctgcacagggcagctgg

SEQ ID NO: 5196192 - DNA, 21 bp, Homo sapiens
agctgcacagggcagctgggc

SEQ ID NO: 5196193 - DNA, 18 bp, Homo sapiens
agctgcaccagcaggtgc

SEQ ID NO: 5196194 - DNA, 23 bp, Homo sapiens
agctgcaccccagcgtcaggcct

SEQ ID NO: 5196195 - DNA, 17 bp, Homo sapiens
agctgcaccctcaggca

SEQ ID NO: 5196196 - DNA, 19 bp, Homo sapiens
agctgcaccctcaggcagg

SEQ ID NO: 5196197 - DNA, 22 bp, Homo sapiens
agctgcacctgccagcctggct

SEQ ID NO: 5196198 - DNA, 11 bp, Homo sapiens
agctgcactga

SEQ ID NO: 5196199 - DNA, 19 bp, Homo sapiens
agctgcacttggcctcagc

SEQ ID NO: 5196200 - DNA, 23 bp, Homo sapiens
agctgcacttggcctcagctggc

SEQ ID NO: 5196201 - DNA, 17 bp, Homo sapiens
agctgcagaaccagtcc

SEQ ID NO: 5196202 - DNA, 19 bp, Homo sapiens
agctgcagagacagagagg

SEQ ID NO: 5196203 - DNA, 17 bp, Homo sapiens
agctgcagagagcacct

SEQ ID NO: 5196204 - DNA, 16 bp, Homo sapiens
agctgcagagatttct

SEQ ID NO: 5196205 - DNA, 13 bp, Homo sapiens
agctgcagagcag

SEQ ID NO: 5196206 - DNA, 14 bp, Homo sapiens
agctgcagagcagc

SEQ ID NO: 5196207 - DNA, 18 bp, Homo sapiens
agctgcagccagtcaggc

SEQ ID NO: 5196208 - DNA, 19 bp, Homo sapiens
agctgcagccagtcaggca

SEQ ID NO: 5196209 - DNA, 21 bp, Homo sapiens
agctgcagccccttgctctca

SEQ ID NO: 5196210 - DNA, 22 bp, Homo sapiens
agctgcagccccttgctctcag

SEQ ID NO: 5196211 - DNA, 14 bp, Homo sapiens
agctgcagcctggc

SEQ ID NO: 5196212 - DNA, 16 bp, Homo sapiens
agctgcagcctggctg

SEQ ID NO: 5196213 - DNA, 17 bp, Homo sapiens
agctgcagcctggctgg

SEQ ID NO: 5196214 - DNA, 19 bp, Homo sapiens
agctgcagcgcctcctgga

SEQ ID NO: 5196215 - DNA, 18 bp, Homo sapiens
agctgcagctgagcctga

SEQ ID NO: 5196216 - DNA, 17 bp, Homo sapiens
agctgcagctgggcccc

SEQ ID NO: 5196217 - DNA, 21 bp, Homo sapiens
agctgcagctgggccccatgc

SEQ ID NO: 5196218 - DNA, 13 bp, Homo sapiens
agctgcagcttgg

SEQ ID NO: 5196219 - DNA, 16 bp, Homo sapiens
agctgcaggaatcaaa

SEQ ID NO: 5196220 - DNA, 17 bp, Homo sapiens
agctgcaggaatcaaaa

SEQ ID NO: 5196221 - DNA, 18 bp, Homo sapiens
agctgcaggcacacacgc

SEQ ID NO: 5196222 - DNA, 19 bp, Homo sapiens
agctgcaggcacacacgcc

SEQ ID NO: 5196223 - DNA, 20 bp, Homo sapiens
agcccagccaggccaacagc

SEQ ID NO: 5196224 - DNA, 15 bp, Homo sapiens
agcccagcccagctg

SEQ ID NO: 5196225 - DNA, 18 bp, Homo sapiens
agcccagcccagctgctc

SEQ ID NO: 5196226 - DNA, 14 bp, Homo sapiens
agcccagccccgcc

SEQ ID NO: 5196227 - DNA, 17 bp, Homo sapiens
agcccagcccctactgc

SEQ ID NO: 5196228 - DNA, 20 bp, Homo sapiens
agcccagcccctactgctgt

SEQ ID NO: 5196229 - DNA, 12 bp, Homo sapiens
agcccagcccgg

SEQ ID NO: 5196230 - DNA, 16 bp, Homo sapiens
agcccagccctgttct

SEQ ID NO: 5196231 - DNA, 17 bp, Homo sapiens
agcccagccctgttctg

SEQ ID NO: 5196232 - DNA, 21 bp, Homo sapiens
agcccagcctctgtccctctt

SEQ ID NO: 5196233 - DNA, 12 bp, Homo sapiens
agcccagcctgc

SEQ ID NO: 5196234 - DNA, 13 bp, Homo sapiens
agcccagcctgcc

SEQ ID NO: 5196235 - DNA, 20 bp, Homo sapiens
agcccagcctgccccctatc

SEQ ID NO: 5196236 - DNA, 13 bp, Homo sapiens
agcccagcctggg

SEQ ID NO: 5196237 - DNA, 15 bp, Homo sapiens
agcccagcggcccaa

SEQ ID NO: 5196238 - DNA, 17 bp, Homo sapiens
agcccagcggcccaaga

SEQ ID NO: 5196239 - DNA, 15 bp, Homo sapiens
agcccagctacattc

SEQ ID NO: 5196240 - DNA, 20 bp, Homo sapiens
agcccagctacattcctcag

SEQ ID NO: 5196241 - DNA, 18 bp, Homo sapiens
agcccagctccactcagg

SEQ ID NO: 5196242 - DNA, 19 bp, Homo sapiens
agcccagctccactcaggg

SEQ ID NO: 5196243 - DNA, 22 bp, Homo sapiens
agcccagctccactcagggctg

SEQ ID NO: 5196244 - DNA, 23 bp, Homo sapiens
agcccagctccactcagggctgg

SEQ ID NO: 5196245 - DNA, 15 bp, Homo sapiens
agcccagctccaggg

SEQ ID NO: 5196246 - DNA, 13 bp, Homo sapiens
agcccagctctgg

SEQ ID NO: 5196247 - DNA, 13 bp, Homo sapiens
agcccagctgcct

SEQ ID NO: 5196248 - DNA, 16 bp, Homo sapiens
agcccagctgcctgga

SEQ ID NO: 5196249 - DNA, 12 bp, Homo sapiens
agcccagctgct

SEQ ID NO: 5196250 - DNA, 14 bp, Homo sapiens
agcccagctgctct

SEQ ID NO: 5196251 - DNA, 15 bp, Homo sapiens
agcccagctgctctg

SEQ ID NO: 5196252 - DNA, 16 bp, Homo sapiens
agcccagctgctctgc

SEQ ID NO: 5196253 - DNA, 18 bp, Homo sapiens
agcccagctgctctgccc

SEQ ID NO: 5196254 - DNA, 19 bp, Homo sapiens
agcccagctgctctgccca

SEQ ID NO: 5196255 - DNA, 21 bp, Homo sapiens
agcccagctgctctgcccaga

SEQ ID NO: 5196256 - DNA, 23 bp, Homo sapiens
agcccagctgctctgcccagagc

SEQ ID NO: 5196257 - DNA, 12 bp, Homo sapiens
agcccagctggc

SEQ ID NO: 5196258 - DNA, 14 bp, Homo sapiens
agcccagctggcca

SEQ ID NO: 5196259 - DNA, 17 bp, Homo sapiens
agcccagctggccacct

SEQ ID NO: 5196260 - DNA, 19 bp, Homo sapiens
agcccagctggccacctag

SEQ ID NO: 5196261 - DNA, 15 bp, Homo sapiens
agcccagctgggtca

SEQ ID NO: 5196262 - DNA, 16 bp, Homo sapiens
agcccagctgggtcag

SEQ ID NO: 5196263 - DNA, 19 bp, Homo sapiens
agcccagctgggtcaggca

SEQ ID NO: 5196264 - DNA, 21 bp, Homo sapiens
agcccagcttggccctttcct

SEQ ID NO: 5196265 - DNA, 20 bp, Homo sapiens
agcccaggaattctcacagg

SEQ ID NO: 5196266 - DNA, 15 bp, Homo sapiens
agcccaggacactgc

SEQ ID NO: 5196267 - DNA, 16 bp, Homo sapiens
agcccaggacactgcc

SEQ ID NO: 5196268 - DNA, 21 bp, Homo sapiens
agcccaggacactgcctttgc

SEQ ID NO: 5196269 - DNA, 21 bp, Homo sapiens
agcccaggagcaacagcctaa

SEQ ID NO: 5196270 - DNA, 15 bp, Homo sapiens
agcccaggagcccat

SEQ ID NO: 5196271 - DNA, 16 bp, Homo sapiens
agcccaggagcccatt

SEQ ID NO: 5196272 - DNA, 15 bp, Homo sapiens
agcccaggagcctca

SEQ ID NO: 5196273 - DNA, 20 bp, Homo sapiens
agcccaggagggagcagagg

SEQ ID NO: 5196274 - DNA, 14 bp, Homo sapiens
agcccaggcaatag

SEQ ID NO: 5196275 - DNA, 13 bp, Homo sapiens
agcccaggcacaa

SEQ ID NO: 5196276 - DNA, 20 bp, Homo sapiens
agcccaggccagagtgcagt

SEQ ID NO: 5196277 - DNA, 20 bp, Homo sapiens
agcccaggccaggactctgc

SEQ ID NO: 5196278 - DNA, 22 bp, Homo sapiens
agcccaggccggggtggagcat

SEQ ID NO: 5196279 - DNA, 14 bp, Homo sapiens
agcccaggcctcct

SEQ ID NO: 5196280 - DNA, 13 bp, Homo sapiens
agcccaggcctgc

SEQ ID NO: 5196281 - DNA, 12 bp, Homo sapiens
agcccaggctcg

SEQ ID NO: 5196282 - DNA, 20 bp, Homo sapiens
agcccaggctcggcctgccc

SEQ ID NO: 5196283 - DNA, 16 bp, Homo sapiens
agcccaggctgaagag

SEQ ID NO: 5196284 - DNA, 23 bp, Homo sapiens
agcccaggctggagatcctaact

SEQ ID NO: 5196285 - DNA, 20 bp, Homo sapiens
agcccagggcaccatccagc

SEQ ID NO: 5196286 - DNA, 15 bp, Homo sapiens
agcccagggcctgca

SEQ ID NO: 5196287 - DNA, 15 bp, Homo sapiens
agcccagggctcctg

SEQ ID NO: 5196288 - DNA, 21 bp, Homo sapiens
agcccaggggaatgtattttt

SEQ ID NO: 5196289 - DNA, 22 bp, Homo sapiens
agcccaggggagaatgcagccc

SEQ ID NO: 5196290 - DNA, 13 bp, Homo sapiens
agcccaggggccg

SEQ ID NO: 5196291 - DNA, 10 bp, Homo sapiens
agcccagggt

SEQ ID NO: 5196292 - DNA, 13 bp, Homo sapiens
agcccagggtgct

SEQ ID NO: 5196293 - DNA, 16 bp, Homo sapiens
agcccagggttccccc

SEQ ID NO: 5196294 - DNA, 17 bp, Homo sapiens
agcccagggttccccca

SEQ ID NO: 5196295 - DNA, 21 bp, Homo sapiens
agcccagggttcccccagccc

SEQ ID NO: 5196296 - DNA, 17 bp, Homo sapiens
agcccaggtcccagtgc

SEQ ID NO: 5196297 - DNA, 14 bp, Homo sapiens
agcccaggtcctcc

SEQ ID NO: 5196298 - DNA, 23 bp, Homo sapiens
agcccagtaactgccctttccct

SEQ ID NO: 5196299 - DNA, 18 bp, Homo sapiens
agcccagtagaccttgtt

SEQ ID NO: 5196300 - DNA, 23 bp, Homo sapiens
agcccagtagccattttgtaact

SEQ ID NO: 5196301 - DNA, 21 bp, Homo sapiens
agcccagtccctggagctgtc

SEQ ID NO: 5196302 - DNA, 14 bp, Homo sapiens
agcccagtgaagcc

SEQ ID NO: 5196303 - DNA, 18 bp, Homo sapiens
agcccagtgaagcctctg

SEQ ID NO: 5196304 - DNA, 18 bp, Homo sapiens
agcccagtgctgctgtaa

SEQ ID NO: 5196305 - DNA, 14 bp, Homo sapiens
agcccagtggtgag

SEQ ID NO: 5196306 - DNA, 14 bp, Homo sapiens
agcccagtgttttc

SEQ ID NO: 5196307 - DNA, 21 bp, Homo sapiens
agcccagttcccgtgacgagg

SEQ ID NO: 5196308 - DNA, 17 bp, Homo sapiens
agcccagttggaaaatt

SEQ ID NO: 5196309 - DNA, 14 bp, Homo sapiens
agcccagtttccct

SEQ ID NO: 5196310 - DNA, 16 bp, Homo sapiens
agcccagtttcccttc

SEQ ID NO: 5196311 - DNA, 23 bp, Homo sapiens
agcccagtttcccttctatgcag

SEQ ID NO: 5196312 - DNA, 19 bp, Homo sapiens
agcccataaagtctgagaa

SEQ ID NO: 5196313 - DNA, 20 bp, Homo sapiens
agcccatactcagcctgctg

SEQ ID NO: 5196314 - DNA, 19 bp, Homo sapiens
agcccatatctacagtact

SEQ ID NO: 5196315 - DNA, 14 bp, Homo sapiens
agcccatatgctac

SEQ ID NO: 5196316 - DNA, 21 bp, Homo sapiens
agcccatatgctaccaccagc

SEQ ID NO: 5196317 - DNA, 16 bp, Homo sapiens
agcccatccatagtaa

SEQ ID NO: 5196318 - DNA, 20 bp, Homo sapiens
agcccatccattaggccagc

SEQ ID NO: 5196319 - DNA, 15 bp, Homo sapiens
agcccatccctgcct

SEQ ID NO: 5196320 - DNA, 14 bp, Homo sapiens
agcccatcctctcg

SEQ ID NO: 5196321 - DNA, 17 bp, Homo sapiens
agcccatcctgaccagc

SEQ ID NO: 5196322 - DNA, 19 bp, Homo sapiens
agcccatcgccacaaactc

SEQ ID NO: 5196323 - DNA, 21 bp, Homo sapiens
agcccatctctccagagagca

SEQ ID NO: 5196324 - DNA, 22 bp, Homo sapiens
agcccatgcccacctgcccatc

SEQ ID NO: 5196325 - DNA, 16 bp, Homo sapiens
agcccatgctggctgg

SEQ ID NO: 5196326 - DNA, 17 bp, Homo sapiens
agcccatggaggcagat

SEQ ID NO: 5196327 - DNA, 23 bp, Homo sapiens
agcccatggaggcagatgccctt

SEQ ID NO: 5196328 - DNA, 18 bp, Homo sapiens
agcccatggcactctatg

SEQ ID NO: 5196329 - DNA, 13 bp, Homo sapiens
agcccatggcccc

SEQ ID NO: 5196330 - DNA, 18 bp, Homo sapiens
agcccatggcccccaata

SEQ ID NO: 5196331 - DNA, 16 bp, Homo sapiens
agcccatggcctctgg

SEQ ID NO: 5196332 - DNA, 13 bp, Homo sapiens
agcccatgtcttc

SEQ ID NO: 5196333 - DNA, 16 bp, Homo sapiens
agcccatgtcttctgc

SEQ ID NO: 5196334 - DNA, 21 bp, Homo sapiens
agcccatgtcttctgctgttc

SEQ ID NO: 5196335 - DNA, 16 bp, Homo sapiens
agcccatgttctgccc

SEQ ID NO: 5196336 - DNA, 21 bp, Homo sapiens
agcccatgttctgcccccagc

SEQ ID NO: 5196337 - DNA, 23 bp, Homo sapiens
agcccattcattccattctggaa

SEQ ID NO: 5196338 - DNA, 17 bp, Homo sapiens
agcccattctctctcct

SEQ ID NO: 5196339 - DNA, 18 bp, Homo sapiens
agcccattctctctcctg

SEQ ID NO: 5196340 - DNA, 19 bp, Homo sapiens
agcccattctctctcctgt

SEQ ID NO: 5196341 - DNA, 20 bp, Homo sapiens
agcccattctctctcctgtc

SEQ ID NO: 5196342 - DNA, 14 bp, Homo sapiens
agcccattcttctg

SEQ ID NO: 5196343 - DNA, 15 bp, Homo sapiens
agcccattcttctgg

SEQ ID NO: 5196344 - DNA, 15 bp, Homo sapiens
agcccattgaagaag

SEQ ID NO: 5196345 - DNA, 15 bp, Homo sapiens
agcccattgctgcca

SEQ ID NO: 5196346 - DNA, 16 bp, Homo sapiens
agcccattgctgccaa

SEQ ID NO: 5196347 - DNA, 22 bp, Homo sapiens
agcccattggccgagctcctgg

SEQ ID NO: 5196348 - DNA, 23 bp, Homo sapiens
agcccattggccgagctcctggg

SEQ ID NO: 5196349 - DNA, 21 bp, Homo sapiens
agcccattgtggaggcggtgg

SEQ ID NO: 5196350 - DNA, 13 bp, Homo sapiens
agcccatttcaat

SEQ ID NO: 5196351 - DNA, 17 bp, Homo sapiens
agccccaaaactctcct

SEQ ID NO: 5196352 - DNA, 18 bp, Homo sapiens
agccccaaaactctcctc

SEQ ID NO: 5196353 - DNA, 22 bp, Homo sapiens
agccccaaaactctcctctgct

SEQ ID NO: 5196354 - DNA, 24 bp, Homo sapiens
agccccaaaactctcctctgctgc

SEQ ID NO: 5196355 - DNA, 18 bp, Homo sapiens
agccccaaaccagggtgc

SEQ ID NO: 5196356 - DNA, 11 bp, Homo sapiens
agccccaaaga

SEQ ID NO: 5196357 - DNA, 18 bp, Homo sapiens
agccccaagcttctgagt

SEQ ID NO: 5196358 - DNA, 15 bp, Homo sapiens
agccccaagggctgg

SEQ ID NO: 5196359 - DNA, 23 bp, Homo sapiens
agccccaagggctggggcggagc

SEQ ID NO: 5196360 - DNA, 14 bp, Homo sapiens
agccccaaggggtg

SEQ ID NO: 5196361 - DNA, 22 bp, Homo sapiens
agccccacaccagggccagcct

SEQ ID NO: 5196362 - DNA, 15 bp, Homo sapiens
agccccacacggagg

SEQ ID NO: 5196363 - DNA, 20 bp, Homo sapiens
agccccacagagcaggaagc

SEQ ID NO: 5196364 - DNA, 12 bp, Homo sapiens
agccccacagca

SEQ ID NO: 5196365 - DNA, 15 bp, Homo sapiens
agccccacagcaccc

SEQ ID NO: 5196366 - DNA, 20 bp, Homo sapiens
agccccacagcacccaggct

SEQ ID NO: 5196367 - DNA, 14 bp, Homo sapiens
agccccacagccca

SEQ ID NO: 5196368 - DNA, 20 bp, Homo sapiens
agccccacagcccacgtcct

SEQ ID NO: 5196369 - DNA, 24 bp, Homo sapiens
agccccacagtcccattcctccac

SEQ ID NO: 5196370 - DNA, 17 bp, Homo sapiens
agccccacagtggaatt

SEQ ID NO: 5196371 - DNA, 17 bp, Homo sapiens
agccccacatgtccagc

SEQ ID NO: 5196372 - DNA, 12 bp, Homo sapiens
agccccacccag

SEQ ID NO: 5196373 - DNA, 15 bp, Homo sapiens
agccccacccagagg

SEQ ID NO: 5196374 - DNA, 17 bp, Homo sapiens
agccccaccccaccctg

SEQ ID NO: 5196375 - DNA, 18 bp, Homo sapiens
agccccaccccagggcag

SEQ ID NO: 5196376 - DNA, 22 bp, Homo sapiens
agccccaccccagggcagccag

SEQ ID NO: 5196377 - DNA, 18 bp, Homo sapiens
agccccacccccagccag

SEQ ID NO: 5196378 - DNA, 17 bp, Homo sapiens
agccccaccctggccta

SEQ ID NO: 5196379 - DNA, 12 bp, Homo sapiens
agccccaccctt

SEQ ID NO: 5196380 - DNA, 17 bp, Homo sapiens
agccccacgtggagctc

SEQ ID NO: 5196381 - DNA, 17 bp, Homo sapiens
agccccactctcagagg

SEQ ID NO: 5196382 - DNA, 19 bp, Homo sapiens
agccccactctcagaggcc

SEQ ID NO: 5196383 - DNA, 14 bp, Homo sapiens
agccccactgccag

SEQ ID NO: 5196384 - DNA, 15 bp, Homo sapiens
agccccactgccagc

SEQ ID NO: 5196385 - DNA, 20 bp, Homo sapiens
agccccactgccctccaggg

SEQ ID NO: 5196386 - DNA, 14 bp, Homo sapiens
agccccacttctgg

SEQ ID NO: 5196387 - DNA, 17 bp, Homo sapiens
agccccagaaaatgaaa

SEQ ID NO: 5196388 - DNA, 23 bp, Homo sapiens
agccccagaaccccaactcccag

SEQ ID NO: 5196389 - DNA, 19 bp, Homo sapiens
agccccagacaacagccca

SEQ ID NO: 5196390 - DNA, 17 bp, Homo sapiens
agccccagacctgccgc

SEQ ID NO: 5196391 - DNA, 21 bp, Homo sapiens
agccccagactgggcccaggc

SEQ ID NO: 5196392 - DNA, 14 bp, Homo sapiens
agccccagagatgc

SEQ ID NO: 5196393 - DNA, 22 bp, Homo sapiens
agccccagagatgccagccctt

SEQ ID NO: 5196394 - DNA, 17 bp, Homo sapiens
agccccagagtgcttta

SEQ ID NO: 5196395 - DNA, 23 bp, Homo sapiens
agccccagagtgctttaaaaaat

SEQ ID NO: 5196396 - DNA, 20 bp, Homo sapiens
agccccagcagccctcaaca

SEQ ID NO: 5196397 - DNA, 13 bp, Homo sapiens
agccccagccagc

SEQ ID NO: 5196398 - DNA, 14 bp, Homo sapiens
agccccagccagcc

SEQ ID NO: 5196399 - DNA, 15 bp, Homo sapiens
agccccagccagccc

SEQ ID NO: 5196400 - DNA, 11 bp, Homo sapiens
agccccagccc

SEQ ID NO: 5196401 - DNA, 15 bp, Homo sapiens
agccccagcccagcc

SEQ ID NO: 5196402 - DNA, 23 bp, Homo sapiens
agctgcaggcacacacgccttca

SEQ ID NO: 5196403 - DNA, 21 bp, Homo sapiens
agctgcaggcgctctcctcct

SEQ ID NO: 5196404 - DNA, 19 bp, Homo sapiens
agctgcagggaattttcat

SEQ ID NO: 5196405 - DNA, 14 bp, Homo sapiens
agctgcagggcacg

SEQ ID NO: 5196406 - DNA, 23 bp, Homo sapiens
agctgcagggcacggggacctgg

SEQ ID NO: 5196407 - DNA, 22 bp, Homo sapiens
agctgcaggggcaggagaggct

SEQ ID NO: 5196408 - DNA, 20 bp, Homo sapiens
agctgcaggtgccagggccc

SEQ ID NO: 5196409 - DNA, 17 bp, Homo sapiens
agctgcaggtttgtaat

SEQ ID NO: 5196410 - DNA, 19 bp, Homo sapiens
agctgcagttgtgaaagca

SEQ ID NO: 5196411 - DNA, 23 bp, Homo sapiens
agctgcatcatccttgcaggtgg

SEQ ID NO: 5196412 - DNA, 21 bp, Homo sapiens
agctgcatcctccaagaatct

SEQ ID NO: 5196413 - DNA, 22 bp, Homo sapiens
agctgcatcctccaagaatcta

SEQ ID NO: 5196414 - DNA, 23 bp, Homo sapiens
agctgcatctataatgtcagctt

SEQ ID NO: 5196415 - DNA, 15 bp, Homo sapiens
agctgcatctgataa

SEQ ID NO: 5196416 - DNA, 14 bp, Homo sapiens
agctgcatctgtct

SEQ ID NO: 5196417 - DNA, 17 bp, Homo sapiens
agctgcatctgttactt

SEQ ID NO: 5196418 - DNA, 19 bp, Homo sapiens
agctgcatggacgcctggc

SEQ ID NO: 5196419 - DNA, 17 bp, Homo sapiens
agctgcatggagcctgg

SEQ ID NO: 5196420 - DNA, 20 bp, Homo sapiens
agctgcatgttaagtgccat

SEQ ID NO: 5196421 - DNA, 17 bp, Homo sapiens
agctgccaaaaagaaca

SEQ ID NO: 5196422 - DNA, 14 bp, Homo sapiens
agctgccaagagtg

SEQ ID NO: 5196423 - DNA, 17 bp, Homo sapiens
agctgccaagtctattt

SEQ ID NO: 5196424 - DNA, 17 bp, Homo sapiens
agctgccacccctcttc

SEQ ID NO: 5196425 - DNA, 21 bp, Homo sapiens
agctgccacccctcttctgct

SEQ ID NO: 5196426 - DNA, 23 bp, Homo sapiens
agctgccacctctccatcctgct

SEQ ID NO: 5196427 - DNA, 15 bp, Homo sapiens
agctgccactgggca

SEQ ID NO: 5196428 - DNA, 12 bp, Homo sapiens
agctgccagaga

SEQ ID NO: 5196429 - DNA, 14 bp, Homo sapiens
agctgccagagaag

SEQ ID NO: 5196430 - DNA, 11 bp, Homo sapiens
agctgccagca

SEQ ID NO: 5196431 - DNA, 15 bp, Homo sapiens
agctgccagcccaga

SEQ ID NO: 5196432 - DNA, 16 bp, Homo sapiens
agctgccagcccagaa

SEQ ID NO: 5196433 - DNA, 17 bp, Homo sapiens
agctgccagcccagaac

SEQ ID NO: 5196434 - DNA, 18 bp, Homo sapiens
agctgccagcccagaaca

SEQ ID NO: 5196435 - DNA, 14 bp, Homo sapiens
agctgccagccgag

SEQ ID NO: 5196436 - DNA, 14 bp, Homo sapiens
agctgccaggcggc

SEQ ID NO: 5196437 - DNA, 15 bp, Homo sapiens
agctgccagtgtcct

SEQ ID NO: 5196438 - DNA, 24 bp, Homo sapiens
agctgccagtgtcctgagccccag

SEQ ID NO: 5196439 - DNA, 17 bp, Homo sapiens
agctgccatccagggat

SEQ ID NO: 5196440 - DNA, 20 bp, Homo sapiens
agctgccatcttgcttttct

SEQ ID NO: 5196441 - DNA, 14 bp, Homo sapiens
agctgccatggcta

SEQ ID NO: 5196442 - DNA, 19 bp, Homo sapiens
agctgcccaatttcacaga

SEQ ID NO: 5196443 - DNA, 20 bp, Homo sapiens
agctgcccaatttcacagag

SEQ ID NO: 5196444 - DNA, 15 bp, Homo sapiens
agctgcccagacaca

SEQ ID NO: 5196445 - DNA, 13 bp, Homo sapiens
agctgcccagccc

SEQ ID NO: 5196446 - DNA, 19 bp, Homo sapiens
agctgcccagcccctcctc

SEQ ID NO: 5196447 - DNA, 20 bp, Homo sapiens
agctgcccagcccctcctcc

SEQ ID NO: 5196448 - DNA, 18 bp, Homo sapiens
agctgcccagccctggcc

SEQ ID NO: 5196449 - DNA, 21 bp, Homo sapiens
agctgcccagccctggcccag

SEQ ID NO: 5196450 - DNA, 22 bp, Homo sapiens
agctgcccagccctggcccagg

SEQ ID NO: 5196451 - DNA, 19 bp, Homo sapiens
agctgcccatcccagtccc

SEQ ID NO: 5196452 - DNA, 22 bp, Homo sapiens
agctgcccatttcgtgagcccc

SEQ ID NO: 5196453 - DNA, 16 bp, Homo sapiens
agctgccccaatgtga

SEQ ID NO: 5196454 - DNA, 14 bp, Homo sapiens
agctgccccagcca

SEQ ID NO: 5196455 - DNA, 20 bp, Homo sapiens
agctgcccccagagccacag

SEQ ID NO: 5196456 - DNA, 18 bp, Homo sapiens
agctgcccccgctcatgg

SEQ ID NO: 5196457 - DNA, 17 bp, Homo sapiens
agctgccccggcccctc

SEQ ID NO: 5196458 - DNA, 22 bp, Homo sapiens
agctgcccctccctcagggagc

SEQ ID NO: 5196459 - DNA, 13 bp, Homo sapiens
agctgcccctcct

SEQ ID NO: 5196460 - DNA, 14 bp, Homo sapiens
agctgcccctcctg

SEQ ID NO: 5196461 - DNA, 22 bp, Homo sapiens
agctgcccctcctggagcagaa

SEQ ID NO: 5196462 - DNA, 16 bp, Homo sapiens
agctgcccctgctgct

SEQ ID NO: 5196463 - DNA, 14 bp, Homo sapiens
agctgcccctggca

SEQ ID NO: 5196464 - DNA, 17 bp, Homo sapiens
agctgcccctggcacct

SEQ ID NO: 5196465 - DNA, 21 bp, Homo sapiens
agctgcccctggcacctgtgt

SEQ ID NO: 5196466 - DNA, 15 bp, Homo sapiens
agctgcccggcgcct

SEQ ID NO: 5196467 - DNA, 10 bp, Homo sapiens
agctgcccta

SEQ ID NO: 5196468 - DNA, 19 bp, Homo sapiens
agctgccctagctgacccc

SEQ ID NO: 5196469 - DNA, 18 bp, Homo sapiens
agctgccctatgggcctg

SEQ ID NO: 5196470 - DNA, 19 bp, Homo sapiens
agctgccctatgggcctgc

SEQ ID NO: 5196471 - DNA, 21 bp, Homo sapiens
agctgccctatgggcctgccg

SEQ ID NO: 5196472 - DNA, 18 bp, Homo sapiens
agctgccctctcctgggc

SEQ ID NO: 5196473 - DNA, 21 bp, Homo sapiens
agctgccctctcctgggcagc

SEQ ID NO: 5196474 - DNA, 15 bp, Homo sapiens
agctgccctgctgcc

SEQ ID NO: 5196475 - DNA, 18 bp, Homo sapiens
agctgccctgctgccaca

SEQ ID NO: 5196476 - DNA, 14 bp, Homo sapiens
agctgccctggctg

SEQ ID NO: 5196477 - DNA, 15 bp, Homo sapiens
agctgcccttccgca

SEQ ID NO: 5196478 - DNA, 13 bp, Homo sapiens
agctgcccttgca

SEQ ID NO: 5196479 - DNA, 20 bp, Homo sapiens
agctgcccttgcagggtggg

SEQ ID NO: 5196480 - DNA, 19 bp, Homo sapiens
agctgccgcaaggccctgt

SEQ ID NO: 5196481 - DNA, 23 bp, Homo sapiens
agctgccgcaaggccctgtccca

SEQ ID NO: 5196482 - DNA, 17 bp, Homo sapiens
agctgccggcagtgctg

SEQ ID NO: 5196483 - DNA, 21 bp, Homo sapiens
agctgcctagattcagggaaa

SEQ ID NO: 5196484 - DNA, 19 bp, Homo sapiens
agctgcctagcaagctggc

SEQ ID NO: 5196485 - DNA, 20 bp, Homo sapiens
agctgcctagcaagctggcc

SEQ ID NO: 5196486 - DNA, 21 bp, Homo sapiens
agctgcctagcaagctggcct

SEQ ID NO: 5196487 - DNA, 19 bp, Homo sapiens
agctgcctatgcccagcct

SEQ ID NO: 5196488 - DNA, 13 bp, Homo sapiens
agctgcctccagc

SEQ ID NO: 5196489 - DNA, 17 bp, Homo sapiens
agctgcctccagcctgg

SEQ ID NO: 5196490 - DNA, 18 bp, Homo sapiens
agctgcctccagcctggt

SEQ ID NO: 5196491 - DNA, 14 bp, Homo sapiens
agctgcctccccaa

SEQ ID NO: 5196492 - DNA, 21 bp, Homo sapiens
agctgcctcccctcctctgct

SEQ ID NO: 5196493 - DNA, 19 bp, Homo sapiens
agctgcctccgggcctcgg

SEQ ID NO: 5196494 - DNA, 16 bp, Homo sapiens
agctgcctctgacagc

SEQ ID NO: 5196495 - DNA, 19 bp, Homo sapiens
agctgcctctgacagcagc

SEQ ID NO: 5196496 - DNA, 19 bp, Homo sapiens
agctgcctctgccactgac

SEQ ID NO: 5196497 - DNA, 20 bp, Homo sapiens
agctgcctctgctccctctg

SEQ ID NO: 5196498 - DNA, 14 bp, Homo sapiens
agctgcctcttctg

SEQ ID NO: 5196499 - DNA, 16 bp, Homo sapiens
agctgcctcttctgtg

SEQ ID NO: 5196500 - DNA, 20 bp, Homo sapiens
agctgcctctttgctgcttt

SEQ ID NO: 5196501 - DNA, 17 bp, Homo sapiens
agctgcctgaaaatcaa

SEQ ID NO: 5196502 - DNA, 12 bp, Homo sapiens
agctgcctgcag

SEQ ID NO: 5196503 - DNA, 19 bp, Homo sapiens
agctgcctgcagcacatgc

SEQ ID NO: 5196504 - DNA, 18 bp, Homo sapiens
agctgcctgcttggcccg

SEQ ID NO: 5196505 - DNA, 20 bp, Homo sapiens
agctgcctgcttggcccggc

SEQ ID NO: 5196506 - DNA, 23 bp, Homo sapiens
agctgcctgcttttcactgctgc

SEQ ID NO: 5196507 - DNA, 10 bp, Homo sapiens
agctgcctgg

SEQ ID NO: 5196508 - DNA, 20 bp, Homo sapiens
agctgcctggaagagcagcc

SEQ ID NO: 5196509 - DNA, 14 bp, Homo sapiens
agctgcctggaccc

SEQ ID NO: 5196510 - DNA, 20 bp, Homo sapiens
agctgcctggagagggtctc

SEQ ID NO: 5196511 - DNA, 15 bp, Homo sapiens
agctgcctggatgag

SEQ ID NO: 5196512 - DNA, 11 bp, Homo sapiens
agctgcctggc

SEQ ID NO: 5196513 - DNA, 16 bp, Homo sapiens
agctgcctggccatgc

SEQ ID NO: 5196514 - DNA, 18 bp, Homo sapiens
agctgcctggccatgctg

SEQ ID NO: 5196515 - DNA, 13 bp, Homo sapiens
agctgcctgggat

SEQ ID NO: 5196516 - DNA, 21 bp, Homo sapiens
agctgcctgggatccctcatc

SEQ ID NO: 5196517 - DNA, 14 bp, Homo sapiens
agctgcctgggccc

SEQ ID NO: 5196518 - DNA, 14 bp, Homo sapiens
agctgcctgtagtt

SEQ ID NO: 5196519 - DNA, 12 bp, Homo sapiens
agctgcctgtgc

SEQ ID NO: 5196520 - DNA, 21 bp, Homo sapiens
agctgcctgttcagctccagc

SEQ ID NO: 5196521 - DNA, 22 bp, Homo sapiens
agctgcctgttcagctccagct

SEQ ID NO: 5196522 - DNA, 22 bp, Homo sapiens
agctgccttagcttcaggaacc

SEQ ID NO: 5196523 - DNA, 10 bp, Homo sapiens
agctgccttc

SEQ ID NO: 5196524 - DNA, 14 bp, Homo sapiens
agctgccttcaagg

SEQ ID NO: 5196525 - DNA, 18 bp, Homo sapiens
agctgccttcaaggactg

SEQ ID NO: 5196526 - DNA, 14 bp, Homo sapiens
agctgccttcccta

SEQ ID NO: 5196527 - DNA, 18 bp, Homo sapiens
agctgccttccctagctt

SEQ ID NO: 5196528 - DNA, 19 bp, Homo sapiens
agctgccttccctagcttt

SEQ ID NO: 5196529 - DNA, 18 bp, Homo sapiens
agctgccttcctcatccc

SEQ ID NO: 5196530 - DNA, 15 bp, Homo sapiens
agctgccttcctggg

SEQ ID NO: 5196531 - DNA, 18 bp, Homo sapiens
agctgccttcctggggct

SEQ ID NO: 5196532 - DNA, 14 bp, Homo sapiens
agctgccttggctc

SEQ ID NO: 5196533 - DNA, 15 bp, Homo sapiens
agctgcgcccccttc

SEQ ID NO: 5196534 - DNA, 17 bp, Homo sapiens
agctgcgcttgcttttc

SEQ ID NO: 5196535 - DNA, 21 bp, Homo sapiens
agctgcggccaggcctgcggg

SEQ ID NO: 5196536 - DNA, 17 bp, Homo sapiens
agctgcgggctgagggc

SEQ ID NO: 5196537 - DNA, 23 bp, Homo sapiens
agctgcgggctgagggcatctct

SEQ ID NO: 5196538 - DNA, 22 bp, Homo sapiens
agctgcgggggcaggccgggcc

SEQ ID NO: 5196539 - DNA, 17 bp, Homo sapiens
agctgcggtccacccag

SEQ ID NO: 5196540 - DNA, 19 bp, Homo sapiens
agctgcggtccacccagga

SEQ ID NO: 5196541 - DNA, 23 bp, Homo sapiens
agctgcggtccacccaggagccc

SEQ ID NO: 5196542 - DNA, 23 bp, Homo sapiens
agctgcgtttattaatgcctctc

SEQ ID NO: 5196543 - DNA, 18 bp, Homo sapiens
agctgctaaaataaacct

SEQ ID NO: 5196544 - DNA, 13 bp, Homo sapiens
agctgctaaatct

SEQ ID NO: 5196545 - DNA, 14 bp, Homo sapiens
agctgctaaatctc

SEQ ID NO: 5196546 - DNA, 15 bp, Homo sapiens
agctgctaaatctcc

SEQ ID NO: 5196547 - DNA, 22 bp, Homo sapiens
agctgctaaatctcctattttt

SEQ ID NO: 5196548 - DNA, 22 bp, Homo sapiens
agctgctaactacatgaacaca

SEQ ID NO: 5196549 - DNA, 21 bp, Homo sapiens
agctgctaagctaaagaaact

SEQ ID NO: 5196550 - DNA, 11 bp, Homo sapiens
agctgctacaa

SEQ ID NO: 5196551 - DNA, 14 bp, Homo sapiens
agctgctacaaaga

SEQ ID NO: 5196552 - DNA, 16 bp, Homo sapiens
agctgctacaaagaag

SEQ ID NO: 5196553 - DNA, 19 bp, Homo sapiens
agctgctacaaagaagaca

SEQ ID NO: 5196554 - DNA, 19 bp, Homo sapiens
agctgctacctaaaaaaag

SEQ ID NO: 5196555 - DNA, 15 bp, Homo sapiens
agctgctaccttctt

SEQ ID NO: 5196556 - DNA, 18 bp, Homo sapiens
agctgctaccttctttgg

SEQ ID NO: 5196557 - DNA, 21 bp, Homo sapiens
agctgctactcgtgagcgcca

SEQ ID NO: 5196558 - DNA, 15 bp, Homo sapiens
agctgctagctattg

SEQ ID NO: 5196559 - DNA, 20 bp, Homo sapiens
agctgctaggggaaggactg

SEQ ID NO: 5196560 - DNA, 22 bp, Homo sapiens
agctgctagtgaaatggctggg

SEQ ID NO: 5196561 - DNA, 16 bp, Homo sapiens
agctgctatagcctgg

SEQ ID NO: 5196562 - DNA, 21 bp, Homo sapiens
agctgctatccccatctccct

SEQ ID NO: 5196563 - DNA, 23 bp, Homo sapiens
agctgctatccccatctccctgc

SEQ ID NO: 5196564 - DNA, 21 bp, Homo sapiens
agctgctatttattttcctaa

SEQ ID NO: 5196565 - DNA, 15 bp, Homo sapiens
agctgctcagagcca

SEQ ID NO: 5196566 - DNA, 22 bp, Homo sapiens
agctgctcagagccaagggggc

SEQ ID NO: 5196567 - DNA, 21 bp, Homo sapiens
agctgctcagggaaaagcagc

SEQ ID NO: 5196568 - DNA, 15 bp, Homo sapiens
agctgctccaggcct

SEQ ID NO: 5196569 - DNA, 16 bp, Homo sapiens
agctgctccaggcctg

SEQ ID NO: 5196570 - DNA, 17 bp, Homo sapiens
agctgctccaggcctgc

SEQ ID NO: 5196571 - DNA, 17 bp, Homo sapiens
agctgctccccagcagc

SEQ ID NO: 5196572 - DNA, 16 bp, Homo sapiens
agctgctccccaggcc

SEQ ID NO: 5196573 - DNA, 15 bp, Homo sapiens
agctgctcccctccc

SEQ ID NO: 5196574 - DNA, 17 bp, Homo sapiens
agctgctcccctgccac

SEQ ID NO: 5196575 - DNA, 14 bp, Homo sapiens
agctgctcccctgg

SEQ ID NO: 5196576 - DNA, 19 bp, Homo sapiens
agctgctcctagagggagg

SEQ ID NO: 5196577 - DNA, 17 bp, Homo sapiens
agctgctcctagagggg

SEQ ID NO: 5196578 - DNA, 23 bp, Homo sapiens
agctgctcctggctgaggggctt

SEQ ID NO: 5196579 - DNA, 19 bp, Homo sapiens
agccccagcccagccccac

SEQ ID NO: 5196580 - DNA, 21 bp, Homo sapiens
agccccagcccagccccactc

SEQ ID NO: 5196581 - DNA, 14 bp, Homo sapiens
agccccagccccgt

SEQ ID NO: 5196582 - DNA, 13 bp, Homo sapiens
agccccagcctgc

SEQ ID NO: 5196583 - DNA, 15 bp, Homo sapiens
agccccagcgagtct

SEQ ID NO: 5196584 - DNA, 18 bp, Homo sapiens
agccccagcgagtctgga

SEQ ID NO: 5196585 - DNA, 12 bp, Homo sapiens
agccccagctta

SEQ ID NO: 5196586 - DNA, 14 bp, Homo sapiens
agccccagcttggc

SEQ ID NO: 5196587 - DNA, 12 bp, Homo sapiens
agccccaggaga

SEQ ID NO: 5196588 - DNA, 14 bp, Homo sapiens
agccccaggagaag

SEQ ID NO: 5196589 - DNA, 13 bp, Homo sapiens
agccccaggccag

SEQ ID NO: 5196590 - DNA, 19 bp, Homo sapiens
agccccaggccagctgcgg

SEQ ID NO: 5196591 - DNA, 20 bp, Homo sapiens
agccccaggcccgccctgcc

SEQ ID NO: 5196592 - DNA, 12 bp, Homo sapiens
agccccaggcct

SEQ ID NO: 5196593 - DNA, 13 bp, Homo sapiens
agccccaggcctc

SEQ ID NO: 5196594 - DNA, 15 bp, Homo sapiens
agccccaggcctctg

SEQ ID NO: 5196595 - DNA, 21 bp, Homo sapiens
agccccaggcctctgtgtcct

SEQ ID NO: 5196596 - DNA, 23 bp, Homo sapiens
agccccaggcctggcctcgcctg

SEQ ID NO: 5196597 - DNA, 18 bp, Homo sapiens
agccccagggatcactgg

SEQ ID NO: 5196598 - DNA, 12 bp, Homo sapiens
agccccagggcc

SEQ ID NO: 5196599 - DNA, 14 bp, Homo sapiens
agccccagggccct

SEQ ID NO: 5196600 - DNA, 18 bp, Homo sapiens
agccccagggccctgctc

SEQ ID NO: 5196601 - DNA, 15 bp, Homo sapiens
agccccagggcctgc

SEQ ID NO: 5196602 - DNA, 17 bp, Homo sapiens
agccccagggcctgggg

SEQ ID NO: 5196603 - DNA, 20 bp, Homo sapiens
agccccagggcctgggggca

SEQ ID NO: 5196604 - DNA, 13 bp, Homo sapiens
agccccaggggtg

SEQ ID NO: 5196605 - DNA, 18 bp, Homo sapiens
agccccagggtgcccaga

SEQ ID NO: 5196606 - DNA, 22 bp, Homo sapiens
agccccaggtaaacgtctaaac

SEQ ID NO: 5196607 - DNA, 17 bp, Homo sapiens
agccccaggtcttttct

SEQ ID NO: 5196608 - DNA, 19 bp, Homo sapiens
agccccaggtcttttcttt

SEQ ID NO: 5196609 - DNA, 16 bp, Homo sapiens
agccccagtctcacct

SEQ ID NO: 5196610 - DNA, 14 bp, Homo sapiens
agccccagtgccca

SEQ ID NO: 5196611 - DNA, 13 bp, Homo sapiens
agccccagtgctg

SEQ ID NO: 5196612 - DNA, 19 bp, Homo sapiens
agccccatcagaacctgag

SEQ ID NO: 5196613 - DNA, 12 bp, Homo sapiens
agccccatccct

SEQ ID NO: 5196614 - DNA, 18 bp, Homo sapiens
agccccatccctgtcctc

SEQ ID NO: 5196615 - DNA, 17 bp, Homo sapiens
agccccatcctctgtac

SEQ ID NO: 5196616 - DNA, 15 bp, Homo sapiens
agccccatcctgccg

SEQ ID NO: 5196617 - DNA, 16 bp, Homo sapiens
agccccatccttcccg

SEQ ID NO: 5196618 - DNA, 21 bp, Homo sapiens
agccccatcttggtcctgtca

SEQ ID NO: 5196619 - DNA, 14 bp, Homo sapiens
agccccatgctgga

SEQ ID NO: 5196620 - DNA, 23 bp, Homo sapiens
agccccatgctggagcctgtgta

SEQ ID NO: 5196621 - DNA, 21 bp, Homo sapiens
agccccattcacggcctggca

SEQ ID NO: 5196622 - DNA, 13 bp, Homo sapiens
agccccattcctg

SEQ ID NO: 5196623 - DNA, 20 bp, Homo sapiens
agccccattctgcctgccca

SEQ ID NO: 5196624 - DNA, 23 bp, Homo sapiens
agccccattctgcctgcccaggc

SEQ ID NO: 5196625 - DNA, 22 bp, Homo sapiens
agccccattgctccattcactc

SEQ ID NO: 5196626 - DNA, 15 bp, Homo sapiens
agccccatttcctca

SEQ ID NO: 5196627 - DNA, 16 bp, Homo sapiens
agcccccaaagagctg

SEQ ID NO: 5196628 - DNA, 13 bp, Homo sapiens
agcccccaacaca

SEQ ID NO: 5196629 - DNA, 20 bp, Homo sapiens
agcccccaaccccgcggtgc

SEQ ID NO: 5196630 - DNA, 12 bp, Homo sapiens
agcccccaagcc

SEQ ID NO: 5196631 - DNA, 13 bp, Homo sapiens
agcccccaagcct

SEQ ID NO: 5196632 - DNA, 16 bp, Homo sapiens
agcccccaagcctctg

SEQ ID NO: 5196633 - DNA, 19 bp, Homo sapiens
agcccccaagcctctgccc

SEQ ID NO: 5196634 - DNA, 14 bp, Homo sapiens
agcccccacagccc

SEQ ID NO: 5196635 - DNA, 15 bp, Homo sapiens
agcccccacagccct

SEQ ID NO: 5196636 - DNA, 20 bp, Homo sapiens
agcccccacagccctggaat

SEQ ID NO: 5196637 - DNA, 17 bp, Homo sapiens
agcccccaccacaaact

SEQ ID NO: 5196638 - DNA, 15 bp, Homo sapiens
agcccccacccatgc

SEQ ID NO: 5196639 - DNA, 19 bp, Homo sapiens
agcccccacccatgccagc

SEQ ID NO: 5196640 - DNA, 12 bp, Homo sapiens
agcccccacccc

SEQ ID NO: 5196641 - DNA, 13 bp, Homo sapiens
agcccccacccca

SEQ ID NO: 5196642 - DNA, 23 bp, Homo sapiens
agcccccaccccagcacagctcc

SEQ ID NO: 5196643 - DNA, 22 bp, Homo sapiens
agcccccacccccgtcaccccg

SEQ ID NO: 5196644 - DNA, 19 bp, Homo sapiens
agcccccaccctgttcctg

SEQ ID NO: 5196645 - DNA, 21 bp, Homo sapiens
agcccccaccggaactgggct

SEQ ID NO: 5196646 - DNA, 19 bp, Homo sapiens
agcccccaccgtgggcagg

SEQ ID NO: 5196647 - DNA, 23 bp, Homo sapiens
agcccccacctccgccccagaca

SEQ ID NO: 5196648 - DNA, 12 bp, Homo sapiens
agcccccacctg

SEQ ID NO: 5196649 - DNA, 19 bp, Homo sapiens
agcccccaccttgatccca

SEQ ID NO: 5196650 - DNA, 19 bp, Homo sapiens
agcccccactgacctgccc

SEQ ID NO: 5196651 - DNA, 18 bp, Homo sapiens
agcccccagagcccaggc

SEQ ID NO: 5196652 - DNA, 18 bp, Homo sapiens
agcccccagatagagctg

SEQ ID NO: 5196653 - DNA, 15 bp, Homo sapiens
agcccccagcccctc

SEQ ID NO: 5196654 - DNA, 18 bp, Homo sapiens
agcccccagcccctcccc

SEQ ID NO: 5196655 - DNA, 16 bp, Homo sapiens
agcccccagcctgtca

SEQ ID NO: 5196656 - DNA, 22 bp, Homo sapiens
agcccccagctaagaacctgga

SEQ ID NO: 5196657 - DNA, 21 bp, Homo sapiens
agcccccaggaagcccaggag

SEQ ID NO: 5196658 - DNA, 15 bp, Homo sapiens
agcccccaggatctg

SEQ ID NO: 5196659 - DNA, 13 bp, Homo sapiens
agcccccaggcca

SEQ ID NO: 5196660 - DNA, 15 bp, Homo sapiens
agcccccagggcccc

SEQ ID NO: 5196661 - DNA, 18 bp, Homo sapiens
agcccccagggcctccag

SEQ ID NO: 5196662 - DNA, 16 bp, Homo sapiens
agccccccacaatgat

SEQ ID NO: 5196663 - DNA, 16 bp, Homo sapiens
agccccccacctttct

SEQ ID NO: 5196664 - DNA, 17 bp, Homo sapiens
agccccccacctttctc

SEQ ID NO: 5196665 - DNA, 20 bp, Homo sapiens
agccccccacctttctcgct

SEQ ID NO: 5196666 - DNA, 11 bp, Homo sapiens
agccccccact

SEQ ID NO: 5196667 - DNA, 15 bp, Homo sapiens
agccccccagctccc

SEQ ID NO: 5196668 - DNA, 19 bp, Homo sapiens
agcccccccaacactgtgc

SEQ ID NO: 5196669 - DNA, 21 bp, Homo sapiens
agcccccccaacactgtgccc

SEQ ID NO: 5196670 - DNA, 15 bp, Homo sapiens
agcccccccacccac

SEQ ID NO: 5196671 - DNA, 19 bp, Homo sapiens
agcccccccacccaccccc

SEQ ID NO: 5196672 - DNA, 23 bp, Homo sapiens
agcccccccacccacccccaggc

SEQ ID NO: 5196673 - DNA, 15 bp, Homo sapiens
agcccccctgctgct

SEQ ID NO: 5196674 - DNA, 19 bp, Homo sapiens
agcccccctgctgctgccc

SEQ ID NO: 5196675 - DNA, 18 bp, Homo sapiens
agccccccttgccccacc

SEQ ID NO: 5196676 - DNA, 20 bp, Homo sapiens
agccccccttgccccacctc

SEQ ID NO: 5196677 - DNA, 22 bp, Homo sapiens
agcccccgccccgccccacatt

SEQ ID NO: 5196678 - DNA, 15 bp, Homo sapiens
agcccccgcccctcc

SEQ ID NO: 5196679 - DNA, 16 bp, Homo sapiens
agcccccgcccctccc

SEQ ID NO: 5196680 - DNA, 18 bp, Homo sapiens
agcccccgcccctccccc

SEQ ID NO: 5196681 - DNA, 20 bp, Homo sapiens
agcccccgggccgctggctg

SEQ ID NO: 5196682 - DNA, 11 bp, Homo sapiens
agccccctcac

SEQ ID NO: 5196683 - DNA, 23 bp, Homo sapiens
agccccctcacagtattgctcac

SEQ ID NO: 5196684 - DNA, 13 bp, Homo sapiens
agccccctccaca

SEQ ID NO: 5196685 - DNA, 20 bp, Homo sapiens
agccccctcctggtgccacc

SEQ ID NO: 5196686 - DNA, 21 bp, Homo sapiens
agccccctcctggtgccacct

SEQ ID NO: 5196687 - DNA, 16 bp, Homo sapiens
agccccctccttgtct

SEQ ID NO: 5196688 - DNA, 13 bp, Homo sapiens
agccccctctcct

SEQ ID NO: 5196689 - DNA, 14 bp, Homo sapiens
agccccctcttccc

SEQ ID NO: 5196690 - DNA, 16 bp, Homo sapiens
agccccctcttcctcc

SEQ ID NO: 5196691 - DNA, 12 bp, Homo sapiens
agccccctgacc

SEQ ID NO: 5196692 - DNA, 21 bp, Homo sapiens
agccccctgaccactcagaga

SEQ ID NO: 5196693 - DNA, 22 bp, Homo sapiens
agccccctgccccgcaggcctg

SEQ ID NO: 5196694 - DNA, 12 bp, Homo sapiens
agccccctgctt

SEQ ID NO: 5196695 - DNA, 14 bp, Homo sapiens
agccccctgcttca

SEQ ID NO: 5196696 - DNA, 14 bp, Homo sapiens
agccccctgcttct

SEQ ID NO: 5196697 - DNA, 18 bp, Homo sapiens
agccccctgcttctcccg

SEQ ID NO: 5196698 - DNA, 21 bp, Homo sapiens
agccccctgcttctcccgcca

SEQ ID NO: 5196699 - DNA, 22 bp, Homo sapiens
agccccctgcttctcccgccat

SEQ ID NO: 5196700 - DNA, 20 bp, Homo sapiens
agccccctggatgggcattg

SEQ ID NO: 5196701 - DNA, 17 bp, Homo sapiens
agccccctggcagctgc

SEQ ID NO: 5196702 - DNA, 18 bp, Homo sapiens
agccccctggcagctgcc

SEQ ID NO: 5196703 - DNA, 16 bp, Homo sapiens
agccccctggcccctc

SEQ ID NO: 5196704 - DNA, 21 bp, Homo sapiens
agccccctggcccctcccaca

SEQ ID NO: 5196705 - DNA, 14 bp, Homo sapiens
agccccctggcctc

SEQ ID NO: 5196706 - DNA, 17 bp, Homo sapiens
agccccctggcctctgt

SEQ ID NO: 5196707 - DNA, 12 bp, Homo sapiens
agccccctggcg

SEQ ID NO: 5196708 - DNA, 16 bp, Homo sapiens
agccccctggcggcag

SEQ ID NO: 5196709 - DNA, 15 bp, Homo sapiens
agccccctgtccttc

SEQ ID NO: 5196710 - DNA, 21 bp, Homo sapiens
agccccctgtgcccacccagg

SEQ ID NO: 5196711 - DNA, 20 bp, Homo sapiens
agccccctttgggcccaggg

SEQ ID NO: 5196712 - DNA, 19 bp, Homo sapiens
agccccgactccagccagc

SEQ ID NO: 5196713 - DNA, 18 bp, Homo sapiens
agccccgagacaccatcc

SEQ ID NO: 5196714 - DNA, 23 bp, Homo sapiens
agccccgagacaccatcctgagc

SEQ ID NO: 5196715 - DNA, 14 bp, Homo sapiens
agccccgaggcctt

SEQ ID NO: 5196716 - DNA, 14 bp, Homo sapiens
agccccgcacgggc

SEQ ID NO: 5196717 - DNA, 18 bp, Homo sapiens
agccccgcacgggctgtc

SEQ ID NO: 5196718 - DNA, 18 bp, Homo sapiens
agccccgcagacctcccc

SEQ ID NO: 5196719 - DNA, 19 bp, Homo sapiens
agccccgcagacctcccca

SEQ ID NO: 5196720 - DNA, 23 bp, Homo sapiens
agccccgcagacctccccagccc

SEQ ID NO: 5196721 - DNA, 15 bp, Homo sapiens
agccccgccccaccc

SEQ ID NO: 5196722 - DNA, 22 bp, Homo sapiens
agccccgccccagccctcagtc

SEQ ID NO: 5196723 - DNA, 14 bp, Homo sapiens
agccccgccctctt

SEQ ID NO: 5196724 - DNA, 16 bp, Homo sapiens
agccccgccctcttcc

SEQ ID NO: 5196725 - DNA, 17 bp, Homo sapiens
agccccgccctcttcct

SEQ ID NO: 5196726 - DNA, 19 bp, Homo sapiens
agccccgccctcttcctga

SEQ ID NO: 5196727 - DNA, 23 bp, Homo sapiens
agccccgccgtgtctgtggccct

SEQ ID NO: 5196728 - DNA, 16 bp, Homo sapiens
agccccgcctccaggc

SEQ ID NO: 5196729 - DNA, 20 bp, Homo sapiens
agccccgcctgtcacaataa

SEQ ID NO: 5196730 - DNA, 15 bp, Homo sapiens
agccccgcgaccacc

SEQ ID NO: 5196731 - DNA, 20 bp, Homo sapiens
agccccgcgaccatgtggcc

SEQ ID NO: 5196732 - DNA, 23 bp, Homo sapiens
agccccgcgaccatgtggccaca

SEQ ID NO: 5196733 - DNA, 14 bp, Homo sapiens
agccccgctcaggc

SEQ ID NO: 5196734 - DNA, 19 bp, Homo sapiens
agccccgctcaggtagcca

SEQ ID NO: 5196735 - DNA, 13 bp, Homo sapiens
agccccgctccca

SEQ ID NO: 5196736 - DNA, 14 bp, Homo sapiens
agccccgctcccac

SEQ ID NO: 5196737 - DNA, 15 bp, Homo sapiens
agccccggcaagcca

SEQ ID NO: 5196738 - DNA, 16 bp, Homo sapiens
agccccggcaagccac

SEQ ID NO: 5196739 - DNA, 20 bp, Homo sapiens
agccccggcaagccacagga

SEQ ID NO: 5196740 - DNA, 19 bp, Homo sapiens
agccccggccactccctgc

SEQ ID NO: 5196741 - DNA, 14 bp, Homo sapiens
agccccggcccccc

SEQ ID NO: 5196742 - DNA, 13 bp, Homo sapiens
agccccgggctga

SEQ ID NO: 5196743 - DNA, 17 bp, Homo sapiens
agccccgggctgaccca

SEQ ID NO: 5196744 - DNA, 15 bp, Homo sapiens
agccccggggccccc

SEQ ID NO: 5196745 - DNA, 21 bp, Homo sapiens
agccccggggccccctggtca

SEQ ID NO: 5196746 - DNA, 22 bp, Homo sapiens
agccccggggccccctggtcac

SEQ ID NO: 5196747 - DNA, 17 bp, Homo sapiens
agccccggtggctgggc

SEQ ID NO: 5196748 - DNA, 16 bp, Homo sapiens
agccccgtcccagagg

SEQ ID NO: 5196749 - DNA, 17 bp, Homo sapiens
agccccgtcccagaggc

SEQ ID NO: 5196750 - DNA, 19 bp, Homo sapiens
agccccgtcccagaggccg

SEQ ID NO: 5196751 - DNA, 20 bp, Homo sapiens
agccccgtctgaccccagcc

SEQ ID NO: 5196752 - DNA, 14 bp, Homo sapiens
agccccgtctgccc

SEQ ID NO: 5196753 - DNA, 22 bp, Homo sapiens
agcccctaagtcaacttagcat

SEQ ID NO: 5196754 - DNA, 17 bp, Homo sapiens
agcccctaccccacacc

SEQ ID NO: 5196755 - DNA, 14 bp, Homo sapiens
agcccctacccctg

SEQ ID NO: 5196756 - DNA, 18 bp, Homo sapiens
agcccctacccctgccct

SEQ ID NO: 5196757 - DNA, 20 bp, Homo sapiens
agcccctacccctgccctgc

SEQ ID NO: 5196758 - DNA, 21 bp, Homo sapiens
agcccctacccctgccctgct

SEQ ID NO: 5196759 - DNA, 22 bp, Homo sapiens
agctgctctaagcccaggatct

SEQ ID NO: 5196760 - DNA, 14 bp, Homo sapiens
agctgctctccttc

SEQ ID NO: 5196761 - DNA, 18 bp, Homo sapiens
agctgctctccttcactc

SEQ ID NO: 5196762 - DNA, 12 bp, Homo sapiens
agctgctctgag

SEQ ID NO: 5196763 - DNA, 15 bp, Homo sapiens
agctgctctgagcca

SEQ ID NO: 5196764 - DNA, 18 bp, Homo sapiens
agctgctctgagccacag

SEQ ID NO: 5196765 - DNA, 15 bp, Homo sapiens
agctgctctgcccag

SEQ ID NO: 5196766 - DNA, 20 bp, Homo sapiens
agctgctctgcccagagctg

SEQ ID NO: 5196767 - DNA, 14 bp, Homo sapiens
agctgctctgcccc

SEQ ID NO: 5196768 - DNA, 13 bp, Homo sapiens
agctgctctgcta

SEQ ID NO: 5196769 - DNA, 19 bp, Homo sapiens
agctgctcttagtgcccgc

SEQ ID NO: 5196770 - DNA, 21 bp, Homo sapiens
agctgctcttagtgcccgcct

SEQ ID NO: 5196771 - DNA, 22 bp, Homo sapiens
agctgctcttgcatctgggcca

SEQ ID NO: 5196772 - DNA, 14 bp, Homo sapiens
agctgctgaaattt

SEQ ID NO: 5196773 - DNA, 16 bp, Homo sapiens
agctgctgaagaggca

SEQ ID NO: 5196774 - DNA, 14 bp, Homo sapiens
agctgctgacagtg

SEQ ID NO: 5196775 - DNA, 23 bp, Homo sapiens
agctgctgaccaattgtgctgcc

SEQ ID NO: 5196776 - DNA, 13 bp, Homo sapiens
agctgctgaggcg

SEQ ID NO: 5196777 - DNA, 15 bp, Homo sapiens
agctgctgagtgaca

SEQ ID NO: 5196778 - DNA, 15 bp, Homo sapiens
agctgctgcacagct

SEQ ID NO: 5196779 - DNA, 14 bp, Homo sapiens
agctgctgcagccc

SEQ ID NO: 5196780 - DNA, 16 bp, Homo sapiens
agctgctgcagccctg

SEQ ID NO: 5196781 - DNA, 21 bp, Homo sapiens
agctgctgccactctgctgcc

SEQ ID NO: 5196782 - DNA, 23 bp, Homo sapiens
agctgctgccactctgctgcctg

SEQ ID NO: 5196783 - DNA, 14 bp, Homo sapiens
agctgctgccgcct

SEQ ID NO: 5196784 - DNA, 18 bp, Homo sapiens
agctgctgcgggaggtag

SEQ ID NO: 5196785 - DNA, 15 bp, Homo sapiens
agctgctgctctccc

SEQ ID NO: 5196786 - DNA, 17 bp, Homo sapiens
agctgctgctctcccct

SEQ ID NO: 5196787 - DNA, 23 bp, Homo sapiens
agctgctggagactcctaggcag

SEQ ID NO: 5196788 - DNA, 23 bp, Homo sapiens
agctgctggatgacttgagatga

SEQ ID NO: 5196789 - DNA, 15 bp, Homo sapiens
agctgctggccaggg

SEQ ID NO: 5196790 - DNA, 13 bp, Homo sapiens
agctgctggccat

SEQ ID NO: 5196791 - DNA, 17 bp, Homo sapiens
agctgctggccatggct

SEQ ID NO: 5196792 - DNA, 21 bp, Homo sapiens
agctgctggctgacctgggcc

SEQ ID NO: 5196793 - DNA, 23 bp, Homo sapiens
agctgctgggacgatcgcccagg

SEQ ID NO: 5196794 - DNA, 15 bp, Homo sapiens
agctgctgggccagt

SEQ ID NO: 5196795 - DNA, 16 bp, Homo sapiens
agctgctgggccagtg

SEQ ID NO: 5196796 - DNA, 20 bp, Homo sapiens
agctgctgggccagtggcac

SEQ ID NO: 5196797 - DNA, 17 bp, Homo sapiens
agctgctgggtggcagg

SEQ ID NO: 5196798 - DNA, 10 bp, Homo sapiens
agctgctgtg

SEQ ID NO: 5196799 - DNA, 18 bp, Homo sapiens
agctgctgtgactgtgtc

SEQ ID NO: 5196800 - DNA, 14 bp, Homo sapiens
agctgctgtgccag

SEQ ID NO: 5196801 - DNA, 13 bp, Homo sapiens
agctgctgtgccc

SEQ ID NO: 5196802 - DNA, 15 bp, Homo sapiens
agctgctgtgcccca

SEQ ID NO: 5196803 - DNA, 22 bp, Homo sapiens
agctgctgtggtgttcccttgg

SEQ ID NO: 5196804 - DNA, 20 bp, Homo sapiens
agctgctgttccaacagaca

SEQ ID NO: 5196805 - DNA, 21 bp, Homo sapiens
agctgctgttctcaggacagc

SEQ ID NO: 5196806 - DNA, 19 bp, Homo sapiens
agctgcttccagttggact

SEQ ID NO: 5196807 - DNA, 12 bp, Homo sapiens
agctgcttctcc

SEQ ID NO: 5196808 - DNA, 15 bp, Homo sapiens
agctgcttctccccc

SEQ ID NO: 5196809 - DNA, 13 bp, Homo sapiens
agctgcttctgcc

SEQ ID NO: 5196810 - DNA, 16 bp, Homo sapiens
agctgcttctgctgcc

SEQ ID NO: 5196811 - DNA, 20 bp, Homo sapiens
agctgcttctgctgcctagg

SEQ ID NO: 5196812 - DNA, 21 bp, Homo sapiens
agctgcttctgctgcctaggt

SEQ ID NO: 5196813 - DNA, 16 bp, Homo sapiens
agctgcttgacctagc

SEQ ID NO: 5196814 - DNA, 15 bp, Homo sapiens
agctgcttgcccaag

SEQ ID NO: 5196815 - DNA, 23 bp, Homo sapiens
agctgcttggacctcgtgcttta

SEQ ID NO: 5196816 - DNA, 21 bp, Homo sapiens
agctgcttgtcctgggcctgc

SEQ ID NO: 5196817 - DNA, 22 bp, Homo sapiens
agctgcttgttgtcaagtataa

SEQ ID NO: 5196818 - DNA, 14 bp, Homo sapiens
agctgctttaaatc

SEQ ID NO: 5196819 - DNA, 21 bp, Homo sapiens
agctgctttcgaataaagtga

SEQ ID NO: 5196820 - DNA, 23 bp, Homo sapiens
agctgctttgacaaaatgactgg

SEQ ID NO: 5196821 - DNA, 20 bp, Homo sapiens
agctgctttgagctacagga

SEQ ID NO: 5196822 - DNA, 23 bp, Homo sapiens
agctgctttgagctacaggacaa

SEQ ID NO: 5196823 - DNA, 13 bp, Homo sapiens
agctgctttgtgg

SEQ ID NO: 5196824 - DNA, 14 bp, Homo sapiens
agctgcttttaaaa

SEQ ID NO: 5196825 - DNA, 19 bp, Homo sapiens
agctgcttttgcagaaatc

SEQ ID NO: 5196826 - DNA, 24 bp, Homo sapiens
agctgcttttgtctatgggactca

SEQ ID NO: 5196827 - DNA, 22 bp, Homo sapiens
agctgctttttttgaaactttg

SEQ ID NO: 5196828 - DNA, 18 bp, Homo sapiens
agctggaaacttctgtaa

SEQ ID NO: 5196829 - DNA, 15 bp, Homo sapiens
agctggaaaggccag

SEQ ID NO: 5196830 - DNA, 19 bp, Homo sapiens
agctggaaaggccagcagc

SEQ ID NO: 5196831 - DNA, 19 bp, Homo sapiens
agctggaaataaacctgga

SEQ ID NO: 5196832 - DNA, 14 bp, Homo sapiens
agctggaacatttg

SEQ ID NO: 5196833 - DNA, 16 bp, Homo sapiens
agctggaacatttgat

SEQ ID NO: 5196834 - DNA, 21 bp, Homo sapiens
agctggaagactgtgcagaag

SEQ ID NO: 5196835 - DNA, 16 bp, Homo sapiens
agctggaagcactgct

SEQ ID NO: 5196836 - DNA, 15 bp, Homo sapiens
agctggaaggcaggg

SEQ ID NO: 5196837 - DNA, 21 bp, Homo sapiens
agctggaagtggctctggggt

SEQ ID NO: 5196838 - DNA, 18 bp, Homo sapiens
agctggaatgtgccacag

SEQ ID NO: 5196839 - DNA, 19 bp, Homo sapiens
agctggaatgtgccacaga

SEQ ID NO: 5196840 - DNA, 23 bp, Homo sapiens
agctggaatgtgccacagaggcc

SEQ ID NO: 5196841 - DNA, 14 bp, Homo sapiens
agctggaatttaag

SEQ ID NO: 5196842 - DNA, 18 bp, Homo sapiens
agctggaattttttattc

SEQ ID NO: 5196843 - DNA, 16 bp, Homo sapiens
agctggacaagaagct

SEQ ID NO: 5196844 - DNA, 16 bp, Homo sapiens
agctggacatgctttg

SEQ ID NO: 5196845 - DNA, 19 bp, Homo sapiens
agctggacatgctttggca

SEQ ID NO: 5196846 - DNA, 16 bp, Homo sapiens
agctggaccatctctg

SEQ ID NO: 5196847 - DNA, 17 bp, Homo sapiens
agctggaccctgaccag

SEQ ID NO: 5196848 - DNA, 19 bp, Homo sapiens
agctggaccctgcttcacc

SEQ ID NO: 5196849 - DNA, 19 bp, Homo sapiens
agctggacgtcgcggtgtg

SEQ ID NO: 5196850 - DNA, 13 bp, Homo sapiens
agctggactgacc

SEQ ID NO: 5196851 - DNA, 14 bp, Homo sapiens
agctggactgacca

SEQ ID NO: 5196852 - DNA, 20 bp, Homo sapiens
agctggactgcattgaaggc

SEQ ID NO: 5196853 - DNA, 23 bp, Homo sapiens
agctggactgggtgggccccaca

SEQ ID NO: 5196854 - DNA, 11 bp, Homo sapiens
agctggacttc

SEQ ID NO: 5196855 - DNA, 22 bp, Homo sapiens
agctggagagagagttctcaca

SEQ ID NO: 5196856 - DNA, 18 bp, Homo sapiens
agctggagatgaggccag

SEQ ID NO: 5196857 - DNA, 21 bp, Homo sapiens
agctggagatgaggccagacc

SEQ ID NO: 5196858 - DNA, 21 bp, Homo sapiens
agctggagcccagcgtcagaa

SEQ ID NO: 5196859 - DNA, 14 bp, Homo sapiens
agctggagccccca

SEQ ID NO: 5196860 - DNA, 18 bp, Homo sapiens
agctggagcccccagcag

SEQ ID NO: 5196861 - DNA, 16 bp, Homo sapiens
agctggagcccgtgcc

SEQ ID NO: 5196862 - DNA, 23 bp, Homo sapiens
agctggagcccgtgccctaccac

SEQ ID NO: 5196863 - DNA, 19 bp, Homo sapiens
agctggagctaaggccagc

SEQ ID NO: 5196864 - DNA, 15 bp, Homo sapiens
agctggagctcttgg

SEQ ID NO: 5196865 - DNA, 23 bp, Homo sapiens
agctggagctcttggaagagctc

SEQ ID NO: 5196866 - DNA, 20 bp, Homo sapiens
agctggaggaatacatttta

SEQ ID NO: 5196867 - DNA, 13 bp, Homo sapiens
agctggaggacta

SEQ ID NO: 5196868 - DNA, 22 bp, Homo sapiens
agctggaggcaggggcttcctg

SEQ ID NO: 5196869 - DNA, 15 bp, Homo sapiens
agctggaggcgcagg

SEQ ID NO: 5196870 - DNA, 17 bp, Homo sapiens
agctggaggctccagga

SEQ ID NO: 5196871 - DNA, 22 bp, Homo sapiens
agctggaggctccaggactcca

SEQ ID NO: 5196872 - DNA, 17 bp, Homo sapiens
agctggaggctgtggga

SEQ ID NO: 5196873 - DNA, 17 bp, Homo sapiens
agctggagggaggggcg

SEQ ID NO: 5196874 - DNA, 15 bp, Homo sapiens
agctggaggggtggg

SEQ ID NO: 5196875 - DNA, 21 bp, Homo sapiens
agctggaggggtggggagcta

SEQ ID NO: 5196876 - DNA, 23 bp, Homo sapiens
agctggagtgagggcctcagagc

SEQ ID NO: 5196877 - DNA, 24 bp, Homo sapiens
agctggagtgagggcctcagagcc

SEQ ID NO: 5196878 - DNA, 19 bp, Homo sapiens
agctggagtgccatggctg

SEQ ID NO: 5196879 - DNA, 16 bp, Homo sapiens
agctggatagacttgg

SEQ ID NO: 5196880 - DNA, 20 bp, Homo sapiens
agctggatgctgagagacct

SEQ ID NO: 5196881 - DNA, 22 bp, Homo sapiens
agctggatttgggagctctgct

SEQ ID NO: 5196882 - DNA, 18 bp, Homo sapiens
agctggcaaactgtgaat

SEQ ID NO: 5196883 - DNA, 15 bp, Homo sapiens
agctggcaaccagcc

SEQ ID NO: 5196884 - DNA, 17 bp, Homo sapiens
agctggcaaccagccag

SEQ ID NO: 5196885 - DNA, 18 bp, Homo sapiens
agctggcaaccagccagc

SEQ ID NO: 5196886 - DNA, 19 bp, Homo sapiens
agctggcaaccagccagcg

SEQ ID NO: 5196887 - DNA, 21 bp, Homo sapiens
agctggcaaccagccagcgtc

SEQ ID NO: 5196888 - DNA, 15 bp, Homo sapiens
agctggcactgacag

SEQ ID NO: 5196889 - DNA, 18 bp, Homo sapiens
agctggcactgacagcct

SEQ ID NO: 5196890 - DNA, 21 bp, Homo sapiens
agctggcactgacagcctggg

SEQ ID NO: 5196891 - DNA, 14 bp, Homo sapiens
agctggcagaacgg

SEQ ID NO: 5196892 - DNA, 18 bp, Homo sapiens
agctggcagcctccagtg

SEQ ID NO: 5196893 - DNA, 14 bp, Homo sapiens
agctggcagcgcct

SEQ ID NO: 5196894 - DNA, 16 bp, Homo sapiens
agctggcagcgcctcc

SEQ ID NO: 5196895 - DNA, 17 bp, Homo sapiens
agctggcagcgcctccc

SEQ ID NO: 5196896 - DNA, 19 bp, Homo sapiens
agctggcagcgcctcccgc

SEQ ID NO: 5196897 - DNA, 17 bp, Homo sapiens
agctggcaggacacatc

SEQ ID NO: 5196898 - DNA, 16 bp, Homo sapiens
agctggcaggagggtg

SEQ ID NO: 5196899 - DNA, 21 bp, Homo sapiens
agctggcaggagggtggcact

SEQ ID NO: 5196900 - DNA, 21 bp, Homo sapiens
agctggcattacagctggaga

SEQ ID NO: 5196901 - DNA, 18 bp, Homo sapiens
agctggcattggtctgct

SEQ ID NO: 5196902 - DNA, 20 bp, Homo sapiens
agctggcattggtctgctga

SEQ ID NO: 5196903 - DNA, 13 bp, Homo sapiens
agctggccaagga

SEQ ID NO: 5196904 - DNA, 23 bp, Homo sapiens
agctggccacctagaagtctccc

SEQ ID NO: 5196905 - DNA, 20 bp, Homo sapiens
agctggccactgctggaggc

SEQ ID NO: 5196906 - DNA, 15 bp, Homo sapiens
agctggccaggccct

SEQ ID NO: 5196907 - DNA, 19 bp, Homo sapiens
agctggccagtaattagtg

SEQ ID NO: 5196908 - DNA, 22 bp, Homo sapiens
agctggcccactgctggctgca

SEQ ID NO: 5196909 - DNA, 17 bp, Homo sapiens
agctggcccccagccct

SEQ ID NO: 5196910 - DNA, 19 bp, Homo sapiens
agctggccccgccgcctgg

SEQ ID NO: 5196911 - DNA, 18 bp, Homo sapiens
agctggccctcagctccc

SEQ ID NO: 5196912 - DNA, 23 bp, Homo sapiens
agctggccctcagctccctgacc

SEQ ID NO: 5196913 - DNA, 13 bp, Homo sapiens
agctggccctgcc

SEQ ID NO: 5196914 - DNA, 15 bp, Homo sapiens
agctggccctgcctc

SEQ ID NO: 5196915 - DNA, 16 bp, Homo sapiens
agctggccctgcctcc

SEQ ID NO: 5196916 - DNA, 22 bp, Homo sapiens
agctggccctgcctcctgggaa

SEQ ID NO: 5196917 - DNA, 13 bp, Homo sapiens
agctggcccttgg

SEQ ID NO: 5196918 - DNA, 19 bp, Homo sapiens
agctggccgggagcctgat

SEQ ID NO: 5196919 - DNA, 14 bp, Homo sapiens
agctggccgggttg

SEQ ID NO: 5196920 - DNA, 22 bp, Homo sapiens
agctggccgggttggaggcctc

SEQ ID NO: 5196921 - DNA, 19 bp, Homo sapiens
agctggccgtgggcctggg

SEQ ID NO: 5196922 - DNA, 22 bp, Homo sapiens
agctggcctaatcactctgagt

SEQ ID NO: 5196923 - DNA, 15 bp, Homo sapiens
agctggcctcacctg

SEQ ID NO: 5196924 - DNA, 16 bp, Homo sapiens
agctggcctcacctgg

SEQ ID NO: 5196925 - DNA, 14 bp, Homo sapiens
agctggcctccccc

SEQ ID NO: 5196926 - DNA, 17 bp, Homo sapiens
agctggcctcccccaac

SEQ ID NO: 5196927 - DNA, 18 bp, Homo sapiens
agctggcctctagaacac

SEQ ID NO: 5196928 - DNA, 20 bp, Homo sapiens
agctggcctctagaacaccc

SEQ ID NO: 5196929 - DNA, 23 bp, Homo sapiens
agctggcctctagaacacccact

SEQ ID NO: 5196930 - DNA, 12 bp, Homo sapiens
agctggcctgag

SEQ ID NO: 5196931 - DNA, 11 bp, Homo sapiens
agctggcctgc

SEQ ID NO: 5196932 - DNA, 15 bp, Homo sapiens
agctggcctggacag

SEQ ID NO: 5196933 - DNA, 21 bp, Homo sapiens
agctggcctggaccattcctg

SEQ ID NO: 5196934 - DNA, 18 bp, Homo sapiens
agctggcctggcccccag

SEQ ID NO: 5196935 - DNA, 23 bp, Homo sapiens
agctggcctggcccccagcttca

SEQ ID NO: 5196936 - DNA, 15 bp, Homo sapiens
agcccctactgctgt

SEQ ID NO: 5196937 - DNA, 21 bp, Homo sapiens
agcccctactgtgggcaaagt

SEQ ID NO: 5196938 - DNA, 12 bp, Homo sapiens
agcccctagccc

SEQ ID NO: 5196939 - DNA, 16 bp, Homo sapiens
agcccctagcccagga

SEQ ID NO: 5196940 - DNA, 21 bp, Homo sapiens
agcccctagcccaggagagag

SEQ ID NO: 5196941 - DNA, 22 bp, Homo sapiens
agcccctagcccaggagagaga

SEQ ID NO: 5196942 - DNA, 23 bp, Homo sapiens
agcccctagcccaggagagagaa

SEQ ID NO: 5196943 - DNA, 19 bp, Homo sapiens
agcccctaggaaagcagtg

SEQ ID NO: 5196944 - DNA, 23 bp, Homo sapiens
agcccctatcctgcaccctctgc

SEQ ID NO: 5196945 - DNA, 15 bp, Homo sapiens
agcccctcaaaggga

SEQ ID NO: 5196946 - DNA, 21 bp, Homo sapiens
agcccctcaaagggagagaaa

SEQ ID NO: 5196947 - DNA, 22 bp, Homo sapiens
agcccctcaaagggagagaaaa

SEQ ID NO: 5196948 - DNA, 12 bp, Homo sapiens
agcccctcacac

SEQ ID NO: 5196949 - DNA, 15 bp, Homo sapiens
agcccctcacactgc

SEQ ID NO: 5196950 - DNA, 22 bp, Homo sapiens
agcccctcacctcaggacccca

SEQ ID NO: 5196951 - DNA, 18 bp, Homo sapiens
agcccctcagagaatgat

SEQ ID NO: 5196952 - DNA, 21 bp, Homo sapiens
agcccctcagagaatgatcac

SEQ ID NO: 5196953 - DNA, 13 bp, Homo sapiens
agcccctcagccc

SEQ ID NO: 5196954 - DNA, 14 bp, Homo sapiens
agcccctcagccct

SEQ ID NO: 5196955 - DNA, 16 bp, Homo sapiens
agcccctcagcccttg

SEQ ID NO: 5196956 - DNA, 18 bp, Homo sapiens
agcccctcagcgccccca

SEQ ID NO: 5196957 - DNA, 17 bp, Homo sapiens
agcccctcatgccacag

SEQ ID NO: 5196958 - DNA, 15 bp, Homo sapiens
agcccctccacgtga

SEQ ID NO: 5196959 - DNA, 16 bp, Homo sapiens
agcccctcccaagctg

SEQ ID NO: 5196960 - DNA, 16 bp, Homo sapiens
agcccctcccaccaca

SEQ ID NO: 5196961 - DNA, 23 bp, Homo sapiens
agcccctcccaccacagcaggtg

SEQ ID NO: 5196962 - DNA, 18 bp, Homo sapiens
agcccctccccagactct

SEQ ID NO: 5196963 - DNA, 15 bp, Homo sapiens
agcccctccccagcc

SEQ ID NO: 5196964 - DNA, 22 bp, Homo sapiens
agcccctccccatggtgcagtg

SEQ ID NO: 5196965 - DNA, 18 bp, Homo sapiens
agcccctcccccatctcc

SEQ ID NO: 5196966 - DNA, 20 bp, Homo sapiens
agcccctcccccatctccca

SEQ ID NO: 5196967 - DNA, 12 bp, Homo sapiens
agcccctccccg

SEQ ID NO: 5196968 - DNA, 16 bp, Homo sapiens
agcccctccccgcctc

SEQ ID NO: 5196969 - DNA, 18 bp, Homo sapiens
agcccctccccgcctcct

SEQ ID NO: 5196970 - DNA, 21 bp, Homo sapiens
agcccctcctaacccagcagt

SEQ ID NO: 5196971 - DNA, 11 bp, Homo sapiens
agcccctcctc

SEQ ID NO: 5196972 - DNA, 12 bp, Homo sapiens
agcccctcctcc

SEQ ID NO: 5196973 - DNA, 15 bp, Homo sapiens
agcccctcctccccc

SEQ ID NO: 5196974 - DNA, 14 bp, Homo sapiens
agcccctcctccct

SEQ ID NO: 5196975 - DNA, 15 bp, Homo sapiens
agcccctcctccctc

SEQ ID NO: 5196976 - DNA, 19 bp, Homo sapiens
agcccctcctccctcagac

SEQ ID NO: 5196977 - DNA, 22 bp, Homo sapiens
agcccctcctccctcaggccca

SEQ ID NO: 5196978 - DNA, 12 bp, Homo sapiens
agcccctcctct

SEQ ID NO: 5196979 - DNA, 16 bp, Homo sapiens
agcccctcctctgcca

SEQ ID NO: 5196980 - DNA, 23 bp, Homo sapiens
agcccctcctctgccacctcccc

SEQ ID NO: 5196981 - DNA, 15 bp, Homo sapiens
agcccctccttctcc

SEQ ID NO: 5196982 - DNA, 17 bp, Homo sapiens
agcccctccttctcccc

SEQ ID NO: 5196983 - DNA, 22 bp, Homo sapiens
agcccctccttctcccctgccg

SEQ ID NO: 5196984 - DNA, 14 bp, Homo sapiens
agcccctctcacag

SEQ ID NO: 5196985 - DNA, 20 bp, Homo sapiens
agcccctctcacaggcagct

SEQ ID NO: 5196986 - DNA, 21 bp, Homo sapiens
agcccctctccccgcagtgtt

SEQ ID NO: 5196987 - DNA, 22 bp, Homo sapiens
agcccctctcccctctctgctc

SEQ ID NO: 5196988 - DNA, 17 bp, Homo sapiens
agcccctctctcacaca

SEQ ID NO: 5196989 - DNA, 13 bp, Homo sapiens
agcccctctggat

SEQ ID NO: 5196990 - DNA, 19 bp, Homo sapiens
agcccctctggattccctt

SEQ ID NO: 5196991 - DNA, 18 bp, Homo sapiens
agcccctcttggagaagt

SEQ ID NO: 5196992 - DNA, 20 bp, Homo sapiens
agcccctcttggagaagtct

SEQ ID NO: 5196993 - DNA, 17 bp, Homo sapiens
agcccctgaaagcctca

SEQ ID NO: 5196994 - DNA, 13 bp, Homo sapiens
agcccctgagagc

SEQ ID NO: 5196995 - DNA, 18 bp, Homo sapiens
agcccctgagtcctgagc

SEQ ID NO: 5196996 - DNA, 20 bp, Homo sapiens
agcccctgatctctgacctc

SEQ ID NO: 5196997 - DNA, 10 bp, Homo sapiens
agcccctgca

SEQ ID NO: 5196998 - DNA, 12 bp, Homo sapiens
agcccctgcaga

SEQ ID NO: 5196999 - DNA, 21 bp, Homo sapiens
agcccctgcagacgtctggcc

SEQ ID NO: 5197000 - DNA, 17 bp, Homo sapiens
agcccctgccccagccc

SEQ ID NO: 5197001 - DNA, 14 bp, Homo sapiens
agcccctgcccctc

SEQ ID NO: 5197002 - DNA, 18 bp, Homo sapiens
agcccctgccctggggag

SEQ ID NO: 5197003 - DNA, 19 bp, Homo sapiens
agcccctgccctggggaga

SEQ ID NO: 5197004 - DNA, 22 bp, Homo sapiens
agcccctgccctggggagaaag

SEQ ID NO: 5197005 - DNA, 13 bp, Homo sapiens
agcccctgcctgg

SEQ ID NO: 5197006 - DNA, 16 bp, Homo sapiens
agcccctgctgctcct

SEQ ID NO: 5197007 - DNA, 13 bp, Homo sapiens
agcccctggagcc

SEQ ID NO: 5197008 - DNA, 16 bp, Homo sapiens
agcccctggagcctca

SEQ ID NO: 5197009 - DNA, 13 bp, Homo sapiens
agcccctggatct

SEQ ID NO: 5197010 - DNA, 18 bp, Homo sapiens
agcccctggatgcagcct

SEQ ID NO: 5197011 - DNA, 17 bp, Homo sapiens
agcccctggcaatccca

SEQ ID NO: 5197012 - DNA, 16 bp, Homo sapiens
agcccctgggaacagg

SEQ ID NO: 5197013 - DNA, 20 bp, Homo sapiens
agcccctgggaacaggcccc

SEQ ID NO: 5197014 - DNA, 22 bp, Homo sapiens
agcccctgggaacaggccccac

SEQ ID NO: 5197015 - DNA, 14 bp, Homo sapiens
agcccctgggccct

SEQ ID NO: 5197016 - DNA, 20 bp, Homo sapiens
agcccctgggcccttgtgct

SEQ ID NO: 5197017 - DNA, 11 bp, Homo sapiens
agcccctgggg

SEQ ID NO: 5197018 - DNA, 21 bp, Homo sapiens
agcccctggggcccagcccct

SEQ ID NO: 5197019 - DNA, 21 bp, Homo sapiens
agcccctggggctgtatttat

SEQ ID NO: 5197020 - DNA, 21 bp, Homo sapiens
agcccctgggggctccctgat

SEQ ID NO: 5197021 - DNA, 12 bp, Homo sapiens
agcccctgggtg

SEQ ID NO: 5197022 - DNA, 14 bp, Homo sapiens
agcccctggtcctg

SEQ ID NO: 5197023 - DNA, 13 bp, Homo sapiens
agcccctggtgtg

SEQ ID NO: 5197024 - DNA, 18 bp, Homo sapiens
agcccctgtatggcactg

SEQ ID NO: 5197025 - DNA, 21 bp, Homo sapiens
agcccctgtctagagagggag

SEQ ID NO: 5197026 - DNA, 15 bp, Homo sapiens
agcccctgtggagac

SEQ ID NO: 5197027 - DNA, 15 bp, Homo sapiens
agccccttccccatg

SEQ ID NO: 5197028 - DNA, 15 bp, Homo sapiens
agccccttcccctgg

SEQ ID NO: 5197029 - DNA, 21 bp, Homo sapiens
agccccttcgaggttgcccct

SEQ ID NO: 5197030 - DNA, 18 bp, Homo sapiens
agccccttcgggagcagg

SEQ ID NO: 5197031 - DNA, 14 bp, Homo sapiens
agccccttctccca

SEQ ID NO: 5197032 - DNA, 23 bp, Homo sapiens
agccccttctcccagcacacggc

SEQ ID NO: 5197033 - DNA, 15 bp, Homo sapiens
agccccttctctcaa

SEQ ID NO: 5197034 - DNA, 24 bp, Homo sapiens
agccccttctgacccatgctgccc

SEQ ID NO: 5197035 - DNA, 15 bp, Homo sapiens
agccccttctgctca

SEQ ID NO: 5197036 - DNA, 14 bp, Homo sapiens
agccccttctggcc

SEQ ID NO: 5197037 - DNA, 20 bp, Homo sapiens
agccccttctggccggtgct

SEQ ID NO: 5197038 - DNA, 23 bp, Homo sapiens
agccccttctggccggtgctggg

SEQ ID NO: 5197039 - DNA, 21 bp, Homo sapiens
agccccttcttccaaggagca

SEQ ID NO: 5197040 - DNA, 16 bp, Homo sapiens
agccccttgctctcag

SEQ ID NO: 5197041 - DNA, 20 bp, Homo sapiens
agccccttgctctcccctgc

SEQ ID NO: 5197042 - DNA, 15 bp, Homo sapiens
agccccttgcttcaa

SEQ ID NO: 5197043 - DNA, 14 bp, Homo sapiens
agccccttgcttct

SEQ ID NO: 5197044 - DNA, 15 bp, Homo sapiens
agccccttgcttcta

SEQ ID NO: 5197045 - DNA, 13 bp, Homo sapiens
agccccttggaga

SEQ ID NO: 5197046 - DNA, 12 bp, Homo sapiens
agcccctttcca

SEQ ID NO: 5197047 - DNA, 14 bp, Homo sapiens
agcccctttccaaa

SEQ ID NO: 5197048 - DNA, 14 bp, Homo sapiens
agcccctttccctt

SEQ ID NO: 5197049 - DNA, 23 bp, Homo sapiens
agcccctttcccttgtagctcct

SEQ ID NO: 5197050 - DNA, 22 bp, Homo sapiens
agcccctttttcatatgttgct

SEQ ID NO: 5197051 - DNA, 14 bp, Homo sapiens
agcccgaacaccat

SEQ ID NO: 5197052 - DNA, 16 bp, Homo sapiens
agcccgacagtgccat

SEQ ID NO: 5197053 - DNA, 14 bp, Homo sapiens
agcccgaggaccgg

SEQ ID NO: 5197054 - DNA, 18 bp, Homo sapiens
agcccgagggcctgacag

SEQ ID NO: 5197055 - DNA, 21 bp, Homo sapiens
agcccgatcctcccctggact

SEQ ID NO: 5197056 - DNA, 17 bp, Homo sapiens
agcccgatgtccctgtc

SEQ ID NO: 5197057 - DNA, 21 bp, Homo sapiens
agcccgatgtccctgtcccct

SEQ ID NO: 5197058 - DNA, 16 bp, Homo sapiens
agcccgcaactctcca

SEQ ID NO: 5197059 - DNA, 17 bp, Homo sapiens
agcccgcaactctccag

SEQ ID NO: 5197060 - DNA, 15 bp, Homo sapiens
agcccgcacacctgc

SEQ ID NO: 5197061 - DNA, 17 bp, Homo sapiens
agcccgcactgtcccag

SEQ ID NO: 5197062 - DNA, 22 bp, Homo sapiens
agcccgcagaggtggggtgctg

SEQ ID NO: 5197063 - DNA, 14 bp, Homo sapiens
agcccgcagcacat

SEQ ID NO: 5197064 - DNA, 14 bp, Homo sapiens
agcccgcagggcca

SEQ ID NO: 5197065 - DNA, 15 bp, Homo sapiens
agcccgcatcagctg

SEQ ID NO: 5197066 - DNA, 17 bp, Homo sapiens
agcccgcatgcagcagc

SEQ ID NO: 5197067 - DNA, 18 bp, Homo sapiens
agcccgcatgcagcagct

SEQ ID NO: 5197068 - DNA, 19 bp, Homo sapiens
agcccgccaaggtagccat

SEQ ID NO: 5197069 - DNA, 14 bp, Homo sapiens
agcccgcccacctg

SEQ ID NO: 5197070 - DNA, 22 bp, Homo sapiens
agcccgcccacctgggccctag

SEQ ID NO: 5197071 - DNA, 19 bp, Homo sapiens
agcccgccgcccgcccctc

SEQ ID NO: 5197072 - DNA, 20 bp, Homo sapiens
agcccgccgcccgcccctca

SEQ ID NO: 5197073 - DNA, 20 bp, Homo sapiens
agcccgccgtcagggtggct

SEQ ID NO: 5197074 - DNA, 22 bp, Homo sapiens
agcccgccgtctgcaggggcct

SEQ ID NO: 5197075 - DNA, 12 bp, Homo sapiens
agcccgcctgcc

SEQ ID NO: 5197076 - DNA, 15 bp, Homo sapiens
agcccgcctgccagt

SEQ ID NO: 5197077 - DNA, 18 bp, Homo sapiens
agcccgcctgccagtcct

SEQ ID NO: 5197078 - DNA, 19 bp, Homo sapiens
agcccgcctgccagtccta

SEQ ID NO: 5197079 - DNA, 16 bp, Homo sapiens
agcccgcgtgctggag

SEQ ID NO: 5197080 - DNA, 19 bp, Homo sapiens
agcccgctgagtggactgg

SEQ ID NO: 5197081 - DNA, 21 bp, Homo sapiens
agcccgcttcaagctctctgt

SEQ ID NO: 5197082 - DNA, 16 bp, Homo sapiens
agcccgcttggccacc

SEQ ID NO: 5197083 - DNA, 14 bp, Homo sapiens
agcccgcttttgtt

SEQ ID NO: 5197084 - DNA, 16 bp, Homo sapiens
agcccggacggcgggt

SEQ ID NO: 5197085 - DNA, 17 bp, Homo sapiens
agcccggactgaccaaa

SEQ ID NO: 5197086 - DNA, 14 bp, Homo sapiens
agcccggagctccg

SEQ ID NO: 5197087 - DNA, 21 bp, Homo sapiens
agcccggaggggactggtccc

SEQ ID NO: 5197088 - DNA, 23 bp, Homo sapiens
agcccggatgcccacccctgctg

SEQ ID NO: 5197089 - DNA, 14 bp, Homo sapiens
agcccggatgcttc

SEQ ID NO: 5197090 - DNA, 20 bp, Homo sapiens
agcccggccaaggacactga

SEQ ID NO: 5197091 - DNA, 13 bp, Homo sapiens
agcccggccaggg

SEQ ID NO: 5197092 - DNA, 22 bp, Homo sapiens
agcccggccagggcctggtgtg

SEQ ID NO: 5197093 - DNA, 16 bp, Homo sapiens
agcccggccccacctc

SEQ ID NO: 5197094 - DNA, 21 bp, Homo sapiens
agcccggccccacctccctgc

SEQ ID NO: 5197095 - DNA, 20 bp, Homo sapiens
agcccggccctcccccagct

SEQ ID NO: 5197096 - DNA, 23 bp, Homo sapiens
agcccggccctcccccagctcct

SEQ ID NO: 5197097 - DNA, 15 bp, Homo sapiens
agcccggctcccacc

SEQ ID NO: 5197098 - DNA, 15 bp, Homo sapiens
agcccggctcctggt

SEQ ID NO: 5197099 - DNA, 19 bp, Homo sapiens
agcccggctcggcccagca

SEQ ID NO: 5197100 - DNA, 13 bp, Homo sapiens
agcccggctgctg

SEQ ID NO: 5197101 - DNA, 13 bp, Homo sapiens
agcccggctggtt

SEQ ID NO: 5197102 - DNA, 17 bp, Homo sapiens
agcccgggagcctagga

SEQ ID NO: 5197103 - DNA, 18 bp, Homo sapiens
agcccgggagcctaggac

SEQ ID NO: 5197104 - DNA, 20 bp, Homo sapiens
agcccgggagcctaggacca

SEQ ID NO: 5197105 - DNA, 21 bp, Homo sapiens
agcccgggagcctaggaccac

SEQ ID NO: 5197106 - DNA, 14 bp, Homo sapiens
agcccgggctctgc

SEQ ID NO: 5197107 - DNA, 20 bp, Homo sapiens
agcccgggctctgcctccca

SEQ ID NO: 5197108 - DNA, 12 bp, Homo sapiens
agcccgggctgc

SEQ ID NO: 5197109 - DNA, 17 bp, Homo sapiens
agcccgggctgcctggg

SEQ ID NO: 5197110 - DNA, 19 bp, Homo sapiens
agcccgggctgcctgggct

SEQ ID NO: 5197111 - DNA, 21 bp, Homo sapiens
agcccgggctgcctgggctgt

SEQ ID NO: 5197112 - DNA, 14 bp, Homo sapiens
agcccggggaggaa

SEQ ID NO: 5197113 - DNA, 14 bp, Homo sapiens
agcccggggccagc

SEQ ID NO: 5197114 - DNA, 20 bp, Homo sapiens
agcccgtgaagcagtgcctc

SEQ ID NO: 5197115 - DNA, 12 bp, Homo sapiens
agctggcctggg

SEQ ID NO: 5197116 - DNA, 18 bp, Homo sapiens
agctggcctggtttcctc

SEQ ID NO: 5197117 - DNA, 19 bp, Homo sapiens
agctggcctgtctgcgtgg

SEQ ID NO: 5197118 - DNA, 12 bp, Homo sapiens
agctggcctgtg

SEQ ID NO: 5197119 - DNA, 14 bp, Homo sapiens
agctggcctgtggc

SEQ ID NO: 5197120 - DNA, 16 bp, Homo sapiens
agctggcctgtggcac

SEQ ID NO: 5197121 - DNA, 17 bp, Homo sapiens
agctggcgcccatccta

SEQ ID NO: 5197122 - DNA, 20 bp, Homo sapiens
agctggcgcgtgtgtggcct

SEQ ID NO: 5197123 - DNA, 20 bp, Homo sapiens
agctggcgctcagcagccct

SEQ ID NO: 5197124 - DNA, 21 bp, Homo sapiens
agctggcgctcagcagcccta

SEQ ID NO: 5197125 - DNA, 15 bp, Homo sapiens
agctggcggaacctg

SEQ ID NO: 5197126 - DNA, 18 bp, Homo sapiens
agctggcggaacctggct

SEQ ID NO: 5197127 - DNA, 19 bp, Homo sapiens
agctggcggaacctggctg

SEQ ID NO: 5197128 - DNA, 15 bp, Homo sapiens
agctggcggaggctg

SEQ ID NO: 5197129 - DNA, 22 bp, Homo sapiens
agctggcggctggggtcccagc

SEQ ID NO: 5197130 - DNA, 23 bp, Homo sapiens
agctggcggctggggtcccagca

SEQ ID NO: 5197131 - DNA, 14 bp, Homo sapiens
agctggcgggtgtg

SEQ ID NO: 5197132 - DNA, 18 bp, Homo sapiens
agctggcgtctgtcttca

SEQ ID NO: 5197133 - DNA, 16 bp, Homo sapiens
agctggctagtccttt

SEQ ID NO: 5197134 - DNA, 16 bp, Homo sapiens
agctggctccagcctg

SEQ ID NO: 5197135 - DNA, 11 bp, Homo sapiens
agctggctcta

SEQ ID NO: 5197136 - DNA, 14 bp, Homo sapiens
agctggctctgaat

SEQ ID NO: 5197137 - DNA, 13 bp, Homo sapiens
agctggctctgag

SEQ ID NO: 5197138 - DNA, 19 bp, Homo sapiens
agctggctctgagcgcctc

SEQ ID NO: 5197139 - DNA, 20 bp, Homo sapiens
agctggctctgagcgcctcc

SEQ ID NO: 5197140 - DNA, 23 bp, Homo sapiens
agctggctctgagcgcctccatc

SEQ ID NO: 5197141 - DNA, 18 bp, Homo sapiens
agctggctctgtgagggt

SEQ ID NO: 5197142 - DNA, 13 bp, Homo sapiens
agctggctgacta

SEQ ID NO: 5197143 - DNA, 21 bp, Homo sapiens
agctggctgactaagccccgt

SEQ ID NO: 5197144 - DNA, 16 bp, Homo sapiens
agctggctgctgacag

SEQ ID NO: 5197145 - DNA, 18 bp, Homo sapiens
agctggctgctgacagga

SEQ ID NO: 5197146 - DNA, 13 bp, Homo sapiens
agctggctggcag

SEQ ID NO: 5197147 - DNA, 15 bp, Homo sapiens
agctggctggcaggt

SEQ ID NO: 5197148 - DNA, 16 bp, Homo sapiens
agctggctggcaggtg

SEQ ID NO: 5197149 - DNA, 17 bp, Homo sapiens
agctggctggcaggtgt

SEQ ID NO: 5197150 - DNA, 19 bp, Homo sapiens
agctggctggggtggcctg

SEQ ID NO: 5197151 - DNA, 22 bp, Homo sapiens
agctggctgggtcgcccctcct

SEQ ID NO: 5197152 - DNA, 21 bp, Homo sapiens
agctggctgtacctgttcctc

SEQ ID NO: 5197153 - DNA, 11 bp, Homo sapiens
agctggctgtc

SEQ ID NO: 5197154 - DNA, 15 bp, Homo sapiens
agctggctgtgcctg

SEQ ID NO: 5197155 - DNA, 21 bp, Homo sapiens
agctggctttcatccaactct

SEQ ID NO: 5197156 - DNA, 23 bp, Homo sapiens
agctggctttgaaacctcagggc

SEQ ID NO: 5197157 - DNA, 18 bp, Homo sapiens
agctgggaaacagggagc

SEQ ID NO: 5197158 - DNA, 20 bp, Homo sapiens
agctgggaacgtgtgtccag

SEQ ID NO: 5197159 - DNA, 13 bp, Homo sapiens
agctgggaacttc

SEQ ID NO: 5197160 - DNA, 15 bp, Homo sapiens
agctgggaaggttcc

SEQ ID NO: 5197161 - DNA, 15 bp, Homo sapiens
agctgggacccctcc

SEQ ID NO: 5197162 - DNA, 15 bp, Homo sapiens
agctgggactacagg

SEQ ID NO: 5197163 - DNA, 18 bp, Homo sapiens
agctgggactacaggcgc

SEQ ID NO: 5197164 - DNA, 16 bp, Homo sapiens
agctgggactacaggt

SEQ ID NO: 5197165 - DNA, 17 bp, Homo sapiens
agctgggactagaggca

SEQ ID NO: 5197166 - DNA, 13 bp, Homo sapiens
agctgggagaagg

SEQ ID NO: 5197167 - DNA, 21 bp, Homo sapiens
agctgggagaccctccccaca

SEQ ID NO: 5197168 - DNA, 14 bp, Homo sapiens
agctgggagccagg

SEQ ID NO: 5197169 - DNA, 17 bp, Homo sapiens
agctgggagccaggctc

SEQ ID NO: 5197170 - DNA, 23 bp, Homo sapiens
agctgggaggcaagaggggtgga

SEQ ID NO: 5197171 - DNA, 19 bp, Homo sapiens
agctgggaggcatggccct

SEQ ID NO: 5197172 - DNA, 18 bp, Homo sapiens
agctgggagggaacctgt

SEQ ID NO: 5197173 - DNA, 15 bp, Homo sapiens
agctgggagggaggg

SEQ ID NO: 5197174 - DNA, 19 bp, Homo sapiens
agctgggagggagggggag

SEQ ID NO: 5197175 - DNA, 15 bp, Homo sapiens
agctgggagtagcat

SEQ ID NO: 5197176 - DNA, 16 bp, Homo sapiens
agctgggatatgtagt

SEQ ID NO: 5197177 - DNA, 17 bp, Homo sapiens
agctgggatcccacagc

SEQ ID NO: 5197178 - DNA, 18 bp, Homo sapiens
agctgggatcccacagcc

SEQ ID NO: 5197179 - DNA, 19 bp, Homo sapiens
agctgggatcccacagccc

SEQ ID NO: 5197180 - DNA, 19 bp, Homo sapiens
agctgggatctgactgcac

SEQ ID NO: 5197181 - DNA, 16 bp, Homo sapiens
agctgggattacaggc

SEQ ID NO: 5197182 - DNA, 21 bp, Homo sapiens
agctgggattacaggcgcctg

SEQ ID NO: 5197183 - DNA, 22 bp, Homo sapiens
agctgggattacaggctcctgc

SEQ ID NO: 5197184 - DNA, 19 bp, Homo sapiens
agctgggcaccacaggctg

SEQ ID NO: 5197185 - DNA, 17 bp, Homo sapiens
agctgggcactgggccg

SEQ ID NO: 5197186 - DNA, 18 bp, Homo sapiens
agctgggcagaaggccaa

SEQ ID NO: 5197187 - DNA, 18 bp, Homo sapiens
agctgggccactcctctt

SEQ ID NO: 5197188 - DNA, 16 bp, Homo sapiens
agctgggccagccgcc

SEQ ID NO: 5197189 - DNA, 12 bp, Homo sapiens
agctgggcccaa

SEQ ID NO: 5197190 - DNA, 21 bp, Homo sapiens
agctgggcccaaaggcccagg

SEQ ID NO: 5197191 - DNA, 22 bp, Homo sapiens
agctgggcccaaaggcccaggg

SEQ ID NO: 5197192 - DNA, 12 bp, Homo sapiens
agctgggcccac

SEQ ID NO: 5197193 - DNA, 13 bp, Homo sapiens
agctgggcccaca

SEQ ID NO: 5197194 - DNA, 15 bp, Homo sapiens
agctgggcccacagc

SEQ ID NO: 5197195 - DNA, 19 bp, Homo sapiens
agctgggcccacagccccc

SEQ ID NO: 5197196 - DNA, 21 bp, Homo sapiens
agctgggcccagcccctccac

SEQ ID NO: 5197197 - DNA, 16 bp, Homo sapiens
agctgggccccaccta

SEQ ID NO: 5197198 - DNA, 13 bp, Homo sapiens
agctgggccccag

SEQ ID NO: 5197199 - DNA, 16 bp, Homo sapiens
agctgggccccagccc

SEQ ID NO: 5197200 - DNA, 17 bp, Homo sapiens
agctgggccccagccca

SEQ ID NO: 5197201 - DNA, 20 bp, Homo sapiens
agctgggccccagcccaccc

SEQ ID NO: 5197202 - DNA, 13 bp, Homo sapiens
agctgggccctgc

SEQ ID NO: 5197203 - DNA, 14 bp, Homo sapiens
agctgggccctgcc

SEQ ID NO: 5197204 - DNA, 22 bp, Homo sapiens
agctgggccctgcctgcagcca

SEQ ID NO: 5197205 - DNA, 14 bp, Homo sapiens
agctgggcctcctg

SEQ ID NO: 5197206 - DNA, 18 bp, Homo sapiens
agctgggcctcctgcctc

SEQ ID NO: 5197207 - DNA, 12 bp, Homo sapiens
agctgggcctgt

SEQ ID NO: 5197208 - DNA, 13 bp, Homo sapiens
agctgggcctgtg

SEQ ID NO: 5197209 - DNA, 14 bp, Homo sapiens
agctgggcctgtgc

SEQ ID NO: 5197210 - DNA, 16 bp, Homo sapiens
agctgggcctgtgcac

SEQ ID NO: 5197211 - DNA, 18 bp, Homo sapiens
agctgggctagaggctga

SEQ ID NO: 5197212 - DNA, 14 bp, Homo sapiens
agctgggctccctt

SEQ ID NO: 5197213 - DNA, 15 bp, Homo sapiens
agctgggctctgcaa

SEQ ID NO: 5197214 - DNA, 15 bp, Homo sapiens
agctgggctctgcca

SEQ ID NO: 5197215 - DNA, 11 bp, Homo sapiens
agctgggctgt

SEQ ID NO: 5197216 - DNA, 14 bp, Homo sapiens
agctgggctgtctc

SEQ ID NO: 5197217 - DNA, 22 bp, Homo sapiens
agctgggctgtctctctccatg

SEQ ID NO: 5197218 - DNA, 19 bp, Homo sapiens
agctgggcttggcctggag

SEQ ID NO: 5197219 - DNA, 20 bp, Homo sapiens
agctgggcttggcctggaga

SEQ ID NO: 5197220 - DNA, 22 bp, Homo sapiens
agctgggcttggcctggagagg

SEQ ID NO: 5197221 - DNA, 20 bp, Homo sapiens
agctggggaagcttcttaaa

SEQ ID NO: 5197222 - DNA, 14 bp, Homo sapiens
agctggggacctgg

SEQ ID NO: 5197223 - DNA, 15 bp, Homo sapiens
agctggggactcagg

SEQ ID NO: 5197224 - DNA, 18 bp, Homo sapiens
agctggggactcagggac

SEQ ID NO: 5197225 - DNA, 14 bp, Homo sapiens
agctggggagatgg

SEQ ID NO: 5197226 - DNA, 16 bp, Homo sapiens
agctggggagcagctg

SEQ ID NO: 5197227 - DNA, 19 bp, Homo sapiens
agctggggagcagctgaga

SEQ ID NO: 5197228 - DNA, 13 bp, Homo sapiens
agctggggagccc

SEQ ID NO: 5197229 - DNA, 18 bp, Homo sapiens
agctggggaggagctttg

SEQ ID NO: 5197230 - DNA, 15 bp, Homo sapiens
agctggggagggaga

SEQ ID NO: 5197231 - DNA, 22 bp, Homo sapiens
agctggggaggtgggaggccag

SEQ ID NO: 5197232 - DNA, 22 bp, Homo sapiens
agctggggatccctccccccca

SEQ ID NO: 5197233 - DNA, 21 bp, Homo sapiens
agctggggcaaggggcagcca

SEQ ID NO: 5197234 - DNA, 17 bp, Homo sapiens
agctggggccagaggct

SEQ ID NO: 5197235 - DNA, 19 bp, Homo sapiens
agctggggccagaggctgg

SEQ ID NO: 5197236 - DNA, 21 bp, Homo sapiens
agctggggccagaggctggga

SEQ ID NO: 5197237 - DNA, 17 bp, Homo sapiens
agctggggccaggctgg

SEQ ID NO: 5197238 - DNA, 20 bp, Homo sapiens
agctggggccaggctgggtc

SEQ ID NO: 5197239 - DNA, 23 bp, Homo sapiens
agctggggcccctcggctacccc

SEQ ID NO: 5197240 - DNA, 19 bp, Homo sapiens
agctggggcctggagaggg

SEQ ID NO: 5197241 - DNA, 18 bp, Homo sapiens
agctggggctgccagcct

SEQ ID NO: 5197242 - DNA, 19 bp, Homo sapiens
agctggggctgccagcctg

SEQ ID NO: 5197243 - DNA, 19 bp, Homo sapiens
agctggggcttatgggtgg

SEQ ID NO: 5197244 - DNA, 15 bp, Homo sapiens
agctggggcttcttt

SEQ ID NO: 5197245 - DNA, 21 bp, Homo sapiens
agctgggggatagaggggctg

SEQ ID NO: 5197246 - DNA, 14 bp, Homo sapiens
agctgggggcgcag

SEQ ID NO: 5197247 - DNA, 15 bp, Homo sapiens
agctgggggcgcaga

SEQ ID NO: 5197248 - DNA, 16 bp, Homo sapiens
agctggggggaaggcg

SEQ ID NO: 5197249 - DNA, 22 bp, Homo sapiens
agctggggggatgttctgcctc

SEQ ID NO: 5197250 - DNA, 15 bp, Homo sapiens
agctggggggctgtc

SEQ ID NO: 5197251 - DNA, 18 bp, Homo sapiens
agctgggggtgggccagg

SEQ ID NO: 5197252 - DNA, 21 bp, Homo sapiens
agctgggggtgggccaggctg

SEQ ID NO: 5197253 - DNA, 22 bp, Homo sapiens
agctggggtaggctgtctgtgc

SEQ ID NO: 5197254 - DNA, 18 bp, Homo sapiens
agctggggtctgggcagt

SEQ ID NO: 5197255 - DNA, 19 bp, Homo sapiens
agctggggtctgggcagtg

SEQ ID NO: 5197256 - DNA, 20 bp, Homo sapiens
agctggggtctgggcagtgc

SEQ ID NO: 5197257 - DNA, 23 bp, Homo sapiens
agctggggtctgggcagtgccac

SEQ ID NO: 5197258 - DNA, 19 bp, Homo sapiens
agctggggttcatgacaat

SEQ ID NO: 5197259 - DNA, 19 bp, Homo sapiens
agctgggtaccaggccacc

SEQ ID NO: 5197260 - DNA, 21 bp, Homo sapiens
agctgggtaccaggccaccca

SEQ ID NO: 5197261 - DNA, 19 bp, Homo sapiens
agctgggtactgactgaga

SEQ ID NO: 5197262 - DNA, 17 bp, Homo sapiens
agctgggtcaggcaggg

SEQ ID NO: 5197263 - DNA, 10 bp, Homo sapiens
agctgggtgg

SEQ ID NO: 5197264 - DNA, 20 bp, Homo sapiens
agctgggtggcactgccatg

SEQ ID NO: 5197265 - DNA, 15 bp, Homo sapiens
agctgggtggcctgt

SEQ ID NO: 5197266 - DNA, 22 bp, Homo sapiens
agctgggtggggcagcacacct

SEQ ID NO: 5197267 - DNA, 17 bp, Homo sapiens
agctgggtgtcaagagg

SEQ ID NO: 5197268 - DNA, 19 bp, Homo sapiens
agctgggttccgggaggca

SEQ ID NO: 5197269 - DNA, 21 bp, Homo sapiens
agctgggttccgggaggcaga

SEQ ID NO: 5197270 - DNA, 20 bp, Homo sapiens
agctgggttggaaaacagta

SEQ ID NO: 5197271 - DNA, 17 bp, Homo sapiens
agctgggttttcctagt

SEQ ID NO: 5197272 - DNA, 13 bp, Homo sapiens
agctggtaacatc

SEQ ID NO: 5197273 - DNA, 17 bp, Homo sapiens
agctggtagaggggaga

SEQ ID NO: 5197274 - DNA, 14 bp, Homo sapiens
agctggtagctggg

SEQ ID NO: 5197275 - DNA, 21 bp, Homo sapiens
agctggtagttagtagcatgt

SEQ ID NO: 5197276 - DNA, 13 bp, Homo sapiens
agctggtatattg

SEQ ID NO: 5197277 - DNA, 13 bp, Homo sapiens
agctggtcagtct

SEQ ID NO: 5197278 - DNA, 19 bp, Homo sapiens
agctggtcagtctttgctc

SEQ ID NO: 5197279 - DNA, 16 bp, Homo sapiens
agctggtccagggcct

SEQ ID NO: 5197280 - DNA, 17 bp, Homo sapiens
agctggtcccactcagt

SEQ ID NO: 5197281 - DNA, 22 bp, Homo sapiens
agctggtcctccactttgctgg

SEQ ID NO: 5197282 - DNA, 19 bp, Homo sapiens
agctggtcctgaccaggat

SEQ ID NO: 5197283 - DNA, 15 bp, Homo sapiens
agctggtcctgtgga

SEQ ID NO: 5197284 - DNA, 14 bp, Homo sapiens
agctggtctaagaa

SEQ ID NO: 5197285 - DNA, 15 bp, Homo sapiens
agctggtctgccagg

SEQ ID NO: 5197286 - DNA, 19 bp, Homo sapiens
agctggtctggagttgctg

SEQ ID NO: 5197287 - DNA, 18 bp, Homo sapiens
agctggtcttttctccta

SEQ ID NO: 5197288 - DNA, 18 bp, Homo sapiens
agctggtgacagccttgg

SEQ ID NO: 5197289 - DNA, 21 bp, Homo sapiens
agctggtgactttggggacag

SEQ ID NO: 5197290 - DNA, 20 bp, Homo sapiens
agctggtgcattacagagag

SEQ ID NO: 5197291 - DNA, 23 bp, Homo sapiens
agctggtgccaaatagccccaga

SEQ ID NO: 5197292 - DNA, 14 bp, Homo sapiens
agctggtgccccac

SEQ ID NO: 5197293 - DNA, 17 bp, Homo sapiens
agctggtgccccacctg

SEQ ID NO: 5197294 - DNA, 20 bp, Homo sapiens
agcccgtgcagtacaggcaa

SEQ ID NO: 5197295 - DNA, 19 bp, Homo sapiens
agcccgtgccacccccagc

SEQ ID NO: 5197296 - DNA, 17 bp, Homo sapiens
agcccgtgccctaccac

SEQ ID NO: 5197297 - DNA, 14 bp, Homo sapiens
agcccgtgggggca

SEQ ID NO: 5197298 - DNA, 16 bp, Homo sapiens
agcccgtgtcctgcct

SEQ ID NO: 5197299 - DNA, 15 bp, Homo sapiens
agcccgtgtggcccc

SEQ ID NO: 5197300 - DNA, 18 bp, Homo sapiens
agcccgtgtggccccttc

SEQ ID NO: 5197301 - DNA, 14 bp, Homo sapiens
agcccgttaaataa

SEQ ID NO: 5197302 - DNA, 18 bp, Homo sapiens
agcccgttagccccaggg

SEQ ID NO: 5197303 - DNA, 19 bp, Homo sapiens
agcccgttagccccaggga

SEQ ID NO: 5197304 - DNA, 15 bp, Homo sapiens
agcccgttttcacac

SEQ ID NO: 5197305 - DNA, 19 bp, Homo sapiens
agccctaaaaatccagact

SEQ ID NO: 5197306 - DNA, 21 bp, Homo sapiens
agccctaaacatcattcttga

SEQ ID NO: 5197307 - DNA, 14 bp, Homo sapiens
agccctaaataaat

SEQ ID NO: 5197308 - DNA, 16 bp, Homo sapiens
agccctaagcctgtcc

SEQ ID NO: 5197309 - DNA, 17 bp, Homo sapiens
agccctaagcctgtccc

SEQ ID NO: 5197310 - DNA, 21 bp, Homo sapiens
agccctaaggatctctcagga

SEQ ID NO: 5197311 - DNA, 18 bp, Homo sapiens
agccctaagtaaatctaa

SEQ ID NO: 5197312 - DNA, 18 bp, Homo sapiens
agccctacagagctgtgg

SEQ ID NO: 5197313 - DNA, 15 bp, Homo sapiens
agccctactccctgc

SEQ ID NO: 5197314 - DNA, 16 bp, Homo sapiens
agccctactccctgca

SEQ ID NO: 5197315 - DNA, 17 bp, Homo sapiens
agccctactccctgcag

SEQ ID NO: 5197316 - DNA, 20 bp, Homo sapiens
agccctactcggatggggca

SEQ ID NO: 5197317 - DNA, 22 bp, Homo sapiens
agccctactcggatggggcacg

SEQ ID NO: 5197318 - DNA, 19 bp, Homo sapiens
agccctagcggctgctcct

SEQ ID NO: 5197319 - DNA, 23 bp, Homo sapiens
agccctagtatgaaagctggggg

SEQ ID NO: 5197320 - DNA, 14 bp, Homo sapiens
agccctatcactga

SEQ ID NO: 5197321 - DNA, 23 bp, Homo sapiens
agccctatctatgtcctggaagt

SEQ ID NO: 5197322 - DNA, 14 bp, Homo sapiens
agccctatggatgt

SEQ ID NO: 5197323 - DNA, 17 bp, Homo sapiens
agccctattgctgctaa

SEQ ID NO: 5197324 - DNA, 16 bp, Homo sapiens
agccctcaacaggccc

SEQ ID NO: 5197325 - DNA, 19 bp, Homo sapiens
agccctcaacaggcccagg

SEQ ID NO: 5197326 - DNA, 22 bp, Homo sapiens
agccctcaacaggcccagggag

SEQ ID NO: 5197327 - DNA, 18 bp, Homo sapiens
agccctcaactattctgt

SEQ ID NO: 5197328 - DNA, 16 bp, Homo sapiens
agccctcaattgtgaa

SEQ ID NO: 5197329 - DNA, 16 bp, Homo sapiens
agccctcacacaccct

SEQ ID NO: 5197330 - DNA, 19 bp, Homo sapiens
agccctcacacaccctgtc

SEQ ID NO: 5197331 - DNA, 19 bp, Homo sapiens
agccctcacaccctggacg

SEQ ID NO: 5197332 - DNA, 17 bp, Homo sapiens
agccctcaccacagcct

SEQ ID NO: 5197333 - DNA, 18 bp, Homo sapiens
agccctcacctctgagga

SEQ ID NO: 5197334 - DNA, 21 bp, Homo sapiens
agccctcacctctgaggacag

SEQ ID NO: 5197335 - DNA, 23 bp, Homo sapiens
agccctcacctctgaggacagag

SEQ ID NO: 5197336 - DNA, 13 bp, Homo sapiens
agccctcagaaca

SEQ ID NO: 5197337 - DNA, 23 bp, Homo sapiens
agccctcagaagaaaacttttgt

SEQ ID NO: 5197338 - DNA, 16 bp, Homo sapiens
agccctcagatcccag

SEQ ID NO: 5197339 - DNA, 16 bp, Homo sapiens
agccctcagctggtcc

SEQ ID NO: 5197340 - DNA, 17 bp, Homo sapiens
agccctcagctggtcct

SEQ ID NO: 5197341 - DNA, 20 bp, Homo sapiens
agccctcagctggtcctgac

SEQ ID NO: 5197342 - DNA, 22 bp, Homo sapiens
agccctcagctggtcctgacca

SEQ ID NO: 5197343 - DNA, 10 bp, Homo sapiens
agccctcagg

SEQ ID NO: 5197344 - DNA, 13 bp, Homo sapiens
agccctcaggcca

SEQ ID NO: 5197345 - DNA, 14 bp, Homo sapiens
agccctcaggccag

SEQ ID NO: 5197346 - DNA, 18 bp, Homo sapiens
agccctcaggccagtgcc

SEQ ID NO: 5197347 - DNA, 22 bp, Homo sapiens
agccctcaggccagtgccagga

SEQ ID NO: 5197348 - DNA, 14 bp, Homo sapiens
agccctcagtcacc

SEQ ID NO: 5197349 - DNA, 16 bp, Homo sapiens
agccctcagttccttc

SEQ ID NO: 5197350 - DNA, 19 bp, Homo sapiens
agccctcatcccacttcct

SEQ ID NO: 5197351 - DNA, 22 bp, Homo sapiens
agccctcatcccacttcctttc

SEQ ID NO: 5197352 - DNA, 16 bp, Homo sapiens
agccctcatcccgagc

SEQ ID NO: 5197353 - DNA, 15 bp, Homo sapiens
agccctcatttttat

SEQ ID NO: 5197354 - DNA, 17 bp, Homo sapiens
agccctccaaaagcact

SEQ ID NO: 5197355 - DNA, 19 bp, Homo sapiens
agccctccacattttcaat

SEQ ID NO: 5197356 - DNA, 17 bp, Homo sapiens
agccctccacattttct

SEQ ID NO: 5197357 - DNA, 14 bp, Homo sapiens
agccctccacgtca

SEQ ID NO: 5197358 - DNA, 18 bp, Homo sapiens
agccctccacgtcagtgc

SEQ ID NO: 5197359 - DNA, 16 bp, Homo sapiens
agccctccagagcagg

SEQ ID NO: 5197360 - DNA, 13 bp, Homo sapiens
agccctccaggcc

SEQ ID NO: 5197361 - DNA, 17 bp, Homo sapiens
agccctccaggcctgca

SEQ ID NO: 5197362 - DNA, 19 bp, Homo sapiens
agccctccaggcctgcagg

SEQ ID NO: 5197363 - DNA, 12 bp, Homo sapiens
agccctcccact

SEQ ID NO: 5197364 - DNA, 12 bp, Homo sapiens
agccctcccagc

SEQ ID NO: 5197365 - DNA, 15 bp, Homo sapiens
agccctccccacctg

SEQ ID NO: 5197366 - DNA, 17 bp, Homo sapiens
agccctccccacctgct

SEQ ID NO: 5197367 - DNA, 19 bp, Homo sapiens
agccctccccacctgctca

SEQ ID NO: 5197368 - DNA, 12 bp, Homo sapiens
agccctccccat

SEQ ID NO: 5197369 - DNA, 12 bp, Homo sapiens
agccctccccca

SEQ ID NO: 5197370 - DNA, 13 bp, Homo sapiens
agccctcccccaa

SEQ ID NO: 5197371 - DNA, 12 bp, Homo sapiens
agccctccccct

SEQ ID NO: 5197372 - DNA, 14 bp, Homo sapiens
agccctccccctca

SEQ ID NO: 5197373 - DNA, 22 bp, Homo sapiens
agccctccctatgtctgcaaag

SEQ ID NO: 5197374 - DNA, 15 bp, Homo sapiens
agccctccctcttcc

SEQ ID NO: 5197375 - DNA, 17 bp, Homo sapiens
agccctccctcttccca

SEQ ID NO: 5197376 - DNA, 16 bp, Homo sapiens
agccctccctgcccct

SEQ ID NO: 5197377 - DNA, 17 bp, Homo sapiens
agccctccctgcccctc

SEQ ID NO: 5197378 - DNA, 19 bp, Homo sapiens
agccctccctgcccctccc

SEQ ID NO: 5197379 - DNA, 23 bp, Homo sapiens
agccctccctggcatgtcagagc

SEQ ID NO: 5197380 - DNA, 18 bp, Homo sapiens
agccctccgccagccctg

SEQ ID NO: 5197381 - DNA, 20 bp, Homo sapiens
agccctccgccagccctgtt

SEQ ID NO: 5197382 - DNA, 17 bp, Homo sapiens
agccctcctctgcactc

SEQ ID NO: 5197383 - DNA, 17 bp, Homo sapiens
agccctcctgagggccg

SEQ ID NO: 5197384 - DNA, 21 bp, Homo sapiens
agccctccttcttgccctgag

SEQ ID NO: 5197385 - DNA, 23 bp, Homo sapiens
agccctccttcttgccctgagct

SEQ ID NO: 5197386 - DNA, 15 bp, Homo sapiens
agccctccttgccac

SEQ ID NO: 5197387 - DNA, 18 bp, Homo sapiens
agccctcgaaccaaggca

SEQ ID NO: 5197388 - DNA, 18 bp, Homo sapiens
agccctcggcctccagac

SEQ ID NO: 5197389 - DNA, 17 bp, Homo sapiens
agccctcggcctccgag

SEQ ID NO: 5197390 - DNA, 16 bp, Homo sapiens
agccctcgtgcacaca

SEQ ID NO: 5197391 - DNA, 19 bp, Homo sapiens
agccctctagggcagggtg

SEQ ID NO: 5197392 - DNA, 14 bp, Homo sapiens
agccctctcactcc

SEQ ID NO: 5197393 - DNA, 17 bp, Homo sapiens
agccctctccacccaga

SEQ ID NO: 5197394 - DNA, 16 bp, Homo sapiens
agccctctgcctcctc

SEQ ID NO: 5197395 - DNA, 12 bp, Homo sapiens
agccctctgtgg

SEQ ID NO: 5197396 - DNA, 22 bp, Homo sapiens
agccctcttcaggggtcacctc

SEQ ID NO: 5197397 - DNA, 12 bp, Homo sapiens
agccctcttcca

SEQ ID NO: 5197398 - DNA, 15 bp, Homo sapiens
agccctcttccatca

SEQ ID NO: 5197399 - DNA, 16 bp, Homo sapiens
agccctcttccatcat

SEQ ID NO: 5197400 - DNA, 17 bp, Homo sapiens
agccctcttccatcatg

SEQ ID NO: 5197401 - DNA, 17 bp, Homo sapiens
agccctcttgcccagca

SEQ ID NO: 5197402 - DNA, 18 bp, Homo sapiens
agccctcttgcccagcac

SEQ ID NO: 5197403 - DNA, 20 bp, Homo sapiens
agccctctttaatgctgtct

SEQ ID NO: 5197404 - DNA, 21 bp, Homo sapiens
agccctctttaatgctgtctt

SEQ ID NO: 5197405 - DNA, 16 bp, Homo sapiens
agccctctttctctct

SEQ ID NO: 5197406 - DNA, 20 bp, Homo sapiens
agccctctttctctctgtgt

SEQ ID NO: 5197407 - DNA, 19 bp, Homo sapiens
agccctgaacaaagcacct

SEQ ID NO: 5197408 - DNA, 17 bp, Homo sapiens
agccctgaccctgtgga

SEQ ID NO: 5197409 - DNA, 23 bp, Homo sapiens
agccctgaccttggctgactggg

SEQ ID NO: 5197410 - DNA, 21 bp, Homo sapiens
agccctgactaaactaccacc

SEQ ID NO: 5197411 - DNA, 23 bp, Homo sapiens
agccctgactaaactaccacctc

SEQ ID NO: 5197412 - DNA, 16 bp, Homo sapiens
agccctgactcctgga

SEQ ID NO: 5197413 - DNA, 14 bp, Homo sapiens
agccctgagatggg

SEQ ID NO: 5197414 - DNA, 11 bp, Homo sapiens
agccctgagcc

SEQ ID NO: 5197415 - DNA, 14 bp, Homo sapiens
agccctgagccatg

SEQ ID NO: 5197416 - DNA, 15 bp, Homo sapiens
agccctgagccatgg

SEQ ID NO: 5197417 - DNA, 20 bp, Homo sapiens
agccctgagcccagaaaaaa

SEQ ID NO: 5197418 - DNA, 22 bp, Homo sapiens
agccctgagctagtgtcacctg

SEQ ID NO: 5197419 - DNA, 15 bp, Homo sapiens
agccctgagctcagg

SEQ ID NO: 5197420 - DNA, 21 bp, Homo sapiens
agccctgagctcaggctgagc

SEQ ID NO: 5197421 - DNA, 22 bp, Homo sapiens
agccctgagctggcctcacctg

SEQ ID NO: 5197422 - DNA, 22 bp, Homo sapiens
agccctgagctggcgtcacctg

SEQ ID NO: 5197423 - DNA, 22 bp, Homo sapiens
agccctgaggacagatgcctcc

SEQ ID NO: 5197424 - DNA, 19 bp, Homo sapiens
agccctgaggacctctcag

SEQ ID NO: 5197425 - DNA, 18 bp, Homo sapiens
agccctgaggaggccttg

SEQ ID NO: 5197426 - DNA, 15 bp, Homo sapiens
agccctgaggcctga

SEQ ID NO: 5197427 - DNA, 16 bp, Homo sapiens
agccctgaggcctgag

SEQ ID NO: 5197428 - DNA, 17 bp, Homo sapiens
agccctgaggcctgagg

SEQ ID NO: 5197429 - DNA, 19 bp, Homo sapiens
agccctgaggcctgaggcc

SEQ ID NO: 5197430 - DNA, 17 bp, Homo sapiens
agccctgaggggctggg

SEQ ID NO: 5197431 - DNA, 19 bp, Homo sapiens
agccctgaggggctgggct

SEQ ID NO: 5197432 - DNA, 19 bp, Homo sapiens
agccctgaggggtggacta

SEQ ID NO: 5197433 - DNA, 22 bp, Homo sapiens
agccctgaggtgaaagggagct

SEQ ID NO: 5197434 - DNA, 17 bp, Homo sapiens
agccctgagtgtcccaa

SEQ ID NO: 5197435 - DNA, 20 bp, Homo sapiens
agccctgagtgtcccaagcc

SEQ ID NO: 5197436 - DNA, 20 bp, Homo sapiens
agccctgagttcctagccac

SEQ ID NO: 5197437 - DNA, 15 bp, Homo sapiens
agccctgcaaatttt

SEQ ID NO: 5197438 - DNA, 12 bp, Homo sapiens
agccctgcacca

SEQ ID NO: 5197439 - DNA, 20 bp, Homo sapiens
agccctgcaccatgctgctg

SEQ ID NO: 5197440 - DNA, 12 bp, Homo sapiens
agccctgcagcc

SEQ ID NO: 5197441 - DNA, 13 bp, Homo sapiens
agccctgcagccc

SEQ ID NO: 5197442 - DNA, 18 bp, Homo sapiens
agccctgcagcccaccag

SEQ ID NO: 5197443 - DNA, 22 bp, Homo sapiens
agccctgcagcccaccagacgt

SEQ ID NO: 5197444 - DNA, 22 bp, Homo sapiens
agccctgcagtaatctccaggg

SEQ ID NO: 5197445 - DNA, 22 bp, Homo sapiens
agccctgcagtcacgtgaggcc

SEQ ID NO: 5197446 - DNA, 14 bp, Homo sapiens
agccctgccaggag

SEQ ID NO: 5197447 - DNA, 13 bp, Homo sapiens
agccctgcccaca

SEQ ID NO: 5197448 - DNA, 15 bp, Homo sapiens
agccctgccccacac

SEQ ID NO: 5197449 - DNA, 20 bp, Homo sapiens
agccctgccccacacctcct

SEQ ID NO: 5197450 - DNA, 18 bp, Homo sapiens
agccctgccctcactcca

SEQ ID NO: 5197451 - DNA, 20 bp, Homo sapiens
agccctgccctcactccact

SEQ ID NO: 5197452 - DNA, 17 bp, Homo sapiens
agccctgccctcccaag

SEQ ID NO: 5197453 - DNA, 14 bp, Homo sapiens
agccctgccctgca

SEQ ID NO: 5197454 - DNA, 16 bp, Homo sapiens
agccctgcctctgtgt

SEQ ID NO: 5197455 - DNA, 12 bp, Homo sapiens
agccctgcctgg

SEQ ID NO: 5197456 - DNA, 15 bp, Homo sapiens
agccctgcctggagg

SEQ ID NO: 5197457 - DNA, 16 bp, Homo sapiens
agccctgcctggagga

SEQ ID NO: 5197458 - DNA, 20 bp, Homo sapiens
agccctgcctggaggacctg

SEQ ID NO: 5197459 - DNA, 17 bp, Homo sapiens
agccctgcggagccggc

SEQ ID NO: 5197460 - DNA, 14 bp, Homo sapiens
agccctgctccctc

SEQ ID NO: 5197461 - DNA, 18 bp, Homo sapiens
agccctgctccctgcctc

SEQ ID NO: 5197462 - DNA, 12 bp, Homo sapiens
agccctgctctt

SEQ ID NO: 5197463 - DNA, 14 bp, Homo sapiens
agccctgctcttct

SEQ ID NO: 5197464 - DNA, 18 bp, Homo sapiens
agccctgctcttctctcc

SEQ ID NO: 5197465 - DNA, 19 bp, Homo sapiens
agccctgctcttctctccc

SEQ ID NO: 5197466 - DNA, 16 bp, Homo sapiens
agccctgctctttctc

SEQ ID NO: 5197467 - DNA, 18 bp, Homo sapiens
agccctgctgctgcctgc

SEQ ID NO: 5197468 - DNA, 17 bp, Homo sapiens
agccctgctgcttccta

SEQ ID NO: 5197469 - DNA, 20 bp, Homo sapiens
agccctgctgcttcctaact

SEQ ID NO: 5197470 - DNA, 22 bp, Homo sapiens
agccctgctgcttcctaactta

SEQ ID NO: 5197471 - DNA, 17 bp, Homo sapiens
agccctgctgtgggaga

SEQ ID NO: 5197472 - DNA, 23 bp, Homo sapiens
agccctgcttttgcataatgcaa

SEQ ID NO: 5197473 - DNA, 14 bp, Homo sapiens
agctggtgcccgga

SEQ ID NO: 5197474 - DNA, 16 bp, Homo sapiens
agctggtgctgcaagg

SEQ ID NO: 5197475 - DNA, 12 bp, Homo sapiens
agctggtggatg

SEQ ID NO: 5197476 - DNA, 20 bp, Homo sapiens
agctggtggatggtgacttt

SEQ ID NO: 5197477 - DNA, 21 bp, Homo sapiens
agctggtggatggtgactttt

SEQ ID NO: 5197478 - DNA, 12 bp, Homo sapiens
agctggtggccc

SEQ ID NO: 5197479 - DNA, 14 bp, Homo sapiens
agctggtggccctg

SEQ ID NO: 5197480 - DNA, 13 bp, Homo sapiens
agctggtggctag

SEQ ID NO: 5197481 - DNA, 19 bp, Homo sapiens
agctggtggctgtgtactt

SEQ ID NO: 5197482 - DNA, 23 bp, Homo sapiens
agctggtgggtgaaagaaatcat

SEQ ID NO: 5197483 - DNA, 22 bp, Homo sapiens
agctggtggtgcagccttcccc

SEQ ID NO: 5197484 - DNA, 19 bp, Homo sapiens
agctggtggttgtgccttt

SEQ ID NO: 5197485 - DNA, 14 bp, Homo sapiens
agctggtgtagcta

SEQ ID NO: 5197486 - DNA, 17 bp, Homo sapiens
agctggtgtagctacag

SEQ ID NO: 5197487 - DNA, 21 bp, Homo sapiens
agctggtgtagctacagagaa

SEQ ID NO: 5197488 - DNA, 22 bp, Homo sapiens
agctggtgtcagcccctcttcc

SEQ ID NO: 5197489 - DNA, 17 bp, Homo sapiens
agctggttactcagggt

SEQ ID NO: 5197490 - DNA, 19 bp, Homo sapiens
agctggttactcagggttc

SEQ ID NO: 5197491 - DNA, 21 bp, Homo sapiens
agctggttactcagggttcat

SEQ ID NO: 5197492 - DNA, 16 bp, Homo sapiens
agctggttcctgctag

SEQ ID NO: 5197493 - DNA, 16 bp, Homo sapiens
agctggttgaggtttc

SEQ ID NO: 5197494 - DNA, 15 bp, Homo sapiens
agctggttgctacat

SEQ ID NO: 5197495 - DNA, 10 bp, Homo sapiens
agctggtttc

SEQ ID NO: 5197496 - DNA, 15 bp, Homo sapiens
agctggtttcctcat

SEQ ID NO: 5197497 - DNA, 22 bp, Homo sapiens
agctggtttcctcattcctgaa

SEQ ID NO: 5197498 - DNA, 13 bp, Homo sapiens
agctggtttcctg

SEQ ID NO: 5197499 - DNA, 14 bp, Homo sapiens
agctggtttcctgc

SEQ ID NO: 5197500 - DNA, 18 bp, Homo sapiens
agctggtttcctgcccag

SEQ ID NO: 5197501 - DNA, 13 bp, Homo sapiens
agctggttttctc

SEQ ID NO: 5197502 - DNA, 22 bp, Homo sapiens
agctggtttttagcggagacgg

SEQ ID NO: 5197503 - DNA, 16 bp, Homo sapiens
agctgtaaaaatgtta

SEQ ID NO: 5197504 - DNA, 17 bp, Homo sapiens
agctgtaaaaatgttac

SEQ ID NO: 5197505 - DNA, 18 bp, Homo sapiens
agctgtaaaaatgttacg

SEQ ID NO: 5197506 - DNA, 14 bp, Homo sapiens
agctgtaaaacgct

SEQ ID NO: 5197507 - DNA, 17 bp, Homo sapiens
agctgtaaatacatgtg

SEQ ID NO: 5197508 - DNA, 17 bp, Homo sapiens
agctgtaagaaaatgct

SEQ ID NO: 5197509 - DNA, 23 bp, Homo sapiens
agctgtaagaaaatgctgtcaca

SEQ ID NO: 5197510 - DNA, 22 bp, Homo sapiens
agctgtaagaagagactgggaa

SEQ ID NO: 5197511 - DNA, 19 bp, Homo sapiens
agctgtaaggcatgaagga

SEQ ID NO: 5197512 - DNA, 13 bp, Homo sapiens
agctgtaagggca

SEQ ID NO: 5197513 - DNA, 14 bp, Homo sapiens
agctgtaagggcag

SEQ ID NO: 5197514 - DNA, 15 bp, Homo sapiens
agctgtaagggcagt

SEQ ID NO: 5197515 - DNA, 17 bp, Homo sapiens
agctgtaagggcagtgc

SEQ ID NO: 5197516 - DNA, 14 bp, Homo sapiens
agctgtaatatcat

SEQ ID NO: 5197517 - DNA, 19 bp, Homo sapiens
agctgtaatatcattttat

SEQ ID NO: 5197518 - DNA, 20 bp, Homo sapiens
agctgtaatatcattttata

SEQ ID NO: 5197519 - DNA, 15 bp, Homo sapiens
agctgtaatttcgcc

SEQ ID NO: 5197520 - DNA, 21 bp, Homo sapiens
agctgtaatttcgccttaaac

SEQ ID NO: 5197521 - DNA, 18 bp, Homo sapiens
agctgtacaaagggaagc

SEQ ID NO: 5197522 - DNA, 13 bp, Homo sapiens
agctgtacaaata

SEQ ID NO: 5197523 - DNA, 19 bp, Homo sapiens
agctgtacaaatcctctgt

SEQ ID NO: 5197524 - DNA, 19 bp, Homo sapiens
agctgtaccggccactgca

SEQ ID NO: 5197525 - DNA, 16 bp, Homo sapiens
agctgtacgaaaaaga

SEQ ID NO: 5197526 - DNA, 18 bp, Homo sapiens
agctgtacgaaaaagagc

SEQ ID NO: 5197527 - DNA, 23 bp, Homo sapiens
agctgtacgaaaaagagcatata

SEQ ID NO: 5197528 - DNA, 13 bp, Homo sapiens
agctgtactataa

SEQ ID NO: 5197529 - DNA, 21 bp, Homo sapiens
agctgtactcagagcagagca

SEQ ID NO: 5197530 - DNA, 12 bp, Homo sapiens
agctgtactctt

SEQ ID NO: 5197531 - DNA, 19 bp, Homo sapiens
agctgtacttcgtcttcta

SEQ ID NO: 5197532 - DNA, 21 bp, Homo sapiens
agctgtacttcgtcttctaat

SEQ ID NO: 5197533 - DNA, 19 bp, Homo sapiens
agctgtagaaatgtatcct

SEQ ID NO: 5197534 - DNA, 19 bp, Homo sapiens
agctgtagaactctgcagg

SEQ ID NO: 5197535 - DNA, 19 bp, Homo sapiens
agctgtagccatggctcag

SEQ ID NO: 5197536 - DNA, 17 bp, Homo sapiens
agctgtagctcccgagc

SEQ ID NO: 5197537 - DNA, 15 bp, Homo sapiens
agctgtaggagagtc

SEQ ID NO: 5197538 - DNA, 23 bp, Homo sapiens
agctgtataattaattgtcatta

SEQ ID NO: 5197539 - DNA, 23 bp, Homo sapiens
agctgtatagatgagtttttcat

SEQ ID NO: 5197540 - DNA, 21 bp, Homo sapiens
agctgtatagctgcttccagt

SEQ ID NO: 5197541 - DNA, 22 bp, Homo sapiens
agctgtatataaacgtgtcccg

SEQ ID NO: 5197542 - DNA, 19 bp, Homo sapiens
agctgtatatttgaaactg

SEQ ID NO: 5197543 - DNA, 14 bp, Homo sapiens
agctgtatcactgc

SEQ ID NO: 5197544 - DNA, 16 bp, Homo sapiens
agctgtatcactgcct

SEQ ID NO: 5197545 - DNA, 23 bp, Homo sapiens
agctgtatcttgatgtttagaaa

SEQ ID NO: 5197546 - DNA, 14 bp, Homo sapiens
agctgtatgattcc

SEQ ID NO: 5197547 - DNA, 17 bp, Homo sapiens
agctgtatgattcccag

SEQ ID NO: 5197548 - DNA, 15 bp, Homo sapiens
agctgtatgtacttc

SEQ ID NO: 5197549 - DNA, 17 bp, Homo sapiens
agctgtattaagtgact

SEQ ID NO: 5197550 - DNA, 21 bp, Homo sapiens
agctgtattatcttaaaccca

SEQ ID NO: 5197551 - DNA, 15 bp, Homo sapiens
agctgtattgaatca

SEQ ID NO: 5197552 - DNA, 16 bp, Homo sapiens
agctgtattgtctgaa

SEQ ID NO: 5197553 - DNA, 20 bp, Homo sapiens
agctgtattttggctttctc

SEQ ID NO: 5197554 - DNA, 20 bp, Homo sapiens
agctgtcaccactacagtaa

SEQ ID NO: 5197555 - DNA, 18 bp, Homo sapiens
agctgtcacctctcagct

SEQ ID NO: 5197556 - DNA, 13 bp, Homo sapiens
agctgtcacctgc

SEQ ID NO: 5197557 - DNA, 15 bp, Homo sapiens
agctgtcacctgctc

SEQ ID NO: 5197558 - DNA, 19 bp, Homo sapiens
agctgtcacctgctcacag

SEQ ID NO: 5197559 - DNA, 16 bp, Homo sapiens
agctgtcactctgtgc

SEQ ID NO: 5197560 - DNA, 21 bp, Homo sapiens
agctgtcacttcgcgtgccct

SEQ ID NO: 5197561 - DNA, 20 bp, Homo sapiens
agctgtcacttttgctccga

SEQ ID NO: 5197562 - DNA, 17 bp, Homo sapiens
agctgtcagaagtttct

SEQ ID NO: 5197563 - DNA, 16 bp, Homo sapiens
agctgtcaggctggga

SEQ ID NO: 5197564 - DNA, 18 bp, Homo sapiens
agctgtcatcaacattct

SEQ ID NO: 5197565 - DNA, 19 bp, Homo sapiens
agctgtcatcaattaaagg

SEQ ID NO: 5197566 - DNA, 21 bp, Homo sapiens
agctgtcatggtgcaatttgt

SEQ ID NO: 5197567 - DNA, 14 bp, Homo sapiens
agctgtcattcagg

SEQ ID NO: 5197568 - DNA, 15 bp, Homo sapiens
agctgtcattcagga

SEQ ID NO: 5197569 - DNA, 13 bp, Homo sapiens
agctgtcccaagt

SEQ ID NO: 5197570 - DNA, 23 bp, Homo sapiens
agctgtcccatctggtcatttgg

SEQ ID NO: 5197571 - DNA, 17 bp, Homo sapiens
agctgtcccctctgtca

SEQ ID NO: 5197572 - DNA, 19 bp, Homo sapiens
agctgtcccctggagaagg

SEQ ID NO: 5197573 - DNA, 12 bp, Homo sapiens
agctgtccctgc

SEQ ID NO: 5197574 - DNA, 14 bp, Homo sapiens
agctgtccctgcag

SEQ ID NO: 5197575 - DNA, 15 bp, Homo sapiens
agctgtccctgcagg

SEQ ID NO: 5197576 - DNA, 14 bp, Homo sapiens
agctgtcctcctgg

SEQ ID NO: 5197577 - DNA, 21 bp, Homo sapiens
agctgtcctctcagaactcct

SEQ ID NO: 5197578 - DNA, 12 bp, Homo sapiens
agctgtcctgaa

SEQ ID NO: 5197579 - DNA, 14 bp, Homo sapiens
agctgtcctgcagc

SEQ ID NO: 5197580 - DNA, 15 bp, Homo sapiens
agctgtcctgcagca

SEQ ID NO: 5197581 - DNA, 15 bp, Homo sapiens
agctgtcctgtgatg

SEQ ID NO: 5197582 - DNA, 19 bp, Homo sapiens
agctgtcctgtgatgtcag

SEQ ID NO: 5197583 - DNA, 14 bp, Homo sapiens
agctgtcctttttc

SEQ ID NO: 5197584 - DNA, 16 bp, Homo sapiens
agctgtcctttttcct

SEQ ID NO: 5197585 - DNA, 17 bp, Homo sapiens
agctgtcctttttcctc

SEQ ID NO: 5197586 - DNA, 18 bp, Homo sapiens
agctgtcctttttcctct

SEQ ID NO: 5197587 - DNA, 21 bp, Homo sapiens
agctgtcctttttcctctcca

SEQ ID NO: 5197588 - DNA, 23 bp, Homo sapiens
agctgtcctttttcctctccaca

SEQ ID NO: 5197589 - DNA, 16 bp, Homo sapiens
agctgtcggagggctg

SEQ ID NO: 5197590 - DNA, 18 bp, Homo sapiens
agctgtcgggggccactg

SEQ ID NO: 5197591 - DNA, 19 bp, Homo sapiens
agctgtcgggggccactgt

SEQ ID NO: 5197592 - DNA, 22 bp, Homo sapiens
agctgtcgggggccactgtgtt

SEQ ID NO: 5197593 - DNA, 18 bp, Homo sapiens
agctgtcgtctgactctg

SEQ ID NO: 5197594 - DNA, 18 bp, Homo sapiens
agctgtctaacccccagc

SEQ ID NO: 5197595 - DNA, 13 bp, Homo sapiens
agctgtctactgg

SEQ ID NO: 5197596 - DNA, 22 bp, Homo sapiens
agctgtctatgcagcctgctct

SEQ ID NO: 5197597 - DNA, 13 bp, Homo sapiens
agctgtctcagga

SEQ ID NO: 5197598 - DNA, 14 bp, Homo sapiens
agctgtctcaggag

SEQ ID NO: 5197599 - DNA, 13 bp, Homo sapiens
agctgtctctctt

SEQ ID NO: 5197600 - DNA, 14 bp, Homo sapiens
agctgtctcttcgg

SEQ ID NO: 5197601 - DNA, 19 bp, Homo sapiens
agctgtctgaagcccaaag

SEQ ID NO: 5197602 - DNA, 22 bp, Homo sapiens
agctgtctgaagcccaaagcct

SEQ ID NO: 5197603 - DNA, 13 bp, Homo sapiens
agctgtctgactg

SEQ ID NO: 5197604 - DNA, 17 bp, Homo sapiens
agctgtctgctcagaca

SEQ ID NO: 5197605 - DNA, 13 bp, Homo sapiens
agctgtctgctgc

SEQ ID NO: 5197606 - DNA, 13 bp, Homo sapiens
agctgtctgtctc

SEQ ID NO: 5197607 - DNA, 14 bp, Homo sapiens
agctgtctgtctct

SEQ ID NO: 5197608 - DNA, 12 bp, Homo sapiens
agctgtcttccc

SEQ ID NO: 5197609 - DNA, 16 bp, Homo sapiens
agctgtcttttggagg

SEQ ID NO: 5197610 - DNA, 23 bp, Homo sapiens
agctgtgaaatgtgcaagagtat

SEQ ID NO: 5197611 - DNA, 13 bp, Homo sapiens
agctgtgaaattg

SEQ ID NO: 5197612 - DNA, 18 bp, Homo sapiens
agctgtgaaattgaagtc

SEQ ID NO: 5197613 - DNA, 13 bp, Homo sapiens
agctgtgaatatt

SEQ ID NO: 5197614 - DNA, 20 bp, Homo sapiens
agctgtgaatggctgtgccc

SEQ ID NO: 5197615 - DNA, 17 bp, Homo sapiens
agctgtgacattgctgg

SEQ ID NO: 5197616 - DNA, 20 bp, Homo sapiens
agctgtgacattgctggtca

SEQ ID NO: 5197617 - DNA, 15 bp, Homo sapiens
agctgtgaccctcaa

SEQ ID NO: 5197618 - DNA, 17 bp, Homo sapiens
agctgtgacctctcccc

SEQ ID NO: 5197619 - DNA, 15 bp, Homo sapiens
agctgtgacctgctg

SEQ ID NO: 5197620 - DNA, 18 bp, Homo sapiens
agctgtgacctgctgagc

SEQ ID NO: 5197621 - DNA, 20 bp, Homo sapiens
agctgtgacctgctgagctc

SEQ ID NO: 5197622 - DNA, 22 bp, Homo sapiens
agctgtgacctgctgagctctg

SEQ ID NO: 5197623 - DNA, 16 bp, Homo sapiens
agctgtgagcaaacag

SEQ ID NO: 5197624 - DNA, 18 bp, Homo sapiens
agctgtgagccatgcctc

SEQ ID NO: 5197625 - DNA, 21 bp, Homo sapiens
agctgtgagtgcgtgtgtgtg

SEQ ID NO: 5197626 - DNA, 19 bp, Homo sapiens
agctgtgcaattactgcct

SEQ ID NO: 5197627 - DNA, 16 bp, Homo sapiens
agctgtgcagaggaaa

SEQ ID NO: 5197628 - DNA, 16 bp, Homo sapiens
agctgtgcaggcatgg

SEQ ID NO: 5197629 - DNA, 20 bp, Homo sapiens
agctgtgccaccctgggctc

SEQ ID NO: 5197630 - DNA, 22 bp, Homo sapiens
agctgtgccaccctgggctctg

SEQ ID NO: 5197631 - DNA, 15 bp, Homo sapiens
agctgtgccagcagg

SEQ ID NO: 5197632 - DNA, 22 bp, Homo sapiens
agctgtgccgggaggcagccac

SEQ ID NO: 5197633 - DNA, 23 bp, Homo sapiens
agctgtgcctgctcagcagccag

SEQ ID NO: 5197634 - DNA, 17 bp, Homo sapiens
agctgtgccttcagctg

SEQ ID NO: 5197635 - DNA, 18 bp, Homo sapiens
agctgtgccttcagctgt

SEQ ID NO: 5197636 - DNA, 16 bp, Homo sapiens
agctgtgcgtgtgtgt

SEQ ID NO: 5197637 - DNA, 17 bp, Homo sapiens
agctgtgcgtgtgtgtg

SEQ ID NO: 5197638 - DNA, 15 bp, Homo sapiens
agctgtgctcagaag

SEQ ID NO: 5197639 - DNA, 22 bp, Homo sapiens
agctgtgctcgggtgctgccag

SEQ ID NO: 5197640 - DNA, 16 bp, Homo sapiens
agctgtgctgggaagc

SEQ ID NO: 5197641 - DNA, 20 bp, Homo sapiens
agctgtgctgggaagcccgg

SEQ ID NO: 5197642 - DNA, 19 bp, Homo sapiens
agctgtgctgggaggtccc

SEQ ID NO: 5197643 - DNA, 17 bp, Homo sapiens
agctgtgctgtggagag

SEQ ID NO: 5197644 - DNA, 22 bp, Homo sapiens
agctgtgcttatggtaccagat

SEQ ID NO: 5197645 - DNA, 18 bp, Homo sapiens
agctgtggaaatggtgag

SEQ ID NO: 5197646 - DNA, 23 bp, Homo sapiens
agctgtggacaaaaaaaaaagaa

SEQ ID NO: 5197647 - DNA, 22 bp, Homo sapiens
agctgtggcagagttacagttc

SEQ ID NO: 5197648 - DNA, 15 bp, Homo sapiens
agctgtggcctcacc

SEQ ID NO: 5197649 - DNA, 21 bp, Homo sapiens
agctgtgggcggctcctggtg

SEQ ID NO: 5197650 - DNA, 20 bp, Homo sapiens
agctgtggggaacacagcta

SEQ ID NO: 5197651 - DNA, 16 bp, Homo sapiens
agccctggaaacatac

SEQ ID NO: 5197652 - DNA, 20 bp, Homo sapiens
agccctggacacccctgctc

SEQ ID NO: 5197653 - DNA, 17 bp, Homo sapiens
agccctggaccccaggc

SEQ ID NO: 5197654 - DNA, 18 bp, Homo sapiens
agccctggaccccaggct

SEQ ID NO: 5197655 - DNA, 20 bp, Homo sapiens
agccctggaccccaggctct

SEQ ID NO: 5197656 - DNA, 20 bp, Homo sapiens
agccctggagccaactgctg

SEQ ID NO: 5197657 - DNA, 22 bp, Homo sapiens
agccctggagccaactgctgct

SEQ ID NO: 5197658 - DNA, 20 bp, Homo sapiens
agccctggaggctggatggc

SEQ ID NO: 5197659 - DNA, 12 bp, Homo sapiens
agccctggaggt

SEQ ID NO: 5197660 - DNA, 15 bp, Homo sapiens
agccctggaggtgcc

SEQ ID NO: 5197661 - DNA, 21 bp, Homo sapiens
agccctggaggtgccagcaaa

SEQ ID NO: 5197662 - DNA, 14 bp, Homo sapiens
agccctggatggcc

SEQ ID NO: 5197663 - DNA, 16 bp, Homo sapiens
agccctggatggcctc

SEQ ID NO: 5197664 - DNA, 21 bp, Homo sapiens
agccctggatggcctctgggg

SEQ ID NO: 5197665 - DNA, 22 bp, Homo sapiens
agccctggatggcctctggggc

SEQ ID NO: 5197666 - DNA, 15 bp, Homo sapiens
agccctggatggtgg

SEQ ID NO: 5197667 - DNA, 18 bp, Homo sapiens
agccctggattaggaggg

SEQ ID NO: 5197668 - DNA, 18 bp, Homo sapiens
agccctggcaaatgcctg

SEQ ID NO: 5197669 - DNA, 23 bp, Homo sapiens
agccctggcaaatgcctgactca

SEQ ID NO: 5197670 - DNA, 11 bp, Homo sapiens
agccctggcag

SEQ ID NO: 5197671 - DNA, 13 bp, Homo sapiens
agccctggcagga

SEQ ID NO: 5197672 - DNA, 22 bp, Homo sapiens
agccctggcatgtcaacagcgt

SEQ ID NO: 5197673 - DNA, 14 bp, Homo sapiens
agccctggccagag

SEQ ID NO: 5197674 - DNA, 17 bp, Homo sapiens
agccctggcccaggtgc

SEQ ID NO: 5197675 - DNA, 21 bp, Homo sapiens
agccctggcccccacagcgct

SEQ ID NO: 5197676 - DNA, 22 bp, Homo sapiens
agccctggcccccacagcgctc

SEQ ID NO: 5197677 - DNA, 19 bp, Homo sapiens
agccctggcccccatcagc

SEQ ID NO: 5197678 - DNA, 16 bp, Homo sapiens
agccctggccccctga

SEQ ID NO: 5197679 - DNA, 14 bp, Homo sapiens
agccctggcccctc

SEQ ID NO: 5197680 - DNA, 17 bp, Homo sapiens
agccctggcccctccaa

SEQ ID NO: 5197681 - DNA, 12 bp, Homo sapiens
agccctggccct

SEQ ID NO: 5197682 - DNA, 15 bp, Homo sapiens
agccctggccctgcc

SEQ ID NO: 5197683 - DNA, 15 bp, Homo sapiens
agccctggcctggct

SEQ ID NO: 5197684 - DNA, 18 bp, Homo sapiens
agccctggcctggctggg

SEQ ID NO: 5197685 - DNA, 19 bp, Homo sapiens
agccctggcctttttcttt

SEQ ID NO: 5197686 - DNA, 14 bp, Homo sapiens
agccctggctccca

SEQ ID NO: 5197687 - DNA, 16 bp, Homo sapiens
agccctggctcccacc

SEQ ID NO: 5197688 - DNA, 21 bp, Homo sapiens
agccctggctctgcccctcag

SEQ ID NO: 5197689 - DNA, 23 bp, Homo sapiens
agccctggctctgcccctcaggg

SEQ ID NO: 5197690 - DNA, 18 bp, Homo sapiens
agccctggctgaaggact

SEQ ID NO: 5197691 - DNA, 20 bp, Homo sapiens
agccctggctgaaggactgt

SEQ ID NO: 5197692 - DNA, 16 bp, Homo sapiens
agccctgggaaccact

SEQ ID NO: 5197693 - DNA, 19 bp, Homo sapiens
agccctgggaaccactccc

SEQ ID NO: 5197694 - DNA, 13 bp, Homo sapiens
agccctgggaccg

SEQ ID NO: 5197695 - DNA, 17 bp, Homo sapiens
agccctgggccagggcg

SEQ ID NO: 5197696 - DNA, 19 bp, Homo sapiens
agccctgggccccaccacc

SEQ ID NO: 5197697 - DNA, 14 bp, Homo sapiens
agccctgggcctgg

SEQ ID NO: 5197698 - DNA, 14 bp, Homo sapiens
agccctgggcttgg

SEQ ID NO: 5197699 - DNA, 20 bp, Homo sapiens
agccctgggcttggctcttg

SEQ ID NO: 5197700 - DNA, 13 bp, Homo sapiens
agccctggggact

SEQ ID NO: 5197701 - DNA, 19 bp, Homo sapiens
agccctggggactgttcca

SEQ ID NO: 5197702 - DNA, 22 bp, Homo sapiens
agccctggggactgttccaaag

SEQ ID NO: 5197703 - DNA, 16 bp, Homo sapiens
agccctggggcagggt

SEQ ID NO: 5197704 - DNA, 19 bp, Homo sapiens
agccctggggcccctcgac

SEQ ID NO: 5197705 - DNA, 15 bp, Homo sapiens
agccctggggctggg

SEQ ID NO: 5197706 - DNA, 16 bp, Homo sapiens
agccctgggggccagc

SEQ ID NO: 5197707 - DNA, 20 bp, Homo sapiens
agccctgggtaccctgagcc

SEQ ID NO: 5197708 - DNA, 16 bp, Homo sapiens
agccctggtggcagtg

SEQ ID NO: 5197709 - DNA, 21 bp, Homo sapiens
agccctggtggcagtgggagc

SEQ ID NO: 5197710 - DNA, 23 bp, Homo sapiens
agccctggtggcagtgggagctg

SEQ ID NO: 5197711 - DNA, 13 bp, Homo sapiens
agccctggtggcc

SEQ ID NO: 5197712 - DNA, 20 bp, Homo sapiens
agccctggtggccaagcctg

SEQ ID NO: 5197713 - DNA, 16 bp, Homo sapiens
agccctggtgtgtttc

SEQ ID NO: 5197714 - DNA, 20 bp, Homo sapiens
agccctggttctccatcccc

SEQ ID NO: 5197715 - DNA, 18 bp, Homo sapiens
agccctggttctggctgt

SEQ ID NO: 5197716 - DNA, 16 bp, Homo sapiens
agccctggtttgaaat

SEQ ID NO: 5197717 - DNA, 16 bp, Homo sapiens
agccctgtacccaccc

SEQ ID NO: 5197718 - DNA, 18 bp, Homo sapiens
agccctgtacccacccca

SEQ ID NO: 5197719 - DNA, 20 bp, Homo sapiens
agccctgtacccaccccagc

SEQ ID NO: 5197720 - DNA, 22 bp, Homo sapiens
agccctgtacccaccccagcac

SEQ ID NO: 5197721 - DNA, 16 bp, Homo sapiens
agccctgtcagtgcag

SEQ ID NO: 5197722 - DNA, 13 bp, Homo sapiens
agccctgtcccct

SEQ ID NO: 5197723 - DNA, 15 bp, Homo sapiens
agccctgtcctggtt

SEQ ID NO: 5197724 - DNA, 18 bp, Homo sapiens
agccctgtctactgacca

SEQ ID NO: 5197725 - DNA, 12 bp, Homo sapiens
agccctgtgctt

SEQ ID NO: 5197726 - DNA, 19 bp, Homo sapiens
agccctgtggatgagccct

SEQ ID NO: 5197727 - DNA, 14 bp, Homo sapiens
agccctgtggccgc

SEQ ID NO: 5197728 - DNA, 20 bp, Homo sapiens
agccctgtggccgccacctg

SEQ ID NO: 5197729 - DNA, 20 bp, Homo sapiens
agccctgttccgcctcactg

SEQ ID NO: 5197730 - DNA, 21 bp, Homo sapiens
agccctgttccgcctcactgg

SEQ ID NO: 5197731 - DNA, 22 bp, Homo sapiens
agccctgttccgcctcactggg

SEQ ID NO: 5197732 - DNA, 11 bp, Homo sapiens
agccctgttct

SEQ ID NO: 5197733 - DNA, 20 bp, Homo sapiens
agccctgttctcgttgccct

SEQ ID NO: 5197734 - DNA, 20 bp, Homo sapiens
agccctgttgacacaggtct

SEQ ID NO: 5197735 - DNA, 18 bp, Homo sapiens
agccctgttggcagctct

SEQ ID NO: 5197736 - DNA, 17 bp, Homo sapiens
agccctgttgtgccaca

SEQ ID NO: 5197737 - DNA, 12 bp, Homo sapiens
agcccttagcct

SEQ ID NO: 5197738 - DNA, 22 bp, Homo sapiens
agcccttagccttgctgtagag

SEQ ID NO: 5197739 - DNA, 21 bp, Homo sapiens
agcccttatgcggttaatttt

SEQ ID NO: 5197740 - DNA, 13 bp, Homo sapiens
agcccttcagatt

SEQ ID NO: 5197741 - DNA, 13 bp, Homo sapiens
agcccttccagcc

SEQ ID NO: 5197742 - DNA, 15 bp, Homo sapiens
agcccttccagcctg

SEQ ID NO: 5197743 - DNA, 20 bp, Homo sapiens
agcccttccagcctgggaca

SEQ ID NO: 5197744 - DNA, 12 bp, Homo sapiens
agcccttcccag

SEQ ID NO: 5197745 - DNA, 17 bp, Homo sapiens
agcccttcccaggccag

SEQ ID NO: 5197746 - DNA, 15 bp, Homo sapiens
agcccttcccagggc

SEQ ID NO: 5197747 - DNA, 12 bp, Homo sapiens
agcccttccctg

SEQ ID NO: 5197748 - DNA, 16 bp, Homo sapiens
agcccttccctgcttt

SEQ ID NO: 5197749 - DNA, 14 bp, Homo sapiens
agcccttcctacct

SEQ ID NO: 5197750 - DNA, 22 bp, Homo sapiens
agcccttcctcctgaagcctct

SEQ ID NO: 5197751 - DNA, 12 bp, Homo sapiens
agcccttcctct

SEQ ID NO: 5197752 - DNA, 20 bp, Homo sapiens
agcccttcctctcactcctg

SEQ ID NO: 5197753 - DNA, 18 bp, Homo sapiens
agcccttcctctgctccc

SEQ ID NO: 5197754 - DNA, 13 bp, Homo sapiens
agcccttccttgg

SEQ ID NO: 5197755 - DNA, 14 bp, Homo sapiens
agcccttccttggg

SEQ ID NO: 5197756 - DNA, 21 bp, Homo sapiens
agcccttccttgggcgtctcc

SEQ ID NO: 5197757 - DNA, 18 bp, Homo sapiens
agcccttctaccccacct

SEQ ID NO: 5197758 - DNA, 20 bp, Homo sapiens
agcccttctaccccacctga

SEQ ID NO: 5197759 - DNA, 11 bp, Homo sapiens
agcccttctct

SEQ ID NO: 5197760 - DNA, 23 bp, Homo sapiens
agcccttctctttgacttaggtt

SEQ ID NO: 5197761 - DNA, 18 bp, Homo sapiens
agcccttctttccacaga

SEQ ID NO: 5197762 - DNA, 16 bp, Homo sapiens
agcccttgaagatatc

SEQ ID NO: 5197763 - DNA, 20 bp, Homo sapiens
agcccttgagctccccaaaa

SEQ ID NO: 5197764 - DNA, 15 bp, Homo sapiens
agcccttgcacaggc

SEQ ID NO: 5197765 - DNA, 18 bp, Homo sapiens
agcccttgcacaggccac

SEQ ID NO: 5197766 - DNA, 14 bp, Homo sapiens
agcccttgcactcc

SEQ ID NO: 5197767 - DNA, 18 bp, Homo sapiens
agcccttgcccccatccc

SEQ ID NO: 5197768 - DNA, 13 bp, Homo sapiens
agcccttgcctcc

SEQ ID NO: 5197769 - DNA, 16 bp, Homo sapiens
agcccttgcctcccca

SEQ ID NO: 5197770 - DNA, 23 bp, Homo sapiens
agcccttgcctccccatttccca

SEQ ID NO: 5197771 - DNA, 19 bp, Homo sapiens
agcccttgctctacctggc

SEQ ID NO: 5197772 - DNA, 23 bp, Homo sapiens
agcccttgctctacctggccggt

SEQ ID NO: 5197773 - DNA, 19 bp, Homo sapiens
agcccttggaacaccctgg

SEQ ID NO: 5197774 - DNA, 20 bp, Homo sapiens
agcccttggaacaccctgga

SEQ ID NO: 5197775 - DNA, 21 bp, Homo sapiens
agcccttggaacaccctggat

SEQ ID NO: 5197776 - DNA, 22 bp, Homo sapiens
agcccttggaacaccctggatg

SEQ ID NO: 5197777 - DNA, 23 bp, Homo sapiens
agcccttggaacaccctggatgc

SEQ ID NO: 5197778 - DNA, 11 bp, Homo sapiens
agcccttggcc

SEQ ID NO: 5197779 - DNA, 12 bp, Homo sapiens
agcccttggcca

SEQ ID NO: 5197780 - DNA, 15 bp, Homo sapiens
agcccttggggaggg

SEQ ID NO: 5197781 - DNA, 23 bp, Homo sapiens
agcccttgggggtcctcctccag

SEQ ID NO: 5197782 - DNA, 21 bp, Homo sapiens
agcccttgtgaatcaagggtc

SEQ ID NO: 5197783 - DNA, 20 bp, Homo sapiens
agcccttgtgtgtgccctgg

SEQ ID NO: 5197784 - DNA, 21 bp, Homo sapiens
agcccttgtgtgtgccctggg

SEQ ID NO: 5197785 - DNA, 14 bp, Homo sapiens
agccctttaaaacg

SEQ ID NO: 5197786 - DNA, 14 bp, Homo sapiens
agccctttccaggg

SEQ ID NO: 5197787 - DNA, 17 bp, Homo sapiens
agccctttctgtgtgca

SEQ ID NO: 5197788 - DNA, 21 bp, Homo sapiens
agccctttgcaggcccagcag

SEQ ID NO: 5197789 - DNA, 16 bp, Homo sapiens
agccctttgctctgga

SEQ ID NO: 5197790 - DNA, 21 bp, Homo sapiens
agccctttgctctggaggaag

SEQ ID NO: 5197791 - DNA, 21 bp, Homo sapiens
agccctttgctgttcgcagcc

SEQ ID NO: 5197792 - DNA, 15 bp, Homo sapiens
agccctttggagaac

SEQ ID NO: 5197793 - DNA, 21 bp, Homo sapiens
agccctttgggaggctgaggc

SEQ ID NO: 5197794 - DNA, 22 bp, Homo sapiens
agccctttgggaggctgaggcg

SEQ ID NO: 5197795 - DNA, 19 bp, Homo sapiens
agccctttggtgataagta

SEQ ID NO: 5197796 - DNA, 22 bp, Homo sapiens
agcccttttacagctcttggca

SEQ ID NO: 5197797 - DNA, 16 bp, Homo sapiens
agccgaactccaggct

SEQ ID NO: 5197798 - DNA, 22 bp, Homo sapiens
agccgaactccaggctgggctg

SEQ ID NO: 5197799 - DNA, 21 bp, Homo sapiens
agccgacaatgccctgctggc

SEQ ID NO: 5197800 - DNA, 13 bp, Homo sapiens
agccgaccccctc

SEQ ID NO: 5197801 - DNA, 20 bp, Homo sapiens
agccgaccccctctccctgc

SEQ ID NO: 5197802 - DNA, 22 bp, Homo sapiens
agccgaccctcctggccttcct

SEQ ID NO: 5197803 - DNA, 12 bp, Homo sapiens
agccgacctcag

SEQ ID NO: 5197804 - DNA, 13 bp, Homo sapiens
agccgacctcagc

SEQ ID NO: 5197805 - DNA, 13 bp, Homo sapiens
agccgactctggc

SEQ ID NO: 5197806 - DNA, 16 bp, Homo sapiens
agccgactctggccct

SEQ ID NO: 5197807 - DNA, 21 bp, Homo sapiens
agccgactctggccctggccc

SEQ ID NO: 5197808 - DNA, 14 bp, Homo sapiens
agccgagaaattgg

SEQ ID NO: 5197809 - DNA, 13 bp, Homo sapiens
agccgagagcctg

SEQ ID NO: 5197810 - DNA, 14 bp, Homo sapiens
agccgagagcctgc

SEQ ID NO: 5197811 - DNA, 16 bp, Homo sapiens
agccgagagcctgctc

SEQ ID NO: 5197812 - DNA, 20 bp, Homo sapiens
agccgagatagccaaggcca

SEQ ID NO: 5197813 - DNA, 21 bp, Homo sapiens
agccgagatagccaaggccaa

SEQ ID NO: 5197814 - DNA, 21 bp, Homo sapiens
agccgagatcggggtggcaga

SEQ ID NO: 5197815 - DNA, 19 bp, Homo sapiens
agccgagattgcaccactg

SEQ ID NO: 5197816 - DNA, 21 bp, Homo sapiens
agccgagattgcgccactgca

SEQ ID NO: 5197817 - DNA, 15 bp, Homo sapiens
agccgagcaggaggc

SEQ ID NO: 5197818 - DNA, 12 bp, Homo sapiens
agccgagcccca

SEQ ID NO: 5197819 - DNA, 14 bp, Homo sapiens
agccgagccccagg

SEQ ID NO: 5197820 - DNA, 16 bp, Homo sapiens
agccgagccgggcctg

SEQ ID NO: 5197821 - DNA, 23 bp, Homo sapiens
agccgagctcgtgtatcctgggg

SEQ ID NO: 5197822 - DNA, 21 bp, Homo sapiens
agccgagctctcctgggccag

SEQ ID NO: 5197823 - DNA, 13 bp, Homo sapiens
agccgaggcctgg

SEQ ID NO: 5197824 - DNA, 16 bp, Homo sapiens
agccgaggcctggcca

SEQ ID NO: 5197825 - DNA, 12 bp, Homo sapiens
agccgaggggag

SEQ ID NO: 5197826 - DNA, 16 bp, Homo sapiens
agccgaggtccctgct

SEQ ID NO: 5197827 - DNA, 14 bp, Homo sapiens
agccgattcctcca

SEQ ID NO: 5197828 - DNA, 16 bp, Homo sapiens
agccgattctctgccc

SEQ ID NO: 5197829 - DNA, 19 bp, Homo sapiens
agctgtggggaacatggct

SEQ ID NO: 5197830 - DNA, 21 bp, Homo sapiens
agctgtggtacaaatgtgata

SEQ ID NO: 5197831 - DNA, 22 bp, Homo sapiens
agctgtggtcaaggctacagat

SEQ ID NO: 5197832 - DNA, 14 bp, Homo sapiens
agctgtggtcccac

SEQ ID NO: 5197833 - DNA, 15 bp, Homo sapiens
agctgtggtcccacc

SEQ ID NO: 5197834 - DNA, 21 bp, Homo sapiens
agctgtgtccaaaaccgccag

SEQ ID NO: 5197835 - DNA, 18 bp, Homo sapiens
agctgtgtccttgcacct

SEQ ID NO: 5197836 - DNA, 21 bp, Homo sapiens
agctgtgtctgacatgtttgt

SEQ ID NO: 5197837 - DNA, 19 bp, Homo sapiens
agctgtgtctgagcccaac

SEQ ID NO: 5197838 - DNA, 13 bp, Homo sapiens
agctgtgtctgcc

SEQ ID NO: 5197839 - DNA, 21 bp, Homo sapiens
agctgtgtctgccaaacacat

SEQ ID NO: 5197840 - DNA, 20 bp, Homo sapiens
agctgtgtgctctccaagcc

SEQ ID NO: 5197841 - DNA, 13 bp, Homo sapiens
agctgtgtgtttt

SEQ ID NO: 5197842 - DNA, 17 bp, Homo sapiens
agctgtgttacttgaag

SEQ ID NO: 5197843 - DNA, 12 bp, Homo sapiens
agctgtgttcat

SEQ ID NO: 5197844 - DNA, 13 bp, Homo sapiens
agctgtgttgaaa

SEQ ID NO: 5197845 - DNA, 14 bp, Homo sapiens
agctgtgttgaaac

SEQ ID NO: 5197846 - DNA, 23 bp, Homo sapiens
agctgtgttgttgcttcttgtga

SEQ ID NO: 5197847 - DNA, 11 bp, Homo sapiens
agctgtgttta

SEQ ID NO: 5197848 - DNA, 20 bp, Homo sapiens
agctgtgtttgagtttctgg

SEQ ID NO: 5197849 - DNA, 23 bp, Homo sapiens
agctgtgttttgtctgagcctct

SEQ ID NO: 5197850 - DNA, 13 bp, Homo sapiens
agctgttaaaata

SEQ ID NO: 5197851 - DNA, 15 bp, Homo sapiens
agctgttaaaataca

SEQ ID NO: 5197852 - DNA, 17 bp, Homo sapiens
agctgttaaaatacata

SEQ ID NO: 5197853 - DNA, 22 bp, Homo sapiens
agctgttaaaatacataacttc

SEQ ID NO: 5197854 - DNA, 23 bp, Homo sapiens
agctgttaaactgttagcactgt

SEQ ID NO: 5197855 - DNA, 23 bp, Homo sapiens
agctgttaaagatatttttattc

SEQ ID NO: 5197856 - DNA, 15 bp, Homo sapiens
agctgttaccattca

SEQ ID NO: 5197857 - DNA, 16 bp, Homo sapiens
agctgttaccattcac

SEQ ID NO: 5197858 - DNA, 14 bp, Homo sapiens
agctgttactgtct

SEQ ID NO: 5197859 - DNA, 18 bp, Homo sapiens
agctgttactgtcttcag

SEQ ID NO: 5197860 - DNA, 17 bp, Homo sapiens
agctgttactttctttc

SEQ ID NO: 5197861 - DNA, 14 bp, Homo sapiens
agctgttagcacgt

SEQ ID NO: 5197862 - DNA, 15 bp, Homo sapiens
agctgttagttgctg

SEQ ID NO: 5197863 - DNA, 17 bp, Homo sapiens
agctgttataaatttat

SEQ ID NO: 5197864 - DNA, 18 bp, Homo sapiens
agctgttatcttgtgtat

SEQ ID NO: 5197865 - DNA, 16 bp, Homo sapiens
agctgttatgctgttt

SEQ ID NO: 5197866 - DNA, 18 bp, Homo sapiens
agctgttatgctgtttcc

SEQ ID NO: 5197867 - DNA, 19 bp, Homo sapiens
agctgttatgctgtttcct

SEQ ID NO: 5197868 - DNA, 12 bp, Homo sapiens
agctgttattct

SEQ ID NO: 5197869 - DNA, 17 bp, Homo sapiens
agctgttatttgcagtc

SEQ ID NO: 5197870 - DNA, 18 bp, Homo sapiens
agctgttccacaggggct

SEQ ID NO: 5197871 - DNA, 21 bp, Homo sapiens
agctgttccccaccgccctgc

SEQ ID NO: 5197872 - DNA, 16 bp, Homo sapiens
agctgttcctgttcag

SEQ ID NO: 5197873 - DNA, 18 bp, Homo sapiens
agctgttcctgttcagta

SEQ ID NO: 5197874 - DNA, 15 bp, Homo sapiens
agctgttctaattaa

SEQ ID NO: 5197875 - DNA, 13 bp, Homo sapiens
agctgttctctgc

SEQ ID NO: 5197876 - DNA, 14 bp, Homo sapiens
agctgttctctgct

SEQ ID NO: 5197877 - DNA, 16 bp, Homo sapiens
agctgttctctgcttt

SEQ ID NO: 5197878 - DNA, 22 bp, Homo sapiens
agctgttctgtcccttggagct

SEQ ID NO: 5197879 - DNA, 15 bp, Homo sapiens
agctgttcttgaaag

SEQ ID NO: 5197880 - DNA, 13 bp, Homo sapiens
agctgttcttttt

SEQ ID NO: 5197881 - DNA, 21 bp, Homo sapiens
agctgttcttttttgtacttt

SEQ ID NO: 5197882 - DNA, 15 bp, Homo sapiens
agctgttgaccaggc

SEQ ID NO: 5197883 - DNA, 16 bp, Homo sapiens
agctgttgaccaggca

SEQ ID NO: 5197884 - DNA, 21 bp, Homo sapiens
agctgttgactctagtactgt

SEQ ID NO: 5197885 - DNA, 13 bp, Homo sapiens
agctgttgagaaa

SEQ ID NO: 5197886 - DNA, 14 bp, Homo sapiens
agctgttgagctgt

SEQ ID NO: 5197887 - DNA, 15 bp, Homo sapiens
agctgttgagctgtt

SEQ ID NO: 5197888 - DNA, 23 bp, Homo sapiens
agctgttgatgggatgattgaag

SEQ ID NO: 5197889 - DNA, 15 bp, Homo sapiens
agctgttgcagatga

SEQ ID NO: 5197890 - DNA, 15 bp, Homo sapiens
agctgttgcaggcag

SEQ ID NO: 5197891 - DNA, 16 bp, Homo sapiens
agctgttgcaggcagt

SEQ ID NO: 5197892 - DNA, 19 bp, Homo sapiens
agctgttgcaggcagtgtc

SEQ ID NO: 5197893 - DNA, 21 bp, Homo sapiens
agctgttgcaggcagtgtctt

SEQ ID NO: 5197894 - DNA, 13 bp, Homo sapiens
agctgttggaaga

SEQ ID NO: 5197895 - DNA, 17 bp, Homo sapiens
agctgttggaagaaaag

SEQ ID NO: 5197896 - DNA, 13 bp, Homo sapiens
agctgttggaatg

SEQ ID NO: 5197897 - DNA, 17 bp, Homo sapiens
agctgttggaatgttgt

SEQ ID NO: 5197898 - DNA, 22 bp, Homo sapiens
agctgttggaatgttgttaaat

SEQ ID NO: 5197899 - DNA, 19 bp, Homo sapiens
agctgttggcctcgcctgg

SEQ ID NO: 5197900 - DNA, 22 bp, Homo sapiens
agctgttggcctcgcctgggcc

SEQ ID NO: 5197901 - DNA, 22 bp, Homo sapiens
agctgttggcctctgcaaagga

SEQ ID NO: 5197902 - DNA, 16 bp, Homo sapiens
agctgttggggcaggg

SEQ ID NO: 5197903 - DNA, 17 bp, Homo sapiens
agctgttggggcagggg

SEQ ID NO: 5197904 - DNA, 18 bp, Homo sapiens
agctgttgtacatttatg

SEQ ID NO: 5197905 - DNA, 17 bp, Homo sapiens
agctgttgtctcttctc

SEQ ID NO: 5197906 - DNA, 16 bp, Homo sapiens
agctgttgtgagcttt

SEQ ID NO: 5197907 - DNA, 21 bp, Homo sapiens
agctgttgtgagctttgaagt

SEQ ID NO: 5197908 - DNA, 16 bp, Homo sapiens
agctgtttaagatggg

SEQ ID NO: 5197909 - DNA, 16 bp, Homo sapiens
agctgtttactgacat

SEQ ID NO: 5197910 - DNA, 17 bp, Homo sapiens
agctgtttactgacatg

SEQ ID NO: 5197911 - DNA, 13 bp, Homo sapiens
agctgtttatgca

SEQ ID NO: 5197912 - DNA, 19 bp, Homo sapiens
agctgtttatggcctcagc

SEQ ID NO: 5197913 - DNA, 12 bp, Homo sapiens
agctgtttatgt

SEQ ID NO: 5197914 - DNA, 13 bp, Homo sapiens
agctgtttattta

SEQ ID NO: 5197915 - DNA, 19 bp, Homo sapiens
agctgtttattttatatta

SEQ ID NO: 5197916 - DNA, 14 bp, Homo sapiens
agctgtttccatag

SEQ ID NO: 5197917 - DNA, 23 bp, Homo sapiens
agctgtttcgcatccaccgccac

SEQ ID NO: 5197918 - DNA, 21 bp, Homo sapiens
agctgtttctaaacagttgag

SEQ ID NO: 5197919 - DNA, 12 bp, Homo sapiens
agctgtttctca

SEQ ID NO: 5197920 - DNA, 13 bp, Homo sapiens
agctgtttctcat

SEQ ID NO: 5197921 - DNA, 17 bp, Homo sapiens
agctgtttctcatgaag

SEQ ID NO: 5197922 - DNA, 16 bp, Homo sapiens
agctgtttgaaatgtt

SEQ ID NO: 5197923 - DNA, 18 bp, Homo sapiens
agctgtttgaaatgttta

SEQ ID NO: 5197924 - DNA, 13 bp, Homo sapiens
agctgtttggaaa

SEQ ID NO: 5197925 - DNA, 20 bp, Homo sapiens
agctgtttggatacagctgc

SEQ ID NO: 5197926 - DNA, 19 bp, Homo sapiens
agctgtttggttttaaaat

SEQ ID NO: 5197927 - DNA, 23 bp, Homo sapiens
agctgtttggttttaaaatactg

SEQ ID NO: 5197928 - DNA, 14 bp, Homo sapiens
agctgttttcaaag

SEQ ID NO: 5197929 - DNA, 17 bp, Homo sapiens
agctgttttcaaagccc

SEQ ID NO: 5197930 - DNA, 15 bp, Homo sapiens
agctgttttccctga

SEQ ID NO: 5197931 - DNA, 14 bp, Homo sapiens
agctgttttcttct

SEQ ID NO: 5197932 - DNA, 22 bp, Homo sapiens
agctgttttggaacgcagttga

SEQ ID NO: 5197933 - DNA, 18 bp, Homo sapiens
agctgttttggatgaatg

SEQ ID NO: 5197934 - DNA, 16 bp, Homo sapiens
agctgttttgtgtata

SEQ ID NO: 5197935 - DNA, 17 bp, Homo sapiens
agctgttttgtgtatat

SEQ ID NO: 5197936 - DNA, 21 bp, Homo sapiens
agctgtttttaggctgttcct

SEQ ID NO: 5197937 - DNA, 21 bp, Homo sapiens
agctgtttttgtgctctttgt

SEQ ID NO: 5197938 - DNA, 18 bp, Homo sapiens
agctgtttttttcattag

SEQ ID NO: 5197939 - DNA, 12 bp, Homo sapiens
agcttaaaaaaa

SEQ ID NO: 5197940 - DNA, 17 bp, Homo sapiens
agcttaaaaaagaaaga

SEQ ID NO: 5197941 - DNA, 14 bp, Homo sapiens
agcttaaaacactt

SEQ ID NO: 5197942 - DNA, 12 bp, Homo sapiens
agcttaaaataa

SEQ ID NO: 5197943 - DNA, 23 bp, Homo sapiens
agcttaaaataaacagttgtgaa

SEQ ID NO: 5197944 - DNA, 15 bp, Homo sapiens
agcttaaaataagtg

SEQ ID NO: 5197945 - DNA, 13 bp, Homo sapiens
agcttaaaataca

SEQ ID NO: 5197946 - DNA, 19 bp, Homo sapiens
agcttaaaattggtaattg

SEQ ID NO: 5197947 - DNA, 21 bp, Homo sapiens
agcttaaaattggtaattgaa

SEQ ID NO: 5197948 - DNA, 14 bp, Homo sapiens
agcttaaactgaat

SEQ ID NO: 5197949 - DNA, 12 bp, Homo sapiens
agcttaaagctt

SEQ ID NO: 5197950 - DNA, 15 bp, Homo sapiens
agcttaaagcttgat

SEQ ID NO: 5197951 - DNA, 18 bp, Homo sapiens
agcttaaagcttgatttg

SEQ ID NO: 5197952 - DNA, 20 bp, Homo sapiens
agcttaaaggggctagagtg

SEQ ID NO: 5197953 - DNA, 16 bp, Homo sapiens
agcttaaataaattca

SEQ ID NO: 5197954 - DNA, 15 bp, Homo sapiens
agcttaacaatgcaa

SEQ ID NO: 5197955 - DNA, 16 bp, Homo sapiens
agcttaacaatgcaac

SEQ ID NO: 5197956 - DNA, 21 bp, Homo sapiens
agcttaacaatgcaactttta

SEQ ID NO: 5197957 - DNA, 13 bp, Homo sapiens
agcttaacagtgt

SEQ ID NO: 5197958 - DNA, 16 bp, Homo sapiens
agcttaacattgactt

SEQ ID NO: 5197959 - DNA, 19 bp, Homo sapiens
agcttaaccgaagaactaa

SEQ ID NO: 5197960 - DNA, 14 bp, Homo sapiens
agcttaagaaaaaa

SEQ ID NO: 5197961 - DNA, 20 bp, Homo sapiens
agcttaagggaatatgcatt

SEQ ID NO: 5197962 - DNA, 21 bp, Homo sapiens
agcttaatcttaatgtctggt

SEQ ID NO: 5197963 - DNA, 14 bp, Homo sapiens
agcttaatgactta

SEQ ID NO: 5197964 - DNA, 19 bp, Homo sapiens
agcttaatggctgataatt

SEQ ID NO: 5197965 - DNA, 22 bp, Homo sapiens
agcttaatggctgataatttta

SEQ ID NO: 5197966 - DNA, 14 bp, Homo sapiens
agcttaatgtcttt

SEQ ID NO: 5197967 - DNA, 15 bp, Homo sapiens
agcttaattctcctt

SEQ ID NO: 5197968 - DNA, 18 bp, Homo sapiens
agcttaatttttaaaaac

SEQ ID NO: 5197969 - DNA, 15 bp, Homo sapiens
agcttacaagccagc

SEQ ID NO: 5197970 - DNA, 17 bp, Homo sapiens
agcttacaagccagctg

SEQ ID NO: 5197971 - DNA, 19 bp, Homo sapiens
agcttacaagccagctgga

SEQ ID NO: 5197972 - DNA, 15 bp, Homo sapiens
agcttacactgagga

SEQ ID NO: 5197973 - DNA, 22 bp, Homo sapiens
agcttacagaatgggagaaaat

SEQ ID NO: 5197974 - DNA, 18 bp, Homo sapiens
agcttacaggaagctttt

SEQ ID NO: 5197975 - DNA, 17 bp, Homo sapiens
agcttacaggagccagc

SEQ ID NO: 5197976 - DNA, 19 bp, Homo sapiens
agcttacaggagccagcct

SEQ ID NO: 5197977 - DNA, 20 bp, Homo sapiens
agcttacaggagccagcctg

SEQ ID NO: 5197978 - DNA, 16 bp, Homo sapiens
agcttacatgagaaca

SEQ ID NO: 5197979 - DNA, 22 bp, Homo sapiens
agcttacattgaaaacagatat

SEQ ID NO: 5197980 - DNA, 20 bp, Homo sapiens
agcttaccagaagcttccat

SEQ ID NO: 5197981 - DNA, 18 bp, Homo sapiens
agcttacccaagctgtgg

SEQ ID NO: 5197982 - DNA, 15 bp, Homo sapiens
agcttacccttggtt

SEQ ID NO: 5197983 - DNA, 15 bp, Homo sapiens
agcttacctgacaca

SEQ ID NO: 5197984 - DNA, 16 bp, Homo sapiens
agcttacctgggcaca

SEQ ID NO: 5197985 - DNA, 13 bp, Homo sapiens
agcttacgtagtt

SEQ ID NO: 5197986 - DNA, 15 bp, Homo sapiens
agcttacgtagttct

SEQ ID NO: 5197987 - DNA, 15 bp, Homo sapiens
agcttagaaactgga

SEQ ID NO: 5197988 - DNA, 10 bp, Homo sapiens
agcttagaac

SEQ ID NO: 5197989 - DNA, 18 bp, Homo sapiens
agcttagaattatttgca

SEQ ID NO: 5197990 - DNA, 23 bp, Homo sapiens
agcttagaccgtggtgtcctctg

SEQ ID NO: 5197991 - DNA, 16 bp, Homo sapiens
agcttagagttcttct

SEQ ID NO: 5197992 - DNA, 21 bp, Homo sapiens
agcttagagttcttctttctt

SEQ ID NO: 5197993 - DNA, 17 bp, Homo sapiens
agcttagattctgtatg

SEQ ID NO: 5197994 - DNA, 19 bp, Homo sapiens
agcttagattttctgtaaa

SEQ ID NO: 5197995 - DNA, 16 bp, Homo sapiens
agcttagcaggagagg

SEQ ID NO: 5197996 - DNA, 22 bp, Homo sapiens
agcttagcaggagaggagagcc

SEQ ID NO: 5197997 - DNA, 17 bp, Homo sapiens
agcttagccaatgtggg

SEQ ID NO: 5197998 - DNA, 13 bp, Homo sapiens
agcttagccttgt

SEQ ID NO: 5197999 - DNA, 16 bp, Homo sapiens
agcttagccttgtgcc

SEQ ID NO: 5198000 - DNA, 21 bp, Homo sapiens
agcttagccttgtgccctgcc

SEQ ID NO: 5198001 - DNA, 17 bp, Homo sapiens
agcttagctctgccctg

SEQ ID NO: 5198002 - DNA, 22 bp, Homo sapiens
agcttagctctgccctggaacc

SEQ ID NO: 5198003 - DNA, 19 bp, Homo sapiens
agcttagctttagaaacag

SEQ ID NO: 5198004 - DNA, 13 bp, Homo sapiens
agcttaggcaggg

SEQ ID NO: 5198005 - DNA, 14 bp, Homo sapiens
agcttagggccctg

SEQ ID NO: 5198006 - DNA, 18 bp, Homo sapiens
agcttagggccctggagg

SEQ ID NO: 5198007 - DNA, 14 bp, Homo sapiens
agcttagggtctca

SEQ ID NO: 5198008 - DNA, 20 bp, Homo sapiens
agcttagtcctgggagagga

SEQ ID NO: 5198009 - DNA, 18 bp, Homo sapiens
agccgcaaatcaacccca

SEQ ID NO: 5198010 - DNA, 15 bp, Homo sapiens
agccgcaaggatcct

SEQ ID NO: 5198011 - DNA, 15 bp, Homo sapiens
agccgcacatctggt

SEQ ID NO: 5198012 - DNA, 21 bp, Homo sapiens
agccgcaccctgcacctgctg

SEQ ID NO: 5198013 - DNA, 13 bp, Homo sapiens
agccgcagacctg

SEQ ID NO: 5198014 - DNA, 18 bp, Homo sapiens
agccgcagacctggagct

SEQ ID NO: 5198015 - DNA, 19 bp, Homo sapiens
agccgcagacctggagctt

SEQ ID NO: 5198016 - DNA, 14 bp, Homo sapiens
agccgcagggcctg

SEQ ID NO: 5198017 - DNA, 16 bp, Homo sapiens
agccgcagggcctgct

SEQ ID NO: 5198018 - DNA, 17 bp, Homo sapiens
agccgcatcttctccat

SEQ ID NO: 5198019 - DNA, 13 bp, Homo sapiens
agccgccagctgg

SEQ ID NO: 5198020 - DNA, 15 bp, Homo sapiens
agccgccagctggga

SEQ ID NO: 5198021 - DNA, 23 bp, Homo sapiens
agccgccagctgggagcactggt

SEQ ID NO: 5198022 - DNA, 17 bp, Homo sapiens
agccgccatcagcccaa

SEQ ID NO: 5198023 - DNA, 20 bp, Homo sapiens
agccgccattgccaccagga

SEQ ID NO: 5198024 - DNA, 13 bp, Homo sapiens
agccgcccaaggc

SEQ ID NO: 5198025 - DNA, 18 bp, Homo sapiens
agccgcccacttcccgtt

SEQ ID NO: 5198026 - DNA, 23 bp, Homo sapiens
agccgcccacttcccgtttcctc

SEQ ID NO: 5198027 - DNA, 22 bp, Homo sapiens
agccgccccgtgtccccccagg

SEQ ID NO: 5198028 - DNA, 12 bp, Homo sapiens
agccgccctgag

SEQ ID NO: 5198029 - DNA, 13 bp, Homo sapiens
agccgccctgggc

SEQ ID NO: 5198030 - DNA, 22 bp, Homo sapiens
agccgccggaagtggctccgtg

SEQ ID NO: 5198031 - DNA, 21 bp, Homo sapiens
agccgcctcccttatgcagga

SEQ ID NO: 5198032 - DNA, 18 bp, Homo sapiens
agccgcctcggagtgtgg

SEQ ID NO: 5198033 - DNA, 19 bp, Homo sapiens
agccgcctgaaagccacaa

SEQ ID NO: 5198034 - DNA, 12 bp, Homo sapiens
agccgcctgctt

SEQ ID NO: 5198035 - DNA, 17 bp, Homo sapiens
agccgccttaagctgat

SEQ ID NO: 5198036 - DNA, 16 bp, Homo sapiens
agccgccttccttgac

SEQ ID NO: 5198037 - DNA, 15 bp, Homo sapiens
agccgcgctctgccc

SEQ ID NO: 5198038 - DNA, 17 bp, Homo sapiens
agccgcgctctgcccct

SEQ ID NO: 5198039 - DNA, 20 bp, Homo sapiens
agccgcgctttcccctcctc

SEQ ID NO: 5198040 - DNA, 16 bp, Homo sapiens
agccgcgggccaggag

SEQ ID NO: 5198041 - DNA, 19 bp, Homo sapiens
agccgcggggaagctggct

SEQ ID NO: 5198042 - DNA, 21 bp, Homo sapiens
agccgcggggaagctggcttt

SEQ ID NO: 5198043 - DNA, 19 bp, Homo sapiens
agccgctctttgctccaga

SEQ ID NO: 5198044 - DNA, 21 bp, Homo sapiens
agccgctgcagggctcccatg

SEQ ID NO: 5198045 - DNA, 17 bp, Homo sapiens
agccgctgcccggcgcc

SEQ ID NO: 5198046 - DNA, 14 bp, Homo sapiens
agccgctgccctgg

SEQ ID NO: 5198047 - DNA, 18 bp, Homo sapiens
agccgctgccctgggtcc

SEQ ID NO: 5198048 - DNA, 19 bp, Homo sapiens
agccgctgccctgggtcct

SEQ ID NO: 5198049 - DNA, 13 bp, Homo sapiens
agccgctggggcc

SEQ ID NO: 5198050 - DNA, 22 bp, Homo sapiens
agccgctggggccagttggtcc

SEQ ID NO: 5198051 - DNA, 16 bp, Homo sapiens
agccgctggtgcccac

SEQ ID NO: 5198052 - DNA, 20 bp, Homo sapiens
agccgctggtgcccaccagc

SEQ ID NO: 5198053 - DNA, 16 bp, Homo sapiens
agccgcttccccagct

SEQ ID NO: 5198054 - DNA, 14 bp, Homo sapiens
agccggaaggccga

SEQ ID NO: 5198055 - DNA, 15 bp, Homo sapiens
agccggaaggccgag

SEQ ID NO: 5198056 - DNA, 18 bp, Homo sapiens
agccggaatagagcctcg

SEQ ID NO: 5198057 - DNA, 21 bp, Homo sapiens
agccggacacaagcggccctg

SEQ ID NO: 5198058 - DNA, 16 bp, Homo sapiens
agccggacacttctca

SEQ ID NO: 5198059 - DNA, 20 bp, Homo sapiens
agccggacacttctcaggaa

SEQ ID NO: 5198060 - DNA, 22 bp, Homo sapiens
agccggacacttctcaggaaat

SEQ ID NO: 5198061 - DNA, 19 bp, Homo sapiens
agccggagcagttggcctg

SEQ ID NO: 5198062 - DNA, 16 bp, Homo sapiens
agccggatcttggaga

SEQ ID NO: 5198063 - DNA, 20 bp, Homo sapiens
agccggcaagcgagcacagt

SEQ ID NO: 5198064 - DNA, 15 bp, Homo sapiens
agccggcacagggtc

SEQ ID NO: 5198065 - DNA, 19 bp, Homo sapiens
agccggcactgagaagaac

SEQ ID NO: 5198066 - DNA, 19 bp, Homo sapiens
agccggcatccttgcctgt

SEQ ID NO: 5198067 - DNA, 20 bp, Homo sapiens
agccggcatccttgcctgtc

SEQ ID NO: 5198068 - DNA, 20 bp, Homo sapiens
agccggccaccagatgctga

SEQ ID NO: 5198069 - DNA, 19 bp, Homo sapiens
agccggccccccctctttt

SEQ ID NO: 5198070 - DNA, 14 bp, Homo sapiens
agccggcctctctg

SEQ ID NO: 5198071 - DNA, 21 bp, Homo sapiens
agccggcggagctctggcttt

SEQ ID NO: 5198072 - DNA, 18 bp, Homo sapiens
agccggcggcccaagccc

SEQ ID NO: 5198073 - DNA, 16 bp, Homo sapiens
agccggctcttcaaag

SEQ ID NO: 5198074 - DNA, 20 bp, Homo sapiens
agccgggaaagaagagccgg

SEQ ID NO: 5198075 - DNA, 12 bp, Homo sapiens
agccgggaaagc

SEQ ID NO: 5198076 - DNA, 15 bp, Homo sapiens
agccgggaaagctgt

SEQ ID NO: 5198077 - DNA, 23 bp, Homo sapiens
agccgggaccctcaggtgtagct

SEQ ID NO: 5198078 - DNA, 12 bp, Homo sapiens
agccgggcacag

SEQ ID NO: 5198079 - DNA, 15 bp, Homo sapiens
agccgggcatggtgg

SEQ ID NO: 5198080 - DNA, 14 bp, Homo sapiens
agccgggccccatg

SEQ ID NO: 5198081 - DNA, 16 bp, Homo sapiens
agccgggccccatggt

SEQ ID NO: 5198082 - DNA, 21 bp, Homo sapiens
agccgggcgtggtggtgagtg

SEQ ID NO: 5198083 - DNA, 15 bp, Homo sapiens
agccgggctccaggg

SEQ ID NO: 5198084 - DNA, 13 bp, Homo sapiens
agccgggctctgc

SEQ ID NO: 5198085 - DNA, 15 bp, Homo sapiens
agccgggctctgcac

SEQ ID NO: 5198086 - DNA, 19 bp, Homo sapiens
agccgggctctgcacccac

SEQ ID NO: 5198087 - DNA, 22 bp, Homo sapiens
agccggggactcccaggctgga

SEQ ID NO: 5198088 - DNA, 15 bp, Homo sapiens
agccggggagctgag

SEQ ID NO: 5198089 - DNA, 21 bp, Homo sapiens
agccggggagctgaggggcag

SEQ ID NO: 5198090 - DNA, 13 bp, Homo sapiens
agccggggcctta

SEQ ID NO: 5198091 - DNA, 20 bp, Homo sapiens
agccgggggaggggccctca

SEQ ID NO: 5198092 - DNA, 23 bp, Homo sapiens
agccgggggaggggccctcaggc

SEQ ID NO: 5198093 - DNA, 22 bp, Homo sapiens
agccgggggctggccttctcct

SEQ ID NO: 5198094 - DNA, 20 bp, Homo sapiens
agccggggtggggtgcctga

SEQ ID NO: 5198095 - DNA, 23 bp, Homo sapiens
agccggggtggggtgcctgagcc

SEQ ID NO: 5198096 - DNA, 20 bp, Homo sapiens
agccggggtggggtggctgc

SEQ ID NO: 5198097 - DNA, 23 bp, Homo sapiens
agccggggtggggtggctgcagc

SEQ ID NO: 5198098 - DNA, 22 bp, Homo sapiens
agccggggtgtaacttcctgct

SEQ ID NO: 5198099 - DNA, 23 bp, Homo sapiens
agccggggtgtaacttcctgctg

SEQ ID NO: 5198100 - DNA, 20 bp, Homo sapiens
agccgggtctgcctcttctg

SEQ ID NO: 5198101 - DNA, 22 bp, Homo sapiens
agccgggtctgcctcttctggg

SEQ ID NO: 5198102 - DNA, 20 bp, Homo sapiens
agccggtaactgtcctgtcc

SEQ ID NO: 5198103 - DNA, 12 bp, Homo sapiens
agccggtgcctg

SEQ ID NO: 5198104 - DNA, 13 bp, Homo sapiens
agccggtgcctgg

SEQ ID NO: 5198105 - DNA, 14 bp, Homo sapiens
agccggtgcctggc

SEQ ID NO: 5198106 - DNA, 16 bp, Homo sapiens
agccggtgtccctgga

SEQ ID NO: 5198107 - DNA, 16 bp, Homo sapiens
agccggtttgggagag

SEQ ID NO: 5198108 - DNA, 20 bp, Homo sapiens
agccgtaaaaactgaagttc

SEQ ID NO: 5198109 - DNA, 22 bp, Homo sapiens
agccgtaatggggactctccag

SEQ ID NO: 5198110 - DNA, 18 bp, Homo sapiens
agccgtagggtggcactg

SEQ ID NO: 5198111 - DNA, 23 bp, Homo sapiens
agccgtagggtggcactgggagg

SEQ ID NO: 5198112 - DNA, 18 bp, Homo sapiens
agccgtattttacatgaa

SEQ ID NO: 5198113 - DNA, 14 bp, Homo sapiens
agccgtcacccctg

SEQ ID NO: 5198114 - DNA, 19 bp, Homo sapiens
agccgtcagccaaatgtaa

SEQ ID NO: 5198115 - DNA, 20 bp, Homo sapiens
agccgtcagccaaatgtaat

SEQ ID NO: 5198116 - DNA, 17 bp, Homo sapiens
agccgtccatggcacca

SEQ ID NO: 5198117 - DNA, 13 bp, Homo sapiens
agccgtcccaggc

SEQ ID NO: 5198118 - DNA, 22 bp, Homo sapiens
agccgtcccgcgttcaagactt

SEQ ID NO: 5198119 - DNA, 13 bp, Homo sapiens
agccgtcctggcg

SEQ ID NO: 5198120 - DNA, 22 bp, Homo sapiens
agccgtccttctaatgaagaca

SEQ ID NO: 5198121 - DNA, 16 bp, Homo sapiens
agccgtcgtctccctc

SEQ ID NO: 5198122 - DNA, 18 bp, Homo sapiens
agccgtctgactccagag

SEQ ID NO: 5198123 - DNA, 20 bp, Homo sapiens
agccgtctgactccagagtc

SEQ ID NO: 5198124 - DNA, 21 bp, Homo sapiens
agccgtctgactccagagtct

SEQ ID NO: 5198125 - DNA, 17 bp, Homo sapiens
agccgtgatgctcaggc

SEQ ID NO: 5198126 - DNA, 16 bp, Homo sapiens
agccgtgccttcagct

SEQ ID NO: 5198127 - DNA, 23 bp, Homo sapiens
agccgtgcctttctctggctcca

SEQ ID NO: 5198128 - DNA, 18 bp, Homo sapiens
agccgtgctcgccccagc

SEQ ID NO: 5198129 - DNA, 22 bp, Homo sapiens
agccgtggccgagggcttccct

SEQ ID NO: 5198130 - DNA, 21 bp, Homo sapiens
agccgtggcttcccgctcagc

SEQ ID NO: 5198131 - DNA, 13 bp, Homo sapiens
agccgtgggcccg

SEQ ID NO: 5198132 - DNA, 16 bp, Homo sapiens
agccgtggtcctttgg

SEQ ID NO: 5198133 - DNA, 15 bp, Homo sapiens
agccgtgtgtgcatg

SEQ ID NO: 5198134 - DNA, 16 bp, Homo sapiens
agccgttcctgggact

SEQ ID NO: 5198135 - DNA, 15 bp, Homo sapiens
agccgttgaatctgg

SEQ ID NO: 5198136 - DNA, 23 bp, Homo sapiens
agccgtttgaatatattttatct

SEQ ID NO: 5198137 - DNA, 19 bp, Homo sapiens
agccgtttgttccccaaga

SEQ ID NO: 5198138 - DNA, 21 bp, Homo sapiens
agccgttttcatgagctgagt

SEQ ID NO: 5198139 - DNA, 14 bp, Homo sapiens
agccgttttcctca

SEQ ID NO: 5198140 - DNA, 17 bp, Homo sapiens
agcctaaaaataaagca

SEQ ID NO: 5198141 - DNA, 23 bp, Homo sapiens
agcctaaaaataaagcacaaacc

SEQ ID NO: 5198142 - DNA, 20 bp, Homo sapiens
agcctaaaagattttgtgaa

SEQ ID NO: 5198143 - DNA, 20 bp, Homo sapiens
agcctaaagaccatttaatc

SEQ ID NO: 5198144 - DNA, 12 bp, Homo sapiens
agcctaaagatt

SEQ ID NO: 5198145 - DNA, 15 bp, Homo sapiens
agcctaaagggcagg

SEQ ID NO: 5198146 - DNA, 17 bp, Homo sapiens
agcctaaagggcagggc

SEQ ID NO: 5198147 - DNA, 18 bp, Homo sapiens
agcctaaagtacagcctg

SEQ ID NO: 5198148 - DNA, 21 bp, Homo sapiens
agcctaaagtatacaactgcc

SEQ ID NO: 5198149 - DNA, 19 bp, Homo sapiens
agcctaaataaaaagtata

SEQ ID NO: 5198150 - DNA, 14 bp, Homo sapiens
agcctaaatctaat

SEQ ID NO: 5198151 - DNA, 15 bp, Homo sapiens
agcctaaatctaatc

SEQ ID NO: 5198152 - DNA, 16 bp, Homo sapiens
agcctaaatctaatca

SEQ ID NO: 5198153 - DNA, 13 bp, Homo sapiens
agcctaaatgatg

SEQ ID NO: 5198154 - DNA, 19 bp, Homo sapiens
agcctaaatttgtgctttt

SEQ ID NO: 5198155 - DNA, 21 bp, Homo sapiens
agcctaacccccagcccctcc

SEQ ID NO: 5198156 - DNA, 19 bp, Homo sapiens
agcctaaggctcctgtttt

SEQ ID NO: 5198157 - DNA, 15 bp, Homo sapiens
agcctaatacaacat

SEQ ID NO: 5198158 - DNA, 14 bp, Homo sapiens
agcctaatattcat

SEQ ID NO: 5198159 - DNA, 22 bp, Homo sapiens
agcctaatattcatgctgcctg

SEQ ID NO: 5198160 - DNA, 15 bp, Homo sapiens
agcctaatccctggg

SEQ ID NO: 5198161 - DNA, 23 bp, Homo sapiens
agcctaatccctgggcattgctt

SEQ ID NO: 5198162 - DNA, 17 bp, Homo sapiens
agcctaattgtcacatc

SEQ ID NO: 5198163 - DNA, 18 bp, Homo sapiens
agcctaattgtcacatca

SEQ ID NO: 5198164 - DNA, 19 bp, Homo sapiens
agcctacaacatttttcag

SEQ ID NO: 5198165 - DNA, 16 bp, Homo sapiens
agcctacagatgaact

SEQ ID NO: 5198166 - DNA, 14 bp, Homo sapiens
agcctacagcagtg

SEQ ID NO: 5198167 - DNA, 15 bp, Homo sapiens
agcctacagcagtgt

SEQ ID NO: 5198168 - DNA, 13 bp, Homo sapiens
agcctaccccctg

SEQ ID NO: 5198169 - DNA, 20 bp, Homo sapiens
agcctacccgactctattta

SEQ ID NO: 5198170 - DNA, 14 bp, Homo sapiens
agcctacccttcct

SEQ ID NO: 5198171 - DNA, 22 bp, Homo sapiens
agcctacccttcctgcatttct

SEQ ID NO: 5198172 - DNA, 20 bp, Homo sapiens
agcctacccttgtaccccat

SEQ ID NO: 5198173 - DNA, 21 bp, Homo sapiens
agcctacccttgtaccccatc

SEQ ID NO: 5198174 - DNA, 19 bp, Homo sapiens
agcctacctctgtctgaga

SEQ ID NO: 5198175 - DNA, 13 bp, Homo sapiens
agcctactgtctc

SEQ ID NO: 5198176 - DNA, 15 bp, Homo sapiens
agcctactgtctcct

SEQ ID NO: 5198177 - DNA, 17 bp, Homo sapiens
agcctactgtctccttc

SEQ ID NO: 5198178 - DNA, 18 bp, Homo sapiens
agcctactgtctccttcc

SEQ ID NO: 5198179 - DNA, 22 bp, Homo sapiens
agcctagaacaagccagagccg

SEQ ID NO: 5198180 - DNA, 19 bp, Homo sapiens
agcctagaacatccctggg

SEQ ID NO: 5198181 - DNA, 21 bp, Homo sapiens
agcctagaacatccctgggca

SEQ ID NO: 5198182 - DNA, 18 bp, Homo sapiens
agcctagaagctggtggc

SEQ ID NO: 5198183 - DNA, 18 bp, Homo sapiens
agcctagatatgaatata

SEQ ID NO: 5198184 - DNA, 19 bp, Homo sapiens
agcctagatatgaatatat

SEQ ID NO: 5198185 - DNA, 17 bp, Homo sapiens
agcctagccgacctcag

SEQ ID NO: 5198186 - DNA, 15 bp, Homo sapiens
agcttagtgagcagt

SEQ ID NO: 5198187 - DNA, 23 bp, Homo sapiens
agcttataagagggcatatacag

SEQ ID NO: 5198188 - DNA, 23 bp, Homo sapiens
agcttataatgaaatctgtttgt

SEQ ID NO: 5198189 - DNA, 15 bp, Homo sapiens
agcttataatgggct

SEQ ID NO: 5198190 - DNA, 21 bp, Homo sapiens
agcttatacgaaataattgtt

SEQ ID NO: 5198191 - DNA, 18 bp, Homo sapiens
agcttatccataaaaaaa

SEQ ID NO: 5198192 - DNA, 12 bp, Homo sapiens
agcttatctcag

SEQ ID NO: 5198193 - DNA, 20 bp, Homo sapiens
agcttatctcagttatgagt

SEQ ID NO: 5198194 - DNA, 14 bp, Homo sapiens
agcttatctccctg

SEQ ID NO: 5198195 - DNA, 21 bp, Homo sapiens
agcttatctccctgcttcata

SEQ ID NO: 5198196 - DNA, 13 bp, Homo sapiens
agcttatctcttt

SEQ ID NO: 5198197 - DNA, 19 bp, Homo sapiens
agcttatctcttttatatt

SEQ ID NO: 5198198 - DNA, 23 bp, Homo sapiens
agcttatctcttttatatttgta

SEQ ID NO: 5198199 - DNA, 16 bp, Homo sapiens
agcttatctttctttc

SEQ ID NO: 5198200 - DNA, 13 bp, Homo sapiens
agcttatgcctag

SEQ ID NO: 5198201 - DNA, 22 bp, Homo sapiens
agcttatgggatccttgtcttt

SEQ ID NO: 5198202 - DNA, 19 bp, Homo sapiens
agcttatgtacaaaacttt

SEQ ID NO: 5198203 - DNA, 16 bp, Homo sapiens
agcttatgtgacatgg

SEQ ID NO: 5198204 - DNA, 20 bp, Homo sapiens
agcttattaaaactcatttt

SEQ ID NO: 5198205 - DNA, 19 bp, Homo sapiens
agcttattaatgctaaggg

SEQ ID NO: 5198206 - DNA, 22 bp, Homo sapiens
agcttattaatgctaagggcag

SEQ ID NO: 5198207 - DNA, 18 bp, Homo sapiens
agcttattgatcccacat

SEQ ID NO: 5198208 - DNA, 13 bp, Homo sapiens
agcttattggcca

SEQ ID NO: 5198209 - DNA, 14 bp, Homo sapiens
agcttattggccac

SEQ ID NO: 5198210 - DNA, 17 bp, Homo sapiens
agcttattggccactgg

SEQ ID NO: 5198211 - DNA, 20 bp, Homo sapiens
agcttattggccactgggtc

SEQ ID NO: 5198212 - DNA, 21 bp, Homo sapiens
agcttattggtggctgttcct

SEQ ID NO: 5198213 - DNA, 21 bp, Homo sapiens
agcttattgtgtgcgctgcct

SEQ ID NO: 5198214 - DNA, 23 bp, Homo sapiens
agcttattgtgtgcgctgcctgg

SEQ ID NO: 5198215 - DNA, 19 bp, Homo sapiens
agcttatttcaaaaggaag

SEQ ID NO: 5198216 - DNA, 20 bp, Homo sapiens
agcttattttggagagatag

SEQ ID NO: 5198217 - DNA, 16 bp, Homo sapiens
agcttatttttctgtg

SEQ ID NO: 5198218 - DNA, 17 bp, Homo sapiens
agcttatttttctgtga

SEQ ID NO: 5198219 - DNA, 14 bp, Homo sapiens
agcttcaaaacaga

SEQ ID NO: 5198220 - DNA, 18 bp, Homo sapiens
agcttcaaccctcagcct

SEQ ID NO: 5198221 - DNA, 18 bp, Homo sapiens
agcttcaacttttctctt

SEQ ID NO: 5198222 - DNA, 24 bp, Homo sapiens
agcttcaagtctgtgcctggagct

SEQ ID NO: 5198223 - DNA, 17 bp, Homo sapiens
agcttcaagtgatatat

SEQ ID NO: 5198224 - DNA, 19 bp, Homo sapiens
agcttcaatatttttctaa

SEQ ID NO: 5198225 - DNA, 20 bp, Homo sapiens
agcttcaccacttgtccatt

SEQ ID NO: 5198226 - DNA, 20 bp, Homo sapiens
agcttcacccaccaggccag

SEQ ID NO: 5198227 - DNA, 23 bp, Homo sapiens
agcttcacccaccaggccagctc

SEQ ID NO: 5198228 - DNA, 14 bp, Homo sapiens
agcttcactcagct

SEQ ID NO: 5198229 - DNA, 16 bp, Homo sapiens
agcttcagaagtttgg

SEQ ID NO: 5198230 - DNA, 18 bp, Homo sapiens
agcttcagagcctagcca

SEQ ID NO: 5198231 - DNA, 21 bp, Homo sapiens
agcttcagagcctagccacct

SEQ ID NO: 5198232 - DNA, 22 bp, Homo sapiens
agcttcagagcctagccacctc

SEQ ID NO: 5198233 - DNA, 20 bp, Homo sapiens
agcttcagccaggagctggg

SEQ ID NO: 5198234 - DNA, 15 bp, Homo sapiens
agcttcagccaggca

SEQ ID NO: 5198235 - DNA, 19 bp, Homo sapiens
agcttcagccaggcaagaa

SEQ ID NO: 5198236 - DNA, 20 bp, Homo sapiens
agcttcagccaggcaagaaa

SEQ ID NO: 5198237 - DNA, 23 bp, Homo sapiens
agcttcagccaggcaagaaagct

SEQ ID NO: 5198238 - DNA, 13 bp, Homo sapiens
agcttcaggacct

SEQ ID NO: 5198239 - DNA, 16 bp, Homo sapiens
agcttcaggcaccagc

SEQ ID NO: 5198240 - DNA, 20 bp, Homo sapiens
agcttcaggcaccagcatcc

SEQ ID NO: 5198241 - DNA, 21 bp, Homo sapiens
agcttcaggcaccagcatcca

SEQ ID NO: 5198242 - DNA, 13 bp, Homo sapiens
agcttcaggtgag

SEQ ID NO: 5198243 - DNA, 11 bp, Homo sapiens
agcttcaggtt

SEQ ID NO: 5198244 - DNA, 17 bp, Homo sapiens
agcttcagtgctgccga

SEQ ID NO: 5198245 - DNA, 16 bp, Homo sapiens
agcttcagttgcttgt

SEQ ID NO: 5198246 - DNA, 19 bp, Homo sapiens
agcttcagttgcttgtctt

SEQ ID NO: 5198247 - DNA, 14 bp, Homo sapiens
agcttcatatctaa

SEQ ID NO: 5198248 - DNA, 20 bp, Homo sapiens
agcttcatcaatttttatac

SEQ ID NO: 5198249 - DNA, 22 bp, Homo sapiens
agcttcatcaatttttatacat

SEQ ID NO: 5198250 - DNA, 22 bp, Homo sapiens
agcttcatcttgagcctgagcc

SEQ ID NO: 5198251 - DNA, 20 bp, Homo sapiens
agcttcatgcacttaaagaa

SEQ ID NO: 5198252 - DNA, 15 bp, Homo sapiens
agcttcatgcctcag

SEQ ID NO: 5198253 - DNA, 16 bp, Homo sapiens
agcttcatgcctcagt

SEQ ID NO: 5198254 - DNA, 19 bp, Homo sapiens
agcttcatgcctcagtttc

SEQ ID NO: 5198255 - DNA, 18 bp, Homo sapiens
agcttcatgcctttgtaa

SEQ ID NO: 5198256 - DNA, 20 bp, Homo sapiens
agcttcatgcctttgtaagt

SEQ ID NO: 5198257 - DNA, 18 bp, Homo sapiens
agcttcattatctgagtt

SEQ ID NO: 5198258 - DNA, 22 bp, Homo sapiens
agcttcattatctgagttgcat

SEQ ID NO: 5198259 - DNA, 20 bp, Homo sapiens
agcttcatttccgtgaaggg

SEQ ID NO: 5198260 - DNA, 19 bp, Homo sapiens
agcttcatttcctgtgtct

SEQ ID NO: 5198261 - DNA, 19 bp, Homo sapiens
agcttcatttgtgtcaatg

SEQ ID NO: 5198262 - DNA, 14 bp, Homo sapiens
agcttccaaagcct

SEQ ID NO: 5198263 - DNA, 18 bp, Homo sapiens
agcttccaaatttgaatg

SEQ ID NO: 5198264 - DNA, 20 bp, Homo sapiens
agcttccacaaaattagaaa

SEQ ID NO: 5198265 - DNA, 20 bp, Homo sapiens
agcttccacctgtccctctc

SEQ ID NO: 5198266 - DNA, 16 bp, Homo sapiens
agcttccactgtcagc

SEQ ID NO: 5198267 - DNA, 13 bp, Homo sapiens
agcttccagagct

SEQ ID NO: 5198268 - DNA, 19 bp, Homo sapiens
agcttccagagctctgacc

SEQ ID NO: 5198269 - DNA, 20 bp, Homo sapiens
agcttccagagctctgaccc

SEQ ID NO: 5198270 - DNA, 11 bp, Homo sapiens
agcttccagat

SEQ ID NO: 5198271 - DNA, 14 bp, Homo sapiens
agcttccagcagga

SEQ ID NO: 5198272 - DNA, 19 bp, Homo sapiens
agcttccagcaggagggac

SEQ ID NO: 5198273 - DNA, 14 bp, Homo sapiens
agcttccaggaaaa

SEQ ID NO: 5198274 - DNA, 21 bp, Homo sapiens
agcttccaggaaaaaggacag

SEQ ID NO: 5198275 - DNA, 17 bp, Homo sapiens
agcttccagtccaatct

SEQ ID NO: 5198276 - DNA, 19 bp, Homo sapiens
agcttccatagctgctgcc

SEQ ID NO: 5198277 - DNA, 16 bp, Homo sapiens
agcttccatgatgcac

SEQ ID NO: 5198278 - DNA, 18 bp, Homo sapiens
agcttccatgatgcacag

SEQ ID NO: 5198279 - DNA, 19 bp, Homo sapiens
agcttcccaagtagctgag

SEQ ID NO: 5198280 - DNA, 20 bp, Homo sapiens
agcttcccacacctgcctgc

SEQ ID NO: 5198281 - DNA, 21 bp, Homo sapiens
agcttcccacacctgcctgcg

SEQ ID NO: 5198282 - DNA, 16 bp, Homo sapiens
agcttccccaggagct

SEQ ID NO: 5198283 - DNA, 20 bp, Homo sapiens
agcttcccccccaccacagg

SEQ ID NO: 5198284 - DNA, 22 bp, Homo sapiens
agcttcccccccaccacaggcc

SEQ ID NO: 5198285 - DNA, 13 bp, Homo sapiens
agcttcccctcac

SEQ ID NO: 5198286 - DNA, 15 bp, Homo sapiens
agcttcccctcactt

SEQ ID NO: 5198287 - DNA, 20 bp, Homo sapiens
agcttcccctcgctgtcctg

SEQ ID NO: 5198288 - DNA, 21 bp, Homo sapiens
agcttcccctcgctgtcctgc

SEQ ID NO: 5198289 - DNA, 16 bp, Homo sapiens
agcttccctattttga

SEQ ID NO: 5198290 - DNA, 21 bp, Homo sapiens
agcttccctcccctctagttt

SEQ ID NO: 5198291 - DNA, 20 bp, Homo sapiens
agcttcctcacacccctgtc

SEQ ID NO: 5198292 - DNA, 22 bp, Homo sapiens
agcttcctcacacccctgtccc

SEQ ID NO: 5198293 - DNA, 13 bp, Homo sapiens
agcttcctccaga

SEQ ID NO: 5198294 - DNA, 11 bp, Homo sapiens
agcttcctgag

SEQ ID NO: 5198295 - DNA, 16 bp, Homo sapiens
agcttcctgagggcta

SEQ ID NO: 5198296 - DNA, 14 bp, Homo sapiens
agcttcctgcagga

SEQ ID NO: 5198297 - DNA, 19 bp, Homo sapiens
agcttcctggggaccaaga

SEQ ID NO: 5198298 - DNA, 18 bp, Homo sapiens
agcttcctgtctgtttat

SEQ ID NO: 5198299 - DNA, 15 bp, Homo sapiens
agcttcctgtgcaga

SEQ ID NO: 5198300 - DNA, 21 bp, Homo sapiens
agcttcctgtgccctcacccc

SEQ ID NO: 5198301 - DNA, 22 bp, Homo sapiens
agcttcctgtgccctcacccca

SEQ ID NO: 5198302 - DNA, 22 bp, Homo sapiens
agcttcctgtgggccaggagct

SEQ ID NO: 5198303 - DNA, 17 bp, Homo sapiens
agcttcctgttactgag

SEQ ID NO: 5198304 - DNA, 15 bp, Homo sapiens
agcttcctgtttcta

SEQ ID NO: 5198305 - DNA, 17 bp, Homo sapiens
agcttccttcagagagc

SEQ ID NO: 5198306 - DNA, 19 bp, Homo sapiens
agcttccttcagagagcag

SEQ ID NO: 5198307 - DNA, 20 bp, Homo sapiens
agcttccttcagagagcagt

SEQ ID NO: 5198308 - DNA, 21 bp, Homo sapiens
agcttccttcagagagcagtg

SEQ ID NO: 5198309 - DNA, 13 bp, Homo sapiens
agcttccttctgg

SEQ ID NO: 5198310 - DNA, 14 bp, Homo sapiens
agcttcggagggcc

SEQ ID NO: 5198311 - DNA, 20 bp, Homo sapiens
agcttcggagggcccctgcg

SEQ ID NO: 5198312 - DNA, 17 bp, Homo sapiens
agcttcggggccggtga

SEQ ID NO: 5198313 - DNA, 18 bp, Homo sapiens
agcttcggggcctcctca

SEQ ID NO: 5198314 - DNA, 17 bp, Homo sapiens
agcttcggtgtgcagat

SEQ ID NO: 5198315 - DNA, 18 bp, Homo sapiens
agcttcggttctccagaa

SEQ ID NO: 5198316 - DNA, 15 bp, Homo sapiens
agcttcgtcttgtgt

SEQ ID NO: 5198317 - DNA, 15 bp, Homo sapiens
agcttcgtgccaaca

SEQ ID NO: 5198318 - DNA, 14 bp, Homo sapiens
agcttcgtgcctgg

SEQ ID NO: 5198319 - DNA, 14 bp, Homo sapiens
agcttcgtgctgga

SEQ ID NO: 5198320 - DNA, 14 bp, Homo sapiens
agcttctaaagcag

SEQ ID NO: 5198321 - DNA, 17 bp, Homo sapiens
agcttctaaatggtgct

SEQ ID NO: 5198322 - DNA, 17 bp, Homo sapiens
agcttctaataaattat

SEQ ID NO: 5198323 - DNA, 21 bp, Homo sapiens
agcttctacagattttagaca

SEQ ID NO: 5198324 - DNA, 22 bp, Homo sapiens
agcttctactcctgcctcatgc

SEQ ID NO: 5198325 - DNA, 19 bp, Homo sapiens
agcttctagacactccttg

SEQ ID NO: 5198326 - DNA, 16 bp, Homo sapiens
agcttctagtctggaa

SEQ ID NO: 5198327 - DNA, 17 bp, Homo sapiens
agcttctataagtgtga

SEQ ID NO: 5198328 - DNA, 17 bp, Homo sapiens
agcttctatcccaggag

SEQ ID NO: 5198329 - DNA, 17 bp, Homo sapiens
agcttctattagccagt

SEQ ID NO: 5198330 - DNA, 23 bp, Homo sapiens
agcttctattatagccacatccc

SEQ ID NO: 5198331 - DNA, 12 bp, Homo sapiens
agcttctcagtt

SEQ ID NO: 5198332 - DNA, 18 bp, Homo sapiens
agcttctcagtttctgcc

SEQ ID NO: 5198333 - DNA, 22 bp, Homo sapiens
agcttctcagtttctgcctggg

SEQ ID NO: 5198334 - DNA, 19 bp, Homo sapiens
agcttctcatcctgcaggc

SEQ ID NO: 5198335 - DNA, 17 bp, Homo sapiens
agcttctcatgttaaat

SEQ ID NO: 5198336 - DNA, 14 bp, Homo sapiens
agcttctccagcca

SEQ ID NO: 5198337 - DNA, 23 bp, Homo sapiens
agcttctccaggctctttggggt

SEQ ID NO: 5198338 - DNA, 15 bp, Homo sapiens
agcttctcccagtgt

SEQ ID NO: 5198339 - DNA, 18 bp, Homo sapiens
agcttctcctctgctcca

SEQ ID NO: 5198340 - DNA, 20 bp, Homo sapiens
agcttctcctgaccagggca

SEQ ID NO: 5198341 - DNA, 18 bp, Homo sapiens
agcttctcctgcgccccg

SEQ ID NO: 5198342 - DNA, 12 bp, Homo sapiens
agcttctcctgt

SEQ ID NO: 5198343 - DNA, 14 bp, Homo sapiens
agcttctctctccc

SEQ ID NO: 5198344 - DNA, 17 bp, Homo sapiens
agcttctctctccctgt

SEQ ID NO: 5198345 - DNA, 23 bp, Homo sapiens
agcttctctctccctgtcacaca

SEQ ID NO: 5198346 - DNA, 16 bp, Homo sapiens
agcttctctctgagct

SEQ ID NO: 5198347 - DNA, 15 bp, Homo sapiens
agcttctctgctaga

SEQ ID NO: 5198348 - DNA, 21 bp, Homo sapiens
agcttctctgctagatttcta

SEQ ID NO: 5198349 - DNA, 20 bp, Homo sapiens
agcttctcttctttctgaag

SEQ ID NO: 5198350 - DNA, 14 bp, Homo sapiens
agcttctcttgctc

SEQ ID NO: 5198351 - DNA, 16 bp, Homo sapiens
agcttctctttaactc

SEQ ID NO: 5198352 - DNA, 15 bp, Homo sapiens
agcttctgacctcag

SEQ ID NO: 5198353 - DNA, 13 bp, Homo sapiens
agcttctgccact

SEQ ID NO: 5198354 - DNA, 13 bp, Homo sapiens
agcttctgctggg

SEQ ID NO: 5198355 - DNA, 16 bp, Homo sapiens
agcttctgctgggctg

SEQ ID NO: 5198356 - DNA, 18 bp, Homo sapiens
agcttctgctgggctggg

SEQ ID NO: 5198357 - DNA, 12 bp, Homo sapiens
agcttctgcttt

SEQ ID NO: 5198358 - DNA, 17 bp, Homo sapiens
agcttctgcttttctgc

SEQ ID NO: 5198359 - DNA, 23 bp, Homo sapiens
agcttctgcttttctgccctggc

SEQ ID NO: 5198360 - DNA, 19 bp, Homo sapiens
agcttctggggtccccagg

SEQ ID NO: 5198361 - DNA, 21 bp, Homo sapiens
agcttctggtgaccttccaag

SEQ ID NO: 5198362 - DNA, 22 bp, Homo sapiens
agcttctggtgaccttccaaga

SEQ ID NO: 5198363 - DNA, 19 bp, Homo sapiens
agcctagcggagcccagcc

SEQ ID NO: 5198364 - DNA, 21 bp, Homo sapiens
agcctagcggagcccagcctg

SEQ ID NO: 5198365 - DNA, 23 bp, Homo sapiens
agcctagcggagcccagcctggg

SEQ ID NO: 5198366 - DNA, 21 bp, Homo sapiens
agcctagctcctgccacatgg

SEQ ID NO: 5198367 - DNA, 18 bp, Homo sapiens
agcctaggaccactcagc

SEQ ID NO: 5198368 - DNA, 23 bp, Homo sapiens
agcctaggaccactcagccccta

SEQ ID NO: 5198369 - DNA, 19 bp, Homo sapiens
agcctaggaccagttttgt

SEQ ID NO: 5198370 - DNA, 18 bp, Homo sapiens
agcctaggacgccaactt

SEQ ID NO: 5198371 - DNA, 19 bp, Homo sapiens
agcctaggaggactggggt

SEQ ID NO: 5198372 - DNA, 13 bp, Homo sapiens
agcctaggccagg

SEQ ID NO: 5198373 - DNA, 12 bp, Homo sapiens
agcctaggccgc

SEQ ID NO: 5198374 - DNA, 17 bp, Homo sapiens
agcctaggcctagtcct

SEQ ID NO: 5198375 - DNA, 19 bp, Homo sapiens
agcctaggcctagtcctgc

SEQ ID NO: 5198376 - DNA, 18 bp, Homo sapiens
agcctaggcttggctcct

SEQ ID NO: 5198377 - DNA, 14 bp, Homo sapiens
agcctaggggtcag

SEQ ID NO: 5198378 - DNA, 13 bp, Homo sapiens
agcctagggtgag

SEQ ID NO: 5198379 - DNA, 15 bp, Homo sapiens
agcctagggtgaggg

SEQ ID NO: 5198380 - DNA, 17 bp, Homo sapiens
agcctagggtgagggtg

SEQ ID NO: 5198381 - DNA, 15 bp, Homo sapiens
agcctaggtggaggc

SEQ ID NO: 5198382 - DNA, 17 bp, Homo sapiens
agcctatacgtttctgt

SEQ ID NO: 5198383 - DNA, 18 bp, Homo sapiens
agcctatagtaaatgtgt

SEQ ID NO: 5198384 - DNA, 16 bp, Homo sapiens
agcctatgagcatcct

SEQ ID NO: 5198385 - DNA, 19 bp, Homo sapiens
agcctatgagcatcctgag

SEQ ID NO: 5198386 - DNA, 23 bp, Homo sapiens
agcctatgagcatcctgagcccc

SEQ ID NO: 5198387 - DNA, 16 bp, Homo sapiens
agcctatggcagaaaa

SEQ ID NO: 5198388 - DNA, 19 bp, Homo sapiens
agcctatggcagaaaaaat

SEQ ID NO: 5198389 - DNA, 20 bp, Homo sapiens
agcctatgggggctctcgga

SEQ ID NO: 5198390 - DNA, 17 bp, Homo sapiens
agcctatgtctggcaga

SEQ ID NO: 5198391 - DNA, 16 bp, Homo sapiens
agcctatgtcttgtat

SEQ ID NO: 5198392 - DNA, 22 bp, Homo sapiens
agcctatgtggattttttccta

SEQ ID NO: 5198393 - DNA, 13 bp, Homo sapiens
agcctattcctga

SEQ ID NO: 5198394 - DNA, 15 bp, Homo sapiens
agcctattgtaaata

SEQ ID NO: 5198395 - DNA, 12 bp, Homo sapiens
agcctattgtct

SEQ ID NO: 5198396 - DNA, 14 bp, Homo sapiens
agcctattgtcttt

SEQ ID NO: 5198397 - DNA, 16 bp, Homo sapiens
agcctatttacctgca

SEQ ID NO: 5198398 - DNA, 16 bp, Homo sapiens
agcctatttttatatt

SEQ ID NO: 5198399 - DNA, 17 bp, Homo sapiens
agcctcaaaaacgccct

SEQ ID NO: 5198400 - DNA, 19 bp, Homo sapiens
agcctcaaaaacgccctca

SEQ ID NO: 5198401 - DNA, 20 bp, Homo sapiens
agcctcaaaacaaaggccta

SEQ ID NO: 5198402 - DNA, 22 bp, Homo sapiens
agcctcaaaacgggtcagtatt

SEQ ID NO: 5198403 - DNA, 15 bp, Homo sapiens
agcctcaaactcaac

SEQ ID NO: 5198404 - DNA, 20 bp, Homo sapiens
agcctcaaatccaggaccct

SEQ ID NO: 5198405 - DNA, 22 bp, Homo sapiens
agcctcaaatccaggaccctgc

SEQ ID NO: 5198406 - DNA, 17 bp, Homo sapiens
agcctcaacctccctgg

SEQ ID NO: 5198407 - DNA, 18 bp, Homo sapiens
agcctcaacctcctgggc

SEQ ID NO: 5198408 - DNA, 19 bp, Homo sapiens
agcctcaacctcctgggct

SEQ ID NO: 5198409 - DNA, 20 bp, Homo sapiens
agcctcaacctcctgggcta

SEQ ID NO: 5198410 - DNA, 19 bp, Homo sapiens
agcctcaacctcctgggtt

SEQ ID NO: 5198411 - DNA, 15 bp, Homo sapiens
agcctcaaccttctg

SEQ ID NO: 5198412 - DNA, 19 bp, Homo sapiens
agcctcaaggccctcggag

SEQ ID NO: 5198413 - DNA, 22 bp, Homo sapiens
agcctcaaggttttaggttcta

SEQ ID NO: 5198414 - DNA, 21 bp, Homo sapiens
agcctcaagtcttatttcctc

SEQ ID NO: 5198415 - DNA, 23 bp, Homo sapiens
agcctcaattttggtttttctca

SEQ ID NO: 5198416 - DNA, 19 bp, Homo sapiens
agcctcacagatgctggcc

SEQ ID NO: 5198417 - DNA, 14 bp, Homo sapiens
agcctcaccaaggt

SEQ ID NO: 5198418 - DNA, 13 bp, Homo sapiens
agcctcacccctg

SEQ ID NO: 5198419 - DNA, 15 bp, Homo sapiens
agcctcacccctgcc

SEQ ID NO: 5198420 - DNA, 16 bp, Homo sapiens
agcctcacccctgccc

SEQ ID NO: 5198421 - DNA, 18 bp, Homo sapiens
agcctcacccctgcccct

SEQ ID NO: 5198422 - DNA, 22 bp, Homo sapiens
agcctcacccctgcccctgtgg

SEQ ID NO: 5198423 - DNA, 17 bp, Homo sapiens
agcctcacgaaactgga

SEQ ID NO: 5198424 - DNA, 18 bp, Homo sapiens
agcctcacgaaactggaa

SEQ ID NO: 5198425 - DNA, 18 bp, Homo sapiens
agcctcactattacttga

SEQ ID NO: 5198426 - DNA, 22 bp, Homo sapiens
agcctcactattacttgaactt

SEQ ID NO: 5198427 - DNA, 13 bp, Homo sapiens
agcctcactgata

SEQ ID NO: 5198428 - DNA, 15 bp, Homo sapiens
agcctcactgcatct

SEQ ID NO: 5198429 - DNA, 16 bp, Homo sapiens
agcctcacttcctttg

SEQ ID NO: 5198430 - DNA, 21 bp, Homo sapiens
agcctcacttcctttgccctt

SEQ ID NO: 5198431 - DNA, 22 bp, Homo sapiens
agcctcacttcctttgcccttc

SEQ ID NO: 5198432 - DNA, 22 bp, Homo sapiens
agcctcacttgaatgtgtcact

SEQ ID NO: 5198433 - DNA, 16 bp, Homo sapiens
agcctcacttgccctc

SEQ ID NO: 5198434 - DNA, 20 bp, Homo sapiens
agcctcacttggtctgccag

SEQ ID NO: 5198435 - DNA, 22 bp, Homo sapiens
agcctcacttggtctgccaggc

SEQ ID NO: 5198436 - DNA, 14 bp, Homo sapiens
agcctcagaagaaa

SEQ ID NO: 5198437 - DNA, 17 bp, Homo sapiens
agcctcagaagccttct

SEQ ID NO: 5198438 - DNA, 22 bp, Homo sapiens
agcctcagaagccttcttgctg

SEQ ID NO: 5198439 - DNA, 15 bp, Homo sapiens
agcctcagaaggccc

SEQ ID NO: 5198440 - DNA, 14 bp, Homo sapiens
agcctcagactgga

SEQ ID NO: 5198441 - DNA, 22 bp, Homo sapiens
agcctcagagatctcccttctc

SEQ ID NO: 5198442 - DNA, 15 bp, Homo sapiens
agcctcagaggcctt

SEQ ID NO: 5198443 - DNA, 22 bp, Homo sapiens
agcctcagatgatttcccccct

SEQ ID NO: 5198444 - DNA, 17 bp, Homo sapiens
agcctcagattccttcc

SEQ ID NO: 5198445 - DNA, 19 bp, Homo sapiens
agcctcagcaaacccaaag

SEQ ID NO: 5198446 - DNA, 21 bp, Homo sapiens
agcctcagcaaacccaaagat

SEQ ID NO: 5198447 - DNA, 16 bp, Homo sapiens
agcctcagcatcctgg

SEQ ID NO: 5198448 - DNA, 20 bp, Homo sapiens
agcctcagcatcctggcacc

SEQ ID NO: 5198449 - DNA, 13 bp, Homo sapiens
agcctcagccact

SEQ ID NO: 5198450 - DNA, 19 bp, Homo sapiens
agcctcagccactcccagg

SEQ ID NO: 5198451 - DNA, 21 bp, Homo sapiens
agcctcagcccaacttcttac

SEQ ID NO: 5198452 - DNA, 17 bp, Homo sapiens
agcctcagccccctgct

SEQ ID NO: 5198453 - DNA, 23 bp, Homo sapiens
agcctcagctctcagttgcagcc

SEQ ID NO: 5198454 - DNA, 16 bp, Homo sapiens
agcctcagctgtacga

SEQ ID NO: 5198455 - DNA, 13 bp, Homo sapiens
agcctcaggactg

SEQ ID NO: 5198456 - DNA, 17 bp, Homo sapiens
agcctcaggactgggag

SEQ ID NO: 5198457 - DNA, 13 bp, Homo sapiens
agcctcaggcctg

SEQ ID NO: 5198458 - DNA, 18 bp, Homo sapiens
agcctcaggcctggccct

SEQ ID NO: 5198459 - DNA, 22 bp, Homo sapiens
agcctcaggcttgagggagggc

SEQ ID NO: 5198460 - DNA, 16 bp, Homo sapiens
agcctcagggcttcct

SEQ ID NO: 5198461 - DNA, 11 bp, Homo sapiens
agcctcagtcc

SEQ ID NO: 5198462 - DNA, 15 bp, Homo sapiens
agcctcagtcctccc

SEQ ID NO: 5198463 - DNA, 19 bp, Homo sapiens
agcctcagtcctcccctca

SEQ ID NO: 5198464 - DNA, 16 bp, Homo sapiens
agcctcagtctccctc

SEQ ID NO: 5198465 - DNA, 17 bp, Homo sapiens
agcctcagtgacccatg

SEQ ID NO: 5198466 - DNA, 21 bp, Homo sapiens
agcctcagtgaccctggctcc

SEQ ID NO: 5198467 - DNA, 15 bp, Homo sapiens
agcctcagtgcagcc

SEQ ID NO: 5198468 - DNA, 20 bp, Homo sapiens
agcctcatatttaaagacag

SEQ ID NO: 5198469 - DNA, 19 bp, Homo sapiens
agcctcatccagcctcaga

SEQ ID NO: 5198470 - DNA, 21 bp, Homo sapiens
agcctcatccagcctcagaga

SEQ ID NO: 5198471 - DNA, 18 bp, Homo sapiens
agcctcatcccaggcagt

SEQ ID NO: 5198472 - DNA, 14 bp, Homo sapiens
agcctcatccgagg

SEQ ID NO: 5198473 - DNA, 13 bp, Homo sapiens
agcctcatcctga

SEQ ID NO: 5198474 - DNA, 22 bp, Homo sapiens
agcctcatgccccaggcctcgt

SEQ ID NO: 5198475 - DNA, 15 bp, Homo sapiens
agcctcatgctctga

SEQ ID NO: 5198476 - DNA, 18 bp, Homo sapiens
agcctcatgttctcttcc

SEQ ID NO: 5198477 - DNA, 22 bp, Homo sapiens
agcctcatgttctcttcccagg

SEQ ID NO: 5198478 - DNA, 23 bp, Homo sapiens
agcctcatgttctcttcccaggc

SEQ ID NO: 5198479 - DNA, 15 bp, Homo sapiens
agcctcatgttctgt

SEQ ID NO: 5198480 - DNA, 13 bp, Homo sapiens
agcctcattcagc

SEQ ID NO: 5198481 - DNA, 20 bp, Homo sapiens
agcctcattgtgccaagcct

SEQ ID NO: 5198482 - DNA, 21 bp, Homo sapiens
agcctcattgtgccaagcctt

SEQ ID NO: 5198483 - DNA, 21 bp, Homo sapiens
agcctccaaagtggagctggg

SEQ ID NO: 5198484 - DNA, 22 bp, Homo sapiens
agcctccaagcacagagcctgg

SEQ ID NO: 5198485 - DNA, 22 bp, Homo sapiens
agcctccaatgcattggcctct

SEQ ID NO: 5198486 - DNA, 12 bp, Homo sapiens
agcctccacagc

SEQ ID NO: 5198487 - DNA, 22 bp, Homo sapiens
agcctccacctgcagccccagg

SEQ ID NO: 5198488 - DNA, 18 bp, Homo sapiens
agcctccaccttgagcac

SEQ ID NO: 5198489 - DNA, 19 bp, Homo sapiens
agcctccaccttgagcact

SEQ ID NO: 5198490 - DNA, 18 bp, Homo sapiens
agcctccaccttgctctt

SEQ ID NO: 5198491 - DNA, 18 bp, Homo sapiens
agcctccacggagagccc

SEQ ID NO: 5198492 - DNA, 19 bp, Homo sapiens
agcctccactccctgtctg

SEQ ID NO: 5198493 - DNA, 21 bp, Homo sapiens
agcctccagagaagccccgca

SEQ ID NO: 5198494 - DNA, 17 bp, Homo sapiens
agcctccagagccagcc

SEQ ID NO: 5198495 - DNA, 20 bp, Homo sapiens
agcctccagagccagcctgg

SEQ ID NO: 5198496 - DNA, 23 bp, Homo sapiens
agcctccagagccagcctgggac

SEQ ID NO: 5198497 - DNA, 18 bp, Homo sapiens
agcctccagggcattgct

SEQ ID NO: 5198498 - DNA, 16 bp, Homo sapiens
agcctccaggttcctc

SEQ ID NO: 5198499 - DNA, 18 bp, Homo sapiens
agcctccagtgctggctg

SEQ ID NO: 5198500 - DNA, 20 bp, Homo sapiens
agcctccagtgctggctgct

SEQ ID NO: 5198501 - DNA, 22 bp, Homo sapiens
agcctccagtgctggctgctgg

SEQ ID NO: 5198502 - DNA, 14 bp, Homo sapiens
agcctccagtggga

SEQ ID NO: 5198503 - DNA, 18 bp, Homo sapiens
agcctccatgctgcctcc

SEQ ID NO: 5198504 - DNA, 14 bp, Homo sapiens
agcctccatttctg

SEQ ID NO: 5198505 - DNA, 18 bp, Homo sapiens
agcctccatttctggctt

SEQ ID NO: 5198506 - DNA, 14 bp, Homo sapiens
agcctcccaaagtg

SEQ ID NO: 5198507 - DNA, 16 bp, Homo sapiens
agcctcccaaagtgct

SEQ ID NO: 5198508 - DNA, 17 bp, Homo sapiens
agcctcccaaagtgctg

SEQ ID NO: 5198509 - DNA, 19 bp, Homo sapiens
agcctcccaaagtgctggg

SEQ ID NO: 5198510 - DNA, 16 bp, Homo sapiens
agcctcccaaagtgtt

SEQ ID NO: 5198511 - DNA, 18 bp, Homo sapiens
agcctcccaacgtgctgg

SEQ ID NO: 5198512 - DNA, 16 bp, Homo sapiens
agcctcccaaggagaa

SEQ ID NO: 5198513 - DNA, 12 bp, Homo sapiens
agcctcccaagt

SEQ ID NO: 5198514 - DNA, 14 bp, Homo sapiens
agcctcccacaggt

SEQ ID NO: 5198515 - DNA, 17 bp, Homo sapiens
agcctcccaccagagcc

SEQ ID NO: 5198516 - DNA, 12 bp, Homo sapiens
agcctcccagag

SEQ ID NO: 5198517 - DNA, 13 bp, Homo sapiens
agcctcccagagt

SEQ ID NO: 5198518 - DNA, 15 bp, Homo sapiens
agcctcccatagctg

SEQ ID NO: 5198519 - DNA, 13 bp, Homo sapiens
agcctccccaccc

SEQ ID NO: 5198520 - DNA, 21 bp, Homo sapiens
agcctccccaccccagtggga

SEQ ID NO: 5198521 - DNA, 11 bp, Homo sapiens
agcctccccca

SEQ ID NO: 5198522 - DNA, 16 bp, Homo sapiens
agcctcccccaggctg

SEQ ID NO: 5198523 - DNA, 19 bp, Homo sapiens
agcctccccctgctgctca

SEQ ID NO: 5198524 - DNA, 13 bp, Homo sapiens
agcctcccctccc

SEQ ID NO: 5198525 - DNA, 21 bp, Homo sapiens
agcctcccctcccctggggac

SEQ ID NO: 5198526 - DNA, 14 bp, Homo sapiens
agcctcccctgcca

SEQ ID NO: 5198527 - DNA, 18 bp, Homo sapiens
agcctcccctgccagggc

SEQ ID NO: 5198528 - DNA, 20 bp, Homo sapiens
agcctcccctgccagggcag

SEQ ID NO: 5198529 - DNA, 15 bp, Homo sapiens
agcctccccttccca

SEQ ID NO: 5198530 - DNA, 19 bp, Homo sapiens
agcctccccttcccagacc

SEQ ID NO: 5198531 - DNA, 16 bp, Homo sapiens
agcctccccttcttcc

SEQ ID NO: 5198532 - DNA, 18 bp, Homo sapiens
agcctcccgagtagctgg

SEQ ID NO: 5198533 - DNA, 22 bp, Homo sapiens
agcctcccgagtagctgggact

SEQ ID NO: 5198534 - DNA, 22 bp, Homo sapiens
agcctcccgagtagctgggatt

SEQ ID NO: 5198535 - DNA, 19 bp, Homo sapiens
agcctcccgagtagggagg

SEQ ID NO: 5198536 - DNA, 14 bp, Homo sapiens
agcctccctcagcc

SEQ ID NO: 5198537 - DNA, 21 bp, Homo sapiens
agcctccctcagcccccagga

SEQ ID NO: 5198538 - DNA, 15 bp, Homo sapiens
agcctccctctcctc

SEQ ID NO: 5198539 - DNA, 20 bp, Homo sapiens
agcctccctctcctctgtcc

SEQ ID NO: 5198540 - DNA, 14 bp, Homo sapiens
agcttctgtcctgc

SEQ ID NO: 5198541 - DNA, 14 bp, Homo sapiens
agcttctgtctcca

SEQ ID NO: 5198542 - DNA, 15 bp, Homo sapiens
agcttctgtgtgtga

SEQ ID NO: 5198543 - DNA, 18 bp, Homo sapiens
agcttctgtgtgtgagct

SEQ ID NO: 5198544 - DNA, 20 bp, Homo sapiens
agcttctgttgctgcctcat

SEQ ID NO: 5198545 - DNA, 21 bp, Homo sapiens
agcttctgttgctgcctcatg

SEQ ID NO: 5198546 - DNA, 23 bp, Homo sapiens
agcttctgttgctgcctcatgct

SEQ ID NO: 5198547 - DNA, 13 bp, Homo sapiens
agcttcttaatta

SEQ ID NO: 5198548 - DNA, 14 bp, Homo sapiens
agcttcttaattaa

SEQ ID NO: 5198549 - DNA, 21 bp, Homo sapiens
agcttcttaattaatttgatt

SEQ ID NO: 5198550 - DNA, 22 bp, Homo sapiens
agcttcttatattaaagaagtt

SEQ ID NO: 5198551 - DNA, 13 bp, Homo sapiens
agcttcttcagag

SEQ ID NO: 5198552 - DNA, 18 bp, Homo sapiens
agcttcttcagagtgaag

SEQ ID NO: 5198553 - DNA, 19 bp, Homo sapiens
agcttcttcatctttaaaa

SEQ ID NO: 5198554 - DNA, 20 bp, Homo sapiens
agcttcttccaggtgcccag

SEQ ID NO: 5198555 - DNA, 22 bp, Homo sapiens
agcttcttccaggtgcccagct

SEQ ID NO: 5198556 - DNA, 18 bp, Homo sapiens
agcttcttccattggaaa

SEQ ID NO: 5198557 - DNA, 14 bp, Homo sapiens
agcttcttcctagg

SEQ ID NO: 5198558 - DNA, 20 bp, Homo sapiens
agcttcttgctgccaggccc

SEQ ID NO: 5198559 - DNA, 17 bp, Homo sapiens
agcttcttgggctgagt

SEQ ID NO: 5198560 - DNA, 22 bp, Homo sapiens
agcttcttgggctgagtgcagc

SEQ ID NO: 5198561 - DNA, 23 bp, Homo sapiens
agcttcttgggctgagtgcagcc

SEQ ID NO: 5198562 - DNA, 18 bp, Homo sapiens
agcttcttgtttccttgt

SEQ ID NO: 5198563 - DNA, 19 bp, Homo sapiens
agcttcttgtttccttgtt

SEQ ID NO: 5198564 - DNA, 15 bp, Homo sapiens
agcttgaaaactgga

SEQ ID NO: 5198565 - DNA, 20 bp, Homo sapiens
agcttgaaaagattctgaaa

SEQ ID NO: 5198566 - DNA, 16 bp, Homo sapiens
agcttgaacctgcttc

SEQ ID NO: 5198567 - DNA, 11 bp, Homo sapiens
agcttgaatgt

SEQ ID NO: 5198568 - DNA, 13 bp, Homo sapiens
agcttgaatgtcc

SEQ ID NO: 5198569 - DNA, 16 bp, Homo sapiens
agcttgacattatgtt

SEQ ID NO: 5198570 - DNA, 16 bp, Homo sapiens
agcttgaccagaccta

SEQ ID NO: 5198571 - DNA, 18 bp, Homo sapiens
agcttgaccagacctaga

SEQ ID NO: 5198572 - DNA, 22 bp, Homo sapiens
agcttgaccgtgaggccagaga

SEQ ID NO: 5198573 - DNA, 20 bp, Homo sapiens
agcttgacctgaggctgtgg

SEQ ID NO: 5198574 - DNA, 13 bp, Homo sapiens
agcttgactccca

SEQ ID NO: 5198575 - DNA, 23 bp, Homo sapiens
agcttgactgcttttaaatgacc

SEQ ID NO: 5198576 - DNA, 16 bp, Homo sapiens
agcttgagaacgtatt

SEQ ID NO: 5198577 - DNA, 15 bp, Homo sapiens
agcttgagcctcccc

SEQ ID NO: 5198578 - DNA, 17 bp, Homo sapiens
agcttgagcctccccca

SEQ ID NO: 5198579 - DNA, 13 bp, Homo sapiens
agcttgagcctga

SEQ ID NO: 5198580 - DNA, 20 bp, Homo sapiens
agcttgagctcccctggagc

SEQ ID NO: 5198581 - DNA, 22 bp, Homo sapiens
agcttgagctcccctggagcca

SEQ ID NO: 5198582 - DNA, 13 bp, Homo sapiens
agcttgaggccaa

SEQ ID NO: 5198583 - DNA, 19 bp, Homo sapiens
agcttgaggccaagatggc

SEQ ID NO: 5198584 - DNA, 20 bp, Homo sapiens
agcttgaggccaagatggct

SEQ ID NO: 5198585 - DNA, 21 bp, Homo sapiens
agcttgagggacaatgccact

SEQ ID NO: 5198586 - DNA, 14 bp, Homo sapiens
agcttgatctgtga

SEQ ID NO: 5198587 - DNA, 15 bp, Homo sapiens
agcttgatctgtgat

SEQ ID NO: 5198588 - DNA, 19 bp, Homo sapiens
agcttgatctgtgatttct

SEQ ID NO: 5198589 - DNA, 21 bp, Homo sapiens
agcttgatctgtgatttcttc

SEQ ID NO: 5198590 - DNA, 17 bp, Homo sapiens
agcttgatgctgtttct

SEQ ID NO: 5198591 - DNA, 17 bp, Homo sapiens
agcttgatttgatcttt

SEQ ID NO: 5198592 - DNA, 21 bp, Homo sapiens
agcttgcaagaagcaggaagg

SEQ ID NO: 5198593 - DNA, 14 bp, Homo sapiens
agcttgcacctttt

SEQ ID NO: 5198594 - DNA, 18 bp, Homo sapiens
agcttgcaccttttcatg

SEQ ID NO: 5198595 - DNA, 22 bp, Homo sapiens
agcttgcagtccgttgctgaaa

SEQ ID NO: 5198596 - DNA, 17 bp, Homo sapiens
agcttgcagtgaagtgt

SEQ ID NO: 5198597 - DNA, 14 bp, Homo sapiens
agcttgccagggat

SEQ ID NO: 5198598 - DNA, 15 bp, Homo sapiens
agcttgccagggatg

SEQ ID NO: 5198599 - DNA, 21 bp, Homo sapiens
agcttgccagggatgggcagc

SEQ ID NO: 5198600 - DNA, 13 bp, Homo sapiens
agcttgcccccgc

SEQ ID NO: 5198601 - DNA, 18 bp, Homo sapiens
agcttgccctgttaaaag

SEQ ID NO: 5198602 - DNA, 16 bp, Homo sapiens
agcttgcctaaaattc

SEQ ID NO: 5198603 - DNA, 13 bp, Homo sapiens
agcttgcctcagg

SEQ ID NO: 5198604 - DNA, 16 bp, Homo sapiens
agcttgcctcagggcc

SEQ ID NO: 5198605 - DNA, 13 bp, Homo sapiens
agcttgcctgcct

SEQ ID NO: 5198606 - DNA, 23 bp, Homo sapiens
agcttgcgttagaatgaggagga

SEQ ID NO: 5198607 - DNA, 16 bp, Homo sapiens
agcttgctccctgtgt

SEQ ID NO: 5198608 - DNA, 17 bp, Homo sapiens
agcttgctccctgtgtc

SEQ ID NO: 5198609 - DNA, 16 bp, Homo sapiens
agcttgctgcacccca

SEQ ID NO: 5198610 - DNA, 20 bp, Homo sapiens
agcttgctgcaccccaagtc

SEQ ID NO: 5198611 - DNA, 16 bp, Homo sapiens
agcttgctgccctagg

SEQ ID NO: 5198612 - DNA, 19 bp, Homo sapiens
agcttgctgggctttggga

SEQ ID NO: 5198613 - DNA, 20 bp, Homo sapiens
agcttgctgggctttgggaa

SEQ ID NO: 5198614 - DNA, 23 bp, Homo sapiens
agcttgcttgctttcttttttaa

SEQ ID NO: 5198615 - DNA, 12 bp, Homo sapiens
agcttgctttga

SEQ ID NO: 5198616 - DNA, 16 bp, Homo sapiens
agcttggaagagcctg

SEQ ID NO: 5198617 - DNA, 16 bp, Homo sapiens
agcttggacagtctga

SEQ ID NO: 5198618 - DNA, 14 bp, Homo sapiens
agcttggacatcag

SEQ ID NO: 5198619 - DNA, 23 bp, Homo sapiens
agcttggacatcagtgtttgttg

SEQ ID NO: 5198620 - DNA, 17 bp, Homo sapiens
agcttggactacacaat

SEQ ID NO: 5198621 - DNA, 18 bp, Homo sapiens
agcttggactacacaata

SEQ ID NO: 5198622 - DNA, 15 bp, Homo sapiens
agcttggagacagga

SEQ ID NO: 5198623 - DNA, 19 bp, Homo sapiens
agcttggagccccctggcg

SEQ ID NO: 5198624 - DNA, 21 bp, Homo sapiens
agcttggagccccctggcggc

SEQ ID NO: 5198625 - DNA, 16 bp, Homo sapiens
agcttggagggatgga

SEQ ID NO: 5198626 - DNA, 16 bp, Homo sapiens
agcttggattaaatac

SEQ ID NO: 5198627 - DNA, 17 bp, Homo sapiens
agcttggattaaataca

SEQ ID NO: 5198628 - DNA, 12 bp, Homo sapiens
agcttggcagcc

SEQ ID NO: 5198629 - DNA, 15 bp, Homo sapiens
agcttggcagccgag

SEQ ID NO: 5198630 - DNA, 13 bp, Homo sapiens
agcttggccctgc

SEQ ID NO: 5198631 - DNA, 17 bp, Homo sapiens
agcttggccctgcgccc

SEQ ID NO: 5198632 - DNA, 21 bp, Homo sapiens
agcttggccctgcgccctgtg

SEQ ID NO: 5198633 - DNA, 13 bp, Homo sapiens
agcttggccttgg

SEQ ID NO: 5198634 - DNA, 17 bp, Homo sapiens
agcttggccttgggccg

SEQ ID NO: 5198635 - DNA, 15 bp, Homo sapiens
agcttggctgagccc

SEQ ID NO: 5198636 - DNA, 20 bp, Homo sapiens
agcttgggaaaggtggtgtt

SEQ ID NO: 5198637 - DNA, 16 bp, Homo sapiens
agcttgggacaaatca

SEQ ID NO: 5198638 - DNA, 18 bp, Homo sapiens
agcttgggagagcccctg

SEQ ID NO: 5198639 - DNA, 24 bp, Homo sapiens
agcttgggagagcccctggggcct

SEQ ID NO: 5198640 - DNA, 17 bp, Homo sapiens
agcttgggcagatctcc

SEQ ID NO: 5198641 - DNA, 21 bp, Homo sapiens
agcttgggcagatctcccaca

SEQ ID NO: 5198642 - DNA, 14 bp, Homo sapiens
agcttgggctggcg

SEQ ID NO: 5198643 - DNA, 15 bp, Homo sapiens
agcttgggctggcgg

SEQ ID NO: 5198644 - DNA, 23 bp, Homo sapiens
agcttggggacaggggcaggagg

SEQ ID NO: 5198645 - DNA, 22 bp, Homo sapiens
agcttggggccaccaaagctgc

SEQ ID NO: 5198646 - DNA, 21 bp, Homo sapiens
agcttgggggatgactagagg

SEQ ID NO: 5198647 - DNA, 19 bp, Homo sapiens
agcttgggtccaccatgca

SEQ ID NO: 5198648 - DNA, 16 bp, Homo sapiens
agcttgggtctctctc

SEQ ID NO: 5198649 - DNA, 18 bp, Homo sapiens
agcttgggtttttgttac

SEQ ID NO: 5198650 - DNA, 15 bp, Homo sapiens
agcttggtattgcag

SEQ ID NO: 5198651 - DNA, 16 bp, Homo sapiens
agcttggtcaaacttt

SEQ ID NO: 5198652 - DNA, 13 bp, Homo sapiens
agcttggtggtta

SEQ ID NO: 5198653 - DNA, 21 bp, Homo sapiens
agcttggtgtcttggcactgt

SEQ ID NO: 5198654 - DNA, 17 bp, Homo sapiens
agcttggttcctgcccc

SEQ ID NO: 5198655 - DNA, 18 bp, Homo sapiens
agcttggttctgtgaaca

SEQ ID NO: 5198656 - DNA, 19 bp, Homo sapiens
agcttgtaaatagctcagg

SEQ ID NO: 5198657 - DNA, 20 bp, Homo sapiens
agcttgtaaatagctcaggt

SEQ ID NO: 5198658 - DNA, 21 bp, Homo sapiens
agcttgtaaatatggggatag

SEQ ID NO: 5198659 - DNA, 13 bp, Homo sapiens
agcttgtagccct

SEQ ID NO: 5198660 - DNA, 18 bp, Homo sapiens
agcttgtatagtgtaaaa

SEQ ID NO: 5198661 - DNA, 21 bp, Homo sapiens
agcttgtatagtgtaaaataa

SEQ ID NO: 5198662 - DNA, 16 bp, Homo sapiens
agcttgtatatacata

SEQ ID NO: 5198663 - DNA, 23 bp, Homo sapiens
agcttgtatatacatattataaa

SEQ ID NO: 5198664 - DNA, 16 bp, Homo sapiens
agcttgtatcaaatgt

SEQ ID NO: 5198665 - DNA, 18 bp, Homo sapiens
agcttgtatctgatatca

SEQ ID NO: 5198666 - DNA, 17 bp, Homo sapiens
agcttgtattatcagtg

SEQ ID NO: 5198667 - DNA, 19 bp, Homo sapiens
agcttgtcattgagcctgg

SEQ ID NO: 5198668 - DNA, 23 bp, Homo sapiens
agcttgtccaacccgaggcccgc

SEQ ID NO: 5198669 - DNA, 20 bp, Homo sapiens
agcttgtccaggttgatctt

SEQ ID NO: 5198670 - DNA, 23 bp, Homo sapiens
agcttgtccaggttgatcttgaa

SEQ ID NO: 5198671 - DNA, 11 bp, Homo sapiens
agcttgtcctg

SEQ ID NO: 5198672 - DNA, 17 bp, Homo sapiens
agcttgtccttgctcct

SEQ ID NO: 5198673 - DNA, 19 bp, Homo sapiens
agcttgtccttgctcctgg

SEQ ID NO: 5198674 - DNA, 13 bp, Homo sapiens
agcttgtctcttg

SEQ ID NO: 5198675 - DNA, 19 bp, Homo sapiens
agcttgtctcttgcctgcc

SEQ ID NO: 5198676 - DNA, 21 bp, Homo sapiens
agcttgtctcttgcctgccac

SEQ ID NO: 5198677 - DNA, 22 bp, Homo sapiens
agcttgtctcttgcctgccact

SEQ ID NO: 5198678 - DNA, 23 bp, Homo sapiens
agcttgtctgtgatctctgctgg

SEQ ID NO: 5198679 - DNA, 18 bp, Homo sapiens
agcttgtcttttctgctg

SEQ ID NO: 5198680 - DNA, 12 bp, Homo sapiens
agcttgtgaaga

SEQ ID NO: 5198681 - DNA, 14 bp, Homo sapiens
agcttgtgaagatt

SEQ ID NO: 5198682 - DNA, 19 bp, Homo sapiens
agcttgtgctcctcttgat

SEQ ID NO: 5198683 - DNA, 23 bp, Homo sapiens
agcttgtgctcctcttgattcct

SEQ ID NO: 5198684 - DNA, 17 bp, Homo sapiens
agcttgtgctgagcctg

SEQ ID NO: 5198685 - DNA, 14 bp, Homo sapiens
agcttgtggcccct

SEQ ID NO: 5198686 - DNA, 23 bp, Homo sapiens
agcttgtggccccttttactttt

SEQ ID NO: 5198687 - DNA, 17 bp, Homo sapiens
agcttgtggtgttcctg

SEQ ID NO: 5198688 - DNA, 18 bp, Homo sapiens
agcttgtggtgttcctga

SEQ ID NO: 5198689 - DNA, 12 bp, Homo sapiens
agcttgtgtatc

SEQ ID NO: 5198690 - DNA, 16 bp, Homo sapiens
agcttgtgtatcttga

SEQ ID NO: 5198691 - DNA, 17 bp, Homo sapiens
agcttgtgtatcttgat

SEQ ID NO: 5198692 - DNA, 15 bp, Homo sapiens
agcttgtgtcctgtc

SEQ ID NO: 5198693 - DNA, 17 bp, Homo sapiens
agcttgtgtcctgtcct

SEQ ID NO: 5198694 - DNA, 13 bp, Homo sapiens
agcttgtgtttct

SEQ ID NO: 5198695 - DNA, 16 bp, Homo sapiens
agcttgttatttataa

SEQ ID NO: 5198696 - DNA, 19 bp, Homo sapiens
agcttgttctgggctcagg

SEQ ID NO: 5198697 - DNA, 15 bp, Homo sapiens
agcttgttgaaaacc

SEQ ID NO: 5198698 - DNA, 13 bp, Homo sapiens
agcttgtttacat

SEQ ID NO: 5198699 - DNA, 16 bp, Homo sapiens
agcttgtttacatgct

SEQ ID NO: 5198700 - DNA, 13 bp, Homo sapiens
agcttgttttgga

SEQ ID NO: 5198701 - DNA, 17 bp, Homo sapiens
agctttaaaaaataaag

SEQ ID NO: 5198702 - DNA, 14 bp, Homo sapiens
agctttaaaaagaa

SEQ ID NO: 5198703 - DNA, 18 bp, Homo sapiens
agctttaaaaagaaaaaa

SEQ ID NO: 5198704 - DNA, 18 bp, Homo sapiens
agctttaaaaccacagct

SEQ ID NO: 5198705 - DNA, 19 bp, Homo sapiens
agctttaaaaccacagctg

SEQ ID NO: 5198706 - DNA, 13 bp, Homo sapiens
agctttaaaagta

SEQ ID NO: 5198707 - DNA, 15 bp, Homo sapiens
agctttaaacaaatt

SEQ ID NO: 5198708 - DNA, 20 bp, Homo sapiens
agctttaaactcagggacag

SEQ ID NO: 5198709 - DNA, 13 bp, Homo sapiens
agctttaaatcat

SEQ ID NO: 5198710 - DNA, 16 bp, Homo sapiens
agctttaaatgacagt

SEQ ID NO: 5198711 - DNA, 21 bp, Homo sapiens
agctttaaatgacagtaatat

SEQ ID NO: 5198712 - DNA, 17 bp, Homo sapiens
agctttaaattatgtga

SEQ ID NO: 5198713 - DNA, 20 bp, Homo sapiens
agctttaaccattaaaactg

SEQ ID NO: 5198714 - DNA, 17 bp, Homo sapiens
agctttaagatatcttt

SEQ ID NO: 5198715 - DNA, 19 bp, Homo sapiens
agctttacatgcaatttat

SEQ ID NO: 5198716 - DNA, 21 bp, Homo sapiens
agctttaccttctaaaagtac

SEQ ID NO: 5198717 - DNA, 13 bp, Homo sapiens
agctttactactg

SEQ ID NO: 5198718 - DNA, 13 bp, Homo sapiens
agcctccctctga

SEQ ID NO: 5198719 - DNA, 13 bp, Homo sapiens
agcctccctgaag

SEQ ID NO: 5198720 - DNA, 16 bp, Homo sapiens
agcctccctgaagcct

SEQ ID NO: 5198721 - DNA, 22 bp, Homo sapiens
agcctccctgacgtctgccacc

SEQ ID NO: 5198722 - DNA, 15 bp, Homo sapiens
agcctccctgagcct

SEQ ID NO: 5198723 - DNA, 19 bp, Homo sapiens
agcctccctgagcctgcat

SEQ ID NO: 5198724 - DNA, 23 bp, Homo sapiens
agcctccctgcctcaggcctctg

SEQ ID NO: 5198725 - DNA, 12 bp, Homo sapiens
agcctccctgtc

SEQ ID NO: 5198726 - DNA, 13 bp, Homo sapiens
agcctccctgtca

SEQ ID NO: 5198727 - DNA, 20 bp, Homo sapiens
agcctccctgtctccagctg

SEQ ID NO: 5198728 - DNA, 21 bp, Homo sapiens
agcctccctgtctccagctgc

SEQ ID NO: 5198729 - DNA, 23 bp, Homo sapiens
agcctccctgtctccagctgcct

SEQ ID NO: 5198730 - DNA, 23 bp, Homo sapiens
agcctcccttccatgccccagga

SEQ ID NO: 5198731 - DNA, 14 bp, Homo sapiens
agcctccgagaggg

SEQ ID NO: 5198732 - DNA, 15 bp, Homo sapiens
agcctccgccaagat

SEQ ID NO: 5198733 - DNA, 18 bp, Homo sapiens
agcctccgcttccctggt

SEQ ID NO: 5198734 - DNA, 23 bp, Homo sapiens
agcctccggagtagctgggacca

SEQ ID NO: 5198735 - DNA, 18 bp, Homo sapiens
agcctccgtatttcagac

SEQ ID NO: 5198736 - DNA, 15 bp, Homo sapiens
agcctccgtcatcca

SEQ ID NO: 5198737 - DNA, 19 bp, Homo sapiens
agcctcctaagcagctggg

SEQ ID NO: 5198738 - DNA, 21 bp, Homo sapiens
agcctcctaagcagctgggac

SEQ ID NO: 5198739 - DNA, 18 bp, Homo sapiens
agcctcctaggctccctg

SEQ ID NO: 5198740 - DNA, 20 bp, Homo sapiens
agcctcctcatcccgtgttc

SEQ ID NO: 5198741 - DNA, 14 bp, Homo sapiens
agcctcctccagcc

SEQ ID NO: 5198742 - DNA, 20 bp, Homo sapiens
agcctcctcccaccaccctc

SEQ ID NO: 5198743 - DNA, 16 bp, Homo sapiens
agcctcctcctgacca

SEQ ID NO: 5198744 - DNA, 16 bp, Homo sapiens
agcctcctcctgggct

SEQ ID NO: 5198745 - DNA, 18 bp, Homo sapiens
agcctcctcctgggctcc

SEQ ID NO: 5198746 - DNA, 13 bp, Homo sapiens
agcctcctctctc

SEQ ID NO: 5198747 - DNA, 12 bp, Homo sapiens
agcctcctctgg

SEQ ID NO: 5198748 - DNA, 13 bp, Homo sapiens
agcctcctctgga

SEQ ID NO: 5198749 - DNA, 14 bp, Homo sapiens
agcctcctctggac

SEQ ID NO: 5198750 - DNA, 15 bp, Homo sapiens
agcctcctctgtctg

SEQ ID NO: 5198751 - DNA, 16 bp, Homo sapiens
agcctcctctgtctgc

SEQ ID NO: 5198752 - DNA, 19 bp, Homo sapiens
agcctcctctgtctgccct

SEQ ID NO: 5198753 - DNA, 20 bp, Homo sapiens
agcctcctgaagttgctgct

SEQ ID NO: 5198754 - DNA, 17 bp, Homo sapiens
agcctcctgacctgagg

SEQ ID NO: 5198755 - DNA, 19 bp, Homo sapiens
agcctcctgacctgaggct

SEQ ID NO: 5198756 - DNA, 13 bp, Homo sapiens
agcctcctgagcc

SEQ ID NO: 5198757 - DNA, 16 bp, Homo sapiens
agcctcctgagcctgt

SEQ ID NO: 5198758 - DNA, 15 bp, Homo sapiens
agcctcctgagtagc

SEQ ID NO: 5198759 - DNA, 19 bp, Homo sapiens
agcctcctgagtagctggg

SEQ ID NO: 5198760 - DNA, 15 bp, Homo sapiens
agcctcctgcccagt

SEQ ID NO: 5198761 - DNA, 17 bp, Homo sapiens
agcctcctgccccctgc

SEQ ID NO: 5198762 - DNA, 13 bp, Homo sapiens
agcctcctgccct

SEQ ID NO: 5198763 - DNA, 21 bp, Homo sapiens
agcctcctgctgagtggtcca

SEQ ID NO: 5198764 - DNA, 15 bp, Homo sapiens
agcctcctgggcagt

SEQ ID NO: 5198765 - DNA, 19 bp, Homo sapiens
agcctcctgtacctcagtg

SEQ ID NO: 5198766 - DNA, 14 bp, Homo sapiens
agcctcctgtctcg

SEQ ID NO: 5198767 - DNA, 14 bp, Homo sapiens
agcctcctgtgcct

SEQ ID NO: 5198768 - DNA, 16 bp, Homo sapiens
agcctcctgtgcctgg

SEQ ID NO: 5198769 - DNA, 18 bp, Homo sapiens
agcctcctgtgcctggcc

SEQ ID NO: 5198770 - DNA, 22 bp, Homo sapiens
agcctcctgtgcctggccccag

SEQ ID NO: 5198771 - DNA, 22 bp, Homo sapiens
agcctccttgctgaccccaggt

SEQ ID NO: 5198772 - DNA, 23 bp, Homo sapiens
agcctccttgctgaccccaggtc

SEQ ID NO: 5198773 - DNA, 14 bp, Homo sapiens
agcctccttgtgca

SEQ ID NO: 5198774 - DNA, 15 bp, Homo sapiens
agcctccttgtgcaa

SEQ ID NO: 5198775 - DNA, 16 bp, Homo sapiens
agcctccttgtgcaat

SEQ ID NO: 5198776 - DNA, 14 bp, Homo sapiens
agcctcctttgtgt

SEQ ID NO: 5198777 - DNA, 15 bp, Homo sapiens
agcctcgaactcctg

SEQ ID NO: 5198778 - DNA, 21 bp, Homo sapiens
agcctcgaactcctgggctca

SEQ ID NO: 5198779 - DNA, 16 bp, Homo sapiens
agcctcgaatatctta

SEQ ID NO: 5198780 - DNA, 17 bp, Homo sapiens
agcctcgacacagagtg

SEQ ID NO: 5198781 - DNA, 18 bp, Homo sapiens
agcctcgacacagagtgg

SEQ ID NO: 5198782 - DNA, 21 bp, Homo sapiens
agcctcgacacccccccaacc

SEQ ID NO: 5198783 - DNA, 22 bp, Homo sapiens
agcctcgacacccccccaaccc

SEQ ID NO: 5198784 - DNA, 22 bp, Homo sapiens
agcctcgacctccctggcttga

SEQ ID NO: 5198785 - DNA, 14 bp, Homo sapiens
agcctcgaggctgg

SEQ ID NO: 5198786 - DNA, 19 bp, Homo sapiens
agcctcgcacaggccctag

SEQ ID NO: 5198787 - DNA, 21 bp, Homo sapiens
agcctcgcacaggccctagct

SEQ ID NO: 5198788 - DNA, 22 bp, Homo sapiens
agcctcgcaggcctccctgcca

SEQ ID NO: 5198789 - DNA, 20 bp, Homo sapiens
agcctcgcccatccccttga

SEQ ID NO: 5198790 - DNA, 16 bp, Homo sapiens
agcctcgcccctccag

SEQ ID NO: 5198791 - DNA, 19 bp, Homo sapiens
agcctcgcccctccagtgt

SEQ ID NO: 5198792 - DNA, 16 bp, Homo sapiens
agcctcgcccctggca

SEQ ID NO: 5198793 - DNA, 16 bp, Homo sapiens
agcctcgcctgtcacc

SEQ ID NO: 5198794 - DNA, 16 bp, Homo sapiens
agcctcgcggtcttgg

SEQ ID NO: 5198795 - DNA, 17 bp, Homo sapiens
agcctcgctttttcatc

SEQ ID NO: 5198796 - DNA, 16 bp, Homo sapiens
agcctcggcctaggtc

SEQ ID NO: 5198797 - DNA, 18 bp, Homo sapiens
agcctcggggatggggag

SEQ ID NO: 5198798 - DNA, 20 bp, Homo sapiens
agcctcggggatggggaggg

SEQ ID NO: 5198799 - DNA, 17 bp, Homo sapiens
agcctcggtggccatgc

SEQ ID NO: 5198800 - DNA, 18 bp, Homo sapiens
agcctcggtggccatgct

SEQ ID NO: 5198801 - DNA, 21 bp, Homo sapiens
agcctcggtggccatgcttct

SEQ ID NO: 5198802 - DNA, 17 bp, Homo sapiens
agcctcgtctttcagcg

SEQ ID NO: 5198803 - DNA, 20 bp, Homo sapiens
agcctcgtggagctcgcccc

SEQ ID NO: 5198804 - DNA, 15 bp, Homo sapiens
agcctcgtgtcatct

SEQ ID NO: 5198805 - DNA, 16 bp, Homo sapiens
agcctcgtgtcatctc

SEQ ID NO: 5198806 - DNA, 13 bp, Homo sapiens
agcctcgtgtcct

SEQ ID NO: 5198807 - DNA, 16 bp, Homo sapiens
agcctcgtgtcctgct

SEQ ID NO: 5198808 - DNA, 19 bp, Homo sapiens
agcctcgtgtcctgctagc

SEQ ID NO: 5198809 - DNA, 21 bp, Homo sapiens
agcctcgtgtcctgctagctg

SEQ ID NO: 5198810 - DNA, 21 bp, Homo sapiens
agcctcgttggaagaggaaca

SEQ ID NO: 5198811 - DNA, 17 bp, Homo sapiens
agcctcgttttgatgcc

SEQ ID NO: 5198812 - DNA, 19 bp, Homo sapiens
agcctctaacaaatgatct

SEQ ID NO: 5198813 - DNA, 22 bp, Homo sapiens
agcctctagagcagactacagc

SEQ ID NO: 5198814 - DNA, 22 bp, Homo sapiens
agcctctagggacccctcctcc

SEQ ID NO: 5198815 - DNA, 19 bp, Homo sapiens
agcctctagtgtaccaagt

SEQ ID NO: 5198816 - DNA, 16 bp, Homo sapiens
agcctctccactcatg

SEQ ID NO: 5198817 - DNA, 18 bp, Homo sapiens
agcctctccccaggtcca

SEQ ID NO: 5198818 - DNA, 20 bp, Homo sapiens
agcctctccccgctctggat

SEQ ID NO: 5198819 - DNA, 13 bp, Homo sapiens
agcctctcccctg

SEQ ID NO: 5198820 - DNA, 15 bp, Homo sapiens
agcctctcccggctg

SEQ ID NO: 5198821 - DNA, 19 bp, Homo sapiens
agcctctcccggctgcctg

SEQ ID NO: 5198822 - DNA, 14 bp, Homo sapiens
agcctctccgactc

SEQ ID NO: 5198823 - DNA, 14 bp, Homo sapiens
agcctctccgccca

SEQ ID NO: 5198824 - DNA, 20 bp, Homo sapiens
agcctctccggcagaaggga

SEQ ID NO: 5198825 - DNA, 18 bp, Homo sapiens
agcctctccttgccccag

SEQ ID NO: 5198826 - DNA, 21 bp, Homo sapiens
agcctctccttgccccagtcc

SEQ ID NO: 5198827 - DNA, 22 bp, Homo sapiens
agcctctccttgccccagtcct

SEQ ID NO: 5198828 - DNA, 13 bp, Homo sapiens
agcctctcgtccc

SEQ ID NO: 5198829 - DNA, 22 bp, Homo sapiens
agcctctcgtcccgtccctccc

SEQ ID NO: 5198830 - DNA, 15 bp, Homo sapiens
agcctctctcccagt

SEQ ID NO: 5198831 - DNA, 15 bp, Homo sapiens
agcctctctggctca

SEQ ID NO: 5198832 - DNA, 16 bp, Homo sapiens
agcctctctggctcag

SEQ ID NO: 5198833 - DNA, 20 bp, Homo sapiens
agcctctcttcactgctaca

SEQ ID NO: 5198834 - DNA, 17 bp, Homo sapiens
agcctctcttcctatcc

SEQ ID NO: 5198835 - DNA, 21 bp, Homo sapiens
agcctctcttcctatcccatc

SEQ ID NO: 5198836 - DNA, 14 bp, Homo sapiens
agcctctctttgtt

SEQ ID NO: 5198837 - DNA, 12 bp, Homo sapiens
agcctctgaccc

SEQ ID NO: 5198838 - DNA, 12 bp, Homo sapiens
agcctctgactc

SEQ ID NO: 5198839 - DNA, 16 bp, Homo sapiens
agcctctgactcacca

SEQ ID NO: 5198840 - DNA, 21 bp, Homo sapiens
agcctctgacttaagctgcct

SEQ ID NO: 5198841 - DNA, 16 bp, Homo sapiens
agcctctgagatgcta

SEQ ID NO: 5198842 - DNA, 22 bp, Homo sapiens
agcctctgagatgctaatttat

SEQ ID NO: 5198843 - DNA, 18 bp, Homo sapiens
agcctctgatctgtgcag

SEQ ID NO: 5198844 - DNA, 16 bp, Homo sapiens
agcctctgccactgtg

SEQ ID NO: 5198845 - DNA, 13 bp, Homo sapiens
agcctctgccagg

SEQ ID NO: 5198846 - DNA, 15 bp, Homo sapiens
agcctctgccaggcc

SEQ ID NO: 5198847 - DNA, 18 bp, Homo sapiens
agcctctgcccaggcact

SEQ ID NO: 5198848 - DNA, 17 bp, Homo sapiens
agcctctgccccaaggg

SEQ ID NO: 5198849 - DNA, 19 bp, Homo sapiens
agcctctgccccaaggggc

SEQ ID NO: 5198850 - DNA, 17 bp, Homo sapiens
agcctctgccgctgcca

SEQ ID NO: 5198851 - DNA, 18 bp, Homo sapiens
agcctctgccgctgccat

SEQ ID NO: 5198852 - DNA, 11 bp, Homo sapiens
agcctctgcct

SEQ ID NO: 5198853 - DNA, 22 bp, Homo sapiens
agcctctgcctgacagcatcct

SEQ ID NO: 5198854 - DNA, 16 bp, Homo sapiens
agcctctgcctgtgca

SEQ ID NO: 5198855 - DNA, 13 bp, Homo sapiens
agcctctgctccc

SEQ ID NO: 5198856 - DNA, 13 bp, Homo sapiens
agcctctgctgga

SEQ ID NO: 5198857 - DNA, 14 bp, Homo sapiens
agcctctggaatgc

SEQ ID NO: 5198858 - DNA, 11 bp, Homo sapiens
agcctctggac

SEQ ID NO: 5198859 - DNA, 14 bp, Homo sapiens
agcctctggacagc

SEQ ID NO: 5198860 - DNA, 13 bp, Homo sapiens
agcctctggactg

SEQ ID NO: 5198861 - DNA, 23 bp, Homo sapiens
agcctctggactggaaagcacaa

SEQ ID NO: 5198862 - DNA, 11 bp, Homo sapiens
agcctctggat

SEQ ID NO: 5198863 - DNA, 19 bp, Homo sapiens
agcctctggatctagaagg

SEQ ID NO: 5198864 - DNA, 23 bp, Homo sapiens
agcctctggcattagaattattt

SEQ ID NO: 5198865 - DNA, 12 bp, Homo sapiens
agcctctggcca

SEQ ID NO: 5198866 - DNA, 13 bp, Homo sapiens
agcctctggccag

SEQ ID NO: 5198867 - DNA, 15 bp, Homo sapiens
agcctctggcccctc

SEQ ID NO: 5198868 - DNA, 16 bp, Homo sapiens
agcctctggcccctca

SEQ ID NO: 5198869 - DNA, 12 bp, Homo sapiens
agcctctggcta

SEQ ID NO: 5198870 - DNA, 19 bp, Homo sapiens
agcctctggctccacacct

SEQ ID NO: 5198871 - DNA, 19 bp, Homo sapiens
agcctctgggatctgccaa

SEQ ID NO: 5198872 - DNA, 17 bp, Homo sapiens
agcctctggggcagagc

SEQ ID NO: 5198873 - DNA, 22 bp, Homo sapiens
agcctctggggggtggccaggc

SEQ ID NO: 5198874 - DNA, 13 bp, Homo sapiens
agcctctgggtca

SEQ ID NO: 5198875 - DNA, 22 bp, Homo sapiens
agcctctgggtcagtggtccac

SEQ ID NO: 5198876 - DNA, 23 bp, Homo sapiens
agcctctgggtcagtggtccaca

SEQ ID NO: 5198877 - DNA, 21 bp, Homo sapiens
agcctctgtcactgcaggcac

SEQ ID NO: 5198878 - DNA, 16 bp, Homo sapiens
agcctctgtcaggcct

SEQ ID NO: 5198879 - DNA, 13 bp, Homo sapiens
agcctctgtgtca

SEQ ID NO: 5198880 - DNA, 23 bp, Homo sapiens
agcctctgtgtcactggctgcct

SEQ ID NO: 5198881 - DNA, 23 bp, Homo sapiens
agcctcttaaagctgcctgtagt

SEQ ID NO: 5198882 - DNA, 16 bp, Homo sapiens
agcctcttaccttccc

SEQ ID NO: 5198883 - DNA, 22 bp, Homo sapiens
agcctcttagtgattgtgtctg

SEQ ID NO: 5198884 - DNA, 17 bp, Homo sapiens
agcctcttattccagga

SEQ ID NO: 5198885 - DNA, 17 bp, Homo sapiens
agcctcttcagcccctt

SEQ ID NO: 5198886 - DNA, 19 bp, Homo sapiens
agcctcttcagccccttct

SEQ ID NO: 5198887 - DNA, 16 bp, Homo sapiens
agcctcttccattccc

SEQ ID NO: 5198888 - DNA, 12 bp, Homo sapiens
agcctcttccct

SEQ ID NO: 5198889 - DNA, 14 bp, Homo sapiens
agcctcttccctct

SEQ ID NO: 5198890 - DNA, 20 bp, Homo sapiens
agcctcttctgccaagagag

SEQ ID NO: 5198891 - DNA, 22 bp, Homo sapiens
agcctcttgaatgcttaaatga

SEQ ID NO: 5198892 - DNA, 21 bp, Homo sapiens
agcctcttgcccgtcggccct

SEQ ID NO: 5198893 - DNA, 22 bp, Homo sapiens
agcctcttgcccgtcggccctg

SEQ ID NO: 5198894 - DNA, 21 bp, Homo sapiens
agcctctttaacagctttctc

SEQ ID NO: 5198895 - DNA, 20 bp, Homo sapiens
agcctctttcccttccagtt

SEQ ID NO: 5198896 - DNA, 21 bp, Homo sapiens
agcctctttcccttccagttt

SEQ ID NO: 5198897 - DNA, 15 bp, Homo sapiens
agctttactgtttct

SEQ ID NO: 5198898 - DNA, 17 bp, Homo sapiens
agctttactgtttctca

SEQ ID NO: 5198899 - DNA, 22 bp, Homo sapiens
agctttactgtttctcaagtgt

SEQ ID NO: 5198900 - DNA, 18 bp, Homo sapiens
agctttagaaacagtgca

SEQ ID NO: 5198901 - DNA, 18 bp, Homo sapiens
agctttagacagcagagc

SEQ ID NO: 5198902 - DNA, 16 bp, Homo sapiens
agctttagaccctggg

SEQ ID NO: 5198903 - DNA, 17 bp, Homo sapiens
agctttagaccctgggt

SEQ ID NO: 5198904 - DNA, 19 bp, Homo sapiens
agctttagaccctgggtgg

SEQ ID NO: 5198905 - DNA, 22 bp, Homo sapiens
agctttagaccctgggtgggct

SEQ ID NO: 5198906 - DNA, 20 bp, Homo sapiens
agctttagagaagccataac

SEQ ID NO: 5198907 - DNA, 17 bp, Homo sapiens
agctttagattgaaatt

SEQ ID NO: 5198908 - DNA, 15 bp, Homo sapiens
agctttagctggagg

SEQ ID NO: 5198909 - DNA, 16 bp, Homo sapiens
agctttaggggaccat

SEQ ID NO: 5198910 - DNA, 21 bp, Homo sapiens
agctttagtgaattaaattta

SEQ ID NO: 5198911 - DNA, 19 bp, Homo sapiens
agctttataataaactgtt

SEQ ID NO: 5198912 - DNA, 23 bp, Homo sapiens
agctttatcaaagggtgaaaatt

SEQ ID NO: 5198913 - DNA, 22 bp, Homo sapiens
agctttatcgaacgtggtctga

SEQ ID NO: 5198914 - DNA, 18 bp, Homo sapiens
agctttatctgtcacaca

SEQ ID NO: 5198915 - DNA, 21 bp, Homo sapiens
agctttatctgtcacacaagg

SEQ ID NO: 5198916 - DNA, 19 bp, Homo sapiens
agctttatctttgtgtaat

SEQ ID NO: 5198917 - DNA, 15 bp, Homo sapiens
agctttatgattttc

SEQ ID NO: 5198918 - DNA, 21 bp, Homo sapiens
agctttatggtcctaaaagca

SEQ ID NO: 5198919 - DNA, 17 bp, Homo sapiens
agctttattatggcttg

SEQ ID NO: 5198920 - DNA, 23 bp, Homo sapiens
agctttattatggcttgtgaact

SEQ ID NO: 5198921 - DNA, 18 bp, Homo sapiens
agctttattgctgcattt

SEQ ID NO: 5198922 - DNA, 14 bp, Homo sapiens
agctttatttctag

SEQ ID NO: 5198923 - DNA, 14 bp, Homo sapiens
agctttatttgcat

SEQ ID NO: 5198924 - DNA, 18 bp, Homo sapiens
agctttatttttctttaa

SEQ ID NO: 5198925 - DNA, 23 bp, Homo sapiens
agctttatttttctttaaagcca

SEQ ID NO: 5198926 - DNA, 23 bp, Homo sapiens
agctttatttttcttttcctggg

SEQ ID NO: 5198927 - DNA, 18 bp, Homo sapiens
agctttattttttaacat

SEQ ID NO: 5198928 - DNA, 22 bp, Homo sapiens
agctttattttttaagtattta

SEQ ID NO: 5198929 - DNA, 17 bp, Homo sapiens
agctttcaaagaaggaa

SEQ ID NO: 5198930 - DNA, 17 bp, Homo sapiens
agctttcaagtgccttt

SEQ ID NO: 5198931 - DNA, 12 bp, Homo sapiens
agctttcagagc

SEQ ID NO: 5198932 - DNA, 16 bp, Homo sapiens
agctttcagagccagt

SEQ ID NO: 5198933 - DNA, 22 bp, Homo sapiens
agctttcatcacacccttttaa

SEQ ID NO: 5198934 - DNA, 20 bp, Homo sapiens
agctttcatttgacacacag

SEQ ID NO: 5198935 - DNA, 16 bp, Homo sapiens
agctttccacaggagg

SEQ ID NO: 5198936 - DNA, 21 bp, Homo sapiens
agctttcccaaataaactcta

SEQ ID NO: 5198937 - DNA, 15 bp, Homo sapiens
agctttccctgtgcc

SEQ ID NO: 5198938 - DNA, 20 bp, Homo sapiens
agctttcctcaaaaagcaga

SEQ ID NO: 5198939 - DNA, 13 bp, Homo sapiens
agctttcctgaca

SEQ ID NO: 5198940 - DNA, 16 bp, Homo sapiens
agctttcctgatgatg

SEQ ID NO: 5198941 - DNA, 13 bp, Homo sapiens
agctttcctgccc

SEQ ID NO: 5198942 - DNA, 14 bp, Homo sapiens
agctttcctgcccc

SEQ ID NO: 5198943 - DNA, 12 bp, Homo sapiens
agctttcctgga

SEQ ID NO: 5198944 - DNA, 21 bp, Homo sapiens
agctttcctggaagtcaaata

SEQ ID NO: 5198945 - DNA, 20 bp, Homo sapiens
agctttcctggtccctcacc

SEQ ID NO: 5198946 - DNA, 16 bp, Homo sapiens
agctttcctgtttcca

SEQ ID NO: 5198947 - DNA, 16 bp, Homo sapiens
agctttccttctccag

SEQ ID NO: 5198948 - DNA, 15 bp, Homo sapiens
agctttccttctgcc

SEQ ID NO: 5198949 - DNA, 16 bp, Homo sapiens
agctttccttctgccc

SEQ ID NO: 5198950 - DNA, 20 bp, Homo sapiens
agctttccttctgcccttcc

SEQ ID NO: 5198951 - DNA, 18 bp, Homo sapiens
agctttcctttccttctg

SEQ ID NO: 5198952 - DNA, 22 bp, Homo sapiens
agctttcctttccttctggctc

SEQ ID NO: 5198953 - DNA, 15 bp, Homo sapiens
agctttctaaagcca

SEQ ID NO: 5198954 - DNA, 17 bp, Homo sapiens
agctttctaactcacag

SEQ ID NO: 5198955 - DNA, 23 bp, Homo sapiens
agctttctagaagtttcccttcc

SEQ ID NO: 5198956 - DNA, 18 bp, Homo sapiens
agctttctcaatgtcttc

SEQ ID NO: 5198957 - DNA, 19 bp, Homo sapiens
agctttctcctctgctatg

SEQ ID NO: 5198958 - DNA, 18 bp, Homo sapiens
agctttctcgcgccctcc

SEQ ID NO: 5198959 - DNA, 21 bp, Homo sapiens
agctttctctccgacttcccc

SEQ ID NO: 5198960 - DNA, 16 bp, Homo sapiens
agctttctctgcttca

SEQ ID NO: 5198961 - DNA, 18 bp, Homo sapiens
agctttctctgcttcagc

SEQ ID NO: 5198962 - DNA, 17 bp, Homo sapiens
agctttctgaacagctg

SEQ ID NO: 5198963 - DNA, 21 bp, Homo sapiens
agctttctgaacagctggtgt

SEQ ID NO: 5198964 - DNA, 19 bp, Homo sapiens
agctttctgaccttcagct

SEQ ID NO: 5198965 - DNA, 21 bp, Homo sapiens
agctttctgaggccctgagca

SEQ ID NO: 5198966 - DNA, 13 bp, Homo sapiens
agctttctgcctt

SEQ ID NO: 5198967 - DNA, 15 bp, Homo sapiens
agctttctggaattt

SEQ ID NO: 5198968 - DNA, 13 bp, Homo sapiens
agctttctgtgca

SEQ ID NO: 5198969 - DNA, 14 bp, Homo sapiens
agctttctgtgcat

SEQ ID NO: 5198970 - DNA, 18 bp, Homo sapiens
agctttctgtgcatgtgc

SEQ ID NO: 5198971 - DNA, 23 bp, Homo sapiens
agctttcttctacaaccagagcc

SEQ ID NO: 5198972 - DNA, 12 bp, Homo sapiens
agctttgaaact

SEQ ID NO: 5198973 - DNA, 18 bp, Homo sapiens
agctttgaaataaaataa

SEQ ID NO: 5198974 - DNA, 22 bp, Homo sapiens
agctttgaatacccccagagac

SEQ ID NO: 5198975 - DNA, 23 bp, Homo sapiens
agctttgaatacccccagagacc

SEQ ID NO: 5198976 - DNA, 23 bp, Homo sapiens
agctttgaatatctgcaatcttt

SEQ ID NO: 5198977 - DNA, 20 bp, Homo sapiens
agctttgaatgcagaagcaa

SEQ ID NO: 5198978 - DNA, 15 bp, Homo sapiens
agctttgactcagga

SEQ ID NO: 5198979 - DNA, 16 bp, Homo sapiens
agctttgactcaggag

SEQ ID NO: 5198980 - DNA, 19 bp, Homo sapiens
agctttgactctataagca

SEQ ID NO: 5198981 - DNA, 19 bp, Homo sapiens
agctttgagacaggtgcct

SEQ ID NO: 5198982 - DNA, 20 bp, Homo sapiens
agctttgagacaggtgcctg

SEQ ID NO: 5198983 - DNA, 17 bp, Homo sapiens
agctttgagatttcagc

SEQ ID NO: 5198984 - DNA, 19 bp, Homo sapiens
agctttgagatttcagcta

SEQ ID NO: 5198985 - DNA, 12 bp, Homo sapiens
agctttgaggaa

SEQ ID NO: 5198986 - DNA, 17 bp, Homo sapiens
agctttgaggaacatgc

SEQ ID NO: 5198987 - DNA, 18 bp, Homo sapiens
agctttgaggctctgtca

SEQ ID NO: 5198988 - DNA, 22 bp, Homo sapiens
agctttgagttgacttctgaca

SEQ ID NO: 5198989 - DNA, 23 bp, Homo sapiens
agctttgagttgacttctgacaa

SEQ ID NO: 5198990 - DNA, 15 bp, Homo sapiens
agctttgatttttac

SEQ ID NO: 5198991 - DNA, 23 bp, Homo sapiens
agctttgcaaccttgtactttac

SEQ ID NO: 5198992 - DNA, 18 bp, Homo sapiens
agctttgcacccctttcc

SEQ ID NO: 5198993 - DNA, 11 bp, Homo sapiens
agctttgcagt

SEQ ID NO: 5198994 - DNA, 22 bp, Homo sapiens
agctttgcccaacaccagcccc

SEQ ID NO: 5198995 - DNA, 16 bp, Homo sapiens
agctttgctaccaaag

SEQ ID NO: 5198996 - DNA, 13 bp, Homo sapiens
agctttgctattc

SEQ ID NO: 5198997 - DNA, 22 bp, Homo sapiens
agctttgctcagcacactctcc

SEQ ID NO: 5198998 - DNA, 21 bp, Homo sapiens
agctttgctccgctcccaccg

SEQ ID NO: 5198999 - DNA, 21 bp, Homo sapiens
agctttgctccttcagttctg

SEQ ID NO: 5199000 - DNA, 23 bp, Homo sapiens
agctttgctccttcagttctgct

SEQ ID NO: 5199001 - DNA, 15 bp, Homo sapiens
agctttgctcttgga

SEQ ID NO: 5199002 - DNA, 18 bp, Homo sapiens
agctttgctctttggtag

SEQ ID NO: 5199003 - DNA, 13 bp, Homo sapiens
agctttgctgcta

SEQ ID NO: 5199004 - DNA, 22 bp, Homo sapiens
agctttgctgctgaaggctcat

SEQ ID NO: 5199005 - DNA, 19 bp, Homo sapiens
agctttggaagcagcaagg

SEQ ID NO: 5199006 - DNA, 23 bp, Homo sapiens
agctttggaagtttagctctgag

SEQ ID NO: 5199007 - DNA, 12 bp, Homo sapiens
agctttggaata

SEQ ID NO: 5199008 - DNA, 14 bp, Homo sapiens
agctttggaatatt

SEQ ID NO: 5199009 - DNA, 19 bp, Homo sapiens
agctttggacacacacagc

SEQ ID NO: 5199010 - DNA, 23 bp, Homo sapiens
agctttggacacacacagcttct

SEQ ID NO: 5199011 - DNA, 19 bp, Homo sapiens
agctttggacccaaggaaa

SEQ ID NO: 5199012 - DNA, 13 bp, Homo sapiens
agctttggcagtg

SEQ ID NO: 5199013 - DNA, 20 bp, Homo sapiens
agctttggctatgagggcct

SEQ ID NO: 5199014 - DNA, 16 bp, Homo sapiens
agctttggctctggct

SEQ ID NO: 5199015 - DNA, 18 bp, Homo sapiens
agctttggctctggctgc

SEQ ID NO: 5199016 - DNA, 13 bp, Homo sapiens
agctttggctgag

SEQ ID NO: 5199017 - DNA, 22 bp, Homo sapiens
agctttggctgagacctgggat

SEQ ID NO: 5199018 - DNA, 20 bp, Homo sapiens
agctttgggaaagctgcctc

SEQ ID NO: 5199019 - DNA, 20 bp, Homo sapiens
agctttgggcagatttgcaa

SEQ ID NO: 5199020 - DNA, 23 bp, Homo sapiens
agctttggggtgtctttttttgg

SEQ ID NO: 5199021 - DNA, 22 bp, Homo sapiens
agctttgggtcatttttaacta

SEQ ID NO: 5199022 - DNA, 23 bp, Homo sapiens
agctttgggtgaccagccactca

SEQ ID NO: 5199023 - DNA, 17 bp, Homo sapiens
agctttggtgcaatggc

SEQ ID NO: 5199024 - DNA, 18 bp, Homo sapiens
agctttggttatgaaaca

SEQ ID NO: 5199025 - DNA, 12 bp, Homo sapiens
agctttgtaatt

SEQ ID NO: 5199026 - DNA, 17 bp, Homo sapiens
agctttgtagaaattaa

SEQ ID NO: 5199027 - DNA, 21 bp, Homo sapiens
agctttgtaggtgagatgcaa

SEQ ID NO: 5199028 - DNA, 12 bp, Homo sapiens
agctttgtagtt

SEQ ID NO: 5199029 - DNA, 22 bp, Homo sapiens
agctttgtcactgtttcactac

SEQ ID NO: 5199030 - DNA, 17 bp, Homo sapiens
agctttgtcccctgctt

SEQ ID NO: 5199031 - DNA, 21 bp, Homo sapiens
agctttgtcccctgcttcaga

SEQ ID NO: 5199032 - DNA, 21 bp, Homo sapiens
agctttgtctccaaagaagat

SEQ ID NO: 5199033 - DNA, 14 bp, Homo sapiens
agctttgtgcttgt

SEQ ID NO: 5199034 - DNA, 22 bp, Homo sapiens
agctttgtgtttggtttacatt

SEQ ID NO: 5199035 - DNA, 13 bp, Homo sapiens
agctttgttctgg

SEQ ID NO: 5199036 - DNA, 14 bp, Homo sapiens
agctttgttgtcct

SEQ ID NO: 5199037 - DNA, 18 bp, Homo sapiens
agctttgttgtcctccca

SEQ ID NO: 5199038 - DNA, 20 bp, Homo sapiens
agctttgttgtcctcccagg

SEQ ID NO: 5199039 - DNA, 21 bp, Homo sapiens
agctttgttgtcctcccagga

SEQ ID NO: 5199040 - DNA, 20 bp, Homo sapiens
agctttgtttagtctttata

SEQ ID NO: 5199041 - DNA, 17 bp, Homo sapiens
agctttgtttgttcttg

SEQ ID NO: 5199042 - DNA, 21 bp, Homo sapiens
agctttgtttgttgtcagctg

SEQ ID NO: 5199043 - DNA, 18 bp, Homo sapiens
agctttgttttatatatt

SEQ ID NO: 5199044 - DNA, 17 bp, Homo sapiens
agcttttaaaaaatatt

SEQ ID NO: 5199045 - DNA, 22 bp, Homo sapiens
agcttttaaaaaatattttaag

SEQ ID NO: 5199046 - DNA, 15 bp, Homo sapiens
agcttttaaaaatgt

SEQ ID NO: 5199047 - DNA, 18 bp, Homo sapiens
agcttttaaaaatgtttg

SEQ ID NO: 5199048 - DNA, 18 bp, Homo sapiens
agcttttaataaaattga

SEQ ID NO: 5199049 - DNA, 19 bp, Homo sapiens
agcttttaataaaattgac

SEQ ID NO: 5199050 - DNA, 19 bp, Homo sapiens
agcttttacagatccagaa

SEQ ID NO: 5199051 - DNA, 13 bp, Homo sapiens
agcttttagcctg

SEQ ID NO: 5199052 - DNA, 18 bp, Homo sapiens
agcttttagcctggctgt

SEQ ID NO: 5199053 - DNA, 18 bp, Homo sapiens
agcttttagtacccacct

SEQ ID NO: 5199054 - DNA, 19 bp, Homo sapiens
agcttttagtacccacctg

SEQ ID NO: 5199055 - DNA, 23 bp, Homo sapiens
agcttttagtacccacctgagct

SEQ ID NO: 5199056 - DNA, 15 bp, Homo sapiens
agcttttattgtata

SEQ ID NO: 5199057 - DNA, 21 bp, Homo sapiens
agcttttatttggtgtgttcg

SEQ ID NO: 5199058 - DNA, 20 bp, Homo sapiens
agcttttcaaacaagaatgt

SEQ ID NO: 5199059 - DNA, 12 bp, Homo sapiens
agcttttcacct

SEQ ID NO: 5199060 - DNA, 15 bp, Homo sapiens
agcttttcacttctt

SEQ ID NO: 5199061 - DNA, 18 bp, Homo sapiens
agcttttcacttcttaag

SEQ ID NO: 5199062 - DNA, 15 bp, Homo sapiens
agcttttcagaacat

SEQ ID NO: 5199063 - DNA, 14 bp, Homo sapiens
agcttttcccagga

SEQ ID NO: 5199064 - DNA, 14 bp, Homo sapiens
agcttttccctgtc

SEQ ID NO: 5199065 - DNA, 12 bp, Homo sapiens
agcttttccttt

SEQ ID NO: 5199066 - DNA, 13 bp, Homo sapiens
agcttttcctttc

SEQ ID NO: 5199067 - DNA, 17 bp, Homo sapiens
agcttttctattttaat

SEQ ID NO: 5199068 - DNA, 12 bp, Homo sapiens
agcttttcttga

SEQ ID NO: 5199069 - DNA, 17 bp, Homo sapiens
agcttttcttgccagct

SEQ ID NO: 5199070 - DNA, 14 bp, Homo sapiens
agcttttctttctt

SEQ ID NO: 5199071 - DNA, 19 bp, Homo sapiens
agcttttgaaatccagaag

SEQ ID NO: 5199072 - DNA, 20 bp, Homo sapiens
agcttttgatgccaggtgca

SEQ ID NO: 5199073 - DNA, 23 bp, Homo sapiens
agcctctttcctaacttccttta

SEQ ID NO: 5199074 - DNA, 15 bp, Homo sapiens
agcctctttgctgga

SEQ ID NO: 5199075 - DNA, 18 bp, Homo sapiens
agcctctttgctggagtc

SEQ ID NO: 5199076 - DNA, 14 bp, Homo sapiens
agcctctttgtgtt

SEQ ID NO: 5199077 - DNA, 23 bp, Homo sapiens
agcctctttgtgtttttgttgtt

SEQ ID NO: 5199078 - DNA, 19 bp, Homo sapiens
agcctctttttccttcttc

SEQ ID NO: 5199079 - DNA, 21 bp, Homo sapiens
agcctctttttccttcttcag

SEQ ID NO: 5199080 - DNA, 16 bp, Homo sapiens
agcctgaaaattccaa

SEQ ID NO: 5199081 - DNA, 20 bp, Homo sapiens
agcctgaaatagtggttctt

SEQ ID NO: 5199082 - DNA, 22 bp, Homo sapiens
agcctgaaatagtggttcttgg

SEQ ID NO: 5199083 - DNA, 18 bp, Homo sapiens
agcctgaaccccagggct

SEQ ID NO: 5199084 - DNA, 17 bp, Homo sapiens
agcctgaactgagcccc

SEQ ID NO: 5199085 - DNA, 21 bp, Homo sapiens
agcctgaactgagccccagcg

SEQ ID NO: 5199086 - DNA, 18 bp, Homo sapiens
agcctgaactgaggcctt

SEQ ID NO: 5199087 - DNA, 20 bp, Homo sapiens
agcctgaagatcagagctgc

SEQ ID NO: 5199088 - DNA, 15 bp, Homo sapiens
agcctgaagcctgga

SEQ ID NO: 5199089 - DNA, 17 bp, Homo sapiens
agcctgaagggcctccc

SEQ ID NO: 5199090 - DNA, 15 bp, Homo sapiens
agcctgaataaacca

SEQ ID NO: 5199091 - DNA, 20 bp, Homo sapiens
agcctgaattttgttgctgt

SEQ ID NO: 5199092 - DNA, 22 bp, Homo sapiens
agcctgacaacagcctgagaaa

SEQ ID NO: 5199093 - DNA, 19 bp, Homo sapiens
agcctgacagccagaactc

SEQ ID NO: 5199094 - DNA, 19 bp, Homo sapiens
agcctgacatggacccact

SEQ ID NO: 5199095 - DNA, 18 bp, Homo sapiens
agcctgacccggaggaaa

SEQ ID NO: 5199096 - DNA, 16 bp, Homo sapiens
agcctgacctgagact

SEQ ID NO: 5199097 - DNA, 18 bp, Homo sapiens
agcctgacctgagactgt

SEQ ID NO: 5199098 - DNA, 18 bp, Homo sapiens
agcctgacgctcagcccc

SEQ ID NO: 5199099 - DNA, 21 bp, Homo sapiens
agcctgactagaactcctgtc

SEQ ID NO: 5199100 - DNA, 23 bp, Homo sapiens
agcctgactcagctaatgtcaca

SEQ ID NO: 5199101 - DNA, 14 bp, Homo sapiens
agcctgactgccag

SEQ ID NO: 5199102 - DNA, 20 bp, Homo sapiens
agcctgactgtgttcagtgc

SEQ ID NO: 5199103 - DNA, 22 bp, Homo sapiens
agcctgactgtgttcagtgcct

SEQ ID NO: 5199104 - DNA, 18 bp, Homo sapiens
agcctgagactggaaaag

SEQ ID NO: 5199105 - DNA, 14 bp, Homo sapiens
agcctgagagctgg

SEQ ID NO: 5199106 - DNA, 16 bp, Homo sapiens
agcctgagcaactctt

SEQ ID NO: 5199107 - DNA, 14 bp, Homo sapiens
agcctgagcaggca

SEQ ID NO: 5199108 - DNA, 15 bp, Homo sapiens
agcctgagcaggcag

SEQ ID NO: 5199109 - DNA, 11 bp, Homo sapiens
agcctgagcca

SEQ ID NO: 5199110 - DNA, 13 bp, Homo sapiens
agcctgagccaca

SEQ ID NO: 5199111 - DNA, 16 bp, Homo sapiens
agcctgagccacagtg

SEQ ID NO: 5199112 - DNA, 11 bp, Homo sapiens
agcctgagcct

SEQ ID NO: 5199113 - DNA, 12 bp, Homo sapiens
agcctgagcctt

SEQ ID NO: 5199114 - DNA, 16 bp, Homo sapiens
agcctgagccttagct

SEQ ID NO: 5199115 - DNA, 18 bp, Homo sapiens
agcctgagcgacagtgag

SEQ ID NO: 5199116 - DNA, 17 bp, Homo sapiens
agcctgagctccaccct

SEQ ID NO: 5199117 - DNA, 13 bp, Homo sapiens
agcctgaggacag

SEQ ID NO: 5199118 - DNA, 21 bp, Homo sapiens
agcctgaggacagaaagaccc

SEQ ID NO: 5199119 - DNA, 16 bp, Homo sapiens
agcctgaggcagccac

SEQ ID NO: 5199120 - DNA, 21 bp, Homo sapiens
agcctgaggcagccacttcgg

SEQ ID NO: 5199121 - DNA, 14 bp, Homo sapiens
agcctgaggcagga

SEQ ID NO: 5199122 - DNA, 14 bp, Homo sapiens
agcctgagggaaag

SEQ ID NO: 5199123 - DNA, 15 bp, Homo sapiens
agcctgagggaaagg

SEQ ID NO: 5199124 - DNA, 23 bp, Homo sapiens
agcctgagggaaaggccagcact

SEQ ID NO: 5199125 - DNA, 14 bp, Homo sapiens
agcctgaggtcccc

SEQ ID NO: 5199126 - DNA, 15 bp, Homo sapiens
agcctgaggtgccca

SEQ ID NO: 5199127 - DNA, 18 bp, Homo sapiens
agcctgaggtgcccactc

SEQ ID NO: 5199128 - DNA, 22 bp, Homo sapiens
agcctgagtaaagttaaaagaa

SEQ ID NO: 5199129 - DNA, 23 bp, Homo sapiens
agcctgagtagaaaggcctttaa

SEQ ID NO: 5199130 - DNA, 16 bp, Homo sapiens
agcctgagtcacctgc

SEQ ID NO: 5199131 - DNA, 19 bp, Homo sapiens
agcctgagtcacctgcaga

SEQ ID NO: 5199132 - DNA, 17 bp, Homo sapiens
agcctgagtcagggccc

SEQ ID NO: 5199133 - DNA, 20 bp, Homo sapiens
agcctgagtcagggcccaga

SEQ ID NO: 5199134 - DNA, 23 bp, Homo sapiens
agcctgagtccacgacctaggca

SEQ ID NO: 5199135 - DNA, 16 bp, Homo sapiens
agcctgagtctcctgt

SEQ ID NO: 5199136 - DNA, 20 bp, Homo sapiens
agcctgagtggtgaggggcc

SEQ ID NO: 5199137 - DNA, 22 bp, Homo sapiens
agcctgatactttagccatcat

SEQ ID NO: 5199138 - DNA, 18 bp, Homo sapiens
agcctgatcacctgccct

SEQ ID NO: 5199139 - DNA, 15 bp, Homo sapiens
agcctgatctcttcc

SEQ ID NO: 5199140 - DNA, 20 bp, Homo sapiens
agcctgatctcttcctgttt

SEQ ID NO: 5199141 - DNA, 13 bp, Homo sapiens
agcctgatggcca

SEQ ID NO: 5199142 - DNA, 19 bp, Homo sapiens
agcctgatggccaaggggg

SEQ ID NO: 5199143 - DNA, 11 bp, Homo sapiens
agcctgatgtc

SEQ ID NO: 5199144 - DNA, 21 bp, Homo sapiens
agcctgattcggggctgacct

SEQ ID NO: 5199145 - DNA, 15 bp, Homo sapiens
agcctgattgaaaag

SEQ ID NO: 5199146 - DNA, 19 bp, Homo sapiens
agcctgattttttgaggcc

SEQ ID NO: 5199147 - DNA, 18 bp, Homo sapiens
agcctgcaaactcactgc

SEQ ID NO: 5199148 - DNA, 17 bp, Homo sapiens
agcctgcaaagctggtt

SEQ ID NO: 5199149 - DNA, 12 bp, Homo sapiens
agcctgcacaca

SEQ ID NO: 5199150 - DNA, 15 bp, Homo sapiens
agcctgcacacacct

SEQ ID NO: 5199151 - DNA, 17 bp, Homo sapiens
agcctgcacacacctgc

SEQ ID NO: 5199152 - DNA, 13 bp, Homo sapiens
agcctgcaccctc

SEQ ID NO: 5199153 - DNA, 15 bp, Homo sapiens
agcctgcacctgccc

SEQ ID NO: 5199154 - DNA, 18 bp, Homo sapiens
agcctgcacctgccccgt

SEQ ID NO: 5199155 - DNA, 14 bp, Homo sapiens
agcctgcactttga

SEQ ID NO: 5199156 - DNA, 23 bp, Homo sapiens
agcctgcactttgatgtcatgtg

SEQ ID NO: 5199157 - DNA, 21 bp, Homo sapiens
agcctgcactttgggttttta

SEQ ID NO: 5199158 - DNA, 22 bp, Homo sapiens
agcctgcactttgggtttttaa

SEQ ID NO: 5199159 - DNA, 13 bp, Homo sapiens
agcctgcagagct

SEQ ID NO: 5199160 - DNA, 23 bp, Homo sapiens
agcctgcaggatctcaccaggca

SEQ ID NO: 5199161 - DNA, 21 bp, Homo sapiens
agcctgcagggtggtgctggg

SEQ ID NO: 5199162 - DNA, 20 bp, Homo sapiens
agcctgcaggtccggggagg

SEQ ID NO: 5199163 - DNA, 22 bp, Homo sapiens
agcctgcaggtccggggaggag

SEQ ID NO: 5199164 - DNA, 17 bp, Homo sapiens
agcctgcaggtgctgct

SEQ ID NO: 5199165 - DNA, 15 bp, Homo sapiens
agcctgcatcttctt

SEQ ID NO: 5199166 - DNA, 18 bp, Homo sapiens
agcctgcattctgcacgc

SEQ ID NO: 5199167 - DNA, 15 bp, Homo sapiens
agcctgcattgagct

SEQ ID NO: 5199168 - DNA, 21 bp, Homo sapiens
agcctgccaaagtgcctggga

SEQ ID NO: 5199169 - DNA, 18 bp, Homo sapiens
agcctgccactcaggccc

SEQ ID NO: 5199170 - DNA, 12 bp, Homo sapiens
agcctgccagca

SEQ ID NO: 5199171 - DNA, 16 bp, Homo sapiens
agcctgccaggccctc

SEQ ID NO: 5199172 - DNA, 10 bp, Homo sapiens
agcctgccca

SEQ ID NO: 5199173 - DNA, 15 bp, Homo sapiens
agcctgcccacctct

SEQ ID NO: 5199174 - DNA, 11 bp, Homo sapiens
agcctgcccag

SEQ ID NO: 5199175 - DNA, 12 bp, Homo sapiens
agcctgcccagc

SEQ ID NO: 5199176 - DNA, 21 bp, Homo sapiens
agcctgcccagttggaggaga

SEQ ID NO: 5199177 - DNA, 15 bp, Homo sapiens
agcctgccccagctg

SEQ ID NO: 5199178 - DNA, 14 bp, Homo sapiens
agcctgccctccag

SEQ ID NO: 5199179 - DNA, 15 bp, Homo sapiens
agcctgccctccagc

SEQ ID NO: 5199180 - DNA, 14 bp, Homo sapiens
agcctgcccttgtc

SEQ ID NO: 5199181 - DNA, 19 bp, Homo sapiens
agcctgccgccgtctctgt

SEQ ID NO: 5199182 - DNA, 15 bp, Homo sapiens
agcctgcctcaccca

SEQ ID NO: 5199183 - DNA, 16 bp, Homo sapiens
agcctgcctcacccac

SEQ ID NO: 5199184 - DNA, 15 bp, Homo sapiens
agcctgcctcagctg

SEQ ID NO: 5199185 - DNA, 16 bp, Homo sapiens
agcctgcctcagtggc

SEQ ID NO: 5199186 - DNA, 20 bp, Homo sapiens
agcctgcctcagtggcagca

SEQ ID NO: 5199187 - DNA, 17 bp, Homo sapiens
agcctgcctctgccaca

SEQ ID NO: 5199188 - DNA, 16 bp, Homo sapiens
agcctgcctcttctct

SEQ ID NO: 5199189 - DNA, 14 bp, Homo sapiens
agcctgcctgaaga

SEQ ID NO: 5199190 - DNA, 17 bp, Homo sapiens
agcctgcctgatccctg

SEQ ID NO: 5199191 - DNA, 13 bp, Homo sapiens
agcctgcctggag

SEQ ID NO: 5199192 - DNA, 14 bp, Homo sapiens
agcctgcctggagt

SEQ ID NO: 5199193 - DNA, 14 bp, Homo sapiens
agcctgcctggcag

SEQ ID NO: 5199194 - DNA, 21 bp, Homo sapiens
agcctgcgccaccgcccagag

SEQ ID NO: 5199195 - DNA, 16 bp, Homo sapiens
agcctgcgcctgctgc

SEQ ID NO: 5199196 - DNA, 17 bp, Homo sapiens
agcctgcgcctgctgca

SEQ ID NO: 5199197 - DNA, 19 bp, Homo sapiens
agcctgcgctcggcaggaa

SEQ ID NO: 5199198 - DNA, 21 bp, Homo sapiens
agcctgcgctcggcaggaagg

SEQ ID NO: 5199199 - DNA, 17 bp, Homo sapiens
agcctgcgggaagctga

SEQ ID NO: 5199200 - DNA, 20 bp, Homo sapiens
agcctgcgggaagctgacct

SEQ ID NO: 5199201 - DNA, 21 bp, Homo sapiens
agcctgcgtggcctggggctg

SEQ ID NO: 5199202 - DNA, 17 bp, Homo sapiens
agcctgcgtggctgacc

SEQ ID NO: 5199203 - DNA, 18 bp, Homo sapiens
agcctgctagctagctca

SEQ ID NO: 5199204 - DNA, 14 bp, Homo sapiens
agcctgctccagct

SEQ ID NO: 5199205 - DNA, 11 bp, Homo sapiens
agcctgctccc

SEQ ID NO: 5199206 - DNA, 17 bp, Homo sapiens
agcctgctcccccaccc

SEQ ID NO: 5199207 - DNA, 23 bp, Homo sapiens
agcctgctcccccaccccctccc

SEQ ID NO: 5199208 - DNA, 15 bp, Homo sapiens
agcctgctccttccc

SEQ ID NO: 5199209 - DNA, 20 bp, Homo sapiens
agcctgctccttcccaggag

SEQ ID NO: 5199210 - DNA, 11 bp, Homo sapiens
agcctgctctg

SEQ ID NO: 5199211 - DNA, 12 bp, Homo sapiens
agcctgctctgc

SEQ ID NO: 5199212 - DNA, 16 bp, Homo sapiens
agcctgctctgccact

SEQ ID NO: 5199213 - DNA, 14 bp, Homo sapiens
agcctgctctggag

SEQ ID NO: 5199214 - DNA, 13 bp, Homo sapiens
agcctgctgacag

SEQ ID NO: 5199215 - DNA, 15 bp, Homo sapiens
agcctgctgagagcc

SEQ ID NO: 5199216 - DNA, 17 bp, Homo sapiens
agcctgctgagagcccc

SEQ ID NO: 5199217 - DNA, 18 bp, Homo sapiens
agcctgctgagagccccc

SEQ ID NO: 5199218 - DNA, 13 bp, Homo sapiens
agcctgctgccca

SEQ ID NO: 5199219 - DNA, 14 bp, Homo sapiens
agcctgctggaagc

SEQ ID NO: 5199220 - DNA, 19 bp, Homo sapiens
agcctgctggaagcccagc

SEQ ID NO: 5199221 - DNA, 12 bp, Homo sapiens
agcctgctggat

SEQ ID NO: 5199222 - DNA, 11 bp, Homo sapiens
agcctgctggc

SEQ ID NO: 5199223 - DNA, 12 bp, Homo sapiens
agcctgctggca

SEQ ID NO: 5199224 - DNA, 17 bp, Homo sapiens
agcctgctggcacccac

SEQ ID NO: 5199225 - DNA, 14 bp, Homo sapiens
agcctgctggcagg

SEQ ID NO: 5199226 - DNA, 15 bp, Homo sapiens
agcctgctggcaggg

SEQ ID NO: 5199227 - DNA, 19 bp, Homo sapiens
agcctgctggcagggccag

SEQ ID NO: 5199228 - DNA, 20 bp, Homo sapiens
agcctgctggcagggccagg

SEQ ID NO: 5199229 - DNA, 22 bp, Homo sapiens
agcctgctggcagggccagggc

SEQ ID NO: 5199230 - DNA, 13 bp, Homo sapiens
agcctgctggctg

SEQ ID NO: 5199231 - DNA, 14 bp, Homo sapiens
agcctgctggctgc

SEQ ID NO: 5199232 - DNA, 18 bp, Homo sapiens
agcctgctggctgcggcc

SEQ ID NO: 5199233 - DNA, 21 bp, Homo sapiens
agcctgctggtcacagcctcc

SEQ ID NO: 5199234 - DNA, 23 bp, Homo sapiens
agcctgctggtcacagcctcctc

SEQ ID NO: 5199235 - DNA, 13 bp, Homo sapiens
agcctgctgtggg

SEQ ID NO: 5199236 - DNA, 22 bp, Homo sapiens
agcctgctgtgtccttcctcca

SEQ ID NO: 5199237 - DNA, 15 bp, Homo sapiens
agcctgcttcccacc

SEQ ID NO: 5199238 - DNA, 19 bp, Homo sapiens
agcctgcttcccacctccc

SEQ ID NO: 5199239 - DNA, 14 bp, Homo sapiens
agcctgcttctgcc

SEQ ID NO: 5199240 - DNA, 21 bp, Homo sapiens
agcctgcttcttcccctctgc

SEQ ID NO: 5199241 - DNA, 17 bp, Homo sapiens
agcctgctttcctgcag

SEQ ID NO: 5199242 - DNA, 17 bp, Homo sapiens
agcctgctttggccttt

SEQ ID NO: 5199243 - DNA, 18 bp, Homo sapiens
agcctgctttggcctttc

SEQ ID NO: 5199244 - DNA, 19 bp, Homo sapiens
agcctgctttggcctttcc

SEQ ID NO: 5199245 - DNA, 19 bp, Homo sapiens
agcctggaaacctgtctga

SEQ ID NO: 5199246 - DNA, 15 bp, Homo sapiens
agcctggacacagtc

SEQ ID NO: 5199247 - DNA, 14 bp, Homo sapiens
agcctggaccctgt

SEQ ID NO: 5199248 - DNA, 24 bp, Homo sapiens
agcctggacctctgacagcagcat

SEQ ID NO: 5199249 - DNA, 14 bp, Homo sapiens
agcctggacgcagc

SEQ ID NO: 5199250 - DNA, 15 bp, Homo sapiens
agcctggacgcagcc

SEQ ID NO: 5199251 - DNA, 16 bp, Homo sapiens
agcctggacgcagcca

SEQ ID NO: 5199252 - DNA, 21 bp, Homo sapiens
agcctggacgcagccacacag

SEQ ID NO: 5199253 - DNA, 12 bp, Homo sapiens
agcttttgatgt

SEQ ID NO: 5199254 - DNA, 17 bp, Homo sapiens
agcttttgccagtatta

SEQ ID NO: 5199255 - DNA, 22 bp, Homo sapiens
agcttttgccagtattatgcat

SEQ ID NO: 5199256 - DNA, 18 bp, Homo sapiens
agcttttggagagtgggt

SEQ ID NO: 5199257 - DNA, 18 bp, Homo sapiens
agcttttggtgagaaggt

SEQ ID NO: 5199258 - DNA, 23 bp, Homo sapiens
agcttttgtgtgcctggtagaaa

SEQ ID NO: 5199259 - DNA, 15 bp, Homo sapiens
agcttttgttctaga

SEQ ID NO: 5199260 - DNA, 17 bp, Homo sapiens
agcttttgttctagact

SEQ ID NO: 5199261 - DNA, 15 bp, Homo sapiens
agctttttaaaacat

SEQ ID NO: 5199262 - DNA, 15 bp, Homo sapiens
agctttttaaaattt

SEQ ID NO: 5199263 - DNA, 15 bp, Homo sapiens
agctttttaatagca

SEQ ID NO: 5199264 - DNA, 18 bp, Homo sapiens
agctttttaatagcacta

SEQ ID NO: 5199265 - DNA, 14 bp, Homo sapiens
agctttttaattgt

SEQ ID NO: 5199266 - DNA, 15 bp, Homo sapiens
agctttttaattgtt

SEQ ID NO: 5199267 - DNA, 17 bp, Homo sapiens
agctttttaattgttgt

SEQ ID NO: 5199268 - DNA, 13 bp, Homo sapiens
agctttttattaa

SEQ ID NO: 5199269 - DNA, 14 bp, Homo sapiens
agctttttattaag

SEQ ID NO: 5199270 - DNA, 14 bp, Homo sapiens
agctttttcaaaag

SEQ ID NO: 5199271 - DNA, 22 bp, Homo sapiens
agctttttcagaaacagggcag

SEQ ID NO: 5199272 - DNA, 12 bp, Homo sapiens
agctttttctca

SEQ ID NO: 5199273 - DNA, 16 bp, Homo sapiens
agctttttctctcagg

SEQ ID NO: 5199274 - DNA, 13 bp, Homo sapiens
agctttttctgtg

SEQ ID NO: 5199275 - DNA, 16 bp, Homo sapiens
agctttttctgtggag

SEQ ID NO: 5199276 - DNA, 18 bp, Homo sapiens
agctttttgttccctcat

SEQ ID NO: 5199277 - DNA, 14 bp, Homo sapiens
agcttttttacaca

SEQ ID NO: 5199278 - DNA, 18 bp, Homo sapiens
agcttttttcctcctttc

SEQ ID NO: 5199279 - DNA, 10 bp, Homo sapiens
aggaaaaaaa

SEQ ID NO: 5199280 - DNA, 15 bp, Homo sapiens
aggaaaaaaaataat

SEQ ID NO: 5199281 - DNA, 13 bp, Homo sapiens
aggaaaaaaactt

SEQ ID NO: 5199282 - DNA, 17 bp, Homo sapiens
aggaaaaaaacttttat

SEQ ID NO: 5199283 - DNA, 13 bp, Homo sapiens
aggaaaaaaagac

SEQ ID NO: 5199284 - DNA, 13 bp, Homo sapiens
aggaaaaaagaac

SEQ ID NO: 5199285 - DNA, 19 bp, Homo sapiens
aggaaaaaagaaccaaaac

SEQ ID NO: 5199286 - DNA, 13 bp, Homo sapiens
aggaaaaaataat

SEQ ID NO: 5199287 - DNA, 17 bp, Homo sapiens
aggaaaaaatggtataa

SEQ ID NO: 5199288 - DNA, 16 bp, Homo sapiens
aggaaaaaattgcttt

SEQ ID NO: 5199289 - DNA, 17 bp, Homo sapiens
aggaaaaacacaagcaa

SEQ ID NO: 5199290 - DNA, 14 bp, Homo sapiens
aggaaaaacagagg

SEQ ID NO: 5199291 - DNA, 18 bp, Homo sapiens
aggaaaaaccgagatagg

SEQ ID NO: 5199292 - DNA, 15 bp, Homo sapiens
aggaaaaactgattt

SEQ ID NO: 5199293 - DNA, 14 bp, Homo sapiens
aggaaaaagaaatg

SEQ ID NO: 5199294 - DNA, 15 bp, Homo sapiens
aggaaaaagcacaag

SEQ ID NO: 5199295 - DNA, 18 bp, Homo sapiens
aggaaaaagcacaagaag

SEQ ID NO: 5199296 - DNA, 13 bp, Homo sapiens
aggaaaaagctcc

SEQ ID NO: 5199297 - DNA, 16 bp, Homo sapiens
aggaaaaagctttact

SEQ ID NO: 5199298 - DNA, 20 bp, Homo sapiens
aggaaaaaggacaggcagaa

SEQ ID NO: 5199299 - DNA, 18 bp, Homo sapiens
aggaaaaaggctggtgga

SEQ ID NO: 5199300 - DNA, 12 bp, Homo sapiens
aggaaaaaggtc

SEQ ID NO: 5199301 - DNA, 16 bp, Homo sapiens
aggaaaaatatgtgaa

SEQ ID NO: 5199302 - DNA, 13 bp, Homo sapiens
aggaaaaatgtgt

SEQ ID NO: 5199303 - DNA, 17 bp, Homo sapiens
aggaaaacacagcctcc

SEQ ID NO: 5199304 - DNA, 18 bp, Homo sapiens
aggaaaacatgctgctct

SEQ ID NO: 5199305 - DNA, 19 bp, Homo sapiens
aggaaaaccaagccgtggc

SEQ ID NO: 5199306 - DNA, 23 bp, Homo sapiens
aggaaaaccaagccgtggcttcc

SEQ ID NO: 5199307 - DNA, 17 bp, Homo sapiens
aggaaaaccagggatag

SEQ ID NO: 5199308 - DNA, 19 bp, Homo sapiens
aggaaaactcttggcctct

SEQ ID NO: 5199309 - DNA, 23 bp, Homo sapiens
aggaaaactcttggcctctgctt

SEQ ID NO: 5199310 - DNA, 20 bp, Homo sapiens
aggaaaactgcatggagacg

SEQ ID NO: 5199311 - DNA, 12 bp, Homo sapiens
aggaaaactgtt

SEQ ID NO: 5199312 - DNA, 10 bp, Homo sapiens
aggaaaagaa

SEQ ID NO: 5199313 - DNA, 13 bp, Homo sapiens
aggaaaagaaaag

SEQ ID NO: 5199314 - DNA, 16 bp, Homo sapiens
aggaaaagaaatctat

SEQ ID NO: 5199315 - DNA, 23 bp, Homo sapiens
aggaaaagaacaaacaaaactta

SEQ ID NO: 5199316 - DNA, 15 bp, Homo sapiens
aggaaaagaggccca

SEQ ID NO: 5199317 - DNA, 20 bp, Homo sapiens
aggaaaagagtaatggtatt

SEQ ID NO: 5199318 - DNA, 18 bp, Homo sapiens
aggaaaagcacaaggact

SEQ ID NO: 5199319 - DNA, 11 bp, Homo sapiens
aggaaaagcat

SEQ ID NO: 5199320 - DNA, 18 bp, Homo sapiens
aggaaaagcatctgccac

SEQ ID NO: 5199321 - DNA, 15 bp, Homo sapiens
aggaaaagcctctgt

SEQ ID NO: 5199322 - DNA, 13 bp, Homo sapiens
aggaaaagctaag

SEQ ID NO: 5199323 - DNA, 12 bp, Homo sapiens
aggaaaaggaaa

SEQ ID NO: 5199324 - DNA, 13 bp, Homo sapiens
aggaaaaggagga

SEQ ID NO: 5199325 - DNA, 13 bp, Homo sapiens
aggaaaaggattt

SEQ ID NO: 5199326 - DNA, 13 bp, Homo sapiens
aggaaaaggcctg

SEQ ID NO: 5199327 - DNA, 17 bp, Homo sapiens
aggaaaaggcctggggt

SEQ ID NO: 5199328 - DNA, 18 bp, Homo sapiens
aggaaaaggcctggggtg

SEQ ID NO: 5199329 - DNA, 22 bp, Homo sapiens
aggaaaaggctgcagctaattt

SEQ ID NO: 5199330 - DNA, 20 bp, Homo sapiens
aggaaaagggcattttgtac

SEQ ID NO: 5199331 - DNA, 22 bp, Homo sapiens
aggaaaaggttgaataatatat

SEQ ID NO: 5199332 - DNA, 17 bp, Homo sapiens
aggaaaaggttgttgtt

SEQ ID NO: 5199333 - DNA, 16 bp, Homo sapiens
aggaaaagtgcaatgc

SEQ ID NO: 5199334 - DNA, 18 bp, Homo sapiens
aggaaaagtgcaatgcgt

SEQ ID NO: 5199335 - DNA, 22 bp, Homo sapiens
aggaaaagttaaactaaaaaaa

SEQ ID NO: 5199336 - DNA, 23 bp, Homo sapiens
aggaaaataacagagctggatgc

SEQ ID NO: 5199337 - DNA, 14 bp, Homo sapiens
aggaaaataagtga

SEQ ID NO: 5199338 - DNA, 19 bp, Homo sapiens
aggaaaataagtgaaattt

SEQ ID NO: 5199339 - DNA, 19 bp, Homo sapiens
aggaaaatagtttaggaga

SEQ ID NO: 5199340 - DNA, 23 bp, Homo sapiens
aggaaaatataatatttactgtt

SEQ ID NO: 5199341 - DNA, 11 bp, Homo sapiens
aggaaaatatt

SEQ ID NO: 5199342 - DNA, 15 bp, Homo sapiens
aggaaaatcaatgct

SEQ ID NO: 5199343 - DNA, 13 bp, Homo sapiens
aggaaaatgaatt

SEQ ID NO: 5199344 - DNA, 16 bp, Homo sapiens
aggaaaatgagtattt

SEQ ID NO: 5199345 - DNA, 20 bp, Homo sapiens
aggaaaatgccctgtcccta

SEQ ID NO: 5199346 - DNA, 15 bp, Homo sapiens
aggaaaatgtattga

SEQ ID NO: 5199347 - DNA, 13 bp, Homo sapiens
aggaaaattaatc

SEQ ID NO: 5199348 - DNA, 12 bp, Homo sapiens
aggaaaattcca

SEQ ID NO: 5199349 - DNA, 14 bp, Homo sapiens
aggaaaattccatt

SEQ ID NO: 5199350 - DNA, 16 bp, Homo sapiens
aggaaaattcttaaaa

SEQ ID NO: 5199351 - DNA, 12 bp, Homo sapiens
aggaaaattgga

SEQ ID NO: 5199352 - DNA, 13 bp, Homo sapiens
aggaaaatttcac

SEQ ID NO: 5199353 - DNA, 22 bp, Homo sapiens
aggaaaattttcttctttaatt

SEQ ID NO: 5199354 - DNA, 13 bp, Homo sapiens
aggaaacaaagat

SEQ ID NO: 5199355 - DNA, 21 bp, Homo sapiens
aggaaacaaagcttagcagga

SEQ ID NO: 5199356 - DNA, 16 bp, Homo sapiens
aggaaacaaatgtgta

SEQ ID NO: 5199357 - DNA, 19 bp, Homo sapiens
aggaaacaaccatgtcatt

SEQ ID NO: 5199358 - DNA, 14 bp, Homo sapiens
aggaaacaagcttt

SEQ ID NO: 5199359 - DNA, 10 bp, Homo sapiens
aggaaacacc

SEQ ID NO: 5199360 - DNA, 17 bp, Homo sapiens
aggaaacacttctattt

SEQ ID NO: 5199361 - DNA, 14 bp, Homo sapiens
aggaaacagaaaag

SEQ ID NO: 5199362 - DNA, 18 bp, Homo sapiens
aggaaacaggctccaaga

SEQ ID NO: 5199363 - DNA, 22 bp, Homo sapiens
aggaaacagttgcatgtagtaa

SEQ ID NO: 5199364 - DNA, 16 bp, Homo sapiens
aggaaacatagaaaga

SEQ ID NO: 5199365 - DNA, 22 bp, Homo sapiens
aggaaacatagaaagacatggg

SEQ ID NO: 5199366 - DNA, 20 bp, Homo sapiens
aggaaacatgaagcataatt

SEQ ID NO: 5199367 - DNA, 13 bp, Homo sapiens
aggaaaccaacac

SEQ ID NO: 5199368 - DNA, 22 bp, Homo sapiens
aggaaaccacaaccttgcagta

SEQ ID NO: 5199369 - DNA, 17 bp, Homo sapiens
aggaaaccacagctgct

SEQ ID NO: 5199370 - DNA, 20 bp, Homo sapiens
aggaaaccacagctgctgga

SEQ ID NO: 5199371 - DNA, 20 bp, Homo sapiens
aggaaaccgcctagtttact

SEQ ID NO: 5199372 - DNA, 15 bp, Homo sapiens
aggaaacgtggcagg

SEQ ID NO: 5199373 - DNA, 16 bp, Homo sapiens
aggaaactaagcattg

SEQ ID NO: 5199374 - DNA, 21 bp, Homo sapiens
aggaaactactgcctttagaa

SEQ ID NO: 5199375 - DNA, 16 bp, Homo sapiens
aggaaactcacctgct

SEQ ID NO: 5199376 - DNA, 16 bp, Homo sapiens
aggaaactcatctcct

SEQ ID NO: 5199377 - DNA, 16 bp, Homo sapiens
aggaaactccacatct

SEQ ID NO: 5199378 - DNA, 19 bp, Homo sapiens
aggaaactccacatctgcc

SEQ ID NO: 5199379 - DNA, 21 bp, Homo sapiens
aggaaactccacatctgcctt

SEQ ID NO: 5199380 - DNA, 22 bp, Homo sapiens
aggaaactccacatctgcctta

SEQ ID NO: 5199381 - DNA, 22 bp, Homo sapiens
aggaaactcctgtgaccacaac

SEQ ID NO: 5199382 - DNA, 17 bp, Homo sapiens
aggaaactcttatctca

SEQ ID NO: 5199383 - DNA, 22 bp, Homo sapiens
aggaaactcttatctcagtcat

SEQ ID NO: 5199384 - DNA, 19 bp, Homo sapiens
aggaaactgaggcccagag

SEQ ID NO: 5199385 - DNA, 20 bp, Homo sapiens
aggaaactgaggcccagaga

SEQ ID NO: 5199386 - DNA, 20 bp, Homo sapiens
aggaaactgagtcactcaca

SEQ ID NO: 5199387 - DNA, 22 bp, Homo sapiens
aggaaactgagtcactcacatt

SEQ ID NO: 5199388 - DNA, 12 bp, Homo sapiens
aggaaactgctt

SEQ ID NO: 5199389 - DNA, 14 bp, Homo sapiens
aggaaactgcttta

SEQ ID NO: 5199390 - DNA, 13 bp, Homo sapiens
aggaaactggcga

SEQ ID NO: 5199391 - DNA, 22 bp, Homo sapiens
aggaaactggcgatctcccagg

SEQ ID NO: 5199392 - DNA, 21 bp, Homo sapiens
aggaaacttcagttgatcttc

SEQ ID NO: 5199393 - DNA, 22 bp, Homo sapiens
aggaaacttggacatttatgta

SEQ ID NO: 5199394 - DNA, 13 bp, Homo sapiens
aggaaactttcct

SEQ ID NO: 5199395 - DNA, 17 bp, Homo sapiens
aggaaactttcctttaa

SEQ ID NO: 5199396 - DNA, 18 bp, Homo sapiens
aggaaactttcctttaac

SEQ ID NO: 5199397 - DNA, 20 bp, Homo sapiens
aggaaactttcctttaactc

SEQ ID NO: 5199398 - DNA, 16 bp, Homo sapiens
aggaaactttttaatt

SEQ ID NO: 5199399 - DNA, 12 bp, Homo sapiens
aggaaagaaata

SEQ ID NO: 5199400 - DNA, 19 bp, Homo sapiens
aggaaagaaggagatgaat

SEQ ID NO: 5199401 - DNA, 16 bp, Homo sapiens
aggaaagaagggggcc

SEQ ID NO: 5199402 - DNA, 20 bp, Homo sapiens
aggaaagaagggggccctgc

SEQ ID NO: 5199403 - DNA, 22 bp, Homo sapiens
aggaaagaagggggccctgcta

SEQ ID NO: 5199404 - DNA, 12 bp, Homo sapiens
aggaaagaatag

SEQ ID NO: 5199405 - DNA, 14 bp, Homo sapiens
aggaaagagaagct

SEQ ID NO: 5199406 - DNA, 17 bp, Homo sapiens
aggaaagagagacccca

SEQ ID NO: 5199407 - DNA, 14 bp, Homo sapiens
aggaaagagctagg

SEQ ID NO: 5199408 - DNA, 21 bp, Homo sapiens
aggaaagaggaggcagaaaga

SEQ ID NO: 5199409 - DNA, 16 bp, Homo sapiens
aggaaagaggctctgg

SEQ ID NO: 5199410 - DNA, 17 bp, Homo sapiens
aggaaagagtcttcaac

SEQ ID NO: 5199411 - DNA, 17 bp, Homo sapiens
aggaaagagtggtttct

SEQ ID NO: 5199412 - DNA, 19 bp, Homo sapiens
aggaaagatgatgctcagt

SEQ ID NO: 5199413 - DNA, 24 bp, Homo sapiens
aggaaagatgtcccacagggacca

SEQ ID NO: 5199414 - DNA, 16 bp, Homo sapiens
aggaaagattcatgtc

SEQ ID NO: 5199415 - DNA, 13 bp, Homo sapiens
aggaaagcaagaa

SEQ ID NO: 5199416 - DNA, 16 bp, Homo sapiens
aggaaagcaaggcaga

SEQ ID NO: 5199417 - DNA, 16 bp, Homo sapiens
aggaaagcaataaatg

SEQ ID NO: 5199418 - DNA, 18 bp, Homo sapiens
aggaaagcaataaatgaa

SEQ ID NO: 5199419 - DNA, 22 bp, Homo sapiens
aggaaagcaataaatgaatggg

SEQ ID NO: 5199420 - DNA, 11 bp, Homo sapiens
aggaaagcacc

SEQ ID NO: 5199421 - DNA, 15 bp, Homo sapiens
aggaaagcatgcatt

SEQ ID NO: 5199422 - DNA, 23 bp, Homo sapiens
aggaaagcatgtctctgcttcca

SEQ ID NO: 5199423 - DNA, 20 bp, Homo sapiens
aggaaagccacacggagagg

SEQ ID NO: 5199424 - DNA, 21 bp, Homo sapiens
aggaaagccacacggagaggc

SEQ ID NO: 5199425 - DNA, 15 bp, Homo sapiens
aggaaagccacatct

SEQ ID NO: 5199426 - DNA, 19 bp, Homo sapiens
aggaaagccacatcttgct

SEQ ID NO: 5199427 - DNA, 17 bp, Homo sapiens
aggaaagccctccccct

SEQ ID NO: 5199428 - DNA, 15 bp, Homo sapiens
aggaaaggaggacca

SEQ ID NO: 5199429 - DNA, 12 bp, Homo sapiens
aggaaaggattt

SEQ ID NO: 5199430 - DNA, 19 bp, Homo sapiens
aggaaaggattttaccaaa

SEQ ID NO: 5199431 - DNA, 21 bp, Homo sapiens
aggaaaggattttaccaaagc

SEQ ID NO: 5199432 - DNA, 22 bp, Homo sapiens
aggaaaggattttaccaaagca

SEQ ID NO: 5199433 - DNA, 14 bp, Homo sapiens
aggaaaggccagct

SEQ ID NO: 5199434 - DNA, 16 bp, Homo sapiens
agcctggactgtttca

SEQ ID NO: 5199435 - DNA, 13 bp, Homo sapiens
agcctggactttg

SEQ ID NO: 5199436 - DNA, 21 bp, Homo sapiens
agcctggactttggttctctc

SEQ ID NO: 5199437 - DNA, 13 bp, Homo sapiens
agcctggagaagc

SEQ ID NO: 5199438 - DNA, 14 bp, Homo sapiens
agcctggagaagct

SEQ ID NO: 5199439 - DNA, 14 bp, Homo sapiens
agcctggagaggcc

SEQ ID NO: 5199440 - DNA, 16 bp, Homo sapiens
agcctggagaggcctg

SEQ ID NO: 5199441 - DNA, 20 bp, Homo sapiens
agcctggagaggcctggggt

SEQ ID NO: 5199442 - DNA, 21 bp, Homo sapiens
agcctggagaggcctggggtg

SEQ ID NO: 5199443 - DNA, 16 bp, Homo sapiens
agcctggagcccctgt

SEQ ID NO: 5199444 - DNA, 17 bp, Homo sapiens
agcctggagcccctgtg

SEQ ID NO: 5199445 - DNA, 18 bp, Homo sapiens
agcctggagccctggaga

SEQ ID NO: 5199446 - DNA, 14 bp, Homo sapiens
agcctggagccgtg

SEQ ID NO: 5199447 - DNA, 12 bp, Homo sapiens
agcctggaggac

SEQ ID NO: 5199448 - DNA, 11 bp, Homo sapiens
agcctggaggc

SEQ ID NO: 5199449 - DNA, 23 bp, Homo sapiens
agcctggatcctcagttctcaaa

SEQ ID NO: 5199450 - DNA, 20 bp, Homo sapiens
agcctggatgccaaggagcc

SEQ ID NO: 5199451 - DNA, 23 bp, Homo sapiens
agcctggatgccaaggagcccct

SEQ ID NO: 5199452 - DNA, 16 bp, Homo sapiens
agcctggatgccatcc

SEQ ID NO: 5199453 - DNA, 17 bp, Homo sapiens
agcctggatggcccctc

SEQ ID NO: 5199454 - DNA, 23 bp, Homo sapiens
agcctggatggcccctccttgca

SEQ ID NO: 5199455 - DNA, 18 bp, Homo sapiens
agcctggattccagcagt

SEQ ID NO: 5199456 - DNA, 13 bp, Homo sapiens
agcctggcaaggc

SEQ ID NO: 5199457 - DNA, 23 bp, Homo sapiens
agcctggcaatttagcaaactga

SEQ ID NO: 5199458 - DNA, 20 bp, Homo sapiens
agcctggcacagggcagtgg

SEQ ID NO: 5199459 - DNA, 13 bp, Homo sapiens
agcctggcaccca

SEQ ID NO: 5199460 - DNA, 12 bp, Homo sapiens
agcctggcaggg

SEQ ID NO: 5199461 - DNA, 13 bp, Homo sapiens
agcctggcagggg

SEQ ID NO: 5199462 - DNA, 14 bp, Homo sapiens
agcctggcagggga

SEQ ID NO: 5199463 - DNA, 17 bp, Homo sapiens
agcctggcatctgtgcg

SEQ ID NO: 5199464 - DNA, 20 bp, Homo sapiens
agcctggccaacatggcgaa

SEQ ID NO: 5199465 - DNA, 18 bp, Homo sapiens
agcctggccaacatggtg

SEQ ID NO: 5199466 - DNA, 16 bp, Homo sapiens
agcctggccaccagcc

SEQ ID NO: 5199467 - DNA, 23 bp, Homo sapiens
agcctggccaccagccatcctcc

SEQ ID NO: 5199468 - DNA, 16 bp, Homo sapiens
agcctggccacgcagc

SEQ ID NO: 5199469 - DNA, 18 bp, Homo sapiens
agcctggccagacacagg

SEQ ID NO: 5199470 - DNA, 14 bp, Homo sapiens
agcctggccagcat

SEQ ID NO: 5199471 - DNA, 15 bp, Homo sapiens
agcctggccaggcag

SEQ ID NO: 5199472 - DNA, 21 bp, Homo sapiens
agcctggccaggcagggagag

SEQ ID NO: 5199473 - DNA, 11 bp, Homo sapiens
agcctggccca

SEQ ID NO: 5199474 - DNA, 13 bp, Homo sapiens
agcctggcccagc

SEQ ID NO: 5199475 - DNA, 15 bp, Homo sapiens
agcctggcccagctc

SEQ ID NO: 5199476 - DNA, 14 bp, Homo sapiens
agcctggccccagg

SEQ ID NO: 5199477 - DNA, 22 bp, Homo sapiens
agcctggccccaggccccagac

SEQ ID NO: 5199478 - DNA, 17 bp, Homo sapiens
agcctggccccatggtc

SEQ ID NO: 5199479 - DNA, 20 bp, Homo sapiens
agcctggcccccgacccagc

SEQ ID NO: 5199480 - DNA, 11 bp, Homo sapiens
agcctggcctc

SEQ ID NO: 5199481 - DNA, 12 bp, Homo sapiens
agcctggcctcc

SEQ ID NO: 5199482 - DNA, 18 bp, Homo sapiens
agcctggcctcccctgcg

SEQ ID NO: 5199483 - DNA, 21 bp, Homo sapiens
agcctggcctcccctgcggag

SEQ ID NO: 5199484 - DNA, 14 bp, Homo sapiens
agcctggcctcctg

SEQ ID NO: 5199485 - DNA, 18 bp, Homo sapiens
agcctggcctcctgcctc

SEQ ID NO: 5199486 - DNA, 19 bp, Homo sapiens
agcctggcctgcccgtgcc

SEQ ID NO: 5199487 - DNA, 17 bp, Homo sapiens
agcctggcggggcagga

SEQ ID NO: 5199488 - DNA, 18 bp, Homo sapiens
agcctggcggggcaggag

SEQ ID NO: 5199489 - DNA, 13 bp, Homo sapiens
agcctggctccaa

SEQ ID NO: 5199490 - DNA, 22 bp, Homo sapiens
agcctggctccaaaccctcgag

SEQ ID NO: 5199491 - DNA, 22 bp, Homo sapiens
agcctggctcccacaggcagct

SEQ ID NO: 5199492 - DNA, 23 bp, Homo sapiens
agcctggctcccacaggcagctt

SEQ ID NO: 5199493 - DNA, 15 bp, Homo sapiens
agcctggctcccctg

SEQ ID NO: 5199494 - DNA, 17 bp, Homo sapiens
agcctggctcccctggg

SEQ ID NO: 5199495 - DNA, 23 bp, Homo sapiens
agcctggctctgccccctccccc

SEQ ID NO: 5199496 - DNA, 19 bp, Homo sapiens
agcctggctctgccccgca

SEQ ID NO: 5199497 - DNA, 10 bp, Homo sapiens
agcctggctg

SEQ ID NO: 5199498 - DNA, 13 bp, Homo sapiens
agcctggctgggc

SEQ ID NO: 5199499 - DNA, 17 bp, Homo sapiens
agcctggctgggctctg

SEQ ID NO: 5199500 - DNA, 19 bp, Homo sapiens
agcctggctgggctctggt

SEQ ID NO: 5199501 - DNA, 22 bp, Homo sapiens
agcctggctgggctctggtggg

SEQ ID NO: 5199502 - DNA, 16 bp, Homo sapiens
agcctggctggtcctc

SEQ ID NO: 5199503 - DNA, 20 bp, Homo sapiens
agcctggctggtcctcccat

SEQ ID NO: 5199504 - DNA, 14 bp, Homo sapiens
agcctggcttagaa

SEQ ID NO: 5199505 - DNA, 14 bp, Homo sapiens
agcctggcttctgg

SEQ ID NO: 5199506 - DNA, 15 bp, Homo sapiens
agcctggcttctgga

SEQ ID NO: 5199507 - DNA, 18 bp, Homo sapiens
agcctggcttctggagcc

SEQ ID NO: 5199508 - DNA, 23 bp, Homo sapiens
agcctggcttctggagcccttgg

SEQ ID NO: 5199509 - DNA, 15 bp, Homo sapiens
agcctgggaaataag

SEQ ID NO: 5199510 - DNA, 21 bp, Homo sapiens
agcctgggaaataagccccct

SEQ ID NO: 5199511 - DNA, 16 bp, Homo sapiens
agcctgggacacacac

SEQ ID NO: 5199512 - DNA, 17 bp, Homo sapiens
agcctgggactcccagt

SEQ ID NO: 5199513 - DNA, 16 bp, Homo sapiens
agcctgggagcccaga

SEQ ID NO: 5199514 - DNA, 16 bp, Homo sapiens
agcctgggaggcacag

SEQ ID NO: 5199515 - DNA, 22 bp, Homo sapiens
agcctgggaggcacagcaaact

SEQ ID NO: 5199516 - DNA, 19 bp, Homo sapiens
agcctgggatttctatgca

SEQ ID NO: 5199517 - DNA, 17 bp, Homo sapiens
agcctgggcaacagagc

SEQ ID NO: 5199518 - DNA, 20 bp, Homo sapiens
agcctgggcagaaatgtgct

SEQ ID NO: 5199519 - DNA, 14 bp, Homo sapiens
agcctgggcagcac

SEQ ID NO: 5199520 - DNA, 20 bp, Homo sapiens
agcctgggcagcatagcaag

SEQ ID NO: 5199521 - DNA, 15 bp, Homo sapiens
agcctgggcagccag

SEQ ID NO: 5199522 - DNA, 18 bp, Homo sapiens
agcctgggcagccaggct

SEQ ID NO: 5199523 - DNA, 20 bp, Homo sapiens
agcctgggcagccaggctgc

SEQ ID NO: 5199524 - DNA, 13 bp, Homo sapiens
agcctgggccact

SEQ ID NO: 5199525 - DNA, 15 bp, Homo sapiens
agcctgggccactgg

SEQ ID NO: 5199526 - DNA, 16 bp, Homo sapiens
agcctgggccactggc

SEQ ID NO: 5199527 - DNA, 22 bp, Homo sapiens
agcctgggccactggcatctct

SEQ ID NO: 5199528 - DNA, 16 bp, Homo sapiens
agcctgggccagagaa

SEQ ID NO: 5199529 - DNA, 22 bp, Homo sapiens
agcctgggccaggagcccacag

SEQ ID NO: 5199530 - DNA, 17 bp, Homo sapiens
agcctgggccatctctt

SEQ ID NO: 5199531 - DNA, 18 bp, Homo sapiens
agcctgggcccatctccc

SEQ ID NO: 5199532 - DNA, 19 bp, Homo sapiens
agcctgggcccctcagcca

SEQ ID NO: 5199533 - DNA, 17 bp, Homo sapiens
agcctgggcgacaaaaa

SEQ ID NO: 5199534 - DNA, 15 bp, Homo sapiens
agcctgggcgacaga

SEQ ID NO: 5199535 - DNA, 18 bp, Homo sapiens
agcctgggcgctggtcct

SEQ ID NO: 5199536 - DNA, 21 bp, Homo sapiens
agcctgggctcatagtgagaa

SEQ ID NO: 5199537 - DNA, 17 bp, Homo sapiens
agcctgggctccctctt

SEQ ID NO: 5199538 - DNA, 19 bp, Homo sapiens
agcctgggctccctcttgt

SEQ ID NO: 5199539 - DNA, 14 bp, Homo sapiens
agcctggggacccc

SEQ ID NO: 5199540 - DNA, 23 bp, Homo sapiens
agcctggggaccccacttcagaa

SEQ ID NO: 5199541 - DNA, 22 bp, Homo sapiens
agcctggggagggggtcattgt

SEQ ID NO: 5199542 - DNA, 16 bp, Homo sapiens
agcctggggcatccca

SEQ ID NO: 5199543 - DNA, 17 bp, Homo sapiens
agcctggggcggtgtgt

SEQ ID NO: 5199544 - DNA, 19 bp, Homo sapiens
agcctggggcggtgtgtgt

SEQ ID NO: 5199545 - DNA, 14 bp, Homo sapiens
agcctggggctccc

SEQ ID NO: 5199546 - DNA, 16 bp, Homo sapiens
agcctggggctccctc

SEQ ID NO: 5199547 - DNA, 17 bp, Homo sapiens
agcctggggctccctct

SEQ ID NO: 5199548 - DNA, 21 bp, Homo sapiens
agcctggggctctaacgcctg

SEQ ID NO: 5199549 - DNA, 14 bp, Homo sapiens
agcctggggctctc

SEQ ID NO: 5199550 - DNA, 17 bp, Homo sapiens
agcctggggctctctga

SEQ ID NO: 5199551 - DNA, 21 bp, Homo sapiens
agcctggggctctctgacccg

SEQ ID NO: 5199552 - DNA, 14 bp, Homo sapiens
agcctggggctggc

SEQ ID NO: 5199553 - DNA, 15 bp, Homo sapiens
agcctggggcttgaa

SEQ ID NO: 5199554 - DNA, 17 bp, Homo sapiens
agcctggggcttgaatt

SEQ ID NO: 5199555 - DNA, 23 bp, Homo sapiens
agcctggggcttgaatttgcatg

SEQ ID NO: 5199556 - DNA, 14 bp, Homo sapiens
agcctgggggccag

SEQ ID NO: 5199557 - DNA, 16 bp, Homo sapiens
agcctgggggccagtg

SEQ ID NO: 5199558 - DNA, 18 bp, Homo sapiens
agcctgggggccagtggg

SEQ ID NO: 5199559 - DNA, 14 bp, Homo sapiens
agcctgggggcctg

SEQ ID NO: 5199560 - DNA, 18 bp, Homo sapiens
agcctgggggcctggctg

SEQ ID NO: 5199561 - DNA, 21 bp, Homo sapiens
agcctgggggcctggctggct

SEQ ID NO: 5199562 - DNA, 22 bp, Homo sapiens
agcctgggggcctggctggctg

SEQ ID NO: 5199563 - DNA, 16 bp, Homo sapiens
agcctggggtgacctc

SEQ ID NO: 5199564 - DNA, 18 bp, Homo sapiens
agcctggggtgatagaac

SEQ ID NO: 5199565 - DNA, 20 bp, Homo sapiens
agcctggggtggggtcatgc

SEQ ID NO: 5199566 - DNA, 18 bp, Homo sapiens
agcctggggttgtccccg

SEQ ID NO: 5199567 - DNA, 23 bp, Homo sapiens
agcctggggtttgaccacccacc

SEQ ID NO: 5199568 - DNA, 14 bp, Homo sapiens
agcctgggtcacag

SEQ ID NO: 5199569 - DNA, 15 bp, Homo sapiens
agcctgggtctggat

SEQ ID NO: 5199570 - DNA, 16 bp, Homo sapiens
agcctgggtctggatg

SEQ ID NO: 5199571 - DNA, 11 bp, Homo sapiens
agcctgggtga

SEQ ID NO: 5199572 - DNA, 15 bp, Homo sapiens
agcctgggtgacaga

SEQ ID NO: 5199573 - DNA, 22 bp, Homo sapiens
agcctgggtgagaatcctgcct

SEQ ID NO: 5199574 - DNA, 12 bp, Homo sapiens
agcctgggtgta

SEQ ID NO: 5199575 - DNA, 21 bp, Homo sapiens
agcctgggtgtaaaacctgga

SEQ ID NO: 5199576 - DNA, 22 bp, Homo sapiens
agcctggtagaattgggaagct

SEQ ID NO: 5199577 - DNA, 22 bp, Homo sapiens
agcctggtagagactagggaag

SEQ ID NO: 5199578 - DNA, 20 bp, Homo sapiens
agcctggtaggaaagggcaa

SEQ ID NO: 5199579 - DNA, 15 bp, Homo sapiens
agcctggtcagccca

SEQ ID NO: 5199580 - DNA, 16 bp, Homo sapiens
agcctggtcagcccaa

SEQ ID NO: 5199581 - DNA, 22 bp, Homo sapiens
agcctggtcccacgagggtgcc

SEQ ID NO: 5199582 - DNA, 16 bp, Homo sapiens
agcctggtctcaaact

SEQ ID NO: 5199583 - DNA, 14 bp, Homo sapiens
agcctggtctgtgc

SEQ ID NO: 5199584 - DNA, 15 bp, Homo sapiens
agcctggtctgtgca

SEQ ID NO: 5199585 - DNA, 16 bp, Homo sapiens
agcctggtgacaggca

SEQ ID NO: 5199586 - DNA, 17 bp, Homo sapiens
agcctggtgcccatcct

SEQ ID NO: 5199587 - DNA, 18 bp, Homo sapiens
agcctggtgggcctcctc

SEQ ID NO: 5199588 - DNA, 14 bp, Homo sapiens
agcctggttcagaa

SEQ ID NO: 5199589 - DNA, 18 bp, Homo sapiens
agcctggttcagaataaa

SEQ ID NO: 5199590 - DNA, 21 bp, Homo sapiens
agcctggtttagcctggatgt

SEQ ID NO: 5199591 - DNA, 22 bp, Homo sapiens
agcctggtttgcaaagaccacc

SEQ ID NO: 5199592 - DNA, 19 bp, Homo sapiens
agcctgtaacactcctctg

SEQ ID NO: 5199593 - DNA, 16 bp, Homo sapiens
agcctgtaagcctgca

SEQ ID NO: 5199594 - DNA, 22 bp, Homo sapiens
agcctgtagggaactttctgga

SEQ ID NO: 5199595 - DNA, 16 bp, Homo sapiens
agcctgtatcttgggg

SEQ ID NO: 5199596 - DNA, 15 bp, Homo sapiens
agcctgtatgtggtg

SEQ ID NO: 5199597 - DNA, 11 bp, Homo sapiens
agcctgtcacc

SEQ ID NO: 5199598 - DNA, 17 bp, Homo sapiens
agcctgtcaccagagct

SEQ ID NO: 5199599 - DNA, 21 bp, Homo sapiens
agcctgtcaccagagcttctc

SEQ ID NO: 5199600 - DNA, 24 bp, Homo sapiens
agcctgtcaccagagcttctctgg

SEQ ID NO: 5199601 - DNA, 15 bp, Homo sapiens
agcctgtcacccagc

SEQ ID NO: 5199602 - DNA, 17 bp, Homo sapiens
agcctgtcacgtggtca

SEQ ID NO: 5199603 - DNA, 20 bp, Homo sapiens
agcctgtcagatccaggagc

SEQ ID NO: 5199604 - DNA, 21 bp, Homo sapiens
agcctgtcagatccaggagct

SEQ ID NO: 5199605 - DNA, 22 bp, Homo sapiens
agcctgtcagccaacattgcct

SEQ ID NO: 5199606 - DNA, 21 bp, Homo sapiens
agcctgtcatccttggtcttt

SEQ ID NO: 5199607 - DNA, 14 bp, Homo sapiens
agcctgtcccagga

SEQ ID NO: 5199608 - DNA, 19 bp, Homo sapiens
agcctgtcccatggacact

SEQ ID NO: 5199609 - DNA, 12 bp, Homo sapiens
agcctgtcccca

SEQ ID NO: 5199610 - DNA, 13 bp, Homo sapiens
agcctgtccccag

SEQ ID NO: 5199611 - DNA, 18 bp, Homo sapiens
agcctgtccccagaccaa

SEQ ID NO: 5199612 - DNA, 15 bp, Homo sapiens
agcctgtccccgcct

SEQ ID NO: 5199613 - DNA, 22 bp, Homo sapiens
aggaaaggccagctggcagcag

SEQ ID NO: 5199614 - DNA, 16 bp, Homo sapiens
aggaaaggctcattta

SEQ ID NO: 5199615 - DNA, 13 bp, Homo sapiens
aggaaaggctcca

SEQ ID NO: 5199616 - DNA, 14 bp, Homo sapiens
aggaaaggctccag

SEQ ID NO: 5199617 - DNA, 18 bp, Homo sapiens
aggaaagggaagcctgac

SEQ ID NO: 5199618 - DNA, 14 bp, Homo sapiens
aggaaagggaggag

SEQ ID NO: 5199619 - DNA, 16 bp, Homo sapiens
aggaaagggcctggcc

SEQ ID NO: 5199620 - DNA, 19 bp, Homo sapiens
aggaaaggggcgagcaccc

SEQ ID NO: 5199621 - DNA, 19 bp, Homo sapiens
aggaaagggggtcccagtg

SEQ ID NO: 5199622 - DNA, 13 bp, Homo sapiens
aggaaaggtgact

SEQ ID NO: 5199623 - DNA, 21 bp, Homo sapiens
aggaaaggtttggaaaactaa

SEQ ID NO: 5199624 - DNA, 22 bp, Homo sapiens
aggaaaggtttggaaaactaac

SEQ ID NO: 5199625 - DNA, 14 bp, Homo sapiens
aggaaagtacattt

SEQ ID NO: 5199626 - DNA, 17 bp, Homo sapiens
aggaaagtacatttttt

SEQ ID NO: 5199627 - DNA, 15 bp, Homo sapiens
aggaaagtactgcat

SEQ ID NO: 5199628 - DNA, 17 bp, Homo sapiens
aggaaagtactgcatga

SEQ ID NO: 5199629 - DNA, 15 bp, Homo sapiens
aggaaagtatctcta

SEQ ID NO: 5199630 - DNA, 21 bp, Homo sapiens
aggaaagtcacccaaacactt

SEQ ID NO: 5199631 - DNA, 13 bp, Homo sapiens
aggaaagtcattg

SEQ ID NO: 5199632 - DNA, 17 bp, Homo sapiens
aggaaagtcattggctt

SEQ ID NO: 5199633 - DNA, 20 bp, Homo sapiens
aggaaagtcattggctttat

SEQ ID NO: 5199634 - DNA, 23 bp, Homo sapiens
aggaaagtcattggctttatcct

SEQ ID NO: 5199635 - DNA, 21 bp, Homo sapiens
aggaaagtgcgttctcccagc

SEQ ID NO: 5199636 - DNA, 13 bp, Homo sapiens
aggaaagtgtgaa

SEQ ID NO: 5199637 - DNA, 17 bp, Homo sapiens
aggaaataaaaaagtct

SEQ ID NO: 5199638 - DNA, 18 bp, Homo sapiens
aggaaataaaaaagtctc

SEQ ID NO: 5199639 - DNA, 21 bp, Homo sapiens
aggaaataaaaaagtctctat

SEQ ID NO: 5199640 - DNA, 17 bp, Homo sapiens
aggaaataaaacctttc

SEQ ID NO: 5199641 - DNA, 19 bp, Homo sapiens
aggaaataaaacctttcaa

SEQ ID NO: 5199642 - DNA, 16 bp, Homo sapiens
aggaaataaaattaat

SEQ ID NO: 5199643 - DNA, 14 bp, Homo sapiens
aggaaataaatcta

SEQ ID NO: 5199644 - DNA, 15 bp, Homo sapiens
aggaaataacattgc

SEQ ID NO: 5199645 - DNA, 16 bp, Homo sapiens
aggaaataagaaaaat

SEQ ID NO: 5199646 - DNA, 20 bp, Homo sapiens
aggaaataagaaaaatcatg

SEQ ID NO: 5199647 - DNA, 17 bp, Homo sapiens
aggaaataatgggaaag

SEQ ID NO: 5199648 - DNA, 14 bp, Homo sapiens
aggaaatacagaga

SEQ ID NO: 5199649 - DNA, 15 bp, Homo sapiens
aggaaatactcagca

SEQ ID NO: 5199650 - DNA, 19 bp, Homo sapiens
aggaaatactttgcataaa

SEQ ID NO: 5199651 - DNA, 15 bp, Homo sapiens
aggaaatagaattga

SEQ ID NO: 5199652 - DNA, 21 bp, Homo sapiens
aggaaatagtaccttcaatac

SEQ ID NO: 5199653 - DNA, 12 bp, Homo sapiens
aggaaatattaa

SEQ ID NO: 5199654 - DNA, 20 bp, Homo sapiens
aggaaatattaagagctatt

SEQ ID NO: 5199655 - DNA, 16 bp, Homo sapiens
aggaaatattgctggg

SEQ ID NO: 5199656 - DNA, 12 bp, Homo sapiens
aggaaatattta

SEQ ID NO: 5199657 - DNA, 13 bp, Homo sapiens
aggaaatatttat

SEQ ID NO: 5199658 - DNA, 14 bp, Homo sapiens
aggaaatatttatt

SEQ ID NO: 5199659 - DNA, 18 bp, Homo sapiens
aggaaatatttattttaa

SEQ ID NO: 5199660 - DNA, 17 bp, Homo sapiens
aggaaatatttttcaac

SEQ ID NO: 5199661 - DNA, 20 bp, Homo sapiens
aggaaatcaaatatgcaaag

SEQ ID NO: 5199662 - DNA, 22 bp, Homo sapiens
aggaaatcaaatatgcaaagca

SEQ ID NO: 5199663 - DNA, 14 bp, Homo sapiens
aggaaatccagccc

SEQ ID NO: 5199664 - DNA, 15 bp, Homo sapiens
aggaaatccagcccc

SEQ ID NO: 5199665 - DNA, 18 bp, Homo sapiens
aggaaatccattgtttaa

SEQ ID NO: 5199666 - DNA, 16 bp, Homo sapiens
aggaaatcccttcata

SEQ ID NO: 5199667 - DNA, 22 bp, Homo sapiens
aggaaatcccttcatacttgaa

SEQ ID NO: 5199668 - DNA, 17 bp, Homo sapiens
aggaaatctgaatgtat

SEQ ID NO: 5199669 - DNA, 13 bp, Homo sapiens
aggaaatgaatgt

SEQ ID NO: 5199670 - DNA, 15 bp, Homo sapiens
aggaaatgaatgtgt

SEQ ID NO: 5199671 - DNA, 18 bp, Homo sapiens
aggaaatgagtggccagc

SEQ ID NO: 5199672 - DNA, 17 bp, Homo sapiens
aggaaatgatggaattt

SEQ ID NO: 5199673 - DNA, 22 bp, Homo sapiens
aggaaatgatggaatttttctg

SEQ ID NO: 5199674 - DNA, 16 bp, Homo sapiens
aggaaatgcaagctct

SEQ ID NO: 5199675 - DNA, 21 bp, Homo sapiens
aggaaatgctgacccatgggc

SEQ ID NO: 5199676 - DNA, 18 bp, Homo sapiens
aggaaatggagaagctct

SEQ ID NO: 5199677 - DNA, 11 bp, Homo sapiens
aggaaatgtat

SEQ ID NO: 5199678 - DNA, 23 bp, Homo sapiens
aggaaatgtttttaataaaagaa

SEQ ID NO: 5199679 - DNA, 12 bp, Homo sapiens
aggaaattaaat

SEQ ID NO: 5199680 - DNA, 18 bp, Homo sapiens
aggaaattaaataatttt

SEQ ID NO: 5199681 - DNA, 22 bp, Homo sapiens
aggaaattaaataattttacat

SEQ ID NO: 5199682 - DNA, 12 bp, Homo sapiens
aggaaattagtc

SEQ ID NO: 5199683 - DNA, 19 bp, Homo sapiens
aggaaattcagcccaccag

SEQ ID NO: 5199684 - DNA, 22 bp, Homo sapiens
aggaaattctttcccagtctgt

SEQ ID NO: 5199685 - DNA, 23 bp, Homo sapiens
aggaaattgagattagagggagg

SEQ ID NO: 5199686 - DNA, 17 bp, Homo sapiens
aggaaattgcaaagaaa

SEQ ID NO: 5199687 - DNA, 23 bp, Homo sapiens
aggaaatttatacaaagaaactt

SEQ ID NO: 5199688 - DNA, 20 bp, Homo sapiens
aggaaatttgtttgtatttt

SEQ ID NO: 5199689 - DNA, 22 bp, Homo sapiens
aggaaatttgtttgtatttttt

SEQ ID NO: 5199690 - DNA, 21 bp, Homo sapiens
aggaaatttttgcatgtttaa

SEQ ID NO: 5199691 - DNA, 15 bp, Homo sapiens
aggaacaaaaaaacc

SEQ ID NO: 5199692 - DNA, 16 bp, Homo sapiens
aggaacaaatcttcct

SEQ ID NO: 5199693 - DNA, 16 bp, Homo sapiens
aggaacaacagcatct

SEQ ID NO: 5199694 - DNA, 18 bp, Homo sapiens
aggaacaagacccccagg

SEQ ID NO: 5199695 - DNA, 22 bp, Homo sapiens
aggaacaagacccccaggaagg

SEQ ID NO: 5199696 - DNA, 16 bp, Homo sapiens
aggaacaagcatgtct

SEQ ID NO: 5199697 - DNA, 20 bp, Homo sapiens
aggaacaagcatgtctctct

SEQ ID NO: 5199698 - DNA, 19 bp, Homo sapiens
aggaacaagctggcttctg

SEQ ID NO: 5199699 - DNA, 16 bp, Homo sapiens
aggaacaaggcaaggc

SEQ ID NO: 5199700 - DNA, 17 bp, Homo sapiens
aggaacaaggcaaggct

SEQ ID NO: 5199701 - DNA, 19 bp, Homo sapiens
aggaacaaggcaaggctgt

SEQ ID NO: 5199702 - DNA, 20 bp, Homo sapiens
aggaacaaggcaaggctgtc

SEQ ID NO: 5199703 - DNA, 21 bp, Homo sapiens
aggaacaatgccgcctgtcaa

SEQ ID NO: 5199704 - DNA, 18 bp, Homo sapiens
aggaacacatgcacacac

SEQ ID NO: 5199705 - DNA, 20 bp, Homo sapiens
aggaacacatgcacacacac

SEQ ID NO: 5199706 - DNA, 20 bp, Homo sapiens
aggaacaccactatcttaat

SEQ ID NO: 5199707 - DNA, 14 bp, Homo sapiens
aggaacacccagcc

SEQ ID NO: 5199708 - DNA, 17 bp, Homo sapiens
aggaacacgattttcaa

SEQ ID NO: 5199709 - DNA, 20 bp, Homo sapiens
aggaacacgtgggtgagcgt

SEQ ID NO: 5199710 - DNA, 13 bp, Homo sapiens
aggaacagaagga

SEQ ID NO: 5199711 - DNA, 21 bp, Homo sapiens
aggaacagaaggatgaatgag

SEQ ID NO: 5199712 - DNA, 20 bp, Homo sapiens
aggaacagaagtgaggatga

SEQ ID NO: 5199713 - DNA, 19 bp, Homo sapiens
aggaacagagactctggaa

SEQ ID NO: 5199714 - DNA, 19 bp, Homo sapiens
aggaacagagtatatatgt

SEQ ID NO: 5199715 - DNA, 21 bp, Homo sapiens
aggaacagcagtgttctcaca

SEQ ID NO: 5199716 - DNA, 22 bp, Homo sapiens
aggaacagcccagcacaggtat

SEQ ID NO: 5199717 - DNA, 23 bp, Homo sapiens
aggaacagctcttcactcagcca

SEQ ID NO: 5199718 - DNA, 17 bp, Homo sapiens
aggaacagggaccagct

SEQ ID NO: 5199719 - DNA, 19 bp, Homo sapiens
aggaacagggaccagctcc

SEQ ID NO: 5199720 - DNA, 23 bp, Homo sapiens
aggaacaggttcctgtggagaca

SEQ ID NO: 5199721 - DNA, 12 bp, Homo sapiens
aggaacatacag

SEQ ID NO: 5199722 - DNA, 19 bp, Homo sapiens
aggaacatggagctgtcat

SEQ ID NO: 5199723 - DNA, 23 bp, Homo sapiens
aggaacattgggaaggaagcccg

SEQ ID NO: 5199724 - DNA, 16 bp, Homo sapiens
aggaacattgtgtcta

SEQ ID NO: 5199725 - DNA, 13 bp, Homo sapiens
aggaacatttttt

SEQ ID NO: 5199726 - DNA, 20 bp, Homo sapiens
aggaaccaaaaaaccccagc

SEQ ID NO: 5199727 - DNA, 21 bp, Homo sapiens
aggaaccaaaaaaccccagct

SEQ ID NO: 5199728 - DNA, 22 bp, Homo sapiens
aggaaccaaaaaaccccagcta

SEQ ID NO: 5199729 - DNA, 23 bp, Homo sapiens
aggaaccaaaaaaccccagctat

SEQ ID NO: 5199730 - DNA, 13 bp, Homo sapiens
aggaaccaaagcg

SEQ ID NO: 5199731 - DNA, 20 bp, Homo sapiens
aggaaccacaatgtttcttc

SEQ ID NO: 5199732 - DNA, 13 bp, Homo sapiens
aggaaccagggcc

SEQ ID NO: 5199733 - DNA, 14 bp, Homo sapiens
aggaaccagggcct

SEQ ID NO: 5199734 - DNA, 15 bp, Homo sapiens
aggaaccagggcctc

SEQ ID NO: 5199735 - DNA, 18 bp, Homo sapiens
aggaaccagggcctccct

SEQ ID NO: 5199736 - DNA, 14 bp, Homo sapiens
aggaacccagctct

SEQ ID NO: 5199737 - DNA, 17 bp, Homo sapiens
aggaacccagctctcag

SEQ ID NO: 5199738 - DNA, 18 bp, Homo sapiens
aggaacccagctctcagg

SEQ ID NO: 5199739 - DNA, 19 bp, Homo sapiens
aggaacccatcactgtgtc

SEQ ID NO: 5199740 - DNA, 18 bp, Homo sapiens
aggaacccccaccagaca

SEQ ID NO: 5199741 - DNA, 21 bp, Homo sapiens
aggaacccggtcccaggccgc

SEQ ID NO: 5199742 - DNA, 13 bp, Homo sapiens
aggaaccctcagg

SEQ ID NO: 5199743 - DNA, 17 bp, Homo sapiens
aggaaccctcaggccac

SEQ ID NO: 5199744 - DNA, 23 bp, Homo sapiens
aggaaccctcaggccaccctcca

SEQ ID NO: 5199745 - DNA, 15 bp, Homo sapiens
aggaaccctggagac

SEQ ID NO: 5199746 - DNA, 14 bp, Homo sapiens
aggaaccctggagg

SEQ ID NO: 5199747 - DNA, 23 bp, Homo sapiens
aggaacccttgcatccattgttg

SEQ ID NO: 5199748 - DNA, 23 bp, Homo sapiens
aggaaccgagggggctgctccca

SEQ ID NO: 5199749 - DNA, 19 bp, Homo sapiens
aggaacctaattgaaattt

SEQ ID NO: 5199750 - DNA, 19 bp, Homo sapiens
aggaacctcctccacacca

SEQ ID NO: 5199751 - DNA, 17 bp, Homo sapiens
aggaacctcgagtactg

SEQ ID NO: 5199752 - DNA, 18 bp, Homo sapiens
aggaacctcgagtactgt

SEQ ID NO: 5199753 - DNA, 21 bp, Homo sapiens
aggaacctctgatttattttg

SEQ ID NO: 5199754 - DNA, 19 bp, Homo sapiens
aggaacctggaccaaagct

SEQ ID NO: 5199755 - DNA, 12 bp, Homo sapiens
aggaacctggga

SEQ ID NO: 5199756 - DNA, 18 bp, Homo sapiens
aggaacgagcactggcca

SEQ ID NO: 5199757 - DNA, 21 bp, Homo sapiens
aggaacgagcactggccagag

SEQ ID NO: 5199758 - DNA, 22 bp, Homo sapiens
aggaacgagcactggccagaga

SEQ ID NO: 5199759 - DNA, 12 bp, Homo sapiens
aggaacggccct

SEQ ID NO: 5199760 - DNA, 15 bp, Homo sapiens
aggaacggctctggg

SEQ ID NO: 5199761 - DNA, 14 bp, Homo sapiens
aggaacgggcagcc

SEQ ID NO: 5199762 - DNA, 16 bp, Homo sapiens
aggaacgggcagccac

SEQ ID NO: 5199763 - DNA, 17 bp, Homo sapiens
aggaacgggcagccaca

SEQ ID NO: 5199764 - DNA, 20 bp, Homo sapiens
aggaacgggcagccacagga

SEQ ID NO: 5199765 - DNA, 19 bp, Homo sapiens
aggaacgggcagcctgggc

SEQ ID NO: 5199766 - DNA, 20 bp, Homo sapiens
aggaacggtggaggcagagg

SEQ ID NO: 5199767 - DNA, 23 bp, Homo sapiens
aggaacgtggttcagagactggc

SEQ ID NO: 5199768 - DNA, 15 bp, Homo sapiens
aggaacgtttctgaa

SEQ ID NO: 5199769 - DNA, 21 bp, Homo sapiens
aggaactaacttactgtccac

SEQ ID NO: 5199770 - DNA, 16 bp, Homo sapiens
aggaactagaaagaag

SEQ ID NO: 5199771 - DNA, 14 bp, Homo sapiens
aggaactagattat

SEQ ID NO: 5199772 - DNA, 20 bp, Homo sapiens
aggaactagtaaacatatgt

SEQ ID NO: 5199773 - DNA, 23 bp, Homo sapiens
aggaactcaaggtggctggagat

SEQ ID NO: 5199774 - DNA, 23 bp, Homo sapiens
aggaactcactctttagatattt

SEQ ID NO: 5199775 - DNA, 22 bp, Homo sapiens
aggaactccaggacgaggagga

SEQ ID NO: 5199776 - DNA, 16 bp, Homo sapiens
aggaactcgcctcagc

SEQ ID NO: 5199777 - DNA, 18 bp, Homo sapiens
aggaactctggcttccag

SEQ ID NO: 5199778 - DNA, 21 bp, Homo sapiens
aggaactctggcttccaggta

SEQ ID NO: 5199779 - DNA, 19 bp, Homo sapiens
aggaactctgtgtgagaga

SEQ ID NO: 5199780 - DNA, 21 bp, Homo sapiens
aggaactctgtgtgagagaga

SEQ ID NO: 5199781 - DNA, 22 bp, Homo sapiens
aggaactcttaagcaatggtaa

SEQ ID NO: 5199782 - DNA, 15 bp, Homo sapiens
aggaactgcaataat

SEQ ID NO: 5199783 - DNA, 20 bp, Homo sapiens
aggaactgcaataatatcaa

SEQ ID NO: 5199784 - DNA, 17 bp, Homo sapiens
aggaactgcagcaatct

SEQ ID NO: 5199785 - DNA, 21 bp, Homo sapiens
aggaactgcagcaatctttga

SEQ ID NO: 5199786 - DNA, 16 bp, Homo sapiens
aggaactgctgggctt

SEQ ID NO: 5199787 - DNA, 13 bp, Homo sapiens
aggaactggctcc

SEQ ID NO: 5199788 - DNA, 19 bp, Homo sapiens
aggaactggctcctttgcc

SEQ ID NO: 5199789 - DNA, 21 bp, Homo sapiens
agcctgtccccgccttccctc

SEQ ID NO: 5199790 - DNA, 22 bp, Homo sapiens
agcctgtccccgccttccctca

SEQ ID NO: 5199791 - DNA, 11 bp, Homo sapiens
agcctgtcctc

SEQ ID NO: 5199792 - DNA, 18 bp, Homo sapiens
agcctgtcctcaccgtct

SEQ ID NO: 5199793 - DNA, 17 bp, Homo sapiens
agcctgtcctgcctgtg

SEQ ID NO: 5199794 - DNA, 20 bp, Homo sapiens
agcctgtcctgcctgtggcc

SEQ ID NO: 5199795 - DNA, 13 bp, Homo sapiens
agcctgtcctggt

SEQ ID NO: 5199796 - DNA, 13 bp, Homo sapiens
agcctgtcggcca

SEQ ID NO: 5199797 - DNA, 14 bp, Homo sapiens
agcctgtcggccac

SEQ ID NO: 5199798 - DNA, 19 bp, Homo sapiens
agcctgtcggccacacccc

SEQ ID NO: 5199799 - DNA, 22 bp, Homo sapiens
agcctgtcggccacaccccaga

SEQ ID NO: 5199800 - DNA, 23 bp, Homo sapiens
agcctgtcggccacaccccagac

SEQ ID NO: 5199801 - DNA, 18 bp, Homo sapiens
agcctgtctcgggctgac

SEQ ID NO: 5199802 - DNA, 13 bp, Homo sapiens
agcctgtctctcc

SEQ ID NO: 5199803 - DNA, 16 bp, Homo sapiens
agcctgtctcttccat

SEQ ID NO: 5199804 - DNA, 20 bp, Homo sapiens
agcctgtctctttccacttt

SEQ ID NO: 5199805 - DNA, 21 bp, Homo sapiens
agcctgtcttcagatcctgct

SEQ ID NO: 5199806 - DNA, 19 bp, Homo sapiens
agcctgtgaacccaggaca

SEQ ID NO: 5199807 - DNA, 22 bp, Homo sapiens
agcctgtgaacccaggacaagc

SEQ ID NO: 5199808 - DNA, 17 bp, Homo sapiens
agcctgtgaactgccag

SEQ ID NO: 5199809 - DNA, 22 bp, Homo sapiens
agcctgtgaactgccaggcagc

SEQ ID NO: 5199810 - DNA, 22 bp, Homo sapiens
agcctgtgaataaaaaccctgt

SEQ ID NO: 5199811 - DNA, 23 bp, Homo sapiens
agcctgtgaataaaaaccctgta

SEQ ID NO: 5199812 - DNA, 16 bp, Homo sapiens
agcctgtgaccttggg

SEQ ID NO: 5199813 - DNA, 14 bp, Homo sapiens
agcctgtgagggag

SEQ ID NO: 5199814 - DNA, 22 bp, Homo sapiens
agcctgtgattaacttgcttag

SEQ ID NO: 5199815 - DNA, 16 bp, Homo sapiens
agcctgtgcaaaaaaa

SEQ ID NO: 5199816 - DNA, 21 bp, Homo sapiens
agcctgtgcaaaaaaattaaa

SEQ ID NO: 5199817 - DNA, 14 bp, Homo sapiens
agcctgtgcagcct

SEQ ID NO: 5199818 - DNA, 13 bp, Homo sapiens
agcctgtgccacc

SEQ ID NO: 5199819 - DNA, 14 bp, Homo sapiens
agcctgtgccacct

SEQ ID NO: 5199820 - DNA, 16 bp, Homo sapiens
agcctgtgccacctgc

SEQ ID NO: 5199821 - DNA, 17 bp, Homo sapiens
agcctgtgccacctgca

SEQ ID NO: 5199822 - DNA, 19 bp, Homo sapiens
agcctgtgccacctgcaag

SEQ ID NO: 5199823 - DNA, 15 bp, Homo sapiens
agcctgtgccagcac

SEQ ID NO: 5199824 - DNA, 13 bp, Homo sapiens
agcctgtgcctcc

SEQ ID NO: 5199825 - DNA, 16 bp, Homo sapiens
agcctgtgcctcccag

SEQ ID NO: 5199826 - DNA, 19 bp, Homo sapiens
agcctgtgcctcccagctt

SEQ ID NO: 5199827 - DNA, 16 bp, Homo sapiens
agcctgtgccttcctc

SEQ ID NO: 5199828 - DNA, 18 bp, Homo sapiens
agcctgtgccttcctccc

SEQ ID NO: 5199829 - DNA, 10 bp, Homo sapiens
agcctgtgcg

SEQ ID NO: 5199830 - DNA, 18 bp, Homo sapiens
agcctgtgcgtcccagct

SEQ ID NO: 5199831 - DNA, 21 bp, Homo sapiens
agcctgtgctgtggcatagac

SEQ ID NO: 5199832 - DNA, 23 bp, Homo sapiens
agcctgtggatgatcaatccttt

SEQ ID NO: 5199833 - DNA, 24 bp, Homo sapiens
agcctgtggcagtaaagagaaact

SEQ ID NO: 5199834 - DNA, 14 bp, Homo sapiens
agcctgtggcatct

SEQ ID NO: 5199835 - DNA, 15 bp, Homo sapiens
agcctgtggccagca

SEQ ID NO: 5199836 - DNA, 13 bp, Homo sapiens
agcctgtggccct

SEQ ID NO: 5199837 - DNA, 19 bp, Homo sapiens
agcctgtggccctgtcctg

SEQ ID NO: 5199838 - DNA, 13 bp, Homo sapiens
agcctgtggcctt

SEQ ID NO: 5199839 - DNA, 14 bp, Homo sapiens
agcctgtggctgtg

SEQ ID NO: 5199840 - DNA, 23 bp, Homo sapiens
agcctgtggctgtggagacaatg

SEQ ID NO: 5199841 - DNA, 13 bp, Homo sapiens
agcctgtggcttg

SEQ ID NO: 5199842 - DNA, 13 bp, Homo sapiens
agcctgtgggaga

SEQ ID NO: 5199843 - DNA, 15 bp, Homo sapiens
agcctgtgggagaag

SEQ ID NO: 5199844 - DNA, 16 bp, Homo sapiens
agcctgtgtaacagct

SEQ ID NO: 5199845 - DNA, 11 bp, Homo sapiens
agcctgtgtca

SEQ ID NO: 5199846 - DNA, 15 bp, Homo sapiens
agcctgtgtgaaaat

SEQ ID NO: 5199847 - DNA, 16 bp, Homo sapiens
agcctgtgtgaaaata

SEQ ID NO: 5199848 - DNA, 19 bp, Homo sapiens
agcctgtgttagtgtctgt

SEQ ID NO: 5199849 - DNA, 20 bp, Homo sapiens
agcctgttacaggaatgaag

SEQ ID NO: 5199850 - DNA, 18 bp, Homo sapiens
agcctgttcatggcagat

SEQ ID NO: 5199851 - DNA, 21 bp, Homo sapiens
agcctgttccataggaaggct

SEQ ID NO: 5199852 - DNA, 17 bp, Homo sapiens
agcctgttcccctcact

SEQ ID NO: 5199853 - DNA, 22 bp, Homo sapiens
agcctgttcccctcactggatg

SEQ ID NO: 5199854 - DNA, 16 bp, Homo sapiens
agcctgttccttcctg

SEQ ID NO: 5199855 - DNA, 22 bp, Homo sapiens
agcctgttccttcctgcagacc

SEQ ID NO: 5199856 - DNA, 24 bp, Homo sapiens
agcctgttccttcctgcagacctg

SEQ ID NO: 5199857 - DNA, 20 bp, Homo sapiens
agcctgttgagacttagata

SEQ ID NO: 5199858 - DNA, 15 bp, Homo sapiens
agcctgttgctgaag

SEQ ID NO: 5199859 - DNA, 13 bp, Homo sapiens
agcctgtttaaga

SEQ ID NO: 5199860 - DNA, 11 bp, Homo sapiens
agcctgtttca

SEQ ID NO: 5199861 - DNA, 14 bp, Homo sapiens
agcctgtttctatc

SEQ ID NO: 5199862 - DNA, 20 bp, Homo sapiens
agcctgtttctatcctgttt

SEQ ID NO: 5199863 - DNA, 19 bp, Homo sapiens
agcctgttttcactcagct

SEQ ID NO: 5199864 - DNA, 18 bp, Homo sapiens
agcctgttttgttggaag

SEQ ID NO: 5199865 - DNA, 20 bp, Homo sapiens
agccttaactaagactcccg

SEQ ID NO: 5199866 - DNA, 22 bp, Homo sapiens
agccttaactaagactcccgcc

SEQ ID NO: 5199867 - DNA, 15 bp, Homo sapiens
agccttaagaaagct

SEQ ID NO: 5199868 - DNA, 18 bp, Homo sapiens
agccttaagaaagctata

SEQ ID NO: 5199869 - DNA, 18 bp, Homo sapiens
agccttaagcacaattaa

SEQ ID NO: 5199870 - DNA, 16 bp, Homo sapiens
agccttaagctgcagg

SEQ ID NO: 5199871 - DNA, 21 bp, Homo sapiens
agccttaagtcttactgtttt

SEQ ID NO: 5199872 - DNA, 17 bp, Homo sapiens
agccttaatttgcacag

SEQ ID NO: 5199873 - DNA, 23 bp, Homo sapiens
agccttacggtcatgatgtctgc

SEQ ID NO: 5199874 - DNA, 24 bp, Homo sapiens
agccttacggtcatgatgtctgca

SEQ ID NO: 5199875 - DNA, 14 bp, Homo sapiens
agccttactcacct

SEQ ID NO: 5199876 - DNA, 20 bp, Homo sapiens
agccttacttcaaagtgcct

SEQ ID NO: 5199877 - DNA, 20 bp, Homo sapiens
agccttagaatctgtagagg

SEQ ID NO: 5199878 - DNA, 20 bp, Homo sapiens
agccttagacgaagaagctg

SEQ ID NO: 5199879 - DNA, 19 bp, Homo sapiens
agccttagaggtatgtcag

SEQ ID NO: 5199880 - DNA, 18 bp, Homo sapiens
agccttagctcccagcta

SEQ ID NO: 5199881 - DNA, 15 bp, Homo sapiens
agccttagctgccag

SEQ ID NO: 5199882 - DNA, 22 bp, Homo sapiens
agccttagggaagctggcctga

SEQ ID NO: 5199883 - DNA, 22 bp, Homo sapiens
agccttagttttttcatctgta

SEQ ID NO: 5199884 - DNA, 20 bp, Homo sapiens
agccttataaaccaatctta

SEQ ID NO: 5199885 - DNA, 15 bp, Homo sapiens
agccttatcaagtgt

SEQ ID NO: 5199886 - DNA, 15 bp, Homo sapiens
agccttatcctctga

SEQ ID NO: 5199887 - DNA, 17 bp, Homo sapiens
agccttatcctctgatc

SEQ ID NO: 5199888 - DNA, 18 bp, Homo sapiens
agccttatcctctgatct

SEQ ID NO: 5199889 - DNA, 21 bp, Homo sapiens
agccttatgaggtcaagaaat

SEQ ID NO: 5199890 - DNA, 21 bp, Homo sapiens
agccttatgtgttacattatt

SEQ ID NO: 5199891 - DNA, 21 bp, Homo sapiens
agccttattaaaatattttct

SEQ ID NO: 5199892 - DNA, 23 bp, Homo sapiens
agccttattaaaatattttctta

SEQ ID NO: 5199893 - DNA, 14 bp, Homo sapiens
agccttattcacct

SEQ ID NO: 5199894 - DNA, 22 bp, Homo sapiens
agccttattcacctttttaata

SEQ ID NO: 5199895 - DNA, 20 bp, Homo sapiens
agccttatttacctagtgca

SEQ ID NO: 5199896 - DNA, 18 bp, Homo sapiens
agccttattttgagtaaa

SEQ ID NO: 5199897 - DNA, 20 bp, Homo sapiens
agccttcaaaactatagctt

SEQ ID NO: 5199898 - DNA, 21 bp, Homo sapiens
agccttcaagaatcagaagaa

SEQ ID NO: 5199899 - DNA, 14 bp, Homo sapiens
agccttcaagctct

SEQ ID NO: 5199900 - DNA, 23 bp, Homo sapiens
agccttcaagctctgagggaaag

SEQ ID NO: 5199901 - DNA, 18 bp, Homo sapiens
agccttcaagtgccaaac

SEQ ID NO: 5199902 - DNA, 24 bp, Homo sapiens
agccttcaagtgccaaacagagta

SEQ ID NO: 5199903 - DNA, 20 bp, Homo sapiens
agccttcacaaccagccaca

SEQ ID NO: 5199904 - DNA, 22 bp, Homo sapiens
agccttcaccatggatcctgga

SEQ ID NO: 5199905 - DNA, 17 bp, Homo sapiens
agccttcacttttctga

SEQ ID NO: 5199906 - DNA, 18 bp, Homo sapiens
agccttcagagtacgtcc

SEQ ID NO: 5199907 - DNA, 16 bp, Homo sapiens
agccttcagccttaat

SEQ ID NO: 5199908 - DNA, 13 bp, Homo sapiens
agccttcaggcca

SEQ ID NO: 5199909 - DNA, 22 bp, Homo sapiens
agccttcataggcggtcatgtg

SEQ ID NO: 5199910 - DNA, 14 bp, Homo sapiens
agccttcatcagaa

SEQ ID NO: 5199911 - DNA, 19 bp, Homo sapiens
agccttcatcagaactctt

SEQ ID NO: 5199912 - DNA, 16 bp, Homo sapiens
agccttccaccggcac

SEQ ID NO: 5199913 - DNA, 16 bp, Homo sapiens
agccttccaggggtgg

SEQ ID NO: 5199914 - DNA, 18 bp, Homo sapiens
agccttccaggggtggga

SEQ ID NO: 5199915 - DNA, 18 bp, Homo sapiens
agccttccagtggcttct

SEQ ID NO: 5199916 - DNA, 22 bp, Homo sapiens
agccttccagtggcttctccca

SEQ ID NO: 5199917 - DNA, 12 bp, Homo sapiens
agccttccagtt

SEQ ID NO: 5199918 - DNA, 13 bp, Homo sapiens
agccttcccattt

SEQ ID NO: 5199919 - DNA, 13 bp, Homo sapiens
agccttccccagc

SEQ ID NO: 5199920 - DNA, 20 bp, Homo sapiens
agccttccccagctccagca

SEQ ID NO: 5199921 - DNA, 16 bp, Homo sapiens
agccttcccctacccc

SEQ ID NO: 5199922 - DNA, 17 bp, Homo sapiens
agccttcccctccctgt

SEQ ID NO: 5199923 - DNA, 17 bp, Homo sapiens
agccttccctctgcatt

SEQ ID NO: 5199924 - DNA, 24 bp, Homo sapiens
agccttccctctgcattgacctgg

SEQ ID NO: 5199925 - DNA, 18 bp, Homo sapiens
agccttccgagtagctgg

SEQ ID NO: 5199926 - DNA, 12 bp, Homo sapiens
agccttcctcca

SEQ ID NO: 5199927 - DNA, 21 bp, Homo sapiens
agccttcctccacatcctttc

SEQ ID NO: 5199928 - DNA, 18 bp, Homo sapiens
agccttcctctgcagctg

SEQ ID NO: 5199929 - DNA, 19 bp, Homo sapiens
agccttccttctgctccca

SEQ ID NO: 5199930 - DNA, 23 bp, Homo sapiens
agccttccttctgctcccacccc

SEQ ID NO: 5199931 - DNA, 19 bp, Homo sapiens
agccttcctttctcctgcc

SEQ ID NO: 5199932 - DNA, 17 bp, Homo sapiens
agccttcgaaaagaaat

SEQ ID NO: 5199933 - DNA, 19 bp, Homo sapiens
agccttcgaaaagaaattg

SEQ ID NO: 5199934 - DNA, 20 bp, Homo sapiens
agccttctccctagctcctc

SEQ ID NO: 5199935 - DNA, 13 bp, Homo sapiens
agccttctctcaa

SEQ ID NO: 5199936 - DNA, 12 bp, Homo sapiens
agccttctctct

SEQ ID NO: 5199937 - DNA, 17 bp, Homo sapiens
agccttctctctctggt

SEQ ID NO: 5199938 - DNA, 19 bp, Homo sapiens
agccttctctgttcatttc

SEQ ID NO: 5199939 - DNA, 23 bp, Homo sapiens
agccttctctgttcatttcctca

SEQ ID NO: 5199940 - DNA, 20 bp, Homo sapiens
agccttctgaggacattcca

SEQ ID NO: 5199941 - DNA, 15 bp, Homo sapiens
agccttctgatgtct

SEQ ID NO: 5199942 - DNA, 14 bp, Homo sapiens
agccttctgcagca

SEQ ID NO: 5199943 - DNA, 15 bp, Homo sapiens
agccttctgcagcag

SEQ ID NO: 5199944 - DNA, 12 bp, Homo sapiens
agccttctgcca

SEQ ID NO: 5199945 - DNA, 13 bp, Homo sapiens
agccttctgccac

SEQ ID NO: 5199946 - DNA, 15 bp, Homo sapiens
agccttctgccacca

SEQ ID NO: 5199947 - DNA, 20 bp, Homo sapiens
agccttcttagaactctgct

SEQ ID NO: 5199948 - DNA, 15 bp, Homo sapiens
agccttcttctgcca

SEQ ID NO: 5199949 - DNA, 19 bp, Homo sapiens
agccttcttgatgtatttc

SEQ ID NO: 5199950 - DNA, 17 bp, Homo sapiens
agccttcttttcaaaac

SEQ ID NO: 5199951 - DNA, 20 bp, Homo sapiens
agccttcttttgtacttttc

SEQ ID NO: 5199952 - DNA, 17 bp, Homo sapiens
agccttctttttctgga

SEQ ID NO: 5199953 - DNA, 23 bp, Homo sapiens
agccttctttttctggactctgg

SEQ ID NO: 5199954 - DNA, 14 bp, Homo sapiens
agccttgaaaaaca

SEQ ID NO: 5199955 - DNA, 18 bp, Homo sapiens
agccttgaaaaacaagtc

SEQ ID NO: 5199956 - DNA, 13 bp, Homo sapiens
agccttgaaaaca

SEQ ID NO: 5199957 - DNA, 14 bp, Homo sapiens
agccttgaaaacaa

SEQ ID NO: 5199958 - DNA, 16 bp, Homo sapiens
agccttgaaaacaaac

SEQ ID NO: 5199959 - DNA, 20 bp, Homo sapiens
agccttgaactcctggcctc

SEQ ID NO: 5199960 - DNA, 13 bp, Homo sapiens
agccttgaacttt

SEQ ID NO: 5199961 - DNA, 15 bp, Homo sapiens
agccttgaactttga

SEQ ID NO: 5199962 - DNA, 16 bp, Homo sapiens
agccttgacacactgt

SEQ ID NO: 5199963 - DNA, 16 bp, Homo sapiens
agccttgagagaccca

SEQ ID NO: 5199964 - DNA, 16 bp, Homo sapiens
agccttgagccctggc

SEQ ID NO: 5199965 - DNA, 18 bp, Homo sapiens
agccttgataatacttga

SEQ ID NO: 5199966 - DNA, 14 bp, Homo sapiens
agccttgcacaccc

SEQ ID NO: 5199967 - DNA, 21 bp, Homo sapiens
aggaactgggccttgtgtgct

SEQ ID NO: 5199968 - DNA, 12 bp, Homo sapiens
aggaactggtcc

SEQ ID NO: 5199969 - DNA, 13 bp, Homo sapiens
aggaactggtcca

SEQ ID NO: 5199970 - DNA, 18 bp, Homo sapiens
aggaactggtccaggcca

SEQ ID NO: 5199971 - DNA, 23 bp, Homo sapiens
aggaactggtccaggccaggcct

SEQ ID NO: 5199972 - DNA, 15 bp, Homo sapiens
aggaactgtccagag

SEQ ID NO: 5199973 - DNA, 14 bp, Homo sapiens
aggaactgttataa

SEQ ID NO: 5199974 - DNA, 22 bp, Homo sapiens
aggaacttgctgctgtgcctgc

SEQ ID NO: 5199975 - DNA, 23 bp, Homo sapiens
aggaacttgctgctgtgcctgcg

SEQ ID NO: 5199976 - DNA, 14 bp, Homo sapiens
aggaactttctggt

SEQ ID NO: 5199977 - DNA, 18 bp, Homo sapiens
aggaacttttaaactgca

SEQ ID NO: 5199978 - DNA, 21 bp, Homo sapiens
aggaagaaaaaagatccctat

SEQ ID NO: 5199979 - DNA, 17 bp, Homo sapiens
aggaagaaacagaagag

SEQ ID NO: 5199980 - DNA, 13 bp, Homo sapiens
aggaagaaacttt

SEQ ID NO: 5199981 - DNA, 13 bp, Homo sapiens
aggaagaaatcac

SEQ ID NO: 5199982 - DNA, 11 bp, Homo sapiens
aggaagaaatt

SEQ ID NO: 5199983 - DNA, 17 bp, Homo sapiens
aggaagaacaacaaaga

SEQ ID NO: 5199984 - DNA, 21 bp, Homo sapiens
aggaagaacaccctctaaatg

SEQ ID NO: 5199985 - DNA, 18 bp, Homo sapiens
aggaagaacagtacattt

SEQ ID NO: 5199986 - DNA, 12 bp, Homo sapiens
aggaagaacggg

SEQ ID NO: 5199987 - DNA, 17 bp, Homo sapiens
aggaagaacttgaagtg

SEQ ID NO: 5199988 - DNA, 20 bp, Homo sapiens
aggaagaagacaaatgacag

SEQ ID NO: 5199989 - DNA, 16 bp, Homo sapiens
aggaagaagcttaggc

SEQ ID NO: 5199990 - DNA, 18 bp, Homo sapiens
aggaagaagggataatag

SEQ ID NO: 5199991 - DNA, 17 bp, Homo sapiens
aggaagaagtggtacta

SEQ ID NO: 5199992 - DNA, 20 bp, Homo sapiens
aggaagaataaaaaagaaga

SEQ ID NO: 5199993 - DNA, 14 bp, Homo sapiens
aggaagaataattt

SEQ ID NO: 5199994 - DNA, 17 bp, Homo sapiens
aggaagaatataatggg

SEQ ID NO: 5199995 - DNA, 20 bp, Homo sapiens
aggaagaatggtgtgggaga

SEQ ID NO: 5199996 - DNA, 18 bp, Homo sapiens
aggaagacacagcccaga

SEQ ID NO: 5199997 - DNA, 22 bp, Homo sapiens
aggaagacataaaactttaaaa

SEQ ID NO: 5199998 - DNA, 21 bp, Homo sapiens
aggaagacatctgtagggaat

SEQ ID NO: 5199999 - DNA, 17 bp, Homo sapiens
aggaagaccaaggcctc

SEQ ID NO: 5200000 - DNA, 20 bp, Homo sapiens
aggaagaccaaggcctcggc

SEQ ID NO: 5200001 - DNA, 19 bp, Homo sapiens
aggaagactctggagccaa

SEQ ID NO: 5200002 - DNA, 15 bp, Homo sapiens
aggaagactggagac

SEQ ID NO: 5200003 - DNA, 13 bp, Homo sapiens
aggaagacttcca

SEQ ID NO: 5200004 - DNA, 19 bp, Homo sapiens
aggaagacttggcccagga

SEQ ID NO: 5200005 - DNA, 15 bp, Homo sapiens
aggaagactttgtga

SEQ ID NO: 5200006 - DNA, 14 bp, Homo sapiens
aggaagagaaaaaa

SEQ ID NO: 5200007 - DNA, 12 bp, Homo sapiens
aggaagagaagg

SEQ ID NO: 5200008 - DNA, 16 bp, Homo sapiens
aggaagagaaggagca

SEQ ID NO: 5200009 - DNA, 17 bp, Homo sapiens
aggaagagaaggagcag

SEQ ID NO: 5200010 - DNA, 17 bp, Homo sapiens
aggaagagcaggcacat

SEQ ID NO: 5200011 - DNA, 11 bp, Homo sapiens
aggaagagcca

SEQ ID NO: 5200012 - DNA, 19 bp, Homo sapiens
aggaagagccacctgcaag

SEQ ID NO: 5200013 - DNA, 15 bp, Homo sapiens
aggaagaggccgctg

SEQ ID NO: 5200014 - DNA, 21 bp, Homo sapiens
aggaagagggctgagctgagc

SEQ ID NO: 5200015 - DNA, 20 bp, Homo sapiens
aggaagaggggaagcagaaa

SEQ ID NO: 5200016 - DNA, 22 bp, Homo sapiens
aggaagaggggcgctgccccca

SEQ ID NO: 5200017 - DNA, 20 bp, Homo sapiens
aggaagaggtaatttttcac

SEQ ID NO: 5200018 - DNA, 18 bp, Homo sapiens
aggaagatcactttgctc

SEQ ID NO: 5200019 - DNA, 16 bp, Homo sapiens
aggaagatcccccaga

SEQ ID NO: 5200020 - DNA, 17 bp, Homo sapiens
aggaagatcctgaagca

SEQ ID NO: 5200021 - DNA, 18 bp, Homo sapiens
aggaagatcttgagagct

SEQ ID NO: 5200022 - DNA, 21 bp, Homo sapiens
aggaagatcttgagagctgct

SEQ ID NO: 5200023 - DNA, 17 bp, Homo sapiens
aggaagatgaaagagga

SEQ ID NO: 5200024 - DNA, 16 bp, Homo sapiens
aggaagatgaagagaa

SEQ ID NO: 5200025 - DNA, 17 bp, Homo sapiens
aggaagatgaagagaag

SEQ ID NO: 5200026 - DNA, 18 bp, Homo sapiens
aggaagatgaagagaagc

SEQ ID NO: 5200027 - DNA, 22 bp, Homo sapiens
aggaagatgaagagaagctgag

SEQ ID NO: 5200028 - DNA, 23 bp, Homo sapiens
aggaagatggctcccaaggttcc

SEQ ID NO: 5200029 - DNA, 18 bp, Homo sapiens
aggaagatgggggcaaga

SEQ ID NO: 5200030 - DNA, 21 bp, Homo sapiens
aggaagatgtatgctttgaat

SEQ ID NO: 5200031 - DNA, 17 bp, Homo sapiens
aggaagattactcagta

SEQ ID NO: 5200032 - DNA, 13 bp, Homo sapiens
aggaagatttgga

SEQ ID NO: 5200033 - DNA, 12 bp, Homo sapiens
aggaagcaacag

SEQ ID NO: 5200034 - DNA, 14 bp, Homo sapiens
aggaagcaacagct

SEQ ID NO: 5200035 - DNA, 13 bp, Homo sapiens
aggaagcaacgaa

SEQ ID NO: 5200036 - DNA, 22 bp, Homo sapiens
aggaagcaagatcgctgtgcta

SEQ ID NO: 5200037 - DNA, 20 bp, Homo sapiens
aggaagcaaggccagccctg

SEQ ID NO: 5200038 - DNA, 16 bp, Homo sapiens
aggaagcacagcaggt

SEQ ID NO: 5200039 - DNA, 14 bp, Homo sapiens
aggaagcacaggcc

SEQ ID NO: 5200040 - DNA, 20 bp, Homo sapiens
aggaagcacaggccagggga

SEQ ID NO: 5200041 - DNA, 14 bp, Homo sapiens
aggaagcacaggtc

SEQ ID NO: 5200042 - DNA, 23 bp, Homo sapiens
aggaagcacatgcctctctcagg

SEQ ID NO: 5200043 - DNA, 18 bp, Homo sapiens
aggaagcaccccatgcca

SEQ ID NO: 5200044 - DNA, 13 bp, Homo sapiens
aggaagcacctct

SEQ ID NO: 5200045 - DNA, 13 bp, Homo sapiens
aggaagcagaaga

SEQ ID NO: 5200046 - DNA, 14 bp, Homo sapiens
aggaagcagaagac

SEQ ID NO: 5200047 - DNA, 13 bp, Homo sapiens
aggaagcagaata

SEQ ID NO: 5200048 - DNA, 16 bp, Homo sapiens
aggaagcagaataaag

SEQ ID NO: 5200049 - DNA, 15 bp, Homo sapiens
aggaagcagagcact

SEQ ID NO: 5200050 - DNA, 14 bp, Homo sapiens
aggaagcagccaag

SEQ ID NO: 5200051 - DNA, 18 bp, Homo sapiens
aggaagcagctttcccca

SEQ ID NO: 5200052 - DNA, 15 bp, Homo sapiens
aggaagcattgtaaa

SEQ ID NO: 5200053 - DNA, 16 bp, Homo sapiens
aggaagcattgtaaaa

SEQ ID NO: 5200054 - DNA, 19 bp, Homo sapiens
aggaagcattgtaaaataa

SEQ ID NO: 5200055 - DNA, 21 bp, Homo sapiens
aggaagcattgtaaaataatt

SEQ ID NO: 5200056 - DNA, 12 bp, Homo sapiens
aggaagccaaag

SEQ ID NO: 5200057 - DNA, 15 bp, Homo sapiens
aggaagccacagctg

SEQ ID NO: 5200058 - DNA, 16 bp, Homo sapiens
aggaagccacagctgg

SEQ ID NO: 5200059 - DNA, 14 bp, Homo sapiens
aggaagccacgtgc

SEQ ID NO: 5200060 - DNA, 22 bp, Homo sapiens
aggaagccagcaggctctcagg

SEQ ID NO: 5200061 - DNA, 23 bp, Homo sapiens
aggaagccagcaggctctcaggc

SEQ ID NO: 5200062 - DNA, 13 bp, Homo sapiens
aggaagccagctg

SEQ ID NO: 5200063 - DNA, 15 bp, Homo sapiens
aggaagccaggctga

SEQ ID NO: 5200064 - DNA, 16 bp, Homo sapiens
aggaagccaggctgag

SEQ ID NO: 5200065 - DNA, 19 bp, Homo sapiens
aggaagccaggctgagtga

SEQ ID NO: 5200066 - DNA, 18 bp, Homo sapiens
aggaagccagtcaccttc

SEQ ID NO: 5200067 - DNA, 22 bp, Homo sapiens
aggaagcccaccaatctgccct

SEQ ID NO: 5200068 - DNA, 16 bp, Homo sapiens
aggaagcccactgcct

SEQ ID NO: 5200069 - DNA, 19 bp, Homo sapiens
aggaagcccagcccaagca

SEQ ID NO: 5200070 - DNA, 15 bp, Homo sapiens
aggaagcccaggctc

SEQ ID NO: 5200071 - DNA, 21 bp, Homo sapiens
aggaagcccaggctcggagga

SEQ ID NO: 5200072 - DNA, 22 bp, Homo sapiens
aggaagccccgctcaggtagcc

SEQ ID NO: 5200073 - DNA, 9 bp, Homo sapiens
aggaagccg

SEQ ID NO: 5200074 - DNA, 20 bp, Homo sapiens
aggaagccggtgtccctgga

SEQ ID NO: 5200075 - DNA, 22 bp, Homo sapiens
aggaagccggtgtccctggatg

SEQ ID NO: 5200076 - DNA, 22 bp, Homo sapiens
aggaagccgttgaatctgggag

SEQ ID NO: 5200077 - DNA, 23 bp, Homo sapiens
aggaagccgttgaatctgggagg

SEQ ID NO: 5200078 - DNA, 17 bp, Homo sapiens
aggaagcctgattaaag

SEQ ID NO: 5200079 - DNA, 15 bp, Homo sapiens
aggaagcgtggggta

SEQ ID NO: 5200080 - DNA, 22 bp, Homo sapiens
aggaagctacgggcacaactgg

SEQ ID NO: 5200081 - DNA, 17 bp, Homo sapiens
aggaagctcagactggt

SEQ ID NO: 5200082 - DNA, 20 bp, Homo sapiens
aggaagctcagactggttga

SEQ ID NO: 5200083 - DNA, 16 bp, Homo sapiens
aggaagctcagggcct

SEQ ID NO: 5200084 - DNA, 19 bp, Homo sapiens
aggaagctccagtcctgct

SEQ ID NO: 5200085 - DNA, 16 bp, Homo sapiens
aggaagctccttcctg

SEQ ID NO: 5200086 - DNA, 18 bp, Homo sapiens
aggaagctccttcctgtt

SEQ ID NO: 5200087 - DNA, 16 bp, Homo sapiens
aggaagctctctttcc

SEQ ID NO: 5200088 - DNA, 22 bp, Homo sapiens
aggaagctgcctggtgtggagt

SEQ ID NO: 5200089 - DNA, 17 bp, Homo sapiens
aggaagctgctccgtgc

SEQ ID NO: 5200090 - DNA, 18 bp, Homo sapiens
aggaagctggcagaacgg

SEQ ID NO: 5200091 - DNA, 17 bp, Homo sapiens
aggaagcttacatgcct

SEQ ID NO: 5200092 - DNA, 13 bp, Homo sapiens
aggaagctttctc

SEQ ID NO: 5200093 - DNA, 18 bp, Homo sapiens
aggaagctttctctgctt

SEQ ID NO: 5200094 - DNA, 22 bp, Homo sapiens
aggaagctttctctgcttcagc

SEQ ID NO: 5200095 - DNA, 19 bp, Homo sapiens
aggaagctttggaagcagc

SEQ ID NO: 5200096 - DNA, 23 bp, Homo sapiens
aggaagctttggtgagaacctgg

SEQ ID NO: 5200097 - DNA, 11 bp, Homo sapiens
aggaaggaaac

SEQ ID NO: 5200098 - DNA, 18 bp, Homo sapiens
aggaaggaaacatagaaa

SEQ ID NO: 5200099 - DNA, 21 bp, Homo sapiens
aggaaggaaacatagaaagac

SEQ ID NO: 5200100 - DNA, 18 bp, Homo sapiens
aggaaggaaacccagctc

SEQ ID NO: 5200101 - DNA, 20 bp, Homo sapiens
aggaaggaaacccagctctg

SEQ ID NO: 5200102 - DNA, 22 bp, Homo sapiens
aggaaggaaacccagctctggt

SEQ ID NO: 5200103 - DNA, 13 bp, Homo sapiens
aggaaggaaactg

SEQ ID NO: 5200104 - DNA, 17 bp, Homo sapiens
aggaaggacagactggc

SEQ ID NO: 5200105 - DNA, 18 bp, Homo sapiens
aggaaggacagactggcc

SEQ ID NO: 5200106 - DNA, 12 bp, Homo sapiens
aggaaggacatg

SEQ ID NO: 5200107 - DNA, 14 bp, Homo sapiens
aggaaggacatttc

SEQ ID NO: 5200108 - DNA, 15 bp, Homo sapiens
aggaaggaccaggct

SEQ ID NO: 5200109 - DNA, 21 bp, Homo sapiens
aggaaggagactcacctctgc

SEQ ID NO: 5200110 - DNA, 15 bp, Homo sapiens
aggaaggagaggaga

SEQ ID NO: 5200111 - DNA, 12 bp, Homo sapiens
aggaaggagccc

SEQ ID NO: 5200112 - DNA, 13 bp, Homo sapiens
aggaaggagcggc

SEQ ID NO: 5200113 - DNA, 14 bp, Homo sapiens
aggaaggagcggcg

SEQ ID NO: 5200114 - DNA, 19 bp, Homo sapiens
aggaaggaggacccaggac

SEQ ID NO: 5200115 - DNA, 14 bp, Homo sapiens
aggaaggatgagca

SEQ ID NO: 5200116 - DNA, 15 bp, Homo sapiens
aggaaggatgccact

SEQ ID NO: 5200117 - DNA, 13 bp, Homo sapiens
aggaaggatggca

SEQ ID NO: 5200118 - DNA, 18 bp, Homo sapiens
aggaaggattgtaaaaaa

SEQ ID NO: 5200119 - DNA, 11 bp, Homo sapiens
aggaaggattt

SEQ ID NO: 5200120 - DNA, 13 bp, Homo sapiens
aggaaggcaagag

SEQ ID NO: 5200121 - DNA, 19 bp, Homo sapiens
aggaaggcagcattccatg

SEQ ID NO: 5200122 - DNA, 12 bp, Homo sapiens
aggaaggcagct

SEQ ID NO: 5200123 - DNA, 13 bp, Homo sapiens
aggaaggcagctg

SEQ ID NO: 5200124 - DNA, 14 bp, Homo sapiens
aggaaggcagctgc

SEQ ID NO: 5200125 - DNA, 15 bp, Homo sapiens
aggaaggcagctgct

SEQ ID NO: 5200126 - DNA, 16 bp, Homo sapiens
aggaaggcagctgctc

SEQ ID NO: 5200127 - DNA, 15 bp, Homo sapiens
aggaaggccacagtg

SEQ ID NO: 5200128 - DNA, 15 bp, Homo sapiens
aggaaggcccagggg

SEQ ID NO: 5200129 - DNA, 15 bp, Homo sapiens
aggaaggcctaggct

SEQ ID NO: 5200130 - DNA, 14 bp, Homo sapiens
aggaaggcctttct

SEQ ID NO: 5200131 - DNA, 15 bp, Homo sapiens
aggaaggcctttctt

SEQ ID NO: 5200132 - DNA, 17 bp, Homo sapiens
aggaaggcctttcttct

SEQ ID NO: 5200133 - DNA, 20 bp, Homo sapiens
aggaaggcctttcttctgtg

SEQ ID NO: 5200134 - DNA, 13 bp, Homo sapiens
aggaaggcggggc

SEQ ID NO: 5200135 - DNA, 20 bp, Homo sapiens
aggaaggcgtgtccaggaga

SEQ ID NO: 5200136 - DNA, 21 bp, Homo sapiens
aggaaggctgaactcttcaga

SEQ ID NO: 5200137 - DNA, 22 bp, Homo sapiens
aggaaggctgagaggagagaga

SEQ ID NO: 5200138 - DNA, 21 bp, Homo sapiens
aggaaggcttgttgtgctttt

SEQ ID NO: 5200139 - DNA, 14 bp, Homo sapiens
aggaagggacacac

SEQ ID NO: 5200140 - DNA, 17 bp, Homo sapiens
aggaagggacacacaca

SEQ ID NO: 5200141 - DNA, 16 bp, Homo sapiens
aggaagggaccaaggc

SEQ ID NO: 5200142 - DNA, 14 bp, Homo sapiens
aggaagggactgac

SEQ ID NO: 5200143 - DNA, 18 bp, Homo sapiens
aggaagggactggtccag

SEQ ID NO: 5200144 - DNA, 16 bp, Homo sapiens
aggaagggagaggagg

SEQ ID NO: 5200145 - DNA, 16 bp, Homo sapiens
aggaagggaggcctga

SEQ ID NO: 5200146 - DNA, 20 bp, Homo sapiens
aggaagggaggcctgagggg

SEQ ID NO: 5200147 - DNA, 20 bp, Homo sapiens
agccttgcacacccactgcc

SEQ ID NO: 5200148 - DNA, 20 bp, Homo sapiens
agccttgcagatatctgcat

SEQ ID NO: 5200149 - DNA, 14 bp, Homo sapiens
agccttgcagcggc

SEQ ID NO: 5200150 - DNA, 20 bp, Homo sapiens
agccttgcagcggctcctgc

SEQ ID NO: 5200151 - DNA, 22 bp, Homo sapiens
agccttgcagcggctcctgcaa

SEQ ID NO: 5200152 - DNA, 13 bp, Homo sapiens
agccttgccagag

SEQ ID NO: 5200153 - DNA, 13 bp, Homo sapiens
agccttgcccatt

SEQ ID NO: 5200154 - DNA, 20 bp, Homo sapiens
agccttgccttttaaaagaa

SEQ ID NO: 5200155 - DNA, 21 bp, Homo sapiens
agccttgccttttaaaagaaa

SEQ ID NO: 5200156 - DNA, 21 bp, Homo sapiens
agccttgcgcaaaacccagaa

SEQ ID NO: 5200157 - DNA, 17 bp, Homo sapiens
agccttgcgctgtccca

SEQ ID NO: 5200158 - DNA, 23 bp, Homo sapiens
agccttgcgctgtcccaggcatg

SEQ ID NO: 5200159 - DNA, 19 bp, Homo sapiens
agccttgcggaaggttcta

SEQ ID NO: 5200160 - DNA, 20 bp, Homo sapiens
agccttgctagacagccagg

SEQ ID NO: 5200161 - DNA, 12 bp, Homo sapiens
agccttgctcag

SEQ ID NO: 5200162 - DNA, 12 bp, Homo sapiens
agccttgctcat

SEQ ID NO: 5200163 - DNA, 12 bp, Homo sapiens
agccttgctctc

SEQ ID NO: 5200164 - DNA, 13 bp, Homo sapiens
agccttgctctct

SEQ ID NO: 5200165 - DNA, 23 bp, Homo sapiens
agccttgctctcttcaataaacc

SEQ ID NO: 5200166 - DNA, 11 bp, Homo sapiens
agccttgctgc

SEQ ID NO: 5200167 - DNA, 23 bp, Homo sapiens
agccttgctgccaagtcctgcct

SEQ ID NO: 5200168 - DNA, 13 bp, Homo sapiens
agccttgctgctc

SEQ ID NO: 5200169 - DNA, 17 bp, Homo sapiens
agccttgctgctctgcg

SEQ ID NO: 5200170 - DNA, 15 bp, Homo sapiens
agccttgctgtagag

SEQ ID NO: 5200171 - DNA, 16 bp, Homo sapiens
agccttgctgtagaga

SEQ ID NO: 5200172 - DNA, 12 bp, Homo sapiens
agccttgcttgt

SEQ ID NO: 5200173 - DNA, 19 bp, Homo sapiens
agccttggaaccagcccca

SEQ ID NO: 5200174 - DNA, 20 bp, Homo sapiens
agccttggaaccagccccat

SEQ ID NO: 5200175 - DNA, 21 bp, Homo sapiens
agccttggaaccagccccatc

SEQ ID NO: 5200176 - DNA, 13 bp, Homo sapiens
agccttggagtgt

SEQ ID NO: 5200177 - DNA, 19 bp, Homo sapiens
agccttggataatgctgtt

SEQ ID NO: 5200178 - DNA, 22 bp, Homo sapiens
agccttggatactccatggggt

SEQ ID NO: 5200179 - DNA, 14 bp, Homo sapiens
agccttggcccaca

SEQ ID NO: 5200180 - DNA, 17 bp, Homo sapiens
agccttggcgagggcag

SEQ ID NO: 5200181 - DNA, 18 bp, Homo sapiens
agccttggctcctgagaa

SEQ ID NO: 5200182 - DNA, 22 bp, Homo sapiens
agccttggctcctgagaaaggt

SEQ ID NO: 5200183 - DNA, 14 bp, Homo sapiens
agccttgggagcca

SEQ ID NO: 5200184 - DNA, 15 bp, Homo sapiens
agccttgggatagca

SEQ ID NO: 5200185 - DNA, 23 bp, Homo sapiens
agccttgggatagcaaactccag

SEQ ID NO: 5200186 - DNA, 20 bp, Homo sapiens
agccttggggctgatgcagt

SEQ ID NO: 5200187 - DNA, 18 bp, Homo sapiens
agccttgggggggctgcc

SEQ ID NO: 5200188 - DNA, 21 bp, Homo sapiens
agccttgggggggctgccttt

SEQ ID NO: 5200189 - DNA, 17 bp, Homo sapiens
agccttggggttggaca

SEQ ID NO: 5200190 - DNA, 23 bp, Homo sapiens
agccttgggttccaaccaggcag

SEQ ID NO: 5200191 - DNA, 19 bp, Homo sapiens
agccttggtgtccacctgg

SEQ ID NO: 5200192 - DNA, 22 bp, Homo sapiens
agccttggtgtccacctggccc

SEQ ID NO: 5200193 - DNA, 22 bp, Homo sapiens
agccttggttggacctattgcc

SEQ ID NO: 5200194 - DNA, 18 bp, Homo sapiens
agccttgtaattctaaat

SEQ ID NO: 5200195 - DNA, 21 bp, Homo sapiens
agccttgtacagtctgctcct

SEQ ID NO: 5200196 - DNA, 15 bp, Homo sapiens
agccttgtcagtgtg

SEQ ID NO: 5200197 - DNA, 22 bp, Homo sapiens
agccttgtgatgtcatacagag

SEQ ID NO: 5200198 - DNA, 23 bp, Homo sapiens
agccttgtgatgtcatacagaga

SEQ ID NO: 5200199 - DNA, 18 bp, Homo sapiens
agccttgtgccctgcccc

SEQ ID NO: 5200200 - DNA, 14 bp, Homo sapiens
agccttgtgtatat

SEQ ID NO: 5200201 - DNA, 19 bp, Homo sapiens
agccttgtgtatatttgta

SEQ ID NO: 5200202 - DNA, 22 bp, Homo sapiens
agccttgtgtatatttgtatat

SEQ ID NO: 5200203 - DNA, 24 bp, Homo sapiens
agccttgtgtatatttgtatatta

SEQ ID NO: 5200204 - DNA, 23 bp, Homo sapiens
agccttgtgtctacagagaacct

SEQ ID NO: 5200205 - DNA, 15 bp, Homo sapiens
agcctttaataggct

SEQ ID NO: 5200206 - DNA, 16 bp, Homo sapiens
agcctttacctgtgaa

SEQ ID NO: 5200207 - DNA, 20 bp, Homo sapiens
agcctttactgtttgatata

SEQ ID NO: 5200208 - DNA, 18 bp, Homo sapiens
agcctttagtatcagtgt

SEQ ID NO: 5200209 - DNA, 19 bp, Homo sapiens
agcctttagtatcagtgtt

SEQ ID NO: 5200210 - DNA, 20 bp, Homo sapiens
agcctttagtatcagtgttt

SEQ ID NO: 5200211 - DNA, 19 bp, Homo sapiens
agcctttcattttgcttta

SEQ ID NO: 5200212 - DNA, 20 bp, Homo sapiens
agcctttcattttgctttaa

SEQ ID NO: 5200213 - DNA, 23 bp, Homo sapiens
agcctttcctcaaaactggagtc

SEQ ID NO: 5200214 - DNA, 15 bp, Homo sapiens
agcctttcctcggtc

SEQ ID NO: 5200215 - DNA, 19 bp, Homo sapiens
agcctttcctcggtctccc

SEQ ID NO: 5200216 - DNA, 23 bp, Homo sapiens
agcctttcctcggtctcccttcc

SEQ ID NO: 5200217 - DNA, 19 bp, Homo sapiens
agcctttcgttctgctgac

SEQ ID NO: 5200218 - DNA, 16 bp, Homo sapiens
agcctttctcccaggc

SEQ ID NO: 5200219 - DNA, 13 bp, Homo sapiens
agcctttcttgta

SEQ ID NO: 5200220 - DNA, 23 bp, Homo sapiens
agcctttcttgtagccatggctg

SEQ ID NO: 5200221 - DNA, 15 bp, Homo sapiens
agcctttcttttctt

SEQ ID NO: 5200222 - DNA, 15 bp, Homo sapiens
agcctttcttttgga

SEQ ID NO: 5200223 - DNA, 16 bp, Homo sapiens
agcctttgaagtgcct

SEQ ID NO: 5200224 - DNA, 15 bp, Homo sapiens
agcctttgaatgtaa

SEQ ID NO: 5200225 - DNA, 13 bp, Homo sapiens
agcctttgacctg

SEQ ID NO: 5200226 - DNA, 19 bp, Homo sapiens
agcctttgacctgttcaga

SEQ ID NO: 5200227 - DNA, 14 bp, Homo sapiens
agcctttgagactg

SEQ ID NO: 5200228 - DNA, 15 bp, Homo sapiens
agcctttgagactgt

SEQ ID NO: 5200229 - DNA, 15 bp, Homo sapiens
agcctttgcctcccc

SEQ ID NO: 5200230 - DNA, 20 bp, Homo sapiens
agcctttgcgctctgggttt

SEQ ID NO: 5200231 - DNA, 15 bp, Homo sapiens
agcctttggaaacag

SEQ ID NO: 5200232 - DNA, 18 bp, Homo sapiens
agcctttggatgaccaga

SEQ ID NO: 5200233 - DNA, 16 bp, Homo sapiens
agcctttggctctgga

SEQ ID NO: 5200234 - DNA, 18 bp, Homo sapiens
agcctttggctctggaga

SEQ ID NO: 5200235 - DNA, 17 bp, Homo sapiens
agcctttgggtcctggg

SEQ ID NO: 5200236 - DNA, 18 bp, Homo sapiens
agcctttgggtcctgggc

SEQ ID NO: 5200237 - DNA, 17 bp, Homo sapiens
agcctttggtgaattcc

SEQ ID NO: 5200238 - DNA, 23 bp, Homo sapiens
agcctttgttaaccttaaataca

SEQ ID NO: 5200239 - DNA, 21 bp, Homo sapiens
agcctttgttccccactggag

SEQ ID NO: 5200240 - DNA, 24 bp, Homo sapiens
agcctttgttccccactggagcag

SEQ ID NO: 5200241 - DNA, 23 bp, Homo sapiens
agcctttgttgaactgttagaat

SEQ ID NO: 5200242 - DNA, 18 bp, Homo sapiens
agcctttgtttttctcca

SEQ ID NO: 5200243 - DNA, 17 bp, Homo sapiens
agccttttatctgcaga

SEQ ID NO: 5200244 - DNA, 17 bp, Homo sapiens
agccttttatgtatttt

SEQ ID NO: 5200245 - DNA, 22 bp, Homo sapiens
agccttttatgtattttccaag

SEQ ID NO: 5200246 - DNA, 20 bp, Homo sapiens
agccttttctggtccctctt

SEQ ID NO: 5200247 - DNA, 22 bp, Homo sapiens
agccttttctggtccctcttct

SEQ ID NO: 5200248 - DNA, 23 bp, Homo sapiens
agccttttctggtccctcttctc

SEQ ID NO: 5200249 - DNA, 13 bp, Homo sapiens
agccttttgcaaa

SEQ ID NO: 5200250 - DNA, 15 bp, Homo sapiens
agccttttgctctct

SEQ ID NO: 5200251 - DNA, 16 bp, Homo sapiens
agccttttgctctctg

SEQ ID NO: 5200252 - DNA, 22 bp, Homo sapiens
agccttttgtttcccttgcttt

SEQ ID NO: 5200253 - DNA, 16 bp, Homo sapiens
agcctttttaaaacac

SEQ ID NO: 5200254 - DNA, 19 bp, Homo sapiens
agcctttttaaaacacatg

SEQ ID NO: 5200255 - DNA, 20 bp, Homo sapiens
agcctttttaaaacacatgt

SEQ ID NO: 5200256 - DNA, 18 bp, Homo sapiens
agcctttttacctggcct

SEQ ID NO: 5200257 - DNA, 19 bp, Homo sapiens
agcctttttcaccatggca

SEQ ID NO: 5200258 - DNA, 21 bp, Homo sapiens
agcctttttgtataaaataga

SEQ ID NO: 5200259 - DNA, 18 bp, Homo sapiens
agcctttttgtttcaatg

SEQ ID NO: 5200260 - DNA, 23 bp, Homo sapiens
agccttttttccccagacttgtt

SEQ ID NO: 5200261 - DNA, 21 bp, Homo sapiens
agcctttttttaggccacatt

SEQ ID NO: 5200262 - DNA, 14 bp, Homo sapiens
agcgaaacacagag

SEQ ID NO: 5200263 - DNA, 13 bp, Homo sapiens
agcgaaagagcaa

SEQ ID NO: 5200264 - DNA, 15 bp, Homo sapiens
agcgaacagccttag

SEQ ID NO: 5200265 - DNA, 12 bp, Homo sapiens
agcgaacatctt

SEQ ID NO: 5200266 - DNA, 13 bp, Homo sapiens
agcgaacatcttc

SEQ ID NO: 5200267 - DNA, 22 bp, Homo sapiens
agcgaaccctttatttgaacaa

SEQ ID NO: 5200268 - DNA, 16 bp, Homo sapiens
agcgaaccgtgaggag

SEQ ID NO: 5200269 - DNA, 17 bp, Homo sapiens
agcgaaccgtgaggagg

SEQ ID NO: 5200270 - DNA, 19 bp, Homo sapiens
agcgaacgtatttctccag

SEQ ID NO: 5200271 - DNA, 20 bp, Homo sapiens
agcgaacgtatttctccaga

SEQ ID NO: 5200272 - DNA, 13 bp, Homo sapiens
agcgaacttcaca

SEQ ID NO: 5200273 - DNA, 16 bp, Homo sapiens
agcgaacttgacaatt

SEQ ID NO: 5200274 - DNA, 15 bp, Homo sapiens
agcgaagcagagagg

SEQ ID NO: 5200275 - DNA, 20 bp, Homo sapiens
agcgaagggggtcaaaggaa

SEQ ID NO: 5200276 - DNA, 13 bp, Homo sapiens
agcgaagtagctt

SEQ ID NO: 5200277 - DNA, 16 bp, Homo sapiens
agcgaatcatctcaaa

SEQ ID NO: 5200278 - DNA, 15 bp, Homo sapiens
agcgaattttaaaag

SEQ ID NO: 5200279 - DNA, 13 bp, Homo sapiens
agcgacacaggct

SEQ ID NO: 5200280 - DNA, 19 bp, Homo sapiens
agcgacatttctccaagtg

SEQ ID NO: 5200281 - DNA, 14 bp, Homo sapiens
agcgaccagcaggc

SEQ ID NO: 5200282 - DNA, 17 bp, Homo sapiens
agcgaccagcaggctcc

SEQ ID NO: 5200283 - DNA, 21 bp, Homo sapiens
agcgaccagcaggctcctcag

SEQ ID NO: 5200284 - DNA, 17 bp, Homo sapiens
agcgacccattcagaga

SEQ ID NO: 5200285 - DNA, 18 bp, Homo sapiens
agcgaccctggctctgcc

SEQ ID NO: 5200286 - DNA, 16 bp, Homo sapiens
agcgaccgaggccctc

SEQ ID NO: 5200287 - DNA, 15 bp, Homo sapiens
agcgaccgccccctc

SEQ ID NO: 5200288 - DNA, 18 bp, Homo sapiens
agcgacctaaacagctgc

SEQ ID NO: 5200289 - DNA, 16 bp, Homo sapiens
agcgacctctctgcct

SEQ ID NO: 5200290 - DNA, 16 bp, Homo sapiens
agcgactcccagctcc

SEQ ID NO: 5200291 - DNA, 16 bp, Homo sapiens
agcgactccgttggcc

SEQ ID NO: 5200292 - DNA, 17 bp, Homo sapiens
agcgactccgttggcca

SEQ ID NO: 5200293 - DNA, 18 bp, Homo sapiens
agcgactctcctgcctca

SEQ ID NO: 5200294 - DNA, 21 bp, Homo sapiens
agcgactctcctgcctcagcc

SEQ ID NO: 5200295 - DNA, 13 bp, Homo sapiens
agcgactggatgc

SEQ ID NO: 5200296 - DNA, 18 bp, Homo sapiens
agcgactggatgctcgcc

SEQ ID NO: 5200297 - DNA, 20 bp, Homo sapiens
agcgagaaccaggctgctgc

SEQ ID NO: 5200298 - DNA, 13 bp, Homo sapiens
agcgagactctgt

SEQ ID NO: 5200299 - DNA, 16 bp, Homo sapiens
agcgagagtctgtctc

SEQ ID NO: 5200300 - DNA, 21 bp, Homo sapiens
agcgagcaaatcctggcaagt

SEQ ID NO: 5200301 - DNA, 16 bp, Homo sapiens
agcgagcaagccggca

SEQ ID NO: 5200302 - DNA, 16 bp, Homo sapiens
agcgagcctggcaggt

SEQ ID NO: 5200303 - DNA, 16 bp, Homo sapiens
agcgagcctgtgcctt

SEQ ID NO: 5200304 - DNA, 23 bp, Homo sapiens
agcgagcctgtgccttcctcccc

SEQ ID NO: 5200305 - DNA, 14 bp, Homo sapiens
agcgagctgctctg

SEQ ID NO: 5200306 - DNA, 16 bp, Homo sapiens
agcgagctgctctgct

SEQ ID NO: 5200307 - DNA, 20 bp, Homo sapiens
agcgaggaggcgcggcctcc

SEQ ID NO: 5200308 - DNA, 15 bp, Homo sapiens
agcgaggaggctcca

SEQ ID NO: 5200309 - DNA, 15 bp, Homo sapiens
agcgaggcagaatgg

SEQ ID NO: 5200310 - DNA, 19 bp, Homo sapiens
agcgaggcagaatggtggg

SEQ ID NO: 5200311 - DNA, 14 bp, Homo sapiens
agcgaggctgggct

SEQ ID NO: 5200312 - DNA, 18 bp, Homo sapiens
agcgaggctgggctggcc

SEQ ID NO: 5200313 - DNA, 19 bp, Homo sapiens
agcgaggtcaacagagaag

SEQ ID NO: 5200314 - DNA, 23 bp, Homo sapiens
agcgaggtcaacagagaaggcag

SEQ ID NO: 5200315 - DNA, 15 bp, Homo sapiens
agcgaggtcagagga

SEQ ID NO: 5200316 - DNA, 16 bp, Homo sapiens
agcgaggtcagaggag

SEQ ID NO: 5200317 - DNA, 16 bp, Homo sapiens
agcgagtctggagacc

SEQ ID NO: 5200318 - DNA, 21 bp, Homo sapiens
agcgagtggagtctgccaccc

SEQ ID NO: 5200319 - DNA, 19 bp, Homo sapiens
agcgagtggatgctgtgct

SEQ ID NO: 5200320 - DNA, 22 bp, Homo sapiens
agcgatacacaaagctttcttt

SEQ ID NO: 5200321 - DNA, 15 bp, Homo sapiens
agcgatatacagatg

SEQ ID NO: 5200322 - DNA, 17 bp, Homo sapiens
agcgatcagccatggcg

SEQ ID NO: 5200323 - DNA, 20 bp, Homo sapiens
agcgatccctcccctcagcc

SEQ ID NO: 5200324 - DNA, 22 bp, Homo sapiens
aggaagggagtgaggggctgtg

SEQ ID NO: 5200325 - DNA, 23 bp, Homo sapiens
aggaagggagtgaggggctgtga

SEQ ID NO: 5200326 - DNA, 12 bp, Homo sapiens
aggaagggcaaa

SEQ ID NO: 5200327 - DNA, 12 bp, Homo sapiens
aggaagggcaga

SEQ ID NO: 5200328 - DNA, 13 bp, Homo sapiens
aggaagggcagag

SEQ ID NO: 5200329 - DNA, 17 bp, Homo sapiens
aggaagggcaggaagga

SEQ ID NO: 5200330 - DNA, 18 bp, Homo sapiens
aggaagggcatccttctg

SEQ ID NO: 5200331 - DNA, 18 bp, Homo sapiens
aggaagggccagagcctg

SEQ ID NO: 5200332 - DNA, 19 bp, Homo sapiens
aggaagggccaggagagag

SEQ ID NO: 5200333 - DNA, 21 bp, Homo sapiens
aggaagggccattttggtgct

SEQ ID NO: 5200334 - DNA, 23 bp, Homo sapiens
aggaagggcccccggctcggcct

SEQ ID NO: 5200335 - DNA, 12 bp, Homo sapiens
aggaagggctgg

SEQ ID NO: 5200336 - DNA, 14 bp, Homo sapiens
aggaagggctgggc

SEQ ID NO: 5200337 - DNA, 15 bp, Homo sapiens
aggaagggctgggcc

SEQ ID NO: 5200338 - DNA, 18 bp, Homo sapiens
aggaaggggacaggattg

SEQ ID NO: 5200339 - DNA, 18 bp, Homo sapiens
aggaaggggccccatggc

SEQ ID NO: 5200340 - DNA, 14 bp, Homo sapiens
aggaaggggctgga

SEQ ID NO: 5200341 - DNA, 19 bp, Homo sapiens
aggaaggggggttgcagtg

SEQ ID NO: 5200342 - DNA, 16 bp, Homo sapiens
aggaagggggttgtgg

SEQ ID NO: 5200343 - DNA, 17 bp, Homo sapiens
aggaaggggtgctgtga

SEQ ID NO: 5200344 - DNA, 23 bp, Homo sapiens
aggaaggggtgctgtgaggcttg

SEQ ID NO: 5200345 - DNA, 22 bp, Homo sapiens
aggaagggtggctttgcatttc

SEQ ID NO: 5200346 - DNA, 23 bp, Homo sapiens
aggaaggtaaaaacccagcggct

SEQ ID NO: 5200347 - DNA, 14 bp, Homo sapiens
aggaaggtactgta

SEQ ID NO: 5200348 - DNA, 12 bp, Homo sapiens
aggaaggtagcc

SEQ ID NO: 5200349 - DNA, 14 bp, Homo sapiens
aggaaggtcatttc

SEQ ID NO: 5200350 - DNA, 18 bp, Homo sapiens
aggaaggtctcatgcctg

SEQ ID NO: 5200351 - DNA, 21 bp, Homo sapiens
aggaaggtctcatgcctgaga

SEQ ID NO: 5200352 - DNA, 16 bp, Homo sapiens
aggaaggtctcattct

SEQ ID NO: 5200353 - DNA, 17 bp, Homo sapiens
aggaaggtctcattctt

SEQ ID NO: 5200354 - DNA, 18 bp, Homo sapiens
aggaaggtctgatttgca

SEQ ID NO: 5200355 - DNA, 19 bp, Homo sapiens
aggaaggtctgatttgcag

SEQ ID NO: 5200356 - DNA, 21 bp, Homo sapiens
aggaaggtctgatttgcagga

SEQ ID NO: 5200357 - DNA, 15 bp, Homo sapiens
aggaaggtgcctggc

SEQ ID NO: 5200358 - DNA, 15 bp, Homo sapiens
aggaaggtgctgagc

SEQ ID NO: 5200359 - DNA, 17 bp, Homo sapiens
aggaaggtgctgagctt

SEQ ID NO: 5200360 - DNA, 12 bp, Homo sapiens
aggaaggtggct

SEQ ID NO: 5200361 - DNA, 14 bp, Homo sapiens
aggaaggtggtggg

SEQ ID NO: 5200362 - DNA, 14 bp, Homo sapiens
aggaaggttctggt

SEQ ID NO: 5200363 - DNA, 21 bp, Homo sapiens
aggaaggttctggtgtgaact

SEQ ID NO: 5200364 - DNA, 21 bp, Homo sapiens
aggaagtaaagtgaagaattt

SEQ ID NO: 5200365 - DNA, 11 bp, Homo sapiens
aggaagtactg

SEQ ID NO: 5200366 - DNA, 19 bp, Homo sapiens
aggaagtactggagaaaat

SEQ ID NO: 5200367 - DNA, 14 bp, Homo sapiens
aggaagtagaaaca

SEQ ID NO: 5200368 - DNA, 15 bp, Homo sapiens
aggaagtagaaacaa

SEQ ID NO: 5200369 - DNA, 13 bp, Homo sapiens
aggaagtagagga

SEQ ID NO: 5200370 - DNA, 17 bp, Homo sapiens
aggaagtagcaggccca

SEQ ID NO: 5200371 - DNA, 18 bp, Homo sapiens
aggaagtcacagattctt

SEQ ID NO: 5200372 - DNA, 23 bp, Homo sapiens
aggaagtcagaatttttaactgt

SEQ ID NO: 5200373 - DNA, 14 bp, Homo sapiens
aggaagtcaggagc

SEQ ID NO: 5200374 - DNA, 18 bp, Homo sapiens
aggaagtcaggagccagc

SEQ ID NO: 5200375 - DNA, 19 bp, Homo sapiens
aggaagtcaggagccagca

SEQ ID NO: 5200376 - DNA, 17 bp, Homo sapiens
aggaagtcatcctgcaa

SEQ ID NO: 5200377 - DNA, 20 bp, Homo sapiens
aggaagtccctgagaagcct

SEQ ID NO: 5200378 - DNA, 23 bp, Homo sapiens
aggaagtccttatctagctgcat

SEQ ID NO: 5200379 - DNA, 18 bp, Homo sapiens
aggaagtctaggagctgg

SEQ ID NO: 5200380 - DNA, 16 bp, Homo sapiens
aggaagtctcatctgg

SEQ ID NO: 5200381 - DNA, 19 bp, Homo sapiens
aggaagtcttcaaatttga

SEQ ID NO: 5200382 - DNA, 14 bp, Homo sapiens
aggaagtgaaccca

SEQ ID NO: 5200383 - DNA, 18 bp, Homo sapiens
aggaagtgacttgaatgt

SEQ ID NO: 5200384 - DNA, 19 bp, Homo sapiens
aggaagtgacttgaatgta

SEQ ID NO: 5200385 - DNA, 14 bp, Homo sapiens
aggaagtgaggtag

SEQ ID NO: 5200386 - DNA, 13 bp, Homo sapiens
aggaagtggaatg

SEQ ID NO: 5200387 - DNA, 15 bp, Homo sapiens
aggaagtggctcaga

SEQ ID NO: 5200388 - DNA, 17 bp, Homo sapiens
aggaagtggctgtccct

SEQ ID NO: 5200389 - DNA, 22 bp, Homo sapiens
aggaagtgggagaagtggcccc

SEQ ID NO: 5200390 - DNA, 17 bp, Homo sapiens
aggaagtggggacagat

SEQ ID NO: 5200391 - DNA, 18 bp, Homo sapiens
aggaagtggggacagatt

SEQ ID NO: 5200392 - DNA, 19 bp, Homo sapiens
aggaagtggggacagattc

SEQ ID NO: 5200393 - DNA, 14 bp, Homo sapiens
aggaagtgggggcc

SEQ ID NO: 5200394 - DNA, 18 bp, Homo sapiens
aggaagtgggggccgctg

SEQ ID NO: 5200395 - DNA, 19 bp, Homo sapiens
aggaagtgggggccgctgg

SEQ ID NO: 5200396 - DNA, 22 bp, Homo sapiens
aggaagtgggggccgctggccc

SEQ ID NO: 5200397 - DNA, 16 bp, Homo sapiens
aggaagtggggtctgg

SEQ ID NO: 5200398 - DNA, 16 bp, Homo sapiens
aggaagtgtaacagct

SEQ ID NO: 5200399 - DNA, 14 bp, Homo sapiens
aggaagtgtttatg

SEQ ID NO: 5200400 - DNA, 22 bp, Homo sapiens
aggaagttagtttttaatctct

SEQ ID NO: 5200401 - DNA, 23 bp, Homo sapiens
aggaagttattaacgggcatgta

SEQ ID NO: 5200402 - DNA, 12 bp, Homo sapiens
aggaagttctcc

SEQ ID NO: 5200403 - DNA, 19 bp, Homo sapiens
aggaagttctccagcttca

SEQ ID NO: 5200404 - DNA, 20 bp, Homo sapiens
aggaagttgctgagaaatgg

SEQ ID NO: 5200405 - DNA, 20 bp, Homo sapiens
aggaagttttgagtttctct

SEQ ID NO: 5200406 - DNA, 19 bp, Homo sapiens
aggaagttttgtctaatta

SEQ ID NO: 5200407 - DNA, 22 bp, Homo sapiens
aggaataaaaccatcctgtttg

SEQ ID NO: 5200408 - DNA, 19 bp, Homo sapiens
aggaataaagctgtgagca

SEQ ID NO: 5200409 - DNA, 13 bp, Homo sapiens
aggaataaagctt

SEQ ID NO: 5200410 - DNA, 14 bp, Homo sapiens
aggaataaagcttc

SEQ ID NO: 5200411 - DNA, 15 bp, Homo sapiens
aggaataaagcttct

SEQ ID NO: 5200412 - DNA, 16 bp, Homo sapiens
aggaataaagcttctc

SEQ ID NO: 5200413 - DNA, 23 bp, Homo sapiens
aggaataaagcttctctctgagc

SEQ ID NO: 5200414 - DNA, 14 bp, Homo sapiens
aggaataaatgaga

SEQ ID NO: 5200415 - DNA, 14 bp, Homo sapiens
aggaataaatgcct

SEQ ID NO: 5200416 - DNA, 19 bp, Homo sapiens
aggaataaattgctccttg

SEQ ID NO: 5200417 - DNA, 13 bp, Homo sapiens
aggaataagcatt

SEQ ID NO: 5200418 - DNA, 22 bp, Homo sapiens
aggaataaggatgttgttatga

SEQ ID NO: 5200419 - DNA, 18 bp, Homo sapiens
aggaataagggggcaaca

SEQ ID NO: 5200420 - DNA, 12 bp, Homo sapiens
aggaataataaa

SEQ ID NO: 5200421 - DNA, 19 bp, Homo sapiens
aggaataatgttttgggaa

SEQ ID NO: 5200422 - DNA, 22 bp, Homo sapiens
aggaatacctgtccccctgaca

SEQ ID NO: 5200423 - DNA, 13 bp, Homo sapiens
aggaatactgttt

SEQ ID NO: 5200424 - DNA, 21 bp, Homo sapiens
aggaatactgttttatctcca

SEQ ID NO: 5200425 - DNA, 18 bp, Homo sapiens
aggaatagagttttcctc

SEQ ID NO: 5200426 - DNA, 18 bp, Homo sapiens
aggaatagcaaaattcct

SEQ ID NO: 5200427 - DNA, 18 bp, Homo sapiens
aggaatagcatgtcacta

SEQ ID NO: 5200428 - DNA, 16 bp, Homo sapiens
aggaatagcccgagga

SEQ ID NO: 5200429 - DNA, 17 bp, Homo sapiens
aggaatagttgagcccc

SEQ ID NO: 5200430 - DNA, 21 bp, Homo sapiens
aggaatagttgagccccaagt

SEQ ID NO: 5200431 - DNA, 22 bp, Homo sapiens
aggaatatacatagtctttgtt

SEQ ID NO: 5200432 - DNA, 20 bp, Homo sapiens
aggaatataccacaccgagg

SEQ ID NO: 5200433 - DNA, 19 bp, Homo sapiens
aggaatatagattaaatca

SEQ ID NO: 5200434 - DNA, 22 bp, Homo sapiens
aggaatatatatggaataagtg

SEQ ID NO: 5200435 - DNA, 23 bp, Homo sapiens
aggaatatatggcagagttgtaa

SEQ ID NO: 5200436 - DNA, 19 bp, Homo sapiens
aggaatatgactcaggagc

SEQ ID NO: 5200437 - DNA, 20 bp, Homo sapiens
aggaatatgactcaggagcc

SEQ ID NO: 5200438 - DNA, 15 bp, Homo sapiens
aggaatatgttcaat

SEQ ID NO: 5200439 - DNA, 17 bp, Homo sapiens
aggaatcaaaaattgaa

SEQ ID NO: 5200440 - DNA, 20 bp, Homo sapiens
aggaatcaaatcttacaaaa

SEQ ID NO: 5200441 - DNA, 15 bp, Homo sapiens
aggaatcaacagggc

SEQ ID NO: 5200442 - DNA, 19 bp, Homo sapiens
aggaatcacccctctgccc

SEQ ID NO: 5200443 - DNA, 19 bp, Homo sapiens
aggaatcacttttaactgt

SEQ ID NO: 5200444 - DNA, 16 bp, Homo sapiens
aggaatcatgttggat

SEQ ID NO: 5200445 - DNA, 23 bp, Homo sapiens
aggaatcattcagaaatgttgag

SEQ ID NO: 5200446 - DNA, 18 bp, Homo sapiens
aggaatcattccagtgct

SEQ ID NO: 5200447 - DNA, 21 bp, Homo sapiens
aggaatcattccagtgctaga

SEQ ID NO: 5200448 - DNA, 16 bp, Homo sapiens
aggaatcattctgtaa

SEQ ID NO: 5200449 - DNA, 16 bp, Homo sapiens
aggaatccactcccag

SEQ ID NO: 5200450 - DNA, 17 bp, Homo sapiens
aggaatccactcccagg

SEQ ID NO: 5200451 - DNA, 20 bp, Homo sapiens
aggaatccagacccggctgc

SEQ ID NO: 5200452 - DNA, 23 bp, Homo sapiens
aggaatccagacccggctgcgtg

SEQ ID NO: 5200453 - DNA, 23 bp, Homo sapiens
aggaatcccggctccagagcagg

SEQ ID NO: 5200454 - DNA, 14 bp, Homo sapiens
aggaatcctggcag

SEQ ID NO: 5200455 - DNA, 19 bp, Homo sapiens
aggaatccttactgatatt

SEQ ID NO: 5200456 - DNA, 15 bp, Homo sapiens
aggaatcctttgaga

SEQ ID NO: 5200457 - DNA, 16 bp, Homo sapiens
aggaatcggctgggga

SEQ ID NO: 5200458 - DNA, 23 bp, Homo sapiens
aggaatcggctggggactgctac

SEQ ID NO: 5200459 - DNA, 13 bp, Homo sapiens
aggaatctcttca

SEQ ID NO: 5200460 - DNA, 22 bp, Homo sapiens
aggaatctcttcactaccctga

SEQ ID NO: 5200461 - DNA, 19 bp, Homo sapiens
aggaatctgaaagtatatt

SEQ ID NO: 5200462 - DNA, 16 bp, Homo sapiens
aggaatctgccttcca

SEQ ID NO: 5200463 - DNA, 18 bp, Homo sapiens
aggaatctgccttccagc

SEQ ID NO: 5200464 - DNA, 20 bp, Homo sapiens
aggaatctgccttccagccc

SEQ ID NO: 5200465 - DNA, 20 bp, Homo sapiens
aggaatctgtgcagatgagc

SEQ ID NO: 5200466 - DNA, 19 bp, Homo sapiens
aggaatctgtgggtctggg

SEQ ID NO: 5200467 - DNA, 12 bp, Homo sapiens
aggaatctgtgt

SEQ ID NO: 5200468 - DNA, 14 bp, Homo sapiens
aggaatctgtttct

SEQ ID NO: 5200469 - DNA, 17 bp, Homo sapiens
aggaatctgtttctctg

SEQ ID NO: 5200470 - DNA, 16 bp, Homo sapiens
aggaatctttaaaaga

SEQ ID NO: 5200471 - DNA, 17 bp, Homo sapiens
aggaatcttttactgtg

SEQ ID NO: 5200472 - DNA, 23 bp, Homo sapiens
aggaatgaaatcctgcttcagtg

SEQ ID NO: 5200473 - DNA, 13 bp, Homo sapiens
aggaatgaacttg

SEQ ID NO: 5200474 - DNA, 14 bp, Homo sapiens
aggaatgaacttgt

SEQ ID NO: 5200475 - DNA, 16 bp, Homo sapiens
aggaatgaacttgtta

SEQ ID NO: 5200476 - DNA, 15 bp, Homo sapiens
aggaatgaagaactg

SEQ ID NO: 5200477 - DNA, 22 bp, Homo sapiens
aggaatgaagaactgttgccta

SEQ ID NO: 5200478 - DNA, 20 bp, Homo sapiens
aggaatgacccttttgtgtc

SEQ ID NO: 5200479 - DNA, 14 bp, Homo sapiens
aggaatgagaagta

SEQ ID NO: 5200480 - DNA, 12 bp, Homo sapiens
aggaatgagaat

SEQ ID NO: 5200481 - DNA, 15 bp, Homo sapiens
aggaatgatattgct

SEQ ID NO: 5200482 - DNA, 15 bp, Homo sapiens
aggaatgcaaagatg

SEQ ID NO: 5200483 - DNA, 12 bp, Homo sapiens
aggaatgcaaga

SEQ ID NO: 5200484 - DNA, 16 bp, Homo sapiens
aggaatgcaagagaag

SEQ ID NO: 5200485 - DNA, 20 bp, Homo sapiens
aggaatgcaagagaaggaga

SEQ ID NO: 5200486 - DNA, 15 bp, Homo sapiens
aggaatgcacaaatt

SEQ ID NO: 5200487 - DNA, 23 bp, Homo sapiens
aggaatgcacaaattgaaaacac

SEQ ID NO: 5200488 - DNA, 19 bp, Homo sapiens
aggaatgcaccacggcagc

SEQ ID NO: 5200489 - DNA, 14 bp, Homo sapiens
aggaatgcctgtgc

SEQ ID NO: 5200490 - DNA, 17 bp, Homo sapiens
aggaatgcctgtgccaa

SEQ ID NO: 5200491 - DNA, 19 bp, Homo sapiens
aggaatgcggttcagggct

SEQ ID NO: 5200492 - DNA, 12 bp, Homo sapiens
aggaatgctcaa

SEQ ID NO: 5200493 - DNA, 15 bp, Homo sapiens
aggaatgctcaatgt

SEQ ID NO: 5200494 - DNA, 15 bp, Homo sapiens
aggaatgctctgtgc

SEQ ID NO: 5200495 - DNA, 22 bp, Homo sapiens
aggaatgctgacaatgctgcca

SEQ ID NO: 5200496 - DNA, 24 bp, Homo sapiens
aggaatgcttggaatatctgctgt

SEQ ID NO: 5200497 - DNA, 14 bp, Homo sapiens
aggaatggaagtcc

SEQ ID NO: 5200498 - DNA, 12 bp, Homo sapiens
aggaatggacag

SEQ ID NO: 5200499 - DNA, 15 bp, Homo sapiens
aggaatggacatttc

SEQ ID NO: 5200500 - DNA, 18 bp, Homo sapiens
aggaatggaggagccagg

SEQ ID NO: 5200501 - DNA, 23 bp, Homo sapiens
aggaatggaggagccaggcccca

SEQ ID NO: 5200502 - DNA, 18 bp, Homo sapiens
agcgatctctcctggcct

SEQ ID NO: 5200503 - DNA, 19 bp, Homo sapiens
agcgatgaatttggagact

SEQ ID NO: 5200504 - DNA, 21 bp, Homo sapiens
agcgatgatgtccccttccct

SEQ ID NO: 5200505 - DNA, 18 bp, Homo sapiens
agcgatggtctcagaaac

SEQ ID NO: 5200506 - DNA, 16 bp, Homo sapiens
agcgatgtgcaggaag

SEQ ID NO: 5200507 - DNA, 17 bp, Homo sapiens
agcgattattgatcaaa

SEQ ID NO: 5200508 - DNA, 15 bp, Homo sapiens
agcgattcttctgct

SEQ ID NO: 5200509 - DNA, 22 bp, Homo sapiens
agcgattcttctgcttcagcct

SEQ ID NO: 5200510 - DNA, 18 bp, Homo sapiens
agcgcaagccacagcctg

SEQ ID NO: 5200511 - DNA, 15 bp, Homo sapiens
agcgcacagctgctc

SEQ ID NO: 5200512 - DNA, 20 bp, Homo sapiens
agcgcacctcgccgtgtctt

SEQ ID NO: 5200513 - DNA, 21 bp, Homo sapiens
agcgcacctgccccctggtgg

SEQ ID NO: 5200514 - DNA, 18 bp, Homo sapiens
agcgcacctgcttccccc

SEQ ID NO: 5200515 - DNA, 12 bp, Homo sapiens
agcgcagagaaa

SEQ ID NO: 5200516 - DNA, 15 bp, Homo sapiens
agcgcagagcgggct

SEQ ID NO: 5200517 - DNA, 19 bp, Homo sapiens
agcgcagcagccctccccg

SEQ ID NO: 5200518 - DNA, 12 bp, Homo sapiens
agcgcagccccc

SEQ ID NO: 5200519 - DNA, 11 bp, Homo sapiens
agcgcagcccg

SEQ ID NO: 5200520 - DNA, 18 bp, Homo sapiens
agcgcagccgagccccag

SEQ ID NO: 5200521 - DNA, 23 bp, Homo sapiens
agcgcagccgccgggcaggcctg

SEQ ID NO: 5200522 - DNA, 15 bp, Homo sapiens
agcgcagcgcctcca

SEQ ID NO: 5200523 - DNA, 17 bp, Homo sapiens
agcgcagcgcctccacc

SEQ ID NO: 5200524 - DNA, 16 bp, Homo sapiens
agcgcaggcagcgcag

SEQ ID NO: 5200525 - DNA, 16 bp, Homo sapiens
agcgcaggctgcagag

SEQ ID NO: 5200526 - DNA, 21 bp, Homo sapiens
agcgcaggctgcagagcccgg

SEQ ID NO: 5200527 - DNA, 12 bp, Homo sapiens
agcgcagggagg

SEQ ID NO: 5200528 - DNA, 14 bp, Homo sapiens
agcgcagggaggat

SEQ ID NO: 5200529 - DNA, 18 bp, Homo sapiens
agcgcagggaggatgcca

SEQ ID NO: 5200530 - DNA, 12 bp, Homo sapiens
agcgcagggctg

SEQ ID NO: 5200531 - DNA, 17 bp, Homo sapiens
agcgccaaatgttcatc

SEQ ID NO: 5200532 - DNA, 21 bp, Homo sapiens
agcgccaagcaacctgggtcc

SEQ ID NO: 5200533 - DNA, 19 bp, Homo sapiens
agcgccagcctcagactgg

SEQ ID NO: 5200534 - DNA, 12 bp, Homo sapiens
agcgccagctcc

SEQ ID NO: 5200535 - DNA, 13 bp, Homo sapiens
agcgccagctcct

SEQ ID NO: 5200536 - DNA, 17 bp, Homo sapiens
agcgccaggaagccaga

SEQ ID NO: 5200537 - DNA, 22 bp, Homo sapiens
agcgccaggaagccagagcccc

SEQ ID NO: 5200538 - DNA, 21 bp, Homo sapiens
agcgccaggctgaccacagca

SEQ ID NO: 5200539 - DNA, 16 bp, Homo sapiens
agcgccagggcccagg

SEQ ID NO: 5200540 - DNA, 16 bp, Homo sapiens
agcgcccacccaggtc

SEQ ID NO: 5200541 - DNA, 18 bp, Homo sapiens
agcgcccacccaggtccc

SEQ ID NO: 5200542 - DNA, 22 bp, Homo sapiens
agcgcccagttgggtggatgcc

SEQ ID NO: 5200543 - DNA, 14 bp, Homo sapiens
agcgcccccactcc

SEQ ID NO: 5200544 - DNA, 19 bp, Homo sapiens
agcgcccccaggcctgccc

SEQ ID NO: 5200545 - DNA, 22 bp, Homo sapiens
agcgcccccaggcctgccctgc

SEQ ID NO: 5200546 - DNA, 18 bp, Homo sapiens
agcgccccggccggcggc

SEQ ID NO: 5200547 - DNA, 12 bp, Homo sapiens
agcgcccctcag

SEQ ID NO: 5200548 - DNA, 20 bp, Homo sapiens
agcgcccctcagcctctgcc

SEQ ID NO: 5200549 - DNA, 21 bp, Homo sapiens
agcgcccctcagcctctgcca

SEQ ID NO: 5200550 - DNA, 14 bp, Homo sapiens
agcgcccctgctgt

SEQ ID NO: 5200551 - DNA, 19 bp, Homo sapiens
agcgcccgaggccagggcc

SEQ ID NO: 5200552 - DNA, 15 bp, Homo sapiens
agcgcccgctgggct

SEQ ID NO: 5200553 - DNA, 16 bp, Homo sapiens
agcgcccgctgggctg

SEQ ID NO: 5200554 - DNA, 19 bp, Homo sapiens
agcgcccgctgggctgagc

SEQ ID NO: 5200555 - DNA, 14 bp, Homo sapiens
agcgcccggtgctc

SEQ ID NO: 5200556 - DNA, 14 bp, Homo sapiens
agcgccctgcagac

SEQ ID NO: 5200557 - DNA, 16 bp, Homo sapiens
agcgccctgcagaccc

SEQ ID NO: 5200558 - DNA, 17 bp, Homo sapiens
agcgccctgcagaccct

SEQ ID NO: 5200559 - DNA, 18 bp, Homo sapiens
agcgccctgcagaccctg

SEQ ID NO: 5200560 - DNA, 20 bp, Homo sapiens
agcgccctgcagaccctgcc

SEQ ID NO: 5200561 - DNA, 15 bp, Homo sapiens
agcgccctgcagggc

SEQ ID NO: 5200562 - DNA, 16 bp, Homo sapiens
agcgccctgcagggcc

SEQ ID NO: 5200563 - DNA, 13 bp, Homo sapiens
agcgcccttcctc

SEQ ID NO: 5200564 - DNA, 14 bp, Homo sapiens
agcgcccttcctct

SEQ ID NO: 5200565 - DNA, 23 bp, Homo sapiens
agcgccgactccctgagtctgga

SEQ ID NO: 5200566 - DNA, 18 bp, Homo sapiens
agcgccgtccggcggccc

SEQ ID NO: 5200567 - DNA, 18 bp, Homo sapiens
agcgccgtgctgtaaata

SEQ ID NO: 5200568 - DNA, 18 bp, Homo sapiens
agcgcctattgtttgtaa

SEQ ID NO: 5200569 - DNA, 18 bp, Homo sapiens
agcgcctccaaccctagc

SEQ ID NO: 5200570 - DNA, 22 bp, Homo sapiens
agcgcctccaaccctagcaaaa

SEQ ID NO: 5200571 - DNA, 23 bp, Homo sapiens
agcgcctccaaccctagcaaaag

SEQ ID NO: 5200572 - DNA, 19 bp, Homo sapiens
agcgcctccaccctgccct

SEQ ID NO: 5200573 - DNA, 20 bp, Homo sapiens
agcgcctccaccctgccctg

SEQ ID NO: 5200574 - DNA, 12 bp, Homo sapiens
agcgcctcccgc

SEQ ID NO: 5200575 - DNA, 12 bp, Homo sapiens
agcgcctccctc

SEQ ID NO: 5200576 - DNA, 14 bp, Homo sapiens
agcgcctccctcca

SEQ ID NO: 5200577 - DNA, 15 bp, Homo sapiens
agcgcctccctccac

SEQ ID NO: 5200578 - DNA, 18 bp, Homo sapiens
agcgcctccctccacccc

SEQ ID NO: 5200579 - DNA, 19 bp, Homo sapiens
agcgcctccctccacccca

SEQ ID NO: 5200580 - DNA, 22 bp, Homo sapiens
agcgcctccctccaccccagga

SEQ ID NO: 5200581 - DNA, 12 bp, Homo sapiens
agcgcctcctgg

SEQ ID NO: 5200582 - DNA, 15 bp, Homo sapiens
agcgcctcctggaca

SEQ ID NO: 5200583 - DNA, 16 bp, Homo sapiens
agcgcctcgccccagc

SEQ ID NO: 5200584 - DNA, 18 bp, Homo sapiens
agcgcctcgccccagcca

SEQ ID NO: 5200585 - DNA, 20 bp, Homo sapiens
agcgcctcgccccagccaag

SEQ ID NO: 5200586 - DNA, 21 bp, Homo sapiens
agcgcctcgccccagccaagc

SEQ ID NO: 5200587 - DNA, 13 bp, Homo sapiens
agcgcctcttcct

SEQ ID NO: 5200588 - DNA, 22 bp, Homo sapiens
agcgcctgaccctggtgggctg

SEQ ID NO: 5200589 - DNA, 20 bp, Homo sapiens
agcgcctgccctccctgggg

SEQ ID NO: 5200590 - DNA, 21 bp, Homo sapiens
agcgcctgccctccctggggt

SEQ ID NO: 5200591 - DNA, 17 bp, Homo sapiens
agcgcctggccttgtgt

SEQ ID NO: 5200592 - DNA, 15 bp, Homo sapiens
agcgcctggctgctg

SEQ ID NO: 5200593 - DNA, 17 bp, Homo sapiens
agcgcctggctgctgct

SEQ ID NO: 5200594 - DNA, 12 bp, Homo sapiens
agcgcctgtccc

SEQ ID NO: 5200595 - DNA, 19 bp, Homo sapiens
agcgcctgtcccctcacag

SEQ ID NO: 5200596 - DNA, 15 bp, Homo sapiens
agcgcctgtgcacac

SEQ ID NO: 5200597 - DNA, 24 bp, Homo sapiens
agcgcctgtgctgaggactccctc

SEQ ID NO: 5200598 - DNA, 20 bp, Homo sapiens
agcgcgccactcgcttcccc

SEQ ID NO: 5200599 - DNA, 22 bp, Homo sapiens
agcgcgcgtgatagaagaaaag

SEQ ID NO: 5200600 - DNA, 22 bp, Homo sapiens
agcgcgctcctgacccctccct

SEQ ID NO: 5200601 - DNA, 21 bp, Homo sapiens
agcgcggacccttctgggtcc

SEQ ID NO: 5200602 - DNA, 22 bp, Homo sapiens
agcgcggatttctctttctctc

SEQ ID NO: 5200603 - DNA, 18 bp, Homo sapiens
agcgcggccctcccgagt

SEQ ID NO: 5200604 - DNA, 15 bp, Homo sapiens
agcgcggctaactta

SEQ ID NO: 5200605 - DNA, 13 bp, Homo sapiens
agcgcggctggct

SEQ ID NO: 5200606 - DNA, 17 bp, Homo sapiens
agcgcggcttggccgcc

SEQ ID NO: 5200607 - DNA, 14 bp, Homo sapiens
agcgcgggcggagg

SEQ ID NO: 5200608 - DNA, 16 bp, Homo sapiens
agcgcgggcggaggcg

SEQ ID NO: 5200609 - DNA, 21 bp, Homo sapiens
agcgcggttttttccacgcag

SEQ ID NO: 5200610 - DNA, 14 bp, Homo sapiens
agcgcgtgcacagc

SEQ ID NO: 5200611 - DNA, 16 bp, Homo sapiens
agcgcgtgccttcccc

SEQ ID NO: 5200612 - DNA, 15 bp, Homo sapiens
agcgcgttgcctgtc

SEQ ID NO: 5200613 - DNA, 14 bp, Homo sapiens
agcgctaagtaaaa

SEQ ID NO: 5200614 - DNA, 17 bp, Homo sapiens
agcgctaagtaaaaata

SEQ ID NO: 5200615 - DNA, 16 bp, Homo sapiens
agcgctagtgccttgc

SEQ ID NO: 5200616 - DNA, 22 bp, Homo sapiens
agcgctagtgccttgcccacag

SEQ ID NO: 5200617 - DNA, 17 bp, Homo sapiens
agcgctatctccctgcc

SEQ ID NO: 5200618 - DNA, 18 bp, Homo sapiens
agcgctatgggtgttaac

SEQ ID NO: 5200619 - DNA, 13 bp, Homo sapiens
agcgctccagggc

SEQ ID NO: 5200620 - DNA, 14 bp, Homo sapiens
agcgctccagggcc

SEQ ID NO: 5200621 - DNA, 16 bp, Homo sapiens
agcgctcccagcctgc

SEQ ID NO: 5200622 - DNA, 20 bp, Homo sapiens
agcgctcccagcctgccctc

SEQ ID NO: 5200623 - DNA, 15 bp, Homo sapiens
agcgctcccttttca

SEQ ID NO: 5200624 - DNA, 17 bp, Homo sapiens
agcgctcctcctgtgtg

SEQ ID NO: 5200625 - DNA, 22 bp, Homo sapiens
agcgctcctcctgtgtgactgg

SEQ ID NO: 5200626 - DNA, 15 bp, Homo sapiens
agcgctcctctgcct

SEQ ID NO: 5200627 - DNA, 22 bp, Homo sapiens
agcgctcctgccgcagagctgg

SEQ ID NO: 5200628 - DNA, 20 bp, Homo sapiens
agcgctcgatggacctcagc

SEQ ID NO: 5200629 - DNA, 23 bp, Homo sapiens
agcgctcgccacgctcagtgccc

SEQ ID NO: 5200630 - DNA, 22 bp, Homo sapiens
agcgctcggcccggagcagcag

SEQ ID NO: 5200631 - DNA, 14 bp, Homo sapiens
agcgctctcctgga

SEQ ID NO: 5200632 - DNA, 11 bp, Homo sapiens
agcgctctgga

SEQ ID NO: 5200633 - DNA, 14 bp, Homo sapiens
agcgctctggacag

SEQ ID NO: 5200634 - DNA, 21 bp, Homo sapiens
agcgctgcagtagctgtggcc

SEQ ID NO: 5200635 - DNA, 19 bp, Homo sapiens
agcgctgcccacaccaccg

SEQ ID NO: 5200636 - DNA, 16 bp, Homo sapiens
agcgctgccctgtgag

SEQ ID NO: 5200637 - DNA, 17 bp, Homo sapiens
agcgctgccgcacccca

SEQ ID NO: 5200638 - DNA, 20 bp, Homo sapiens
agcgctgccgcaccccagag

SEQ ID NO: 5200639 - DNA, 16 bp, Homo sapiens
agcgctggctcaggaa

SEQ ID NO: 5200640 - DNA, 20 bp, Homo sapiens
agcgctggctccctgggcag

SEQ ID NO: 5200641 - DNA, 16 bp, Homo sapiens
agcgctgtggactgtc

SEQ ID NO: 5200642 - DNA, 19 bp, Homo sapiens
agcgctgttgatcccctct

SEQ ID NO: 5200643 - DNA, 22 bp, Homo sapiens
agcgcttagaaacatgttcctg

SEQ ID NO: 5200644 - DNA, 22 bp, Homo sapiens
agcgcttctttctgactctaaa

SEQ ID NO: 5200645 - DNA, 16 bp, Homo sapiens
agcgcttttccttggc

SEQ ID NO: 5200646 - DNA, 17 bp, Homo sapiens
agcggaacatgtgcttc

SEQ ID NO: 5200647 - DNA, 22 bp, Homo sapiens
agcggaataaactagagaaggg

SEQ ID NO: 5200648 - DNA, 14 bp, Homo sapiens
agcggacagtggca

SEQ ID NO: 5200649 - DNA, 15 bp, Homo sapiens
agcggacagtggcag

SEQ ID NO: 5200650 - DNA, 18 bp, Homo sapiens
agcggagacggagtccca

SEQ ID NO: 5200651 - DNA, 15 bp, Homo sapiens
agcggagcccagcct

SEQ ID NO: 5200652 - DNA, 17 bp, Homo sapiens
agcggagcccagcctgg

SEQ ID NO: 5200653 - DNA, 19 bp, Homo sapiens
agcggagcttggccctgcg

SEQ ID NO: 5200654 - DNA, 15 bp, Homo sapiens
agcggaggagaccag

SEQ ID NO: 5200655 - DNA, 21 bp, Homo sapiens
agcggaggagaccagctcaga

SEQ ID NO: 5200656 - DNA, 11 bp, Homo sapiens
agcggaggggt

SEQ ID NO: 5200657 - DNA, 23 bp, Homo sapiens
agcggaggggtttgggagtcagg

SEQ ID NO: 5200658 - DNA, 21 bp, Homo sapiens
agcggaggttgcagtgagctg

SEQ ID NO: 5200659 - DNA, 17 bp, Homo sapiens
agcggagtctgtcctgt

SEQ ID NO: 5200660 - DNA, 19 bp, Homo sapiens
agcggagttcctaacagga

SEQ ID NO: 5200661 - DNA, 16 bp, Homo sapiens
agcggatcacaaggtc

SEQ ID NO: 5200662 - DNA, 17 bp, Homo sapiens
agcggattgctctggag

SEQ ID NO: 5200663 - DNA, 12 bp, Homo sapiens
agcggcatagca

SEQ ID NO: 5200664 - DNA, 15 bp, Homo sapiens
agcggcatcaggctt

SEQ ID NO: 5200665 - DNA, 21 bp, Homo sapiens
agcggcatttagtacatccag

SEQ ID NO: 5200666 - DNA, 17 bp, Homo sapiens
agcggcccaagagcccg

SEQ ID NO: 5200667 - DNA, 23 bp, Homo sapiens
agcggccccccgcacagccaccc

SEQ ID NO: 5200668 - DNA, 20 bp, Homo sapiens
agcggccccgcacccctcct

SEQ ID NO: 5200669 - DNA, 13 bp, Homo sapiens
agcggccccgcgg

SEQ ID NO: 5200670 - DNA, 20 bp, Homo sapiens
agcggccccttgactctggg

SEQ ID NO: 5200671 - DNA, 17 bp, Homo sapiens
agcggcccggcccacgc

SEQ ID NO: 5200672 - DNA, 18 bp, Homo sapiens
agcggcccggcccacgca

SEQ ID NO: 5200673 - DNA, 15 bp, Homo sapiens
agcggccctcccagg

SEQ ID NO: 5200674 - DNA, 14 bp, Homo sapiens
agcggccctgtcat

SEQ ID NO: 5200675 - DNA, 16 bp, Homo sapiens
agcggccctgtgtgtt

SEQ ID NO: 5200676 - DNA, 11 bp, Homo sapiens
agcggccggcc

SEQ ID NO: 5200677 - DNA, 18 bp, Homo sapiens
agcggccggccagcccct

SEQ ID NO: 5200678 - DNA, 21 bp, Homo sapiens
agcggcctcagggtctaagga

SEQ ID NO: 5200679 - DNA, 20 bp, Homo sapiens
agcggcgcagagccctccag

SEQ ID NO: 5200680 - DNA, 14 bp, Homo sapiens
agcggcgccctgga

SEQ ID NO: 5200681 - DNA, 19 bp, Homo sapiens
aggaatgggccaagccagg

SEQ ID NO: 5200682 - DNA, 21 bp, Homo sapiens
aggaatgggccaagccagggt

SEQ ID NO: 5200683 - DNA, 13 bp, Homo sapiens
aggaatgggctgt

SEQ ID NO: 5200684 - DNA, 15 bp, Homo sapiens
aggaatgggggtcag

SEQ ID NO: 5200685 - DNA, 13 bp, Homo sapiens
aggaatggtgctt

SEQ ID NO: 5200686 - DNA, 21 bp, Homo sapiens
aggaatggtgcttggcaggaa

SEQ ID NO: 5200687 - DNA, 17 bp, Homo sapiens
aggaatgtcagggccag

SEQ ID NO: 5200688 - DNA, 16 bp, Homo sapiens
aggaatgtgaaattta

SEQ ID NO: 5200689 - DNA, 15 bp, Homo sapiens
aggaatgtgtccaag

SEQ ID NO: 5200690 - DNA, 20 bp, Homo sapiens
aggaatgtgtccaagacaca

SEQ ID NO: 5200691 - DNA, 14 bp, Homo sapiens
aggaatgttaaagt

SEQ ID NO: 5200692 - DNA, 22 bp, Homo sapiens
aggaatgttaaagtcagtggga

SEQ ID NO: 5200693 - DNA, 18 bp, Homo sapiens
aggaatgttatcagtatt

SEQ ID NO: 5200694 - DNA, 17 bp, Homo sapiens
aggaattaagttatctt

SEQ ID NO: 5200695 - DNA, 15 bp, Homo sapiens
aggaattactttatt

SEQ ID NO: 5200696 - DNA, 20 bp, Homo sapiens
aggaattactttattataaa

SEQ ID NO: 5200697 - DNA, 22 bp, Homo sapiens
aggaattactttattataaaat

SEQ ID NO: 5200698 - DNA, 19 bp, Homo sapiens
aggaattagagaagctgaa

SEQ ID NO: 5200699 - DNA, 19 bp, Homo sapiens
aggaattcaatttggcaaa

SEQ ID NO: 5200700 - DNA, 20 bp, Homo sapiens
aggaattcaatttggcaaaa

SEQ ID NO: 5200701 - DNA, 15 bp, Homo sapiens
aggaattcagtgcct

SEQ ID NO: 5200702 - DNA, 20 bp, Homo sapiens
aggaattctaaataaatttc

SEQ ID NO: 5200703 - DNA, 19 bp, Homo sapiens
aggaattctcaagacctga

SEQ ID NO: 5200704 - DNA, 17 bp, Homo sapiens
aggaattctgtatagat

SEQ ID NO: 5200705 - DNA, 20 bp, Homo sapiens
aggaattcttctgttctctg

SEQ ID NO: 5200706 - DNA, 14 bp, Homo sapiens
aggaattgaagatg

SEQ ID NO: 5200707 - DNA, 21 bp, Homo sapiens
aggaattgaagatgtaaggaa

SEQ ID NO: 5200708 - DNA, 22 bp, Homo sapiens
aggaattgaagatgtaaggaat

SEQ ID NO: 5200709 - DNA, 18 bp, Homo sapiens
aggaattgaattaataat

SEQ ID NO: 5200710 - DNA, 19 bp, Homo sapiens
aggaattgacccacaagaa

SEQ ID NO: 5200711 - DNA, 23 bp, Homo sapiens
aggaattgacccacaagaaatga

SEQ ID NO: 5200712 - DNA, 12 bp, Homo sapiens
aggaattgactt

SEQ ID NO: 5200713 - DNA, 23 bp, Homo sapiens
aggaattgacttcagcaggggtg

SEQ ID NO: 5200714 - DNA, 18 bp, Homo sapiens
aggaattgagaagtaatt

SEQ ID NO: 5200715 - DNA, 23 bp, Homo sapiens
aggaattgatacgtttattagga

SEQ ID NO: 5200716 - DNA, 17 bp, Homo sapiens
aggaattgattgtcagc

SEQ ID NO: 5200717 - DNA, 18 bp, Homo sapiens
aggaatttcacctgtaaa

SEQ ID NO: 5200718 - DNA, 22 bp, Homo sapiens
aggaatttcacctgtaaacctg

SEQ ID NO: 5200719 - DNA, 15 bp, Homo sapiens
aggaatttctgagtg

SEQ ID NO: 5200720 - DNA, 15 bp, Homo sapiens
aggaatttcttaact

SEQ ID NO: 5200721 - DNA, 18 bp, Homo sapiens
aggaatttgaagctcaga

SEQ ID NO: 5200722 - DNA, 20 bp, Homo sapiens
aggaatttgattgctttgct

SEQ ID NO: 5200723 - DNA, 13 bp, Homo sapiens
aggaatttgggac

SEQ ID NO: 5200724 - DNA, 18 bp, Homo sapiens
aggaattttattttgctg

SEQ ID NO: 5200725 - DNA, 19 bp, Homo sapiens
aggaattttattttgctga

SEQ ID NO: 5200726 - DNA, 15 bp, Homo sapiens
aggaattttcattgt

SEQ ID NO: 5200727 - DNA, 16 bp, Homo sapiens
aggaattttctccaat

SEQ ID NO: 5200728 - DNA, 14 bp, Homo sapiens
aggaattttctttg

SEQ ID NO: 5200729 - DNA, 13 bp, Homo sapiens
aggaattttgcta

SEQ ID NO: 5200730 - DNA, 17 bp, Homo sapiens
aggaattttgtgtgatt

SEQ ID NO: 5200731 - DNA, 16 bp, Homo sapiens
aggaatttttaaacca

SEQ ID NO: 5200732 - DNA, 18 bp, Homo sapiens
aggacaaaaatgaactga

SEQ ID NO: 5200733 - DNA, 15 bp, Homo sapiens
aggacaaaacttctt

SEQ ID NO: 5200734 - DNA, 16 bp, Homo sapiens
aggacaaaacttcttg

SEQ ID NO: 5200735 - DNA, 20 bp, Homo sapiens
aggacaaaacttcttgtcag

SEQ ID NO: 5200736 - DNA, 22 bp, Homo sapiens
aggacaaaacttcttgtcagac

SEQ ID NO: 5200737 - DNA, 23 bp, Homo sapiens
aggacaaaacttcttgtcagaca

SEQ ID NO: 5200738 - DNA, 18 bp, Homo sapiens
aggacaaaataaagtgtg

SEQ ID NO: 5200739 - DNA, 15 bp, Homo sapiens
aggacaaaatcacat

SEQ ID NO: 5200740 - DNA, 13 bp, Homo sapiens
aggacaaacagtg

SEQ ID NO: 5200741 - DNA, 16 bp, Homo sapiens
aggacaaacagtgaat

SEQ ID NO: 5200742 - DNA, 18 bp, Homo sapiens
aggacaaacagtgaattt

SEQ ID NO: 5200743 - DNA, 17 bp, Homo sapiens
aggacaaagaaggaaat

SEQ ID NO: 5200744 - DNA, 17 bp, Homo sapiens
aggacaaagtgccaaag

SEQ ID NO: 5200745 - DNA, 20 bp, Homo sapiens
aggacaaagtgccaaagaaa

SEQ ID NO: 5200746 - DNA, 16 bp, Homo sapiens
aggacaaataaaacat

SEQ ID NO: 5200747 - DNA, 17 bp, Homo sapiens
aggacaaataagaaatg

SEQ ID NO: 5200748 - DNA, 18 bp, Homo sapiens
aggacaaataagaaatga

SEQ ID NO: 5200749 - DNA, 16 bp, Homo sapiens
aggacaaatgataagt

SEQ ID NO: 5200750 - DNA, 21 bp, Homo sapiens
aggacaaattagcatgcaagc

SEQ ID NO: 5200751 - DNA, 16 bp, Homo sapiens
aggacaaattgagaca

SEQ ID NO: 5200752 - DNA, 16 bp, Homo sapiens
aggacaacacagctgc

SEQ ID NO: 5200753 - DNA, 17 bp, Homo sapiens
aggacaacacagctgct

SEQ ID NO: 5200754 - DNA, 14 bp, Homo sapiens
aggacaaccattcc

SEQ ID NO: 5200755 - DNA, 14 bp, Homo sapiens
aggacaagaccctc

SEQ ID NO: 5200756 - DNA, 12 bp, Homo sapiens
aggacaaggaaa

SEQ ID NO: 5200757 - DNA, 19 bp, Homo sapiens
aggacaaggaagtgggggc

SEQ ID NO: 5200758 - DNA, 23 bp, Homo sapiens
aggacaaggaagtgggggccgct

SEQ ID NO: 5200759 - DNA, 17 bp, Homo sapiens
aggacaaggctgtgcca

SEQ ID NO: 5200760 - DNA, 13 bp, Homo sapiens
aggacaaggggtg

SEQ ID NO: 5200761 - DNA, 14 bp, Homo sapiens
aggacaaggtacag

SEQ ID NO: 5200762 - DNA, 16 bp, Homo sapiens
aggacaagtgtaataa

SEQ ID NO: 5200763 - DNA, 14 bp, Homo sapiens
aggacaagttacac

SEQ ID NO: 5200764 - DNA, 16 bp, Homo sapiens
aggacaatactggggt

SEQ ID NO: 5200765 - DNA, 15 bp, Homo sapiens
aggacaatcccagga

SEQ ID NO: 5200766 - DNA, 23 bp, Homo sapiens
aggacaatgaaatactccagcac

SEQ ID NO: 5200767 - DNA, 14 bp, Homo sapiens
aggacaattcactt

SEQ ID NO: 5200768 - DNA, 14 bp, Homo sapiens
aggacacacagtct

SEQ ID NO: 5200769 - DNA, 23 bp, Homo sapiens
aggacacacagtctcagtccaga

SEQ ID NO: 5200770 - DNA, 23 bp, Homo sapiens
aggacacaccccacaccccagcc

SEQ ID NO: 5200771 - DNA, 12 bp, Homo sapiens
aggacacactga

SEQ ID NO: 5200772 - DNA, 23 bp, Homo sapiens
aggacacagatgaaacacaaaca

SEQ ID NO: 5200773 - DNA, 12 bp, Homo sapiens
aggacacagcag

SEQ ID NO: 5200774 - DNA, 14 bp, Homo sapiens
aggacacagcagta

SEQ ID NO: 5200775 - DNA, 11 bp, Homo sapiens
aggacacaggc

SEQ ID NO: 5200776 - DNA, 12 bp, Homo sapiens
aggacacaggca

SEQ ID NO: 5200777 - DNA, 13 bp, Homo sapiens
aggacacaggcct

SEQ ID NO: 5200778 - DNA, 13 bp, Homo sapiens
aggacacagtcag

SEQ ID NO: 5200779 - DNA, 21 bp, Homo sapiens
aggacacagttcctgggaaca

SEQ ID NO: 5200780 - DNA, 21 bp, Homo sapiens
aggacacatcccggcctcttc

SEQ ID NO: 5200781 - DNA, 21 bp, Homo sapiens
aggacacatcgttcgatttaa

SEQ ID NO: 5200782 - DNA, 11 bp, Homo sapiens
aggacacatgt

SEQ ID NO: 5200783 - DNA, 12 bp, Homo sapiens
aggacacatgtc

SEQ ID NO: 5200784 - DNA, 22 bp, Homo sapiens
aggacacattgccccatgagac

SEQ ID NO: 5200785 - DNA, 22 bp, Homo sapiens
aggacaccacacccagcctcag

SEQ ID NO: 5200786 - DNA, 23 bp, Homo sapiens
aggacaccacacccagcctcagt

SEQ ID NO: 5200787 - DNA, 14 bp, Homo sapiens
aggacaccagtcca

SEQ ID NO: 5200788 - DNA, 11 bp, Homo sapiens
aggacacctgc

SEQ ID NO: 5200789 - DNA, 18 bp, Homo sapiens
aggacacctgccccagcg

SEQ ID NO: 5200790 - DNA, 17 bp, Homo sapiens
aggacacctggccgcct

SEQ ID NO: 5200791 - DNA, 22 bp, Homo sapiens
aggacacgcgcccccctcccag

SEQ ID NO: 5200792 - DNA, 15 bp, Homo sapiens
aggacacgtggcctg

SEQ ID NO: 5200793 - DNA, 19 bp, Homo sapiens
aggacactaaccacgctgg

SEQ ID NO: 5200794 - DNA, 14 bp, Homo sapiens
aggacactaggaga

SEQ ID NO: 5200795 - DNA, 18 bp, Homo sapiens
aggacactaggagactgg

SEQ ID NO: 5200796 - DNA, 19 bp, Homo sapiens
aggacactaggagactggt

SEQ ID NO: 5200797 - DNA, 14 bp, Homo sapiens
aggacactgatatg

SEQ ID NO: 5200798 - DNA, 17 bp, Homo sapiens
aggacactgatatgggt

SEQ ID NO: 5200799 - DNA, 12 bp, Homo sapiens
aggacactgatg

SEQ ID NO: 5200800 - DNA, 20 bp, Homo sapiens
aggacactgatgggtcctgc

SEQ ID NO: 5200801 - DNA, 23 bp, Homo sapiens
aggacactgatgggtcctgctgc

SEQ ID NO: 5200802 - DNA, 22 bp, Homo sapiens
aggacactgcctttgctgcctt

SEQ ID NO: 5200803 - DNA, 11 bp, Homo sapiens
aggacactggt

SEQ ID NO: 5200804 - DNA, 22 bp, Homo sapiens
aggacagaacattgccttcctc

SEQ ID NO: 5200805 - DNA, 14 bp, Homo sapiens
aggacagaaggact

SEQ ID NO: 5200806 - DNA, 18 bp, Homo sapiens
aggacagaaggactggtg

SEQ ID NO: 5200807 - DNA, 19 bp, Homo sapiens
aggacagaaggactggtgc

SEQ ID NO: 5200808 - DNA, 12 bp, Homo sapiens
aggacagaatgg

SEQ ID NO: 5200809 - DNA, 17 bp, Homo sapiens
aggacagaatggatata

SEQ ID NO: 5200810 - DNA, 18 bp, Homo sapiens
aggacagaatggatataa

SEQ ID NO: 5200811 - DNA, 14 bp, Homo sapiens
aggacagaatgtgt

SEQ ID NO: 5200812 - DNA, 13 bp, Homo sapiens
aggacagactggc

SEQ ID NO: 5200813 - DNA, 14 bp, Homo sapiens
aggacagagagaaa

SEQ ID NO: 5200814 - DNA, 14 bp, Homo sapiens
aggacagagccagc

SEQ ID NO: 5200815 - DNA, 15 bp, Homo sapiens
aggacagagggaagc

SEQ ID NO: 5200816 - DNA, 20 bp, Homo sapiens
aggacagagggaagccagtc

SEQ ID NO: 5200817 - DNA, 23 bp, Homo sapiens
aggacagagggaagccagtcagg

SEQ ID NO: 5200818 - DNA, 13 bp, Homo sapiens
aggacagagggat

SEQ ID NO: 5200819 - DNA, 15 bp, Homo sapiens
aggacagagtgccct

SEQ ID NO: 5200820 - DNA, 14 bp, Homo sapiens
aggacagagttcac

SEQ ID NO: 5200821 - DNA, 16 bp, Homo sapiens
aggacagatgcctcct

SEQ ID NO: 5200822 - DNA, 17 bp, Homo sapiens
aggacagatgcctcctt

SEQ ID NO: 5200823 - DNA, 14 bp, Homo sapiens
aggacagcacacgg

SEQ ID NO: 5200824 - DNA, 12 bp, Homo sapiens
aggacagcagca

SEQ ID NO: 5200825 - DNA, 14 bp, Homo sapiens
aggacagcagctgg

SEQ ID NO: 5200826 - DNA, 23 bp, Homo sapiens
aggacagcagctggtgccccacc

SEQ ID NO: 5200827 - DNA, 23 bp, Homo sapiens
aggacagcccttctttccacaga

SEQ ID NO: 5200828 - DNA, 13 bp, Homo sapiens
aggacagcctgcc

SEQ ID NO: 5200829 - DNA, 16 bp, Homo sapiens
aggacagcctgcctct

SEQ ID NO: 5200830 - DNA, 17 bp, Homo sapiens
aggacagcctgcctctg

SEQ ID NO: 5200831 - DNA, 19 bp, Homo sapiens
aggacagctcctggaccag

SEQ ID NO: 5200832 - DNA, 14 bp, Homo sapiens
aggacagctggctg

SEQ ID NO: 5200833 - DNA, 23 bp, Homo sapiens
aggacagctggctgctgacagga

SEQ ID NO: 5200834 - DNA, 12 bp, Homo sapiens
aggacagctgtc

SEQ ID NO: 5200835 - DNA, 20 bp, Homo sapiens
aggacagctttgataatgtc

SEQ ID NO: 5200836 - DNA, 20 bp, Homo sapiens
aggacaggaaagtggcacct

SEQ ID NO: 5200837 - DNA, 22 bp, Homo sapiens
aggacaggaaagtggcacctgt

SEQ ID NO: 5200838 - DNA, 16 bp, Homo sapiens
aggacaggaaatatgt

SEQ ID NO: 5200839 - DNA, 19 bp, Homo sapiens
aggacaggaccctcaggaa

SEQ ID NO: 5200840 - DNA, 13 bp, Homo sapiens
aggacaggagcct

SEQ ID NO: 5200841 - DNA, 16 bp, Homo sapiens
aggacaggaggcggcc

SEQ ID NO: 5200842 - DNA, 14 bp, Homo sapiens
aggacaggatccag

SEQ ID NO: 5200843 - DNA, 13 bp, Homo sapiens
aggacaggcaggc

SEQ ID NO: 5200844 - DNA, 12 bp, Homo sapiens
aggacaggcccg

SEQ ID NO: 5200845 - DNA, 16 bp, Homo sapiens
aggacaggctctagag

SEQ ID NO: 5200846 - DNA, 19 bp, Homo sapiens
aggacaggctctagagaga

SEQ ID NO: 5200847 - DNA, 21 bp, Homo sapiens
aggacaggctgcggcccctcc

SEQ ID NO: 5200848 - DNA, 12 bp, Homo sapiens
aggacagggagg

SEQ ID NO: 5200849 - DNA, 22 bp, Homo sapiens
aggacagggaggtgaccccagg

SEQ ID NO: 5200850 - DNA, 15 bp, Homo sapiens
aggacagggctgagc

SEQ ID NO: 5200851 - DNA, 15 bp, Homo sapiens
aggacagggctggct

SEQ ID NO: 5200852 - DNA, 20 bp, Homo sapiens
aggacaggggcatctctggg

SEQ ID NO: 5200853 - DNA, 12 bp, Homo sapiens
aggacagtattt

SEQ ID NO: 5200854 - DNA, 19 bp, Homo sapiens
aggacagtatttgtgggga

SEQ ID NO: 5200855 - DNA, 17 bp, Homo sapiens
aggacagtccctgctgg

SEQ ID NO: 5200856 - DNA, 22 bp, Homo sapiens
aggacagtccctgctggggaag

SEQ ID NO: 5200857 - DNA, 19 bp, Homo sapiens
aggacagtctggagaaggt

SEQ ID NO: 5200858 - DNA, 20 bp, Homo sapiens
aggacagtctggagaaggta

SEQ ID NO: 5200859 - DNA, 22 bp, Homo sapiens
aggacagtgctgaccccaggaa

SEQ ID NO: 5200860 - DNA, 17 bp, Homo sapiens
aggacagtgcttcagcc

SEQ ID NO: 5200861 - DNA, 15 bp, Homo sapiens
agcggcgccctggac

SEQ ID NO: 5200862 - DNA, 20 bp, Homo sapiens
agcggcgccctggacttggt

SEQ ID NO: 5200863 - DNA, 21 bp, Homo sapiens
agcggcgcgccctgcagaggg

SEQ ID NO: 5200864 - DNA, 17 bp, Homo sapiens
agcggctcaagaataaa

SEQ ID NO: 5200865 - DNA, 17 bp, Homo sapiens
agcggctcaagcccagg

SEQ ID NO: 5200866 - DNA, 18 bp, Homo sapiens
agcggctcaagcccagga

SEQ ID NO: 5200867 - DNA, 13 bp, Homo sapiens
agcggctcccctc

SEQ ID NO: 5200868 - DNA, 14 bp, Homo sapiens
agcggctcctcgcc

SEQ ID NO: 5200869 - DNA, 20 bp, Homo sapiens
agcggctcctcgcccccacc

SEQ ID NO: 5200870 - DNA, 12 bp, Homo sapiens
agcggctctggt

SEQ ID NO: 5200871 - DNA, 14 bp, Homo sapiens
agcggctctggtcc

SEQ ID NO: 5200872 - DNA, 18 bp, Homo sapiens
agcggctgaacaggccgc

SEQ ID NO: 5200873 - DNA, 20 bp, Homo sapiens
agcggctgaggacggggcag

SEQ ID NO: 5200874 - DNA, 22 bp, Homo sapiens
agcggctgaggacggggcagag

SEQ ID NO: 5200875 - DNA, 16 bp, Homo sapiens
agcggctgagtcatga

SEQ ID NO: 5200876 - DNA, 16 bp, Homo sapiens
agcggctgccctctgg

SEQ ID NO: 5200877 - DNA, 13 bp, Homo sapiens
agcggctgcctcc

SEQ ID NO: 5200878 - DNA, 14 bp, Homo sapiens
agcggctgcctcca

SEQ ID NO: 5200879 - DNA, 16 bp, Homo sapiens
agcggctgcctccatt

SEQ ID NO: 5200880 - DNA, 15 bp, Homo sapiens
agcggctgcctcctg

SEQ ID NO: 5200881 - DNA, 22 bp, Homo sapiens
agcggctgctcgcccaggaagg

SEQ ID NO: 5200882 - DNA, 21 bp, Homo sapiens
agcggctggacttggaggtag

SEQ ID NO: 5200883 - DNA, 14 bp, Homo sapiens
agcggctggagaaa

SEQ ID NO: 5200884 - DNA, 23 bp, Homo sapiens
agcggctggcagcccacccctca

SEQ ID NO: 5200885 - DNA, 15 bp, Homo sapiens
agcgggaaggacatt

SEQ ID NO: 5200886 - DNA, 15 bp, Homo sapiens
agcgggacctgtggc

SEQ ID NO: 5200887 - DNA, 17 bp, Homo sapiens
agcgggagacctgtgct

SEQ ID NO: 5200888 - DNA, 11 bp, Homo sapiens
agcgggagccc

SEQ ID NO: 5200889 - DNA, 14 bp, Homo sapiens
agcgggagcccgtg

SEQ ID NO: 5200890 - DNA, 17 bp, Homo sapiens
agcgggagcctccctgc

SEQ ID NO: 5200891 - DNA, 19 bp, Homo sapiens
agcgggagtctcctcactg

SEQ ID NO: 5200892 - DNA, 23 bp, Homo sapiens
agcgggagtgtgggggtgccatg

SEQ ID NO: 5200893 - DNA, 18 bp, Homo sapiens
agcgggatggggatggga

SEQ ID NO: 5200894 - DNA, 10 bp, Homo sapiens
agcgggcaca

SEQ ID NO: 5200895 - DNA, 14 bp, Homo sapiens
agcgggcacagggc

SEQ ID NO: 5200896 - DNA, 23 bp, Homo sapiens
agcgggcaggttctgcctgcttt

SEQ ID NO: 5200897 - DNA, 15 bp, Homo sapiens
agcgggccaggcagg

SEQ ID NO: 5200898 - DNA, 13 bp, Homo sapiens
agcgggccaggcc

SEQ ID NO: 5200899 - DNA, 13 bp, Homo sapiens
agcgggccctctg

SEQ ID NO: 5200900 - DNA, 16 bp, Homo sapiens
agcgggccctctgccg

SEQ ID NO: 5200901 - DNA, 13 bp, Homo sapiens
agcgggcctcttc

SEQ ID NO: 5200902 - DNA, 15 bp, Homo sapiens
agcgggcctcttccc

SEQ ID NO: 5200903 - DNA, 20 bp, Homo sapiens
agcgggcctcttccctcagt

SEQ ID NO: 5200904 - DNA, 22 bp, Homo sapiens
agcgggcgcgggacaggacttg

SEQ ID NO: 5200905 - DNA, 17 bp, Homo sapiens
agcgggctgtgcccggc

SEQ ID NO: 5200906 - DNA, 19 bp, Homo sapiens
agcggggacagctccttct

SEQ ID NO: 5200907 - DNA, 20 bp, Homo sapiens
agcggggacagctccttctg

SEQ ID NO: 5200908 - DNA, 21 bp, Homo sapiens
agcggggccaggagccgggcc

SEQ ID NO: 5200909 - DNA, 21 bp, Homo sapiens
agcggggccccagggctaccc

SEQ ID NO: 5200910 - DNA, 20 bp, Homo sapiens
agcggggccttgtctcttcc

SEQ ID NO: 5200911 - DNA, 13 bp, Homo sapiens
agcggggctgctc

SEQ ID NO: 5200912 - DNA, 12 bp, Homo sapiens
agcggggctggc

SEQ ID NO: 5200913 - DNA, 14 bp, Homo sapiens
agcgggggaggccc

SEQ ID NO: 5200914 - DNA, 21 bp, Homo sapiens
agcgggggagggtaggcagga

SEQ ID NO: 5200915 - DNA, 19 bp, Homo sapiens
agcgggggccttgaagact

SEQ ID NO: 5200916 - DNA, 23 bp, Homo sapiens
agcgggggccttgaagactccct

SEQ ID NO: 5200917 - DNA, 14 bp, Homo sapiens
agcgggggcgtggc

SEQ ID NO: 5200918 - DNA, 20 bp, Homo sapiens
agcgggggctaactggcccc

SEQ ID NO: 5200919 - DNA, 23 bp, Homo sapiens
agcgggggctaactggccccagg

SEQ ID NO: 5200920 - DNA, 13 bp, Homo sapiens
agcggggggaggg

SEQ ID NO: 5200921 - DNA, 16 bp, Homo sapiens
agcggggtatgaagag

SEQ ID NO: 5200922 - DNA, 17 bp, Homo sapiens
agcggggtcccctctgt

SEQ ID NO: 5200923 - DNA, 16 bp, Homo sapiens
agcgggtaaaaagaga

SEQ ID NO: 5200924 - DNA, 16 bp, Homo sapiens
agcgggtaaagtgcaa

SEQ ID NO: 5200925 - DNA, 22 bp, Homo sapiens
agcgggtacttatttctcagct

SEQ ID NO: 5200926 - DNA, 18 bp, Homo sapiens
agcgggtctagtggaaag

SEQ ID NO: 5200927 - DNA, 12 bp, Homo sapiens
agcgggtggggt

SEQ ID NO: 5200928 - DNA, 17 bp, Homo sapiens
agcgggtgggtgggtgt

SEQ ID NO: 5200929 - DNA, 18 bp, Homo sapiens
agcggtccaacgccgcct

SEQ ID NO: 5200930 - DNA, 21 bp, Homo sapiens
agcggtccatgggtctggcct

SEQ ID NO: 5200931 - DNA, 23 bp, Homo sapiens
agcggtccctgcagaagccagaa

SEQ ID NO: 5200932 - DNA, 17 bp, Homo sapiens
agcggtccctgtccctc

SEQ ID NO: 5200933 - DNA, 22 bp, Homo sapiens
agcggtgcagcgtgtgtgccac

SEQ ID NO: 5200934 - DNA, 17 bp, Homo sapiens
agcggtggaaggagcct

SEQ ID NO: 5200935 - DNA, 18 bp, Homo sapiens
agcggtggaaggagcctg

SEQ ID NO: 5200936 - DNA, 19 bp, Homo sapiens
agcggtggaaggagcctgc

SEQ ID NO: 5200937 - DNA, 23 bp, Homo sapiens
agcggtggaaggagcctgcggct

SEQ ID NO: 5200938 - DNA, 21 bp, Homo sapiens
agcggtggataactagccaga

SEQ ID NO: 5200939 - DNA, 14 bp, Homo sapiens
agcggtgtctctcc

SEQ ID NO: 5200940 - DNA, 22 bp, Homo sapiens
agcggtgtggaccgaggaacaa

SEQ ID NO: 5200941 - DNA, 21 bp, Homo sapiens
agcggttgcttctggctcctc

SEQ ID NO: 5200942 - DNA, 16 bp, Homo sapiens
agcggttgtaaataca

SEQ ID NO: 5200943 - DNA, 13 bp, Homo sapiens
agcggtttcctgg

SEQ ID NO: 5200944 - DNA, 13 bp, Homo sapiens
agcgtaaaatggt

SEQ ID NO: 5200945 - DNA, 18 bp, Homo sapiens
agcgtacgatggaggcct

SEQ ID NO: 5200946 - DNA, 20 bp, Homo sapiens
agcgtagtgcagcagggcag

SEQ ID NO: 5200947 - DNA, 18 bp, Homo sapiens
agcgtcaaagaaaatgcc

SEQ ID NO: 5200948 - DNA, 15 bp, Homo sapiens
agcgtcactccagtg

SEQ ID NO: 5200949 - DNA, 16 bp, Homo sapiens
agcgtcactccagtgc

SEQ ID NO: 5200950 - DNA, 17 bp, Homo sapiens
agcgtcactccagtgct

SEQ ID NO: 5200951 - DNA, 21 bp, Homo sapiens
agcgtcactccagtgctcagc

SEQ ID NO: 5200952 - DNA, 20 bp, Homo sapiens
agcgtcactgcccaccaaag

SEQ ID NO: 5200953 - DNA, 22 bp, Homo sapiens
agcgtcactgcccaccaaaggt

SEQ ID NO: 5200954 - DNA, 19 bp, Homo sapiens
agcgtcagaagtctagttt

SEQ ID NO: 5200955 - DNA, 15 bp, Homo sapiens
agcgtcagctgctcc

SEQ ID NO: 5200956 - DNA, 21 bp, Homo sapiens
agcgtcagctgctccctggca

SEQ ID NO: 5200957 - DNA, 20 bp, Homo sapiens
agcgtcaggcctacctcaag

SEQ ID NO: 5200958 - DNA, 21 bp, Homo sapiens
agcgtcagggttggtgtgctg

SEQ ID NO: 5200959 - DNA, 19 bp, Homo sapiens
agcgtccatttcttattta

SEQ ID NO: 5200960 - DNA, 23 bp, Homo sapiens
agcgtccatttcttatttaatta

SEQ ID NO: 5200961 - DNA, 13 bp, Homo sapiens
agcgtcccagtct

SEQ ID NO: 5200962 - DNA, 22 bp, Homo sapiens
agcgtcccctgctactcctgtg

SEQ ID NO: 5200963 - DNA, 16 bp, Homo sapiens
agcgtccctagcagtg

SEQ ID NO: 5200964 - DNA, 14 bp, Homo sapiens
agcgtccctggcgc

SEQ ID NO: 5200965 - DNA, 16 bp, Homo sapiens
agcgtccggggtggtg

SEQ ID NO: 5200966 - DNA, 20 bp, Homo sapiens
agcgtcctcgttcaaaacat

SEQ ID NO: 5200967 - DNA, 13 bp, Homo sapiens
agcgtcctgagga

SEQ ID NO: 5200968 - DNA, 15 bp, Homo sapiens
agcgtcctgaggaat

SEQ ID NO: 5200969 - DNA, 14 bp, Homo sapiens
agcgtcctgccctg

SEQ ID NO: 5200970 - DNA, 16 bp, Homo sapiens
agcgtcctgccctgcc

SEQ ID NO: 5200971 - DNA, 14 bp, Homo sapiens
agcgtccttgtccc

SEQ ID NO: 5200972 - DNA, 18 bp, Homo sapiens
agcgtcgccccagtggca

SEQ ID NO: 5200973 - DNA, 15 bp, Homo sapiens
agcgtctccccatgc

SEQ ID NO: 5200974 - DNA, 22 bp, Homo sapiens
agcgtctcccttggccacggcc

SEQ ID NO: 5200975 - DNA, 13 bp, Homo sapiens
agcgtctgctcat

SEQ ID NO: 5200976 - DNA, 15 bp, Homo sapiens
agcgtctgctgttga

SEQ ID NO: 5200977 - DNA, 12 bp, Homo sapiens
agcgtctgggaa

SEQ ID NO: 5200978 - DNA, 20 bp, Homo sapiens
agcgtctgggaacttgcgag

SEQ ID NO: 5200979 - DNA, 21 bp, Homo sapiens
agcgtctgggcaagaggaaaa

SEQ ID NO: 5200980 - DNA, 17 bp, Homo sapiens
agcgtctttaagagact

SEQ ID NO: 5200981 - DNA, 22 bp, Homo sapiens
agcgtctttttaacctcagaaa

SEQ ID NO: 5200982 - DNA, 22 bp, Homo sapiens
agcgtgaaggacttagccgact

SEQ ID NO: 5200983 - DNA, 23 bp, Homo sapiens
agcgtgaaggccgagaagcaaga

SEQ ID NO: 5200984 - DNA, 15 bp, Homo sapiens
agcgtgagccactgc

SEQ ID NO: 5200985 - DNA, 22 bp, Homo sapiens
agcgtgagccactgcaccgggc

SEQ ID NO: 5200986 - DNA, 16 bp, Homo sapiens
agcgtgagctgagcag

SEQ ID NO: 5200987 - DNA, 12 bp, Homo sapiens
agcgtgagctta

SEQ ID NO: 5200988 - DNA, 15 bp, Homo sapiens
agcgtgcacatctgc

SEQ ID NO: 5200989 - DNA, 15 bp, Homo sapiens
agcgtgcataagtta

SEQ ID NO: 5200990 - DNA, 13 bp, Homo sapiens
agcgtgcgcactg

SEQ ID NO: 5200991 - DNA, 18 bp, Homo sapiens
agcgtgcgcactgcatgg

SEQ ID NO: 5200992 - DNA, 19 bp, Homo sapiens
agcgtgcgcactgcatggg

SEQ ID NO: 5200993 - DNA, 22 bp, Homo sapiens
agcgtgcgtctgtgtgtgcctg

SEQ ID NO: 5200994 - DNA, 19 bp, Homo sapiens
agcgtgctccagcctggct

SEQ ID NO: 5200995 - DNA, 20 bp, Homo sapiens
agcgtgctggcgacactcag

SEQ ID NO: 5200996 - DNA, 23 bp, Homo sapiens
agcgtgctggcgacactcagggc

SEQ ID NO: 5200997 - DNA, 13 bp, Homo sapiens
agcgtggaagggg

SEQ ID NO: 5200998 - DNA, 14 bp, Homo sapiens
agcgtggaggggta

SEQ ID NO: 5200999 - DNA, 20 bp, Homo sapiens
agcgtggaggggtaggggct

SEQ ID NO: 5201000 - DNA, 20 bp, Homo sapiens
agcgtggcccaggccgggaa

SEQ ID NO: 5201001 - DNA, 22 bp, Homo sapiens
agcgtggcccaggccgggaaga

SEQ ID NO: 5201002 - DNA, 13 bp, Homo sapiens
agcgtggccttgg

SEQ ID NO: 5201003 - DNA, 15 bp, Homo sapiens
agcgtggccttggga

SEQ ID NO: 5201004 - DNA, 18 bp, Homo sapiens
agcgtggccttgggagga

SEQ ID NO: 5201005 - DNA, 21 bp, Homo sapiens
agcgtggccttgggaggacat

SEQ ID NO: 5201006 - DNA, 18 bp, Homo sapiens
agcgtggccttgttctgt

SEQ ID NO: 5201007 - DNA, 22 bp, Homo sapiens
agcgtggccttgttctgtcacc

SEQ ID NO: 5201008 - DNA, 21 bp, Homo sapiens
agcgtggcgcagtggccctga

SEQ ID NO: 5201009 - DNA, 22 bp, Homo sapiens
agcgtggcgcagtggccctgag

SEQ ID NO: 5201010 - DNA, 13 bp, Homo sapiens
agcgtgggctctg

SEQ ID NO: 5201011 - DNA, 15 bp, Homo sapiens
agcgtggggaggggc

SEQ ID NO: 5201012 - DNA, 20 bp, Homo sapiens
agcgtggggaggggctgagg

SEQ ID NO: 5201013 - DNA, 22 bp, Homo sapiens
agcgtgggggtggccactcctg

SEQ ID NO: 5201014 - DNA, 21 bp, Homo sapiens
agcgtggtttttatgtgtatt

SEQ ID NO: 5201015 - DNA, 17 bp, Homo sapiens
agcgtgtaagcttgtgt

SEQ ID NO: 5201016 - DNA, 12 bp, Homo sapiens
agcgtgtcctat

SEQ ID NO: 5201017 - DNA, 14 bp, Homo sapiens
agcgtgtcctatcc

SEQ ID NO: 5201018 - DNA, 12 bp, Homo sapiens
agcgtgtgtatc

SEQ ID NO: 5201019 - DNA, 21 bp, Homo sapiens
agcgtgtgtatccgactctaa

SEQ ID NO: 5201020 - DNA, 18 bp, Homo sapiens
agcgttaacacagtaaaa

SEQ ID NO: 5201021 - DNA, 15 bp, Homo sapiens
agcgttaatgtaaag

SEQ ID NO: 5201022 - DNA, 15 bp, Homo sapiens
agcgttagggctgct

SEQ ID NO: 5201023 - DNA, 16 bp, Homo sapiens
agcgttagggctgctt

SEQ ID NO: 5201024 - DNA, 15 bp, Homo sapiens
agcgttcatgttctg

SEQ ID NO: 5201025 - DNA, 14 bp, Homo sapiens
agcgttcccagcag

SEQ ID NO: 5201026 - DNA, 15 bp, Homo sapiens
agcgttcctggcctt

SEQ ID NO: 5201027 - DNA, 15 bp, Homo sapiens
agcgttctaaatatg

SEQ ID NO: 5201028 - DNA, 16 bp, Homo sapiens
agcgttctggactctg

SEQ ID NO: 5201029 - DNA, 18 bp, Homo sapiens
agcgttctggactctgcc

SEQ ID NO: 5201030 - DNA, 20 bp, Homo sapiens
agcgttcttcaggagatgat

SEQ ID NO: 5201031 - DNA, 11 bp, Homo sapiens
agcgttcttgt

SEQ ID NO: 5201032 - DNA, 18 bp, Homo sapiens
agcgttcttgtaatttta

SEQ ID NO: 5201033 - DNA, 14 bp, Homo sapiens
agcgttgcatgtcg

SEQ ID NO: 5201034 - DNA, 19 bp, Homo sapiens
agcgttggaattaaaacaa

SEQ ID NO: 5201035 - DNA, 20 bp, Homo sapiens
agcgttggaattaaaacaat

SEQ ID NO: 5201036 - DNA, 21 bp, Homo sapiens
agcgttgggtttgctcatgta

SEQ ID NO: 5201037 - DNA, 14 bp, Homo sapiens
agcgttgttttgtg

SEQ ID NO: 5201038 - DNA, 17 bp, Homo sapiens
agcgttgttttgtggat

SEQ ID NO: 5201039 - DNA, 18 bp, Homo sapiens
agcgttgttttgtggata

SEQ ID NO: 5201040 - DNA, 22 bp, Homo sapiens
aggacagtgcttcagcctgagg

SEQ ID NO: 5201041 - DNA, 15 bp, Homo sapiens
aggacagttcagaga

SEQ ID NO: 5201042 - DNA, 21 bp, Homo sapiens
aggacagtttatcctgtctga

SEQ ID NO: 5201043 - DNA, 16 bp, Homo sapiens
aggacagtttttttgt

SEQ ID NO: 5201044 - DNA, 13 bp, Homo sapiens
aggacataatggg

SEQ ID NO: 5201045 - DNA, 20 bp, Homo sapiens
aggacataatggggtcctgg

SEQ ID NO: 5201046 - DNA, 16 bp, Homo sapiens
aggacatactgcatgt

SEQ ID NO: 5201047 - DNA, 22 bp, Homo sapiens
aggacatagaggtatattggaa

SEQ ID NO: 5201048 - DNA, 21 bp, Homo sapiens
aggacatagcctgcaaagctg

SEQ ID NO: 5201049 - DNA, 13 bp, Homo sapiens
aggacatcaaagt

SEQ ID NO: 5201050 - DNA, 13 bp, Homo sapiens
aggacatcagcaa

SEQ ID NO: 5201051 - DNA, 14 bp, Homo sapiens
aggacatcagcaaa

SEQ ID NO: 5201052 - DNA, 20 bp, Homo sapiens
aggacatcttaaatctaaac

SEQ ID NO: 5201053 - DNA, 19 bp, Homo sapiens
aggacatgaacagacactt

SEQ ID NO: 5201054 - DNA, 14 bp, Homo sapiens
aggacatgagatca

SEQ ID NO: 5201055 - DNA, 16 bp, Homo sapiens
aggacatgcaataaaa

SEQ ID NO: 5201056 - DNA, 22 bp, Homo sapiens
aggacatgcaataaaatttaaa

SEQ ID NO: 5201057 - DNA, 17 bp, Homo sapiens
aggacatgcgtgtgtca

SEQ ID NO: 5201058 - DNA, 20 bp, Homo sapiens
aggacatgcgtgtgtcaggg

SEQ ID NO: 5201059 - DNA, 17 bp, Homo sapiens
aggacatgctgaagcca

SEQ ID NO: 5201060 - DNA, 16 bp, Homo sapiens
aggacatggagagaga

SEQ ID NO: 5201061 - DNA, 17 bp, Homo sapiens
aggacatggagagagac

SEQ ID NO: 5201062 - DNA, 14 bp, Homo sapiens
aggacatggcttct

SEQ ID NO: 5201063 - DNA, 23 bp, Homo sapiens
aggacatggggcatagaaactga

SEQ ID NO: 5201064 - DNA, 21 bp, Homo sapiens
aggacatggtgagtctatttt

SEQ ID NO: 5201065 - DNA, 21 bp, Homo sapiens
aggacatgtttttgttttctt

SEQ ID NO: 5201066 - DNA, 13 bp, Homo sapiens
aggacattcactg

SEQ ID NO: 5201067 - DNA, 14 bp, Homo sapiens
aggacattcactgc

SEQ ID NO: 5201068 - DNA, 15 bp, Homo sapiens
aggacattcactgct

SEQ ID NO: 5201069 - DNA, 17 bp, Homo sapiens
aggacattcactgctga

SEQ ID NO: 5201070 - DNA, 16 bp, Homo sapiens
aggacattccaagaca

SEQ ID NO: 5201071 - DNA, 17 bp, Homo sapiens
aggacattccaagacag

SEQ ID NO: 5201072 - DNA, 22 bp, Homo sapiens
aggacattctgctaagattcct

SEQ ID NO: 5201073 - DNA, 13 bp, Homo sapiens
aggacattgcccc

SEQ ID NO: 5201074 - DNA, 14 bp, Homo sapiens
aggacattgcccca

SEQ ID NO: 5201075 - DNA, 18 bp, Homo sapiens
aggacattgccccaagat

SEQ ID NO: 5201076 - DNA, 19 bp, Homo sapiens
aggacattgccccaagata

SEQ ID NO: 5201077 - DNA, 18 bp, Homo sapiens
aggacattgcggacagcc

SEQ ID NO: 5201078 - DNA, 19 bp, Homo sapiens
aggacattgtatgcaggga

SEQ ID NO: 5201079 - DNA, 15 bp, Homo sapiens
aggacatttacctct

SEQ ID NO: 5201080 - DNA, 18 bp, Homo sapiens
aggacatttatgattgtc

SEQ ID NO: 5201081 - DNA, 17 bp, Homo sapiens
aggacatttgacatgag

SEQ ID NO: 5201082 - DNA, 22 bp, Homo sapiens
aggacatttgtgggcaagcaga

SEQ ID NO: 5201083 - DNA, 18 bp, Homo sapiens
aggacattttctctttaa

SEQ ID NO: 5201084 - DNA, 19 bp, Homo sapiens
aggaccaaaaaacctcact

SEQ ID NO: 5201085 - DNA, 15 bp, Homo sapiens
aggaccaaagaacac

SEQ ID NO: 5201086 - DNA, 20 bp, Homo sapiens
aggaccaacccatgccctgc

SEQ ID NO: 5201087 - DNA, 17 bp, Homo sapiens
aggaccaactggcttct

SEQ ID NO: 5201088 - DNA, 19 bp, Homo sapiens
aggaccaactggcttctgt

SEQ ID NO: 5201089 - DNA, 17 bp, Homo sapiens
aggaccaagcatcttgg

SEQ ID NO: 5201090 - DNA, 23 bp, Homo sapiens
aggaccaagcttaaggagaggag

SEQ ID NO: 5201091 - DNA, 17 bp, Homo sapiens
aggaccaagggcagagg

SEQ ID NO: 5201092 - DNA, 23 bp, Homo sapiens
aggaccaatgcttgcatggagaa

SEQ ID NO: 5201093 - DNA, 20 bp, Homo sapiens
aggaccaattgactctcaca

SEQ ID NO: 5201094 - DNA, 17 bp, Homo sapiens
aggaccacacagtcccc

SEQ ID NO: 5201095 - DNA, 22 bp, Homo sapiens
aggaccacactttgagaacctg

SEQ ID NO: 5201096 - DNA, 14 bp, Homo sapiens
aggaccacaggctc

SEQ ID NO: 5201097 - DNA, 17 bp, Homo sapiens
aggaccacaggctcagg

SEQ ID NO: 5201098 - DNA, 20 bp, Homo sapiens
aggaccacaggctcaggcag

SEQ ID NO: 5201099 - DNA, 16 bp, Homo sapiens
aggaccacagtgggtg

SEQ ID NO: 5201100 - DNA, 19 bp, Homo sapiens
aggaccacagtgggtggca

SEQ ID NO: 5201101 - DNA, 21 bp, Homo sapiens
aggaccaccagcaggcaggtg

SEQ ID NO: 5201102 - DNA, 16 bp, Homo sapiens
aggaccaccctgccaa

SEQ ID NO: 5201103 - DNA, 23 bp, Homo sapiens
aggaccacctcctctgccagcag

SEQ ID NO: 5201104 - DNA, 23 bp, Homo sapiens
aggaccactagctaagcaagcca

SEQ ID NO: 5201105 - DNA, 12 bp, Homo sapiens
aggaccactcct

SEQ ID NO: 5201106 - DNA, 22 bp, Homo sapiens
aggaccactcctgtacactgaa

SEQ ID NO: 5201107 - DNA, 22 bp, Homo sapiens
aggaccagaaaatgtaaggcaa

SEQ ID NO: 5201108 - DNA, 12 bp, Homo sapiens
aggaccagaagg

SEQ ID NO: 5201109 - DNA, 12 bp, Homo sapiens
aggaccagagga

SEQ ID NO: 5201110 - DNA, 14 bp, Homo sapiens
aggaccagaggagc

SEQ ID NO: 5201111 - DNA, 22 bp, Homo sapiens
aggaccagattgctctgcccca

SEQ ID NO: 5201112 - DNA, 18 bp, Homo sapiens
aggaccagcacactcccg

SEQ ID NO: 5201113 - DNA, 13 bp, Homo sapiens
aggaccagcccac

SEQ ID NO: 5201114 - DNA, 12 bp, Homo sapiens
aggaccagctca

SEQ ID NO: 5201115 - DNA, 13 bp, Homo sapiens
aggaccagctcag

SEQ ID NO: 5201116 - DNA, 19 bp, Homo sapiens
aggaccaggaaacagcctc

SEQ ID NO: 5201117 - DNA, 15 bp, Homo sapiens
aggaccaggacccag

SEQ ID NO: 5201118 - DNA, 21 bp, Homo sapiens
aggaccaggacccagggagag

SEQ ID NO: 5201119 - DNA, 13 bp, Homo sapiens
aggaccaggagcc

SEQ ID NO: 5201120 - DNA, 19 bp, Homo sapiens
aggaccaggccaccgctag

SEQ ID NO: 5201121 - DNA, 22 bp, Homo sapiens
aggaccaggctggggccagggg

SEQ ID NO: 5201122 - DNA, 18 bp, Homo sapiens
aggaccagggcagggcca

SEQ ID NO: 5201123 - DNA, 12 bp, Homo sapiens
aggaccagggcc

SEQ ID NO: 5201124 - DNA, 20 bp, Homo sapiens
aggaccagtcaggatgaggc

SEQ ID NO: 5201125 - DNA, 23 bp, Homo sapiens
aggaccagtcaggatgaggcccc

SEQ ID NO: 5201126 - DNA, 16 bp, Homo sapiens
aggaccagtcccagag

SEQ ID NO: 5201127 - DNA, 20 bp, Homo sapiens
aggaccatcagagaggcaag

SEQ ID NO: 5201128 - DNA, 23 bp, Homo sapiens
aggaccatgaggcctcctgccat

SEQ ID NO: 5201129 - DNA, 12 bp, Homo sapiens
aggaccatttta

SEQ ID NO: 5201130 - DNA, 23 bp, Homo sapiens
aggacccaaatttccctgggggc

SEQ ID NO: 5201131 - DNA, 13 bp, Homo sapiens
aggacccaagcag

SEQ ID NO: 5201132 - DNA, 18 bp, Homo sapiens
aggacccaagcagagaag

SEQ ID NO: 5201133 - DNA, 19 bp, Homo sapiens
aggacccaccactggaagc

SEQ ID NO: 5201134 - DNA, 22 bp, Homo sapiens
aggacccacccatcttcctgct

SEQ ID NO: 5201135 - DNA, 14 bp, Homo sapiens
aggacccagaccca

SEQ ID NO: 5201136 - DNA, 18 bp, Homo sapiens
aggacccagacccagtgg

SEQ ID NO: 5201137 - DNA, 16 bp, Homo sapiens
aggacccagagctgct

SEQ ID NO: 5201138 - DNA, 14 bp, Homo sapiens
aggacccaggacag

SEQ ID NO: 5201139 - DNA, 18 bp, Homo sapiens
aggacccaggacaggatc

SEQ ID NO: 5201140 - DNA, 23 bp, Homo sapiens
aggacccaggacaggatccaggc

SEQ ID NO: 5201141 - DNA, 17 bp, Homo sapiens
aggacccaggccctcca

SEQ ID NO: 5201142 - DNA, 14 bp, Homo sapiens
aggacccaggccgc

SEQ ID NO: 5201143 - DNA, 20 bp, Homo sapiens
aggacccaggccgcctgcca

SEQ ID NO: 5201144 - DNA, 12 bp, Homo sapiens
aggacccaggcg

SEQ ID NO: 5201145 - DNA, 20 bp, Homo sapiens
aggacccagggagaggctgt

SEQ ID NO: 5201146 - DNA, 22 bp, Homo sapiens
aggacccagtggtcagcaggtg

SEQ ID NO: 5201147 - DNA, 22 bp, Homo sapiens
aggacccatatgggaattatta

SEQ ID NO: 5201148 - DNA, 18 bp, Homo sapiens
aggacccatcacgcctgt

SEQ ID NO: 5201149 - DNA, 20 bp, Homo sapiens
aggacccatccctgcctgga

SEQ ID NO: 5201150 - DNA, 22 bp, Homo sapiens
aggacccatgaaacagcagctg

SEQ ID NO: 5201151 - DNA, 17 bp, Homo sapiens
aggaccccacatccttc

SEQ ID NO: 5201152 - DNA, 15 bp, Homo sapiens
aggaccccagaggga

SEQ ID NO: 5201153 - DNA, 13 bp, Homo sapiens
aggaccccagctc

SEQ ID NO: 5201154 - DNA, 16 bp, Homo sapiens
aggaccccagctctgc

SEQ ID NO: 5201155 - DNA, 16 bp, Homo sapiens
aggaccccatctgctg

SEQ ID NO: 5201156 - DNA, 18 bp, Homo sapiens
aggaccccattctgggac

SEQ ID NO: 5201157 - DNA, 23 bp, Homo sapiens
aggacccccgaggggagggcagg

SEQ ID NO: 5201158 - DNA, 13 bp, Homo sapiens
aggacccccttcc

SEQ ID NO: 5201159 - DNA, 17 bp, Homo sapiens
aggaccccgagggctga

SEQ ID NO: 5201160 - DNA, 20 bp, Homo sapiens
aggaccccgagggctgagga

SEQ ID NO: 5201161 - DNA, 14 bp, Homo sapiens
aggacccctcacca

SEQ ID NO: 5201162 - DNA, 15 bp, Homo sapiens
aggacccctcaccac

SEQ ID NO: 5201163 - DNA, 16 bp, Homo sapiens
aggacccctcaccacc

SEQ ID NO: 5201164 - DNA, 14 bp, Homo sapiens
aggacccctgccct

SEQ ID NO: 5201165 - DNA, 15 bp, Homo sapiens
aggacccctgccctc

SEQ ID NO: 5201166 - DNA, 15 bp, Homo sapiens
aggacccgccagccc

SEQ ID NO: 5201167 - DNA, 18 bp, Homo sapiens
aggacccgccagccccgc

SEQ ID NO: 5201168 - DNA, 20 bp, Homo sapiens
aggacccgccagccccgctc

SEQ ID NO: 5201169 - DNA, 21 bp, Homo sapiens
aggacccgccagccccgctcc

SEQ ID NO: 5201170 - DNA, 22 bp, Homo sapiens
aggacccggaggggcctggcag

SEQ ID NO: 5201171 - DNA, 21 bp, Homo sapiens
aggacccggggcccgcctcac

SEQ ID NO: 5201172 - DNA, 16 bp, Homo sapiens
aggaccctcagcccca

SEQ ID NO: 5201173 - DNA, 17 bp, Homo sapiens
aggaccctcaggaattc

SEQ ID NO: 5201174 - DNA, 21 bp, Homo sapiens
aggaccctcatgatgggatga

SEQ ID NO: 5201175 - DNA, 21 bp, Homo sapiens
aggaccctccactcactgctg

SEQ ID NO: 5201176 - DNA, 18 bp, Homo sapiens
aggaccctcgctggcccc

SEQ ID NO: 5201177 - DNA, 19 bp, Homo sapiens
aggaccctgaaggggccat

SEQ ID NO: 5201178 - DNA, 14 bp, Homo sapiens
aggaccctgcacct

SEQ ID NO: 5201179 - DNA, 16 bp, Homo sapiens
aggaccctgccaggca

SEQ ID NO: 5201180 - DNA, 18 bp, Homo sapiens
aggaccctgccaggcaca

SEQ ID NO: 5201181 - DNA, 22 bp, Homo sapiens
aggaccctgccaggcacaggca

SEQ ID NO: 5201182 - DNA, 23 bp, Homo sapiens
aggaccctgccaggcacaggcag

SEQ ID NO: 5201183 - DNA, 13 bp, Homo sapiens
aggaccctggacc

SEQ ID NO: 5201184 - DNA, 14 bp, Homo sapiens
aggaccctggctct

SEQ ID NO: 5201185 - DNA, 11 bp, Homo sapiens
aggaccctggg

SEQ ID NO: 5201186 - DNA, 22 bp, Homo sapiens
aggaccctgtcaggattgcagg

SEQ ID NO: 5201187 - DNA, 22 bp, Homo sapiens
aggaccctgtcctgcagtccca

SEQ ID NO: 5201188 - DNA, 13 bp, Homo sapiens
aggacccttccct

SEQ ID NO: 5201189 - DNA, 19 bp, Homo sapiens
aggaccgccatggtgctgg

SEQ ID NO: 5201190 - DNA, 22 bp, Homo sapiens
aggaccgccccaaccctcggag

SEQ ID NO: 5201191 - DNA, 20 bp, Homo sapiens
aggaccgccccaccctggaa

SEQ ID NO: 5201192 - DNA, 22 bp, Homo sapiens
aggaccgcctgccctgcctggg

SEQ ID NO: 5201193 - DNA, 21 bp, Homo sapiens
aggaccgggcactcccgggat

SEQ ID NO: 5201194 - DNA, 13 bp, Homo sapiens
aggaccgtgccct

SEQ ID NO: 5201195 - DNA, 14 bp, Homo sapiens
aggaccgttttgta

SEQ ID NO: 5201196 - DNA, 14 bp, Homo sapiens
aggacctaaaacat

SEQ ID NO: 5201197 - DNA, 22 bp, Homo sapiens
aggacctagggatgttctggcc

SEQ ID NO: 5201198 - DNA, 23 bp, Homo sapiens
aggacctagtcggggggtggctg

SEQ ID NO: 5201199 - DNA, 18 bp, Homo sapiens
aggacctatgttgtaatt

SEQ ID NO: 5201200 - DNA, 21 bp, Homo sapiens
aggacctcatatcttcctcat

SEQ ID NO: 5201201 - DNA, 22 bp, Homo sapiens
aggacctcatatcttcctcatc

SEQ ID NO: 5201202 - DNA, 15 bp, Homo sapiens
aggacctccaagcca

SEQ ID NO: 5201203 - DNA, 19 bp, Homo sapiens
aggacctccacctgggaga

SEQ ID NO: 5201204 - DNA, 13 bp, Homo sapiens
aggacctcccttc

SEQ ID NO: 5201205 - DNA, 16 bp, Homo sapiens
aggacctcccttccga

SEQ ID NO: 5201206 - DNA, 22 bp, Homo sapiens
aggacctcggatgaccatactc

SEQ ID NO: 5201207 - DNA, 22 bp, Homo sapiens
aggacctctcagcatagcctgc

SEQ ID NO: 5201208 - DNA, 11 bp, Homo sapiens
aggacctctgg

SEQ ID NO: 5201209 - DNA, 12 bp, Homo sapiens
aggacctctggg

SEQ ID NO: 5201210 - DNA, 20 bp, Homo sapiens
aggacctctgtaggcagcag

SEQ ID NO: 5201211 - DNA, 16 bp, Homo sapiens
aggacctgagactcac

SEQ ID NO: 5201212 - DNA, 16 bp, Homo sapiens
aggacctgagcctgcc

SEQ ID NO: 5201213 - DNA, 16 bp, Homo sapiens
aggacctgagcctggc

SEQ ID NO: 5201214 - DNA, 15 bp, Homo sapiens
aggacctgagctggc

SEQ ID NO: 5201215 - DNA, 21 bp, Homo sapiens
aggacctgagtttgggagagt

SEQ ID NO: 5201216 - DNA, 13 bp, Homo sapiens
aggacctgcaaac

SEQ ID NO: 5201217 - DNA, 19 bp, Homo sapiens
agcgtttaaagtactgagc

SEQ ID NO: 5201218 - DNA, 23 bp, Homo sapiens
agcgtttaatggtatctgttact

SEQ ID NO: 5201219 - DNA, 17 bp, Homo sapiens
agcgtttctttacttct

SEQ ID NO: 5201220 - DNA, 16 bp, Homo sapiens
agcgtttgctgtgcca

SEQ ID NO: 5201221 - DNA, 14 bp, Homo sapiens
agcgttttgcaagg

SEQ ID NO: 5201222 - DNA, 17 bp, Homo sapiens
agcgtttttaacctgtt

SEQ ID NO: 5201223 - DNA, 18 bp, Homo sapiens
agcgtttttaacctgttt

SEQ ID NO: 5201224 - DNA, 14 bp, Homo sapiens
agctaaaaatgaac

SEQ ID NO: 5201225 - DNA, 16 bp, Homo sapiens
agctaaaatgatttta

SEQ ID NO: 5201226 - DNA, 14 bp, Homo sapiens
agctaaaattttta

SEQ ID NO: 5201227 - DNA, 23 bp, Homo sapiens
agctaaactccttcctggcctga

SEQ ID NO: 5201228 - DNA, 17 bp, Homo sapiens
agctaaagaaactgctt

SEQ ID NO: 5201229 - DNA, 16 bp, Homo sapiens
agctaaagaagtttga

SEQ ID NO: 5201230 - DNA, 13 bp, Homo sapiens
agctaaagaggct

SEQ ID NO: 5201231 - DNA, 23 bp, Homo sapiens
agctaaagaggtggggtgaagct

SEQ ID NO: 5201232 - DNA, 23 bp, Homo sapiens
agctaaagcagtcctccagcctc

SEQ ID NO: 5201233 - DNA, 16 bp, Homo sapiens
agctaaagcccaacct

SEQ ID NO: 5201234 - DNA, 18 bp, Homo sapiens
agctaaattacaattgtc

SEQ ID NO: 5201235 - DNA, 17 bp, Homo sapiens
agctaaattcagggaga

SEQ ID NO: 5201236 - DNA, 18 bp, Homo sapiens
agctaaattgaatacaca

SEQ ID NO: 5201237 - DNA, 21 bp, Homo sapiens
agctaaattgaatacacaaat

SEQ ID NO: 5201238 - DNA, 15 bp, Homo sapiens
agctaacaaaagata

SEQ ID NO: 5201239 - DNA, 22 bp, Homo sapiens
agctaacaaaagatatgaagaa

SEQ ID NO: 5201240 - DNA, 23 bp, Homo sapiens
agctaacaaaagatatgaagaac

SEQ ID NO: 5201241 - DNA, 19 bp, Homo sapiens
agctaacactggcccctag

SEQ ID NO: 5201242 - DNA, 19 bp, Homo sapiens
agctaacagggaaggcagg

SEQ ID NO: 5201243 - DNA, 20 bp, Homo sapiens
agctaacagggaaggcaggc

SEQ ID NO: 5201244 - DNA, 23 bp, Homo sapiens
agctaacagggaaggcaggcagg

SEQ ID NO: 5201245 - DNA, 13 bp, Homo sapiens
agctaacagtgaa

SEQ ID NO: 5201246 - DNA, 20 bp, Homo sapiens
agctaacatggaagtactat

SEQ ID NO: 5201247 - DNA, 17 bp, Homo sapiens
agctaacattttaaata

SEQ ID NO: 5201248 - DNA, 18 bp, Homo sapiens
agctaacattttaaataa

SEQ ID NO: 5201249 - DNA, 23 bp, Homo sapiens
agctaacattttaaataaaagaa

SEQ ID NO: 5201250 - DNA, 21 bp, Homo sapiens
agctaaccacttcgcacacac

SEQ ID NO: 5201251 - DNA, 15 bp, Homo sapiens
agctaaccttatcct

SEQ ID NO: 5201252 - DNA, 22 bp, Homo sapiens
agctaaccttatcctgcattgt

SEQ ID NO: 5201253 - DNA, 16 bp, Homo sapiens
agctaactgagagaag

SEQ ID NO: 5201254 - DNA, 15 bp, Homo sapiens
agctaactgtaaatc

SEQ ID NO: 5201255 - DNA, 13 bp, Homo sapiens
agctaagagcagt

SEQ ID NO: 5201256 - DNA, 17 bp, Homo sapiens
agctaagatagaaagct

SEQ ID NO: 5201257 - DNA, 18 bp, Homo sapiens
agctaagatagaaagctg

SEQ ID NO: 5201258 - DNA, 20 bp, Homo sapiens
agctaagatagaaagctgga

SEQ ID NO: 5201259 - DNA, 21 bp, Homo sapiens
agctaagatagaaagctggac

SEQ ID NO: 5201260 - DNA, 14 bp, Homo sapiens
agctaagcaagcca

SEQ ID NO: 5201261 - DNA, 17 bp, Homo sapiens
agctaagcaagccagga

SEQ ID NO: 5201262 - DNA, 15 bp, Homo sapiens
agctaagcagaataa

SEQ ID NO: 5201263 - DNA, 17 bp, Homo sapiens
agctaagcctgatgatg

SEQ ID NO: 5201264 - DNA, 19 bp, Homo sapiens
agctaagccttatgtgagc

SEQ ID NO: 5201265 - DNA, 19 bp, Homo sapiens
agctaagctaccttgtcat

SEQ ID NO: 5201266 - DNA, 15 bp, Homo sapiens
agctaagctgcaggc

SEQ ID NO: 5201267 - DNA, 18 bp, Homo sapiens
agctaagctgcaggcaca

SEQ ID NO: 5201268 - DNA, 18 bp, Homo sapiens
agctaaggaagggaaagg

SEQ ID NO: 5201269 - DNA, 18 bp, Homo sapiens
agctaaggccaatgggct

SEQ ID NO: 5201270 - DNA, 18 bp, Homo sapiens
agctaaggctctatgagt

SEQ ID NO: 5201271 - DNA, 17 bp, Homo sapiens
agctaagggaagacatt

SEQ ID NO: 5201272 - DNA, 19 bp, Homo sapiens
agctaagggaagacatttc

SEQ ID NO: 5201273 - DNA, 20 bp, Homo sapiens
agctaagggaagacatttct

SEQ ID NO: 5201274 - DNA, 16 bp, Homo sapiens
agctaagggtgggtgc

SEQ ID NO: 5201275 - DNA, 20 bp, Homo sapiens
agctaagggtgggtgctcag

SEQ ID NO: 5201276 - DNA, 23 bp, Homo sapiens
agctaagggtgggtgctcagaat

SEQ ID NO: 5201277 - DNA, 16 bp, Homo sapiens
agctaagtaaaaatat

SEQ ID NO: 5201278 - DNA, 19 bp, Homo sapiens
agctaagtcacccagagca

SEQ ID NO: 5201279 - DNA, 23 bp, Homo sapiens
agctaagtgacagtcacttaact

SEQ ID NO: 5201280 - DNA, 23 bp, Homo sapiens
agctaataaaatatcattcagca

SEQ ID NO: 5201281 - DNA, 14 bp, Homo sapiens
agctaataaaccag

SEQ ID NO: 5201282 - DNA, 18 bp, Homo sapiens
agctaatacccagagcac

SEQ ID NO: 5201283 - DNA, 23 bp, Homo sapiens
agctaatctgtagggctggacct

SEQ ID NO: 5201284 - DNA, 21 bp, Homo sapiens
agctaatgaccaacctgtttc

SEQ ID NO: 5201285 - DNA, 13 bp, Homo sapiens
agctaatgggaca

SEQ ID NO: 5201286 - DNA, 18 bp, Homo sapiens
agctaatggtcctgttat

SEQ ID NO: 5201287 - DNA, 21 bp, Homo sapiens
agctaatgtcacaacatggtg

SEQ ID NO: 5201288 - DNA, 13 bp, Homo sapiens
agctaatgtgaat

SEQ ID NO: 5201289 - DNA, 16 bp, Homo sapiens
agctaatgtggtagtg

SEQ ID NO: 5201290 - DNA, 19 bp, Homo sapiens
agctaatgtggtagtgaaa

SEQ ID NO: 5201291 - DNA, 17 bp, Homo sapiens
agctaattaaggtttgc

SEQ ID NO: 5201292 - DNA, 18 bp, Homo sapiens
agctaattattttaatta

SEQ ID NO: 5201293 - DNA, 21 bp, Homo sapiens
agctaattctactcacagtgc

SEQ ID NO: 5201294 - DNA, 13 bp, Homo sapiens
agctaattggact

SEQ ID NO: 5201295 - DNA, 20 bp, Homo sapiens
agctaatttatttccccagg

SEQ ID NO: 5201296 - DNA, 14 bp, Homo sapiens
agctaatttgcatt

SEQ ID NO: 5201297 - DNA, 20 bp, Homo sapiens
agctaatttgcattaaattc

SEQ ID NO: 5201298 - DNA, 17 bp, Homo sapiens
agctaatttgtgaaagt

SEQ ID NO: 5201299 - DNA, 13 bp, Homo sapiens
agctaatttttgt

SEQ ID NO: 5201300 - DNA, 16 bp, Homo sapiens
agctaatttttgtatg

SEQ ID NO: 5201301 - DNA, 15 bp, Homo sapiens
agctacaaactttta

SEQ ID NO: 5201302 - DNA, 19 bp, Homo sapiens
agctacaacagcctcactt

SEQ ID NO: 5201303 - DNA, 20 bp, Homo sapiens
agctacaacagcctcacttg

SEQ ID NO: 5201304 - DNA, 19 bp, Homo sapiens
agctacaatattctctctt

SEQ ID NO: 5201305 - DNA, 18 bp, Homo sapiens
agctacaatcctaccttt

SEQ ID NO: 5201306 - DNA, 18 bp, Homo sapiens
agctacacctgaggctga

SEQ ID NO: 5201307 - DNA, 19 bp, Homo sapiens
agctacacctgaggctgag

SEQ ID NO: 5201308 - DNA, 14 bp, Homo sapiens
agctacactgagca

SEQ ID NO: 5201309 - DNA, 15 bp, Homo sapiens
agctacactgagcag

SEQ ID NO: 5201310 - DNA, 13 bp, Homo sapiens
agctacagaacac

SEQ ID NO: 5201311 - DNA, 13 bp, Homo sapiens
agctacagagaaa

SEQ ID NO: 5201312 - DNA, 20 bp, Homo sapiens
agctacagagaaaccagctt

SEQ ID NO: 5201313 - DNA, 17 bp, Homo sapiens
agctacagcttgtttaa

SEQ ID NO: 5201314 - DNA, 22 bp, Homo sapiens
agctacagctttcttgctccct

SEQ ID NO: 5201315 - DNA, 14 bp, Homo sapiens
agctacaggaagca

SEQ ID NO: 5201316 - DNA, 13 bp, Homo sapiens
agctacaggagag

SEQ ID NO: 5201317 - DNA, 12 bp, Homo sapiens
agctacaggtta

SEQ ID NO: 5201318 - DNA, 13 bp, Homo sapiens
agctacaggttac

SEQ ID NO: 5201319 - DNA, 18 bp, Homo sapiens
agctacaggttacaacag

SEQ ID NO: 5201320 - DNA, 15 bp, Homo sapiens
agctacataatttag

SEQ ID NO: 5201321 - DNA, 14 bp, Homo sapiens
agctacatgttctt

SEQ ID NO: 5201322 - DNA, 21 bp, Homo sapiens
agctacatgttctttgtacct

SEQ ID NO: 5201323 - DNA, 12 bp, Homo sapiens
agctacattcct

SEQ ID NO: 5201324 - DNA, 21 bp, Homo sapiens
agctacattcctcagctgcca

SEQ ID NO: 5201325 - DNA, 19 bp, Homo sapiens
agctaccaacggccaggaa

SEQ ID NO: 5201326 - DNA, 22 bp, Homo sapiens
agctaccaccacggccaccact

SEQ ID NO: 5201327 - DNA, 19 bp, Homo sapiens
agctaccagagctctatcc

SEQ ID NO: 5201328 - DNA, 19 bp, Homo sapiens
agctaccaggaagaggggc

SEQ ID NO: 5201329 - DNA, 13 bp, Homo sapiens
agctaccatgaca

SEQ ID NO: 5201330 - DNA, 18 bp, Homo sapiens
agctaccatgttaataca

SEQ ID NO: 5201331 - DNA, 17 bp, Homo sapiens
agctacccaggaggctg

SEQ ID NO: 5201332 - DNA, 15 bp, Homo sapiens
agctaccctcagcct

SEQ ID NO: 5201333 - DNA, 17 bp, Homo sapiens
agctaccctcagcctcc

SEQ ID NO: 5201334 - DNA, 19 bp, Homo sapiens
agctacccttttcctttgt

SEQ ID NO: 5201335 - DNA, 22 bp, Homo sapiens
agctacctacatgctgaaaaat

SEQ ID NO: 5201336 - DNA, 22 bp, Homo sapiens
agctacctgctcagccctgcac

SEQ ID NO: 5201337 - DNA, 18 bp, Homo sapiens
agctacctgtgtggacag

SEQ ID NO: 5201338 - DNA, 22 bp, Homo sapiens
agctaccttttttttacggaat

SEQ ID NO: 5201339 - DNA, 20 bp, Homo sapiens
agctacgaaaggatgagcag

SEQ ID NO: 5201340 - DNA, 16 bp, Homo sapiens
agctacgcagacaaga

SEQ ID NO: 5201341 - DNA, 14 bp, Homo sapiens
agctactaaaatca

SEQ ID NO: 5201342 - DNA, 17 bp, Homo sapiens
agctactaacctggaga

SEQ ID NO: 5201343 - DNA, 18 bp, Homo sapiens
agctactaacctggagac

SEQ ID NO: 5201344 - DNA, 19 bp, Homo sapiens
agctactaacctggagaca

SEQ ID NO: 5201345 - DNA, 20 bp, Homo sapiens
agctactaacctggagacag

SEQ ID NO: 5201346 - DNA, 13 bp, Homo sapiens
agctactaatgat

SEQ ID NO: 5201347 - DNA, 19 bp, Homo sapiens
agctactaattttaaaatg

SEQ ID NO: 5201348 - DNA, 15 bp, Homo sapiens
agctactagcaaaat

SEQ ID NO: 5201349 - DNA, 14 bp, Homo sapiens
agctactataaata

SEQ ID NO: 5201350 - DNA, 15 bp, Homo sapiens
agctactatatgcat

SEQ ID NO: 5201351 - DNA, 12 bp, Homo sapiens
agctactcagga

SEQ ID NO: 5201352 - DNA, 13 bp, Homo sapiens
agctactcaggag

SEQ ID NO: 5201353 - DNA, 15 bp, Homo sapiens
agctactcaggaggc

SEQ ID NO: 5201354 - DNA, 17 bp, Homo sapiens
agctactcaggaggctg

SEQ ID NO: 5201355 - DNA, 22 bp, Homo sapiens
agctactcaggaggctgaggca

SEQ ID NO: 5201356 - DNA, 14 bp, Homo sapiens
agctactcatgact

SEQ ID NO: 5201357 - DNA, 18 bp, Homo sapiens
agctactccggaggctga

SEQ ID NO: 5201358 - DNA, 16 bp, Homo sapiens
agctactctgatccct

SEQ ID NO: 5201359 - DNA, 17 bp, Homo sapiens
agctactctgatccctc

SEQ ID NO: 5201360 - DNA, 18 bp, Homo sapiens
agctactctgtccaggcc

SEQ ID NO: 5201361 - DNA, 18 bp, Homo sapiens
agctactgatgaaatctg

SEQ ID NO: 5201362 - DNA, 23 bp, Homo sapiens
agctactgatttcctttggagct

SEQ ID NO: 5201363 - DNA, 16 bp, Homo sapiens
agctactgatttttgt

SEQ ID NO: 5201364 - DNA, 22 bp, Homo sapiens
agctactgccatcctggcccag

SEQ ID NO: 5201365 - DNA, 23 bp, Homo sapiens
agctactgccgtcagtgctgtgc

SEQ ID NO: 5201366 - DNA, 18 bp, Homo sapiens
agctactggggaggctga

SEQ ID NO: 5201367 - DNA, 21 bp, Homo sapiens
agctactggggaggctgaggc

SEQ ID NO: 5201368 - DNA, 13 bp, Homo sapiens
agctactgtaact

SEQ ID NO: 5201369 - DNA, 16 bp, Homo sapiens
agctactgtagaaagg

SEQ ID NO: 5201370 - DNA, 18 bp, Homo sapiens
agctactgtagaaaggaa

SEQ ID NO: 5201371 - DNA, 17 bp, Homo sapiens
agctacttaagagaaat

SEQ ID NO: 5201372 - DNA, 21 bp, Homo sapiens
agctacttaagagaaatggca

SEQ ID NO: 5201373 - DNA, 13 bp, Homo sapiens
agctacttgatgt

SEQ ID NO: 5201374 - DNA, 17 bp, Homo sapiens
agctacttggcaggctg

SEQ ID NO: 5201375 - DNA, 18 bp, Homo sapiens
agctacttgggagcctga

SEQ ID NO: 5201376 - DNA, 21 bp, Homo sapiens
agctacttgggaggctgaggc

SEQ ID NO: 5201377 - DNA, 13 bp, Homo sapiens
agctacttgggcc

SEQ ID NO: 5201378 - DNA, 19 bp, Homo sapiens
agctactttccatttggta

SEQ ID NO: 5201379 - DNA, 18 bp, Homo sapiens
agctagaaaaataaaatg

SEQ ID NO: 5201380 - DNA, 12 bp, Homo sapiens
agctagaaacaa

SEQ ID NO: 5201381 - DNA, 13 bp, Homo sapiens
agctagaaagaga

SEQ ID NO: 5201382 - DNA, 21 bp, Homo sapiens
agctagaaagtggcagagcca

SEQ ID NO: 5201383 - DNA, 22 bp, Homo sapiens
agctagaaagtggcagagccag

SEQ ID NO: 5201384 - DNA, 15 bp, Homo sapiens
agctagaaccctctg

SEQ ID NO: 5201385 - DNA, 17 bp, Homo sapiens
agctagaaccctctgtt

SEQ ID NO: 5201386 - DNA, 16 bp, Homo sapiens
agctagaaggccacat

SEQ ID NO: 5201387 - DNA, 22 bp, Homo sapiens
agctagaagtgggccaggacag

SEQ ID NO: 5201388 - DNA, 15 bp, Homo sapiens
agctagaatttctgg

SEQ ID NO: 5201389 - DNA, 19 bp, Homo sapiens
agctagacaaaggcccaga

SEQ ID NO: 5201390 - DNA, 21 bp, Homo sapiens
agctagacaaaggcccagaaa

SEQ ID NO: 5201391 - DNA, 13 bp, Homo sapiens
agctagacaatga

SEQ ID NO: 5201392 - DNA, 15 bp, Homo sapiens
agctagacacatgaa

SEQ ID NO: 5201393 - DNA, 16 bp, Homo sapiens
agctagaccaaggtca

SEQ ID NO: 5201394 - DNA, 15 bp, Homo sapiens
agctagactaggaga

SEQ ID NO: 5201395 - DNA, 21 bp, Homo sapiens
aggacctgcatccttcctggg

SEQ ID NO: 5201396 - DNA, 12 bp, Homo sapiens
aggacctgcccg

SEQ ID NO: 5201397 - DNA, 14 bp, Homo sapiens
aggacctgcctgta

SEQ ID NO: 5201398 - DNA, 13 bp, Homo sapiens
aggacctgcggcc

SEQ ID NO: 5201399 - DNA, 18 bp, Homo sapiens
aggacctggcatcatggt

SEQ ID NO: 5201400 - DNA, 20 bp, Homo sapiens
aggacctggcttggctttaa

SEQ ID NO: 5201401 - DNA, 17 bp, Homo sapiens
aggacctgtatttaagc

SEQ ID NO: 5201402 - DNA, 18 bp, Homo sapiens
aggacctgtatttaagca

SEQ ID NO: 5201403 - DNA, 17 bp, Homo sapiens
aggaccttaagacagag

SEQ ID NO: 5201404 - DNA, 16 bp, Homo sapiens
aggaccttatctgtgc

SEQ ID NO: 5201405 - DNA, 21 bp, Homo sapiens
aggaccttcactctaagatgt

SEQ ID NO: 5201406 - DNA, 20 bp, Homo sapiens
aggaccttcgggctgtgccc

SEQ ID NO: 5201407 - DNA, 11 bp, Homo sapiens
aggaccttgct

SEQ ID NO: 5201408 - DNA, 15 bp, Homo sapiens
aggaccttgggccaa

SEQ ID NO: 5201409 - DNA, 23 bp, Homo sapiens
aggacctttaggtcaaactccct

SEQ ID NO: 5201410 - DNA, 22 bp, Homo sapiens
aggacctttccaccacagccag

SEQ ID NO: 5201411 - DNA, 16 bp, Homo sapiens
aggacgagacccccat

SEQ ID NO: 5201412 - DNA, 23 bp, Homo sapiens
aggacgagggatgggatttcatg

SEQ ID NO: 5201413 - DNA, 20 bp, Homo sapiens
aggacgatttcactgacact

SEQ ID NO: 5201414 - DNA, 21 bp, Homo sapiens
aggacgcacgctcgctgccat

SEQ ID NO: 5201415 - DNA, 18 bp, Homo sapiens
aggacgcagggagaccct

SEQ ID NO: 5201416 - DNA, 21 bp, Homo sapiens
aggacgccaacttctcccacc

SEQ ID NO: 5201417 - DNA, 23 bp, Homo sapiens
aggacgccaacttctcccacccc

SEQ ID NO: 5201418 - DNA, 20 bp, Homo sapiens
aggacgccactcatttcatc

SEQ ID NO: 5201419 - DNA, 14 bp, Homo sapiens
aggacgcctgcagg

SEQ ID NO: 5201420 - DNA, 17 bp, Homo sapiens
aggacgcctgcaggaga

SEQ ID NO: 5201421 - DNA, 22 bp, Homo sapiens
aggacgcgaggggaaaggcctg

SEQ ID NO: 5201422 - DNA, 19 bp, Homo sapiens
aggacgctgaccgtggagc

SEQ ID NO: 5201423 - DNA, 14 bp, Homo sapiens
aggacgctggctac

SEQ ID NO: 5201424 - DNA, 21 bp, Homo sapiens
aggacggaaaatgcttaaaaa

SEQ ID NO: 5201425 - DNA, 23 bp, Homo sapiens
aggacggagtggggggacagaga

SEQ ID NO: 5201426 - DNA, 19 bp, Homo sapiens
aggacggcaaggctgaggt

SEQ ID NO: 5201427 - DNA, 14 bp, Homo sapiens
aggacggccctgcc

SEQ ID NO: 5201428 - DNA, 13 bp, Homo sapiens
aggacggccggct

SEQ ID NO: 5201429 - DNA, 15 bp, Homo sapiens
aggacggctcctcag

SEQ ID NO: 5201430 - DNA, 14 bp, Homo sapiens
aggacgggccacac

SEQ ID NO: 5201431 - DNA, 14 bp, Homo sapiens
aggacggggcagag

SEQ ID NO: 5201432 - DNA, 17 bp, Homo sapiens
aggacggtccccacccc

SEQ ID NO: 5201433 - DNA, 16 bp, Homo sapiens
aggacggtctgtgccc

SEQ ID NO: 5201434 - DNA, 18 bp, Homo sapiens
aggacggtgccaagggcc

SEQ ID NO: 5201435 - DNA, 16 bp, Homo sapiens
aggacggttgtaagca

SEQ ID NO: 5201436 - DNA, 15 bp, Homo sapiens
aggacgtccttccat

SEQ ID NO: 5201437 - DNA, 23 bp, Homo sapiens
aggacgtccttccatatccctgc

SEQ ID NO: 5201438 - DNA, 18 bp, Homo sapiens
aggacgtggactggggta

SEQ ID NO: 5201439 - DNA, 20 bp, Homo sapiens
aggacgtggactggggtagg

SEQ ID NO: 5201440 - DNA, 19 bp, Homo sapiens
aggacgtgtgtaaatatgt

SEQ ID NO: 5201441 - DNA, 19 bp, Homo sapiens
aggactaacaactgggaaa

SEQ ID NO: 5201442 - DNA, 18 bp, Homo sapiens
aggactaacactcagaag

SEQ ID NO: 5201443 - DNA, 22 bp, Homo sapiens
aggactaacataaaatctgtga

SEQ ID NO: 5201444 - DNA, 13 bp, Homo sapiens
aggactaatagaa

SEQ ID NO: 5201445 - DNA, 21 bp, Homo sapiens
aggactacaataccctaccct

SEQ ID NO: 5201446 - DNA, 14 bp, Homo sapiens
aggactacagaatt

SEQ ID NO: 5201447 - DNA, 15 bp, Homo sapiens
aggactacagaattg

SEQ ID NO: 5201448 - DNA, 16 bp, Homo sapiens
aggactacagaattgg

SEQ ID NO: 5201449 - DNA, 14 bp, Homo sapiens
aggactacaggtat

SEQ ID NO: 5201450 - DNA, 14 bp, Homo sapiens
aggactaccgcagg

SEQ ID NO: 5201451 - DNA, 17 bp, Homo sapiens
aggactaccgcaggccc

SEQ ID NO: 5201452 - DNA, 20 bp, Homo sapiens
aggactaccgcaggcccgga

SEQ ID NO: 5201453 - DNA, 20 bp, Homo sapiens
aggactacgttaagggaagg

SEQ ID NO: 5201454 - DNA, 21 bp, Homo sapiens
aggactagaaaaacttgggtc

SEQ ID NO: 5201455 - DNA, 13 bp, Homo sapiens
aggactagaagat

SEQ ID NO: 5201456 - DNA, 14 bp, Homo sapiens
aggactaggaccca

SEQ ID NO: 5201457 - DNA, 19 bp, Homo sapiens
aggactagggtcctgggga

SEQ ID NO: 5201458 - DNA, 16 bp, Homo sapiens
aggactatagcccagg

SEQ ID NO: 5201459 - DNA, 18 bp, Homo sapiens
aggactatagcccaggtc

SEQ ID NO: 5201460 - DNA, 20 bp, Homo sapiens
aggactatagcccaggtcct

SEQ ID NO: 5201461 - DNA, 21 bp, Homo sapiens
aggactatattaatcaccttc

SEQ ID NO: 5201462 - DNA, 16 bp, Homo sapiens
aggactattaattcca

SEQ ID NO: 5201463 - DNA, 18 bp, Homo sapiens
aggactcaacattacatt

SEQ ID NO: 5201464 - DNA, 22 bp, Homo sapiens
aggactcacaggttggaagaga

SEQ ID NO: 5201465 - DNA, 14 bp, Homo sapiens
aggactcagctccc

SEQ ID NO: 5201466 - DNA, 17 bp, Homo sapiens
aggactccactggacag

SEQ ID NO: 5201467 - DNA, 20 bp, Homo sapiens
aggactccactggacagacc

SEQ ID NO: 5201468 - DNA, 14 bp, Homo sapiens
aggactccaggcag

SEQ ID NO: 5201469 - DNA, 18 bp, Homo sapiens
aggactcccaaccctggc

SEQ ID NO: 5201470 - DNA, 13 bp, Homo sapiens
aggactcccagaa

SEQ ID NO: 5201471 - DNA, 17 bp, Homo sapiens
aggactcccagaacctc

SEQ ID NO: 5201472 - DNA, 17 bp, Homo sapiens
aggactccccaggccag

SEQ ID NO: 5201473 - DNA, 15 bp, Homo sapiens
aggactccccgaggt

SEQ ID NO: 5201474 - DNA, 20 bp, Homo sapiens
aggactccctccatgtggcc

SEQ ID NO: 5201475 - DNA, 14 bp, Homo sapiens
aggactccctcctc

SEQ ID NO: 5201476 - DNA, 15 bp, Homo sapiens
aggactccctcctca

SEQ ID NO: 5201477 - DNA, 21 bp, Homo sapiens
aggactcctcctttttccatg

SEQ ID NO: 5201478 - DNA, 13 bp, Homo sapiens
aggactcctggca

SEQ ID NO: 5201479 - DNA, 17 bp, Homo sapiens
aggactcgcttgtaaat

SEQ ID NO: 5201480 - DNA, 20 bp, Homo sapiens
aggactcggccactgtgtct

SEQ ID NO: 5201481 - DNA, 21 bp, Homo sapiens
aggactctcacgatatgcaag

SEQ ID NO: 5201482 - DNA, 16 bp, Homo sapiens
aggactctcctcttcg

SEQ ID NO: 5201483 - DNA, 14 bp, Homo sapiens
aggactctctccag

SEQ ID NO: 5201484 - DNA, 22 bp, Homo sapiens
aggactctgcaagtgtctggag

SEQ ID NO: 5201485 - DNA, 24 bp, Homo sapiens
aggactctgcaagtgtctggagcg

SEQ ID NO: 5201486 - DNA, 14 bp, Homo sapiens
aggactctgcagat

SEQ ID NO: 5201487 - DNA, 19 bp, Homo sapiens
aggactctgcagcctcaga

SEQ ID NO: 5201488 - DNA, 20 bp, Homo sapiens
aggactctgccccttctgtt

SEQ ID NO: 5201489 - DNA, 12 bp, Homo sapiens
aggactctgcct

SEQ ID NO: 5201490 - DNA, 13 bp, Homo sapiens
aggactctgcctt

SEQ ID NO: 5201491 - DNA, 21 bp, Homo sapiens
aggactctgccttccaggcgt

SEQ ID NO: 5201492 - DNA, 19 bp, Homo sapiens
aggactctgcgggaggctg

SEQ ID NO: 5201493 - DNA, 22 bp, Homo sapiens
aggactctgcgggaggctgggg

SEQ ID NO: 5201494 - DNA, 23 bp, Homo sapiens
aggactctggaagattttcattg

SEQ ID NO: 5201495 - DNA, 22 bp, Homo sapiens
aggactcttccatcagagatgg

SEQ ID NO: 5201496 - DNA, 17 bp, Homo sapiens
aggactctttccgactg

SEQ ID NO: 5201497 - DNA, 22 bp, Homo sapiens
aggactctttccgactgcccag

SEQ ID NO: 5201498 - DNA, 13 bp, Homo sapiens
aggactctttgaa

SEQ ID NO: 5201499 - DNA, 14 bp, Homo sapiens
aggactgaagaaaa

SEQ ID NO: 5201500 - DNA, 13 bp, Homo sapiens
aggactgaagctg

SEQ ID NO: 5201501 - DNA, 15 bp, Homo sapiens
aggactgaagctggg

SEQ ID NO: 5201502 - DNA, 19 bp, Homo sapiens
aggactgaattatgaaact

SEQ ID NO: 5201503 - DNA, 17 bp, Homo sapiens
aggactgaattgtcccc

SEQ ID NO: 5201504 - DNA, 22 bp, Homo sapiens
aggactgacctgcccctgccgc

SEQ ID NO: 5201505 - DNA, 17 bp, Homo sapiens
aggactgactgaggcag

SEQ ID NO: 5201506 - DNA, 16 bp, Homo sapiens
aggactgactttgcca

SEQ ID NO: 5201507 - DNA, 15 bp, Homo sapiens
aggactgagactggc

SEQ ID NO: 5201508 - DNA, 19 bp, Homo sapiens
aggactgagcaccctctgg

SEQ ID NO: 5201509 - DNA, 21 bp, Homo sapiens
aggactgagccctctcactcc

SEQ ID NO: 5201510 - DNA, 22 bp, Homo sapiens
aggactgagccctctcactcca

SEQ ID NO: 5201511 - DNA, 21 bp, Homo sapiens
aggactgagggcagtgccctt

SEQ ID NO: 5201512 - DNA, 16 bp, Homo sapiens
aggactgcaccattgc

SEQ ID NO: 5201513 - DNA, 14 bp, Homo sapiens
aggactgcagagca

SEQ ID NO: 5201514 - DNA, 16 bp, Homo sapiens
aggactgcagagggct

SEQ ID NO: 5201515 - DNA, 15 bp, Homo sapiens
aggactgcagtgtgg

SEQ ID NO: 5201516 - DNA, 10 bp, Homo sapiens
aggactggaa

SEQ ID NO: 5201517 - DNA, 19 bp, Homo sapiens
aggactggccgtggctcca

SEQ ID NO: 5201518 - DNA, 21 bp, Homo sapiens
aggactggccgtggctccaga

SEQ ID NO: 5201519 - DNA, 10 bp, Homo sapiens
aggactggct

SEQ ID NO: 5201520 - DNA, 17 bp, Homo sapiens
aggactggctgccccgt

SEQ ID NO: 5201521 - DNA, 20 bp, Homo sapiens
aggactgggagcccccagcc

SEQ ID NO: 5201522 - DNA, 23 bp, Homo sapiens
aggactgggagcccccagcctgt

SEQ ID NO: 5201523 - DNA, 12 bp, Homo sapiens
aggactgggcca

SEQ ID NO: 5201524 - DNA, 21 bp, Homo sapiens
aggactgggcccgagggtggt

SEQ ID NO: 5201525 - DNA, 23 bp, Homo sapiens
aggactgggccgggcccagggcc

SEQ ID NO: 5201526 - DNA, 15 bp, Homo sapiens
aggactggggcttgc

SEQ ID NO: 5201527 - DNA, 19 bp, Homo sapiens
aggactggggcttgccagg

SEQ ID NO: 5201528 - DNA, 20 bp, Homo sapiens
aggactggggcttgccaggc

SEQ ID NO: 5201529 - DNA, 21 bp, Homo sapiens
aggactggggcttgccaggct

SEQ ID NO: 5201530 - DNA, 16 bp, Homo sapiens
aggactggtgaatata

SEQ ID NO: 5201531 - DNA, 13 bp, Homo sapiens
aggactggtgcct

SEQ ID NO: 5201532 - DNA, 14 bp, Homo sapiens
aggactggtgcgac

SEQ ID NO: 5201533 - DNA, 23 bp, Homo sapiens
aggactggtgcgaccccccaccc

SEQ ID NO: 5201534 - DNA, 16 bp, Homo sapiens
aggactggttccttcc

SEQ ID NO: 5201535 - DNA, 18 bp, Homo sapiens
aggactggttccttcctt

SEQ ID NO: 5201536 - DNA, 20 bp, Homo sapiens
aggactggttctgaggccag

SEQ ID NO: 5201537 - DNA, 21 bp, Homo sapiens
aggactggttctgaggccaga

SEQ ID NO: 5201538 - DNA, 13 bp, Homo sapiens
aggactgtaaaca

SEQ ID NO: 5201539 - DNA, 15 bp, Homo sapiens
aggactgtaagcaga

SEQ ID NO: 5201540 - DNA, 18 bp, Homo sapiens
aggactgtataggtagat

SEQ ID NO: 5201541 - DNA, 21 bp, Homo sapiens
aggactgtcattttggcatct

SEQ ID NO: 5201542 - DNA, 14 bp, Homo sapiens
aggactgtcctccc

SEQ ID NO: 5201543 - DNA, 23 bp, Homo sapiens
aggactgtcctcccacagacctg

SEQ ID NO: 5201544 - DNA, 16 bp, Homo sapiens
aggactgtgacaggca

SEQ ID NO: 5201545 - DNA, 18 bp, Homo sapiens
aggactgtgacaggcagc

SEQ ID NO: 5201546 - DNA, 19 bp, Homo sapiens
aggactgtgacaggcagca

SEQ ID NO: 5201547 - DNA, 22 bp, Homo sapiens
aggactgtgacaggcagcagag

SEQ ID NO: 5201548 - DNA, 15 bp, Homo sapiens
aggactgtgaccaaa

SEQ ID NO: 5201549 - DNA, 22 bp, Homo sapiens
aggactgtgataatcagaagct

SEQ ID NO: 5201550 - DNA, 14 bp, Homo sapiens
aggactgtgatgcc

SEQ ID NO: 5201551 - DNA, 22 bp, Homo sapiens
aggactgtggaggggagctgct

SEQ ID NO: 5201552 - DNA, 12 bp, Homo sapiens
aggactgtggca

SEQ ID NO: 5201553 - DNA, 17 bp, Homo sapiens
aggactgtggcaaacaa

SEQ ID NO: 5201554 - DNA, 14 bp, Homo sapiens
aggactgtggctgc

SEQ ID NO: 5201555 - DNA, 14 bp, Homo sapiens
aggactgtgggggc

SEQ ID NO: 5201556 - DNA, 20 bp, Homo sapiens
aggactgtgtttccaaaggt

SEQ ID NO: 5201557 - DNA, 22 bp, Homo sapiens
aggactgttactcaatgtgtgc

SEQ ID NO: 5201558 - DNA, 13 bp, Homo sapiens
aggactgttcttt

SEQ ID NO: 5201559 - DNA, 22 bp, Homo sapiens
aggactgttctttgctgttgtt

SEQ ID NO: 5201560 - DNA, 16 bp, Homo sapiens
aggactgtttcagtgt

SEQ ID NO: 5201561 - DNA, 18 bp, Homo sapiens
aggactgttttttcctga

SEQ ID NO: 5201562 - DNA, 14 bp, Homo sapiens
aggacttaatttag

SEQ ID NO: 5201563 - DNA, 21 bp, Homo sapiens
aggacttacccagtattactg

SEQ ID NO: 5201564 - DNA, 20 bp, Homo sapiens
aggacttagaatagtgccta

SEQ ID NO: 5201565 - DNA, 16 bp, Homo sapiens
aggacttagctggcca

SEQ ID NO: 5201566 - DNA, 11 bp, Homo sapiens
aggacttcaaa

SEQ ID NO: 5201567 - DNA, 18 bp, Homo sapiens
aggacttcaaaaggtgat

SEQ ID NO: 5201568 - DNA, 19 bp, Homo sapiens
aggacttcaggaacaagta

SEQ ID NO: 5201569 - DNA, 14 bp, Homo sapiens
aggacttcccgagc

SEQ ID NO: 5201570 - DNA, 19 bp, Homo sapiens
aggacttcggggtagaggc

SEQ ID NO: 5201571 - DNA, 22 bp, Homo sapiens
aggacttcggggtagaggctgg

SEQ ID NO: 5201572 - DNA, 14 bp, Homo sapiens
aggacttctgcctg

SEQ ID NO: 5201573 - DNA, 16 bp, Homo sapiens
agctagactggtgact

SEQ ID NO: 5201574 - DNA, 17 bp, Homo sapiens
agctagactggtgactg

SEQ ID NO: 5201575 - DNA, 12 bp, Homo sapiens
agctagactgtg

SEQ ID NO: 5201576 - DNA, 15 bp, Homo sapiens
agctagactgtgtct

SEQ ID NO: 5201577 - DNA, 16 bp, Homo sapiens
agctagactgtgtctg

SEQ ID NO: 5201578 - DNA, 19 bp, Homo sapiens
agctagagaggggcctctg

SEQ ID NO: 5201579 - DNA, 14 bp, Homo sapiens
agctagagcttcaa

SEQ ID NO: 5201580 - DNA, 14 bp, Homo sapiens
agctagagcttcca

SEQ ID NO: 5201581 - DNA, 21 bp, Homo sapiens
agctagatacgaaatcagttt

SEQ ID NO: 5201582 - DNA, 16 bp, Homo sapiens
agctagatactggaaa

SEQ ID NO: 5201583 - DNA, 13 bp, Homo sapiens
agctagatgcttt

SEQ ID NO: 5201584 - DNA, 20 bp, Homo sapiens
agctagccagagggtgggag

SEQ ID NO: 5201585 - DNA, 14 bp, Homo sapiens
agctagccagccaa

SEQ ID NO: 5201586 - DNA, 17 bp, Homo sapiens
agctagcctgaaggatt

SEQ ID NO: 5201587 - DNA, 23 bp, Homo sapiens
agctagcgtctcggcccttgccg

SEQ ID NO: 5201588 - DNA, 16 bp, Homo sapiens
agctagcgtgtgccag

SEQ ID NO: 5201589 - DNA, 18 bp, Homo sapiens
agctagctagcgcaccgc

SEQ ID NO: 5201590 - DNA, 19 bp, Homo sapiens
agctagctatttctatgta

SEQ ID NO: 5201591 - DNA, 22 bp, Homo sapiens
agctagctatttctatgtatgt

SEQ ID NO: 5201592 - DNA, 23 bp, Homo sapiens
agctagctatttctatgtatgtg

SEQ ID NO: 5201593 - DNA, 14 bp, Homo sapiens
agctagctcccctc

SEQ ID NO: 5201594 - DNA, 17 bp, Homo sapiens
agctagctgccactttc

SEQ ID NO: 5201595 - DNA, 15 bp, Homo sapiens
agctagctgcttttc

SEQ ID NO: 5201596 - DNA, 20 bp, Homo sapiens
agctagcttttaggaaaatc

SEQ ID NO: 5201597 - DNA, 20 bp, Homo sapiens
agctaggaaaagaaatctat

SEQ ID NO: 5201598 - DNA, 14 bp, Homo sapiens
agctaggaaagagg

SEQ ID NO: 5201599 - DNA, 22 bp, Homo sapiens
agctaggaaagagttgagcaca

SEQ ID NO: 5201600 - DNA, 16 bp, Homo sapiens
agctaggaaaggcaga

SEQ ID NO: 5201601 - DNA, 17 bp, Homo sapiens
agctaggaaaggcagaa

SEQ ID NO: 5201602 - DNA, 19 bp, Homo sapiens
agctaggaaaggcagaaac

SEQ ID NO: 5201603 - DNA, 18 bp, Homo sapiens
agctaggaaccctggagg

SEQ ID NO: 5201604 - DNA, 17 bp, Homo sapiens
agctaggactgaggagt

SEQ ID NO: 5201605 - DNA, 17 bp, Homo sapiens
agctaggagcaaagcct

SEQ ID NO: 5201606 - DNA, 20 bp, Homo sapiens
agctaggagcaaagcctgtt

SEQ ID NO: 5201607 - DNA, 21 bp, Homo sapiens
agctaggagcaaagcctgttc

SEQ ID NO: 5201608 - DNA, 20 bp, Homo sapiens
agctaggatggttctgtgac

SEQ ID NO: 5201609 - DNA, 20 bp, Homo sapiens
agctaggatttgaacacttg

SEQ ID NO: 5201610 - DNA, 12 bp, Homo sapiens
agctaggcaggg

SEQ ID NO: 5201611 - DNA, 13 bp, Homo sapiens
agctaggcaggga

SEQ ID NO: 5201612 - DNA, 21 bp, Homo sapiens
agctaggcagggagggggctg

SEQ ID NO: 5201613 - DNA, 15 bp, Homo sapiens
agctaggcatgcctg

SEQ ID NO: 5201614 - DNA, 18 bp, Homo sapiens
agctaggccccagaggcc

SEQ ID NO: 5201615 - DNA, 22 bp, Homo sapiens
agctaggccccagaggccctgg

SEQ ID NO: 5201616 - DNA, 12 bp, Homo sapiens
agctaggcctgg

SEQ ID NO: 5201617 - DNA, 15 bp, Homo sapiens
agctaggcctggcca

SEQ ID NO: 5201618 - DNA, 23 bp, Homo sapiens
agctaggcttcccaggctgggct

SEQ ID NO: 5201619 - DNA, 13 bp, Homo sapiens
agctagggctgct

SEQ ID NO: 5201620 - DNA, 22 bp, Homo sapiens
agctagggctgctgcttctgct

SEQ ID NO: 5201621 - DNA, 13 bp, Homo sapiens
agctagggctgga

SEQ ID NO: 5201622 - DNA, 20 bp, Homo sapiens
agctaggtgacatatacata

SEQ ID NO: 5201623 - DNA, 20 bp, Homo sapiens
agctaggttaataggaggac

SEQ ID NO: 5201624 - DNA, 15 bp, Homo sapiens
agctagtaatgcttt

SEQ ID NO: 5201625 - DNA, 16 bp, Homo sapiens
agctagtatcttcaaa

SEQ ID NO: 5201626 - DNA, 23 bp, Homo sapiens
agctagtcttttgcttttgccca

SEQ ID NO: 5201627 - DNA, 14 bp, Homo sapiens
agctagtgaagacc

SEQ ID NO: 5201628 - DNA, 20 bp, Homo sapiens
agctagtgacccacatgcca

SEQ ID NO: 5201629 - DNA, 19 bp, Homo sapiens
agctagtgatttacacagg

SEQ ID NO: 5201630 - DNA, 20 bp, Homo sapiens
agctagtgatttacacaggt

SEQ ID NO: 5201631 - DNA, 21 bp, Homo sapiens
agctagtgatttacacaggtt

SEQ ID NO: 5201632 - DNA, 13 bp, Homo sapiens
agctagtgccaaa

SEQ ID NO: 5201633 - DNA, 19 bp, Homo sapiens
agctagtgccaaataattg

SEQ ID NO: 5201634 - DNA, 21 bp, Homo sapiens
agctagtgcctttagagggta

SEQ ID NO: 5201635 - DNA, 19 bp, Homo sapiens
agctagtggcttcaaaata

SEQ ID NO: 5201636 - DNA, 22 bp, Homo sapiens
agctagtggtggcttctccagc

SEQ ID NO: 5201637 - DNA, 21 bp, Homo sapiens
agctagtgtacctcctctcag

SEQ ID NO: 5201638 - DNA, 14 bp, Homo sapiens
agctagtgtcttat

SEQ ID NO: 5201639 - DNA, 20 bp, Homo sapiens
agctagttaatgtcagtgac

SEQ ID NO: 5201640 - DNA, 15 bp, Homo sapiens
agctagttagctcac

SEQ ID NO: 5201641 - DNA, 17 bp, Homo sapiens
agctagttcgtagcttt

SEQ ID NO: 5201642 - DNA, 18 bp, Homo sapiens
agctagttcgtagctttc

SEQ ID NO: 5201643 - DNA, 17 bp, Homo sapiens
agctagttgaatacttg

SEQ ID NO: 5201644 - DNA, 19 bp, Homo sapiens
agctagttgaatacttgaa

SEQ ID NO: 5201645 - DNA, 24 bp, Homo sapiens
agctagttgaatacttgaaccata

SEQ ID NO: 5201646 - DNA, 21 bp, Homo sapiens
agctagttggttgaatttttt

SEQ ID NO: 5201647 - DNA, 15 bp, Homo sapiens
agctataaagtatat

SEQ ID NO: 5201648 - DNA, 12 bp, Homo sapiens
agctataaatag

SEQ ID NO: 5201649 - DNA, 23 bp, Homo sapiens
agctataaattcctctttgcttt

SEQ ID NO: 5201650 - DNA, 20 bp, Homo sapiens
agctataacatatttattgt

SEQ ID NO: 5201651 - DNA, 14 bp, Homo sapiens
agctataacatttg

SEQ ID NO: 5201652 - DNA, 16 bp, Homo sapiens
agctataatgtttccc

SEQ ID NO: 5201653 - DNA, 20 bp, Homo sapiens
agctatagttgcagcccaag

SEQ ID NO: 5201654 - DNA, 17 bp, Homo sapiens
agctatataagacaaga

SEQ ID NO: 5201655 - DNA, 23 bp, Homo sapiens
agctatatatatatatatatgta

SEQ ID NO: 5201656 - DNA, 20 bp, Homo sapiens
agctatatccatgtactgta

SEQ ID NO: 5201657 - DNA, 22 bp, Homo sapiens
agctatatccatgtactgtagt

SEQ ID NO: 5201658 - DNA, 21 bp, Homo sapiens
agctatatcgaatatagttct

SEQ ID NO: 5201659 - DNA, 18 bp, Homo sapiens
agctatatttaagtattc

SEQ ID NO: 5201660 - DNA, 22 bp, Homo sapiens
agctatatttaagtattcaaga

SEQ ID NO: 5201661 - DNA, 20 bp, Homo sapiens
agctatatttgattatgtat

SEQ ID NO: 5201662 - DNA, 15 bp, Homo sapiens
agctatcaagaggct

SEQ ID NO: 5201663 - DNA, 21 bp, Homo sapiens
agctatcaagaggctgagaca

SEQ ID NO: 5201664 - DNA, 23 bp, Homo sapiens
agctatcaagtgtgctttagctt

SEQ ID NO: 5201665 - DNA, 12 bp, Homo sapiens
agctatcagcaa

SEQ ID NO: 5201666 - DNA, 18 bp, Homo sapiens
agctatcagtgttcttct

SEQ ID NO: 5201667 - DNA, 16 bp, Homo sapiens
agctatccagtgactt

SEQ ID NO: 5201668 - DNA, 23 bp, Homo sapiens
agctatcctaaatttgaaatagt

SEQ ID NO: 5201669 - DNA, 16 bp, Homo sapiens
agctatcctggctctt

SEQ ID NO: 5201670 - DNA, 17 bp, Homo sapiens
agctatcgtaaaattaa

SEQ ID NO: 5201671 - DNA, 18 bp, Homo sapiens
agctatctaaagtttgtt

SEQ ID NO: 5201672 - DNA, 18 bp, Homo sapiens
agctatctaggtggagtt

SEQ ID NO: 5201673 - DNA, 18 bp, Homo sapiens
agctatctatatggaatt

SEQ ID NO: 5201674 - DNA, 14 bp, Homo sapiens
agctatctctgtgg

SEQ ID NO: 5201675 - DNA, 22 bp, Homo sapiens
agctatctgcactctaaactgc

SEQ ID NO: 5201676 - DNA, 23 bp, Homo sapiens
agctatctgcactctaaactgca

SEQ ID NO: 5201677 - DNA, 16 bp, Homo sapiens
agctatctgcctgaca

SEQ ID NO: 5201678 - DNA, 24 bp, Homo sapiens
agctatctggtcaacctcctggac

SEQ ID NO: 5201679 - DNA, 17 bp, Homo sapiens
agctatcttcatgtaaa

SEQ ID NO: 5201680 - DNA, 20 bp, Homo sapiens
agctatgaaatactcagggt

SEQ ID NO: 5201681 - DNA, 13 bp, Homo sapiens
agctatgaagaaa

SEQ ID NO: 5201682 - DNA, 15 bp, Homo sapiens
agctatgagaataac

SEQ ID NO: 5201683 - DNA, 18 bp, Homo sapiens
agctatgagagatgtgtc

SEQ ID NO: 5201684 - DNA, 13 bp, Homo sapiens
agctatgagagga

SEQ ID NO: 5201685 - DNA, 16 bp, Homo sapiens
agctatgatatgtgct

SEQ ID NO: 5201686 - DNA, 20 bp, Homo sapiens
agctatgatttttttttcca

SEQ ID NO: 5201687 - DNA, 17 bp, Homo sapiens
agctatgcaaaaagcta

SEQ ID NO: 5201688 - DNA, 23 bp, Homo sapiens
agctatgctggtaggctcctgcc

SEQ ID NO: 5201689 - DNA, 17 bp, Homo sapiens
agctatgctgtatctgt

SEQ ID NO: 5201690 - DNA, 20 bp, Homo sapiens
agctatgctgtatctgtgct

SEQ ID NO: 5201691 - DNA, 15 bp, Homo sapiens
agctatggacaattt

SEQ ID NO: 5201692 - DNA, 20 bp, Homo sapiens
agctatggacagcattgcca

SEQ ID NO: 5201693 - DNA, 20 bp, Homo sapiens
agctatggagagaattaaaa

SEQ ID NO: 5201694 - DNA, 21 bp, Homo sapiens
agctatggcccagaaacaaca

SEQ ID NO: 5201695 - DNA, 20 bp, Homo sapiens
agctatggcccatctgtatg

SEQ ID NO: 5201696 - DNA, 19 bp, Homo sapiens
agctatgggagccccaggg

SEQ ID NO: 5201697 - DNA, 17 bp, Homo sapiens
agctatggtgagatgca

SEQ ID NO: 5201698 - DNA, 20 bp, Homo sapiens
agctatggtgagatgcagct

SEQ ID NO: 5201699 - DNA, 13 bp, Homo sapiens
agctatggtgagg

SEQ ID NO: 5201700 - DNA, 16 bp, Homo sapiens
agctatggttgtaaca

SEQ ID NO: 5201701 - DNA, 15 bp, Homo sapiens
agctatgtaaatgac

SEQ ID NO: 5201702 - DNA, 20 bp, Homo sapiens
agctatgtcccaggaatcag

SEQ ID NO: 5201703 - DNA, 14 bp, Homo sapiens
agctattaaaactc

SEQ ID NO: 5201704 - DNA, 18 bp, Homo sapiens
agctattaaaatgtaact

SEQ ID NO: 5201705 - DNA, 18 bp, Homo sapiens
agctattagcaactgtgc

SEQ ID NO: 5201706 - DNA, 20 bp, Homo sapiens
agctattagcaactgtgcta

SEQ ID NO: 5201707 - DNA, 14 bp, Homo sapiens
agctattagccagg

SEQ ID NO: 5201708 - DNA, 15 bp, Homo sapiens
agctattcacacaca

SEQ ID NO: 5201709 - DNA, 21 bp, Homo sapiens
agctattcacctcagtagaaa

SEQ ID NO: 5201710 - DNA, 14 bp, Homo sapiens
agctattcaggagg

SEQ ID NO: 5201711 - DNA, 20 bp, Homo sapiens
agctattcctttcccttcct

SEQ ID NO: 5201712 - DNA, 22 bp, Homo sapiens
agctattcctttcccttcctct

SEQ ID NO: 5201713 - DNA, 13 bp, Homo sapiens
agctattgatgtt

SEQ ID NO: 5201714 - DNA, 14 bp, Homo sapiens
agctattgatgttt

SEQ ID NO: 5201715 - DNA, 16 bp, Homo sapiens
agctattgcatgtaaa

SEQ ID NO: 5201716 - DNA, 22 bp, Homo sapiens
agctattggcctcccaaaagac

SEQ ID NO: 5201717 - DNA, 23 bp, Homo sapiens
agctattggcctcccaaaagact

SEQ ID NO: 5201718 - DNA, 15 bp, Homo sapiens
agctatttaaagcat

SEQ ID NO: 5201719 - DNA, 21 bp, Homo sapiens
agctatttaagtggactgtat

SEQ ID NO: 5201720 - DNA, 11 bp, Homo sapiens
agctatttaat

SEQ ID NO: 5201721 - DNA, 22 bp, Homo sapiens
agctatttaatatctggcactg

SEQ ID NO: 5201722 - DNA, 15 bp, Homo sapiens
agctatttatgggcc

SEQ ID NO: 5201723 - DNA, 16 bp, Homo sapiens
agctatttatgggccc

SEQ ID NO: 5201724 - DNA, 17 bp, Homo sapiens
agctatttatgggcccc

SEQ ID NO: 5201725 - DNA, 22 bp, Homo sapiens
agctatttcagcctcctgtttg

SEQ ID NO: 5201726 - DNA, 17 bp, Homo sapiens
agctatttcatctattt

SEQ ID NO: 5201727 - DNA, 14 bp, Homo sapiens
agctatttcccttt

SEQ ID NO: 5201728 - DNA, 14 bp, Homo sapiens
agctatttccttcc

SEQ ID NO: 5201729 - DNA, 16 bp, Homo sapiens
agctatttctatgtat

SEQ ID NO: 5201730 - DNA, 15 bp, Homo sapiens
agctatttgatgtaa

SEQ ID NO: 5201731 - DNA, 20 bp, Homo sapiens
agctatttgatgtaatactt

SEQ ID NO: 5201732 - DNA, 14 bp, Homo sapiens
agctatttgtggtt

SEQ ID NO: 5201733 - DNA, 20 bp, Homo sapiens
agctatttgtggttgttgag

SEQ ID NO: 5201734 - DNA, 16 bp, Homo sapiens
agctatttgttaaaat

SEQ ID NO: 5201735 - DNA, 15 bp, Homo sapiens
agctattttaagcca

SEQ ID NO: 5201736 - DNA, 20 bp, Homo sapiens
agctattttagaaagctaaa

SEQ ID NO: 5201737 - DNA, 15 bp, Homo sapiens
agctattttcctctg

SEQ ID NO: 5201738 - DNA, 13 bp, Homo sapiens
agctattttcctt

SEQ ID NO: 5201739 - DNA, 19 bp, Homo sapiens
agctattttccttgctttt

SEQ ID NO: 5201740 - DNA, 14 bp, Homo sapiens
agctattttctgac

SEQ ID NO: 5201741 - DNA, 16 bp, Homo sapiens
agctattttctgacca

SEQ ID NO: 5201742 - DNA, 17 bp, Homo sapiens
agctatttttctaacta

SEQ ID NO: 5201743 - DNA, 20 bp, Homo sapiens
agctatttttctaactacaa

SEQ ID NO: 5201744 - DNA, 23 bp, Homo sapiens
agctattttttaaaaaaaactat

SEQ ID NO: 5201745 - DNA, 21 bp, Homo sapiens
agctatttttttcctaagaca

SEQ ID NO: 5201746 - DNA, 14 bp, Homo sapiens
agctcaaaccctgt

SEQ ID NO: 5201747 - DNA, 18 bp, Homo sapiens
agctcaaagacttccacc

SEQ ID NO: 5201748 - DNA, 22 bp, Homo sapiens
agctcaaagcgtggacaggtgt

SEQ ID NO: 5201749 - DNA, 16 bp, Homo sapiens
agctcaaaggcacagt

SEQ ID NO: 5201750 - DNA, 16 bp, Homo sapiens
aggacttctttaattt

SEQ ID NO: 5201751 - DNA, 21 bp, Homo sapiens
aggacttctttaattttggaa

SEQ ID NO: 5201752 - DNA, 22 bp, Homo sapiens
aggacttctttaattttggaat

SEQ ID NO: 5201753 - DNA, 21 bp, Homo sapiens
aggacttgaaagcatccatgt

SEQ ID NO: 5201754 - DNA, 16 bp, Homo sapiens
aggacttgagcctcca

SEQ ID NO: 5201755 - DNA, 22 bp, Homo sapiens
aggacttgagcctccatttctg

SEQ ID NO: 5201756 - DNA, 17 bp, Homo sapiens
aggacttgctaaagcac

SEQ ID NO: 5201757 - DNA, 16 bp, Homo sapiens
aggacttggagggtct

SEQ ID NO: 5201758 - DNA, 23 bp, Homo sapiens
aggacttgggcgggacacaggct

SEQ ID NO: 5201759 - DNA, 21 bp, Homo sapiens
aggacttgggggcagagcagc

SEQ ID NO: 5201760 - DNA, 17 bp, Homo sapiens
aggacttggggtcagga

SEQ ID NO: 5201761 - DNA, 23 bp, Homo sapiens
aggacttggtaagatgactctga

SEQ ID NO: 5201762 - DNA, 16 bp, Homo sapiens
aggacttgtgtctctg

SEQ ID NO: 5201763 - DNA, 20 bp, Homo sapiens
aggacttgttaaagagcact

SEQ ID NO: 5201764 - DNA, 21 bp, Homo sapiens
aggacttgttaaagagcactg

SEQ ID NO: 5201765 - DNA, 13 bp, Homo sapiens
aggactttccagt

SEQ ID NO: 5201766 - DNA, 23 bp, Homo sapiens
aggactttgaggcaagtgtgggc

SEQ ID NO: 5201767 - DNA, 22 bp, Homo sapiens
aggactttgattgcacattgtt

SEQ ID NO: 5201768 - DNA, 22 bp, Homo sapiens
aggactttggcttacatttgaa

SEQ ID NO: 5201769 - DNA, 22 bp, Homo sapiens
aggactttggtcacccagacta

SEQ ID NO: 5201770 - DNA, 17 bp, Homo sapiens
aggacttttctttgtgg

SEQ ID NO: 5201771 - DNA, 15 bp, Homo sapiens
aggagaaaaaaaacc

SEQ ID NO: 5201772 - DNA, 13 bp, Homo sapiens
aggagaaaaacaa

SEQ ID NO: 5201773 - DNA, 19 bp, Homo sapiens
aggagaaaaagaagaaaag

SEQ ID NO: 5201774 - DNA, 21 bp, Homo sapiens
aggagaaaaagaagaaaagat

SEQ ID NO: 5201775 - DNA, 17 bp, Homo sapiens
aggagaaaaattattcc

SEQ ID NO: 5201776 - DNA, 17 bp, Homo sapiens
aggagaaaagtgggctg

SEQ ID NO: 5201777 - DNA, 14 bp, Homo sapiens
aggagaaaatgcaa

SEQ ID NO: 5201778 - DNA, 16 bp, Homo sapiens
aggagaaacagagaca

SEQ ID NO: 5201779 - DNA, 20 bp, Homo sapiens
aggagaaactctagactgca

SEQ ID NO: 5201780 - DNA, 11 bp, Homo sapiens
aggagaaactg

SEQ ID NO: 5201781 - DNA, 18 bp, Homo sapiens
aggagaaactggaactct

SEQ ID NO: 5201782 - DNA, 23 bp, Homo sapiens
aggagaaagaaagtacccagcaa

SEQ ID NO: 5201783 - DNA, 12 bp, Homo sapiens
aggagaaataaa

SEQ ID NO: 5201784 - DNA, 14 bp, Homo sapiens
aggagaaataaact

SEQ ID NO: 5201785 - DNA, 15 bp, Homo sapiens
aggagaaatgcaata

SEQ ID NO: 5201786 - DNA, 18 bp, Homo sapiens
aggagaaatgcaataact

SEQ ID NO: 5201787 - DNA, 20 bp, Homo sapiens
aggagaaattttggtttttc

SEQ ID NO: 5201788 - DNA, 15 bp, Homo sapiens
aggagaaccactaca

SEQ ID NO: 5201789 - DNA, 15 bp, Homo sapiens
aggagaactgtgctc

SEQ ID NO: 5201790 - DNA, 15 bp, Homo sapiens
aggagaacttgctgc

SEQ ID NO: 5201791 - DNA, 17 bp, Homo sapiens
aggagaacttgctgcct

SEQ ID NO: 5201792 - DNA, 13 bp, Homo sapiens
aggagaagaaaat

SEQ ID NO: 5201793 - DNA, 16 bp, Homo sapiens
aggagaagacccctgc

SEQ ID NO: 5201794 - DNA, 14 bp, Homo sapiens
aggagaagaggcat

SEQ ID NO: 5201795 - DNA, 17 bp, Homo sapiens
aggagaagaggcatcct

SEQ ID NO: 5201796 - DNA, 15 bp, Homo sapiens
aggagaagagttgag

SEQ ID NO: 5201797 - DNA, 17 bp, Homo sapiens
aggagaagcacagctcc

SEQ ID NO: 5201798 - DNA, 15 bp, Homo sapiens
aggagaagccaggaa

SEQ ID NO: 5201799 - DNA, 13 bp, Homo sapiens
aggagaaggagag

SEQ ID NO: 5201800 - DNA, 15 bp, Homo sapiens
aggagaaggagaggg

SEQ ID NO: 5201801 - DNA, 14 bp, Homo sapiens
aggagaaggaggaa

SEQ ID NO: 5201802 - DNA, 15 bp, Homo sapiens
aggagaaggaggaga

SEQ ID NO: 5201803 - DNA, 15 bp, Homo sapiens
aggagaagggctggg

SEQ ID NO: 5201804 - DNA, 21 bp, Homo sapiens
aggagaagggggctctgcccc

SEQ ID NO: 5201805 - DNA, 21 bp, Homo sapiens
aggagaagtcttctatttatt

SEQ ID NO: 5201806 - DNA, 22 bp, Homo sapiens
aggagaagtcttctatttattt

SEQ ID NO: 5201807 - DNA, 23 bp, Homo sapiens
aggagaagtcttctatttattta

SEQ ID NO: 5201808 - DNA, 16 bp, Homo sapiens
aggagaagtgctccct

SEQ ID NO: 5201809 - DNA, 22 bp, Homo sapiens
aggagaagtggggaccccaccc

SEQ ID NO: 5201810 - DNA, 11 bp, Homo sapiens
aggagaataag

SEQ ID NO: 5201811 - DNA, 17 bp, Homo sapiens
aggagaataagaaaagg

SEQ ID NO: 5201812 - DNA, 21 bp, Homo sapiens
aggagaatagcagagagccaa

SEQ ID NO: 5201813 - DNA, 20 bp, Homo sapiens
aggagaatagcctgaacctg

SEQ ID NO: 5201814 - DNA, 18 bp, Homo sapiens
aggagaatcaataaaaat

SEQ ID NO: 5201815 - DNA, 22 bp, Homo sapiens
aggagaatcacctgaaccccag

SEQ ID NO: 5201816 - DNA, 22 bp, Homo sapiens
aggagaatcactgcagcccagg

SEQ ID NO: 5201817 - DNA, 20 bp, Homo sapiens
aggagaatcacttgaaccca

SEQ ID NO: 5201818 - DNA, 18 bp, Homo sapiens
aggagaatcatcaggacc

SEQ ID NO: 5201819 - DNA, 18 bp, Homo sapiens
aggagaatccaagcgagg

SEQ ID NO: 5201820 - DNA, 17 bp, Homo sapiens
aggagaatcgcttgaac

SEQ ID NO: 5201821 - DNA, 20 bp, Homo sapiens
aggagaatcgcttgaaccca

SEQ ID NO: 5201822 - DNA, 20 bp, Homo sapiens
aggagaatctcttgaacccg

SEQ ID NO: 5201823 - DNA, 20 bp, Homo sapiens
aggagaatctcttgaacctg

SEQ ID NO: 5201824 - DNA, 20 bp, Homo sapiens
aggagaatggcatggcagga

SEQ ID NO: 5201825 - DNA, 21 bp, Homo sapiens
aggagaatggcatggcaggag

SEQ ID NO: 5201826 - DNA, 20 bp, Homo sapiens
aggagaatggcgtgaacccg

SEQ ID NO: 5201827 - DNA, 16 bp, Homo sapiens
aggagaattcacagaa

SEQ ID NO: 5201828 - DNA, 15 bp, Homo sapiens
aggagaatttctact

SEQ ID NO: 5201829 - DNA, 16 bp, Homo sapiens
aggagacaaaagagca

SEQ ID NO: 5201830 - DNA, 17 bp, Homo sapiens
aggagacaaagcaggag

SEQ ID NO: 5201831 - DNA, 18 bp, Homo sapiens
aggagacacacctgaggc

SEQ ID NO: 5201832 - DNA, 12 bp, Homo sapiens
aggagacacaga

SEQ ID NO: 5201833 - DNA, 15 bp, Homo sapiens
aggagacacagatgt

SEQ ID NO: 5201834 - DNA, 16 bp, Homo sapiens
aggagacacagatgtt

SEQ ID NO: 5201835 - DNA, 13 bp, Homo sapiens
aggagacacaggg

SEQ ID NO: 5201836 - DNA, 13 bp, Homo sapiens
aggagacagacac

SEQ ID NO: 5201837 - DNA, 21 bp, Homo sapiens
aggagacagagccaagcactg

SEQ ID NO: 5201838 - DNA, 22 bp, Homo sapiens
aggagacagagccaagcactgc

SEQ ID NO: 5201839 - DNA, 13 bp, Homo sapiens
aggagacagcagc

SEQ ID NO: 5201840 - DNA, 14 bp, Homo sapiens
aggagacagcagca

SEQ ID NO: 5201841 - DNA, 15 bp, Homo sapiens
aggagacaggaagcc

SEQ ID NO: 5201842 - DNA, 14 bp, Homo sapiens
aggagacaggatga

SEQ ID NO: 5201843 - DNA, 15 bp, Homo sapiens
aggagacaggatgag

SEQ ID NO: 5201844 - DNA, 17 bp, Homo sapiens
aggagacaggatgaggt

SEQ ID NO: 5201845 - DNA, 18 bp, Homo sapiens
aggagacagttcaagaaa

SEQ ID NO: 5201846 - DNA, 15 bp, Homo sapiens
aggagacattgctct

SEQ ID NO: 5201847 - DNA, 13 bp, Homo sapiens
aggagacattttc

SEQ ID NO: 5201848 - DNA, 20 bp, Homo sapiens
aggagaccaagtcctggcta

SEQ ID NO: 5201849 - DNA, 13 bp, Homo sapiens
aggagaccagaag

SEQ ID NO: 5201850 - DNA, 17 bp, Homo sapiens
aggagaccagaagtgaa

SEQ ID NO: 5201851 - DNA, 18 bp, Homo sapiens
aggagaccagaagtgaat

SEQ ID NO: 5201852 - DNA, 14 bp, Homo sapiens
aggagaccagcggt

SEQ ID NO: 5201853 - DNA, 15 bp, Homo sapiens
aggagaccagctcag

SEQ ID NO: 5201854 - DNA, 22 bp, Homo sapiens
aggagacccacctgaggctcag

SEQ ID NO: 5201855 - DNA, 16 bp, Homo sapiens
aggagaccctgtcttt

SEQ ID NO: 5201856 - DNA, 13 bp, Homo sapiens
aggagacctcttc

SEQ ID NO: 5201857 - DNA, 21 bp, Homo sapiens
aggagacctggcactggatgc

SEQ ID NO: 5201858 - DNA, 22 bp, Homo sapiens
aggagacgaagtgaaaacaaat

SEQ ID NO: 5201859 - DNA, 11 bp, Homo sapiens
aggagactcac

SEQ ID NO: 5201860 - DNA, 18 bp, Homo sapiens
aggagactcacctctgcc

SEQ ID NO: 5201861 - DNA, 18 bp, Homo sapiens
aggagactggcaagagct

SEQ ID NO: 5201862 - DNA, 14 bp, Homo sapiens
aggagactgtggtt

SEQ ID NO: 5201863 - DNA, 20 bp, Homo sapiens
aggagactttacaaaccttt

SEQ ID NO: 5201864 - DNA, 13 bp, Homo sapiens
aggagagaaagca

SEQ ID NO: 5201865 - DNA, 14 bp, Homo sapiens
aggagagaatgaga

SEQ ID NO: 5201866 - DNA, 17 bp, Homo sapiens
aggagagacacctagct

SEQ ID NO: 5201867 - DNA, 11 bp, Homo sapiens
aggagagaccc

SEQ ID NO: 5201868 - DNA, 16 bp, Homo sapiens
aggagagacccctccc

SEQ ID NO: 5201869 - DNA, 23 bp, Homo sapiens
aggagagactgaaagcagcagct

SEQ ID NO: 5201870 - DNA, 18 bp, Homo sapiens
aggagagactgagcagcc

SEQ ID NO: 5201871 - DNA, 23 bp, Homo sapiens
aggagagactggccagaggcagc

SEQ ID NO: 5201872 - DNA, 11 bp, Homo sapiens
aggagagagaa

SEQ ID NO: 5201873 - DNA, 12 bp, Homo sapiens
aggagagagaaa

SEQ ID NO: 5201874 - DNA, 22 bp, Homo sapiens
aggagagagaaagccaggcagg

SEQ ID NO: 5201875 - DNA, 17 bp, Homo sapiens
aggagagagacagagag

SEQ ID NO: 5201876 - DNA, 14 bp, Homo sapiens
aggagagagacccc

SEQ ID NO: 5201877 - DNA, 16 bp, Homo sapiens
aggagagagaccccgc

SEQ ID NO: 5201878 - DNA, 15 bp, Homo sapiens
aggagagagagagag

SEQ ID NO: 5201879 - DNA, 21 bp, Homo sapiens
aggagagagatctagaaagtg

SEQ ID NO: 5201880 - DNA, 17 bp, Homo sapiens
aggagagagatggacat

SEQ ID NO: 5201881 - DNA, 20 bp, Homo sapiens
aggagagagcagcttctgcc

SEQ ID NO: 5201882 - DNA, 14 bp, Homo sapiens
aggagagagccagg

SEQ ID NO: 5201883 - DNA, 15 bp, Homo sapiens
aggagagagccagga

SEQ ID NO: 5201884 - DNA, 13 bp, Homo sapiens
aggagagagcctt

SEQ ID NO: 5201885 - DNA, 15 bp, Homo sapiens
aggagagagccttgg

SEQ ID NO: 5201886 - DNA, 22 bp, Homo sapiens
aggagagagccttgggagccac

SEQ ID NO: 5201887 - DNA, 18 bp, Homo sapiens
aggagagaggaggaaaag

SEQ ID NO: 5201888 - DNA, 18 bp, Homo sapiens
aggagagagggtctccag

SEQ ID NO: 5201889 - DNA, 20 bp, Homo sapiens
aggagagagtctaagataaa

SEQ ID NO: 5201890 - DNA, 14 bp, Homo sapiens
aggagagagttgaa

SEQ ID NO: 5201891 - DNA, 20 bp, Homo sapiens
aggagagatagcctgtggcc

SEQ ID NO: 5201892 - DNA, 16 bp, Homo sapiens
aggagagatgacccct

SEQ ID NO: 5201893 - DNA, 22 bp, Homo sapiens
aggagagattattaaatcgttt

SEQ ID NO: 5201894 - DNA, 11 bp, Homo sapiens
aggagagcact

SEQ ID NO: 5201895 - DNA, 15 bp, Homo sapiens
aggagagcactgcct

SEQ ID NO: 5201896 - DNA, 18 bp, Homo sapiens
aggagagcatcaccacca

SEQ ID NO: 5201897 - DNA, 19 bp, Homo sapiens
aggagagcatcggcctagg

SEQ ID NO: 5201898 - DNA, 18 bp, Homo sapiens
aggagagcatctgctctg

SEQ ID NO: 5201899 - DNA, 20 bp, Homo sapiens
aggagagcatctgctctgag

SEQ ID NO: 5201900 - DNA, 24 bp, Homo sapiens
aggagagccaacctcggcttgtgg

SEQ ID NO: 5201901 - DNA, 17 bp, Homo sapiens
aggagagccactgggcc

SEQ ID NO: 5201902 - DNA, 18 bp, Homo sapiens
aggagagccactgggccc

SEQ ID NO: 5201903 - DNA, 22 bp, Homo sapiens
aggagagccactgggcccctgt

SEQ ID NO: 5201904 - DNA, 15 bp, Homo sapiens
aggagagccagccct

SEQ ID NO: 5201905 - DNA, 16 bp, Homo sapiens
aggagagcccttcatt

SEQ ID NO: 5201906 - DNA, 13 bp, Homo sapiens
aggagagcctgct

SEQ ID NO: 5201907 - DNA, 14 bp, Homo sapiens
aggagagcctgctg

SEQ ID NO: 5201908 - DNA, 15 bp, Homo sapiens
aggagagcctgctgc

SEQ ID NO: 5201909 - DNA, 23 bp, Homo sapiens
aggagagcttcaggccccaggac

SEQ ID NO: 5201910 - DNA, 21 bp, Homo sapiens
aggagaggaaacttgcctttt

SEQ ID NO: 5201911 - DNA, 15 bp, Homo sapiens
aggagaggagaaaaa

SEQ ID NO: 5201912 - DNA, 17 bp, Homo sapiens
aggagaggagagaggca

SEQ ID NO: 5201913 - DNA, 15 bp, Homo sapiens
aggagaggagagcca

SEQ ID NO: 5201914 - DNA, 23 bp, Homo sapiens
aggagaggagttctttggctcta

SEQ ID NO: 5201915 - DNA, 13 bp, Homo sapiens
aggagaggatgag

SEQ ID NO: 5201916 - DNA, 17 bp, Homo sapiens
aggagaggatgagagcc

SEQ ID NO: 5201917 - DNA, 16 bp, Homo sapiens
aggagaggatggccca

SEQ ID NO: 5201918 - DNA, 23 bp, Homo sapiens
aggagaggatttggctcgctgtg

SEQ ID NO: 5201919 - DNA, 19 bp, Homo sapiens
aggagaggcaaagaaagga

SEQ ID NO: 5201920 - DNA, 16 bp, Homo sapiens
aggagaggcagcatgc

SEQ ID NO: 5201921 - DNA, 12 bp, Homo sapiens
aggagaggctgc

SEQ ID NO: 5201922 - DNA, 17 bp, Homo sapiens
aggagagggaaaatgtt

SEQ ID NO: 5201923 - DNA, 13 bp, Homo sapiens
aggagagggcctt

SEQ ID NO: 5201924 - DNA, 16 bp, Homo sapiens
aggagagggccttccc

SEQ ID NO: 5201925 - DNA, 18 bp, Homo sapiens
aggagaggggaagggcca

SEQ ID NO: 5201926 - DNA, 19 bp, Homo sapiens
aggagaggtcttgctcaca

SEQ ID NO: 5201927 - DNA, 22 bp, Homo sapiens
aggagaggttaaagcaaaccag

SEQ ID NO: 5201928 - DNA, 14 bp, Homo sapiens
aggagagtaaaaat

SEQ ID NO: 5201929 - DNA, 20 bp, Homo sapiens
agctcaaaggtttggaagga

SEQ ID NO: 5201930 - DNA, 15 bp, Homo sapiens
agctcaacggtctgg

SEQ ID NO: 5201931 - DNA, 23 bp, Homo sapiens
agctcaactcacagcttctccaa

SEQ ID NO: 5201932 - DNA, 23 bp, Homo sapiens
agctcaactcgggggcgcctgga

SEQ ID NO: 5201933 - DNA, 22 bp, Homo sapiens
agctcaactctcttattgcctc

SEQ ID NO: 5201934 - DNA, 19 bp, Homo sapiens
agctcaactttctgttgga

SEQ ID NO: 5201935 - DNA, 18 bp, Homo sapiens
agctcaagatgacagctc

SEQ ID NO: 5201936 - DNA, 20 bp, Homo sapiens
agctcaagcaggaagttcaa

SEQ ID NO: 5201937 - DNA, 20 bp, Homo sapiens
agctcaaggcaatgggctac

SEQ ID NO: 5201938 - DNA, 15 bp, Homo sapiens
agctcaaggccacct

SEQ ID NO: 5201939 - DNA, 16 bp, Homo sapiens
agctcaaggccacctt

SEQ ID NO: 5201940 - DNA, 19 bp, Homo sapiens
agctcaagggacaaggaca

SEQ ID NO: 5201941 - DNA, 16 bp, Homo sapiens
agctcaagggctggca

SEQ ID NO: 5201942 - DNA, 18 bp, Homo sapiens
agctcaagggctggcact

SEQ ID NO: 5201943 - DNA, 14 bp, Homo sapiens
agctcaagtttaaa

SEQ ID NO: 5201944 - DNA, 22 bp, Homo sapiens
agctcaagtttaaaagccatgt

SEQ ID NO: 5201945 - DNA, 19 bp, Homo sapiens
agctcaataaaagaatctg

SEQ ID NO: 5201946 - DNA, 14 bp, Homo sapiens
agctcaatggactg

SEQ ID NO: 5201947 - DNA, 21 bp, Homo sapiens
agctcaattgttaatgtgatg

SEQ ID NO: 5201948 - DNA, 21 bp, Homo sapiens
agctcacaataaaaatggctc

SEQ ID NO: 5201949 - DNA, 14 bp, Homo sapiens
agctcacacttggg

SEQ ID NO: 5201950 - DNA, 17 bp, Homo sapiens
agctcacacttgggctg

SEQ ID NO: 5201951 - DNA, 19 bp, Homo sapiens
agctcacacttgggctggc

SEQ ID NO: 5201952 - DNA, 12 bp, Homo sapiens
agctcacagcac

SEQ ID NO: 5201953 - DNA, 13 bp, Homo sapiens
agctcacagcaca

SEQ ID NO: 5201954 - DNA, 16 bp, Homo sapiens
agctcacagcacattt

SEQ ID NO: 5201955 - DNA, 18 bp, Homo sapiens
agctcacagtgctgtgtg

SEQ ID NO: 5201956 - DNA, 21 bp, Homo sapiens
agctcacatgggactgggata

SEQ ID NO: 5201957 - DNA, 13 bp, Homo sapiens
agctcaccaggcc

SEQ ID NO: 5201958 - DNA, 21 bp, Homo sapiens
agctcaccaggcctggcctct

SEQ ID NO: 5201959 - DNA, 18 bp, Homo sapiens
agctcacccaaggtcacc

SEQ ID NO: 5201960 - DNA, 21 bp, Homo sapiens
agctcaccccccacactcact

SEQ ID NO: 5201961 - DNA, 14 bp, Homo sapiens
agctcacccctggg

SEQ ID NO: 5201962 - DNA, 15 bp, Homo sapiens
agctcacccctgggc

SEQ ID NO: 5201963 - DNA, 16 bp, Homo sapiens
agctcacccctgggca

SEQ ID NO: 5201964 - DNA, 21 bp, Homo sapiens
agctcaccctgcccgctccca

SEQ ID NO: 5201965 - DNA, 16 bp, Homo sapiens
agctcaccctgctcct

SEQ ID NO: 5201966 - DNA, 17 bp, Homo sapiens
agctcacctgttgctta

SEQ ID NO: 5201967 - DNA, 21 bp, Homo sapiens
agctcacctgttgcttacaat

SEQ ID NO: 5201968 - DNA, 13 bp, Homo sapiens
agctcacgtcaca

SEQ ID NO: 5201969 - DNA, 19 bp, Homo sapiens
agctcactccccaaccccc

SEQ ID NO: 5201970 - DNA, 12 bp, Homo sapiens
agctcactccct

SEQ ID NO: 5201971 - DNA, 19 bp, Homo sapiens
agctcactgcaacctccac

SEQ ID NO: 5201972 - DNA, 13 bp, Homo sapiens
agctcactgctga

SEQ ID NO: 5201973 - DNA, 13 bp, Homo sapiens
agctcactgctgc

SEQ ID NO: 5201974 - DNA, 16 bp, Homo sapiens
agctcactgctgctgc

SEQ ID NO: 5201975 - DNA, 19 bp, Homo sapiens
agctcactggtccatttct

SEQ ID NO: 5201976 - DNA, 23 bp, Homo sapiens
agctcacttctgggcttcatctg

SEQ ID NO: 5201977 - DNA, 18 bp, Homo sapiens
agctcagaaaggttgagg

SEQ ID NO: 5201978 - DNA, 17 bp, Homo sapiens
agctcagaacccagggc

SEQ ID NO: 5201979 - DNA, 14 bp, Homo sapiens
agctcagacatcta

SEQ ID NO: 5201980 - DNA, 18 bp, Homo sapiens
agctcagacattttcttt

SEQ ID NO: 5201981 - DNA, 16 bp, Homo sapiens
agctcagacccccact

SEQ ID NO: 5201982 - DNA, 14 bp, Homo sapiens
agctcagagagggc

SEQ ID NO: 5201983 - DNA, 14 bp, Homo sapiens
agctcagagagggt

SEQ ID NO: 5201984 - DNA, 17 bp, Homo sapiens
agctcagagcagcctct

SEQ ID NO: 5201985 - DNA, 22 bp, Homo sapiens
agctcagagccccgccccaccc

SEQ ID NO: 5201986 - DNA, 13 bp, Homo sapiens
agctcagcactgc

SEQ ID NO: 5201987 - DNA, 20 bp, Homo sapiens
agctcagcactgcctgctcc

SEQ ID NO: 5201988 - DNA, 21 bp, Homo sapiens
agctcagcactgcctgctccc

SEQ ID NO: 5201989 - DNA, 19 bp, Homo sapiens
agctcagcagttcacttcc

SEQ ID NO: 5201990 - DNA, 16 bp, Homo sapiens
agctcagcatttccac

SEQ ID NO: 5201991 - DNA, 22 bp, Homo sapiens
agctcagccaccactcagtgct

SEQ ID NO: 5201992 - DNA, 19 bp, Homo sapiens
agctcagcccacccccctc

SEQ ID NO: 5201993 - DNA, 20 bp, Homo sapiens
agctcagcccacccccctca

SEQ ID NO: 5201994 - DNA, 18 bp, Homo sapiens
agctcagccccaactctt

SEQ ID NO: 5201995 - DNA, 17 bp, Homo sapiens
agctcagccccagccca

SEQ ID NO: 5201996 - DNA, 23 bp, Homo sapiens
agctcagccccgagctgtccccg

SEQ ID NO: 5201997 - DNA, 19 bp, Homo sapiens
agctcagccccggccactc

SEQ ID NO: 5201998 - DNA, 12 bp, Homo sapiens
agctcagccctg

SEQ ID NO: 5201999 - DNA, 20 bp, Homo sapiens
agctcagccctggcctggct

SEQ ID NO: 5202000 - DNA, 16 bp, Homo sapiens
agctcagcctccccct

SEQ ID NO: 5202001 - DNA, 21 bp, Homo sapiens
agctcagcctccccctgctgc

SEQ ID NO: 5202002 - DNA, 15 bp, Homo sapiens
agctcagcctcgctt

SEQ ID NO: 5202003 - DNA, 23 bp, Homo sapiens
agctcagccttctcctcccaagg

SEQ ID NO: 5202004 - DNA, 17 bp, Homo sapiens
agctcagcgccagcctg

SEQ ID NO: 5202005 - DNA, 14 bp, Homo sapiens
agctcagctcactg

SEQ ID NO: 5202006 - DNA, 19 bp, Homo sapiens
agctcagctcgctgcccag

SEQ ID NO: 5202007 - DNA, 12 bp, Homo sapiens
agctcagctgcc

SEQ ID NO: 5202008 - DNA, 13 bp, Homo sapiens
agctcagctgccc

SEQ ID NO: 5202009 - DNA, 15 bp, Homo sapiens
agctcagctgcccat

SEQ ID NO: 5202010 - DNA, 23 bp, Homo sapiens
agctcagctgggccactcctctt

SEQ ID NO: 5202011 - DNA, 20 bp, Homo sapiens
agctcagctttttgtctttt

SEQ ID NO: 5202012 - DNA, 22 bp, Homo sapiens
agctcagctttttgtcttttct

SEQ ID NO: 5202013 - DNA, 21 bp, Homo sapiens
agctcaggaaccgaggcaggg

SEQ ID NO: 5202014 - DNA, 13 bp, Homo sapiens
agctcaggacaga

SEQ ID NO: 5202015 - DNA, 17 bp, Homo sapiens
agctcaggacagatgcc

SEQ ID NO: 5202016 - DNA, 18 bp, Homo sapiens
agctcaggaccaggcaat

SEQ ID NO: 5202017 - DNA, 21 bp, Homo sapiens
agctcaggagaaggcctgccc

SEQ ID NO: 5202018 - DNA, 13 bp, Homo sapiens
agctcaggaggcg

SEQ ID NO: 5202019 - DNA, 22 bp, Homo sapiens
agctcaggaggcgaataaatgt

SEQ ID NO: 5202020 - DNA, 20 bp, Homo sapiens
agctcaggagtttgagacca

SEQ ID NO: 5202021 - DNA, 12 bp, Homo sapiens
agctcaggcagc

SEQ ID NO: 5202022 - DNA, 18 bp, Homo sapiens
agctcaggcgcagcccta

SEQ ID NO: 5202023 - DNA, 15 bp, Homo sapiens
agctcaggctgagcc

SEQ ID NO: 5202024 - DNA, 17 bp, Homo sapiens
agctcaggctgagccca

SEQ ID NO: 5202025 - DNA, 21 bp, Homo sapiens
agctcaggctgagcccagcca

SEQ ID NO: 5202026 - DNA, 22 bp, Homo sapiens
agctcaggctgagcccagccac

SEQ ID NO: 5202027 - DNA, 12 bp, Homo sapiens
agctcagggcag

SEQ ID NO: 5202028 - DNA, 20 bp, Homo sapiens
agctcagggccctgtgccag

SEQ ID NO: 5202029 - DNA, 12 bp, Homo sapiens
agctcagggcct

SEQ ID NO: 5202030 - DNA, 14 bp, Homo sapiens
agctcagggcctgg

SEQ ID NO: 5202031 - DNA, 18 bp, Homo sapiens
agctcagggcctggctca

SEQ ID NO: 5202032 - DNA, 20 bp, Homo sapiens
agctcagggcctggctcagg

SEQ ID NO: 5202033 - DNA, 22 bp, Homo sapiens
agctcagggtaagctgctctga

SEQ ID NO: 5202034 - DNA, 23 bp, Homo sapiens
agctcagggtgctccctcctcag

SEQ ID NO: 5202035 - DNA, 22 bp, Homo sapiens
agctcaggtgtccctgcacttg

SEQ ID NO: 5202036 - DNA, 13 bp, Homo sapiens
agctcaggttccc

SEQ ID NO: 5202037 - DNA, 15 bp, Homo sapiens
agctcaggttccctg

SEQ ID NO: 5202038 - DNA, 18 bp, Homo sapiens
agctcaggttccctgcca

SEQ ID NO: 5202039 - DNA, 21 bp, Homo sapiens
agctcaggtttctggacaaga

SEQ ID NO: 5202040 - DNA, 13 bp, Homo sapiens
agctcagtacagg

SEQ ID NO: 5202041 - DNA, 15 bp, Homo sapiens
agctcagtacagggc

SEQ ID NO: 5202042 - DNA, 19 bp, Homo sapiens
agctcagtcatcaaagcag

SEQ ID NO: 5202043 - DNA, 18 bp, Homo sapiens
agctcagtcttccctagg

SEQ ID NO: 5202044 - DNA, 22 bp, Homo sapiens
agctcagtcttccctagggctg

SEQ ID NO: 5202045 - DNA, 23 bp, Homo sapiens
agctcagtcttccctagggctgg

SEQ ID NO: 5202046 - DNA, 12 bp, Homo sapiens
agctcagtgcca

SEQ ID NO: 5202047 - DNA, 16 bp, Homo sapiens
agctcagtgccaaaga

SEQ ID NO: 5202048 - DNA, 12 bp, Homo sapiens
agctcagtgctc

SEQ ID NO: 5202049 - DNA, 23 bp, Homo sapiens
agctcagttctagtctctctggg

SEQ ID NO: 5202050 - DNA, 23 bp, Homo sapiens
agctcagtttggctgtaatttaa

SEQ ID NO: 5202051 - DNA, 15 bp, Homo sapiens
agctcagttttcaac

SEQ ID NO: 5202052 - DNA, 20 bp, Homo sapiens
agctcataagctgtagaact

SEQ ID NO: 5202053 - DNA, 22 bp, Homo sapiens
agctcataagctgtagaactct

SEQ ID NO: 5202054 - DNA, 20 bp, Homo sapiens
agctcatagaggtgagaaaa

SEQ ID NO: 5202055 - DNA, 19 bp, Homo sapiens
agctcatagcacatgtttt

SEQ ID NO: 5202056 - DNA, 20 bp, Homo sapiens
agctcatagcacatgtttta

SEQ ID NO: 5202057 - DNA, 22 bp, Homo sapiens
agctcatagcacatgttttaca

SEQ ID NO: 5202058 - DNA, 14 bp, Homo sapiens
agctcatattttgt

SEQ ID NO: 5202059 - DNA, 17 bp, Homo sapiens
agctcatcactgtgcct

SEQ ID NO: 5202060 - DNA, 13 bp, Homo sapiens
agctcatcccccc

SEQ ID NO: 5202061 - DNA, 12 bp, Homo sapiens
agctcatccctc

SEQ ID NO: 5202062 - DNA, 15 bp, Homo sapiens
agctcatccctctca

SEQ ID NO: 5202063 - DNA, 15 bp, Homo sapiens
agctcatccctggac

SEQ ID NO: 5202064 - DNA, 18 bp, Homo sapiens
agctcatctatttggaac

SEQ ID NO: 5202065 - DNA, 15 bp, Homo sapiens
agctcatctgccaaa

SEQ ID NO: 5202066 - DNA, 15 bp, Homo sapiens
agctcatcttcaaag

SEQ ID NO: 5202067 - DNA, 17 bp, Homo sapiens
agctcatcttcactgca

SEQ ID NO: 5202068 - DNA, 22 bp, Homo sapiens
agctcatgacactgtttggcct

SEQ ID NO: 5202069 - DNA, 17 bp, Homo sapiens
agctcatgagtggaaag

SEQ ID NO: 5202070 - DNA, 23 bp, Homo sapiens
agctcatgagtggaaagtcacct

SEQ ID NO: 5202071 - DNA, 20 bp, Homo sapiens
agctcatgtaggtgagcctg

SEQ ID NO: 5202072 - DNA, 14 bp, Homo sapiens
agctcatgtcatta

SEQ ID NO: 5202073 - DNA, 16 bp, Homo sapiens
agctcattaaactttt

SEQ ID NO: 5202074 - DNA, 19 bp, Homo sapiens
agctcattaaactttttta

SEQ ID NO: 5202075 - DNA, 21 bp, Homo sapiens
agctcattaaacttttttaac

SEQ ID NO: 5202076 - DNA, 18 bp, Homo sapiens
agctcattatgaaaaaca

SEQ ID NO: 5202077 - DNA, 16 bp, Homo sapiens
agctcattcattttat

SEQ ID NO: 5202078 - DNA, 20 bp, Homo sapiens
agctcattctccttgtgtta

SEQ ID NO: 5202079 - DNA, 21 bp, Homo sapiens
agctcatttaatcccaggaaa

SEQ ID NO: 5202080 - DNA, 20 bp, Homo sapiens
agctcatttggggaccacag

SEQ ID NO: 5202081 - DNA, 23 bp, Homo sapiens
agctcatttggggaccacagagg

SEQ ID NO: 5202082 - DNA, 22 bp, Homo sapiens
agctccaacactttgagcattt

SEQ ID NO: 5202083 - DNA, 14 bp, Homo sapiens
agctccaacagctt

SEQ ID NO: 5202084 - DNA, 17 bp, Homo sapiens
agctccaacagcttgac

SEQ ID NO: 5202085 - DNA, 20 bp, Homo sapiens
agctccaagacctgttggtt

SEQ ID NO: 5202086 - DNA, 15 bp, Homo sapiens
agctccaagccccat

SEQ ID NO: 5202087 - DNA, 14 bp, Homo sapiens
agctccaagctgtt

SEQ ID NO: 5202088 - DNA, 17 bp, Homo sapiens
agctccaagctgttaaa

SEQ ID NO: 5202089 - DNA, 22 bp, Homo sapiens
agctccaagctgttaaagatat

SEQ ID NO: 5202090 - DNA, 14 bp, Homo sapiens
agctccacaagaga

SEQ ID NO: 5202091 - DNA, 16 bp, Homo sapiens
agctccacaagagaga

SEQ ID NO: 5202092 - DNA, 21 bp, Homo sapiens
agctccacaccctctcccagg

SEQ ID NO: 5202093 - DNA, 22 bp, Homo sapiens
agctccacaccctctcccagga

SEQ ID NO: 5202094 - DNA, 20 bp, Homo sapiens
agctccacacgccccggtcc

SEQ ID NO: 5202095 - DNA, 18 bp, Homo sapiens
agctccaccactgtgcac

SEQ ID NO: 5202096 - DNA, 21 bp, Homo sapiens
agctccaccccgcaagcacca

SEQ ID NO: 5202097 - DNA, 19 bp, Homo sapiens
agctccaccctcaccagga

SEQ ID NO: 5202098 - DNA, 17 bp, Homo sapiens
agctccaccctcccctc

SEQ ID NO: 5202099 - DNA, 20 bp, Homo sapiens
agctccaccctcctggcctc

SEQ ID NO: 5202100 - DNA, 15 bp, Homo sapiens
agctccaccctggcc

SEQ ID NO: 5202101 - DNA, 13 bp, Homo sapiens
agctccacctctg

SEQ ID NO: 5202102 - DNA, 16 bp, Homo sapiens
agctccacctctggtg

SEQ ID NO: 5202103 - DNA, 16 bp, Homo sapiens
agctccactcagggct

SEQ ID NO: 5202104 - DNA, 17 bp, Homo sapiens
agctccactcagggctg

SEQ ID NO: 5202105 - DNA, 19 bp, Homo sapiens
agctccactcagggctggc

SEQ ID NO: 5202106 - DNA, 15 bp, Homo sapiens
aggagagtaaaaatt

SEQ ID NO: 5202107 - DNA, 19 bp, Homo sapiens
aggagagtacccccctgag

SEQ ID NO: 5202108 - DNA, 24 bp, Homo sapiens
aggagagtcccagagcaggaggcc

SEQ ID NO: 5202109 - DNA, 14 bp, Homo sapiens
aggagagtcctggg

SEQ ID NO: 5202110 - DNA, 18 bp, Homo sapiens
aggagagtcctgggagcc

SEQ ID NO: 5202111 - DNA, 20 bp, Homo sapiens
aggagagtcggtctgctttg

SEQ ID NO: 5202112 - DNA, 17 bp, Homo sapiens
aggagagtgcagatctg

SEQ ID NO: 5202113 - DNA, 19 bp, Homo sapiens
aggagagtgtgtgggcagg

SEQ ID NO: 5202114 - DNA, 12 bp, Homo sapiens
aggagataaatc

SEQ ID NO: 5202115 - DNA, 13 bp, Homo sapiens
aggagataagaaa

SEQ ID NO: 5202116 - DNA, 17 bp, Homo sapiens
aggagataagaaagcag

SEQ ID NO: 5202117 - DNA, 17 bp, Homo sapiens
aggagataaggtggctt

SEQ ID NO: 5202118 - DNA, 18 bp, Homo sapiens
aggagataaggtggcttc

SEQ ID NO: 5202119 - DNA, 20 bp, Homo sapiens
aggagataattactgccttg

SEQ ID NO: 5202120 - DNA, 13 bp, Homo sapiens
aggagatataaaa

SEQ ID NO: 5202121 - DNA, 18 bp, Homo sapiens
aggagatatctgagggag

SEQ ID NO: 5202122 - DNA, 19 bp, Homo sapiens
aggagatatctgagggagg

SEQ ID NO: 5202123 - DNA, 15 bp, Homo sapiens
aggagatcagcagcg

SEQ ID NO: 5202124 - DNA, 13 bp, Homo sapiens
aggagatcagggc

SEQ ID NO: 5202125 - DNA, 23 bp, Homo sapiens
aggagatcgacaccatcctggct

SEQ ID NO: 5202126 - DNA, 15 bp, Homo sapiens
aggagatcttcccct

SEQ ID NO: 5202127 - DNA, 16 bp, Homo sapiens
aggagatgaatagaag

SEQ ID NO: 5202128 - DNA, 21 bp, Homo sapiens
aggagatgaatagaagaaaga

SEQ ID NO: 5202129 - DNA, 16 bp, Homo sapiens
aggagatgaccaggga

SEQ ID NO: 5202130 - DNA, 22 bp, Homo sapiens
aggagatgctccttgggccctt

SEQ ID NO: 5202131 - DNA, 13 bp, Homo sapiens
aggagatgctttc

SEQ ID NO: 5202132 - DNA, 18 bp, Homo sapiens
aggagatggagttatgag

SEQ ID NO: 5202133 - DNA, 22 bp, Homo sapiens
aggagatggccataggagagga

SEQ ID NO: 5202134 - DNA, 13 bp, Homo sapiens
aggagatggcccc

SEQ ID NO: 5202135 - DNA, 14 bp, Homo sapiens
aggagatggcccca

SEQ ID NO: 5202136 - DNA, 15 bp, Homo sapiens
aggagatggccccaa

SEQ ID NO: 5202137 - DNA, 14 bp, Homo sapiens
aggagatggggaat

SEQ ID NO: 5202138 - DNA, 17 bp, Homo sapiens
aggagatggggagggcg

SEQ ID NO: 5202139 - DNA, 17 bp, Homo sapiens
aggagatgtaagagctt

SEQ ID NO: 5202140 - DNA, 18 bp, Homo sapiens
aggagatgtaatgacaga

SEQ ID NO: 5202141 - DNA, 23 bp, Homo sapiens
aggagatgtaatgacagagagtt

SEQ ID NO: 5202142 - DNA, 21 bp, Homo sapiens
aggagatgtgatcaggcccca

SEQ ID NO: 5202143 - DNA, 22 bp, Homo sapiens
aggagatgtgatcaggccccac

SEQ ID NO: 5202144 - DNA, 23 bp, Homo sapiens
aggagatgttgaggggaggaggc

SEQ ID NO: 5202145 - DNA, 14 bp, Homo sapiens
aggagattccacac

SEQ ID NO: 5202146 - DNA, 18 bp, Homo sapiens
aggagattccacacaggg

SEQ ID NO: 5202147 - DNA, 16 bp, Homo sapiens
aggagattctgccttt

SEQ ID NO: 5202148 - DNA, 21 bp, Homo sapiens
aggagattctgtgtattaaca

SEQ ID NO: 5202149 - DNA, 12 bp, Homo sapiens
aggagatttctt

SEQ ID NO: 5202150 - DNA, 14 bp, Homo sapiens
aggagatttcttag

SEQ ID NO: 5202151 - DNA, 20 bp, Homo sapiens
aggagcaaaacgcctctttt

SEQ ID NO: 5202152 - DNA, 15 bp, Homo sapiens
aggagcaaacactga

SEQ ID NO: 5202153 - DNA, 15 bp, Homo sapiens
aggagcaaagcagca

SEQ ID NO: 5202154 - DNA, 14 bp, Homo sapiens
aggagcaaagcctg

SEQ ID NO: 5202155 - DNA, 22 bp, Homo sapiens
aggagcaaaggctgagaacact

SEQ ID NO: 5202156 - DNA, 14 bp, Homo sapiens
aggagcaaatgctg

SEQ ID NO: 5202157 - DNA, 17 bp, Homo sapiens
aggagcaaatgtttctg

SEQ ID NO: 5202158 - DNA, 18 bp, Homo sapiens
aggagcaaatgtttctgc

SEQ ID NO: 5202159 - DNA, 19 bp, Homo sapiens
aggagcaaatgtttctgca

SEQ ID NO: 5202160 - DNA, 17 bp, Homo sapiens
aggagcaagaagaaaat

SEQ ID NO: 5202161 - DNA, 21 bp, Homo sapiens
aggagcaaggctgccctgtcc

SEQ ID NO: 5202162 - DNA, 20 bp, Homo sapiens
aggagcaagtgaggccggag

SEQ ID NO: 5202163 - DNA, 13 bp, Homo sapiens
aggagcaatggga

SEQ ID NO: 5202164 - DNA, 14 bp, Homo sapiens
aggagcaatgggac

SEQ ID NO: 5202165 - DNA, 18 bp, Homo sapiens
aggagcacacggccctgc

SEQ ID NO: 5202166 - DNA, 19 bp, Homo sapiens
aggagcacacggccctgcc

SEQ ID NO: 5202167 - DNA, 22 bp, Homo sapiens
aggagcacacggccctgcccca

SEQ ID NO: 5202168 - DNA, 13 bp, Homo sapiens
aggagcacagcca

SEQ ID NO: 5202169 - DNA, 15 bp, Homo sapiens
aggagcacagccata

SEQ ID NO: 5202170 - DNA, 15 bp, Homo sapiens
aggagcacaggtccc

SEQ ID NO: 5202171 - DNA, 10 bp, Homo sapiens
aggagcaccc

SEQ ID NO: 5202172 - DNA, 19 bp, Homo sapiens
aggagcacccccagcctcc

SEQ ID NO: 5202173 - DNA, 20 bp, Homo sapiens
aggagcacccccagcctccc

SEQ ID NO: 5202174 - DNA, 22 bp, Homo sapiens
aggagcacctggaccccctgcc

SEQ ID NO: 5202175 - DNA, 23 bp, Homo sapiens
aggagcacctggaccccctgccc

SEQ ID NO: 5202176 - DNA, 19 bp, Homo sapiens
aggagcacgaggtctggcc

SEQ ID NO: 5202177 - DNA, 23 bp, Homo sapiens
aggagcacggctctgtccccagc

SEQ ID NO: 5202178 - DNA, 24 bp, Homo sapiens
aggagcactgcatgtcagagcact

SEQ ID NO: 5202179 - DNA, 14 bp, Homo sapiens
aggagcagaaagat

SEQ ID NO: 5202180 - DNA, 14 bp, Homo sapiens
aggagcagaaatgc

SEQ ID NO: 5202181 - DNA, 21 bp, Homo sapiens
aggagcagaaggacaggtctc

SEQ ID NO: 5202182 - DNA, 13 bp, Homo sapiens
aggagcagacaga

SEQ ID NO: 5202183 - DNA, 15 bp, Homo sapiens
aggagcagacagaga

SEQ ID NO: 5202184 - DNA, 17 bp, Homo sapiens
aggagcagacagagaaa

SEQ ID NO: 5202185 - DNA, 13 bp, Homo sapiens
aggagcagagagg

SEQ ID NO: 5202186 - DNA, 14 bp, Homo sapiens
aggagcagagaggt

SEQ ID NO: 5202187 - DNA, 20 bp, Homo sapiens
aggagcagagaggtggccac

SEQ ID NO: 5202188 - DNA, 13 bp, Homo sapiens
aggagcagagggc

SEQ ID NO: 5202189 - DNA, 14 bp, Homo sapiens
aggagcagagggca

SEQ ID NO: 5202190 - DNA, 15 bp, Homo sapiens
aggagcagagggcag

SEQ ID NO: 5202191 - DNA, 22 bp, Homo sapiens
aggagcagagggcaggggtgct

SEQ ID NO: 5202192 - DNA, 19 bp, Homo sapiens
aggagcagagggcctagga

SEQ ID NO: 5202193 - DNA, 12 bp, Homo sapiens
aggagcagcagc

SEQ ID NO: 5202194 - DNA, 15 bp, Homo sapiens
aggagcagcagccag

SEQ ID NO: 5202195 - DNA, 16 bp, Homo sapiens
aggagcagcagccagc

SEQ ID NO: 5202196 - DNA, 14 bp, Homo sapiens
aggagcagcagctt

SEQ ID NO: 5202197 - DNA, 13 bp, Homo sapiens
aggagcagcatca

SEQ ID NO: 5202198 - DNA, 17 bp, Homo sapiens
aggagcagcatcattca

SEQ ID NO: 5202199 - DNA, 13 bp, Homo sapiens
aggagcagccagg

SEQ ID NO: 5202200 - DNA, 16 bp, Homo sapiens
aggagcagccaggacc

SEQ ID NO: 5202201 - DNA, 17 bp, Homo sapiens
aggagcagccaggaccc

SEQ ID NO: 5202202 - DNA, 12 bp, Homo sapiens
aggagcagccca

SEQ ID NO: 5202203 - DNA, 13 bp, Homo sapiens
aggagcagccctg

SEQ ID NO: 5202204 - DNA, 15 bp, Homo sapiens
aggagcagccctggc

SEQ ID NO: 5202205 - DNA, 18 bp, Homo sapiens
aggagcagccctggcccc

SEQ ID NO: 5202206 - DNA, 11 bp, Homo sapiens
aggagcagcct

SEQ ID NO: 5202207 - DNA, 20 bp, Homo sapiens
aggagcagcctcgaggctgg

SEQ ID NO: 5202208 - DNA, 14 bp, Homo sapiens
aggagcagccttag

SEQ ID NO: 5202209 - DNA, 11 bp, Homo sapiens
aggagcagctg

SEQ ID NO: 5202210 - DNA, 23 bp, Homo sapiens
aggagcagctggcactgacagcc

SEQ ID NO: 5202211 - DNA, 20 bp, Homo sapiens
aggagcagcttcagttgttt

SEQ ID NO: 5202212 - DNA, 23 bp, Homo sapiens
aggagcagcttccttctgggact

SEQ ID NO: 5202213 - DNA, 20 bp, Homo sapiens
aggagcaggaacagagactc

SEQ ID NO: 5202214 - DNA, 14 bp, Homo sapiens
aggagcaggaagca

SEQ ID NO: 5202215 - DNA, 14 bp, Homo sapiens
aggagcaggccctg

SEQ ID NO: 5202216 - DNA, 22 bp, Homo sapiens
aggagcaggccctgggcctcca

SEQ ID NO: 5202217 - DNA, 11 bp, Homo sapiens
aggagcagggt

SEQ ID NO: 5202218 - DNA, 19 bp, Homo sapiens
aggagcagtgggccctggc

SEQ ID NO: 5202219 - DNA, 23 bp, Homo sapiens
aggagcagtgggccctggctctg

SEQ ID NO: 5202220 - DNA, 20 bp, Homo sapiens
aggagcatccacctccttct

SEQ ID NO: 5202221 - DNA, 21 bp, Homo sapiens
aggagcatgcgcagaggccag

SEQ ID NO: 5202222 - DNA, 22 bp, Homo sapiens
aggagcatgcgcagaggccagt

SEQ ID NO: 5202223 - DNA, 20 bp, Homo sapiens
aggagcatgtcctatccctg

SEQ ID NO: 5202224 - DNA, 20 bp, Homo sapiens
aggagcattaagcccaatct

SEQ ID NO: 5202225 - DNA, 23 bp, Homo sapiens
aggagcatttttttattcagcag

SEQ ID NO: 5202226 - DNA, 15 bp, Homo sapiens
aggagccaccagttc

SEQ ID NO: 5202227 - DNA, 17 bp, Homo sapiens
aggagccaccagttctc

SEQ ID NO: 5202228 - DNA, 21 bp, Homo sapiens
aggagccacctgggctgggag

SEQ ID NO: 5202229 - DNA, 16 bp, Homo sapiens
aggagccagacagacc

SEQ ID NO: 5202230 - DNA, 13 bp, Homo sapiens
aggagccagcagg

SEQ ID NO: 5202231 - DNA, 15 bp, Homo sapiens
aggagccagcagggc

SEQ ID NO: 5202232 - DNA, 15 bp, Homo sapiens
aggagccagccagga

SEQ ID NO: 5202233 - DNA, 13 bp, Homo sapiens
aggagccagcctg

SEQ ID NO: 5202234 - DNA, 14 bp, Homo sapiens
aggagccagcctgc

SEQ ID NO: 5202235 - DNA, 15 bp, Homo sapiens
aggagccagcctgct

SEQ ID NO: 5202236 - DNA, 16 bp, Homo sapiens
aggagccagctcccag

SEQ ID NO: 5202237 - DNA, 18 bp, Homo sapiens
aggagccagctcccagcc

SEQ ID NO: 5202238 - DNA, 14 bp, Homo sapiens
aggagccaggcccc

SEQ ID NO: 5202239 - DNA, 18 bp, Homo sapiens
aggagccaggccccaccc

SEQ ID NO: 5202240 - DNA, 19 bp, Homo sapiens
aggagccaggccccacccc

SEQ ID NO: 5202241 - DNA, 23 bp, Homo sapiens
aggagccagtttgccggatacaa

SEQ ID NO: 5202242 - DNA, 13 bp, Homo sapiens
aggagcccacggg

SEQ ID NO: 5202243 - DNA, 19 bp, Homo sapiens
aggagcccacggggcaaag

SEQ ID NO: 5202244 - DNA, 20 bp, Homo sapiens
aggagcccacggggcaaagc

SEQ ID NO: 5202245 - DNA, 13 bp, Homo sapiens
aggagcccagagg

SEQ ID NO: 5202246 - DNA, 16 bp, Homo sapiens
aggagcccagccagaa

SEQ ID NO: 5202247 - DNA, 17 bp, Homo sapiens
aggagcccaggccagga

SEQ ID NO: 5202248 - DNA, 19 bp, Homo sapiens
aggagcccaggccaggact

SEQ ID NO: 5202249 - DNA, 13 bp, Homo sapiens
aggagcccagtgg

SEQ ID NO: 5202250 - DNA, 11 bp, Homo sapiens
aggagccccag

SEQ ID NO: 5202251 - DNA, 12 bp, Homo sapiens
aggagccccagc

SEQ ID NO: 5202252 - DNA, 17 bp, Homo sapiens
aggagccccagccccgt

SEQ ID NO: 5202253 - DNA, 13 bp, Homo sapiens
aggagccccagct

SEQ ID NO: 5202254 - DNA, 15 bp, Homo sapiens
aggagccccattcct

SEQ ID NO: 5202255 - DNA, 21 bp, Homo sapiens
aggagccccattcctgggaaa

SEQ ID NO: 5202256 - DNA, 20 bp, Homo sapiens
aggagcccccaacacaggca

SEQ ID NO: 5202257 - DNA, 21 bp, Homo sapiens
aggagcccctggacatgcctg

SEQ ID NO: 5202258 - DNA, 20 bp, Homo sapiens
aggagcccgtcaggccacag

SEQ ID NO: 5202259 - DNA, 18 bp, Homo sapiens
aggagccctgaggacctc

SEQ ID NO: 5202260 - DNA, 21 bp, Homo sapiens
aggagccctgaggacctctca

SEQ ID NO: 5202261 - DNA, 15 bp, Homo sapiens
aggagccctgcctct

SEQ ID NO: 5202262 - DNA, 23 bp, Homo sapiens
aggagcccttatctgtgctcagg

SEQ ID NO: 5202263 - DNA, 15 bp, Homo sapiens
aggagcccttctctt

SEQ ID NO: 5202264 - DNA, 23 bp, Homo sapiens
aggagccggacacttctcaggaa

SEQ ID NO: 5202265 - DNA, 21 bp, Homo sapiens
aggagccggaccaagatgggc

SEQ ID NO: 5202266 - DNA, 18 bp, Homo sapiens
aggagccgggcctcccac

SEQ ID NO: 5202267 - DNA, 22 bp, Homo sapiens
aggagcctagcggagcccagcc

SEQ ID NO: 5202268 - DNA, 15 bp, Homo sapiens
aggagcctaggccag

SEQ ID NO: 5202269 - DNA, 17 bp, Homo sapiens
aggagcctatggcatct

SEQ ID NO: 5202270 - DNA, 22 bp, Homo sapiens
aggagcctcactggggcagaca

SEQ ID NO: 5202271 - DNA, 12 bp, Homo sapiens
aggagcctcaga

SEQ ID NO: 5202272 - DNA, 14 bp, Homo sapiens
aggagcctcagaag

SEQ ID NO: 5202273 - DNA, 16 bp, Homo sapiens
aggagcctcagaagaa

SEQ ID NO: 5202274 - DNA, 16 bp, Homo sapiens
aggagcctcatccagc

SEQ ID NO: 5202275 - DNA, 18 bp, Homo sapiens
aggagcctcatccagcct

SEQ ID NO: 5202276 - DNA, 12 bp, Homo sapiens
aggagcctccct

SEQ ID NO: 5202277 - DNA, 13 bp, Homo sapiens
aggagcctccctg

SEQ ID NO: 5202278 - DNA, 22 bp, Homo sapiens
aggagcctccctgcacggccca

SEQ ID NO: 5202279 - DNA, 14 bp, Homo sapiens
aggagcctcctgac

SEQ ID NO: 5202280 - DNA, 17 bp, Homo sapiens
aggagcctcgtgtcctg

SEQ ID NO: 5202281 - DNA, 21 bp, Homo sapiens
aggagcctcgtgtcctgctag

SEQ ID NO: 5202282 - DNA, 11 bp, Homo sapiens
aggagcctctg

SEQ ID NO: 5202283 - DNA, 12 bp, Homo sapiens
aggagcctctga

SEQ ID NO: 5202284 - DNA, 14 bp, Homo sapiens
aggagcctctggct

SEQ ID NO: 5202285 - DNA, 15 bp, Homo sapiens
aggagcctctggctt

SEQ ID NO: 5202286 - DNA, 21 bp, Homo sapiens
agctccactcagggctggccc

SEQ ID NO: 5202287 - DNA, 16 bp, Homo sapiens
agctccactctgcttc

SEQ ID NO: 5202288 - DNA, 24 bp, Homo sapiens
agctccactctgcttctctgactt

SEQ ID NO: 5202289 - DNA, 15 bp, Homo sapiens
agctccactggcctg

SEQ ID NO: 5202290 - DNA, 17 bp, Homo sapiens
agctccagacccccagc

SEQ ID NO: 5202291 - DNA, 18 bp, Homo sapiens
agctccagacccccagca

SEQ ID NO: 5202292 - DNA, 19 bp, Homo sapiens
agctccagacccccagcaa

SEQ ID NO: 5202293 - DNA, 19 bp, Homo sapiens
agctccagatgtttctcat

SEQ ID NO: 5202294 - DNA, 14 bp, Homo sapiens
agctccagcccctt

SEQ ID NO: 5202295 - DNA, 18 bp, Homo sapiens
agctccagcccctttcca

SEQ ID NO: 5202296 - DNA, 20 bp, Homo sapiens
agctccagcccctttccaaa

SEQ ID NO: 5202297 - DNA, 13 bp, Homo sapiens
agctccagcgatg

SEQ ID NO: 5202298 - DNA, 19 bp, Homo sapiens
agctccagcgatggtgctg

SEQ ID NO: 5202299 - DNA, 18 bp, Homo sapiens
agctccagctcaccagcc

SEQ ID NO: 5202300 - DNA, 21 bp, Homo sapiens
agctccagctcaccagcccca

SEQ ID NO: 5202301 - DNA, 19 bp, Homo sapiens
agctccagctcctttgggc

SEQ ID NO: 5202302 - DNA, 12 bp, Homo sapiens
agctccaggaca

SEQ ID NO: 5202303 - DNA, 13 bp, Homo sapiens
agctccaggacac

SEQ ID NO: 5202304 - DNA, 17 bp, Homo sapiens
agctccaggatggggag

SEQ ID NO: 5202305 - DNA, 21 bp, Homo sapiens
agctccaggatggggaggggc

SEQ ID NO: 5202306 - DNA, 12 bp, Homo sapiens
agctccaggccc

SEQ ID NO: 5202307 - DNA, 15 bp, Homo sapiens
agctccagggccaga

SEQ ID NO: 5202308 - DNA, 13 bp, Homo sapiens
agctccaggggcc

SEQ ID NO: 5202309 - DNA, 13 bp, Homo sapiens
agctccaggtgcc

SEQ ID NO: 5202310 - DNA, 19 bp, Homo sapiens
agctccaggtgccctgtgg

SEQ ID NO: 5202311 - DNA, 16 bp, Homo sapiens
agctccagtagctccg

SEQ ID NO: 5202312 - DNA, 17 bp, Homo sapiens
agctccagtcctgctct

SEQ ID NO: 5202313 - DNA, 17 bp, Homo sapiens
agctccagtgccgctcc

SEQ ID NO: 5202314 - DNA, 16 bp, Homo sapiens
agctccagtgtcctga

SEQ ID NO: 5202315 - DNA, 17 bp, Homo sapiens
agctccatactctgtcc

SEQ ID NO: 5202316 - DNA, 22 bp, Homo sapiens
agctccatcaatgaggtatctt

SEQ ID NO: 5202317 - DNA, 16 bp, Homo sapiens
agctccatccttgcat

SEQ ID NO: 5202318 - DNA, 14 bp, Homo sapiens
agctccatgtgcat

SEQ ID NO: 5202319 - DNA, 15 bp, Homo sapiens
agctccatgtgcata

SEQ ID NO: 5202320 - DNA, 19 bp, Homo sapiens
agctccatgtgcatataaa

SEQ ID NO: 5202321 - DNA, 16 bp, Homo sapiens
agctccatgttgcttc

SEQ ID NO: 5202322 - DNA, 18 bp, Homo sapiens
agctccatttaaacagat

SEQ ID NO: 5202323 - DNA, 19 bp, Homo sapiens
agctcccaacagaggcctc

SEQ ID NO: 5202324 - DNA, 21 bp, Homo sapiens
agctcccaacgagcctcctca

SEQ ID NO: 5202325 - DNA, 12 bp, Homo sapiens
agctcccaagag

SEQ ID NO: 5202326 - DNA, 18 bp, Homo sapiens
agctcccaagagcttcca

SEQ ID NO: 5202327 - DNA, 21 bp, Homo sapiens
agctcccaagagcttccagag

SEQ ID NO: 5202328 - DNA, 20 bp, Homo sapiens
agctcccaagggatggtgcc

SEQ ID NO: 5202329 - DNA, 16 bp, Homo sapiens
agctcccacaagcctc

SEQ ID NO: 5202330 - DNA, 13 bp, Homo sapiens
agctcccacccca

SEQ ID NO: 5202331 - DNA, 15 bp, Homo sapiens
agctcccaccccacc

SEQ ID NO: 5202332 - DNA, 16 bp, Homo sapiens
agctcccaccccactc

SEQ ID NO: 5202333 - DNA, 13 bp, Homo sapiens
agctcccacctcc

SEQ ID NO: 5202334 - DNA, 19 bp, Homo sapiens
agctcccacctccccttgg

SEQ ID NO: 5202335 - DNA, 18 bp, Homo sapiens
agctcccacttctgccag

SEQ ID NO: 5202336 - DNA, 19 bp, Homo sapiens
agctcccacttctgccaga

SEQ ID NO: 5202337 - DNA, 12 bp, Homo sapiens
agctcccaggaa

SEQ ID NO: 5202338 - DNA, 14 bp, Homo sapiens
agctcccaggaaca

SEQ ID NO: 5202339 - DNA, 19 bp, Homo sapiens
agctcccaggacgcaggga

SEQ ID NO: 5202340 - DNA, 12 bp, Homo sapiens
agctcccaggcc

SEQ ID NO: 5202341 - DNA, 13 bp, Homo sapiens
agctcccaggcca

SEQ ID NO: 5202342 - DNA, 19 bp, Homo sapiens
agctcccatagcgctggct

SEQ ID NO: 5202343 - DNA, 20 bp, Homo sapiens
agctcccattctatgtgtca

SEQ ID NO: 5202344 - DNA, 18 bp, Homo sapiens
agctccccaactccctgc

SEQ ID NO: 5202345 - DNA, 17 bp, Homo sapiens
agctccccaatccctga

SEQ ID NO: 5202346 - DNA, 20 bp, Homo sapiens
agctccccaatccctgaccc

SEQ ID NO: 5202347 - DNA, 22 bp, Homo sapiens
agctccccacaccttccagggc

SEQ ID NO: 5202348 - DNA, 23 bp, Homo sapiens
agctccccacaccttccagggcc

SEQ ID NO: 5202349 - DNA, 10 bp, Homo sapiens
agctccccca

SEQ ID NO: 5202350 - DNA, 16 bp, Homo sapiens
agctcccccagctccc

SEQ ID NO: 5202351 - DNA, 20 bp, Homo sapiens
agctccccccacctccccca

SEQ ID NO: 5202352 - DNA, 18 bp, Homo sapiens
agctccccccgcccaccc

SEQ ID NO: 5202353 - DNA, 23 bp, Homo sapiens
agctcccccgggaggggcccgct

SEQ ID NO: 5202354 - DNA, 22 bp, Homo sapiens
agctcccccgtggtgcctgcac

SEQ ID NO: 5202355 - DNA, 14 bp, Homo sapiens
agctcccccttgcc

SEQ ID NO: 5202356 - DNA, 14 bp, Homo sapiens
agctcccctccaca

SEQ ID NO: 5202357 - DNA, 13 bp, Homo sapiens
agctcccctcctc

SEQ ID NO: 5202358 - DNA, 14 bp, Homo sapiens
agctcccctcctct

SEQ ID NO: 5202359 - DNA, 17 bp, Homo sapiens
agctcccctcggagaag

SEQ ID NO: 5202360 - DNA, 20 bp, Homo sapiens
agctcccctcggagaagagc

SEQ ID NO: 5202361 - DNA, 12 bp, Homo sapiens
agctcccctctt

SEQ ID NO: 5202362 - DNA, 17 bp, Homo sapiens
agctcccctcttttgta

SEQ ID NO: 5202363 - DNA, 20 bp, Homo sapiens
agctcccctgctgaggcagt

SEQ ID NO: 5202364 - DNA, 14 bp, Homo sapiens
agctcccctggctg

SEQ ID NO: 5202365 - DNA, 15 bp, Homo sapiens
agctcccctggctgg

SEQ ID NO: 5202366 - DNA, 17 bp, Homo sapiens
agctcccctggctggct

SEQ ID NO: 5202367 - DNA, 19 bp, Homo sapiens
agctcccctggctggctcc

SEQ ID NO: 5202368 - DNA, 22 bp, Homo sapiens
agctcccgaggaagcacagctt

SEQ ID NO: 5202369 - DNA, 20 bp, Homo sapiens
agctcccgtgtaaataattt

SEQ ID NO: 5202370 - DNA, 15 bp, Homo sapiens
agctccctaggagac

SEQ ID NO: 5202371 - DNA, 15 bp, Homo sapiens
agctccctcccctgc

SEQ ID NO: 5202372 - DNA, 16 bp, Homo sapiens
agctccctcccctgct

SEQ ID NO: 5202373 - DNA, 19 bp, Homo sapiens
agctccctcctcccatctc

SEQ ID NO: 5202374 - DNA, 23 bp, Homo sapiens
agctccctcctcccatctccttc

SEQ ID NO: 5202375 - DNA, 23 bp, Homo sapiens
agctccctgaatctgaccacaga

SEQ ID NO: 5202376 - DNA, 20 bp, Homo sapiens
agctccctgaccccctgtcc

SEQ ID NO: 5202377 - DNA, 16 bp, Homo sapiens
agctccctgcaccgcc

SEQ ID NO: 5202378 - DNA, 11 bp, Homo sapiens
agctccctgcc

SEQ ID NO: 5202379 - DNA, 13 bp, Homo sapiens
agctccctgccaa

SEQ ID NO: 5202380 - DNA, 13 bp, Homo sapiens
agctccctgcccc

SEQ ID NO: 5202381 - DNA, 14 bp, Homo sapiens
agctccctgcccca

SEQ ID NO: 5202382 - DNA, 19 bp, Homo sapiens
agctccctgcctgtttccc

SEQ ID NO: 5202383 - DNA, 17 bp, Homo sapiens
agctccctggagccctg

SEQ ID NO: 5202384 - DNA, 14 bp, Homo sapiens
agctccctggcttc

SEQ ID NO: 5202385 - DNA, 18 bp, Homo sapiens
agctccctggcttctgtg

SEQ ID NO: 5202386 - DNA, 22 bp, Homo sapiens
agctccctggtgagggagcctc

SEQ ID NO: 5202387 - DNA, 16 bp, Homo sapiens
agctccctgtgccccc

SEQ ID NO: 5202388 - DNA, 19 bp, Homo sapiens
agctccctgtgcccccagg

SEQ ID NO: 5202389 - DNA, 19 bp, Homo sapiens
agctcccttcccctgcctg

SEQ ID NO: 5202390 - DNA, 21 bp, Homo sapiens
agctcccttcccttgagatga

SEQ ID NO: 5202391 - DNA, 14 bp, Homo sapiens
agctcccttcctga

SEQ ID NO: 5202392 - DNA, 13 bp, Homo sapiens
agctcccttctct

SEQ ID NO: 5202393 - DNA, 13 bp, Homo sapiens
agctccctttttg

SEQ ID NO: 5202394 - DNA, 18 bp, Homo sapiens
agctccctttttgaattg

SEQ ID NO: 5202395 - DNA, 18 bp, Homo sapiens
agctccgacctctctcag

SEQ ID NO: 5202396 - DNA, 18 bp, Homo sapiens
agctccgcctggcaccca

SEQ ID NO: 5202397 - DNA, 23 bp, Homo sapiens
agctccgcgtgtctcatttgcca

SEQ ID NO: 5202398 - DNA, 21 bp, Homo sapiens
agctccgggggtacagccctt

SEQ ID NO: 5202399 - DNA, 22 bp, Homo sapiens
agctccgggtgtagattccctt

SEQ ID NO: 5202400 - DNA, 15 bp, Homo sapiens
agctccgtggagcag

SEQ ID NO: 5202401 - DNA, 17 bp, Homo sapiens
agctcctagcagagaga

SEQ ID NO: 5202402 - DNA, 19 bp, Homo sapiens
agctcctagtatgccctgt

SEQ ID NO: 5202403 - DNA, 17 bp, Homo sapiens
agctcctcaaagcctca

SEQ ID NO: 5202404 - DNA, 16 bp, Homo sapiens
agctcctcaactcacc

SEQ ID NO: 5202405 - DNA, 23 bp, Homo sapiens
agctcctcaactcacctaatgtt

SEQ ID NO: 5202406 - DNA, 10 bp, Homo sapiens
agctcctcac

SEQ ID NO: 5202407 - DNA, 14 bp, Homo sapiens
agctcctcactgtg

SEQ ID NO: 5202408 - DNA, 12 bp, Homo sapiens
agctcctcagcg

SEQ ID NO: 5202409 - DNA, 18 bp, Homo sapiens
agctcctcagcggctcca

SEQ ID NO: 5202410 - DNA, 19 bp, Homo sapiens
agctcctccagccctgccg

SEQ ID NO: 5202411 - DNA, 16 bp, Homo sapiens
agctcctcccctgccg

SEQ ID NO: 5202412 - DNA, 22 bp, Homo sapiens
agctcctcccctgccgcctccc

SEQ ID NO: 5202413 - DNA, 14 bp, Homo sapiens
agctcctcccctgg

SEQ ID NO: 5202414 - DNA, 18 bp, Homo sapiens
agctcctccctccagctg

SEQ ID NO: 5202415 - DNA, 15 bp, Homo sapiens
agctcctccctgtgc

SEQ ID NO: 5202416 - DNA, 17 bp, Homo sapiens
agctcctccctgtgccc

SEQ ID NO: 5202417 - DNA, 20 bp, Homo sapiens
agctcctccgtgcttcctca

SEQ ID NO: 5202418 - DNA, 21 bp, Homo sapiens
agctcctcctccctgcatctg

SEQ ID NO: 5202419 - DNA, 23 bp, Homo sapiens
agctcctcctccctgcatctgac

SEQ ID NO: 5202420 - DNA, 16 bp, Homo sapiens
agctcctcctcggaac

SEQ ID NO: 5202421 - DNA, 22 bp, Homo sapiens
agctcctccttgtcttggcagc

SEQ ID NO: 5202422 - DNA, 20 bp, Homo sapiens
agctcctcgggtggggcctg

SEQ ID NO: 5202423 - DNA, 19 bp, Homo sapiens
agctcctctaggggcagcc

SEQ ID NO: 5202424 - DNA, 17 bp, Homo sapiens
agctcctctccccagcc

SEQ ID NO: 5202425 - DNA, 19 bp, Homo sapiens
agctcctctccttgggctc

SEQ ID NO: 5202426 - DNA, 23 bp, Homo sapiens
agctcctctccttgggctcctgg

SEQ ID NO: 5202427 - DNA, 24 bp, Homo sapiens
agctcctctccttgggctcctggc

SEQ ID NO: 5202428 - DNA, 13 bp, Homo sapiens
agctcctctctga

SEQ ID NO: 5202429 - DNA, 14 bp, Homo sapiens
agctcctctctgaa

SEQ ID NO: 5202430 - DNA, 12 bp, Homo sapiens
agctcctctgag

SEQ ID NO: 5202431 - DNA, 13 bp, Homo sapiens
agctcctctgagc

SEQ ID NO: 5202432 - DNA, 14 bp, Homo sapiens
agctcctctgagcc

SEQ ID NO: 5202433 - DNA, 15 bp, Homo sapiens
agctcctctgagcca

SEQ ID NO: 5202434 - DNA, 12 bp, Homo sapiens
agctcctctgct

SEQ ID NO: 5202435 - DNA, 13 bp, Homo sapiens
agctcctctgctc

SEQ ID NO: 5202436 - DNA, 15 bp, Homo sapiens
agctcctctgctgct

SEQ ID NO: 5202437 - DNA, 17 bp, Homo sapiens
agctcctctgctgctcc

SEQ ID NO: 5202438 - DNA, 18 bp, Homo sapiens
agctcctctgctgctccc

SEQ ID NO: 5202439 - DNA, 12 bp, Homo sapiens
agctcctctggg

SEQ ID NO: 5202440 - DNA, 19 bp, Homo sapiens
agctcctctgggcaggacc

SEQ ID NO: 5202441 - DNA, 15 bp, Homo sapiens
agctcctctgtcctg

SEQ ID NO: 5202442 - DNA, 14 bp, Homo sapiens
agctcctcttccat

SEQ ID NO: 5202443 - DNA, 15 bp, Homo sapiens
agctcctcttccatg

SEQ ID NO: 5202444 - DNA, 18 bp, Homo sapiens
agctcctcttccatgctg

SEQ ID NO: 5202445 - DNA, 13 bp, Homo sapiens
agctcctgaataa

SEQ ID NO: 5202446 - DNA, 19 bp, Homo sapiens
agctcctgaatccctttca

SEQ ID NO: 5202447 - DNA, 24 bp, Homo sapiens
agctcctgaccagttgcagtcact

SEQ ID NO: 5202448 - DNA, 17 bp, Homo sapiens
agctcctgaccttgggt

SEQ ID NO: 5202449 - DNA, 21 bp, Homo sapiens
agctcctgagtagctgggcct

SEQ ID NO: 5202450 - DNA, 17 bp, Homo sapiens
agctcctgctacttccc

SEQ ID NO: 5202451 - DNA, 18 bp, Homo sapiens
agctcctgctcattgtgg

SEQ ID NO: 5202452 - DNA, 18 bp, Homo sapiens
agctcctggaccaggccc

SEQ ID NO: 5202453 - DNA, 13 bp, Homo sapiens
agctcctggcagc

SEQ ID NO: 5202454 - DNA, 19 bp, Homo sapiens
agctcctggggagctcctg

SEQ ID NO: 5202455 - DNA, 21 bp, Homo sapiens
agctcctggggagctcctggg

SEQ ID NO: 5202456 - DNA, 22 bp, Homo sapiens
agctcctggggagctcctggga

SEQ ID NO: 5202457 - DNA, 13 bp, Homo sapiens
agctcctggggcg

SEQ ID NO: 5202458 - DNA, 20 bp, Homo sapiens
agctcctggtcttgagatgt

SEQ ID NO: 5202459 - DNA, 14 bp, Homo sapiens
agctcctgtcccct

SEQ ID NO: 5202460 - DNA, 16 bp, Homo sapiens
agctcctgtccctacc

SEQ ID NO: 5202461 - DNA, 13 bp, Homo sapiens
agctcctgtcctc

SEQ ID NO: 5202462 - DNA, 21 bp, Homo sapiens
agctcctgtcctcccatcccc

SEQ ID NO: 5202463 - DNA, 16 bp, Homo sapiens
agctcctgtggcccca

SEQ ID NO: 5202464 - DNA, 15 bp, Homo sapiens
agctcctgtttggaa

SEQ ID NO: 5202465 - DNA, 18 bp, Homo sapiens
agctccttaaggctcttt

SEQ ID NO: 5202466 - DNA, 11 bp, Homo sapiens
aggagcctgcg

SEQ ID NO: 5202467 - DNA, 23 bp, Homo sapiens
aggagcctgctaaggaacaatgc

SEQ ID NO: 5202468 - DNA, 14 bp, Homo sapiens
aggagcctggaggg

SEQ ID NO: 5202469 - DNA, 15 bp, Homo sapiens
aggagcctggccagg

SEQ ID NO: 5202470 - DNA, 19 bp, Homo sapiens
aggagcctggccaggcagg

SEQ ID NO: 5202471 - DNA, 20 bp, Homo sapiens
aggagcctggtccttccctg

SEQ ID NO: 5202472 - DNA, 20 bp, Homo sapiens
aggagcctgtgaacccagga

SEQ ID NO: 5202473 - DNA, 18 bp, Homo sapiens
aggagccttgctgggcca

SEQ ID NO: 5202474 - DNA, 19 bp, Homo sapiens
aggagccttgctgggccag

SEQ ID NO: 5202475 - DNA, 21 bp, Homo sapiens
aggagccttgttggtggagag

SEQ ID NO: 5202476 - DNA, 16 bp, Homo sapiens
aggagcctttttaaaa

SEQ ID NO: 5202477 - DNA, 14 bp, Homo sapiens
aggagcgagcatgt

SEQ ID NO: 5202478 - DNA, 16 bp, Homo sapiens
aggagcgcagctgcat

SEQ ID NO: 5202479 - DNA, 18 bp, Homo sapiens
aggagcgctagtgccttg

SEQ ID NO: 5202480 - DNA, 19 bp, Homo sapiens
aggagcgctagtgccttgc

SEQ ID NO: 5202481 - DNA, 20 bp, Homo sapiens
aggagcgctagtgccttgcc

SEQ ID NO: 5202482 - DNA, 22 bp, Homo sapiens
aggagcgctagtgccttgccca

SEQ ID NO: 5202483 - DNA, 22 bp, Homo sapiens
aggagcgctcccttgacctgct

SEQ ID NO: 5202484 - DNA, 18 bp, Homo sapiens
aggagcggcgccctggac

SEQ ID NO: 5202485 - DNA, 20 bp, Homo sapiens
aggagcggcgccctggactt

SEQ ID NO: 5202486 - DNA, 13 bp, Homo sapiens
aggagcgggcagg

SEQ ID NO: 5202487 - DNA, 16 bp, Homo sapiens
aggagcgtggactctg

SEQ ID NO: 5202488 - DNA, 19 bp, Homo sapiens
aggagcgtggactctgcta

SEQ ID NO: 5202489 - DNA, 13 bp, Homo sapiens
aggagcgtgtcct

SEQ ID NO: 5202490 - DNA, 13 bp, Homo sapiens
aggagctaaggct

SEQ ID NO: 5202491 - DNA, 17 bp, Homo sapiens
aggagctaaggctctat

SEQ ID NO: 5202492 - DNA, 19 bp, Homo sapiens
aggagctaaggctctatga

SEQ ID NO: 5202493 - DNA, 20 bp, Homo sapiens
aggagctaaggctctatgag

SEQ ID NO: 5202494 - DNA, 14 bp, Homo sapiens
aggagctacctgtg

SEQ ID NO: 5202495 - DNA, 16 bp, Homo sapiens
aggagctacctgtgtg

SEQ ID NO: 5202496 - DNA, 17 bp, Homo sapiens
aggagctacctgtgtgg

SEQ ID NO: 5202497 - DNA, 18 bp, Homo sapiens
aggagctactgacattcc

SEQ ID NO: 5202498 - DNA, 19 bp, Homo sapiens
aggagctagcccagtccct

SEQ ID NO: 5202499 - DNA, 14 bp, Homo sapiens
aggagctagcctga

SEQ ID NO: 5202500 - DNA, 18 bp, Homo sapiens
aggagctagcctgaagga

SEQ ID NO: 5202501 - DNA, 16 bp, Homo sapiens
aggagctagtgttaat

SEQ ID NO: 5202502 - DNA, 22 bp, Homo sapiens
aggagctagtgttaatccagag

SEQ ID NO: 5202503 - DNA, 18 bp, Homo sapiens
aggagctagttctcagct

SEQ ID NO: 5202504 - DNA, 18 bp, Homo sapiens
aggagctcaacggtctgg

SEQ ID NO: 5202505 - DNA, 14 bp, Homo sapiens
aggagctcaccctg

SEQ ID NO: 5202506 - DNA, 23 bp, Homo sapiens
aggagctcactgtggtgtctgtg

SEQ ID NO: 5202507 - DNA, 18 bp, Homo sapiens
aggagctcagggctggat

SEQ ID NO: 5202508 - DNA, 19 bp, Homo sapiens
aggagctcaggtggggagt

SEQ ID NO: 5202509 - DNA, 22 bp, Homo sapiens
aggagctccctttttgaattgt

SEQ ID NO: 5202510 - DNA, 23 bp, Homo sapiens
aggagctccgctaagacctcccc

SEQ ID NO: 5202511 - DNA, 13 bp, Homo sapiens
aggagctctctgc

SEQ ID NO: 5202512 - DNA, 14 bp, Homo sapiens
aggagctctctgct

SEQ ID NO: 5202513 - DNA, 23 bp, Homo sapiens
aggagctctgaatctgataggaa

SEQ ID NO: 5202514 - DNA, 12 bp, Homo sapiens
aggagctctgcg

SEQ ID NO: 5202515 - DNA, 20 bp, Homo sapiens
aggagctctgcgccaggcag

SEQ ID NO: 5202516 - DNA, 24 bp, Homo sapiens
aggagctctgcgccaggcagagct

SEQ ID NO: 5202517 - DNA, 23 bp, Homo sapiens
aggagctcttaactacagtggct

SEQ ID NO: 5202518 - DNA, 17 bp, Homo sapiens
aggagctcttcaggcct

SEQ ID NO: 5202519 - DNA, 19 bp, Homo sapiens
aggagctcttcaggcctcc

SEQ ID NO: 5202520 - DNA, 22 bp, Homo sapiens
aggagctgactcacacctgaac

SEQ ID NO: 5202521 - DNA, 22 bp, Homo sapiens
aggagctgagaatagaaggaaa

SEQ ID NO: 5202522 - DNA, 15 bp, Homo sapiens
aggagctgagggagg

SEQ ID NO: 5202523 - DNA, 16 bp, Homo sapiens
aggagctgagggaggg

SEQ ID NO: 5202524 - DNA, 18 bp, Homo sapiens
aggagctgagggagggag

SEQ ID NO: 5202525 - DNA, 20 bp, Homo sapiens
aggagctgatttccaggccc

SEQ ID NO: 5202526 - DNA, 21 bp, Homo sapiens
aggagctgcccagagttgctg

SEQ ID NO: 5202527 - DNA, 15 bp, Homo sapiens
aggagctgccgcaag

SEQ ID NO: 5202528 - DNA, 22 bp, Homo sapiens
aggagctgccgcaaggccctgt

SEQ ID NO: 5202529 - DNA, 23 bp, Homo sapiens
aggagctgccttggctcagacat

SEQ ID NO: 5202530 - DNA, 13 bp, Homo sapiens
aggagctgctata

SEQ ID NO: 5202531 - DNA, 21 bp, Homo sapiens
aggagctgctatagcctgggg

SEQ ID NO: 5202532 - DNA, 12 bp, Homo sapiens
aggagctgctca

SEQ ID NO: 5202533 - DNA, 24 bp, Homo sapiens
aggagctgctcaggcttggcggag

SEQ ID NO: 5202534 - DNA, 17 bp, Homo sapiens
aggagctggaggggtgg

SEQ ID NO: 5202535 - DNA, 21 bp, Homo sapiens
aggagctggaggggtggggag

SEQ ID NO: 5202536 - DNA, 16 bp, Homo sapiens
aggagctggcctgcgg

SEQ ID NO: 5202537 - DNA, 14 bp, Homo sapiens
aggagctggcctgt

SEQ ID NO: 5202538 - DNA, 16 bp, Homo sapiens
aggagctggcctgtgg

SEQ ID NO: 5202539 - DNA, 14 bp, Homo sapiens
aggagctggctggc

SEQ ID NO: 5202540 - DNA, 16 bp, Homo sapiens
aggagctggctggcag

SEQ ID NO: 5202541 - DNA, 15 bp, Homo sapiens
aggagctgggagccg

SEQ ID NO: 5202542 - DNA, 16 bp, Homo sapiens
aggagctgggaggaaa

SEQ ID NO: 5202543 - DNA, 13 bp, Homo sapiens
aggagctgggccc

SEQ ID NO: 5202544 - DNA, 20 bp, Homo sapiens
aggagctgggcccctgcaca

SEQ ID NO: 5202545 - DNA, 20 bp, Homo sapiens
aggagctggggatccctccc

SEQ ID NO: 5202546 - DNA, 16 bp, Homo sapiens
aggagcttacccaagc

SEQ ID NO: 5202547 - DNA, 17 bp, Homo sapiens
aggagcttacccaagct

SEQ ID NO: 5202548 - DNA, 21 bp, Homo sapiens
aggagcttacccaagctgtgg

SEQ ID NO: 5202549 - DNA, 18 bp, Homo sapiens
aggagcttacctcccacc

SEQ ID NO: 5202550 - DNA, 14 bp, Homo sapiens
aggagcttccagtg

SEQ ID NO: 5202551 - DNA, 19 bp, Homo sapiens
aggagcttccagtgcatgt

SEQ ID NO: 5202552 - DNA, 16 bp, Homo sapiens
aggagcttcctgtcct

SEQ ID NO: 5202553 - DNA, 15 bp, Homo sapiens
aggagcttctcccag

SEQ ID NO: 5202554 - DNA, 19 bp, Homo sapiens
aggagcttctcccagtgtg

SEQ ID NO: 5202555 - DNA, 20 bp, Homo sapiens
aggagcttctggggtcccca

SEQ ID NO: 5202556 - DNA, 15 bp, Homo sapiens
aggagctttctcaat

SEQ ID NO: 5202557 - DNA, 19 bp, Homo sapiens
aggagctttctcaatgtct

SEQ ID NO: 5202558 - DNA, 20 bp, Homo sapiens
aggagctttcttgtttctta

SEQ ID NO: 5202559 - DNA, 19 bp, Homo sapiens
aggagctttgactcaggag

SEQ ID NO: 5202560 - DNA, 13 bp, Homo sapiens
aggagctttgctc

SEQ ID NO: 5202561 - DNA, 13 bp, Homo sapiens
aggagcttttctg

SEQ ID NO: 5202562 - DNA, 17 bp, Homo sapiens
aggaggaaaaaggctgg

SEQ ID NO: 5202563 - DNA, 18 bp, Homo sapiens
aggaggaaaaaggctggt

SEQ ID NO: 5202564 - DNA, 21 bp, Homo sapiens
aggaggaaaacacagcctccc

SEQ ID NO: 5202565 - DNA, 22 bp, Homo sapiens
aggaggaaaacacagcctccct

SEQ ID NO: 5202566 - DNA, 15 bp, Homo sapiens
aggaggaaaagacag

SEQ ID NO: 5202567 - DNA, 13 bp, Homo sapiens
aggaggaaaagga

SEQ ID NO: 5202568 - DNA, 14 bp, Homo sapiens
aggaggaaaaggaa

SEQ ID NO: 5202569 - DNA, 17 bp, Homo sapiens
aggaggaaaaggcttgg

SEQ ID NO: 5202570 - DNA, 18 bp, Homo sapiens
aggaggaaaaggcttggt

SEQ ID NO: 5202571 - DNA, 19 bp, Homo sapiens
aggaggaaaagtcttccta

SEQ ID NO: 5202572 - DNA, 16 bp, Homo sapiens
aggaggaaacagttct

SEQ ID NO: 5202573 - DNA, 18 bp, Homo sapiens
aggaggaacgggcagcca

SEQ ID NO: 5202574 - DNA, 17 bp, Homo sapiens
aggaggaactggtccag

SEQ ID NO: 5202575 - DNA, 22 bp, Homo sapiens
aggaggaactggtccaggccag

SEQ ID NO: 5202576 - DNA, 12 bp, Homo sapiens
aggaggaagccg

SEQ ID NO: 5202577 - DNA, 14 bp, Homo sapiens
aggaggaaggcaaa

SEQ ID NO: 5202578 - DNA, 15 bp, Homo sapiens
aggaggaagggactg

SEQ ID NO: 5202579 - DNA, 21 bp, Homo sapiens
aggaggaagggactggtccag

SEQ ID NO: 5202580 - DNA, 21 bp, Homo sapiens
aggaggaataagctcccaggg

SEQ ID NO: 5202581 - DNA, 15 bp, Homo sapiens
aggaggaatactgaa

SEQ ID NO: 5202582 - DNA, 22 bp, Homo sapiens
aggaggaatcatgtcaggcctg

SEQ ID NO: 5202583 - DNA, 22 bp, Homo sapiens
aggaggacaagaccctctcagg

SEQ ID NO: 5202584 - DNA, 18 bp, Homo sapiens
aggaggacagagtgccct

SEQ ID NO: 5202585 - DNA, 19 bp, Homo sapiens
aggaggacagagtgccctg

SEQ ID NO: 5202586 - DNA, 21 bp, Homo sapiens
aggaggacagagtgccctggg

SEQ ID NO: 5202587 - DNA, 15 bp, Homo sapiens
aggaggacagggagg

SEQ ID NO: 5202588 - DNA, 15 bp, Homo sapiens
aggaggacaggtgga

SEQ ID NO: 5202589 - DNA, 19 bp, Homo sapiens
aggaggacaggtggaggcg

SEQ ID NO: 5202590 - DNA, 14 bp, Homo sapiens
aggaggacccagga

SEQ ID NO: 5202591 - DNA, 17 bp, Homo sapiens
aggaggacccaggacag

SEQ ID NO: 5202592 - DNA, 18 bp, Homo sapiens
aggaggacccagggctct

SEQ ID NO: 5202593 - DNA, 19 bp, Homo sapiens
aggaggacccctgccttcc

SEQ ID NO: 5202594 - DNA, 20 bp, Homo sapiens
aggaggacccctgccttcct

SEQ ID NO: 5202595 - DNA, 23 bp, Homo sapiens
aggaggacctggggggggcaaga

SEQ ID NO: 5202596 - DNA, 22 bp, Homo sapiens
aggaggacttggagggtctggg

SEQ ID NO: 5202597 - DNA, 11 bp, Homo sapiens
aggaggagaaa

SEQ ID NO: 5202598 - DNA, 13 bp, Homo sapiens
aggaggagaagga

SEQ ID NO: 5202599 - DNA, 14 bp, Homo sapiens
aggaggagacagag

SEQ ID NO: 5202600 - DNA, 16 bp, Homo sapiens
aggaggagacagtcag

SEQ ID NO: 5202601 - DNA, 13 bp, Homo sapiens
aggaggagagagt

SEQ ID NO: 5202602 - DNA, 16 bp, Homo sapiens
aggaggagagggaaaa

SEQ ID NO: 5202603 - DNA, 20 bp, Homo sapiens
aggaggagattaacacactg

SEQ ID NO: 5202604 - DNA, 22 bp, Homo sapiens
aggaggagattaacacactgaa

SEQ ID NO: 5202605 - DNA, 15 bp, Homo sapiens
aggaggagcaggggc

SEQ ID NO: 5202606 - DNA, 21 bp, Homo sapiens
aggaggagcctgtcctgcctg

SEQ ID NO: 5202607 - DNA, 15 bp, Homo sapiens
aggaggagctggcct

SEQ ID NO: 5202608 - DNA, 16 bp, Homo sapiens
aggaggagctggcctg

SEQ ID NO: 5202609 - DNA, 13 bp, Homo sapiens
aggaggaggagaa

SEQ ID NO: 5202610 - DNA, 16 bp, Homo sapiens
aggaggaggagatggc

SEQ ID NO: 5202611 - DNA, 16 bp, Homo sapiens
aggaggaggagggaga

SEQ ID NO: 5202612 - DNA, 17 bp, Homo sapiens
aggaggaggattgtgct

SEQ ID NO: 5202613 - DNA, 23 bp, Homo sapiens
aggaggaggcaattgggatggcg

SEQ ID NO: 5202614 - DNA, 15 bp, Homo sapiens
aggaggaggcatgga

SEQ ID NO: 5202615 - DNA, 13 bp, Homo sapiens
aggaggagggaga

SEQ ID NO: 5202616 - DNA, 15 bp, Homo sapiens
aggaggagggagaag

SEQ ID NO: 5202617 - DNA, 17 bp, Homo sapiens
aggaggagggagaagag

SEQ ID NO: 5202618 - DNA, 22 bp, Homo sapiens
aggaggagggagaagagaaaat

SEQ ID NO: 5202619 - DNA, 16 bp, Homo sapiens
aggaggagggaggccg

SEQ ID NO: 5202620 - DNA, 22 bp, Homo sapiens
aggaggagggaggcgctgctgg

SEQ ID NO: 5202621 - DNA, 20 bp, Homo sapiens
aggaggagtcagatgaggcc

SEQ ID NO: 5202622 - DNA, 17 bp, Homo sapiens
aggaggagtgggacaga

SEQ ID NO: 5202623 - DNA, 23 bp, Homo sapiens
aggaggagtgggacagacagcag

SEQ ID NO: 5202624 - DNA, 18 bp, Homo sapiens
aggaggatgactaacaag

SEQ ID NO: 5202625 - DNA, 18 bp, Homo sapiens
aggaggatgagccacaga

SEQ ID NO: 5202626 - DNA, 12 bp, Homo sapiens
aggaggatgctg

SEQ ID NO: 5202627 - DNA, 15 bp, Homo sapiens
aggaggatgctgtgc

SEQ ID NO: 5202628 - DNA, 14 bp, Homo sapiens
aggaggatggcttg

SEQ ID NO: 5202629 - DNA, 17 bp, Homo sapiens
aggaggatgtccctggg

SEQ ID NO: 5202630 - DNA, 21 bp, Homo sapiens
aggaggattgcctttaatatt

SEQ ID NO: 5202631 - DNA, 13 bp, Homo sapiens
aggaggattgctt

SEQ ID NO: 5202632 - DNA, 14 bp, Homo sapiens
aggaggcagagaag

SEQ ID NO: 5202633 - DNA, 21 bp, Homo sapiens
aggaggcagagagggtcactg

SEQ ID NO: 5202634 - DNA, 20 bp, Homo sapiens
aggaggcagaggttgcaatg

SEQ ID NO: 5202635 - DNA, 15 bp, Homo sapiens
aggaggcagcaggac

SEQ ID NO: 5202636 - DNA, 17 bp, Homo sapiens
aggaggcagcaggactg

SEQ ID NO: 5202637 - DNA, 16 bp, Homo sapiens
aggaggcagccccctc

SEQ ID NO: 5202638 - DNA, 19 bp, Homo sapiens
aggaggcagccccctccac

SEQ ID NO: 5202639 - DNA, 20 bp, Homo sapiens
aggaggcagccccctccaca

SEQ ID NO: 5202640 - DNA, 21 bp, Homo sapiens
aggaggcagggctctggggcc

SEQ ID NO: 5202641 - DNA, 19 bp, Homo sapiens
aggaggccaaccagcccga

SEQ ID NO: 5202642 - DNA, 22 bp, Homo sapiens
aggaggccaaccagcccgacag

SEQ ID NO: 5202643 - DNA, 14 bp, Homo sapiens
aggaggccacctcc

SEQ ID NO: 5202644 - DNA, 19 bp, Homo sapiens
agctccttactctgaggaa

SEQ ID NO: 5202645 - DNA, 13 bp, Homo sapiens
agctccttagcta

SEQ ID NO: 5202646 - DNA, 13 bp, Homo sapiens
agctccttcatgc

SEQ ID NO: 5202647 - DNA, 12 bp, Homo sapiens
agctccttcctg

SEQ ID NO: 5202648 - DNA, 18 bp, Homo sapiens
agctccttcctgtttgtt

SEQ ID NO: 5202649 - DNA, 12 bp, Homo sapiens
agctccttctgt

SEQ ID NO: 5202650 - DNA, 15 bp, Homo sapiens
agctccttctgtcct

SEQ ID NO: 5202651 - DNA, 21 bp, Homo sapiens
agctccttctgtcctactctg

SEQ ID NO: 5202652 - DNA, 22 bp, Homo sapiens
agctccttctgtcctactctgt

SEQ ID NO: 5202653 - DNA, 19 bp, Homo sapiens
agctccttgggaggaagca

SEQ ID NO: 5202654 - DNA, 21 bp, Homo sapiens
agctccttgggaggaagcaga

SEQ ID NO: 5202655 - DNA, 22 bp, Homo sapiens
agctccttgggaggaagcagaa

SEQ ID NO: 5202656 - DNA, 19 bp, Homo sapiens
agctccttgggaggcccca

SEQ ID NO: 5202657 - DNA, 23 bp, Homo sapiens
agctccttggggcagggcctggg

SEQ ID NO: 5202658 - DNA, 21 bp, Homo sapiens
agctccttggttttgcctctt

SEQ ID NO: 5202659 - DNA, 16 bp, Homo sapiens
agctcctttcatgctc

SEQ ID NO: 5202660 - DNA, 14 bp, Homo sapiens
agctccttttccag

SEQ ID NO: 5202661 - DNA, 22 bp, Homo sapiens
agctccttttccgttctgttct

SEQ ID NO: 5202662 - DNA, 23 bp, Homo sapiens
agctccttttccgttctgttctg

SEQ ID NO: 5202663 - DNA, 16 bp, Homo sapiens
agctccttttctgtga

SEQ ID NO: 5202664 - DNA, 21 bp, Homo sapiens
agctccttttgtccccagggc

SEQ ID NO: 5202665 - DNA, 17 bp, Homo sapiens
agctcgaaataaaggcg

SEQ ID NO: 5202666 - DNA, 16 bp, Homo sapiens
agctcgatccaaattg

SEQ ID NO: 5202667 - DNA, 23 bp, Homo sapiens
agctcgatgtggtcacagctgta

SEQ ID NO: 5202668 - DNA, 14 bp, Homo sapiens
agctcgcacccccc

SEQ ID NO: 5202669 - DNA, 16 bp, Homo sapiens
agctcgcagcccccgc

SEQ ID NO: 5202670 - DNA, 23 bp, Homo sapiens
agctcgcagcccccgcgccctcc

SEQ ID NO: 5202671 - DNA, 16 bp, Homo sapiens
agctcgccccacctcc

SEQ ID NO: 5202672 - DNA, 18 bp, Homo sapiens
agctcgccccacctccac

SEQ ID NO: 5202673 - DNA, 22 bp, Homo sapiens
agctcgccccacctccacctgt

SEQ ID NO: 5202674 - DNA, 18 bp, Homo sapiens
agctcgcccctcccctca

SEQ ID NO: 5202675 - DNA, 14 bp, Homo sapiens
agctcgctggcttt

SEQ ID NO: 5202676 - DNA, 17 bp, Homo sapiens
agctcgctggctttctc

SEQ ID NO: 5202677 - DNA, 21 bp, Homo sapiens
agctcgctggctttctctctg

SEQ ID NO: 5202678 - DNA, 18 bp, Homo sapiens
agctcggaacttactgtg

SEQ ID NO: 5202679 - DNA, 16 bp, Homo sapiens
agctcggggacaggtg

SEQ ID NO: 5202680 - DNA, 15 bp, Homo sapiens
agctcggggagcctt

SEQ ID NO: 5202681 - DNA, 16 bp, Homo sapiens
agctcggggagcctta

SEQ ID NO: 5202682 - DNA, 16 bp, Homo sapiens
agctcggggggctctg

SEQ ID NO: 5202683 - DNA, 18 bp, Homo sapiens
agctcggggggctctgcc

SEQ ID NO: 5202684 - DNA, 17 bp, Homo sapiens
agctcggggtccaccag

SEQ ID NO: 5202685 - DNA, 19 bp, Homo sapiens
agctcggggtccaccagtg

SEQ ID NO: 5202686 - DNA, 22 bp, Homo sapiens
agctcggtacccggggcccagg

SEQ ID NO: 5202687 - DNA, 16 bp, Homo sapiens
agctcggtggacccag

SEQ ID NO: 5202688 - DNA, 19 bp, Homo sapiens
agctcggtggacccaggga

SEQ ID NO: 5202689 - DNA, 19 bp, Homo sapiens
agctcgtagaaacaagaca

SEQ ID NO: 5202690 - DNA, 21 bp, Homo sapiens
agctcgtgtgcttagaaacct

SEQ ID NO: 5202691 - DNA, 13 bp, Homo sapiens
agctcgtttctta

SEQ ID NO: 5202692 - DNA, 14 bp, Homo sapiens
agctcgtttttcag

SEQ ID NO: 5202693 - DNA, 23 bp, Homo sapiens
agctcgtttttcagcacccccac

SEQ ID NO: 5202694 - DNA, 16 bp, Homo sapiens
agctctaaaacataga

SEQ ID NO: 5202695 - DNA, 17 bp, Homo sapiens
agctctaaaatctgctt

SEQ ID NO: 5202696 - DNA, 13 bp, Homo sapiens
agctctaaagcag

SEQ ID NO: 5202697 - DNA, 18 bp, Homo sapiens
agctctaaagtagcaact

SEQ ID NO: 5202698 - DNA, 22 bp, Homo sapiens
agctctaaagtagcaactgctg

SEQ ID NO: 5202699 - DNA, 17 bp, Homo sapiens
agctctaagcagccagg

SEQ ID NO: 5202700 - DNA, 19 bp, Homo sapiens
agctctaagcagccaggag

SEQ ID NO: 5202701 - DNA, 17 bp, Homo sapiens
agctctaagtacctttc

SEQ ID NO: 5202702 - DNA, 16 bp, Homo sapiens
agctctaatagagtca

SEQ ID NO: 5202703 - DNA, 18 bp, Homo sapiens
agctctaatgtttgcata

SEQ ID NO: 5202704 - DNA, 17 bp, Homo sapiens
agctctacacaacatgt

SEQ ID NO: 5202705 - DNA, 21 bp, Homo sapiens
agctctacacaacatgtatgt

SEQ ID NO: 5202706 - DNA, 15 bp, Homo sapiens
agctctacaggcctg

SEQ ID NO: 5202707 - DNA, 14 bp, Homo sapiens
agctctacattctg

SEQ ID NO: 5202708 - DNA, 17 bp, Homo sapiens
agctctacattctgctc

SEQ ID NO: 5202709 - DNA, 22 bp, Homo sapiens
agctctacattctgctctgccc

SEQ ID NO: 5202710 - DNA, 23 bp, Homo sapiens
agctctacattctgctctgccca

SEQ ID NO: 5202711 - DNA, 13 bp, Homo sapiens
agctctacccagg

SEQ ID NO: 5202712 - DNA, 17 bp, Homo sapiens
agctctaccctgctccc

SEQ ID NO: 5202713 - DNA, 15 bp, Homo sapiens
agctctacgtcccac

SEQ ID NO: 5202714 - DNA, 19 bp, Homo sapiens
agctctactgccctcccct

SEQ ID NO: 5202715 - DNA, 20 bp, Homo sapiens
agctctactgccctcccctt

SEQ ID NO: 5202716 - DNA, 14 bp, Homo sapiens
agctctagaatctg

SEQ ID NO: 5202717 - DNA, 16 bp, Homo sapiens
agctctagacaaccct

SEQ ID NO: 5202718 - DNA, 17 bp, Homo sapiens
agctctagacaaccctg

SEQ ID NO: 5202719 - DNA, 20 bp, Homo sapiens
agctctagacaaccctgcaa

SEQ ID NO: 5202720 - DNA, 13 bp, Homo sapiens
agctctagataaa

SEQ ID NO: 5202721 - DNA, 18 bp, Homo sapiens
agctctagcaagggaggc

SEQ ID NO: 5202722 - DNA, 15 bp, Homo sapiens
agctctagcctctgg

SEQ ID NO: 5202723 - DNA, 16 bp, Homo sapiens
agctctagcctctgga

SEQ ID NO: 5202724 - DNA, 17 bp, Homo sapiens
agctctagcctctggac

SEQ ID NO: 5202725 - DNA, 18 bp, Homo sapiens
agctctagcctctggact

SEQ ID NO: 5202726 - DNA, 23 bp, Homo sapiens
agctctagtatttccacaaatag

SEQ ID NO: 5202727 - DNA, 16 bp, Homo sapiens
agctctataattgttt

SEQ ID NO: 5202728 - DNA, 21 bp, Homo sapiens
agctctatcccaacctctccc

SEQ ID NO: 5202729 - DNA, 16 bp, Homo sapiens
agctctatctgcaatg

SEQ ID NO: 5202730 - DNA, 17 bp, Homo sapiens
agctctatctgcaatgt

SEQ ID NO: 5202731 - DNA, 18 bp, Homo sapiens
agctctatctgcaatgtt

SEQ ID NO: 5202732 - DNA, 23 bp, Homo sapiens
agctctatgtcaattgatatttc

SEQ ID NO: 5202733 - DNA, 20 bp, Homo sapiens
agctctattaagatttccaa

SEQ ID NO: 5202734 - DNA, 16 bp, Homo sapiens
agctctattatgaatg

SEQ ID NO: 5202735 - DNA, 19 bp, Homo sapiens
agctctattatgaatgtga

SEQ ID NO: 5202736 - DNA, 15 bp, Homo sapiens
agctctcaaatgtga

SEQ ID NO: 5202737 - DNA, 12 bp, Homo sapiens
agctctcacaga

SEQ ID NO: 5202738 - DNA, 13 bp, Homo sapiens
agctctcactggc

SEQ ID NO: 5202739 - DNA, 20 bp, Homo sapiens
agctctcagcaagtgcccag

SEQ ID NO: 5202740 - DNA, 21 bp, Homo sapiens
agctctcaggaccgtgccctc

SEQ ID NO: 5202741 - DNA, 14 bp, Homo sapiens
agctctcaggccga

SEQ ID NO: 5202742 - DNA, 15 bp, Homo sapiens
agctctcatctgagg

SEQ ID NO: 5202743 - DNA, 15 bp, Homo sapiens
agctctccagaagcc

SEQ ID NO: 5202744 - DNA, 17 bp, Homo sapiens
agctctccagctccaag

SEQ ID NO: 5202745 - DNA, 12 bp, Homo sapiens
agctctccaggc

SEQ ID NO: 5202746 - DNA, 13 bp, Homo sapiens
agctctccaggcc

SEQ ID NO: 5202747 - DNA, 19 bp, Homo sapiens
agctctccagtcaggaggc

SEQ ID NO: 5202748 - DNA, 12 bp, Homo sapiens
agctctcccaca

SEQ ID NO: 5202749 - DNA, 19 bp, Homo sapiens
agctctcccacatcccact

SEQ ID NO: 5202750 - DNA, 12 bp, Homo sapiens
agctctcccagt

SEQ ID NO: 5202751 - DNA, 15 bp, Homo sapiens
agctctcccagtgaa

SEQ ID NO: 5202752 - DNA, 14 bp, Homo sapiens
agctctcccatgga

SEQ ID NO: 5202753 - DNA, 18 bp, Homo sapiens
agctctcccatggagccc

SEQ ID NO: 5202754 - DNA, 16 bp, Homo sapiens
agctctcccctcctgc

SEQ ID NO: 5202755 - DNA, 15 bp, Homo sapiens
agctctccctctggc

SEQ ID NO: 5202756 - DNA, 17 bp, Homo sapiens
agctctccgagctctgg

SEQ ID NO: 5202757 - DNA, 18 bp, Homo sapiens
agctctccggtctctctc

SEQ ID NO: 5202758 - DNA, 17 bp, Homo sapiens
agctctcctgactttta

SEQ ID NO: 5202759 - DNA, 12 bp, Homo sapiens
agctctcctggc

SEQ ID NO: 5202760 - DNA, 13 bp, Homo sapiens
agctctcctggct

SEQ ID NO: 5202761 - DNA, 20 bp, Homo sapiens
agctctcctggctccctccc

SEQ ID NO: 5202762 - DNA, 16 bp, Homo sapiens
agctctcctgggccag

SEQ ID NO: 5202763 - DNA, 22 bp, Homo sapiens
agctctcctgggccagggtctc

SEQ ID NO: 5202764 - DNA, 22 bp, Homo sapiens
agctctcgggactagctgcctt

SEQ ID NO: 5202765 - DNA, 18 bp, Homo sapiens
agctctcgttctccttcc

SEQ ID NO: 5202766 - DNA, 17 bp, Homo sapiens
agctctctaggcctctc

SEQ ID NO: 5202767 - DNA, 24 bp, Homo sapiens
agctctctcagacccttgaagatg

SEQ ID NO: 5202768 - DNA, 16 bp, Homo sapiens
agctctctcctccctt

SEQ ID NO: 5202769 - DNA, 13 bp, Homo sapiens
agctctctgacgc

SEQ ID NO: 5202770 - DNA, 19 bp, Homo sapiens
agctctctgctgagcagcc

SEQ ID NO: 5202771 - DNA, 15 bp, Homo sapiens
agctctctgctgggt

SEQ ID NO: 5202772 - DNA, 12 bp, Homo sapiens
agctctctggga

SEQ ID NO: 5202773 - DNA, 13 bp, Homo sapiens
agctctctgggcc

SEQ ID NO: 5202774 - DNA, 14 bp, Homo sapiens
agctctctgggcct

SEQ ID NO: 5202775 - DNA, 17 bp, Homo sapiens
agctctctgggcctggg

SEQ ID NO: 5202776 - DNA, 12 bp, Homo sapiens
agctctctgtat

SEQ ID NO: 5202777 - DNA, 18 bp, Homo sapiens
agctctctgtataaacat

SEQ ID NO: 5202778 - DNA, 19 bp, Homo sapiens
agctctcttcaatgacata

SEQ ID NO: 5202779 - DNA, 14 bp, Homo sapiens
agctctcttcctgt

SEQ ID NO: 5202780 - DNA, 15 bp, Homo sapiens
agctctcttctggct

SEQ ID NO: 5202781 - DNA, 20 bp, Homo sapiens
agctctcttctggctttctg

SEQ ID NO: 5202782 - DNA, 16 bp, Homo sapiens
agctctctttggaatg

SEQ ID NO: 5202783 - DNA, 15 bp, Homo sapiens
agctctgaaagagaa

SEQ ID NO: 5202784 - DNA, 16 bp, Homo sapiens
agctctgaaagagaaa

SEQ ID NO: 5202785 - DNA, 22 bp, Homo sapiens
agctctgaaagagaaacacgta

SEQ ID NO: 5202786 - DNA, 21 bp, Homo sapiens
agctctgaaatcaactctctt

SEQ ID NO: 5202787 - DNA, 16 bp, Homo sapiens
agctctgaagggaggg

SEQ ID NO: 5202788 - DNA, 18 bp, Homo sapiens
agctctgaagggagggga

SEQ ID NO: 5202789 - DNA, 22 bp, Homo sapiens
agctctgaagggaggggaagag

SEQ ID NO: 5202790 - DNA, 22 bp, Homo sapiens
agctctgaattcaggtcccagt

SEQ ID NO: 5202791 - DNA, 16 bp, Homo sapiens
agctctgacatccctt

SEQ ID NO: 5202792 - DNA, 20 bp, Homo sapiens
agctctgacattctgattcg

SEQ ID NO: 5202793 - DNA, 21 bp, Homo sapiens
agctctgaccacttgaggcct

SEQ ID NO: 5202794 - DNA, 14 bp, Homo sapiens
agctctgacccaca

SEQ ID NO: 5202795 - DNA, 15 bp, Homo sapiens
agctctgaccctgat

SEQ ID NO: 5202796 - DNA, 15 bp, Homo sapiens
agctctgacccttgg

SEQ ID NO: 5202797 - DNA, 16 bp, Homo sapiens
agctctgacccttggg

SEQ ID NO: 5202798 - DNA, 19 bp, Homo sapiens
agctctgacccttgggcct

SEQ ID NO: 5202799 - DNA, 21 bp, Homo sapiens
agctctgacctgcccccgctc

SEQ ID NO: 5202800 - DNA, 23 bp, Homo sapiens
agctctgagacccttttctcagg

SEQ ID NO: 5202801 - DNA, 13 bp, Homo sapiens
agctctgagaggc

SEQ ID NO: 5202802 - DNA, 16 bp, Homo sapiens
agctctgagaggccct

SEQ ID NO: 5202803 - DNA, 20 bp, Homo sapiens
agctctgagaggccctggat

SEQ ID NO: 5202804 - DNA, 23 bp, Homo sapiens
agctctgagaggccctggatcag

SEQ ID NO: 5202805 - DNA, 15 bp, Homo sapiens
agctctgagccagat

SEQ ID NO: 5202806 - DNA, 13 bp, Homo sapiens
agctctgagccct

SEQ ID NO: 5202807 - DNA, 15 bp, Homo sapiens
agctctgagctgtca

SEQ ID NO: 5202808 - DNA, 12 bp, Homo sapiens
agctctgaggga

SEQ ID NO: 5202809 - DNA, 23 bp, Homo sapiens
agctctgagttccggcaccagta

SEQ ID NO: 5202810 - DNA, 23 bp, Homo sapiens
agctctgatctgaggctaagaca

SEQ ID NO: 5202811 - DNA, 21 bp, Homo sapiens
agctctgcagagcaggaaaca

SEQ ID NO: 5202812 - DNA, 16 bp, Homo sapiens
agctctgcagcccagg

SEQ ID NO: 5202813 - DNA, 18 bp, Homo sapiens
agctctgcataagattat

SEQ ID NO: 5202814 - DNA, 22 bp, Homo sapiens
agctctgcataagattatatac

SEQ ID NO: 5202815 - DNA, 16 bp, Homo sapiens
agctctgcatctcctg

SEQ ID NO: 5202816 - DNA, 13 bp, Homo sapiens
agctctgcatgtg

SEQ ID NO: 5202817 - DNA, 13 bp, Homo sapiens
agctctgcccccg

SEQ ID NO: 5202818 - DNA, 14 bp, Homo sapiens
agctctgcccccgc

SEQ ID NO: 5202819 - DNA, 16 bp, Homo sapiens
agctctgccccttccc

SEQ ID NO: 5202820 - DNA, 18 bp, Homo sapiens
agctctgccctggaacct

SEQ ID NO: 5202821 - DNA, 18 bp, Homo sapiens
agctctgccctggctgtg

SEQ ID NO: 5202822 - DNA, 17 bp, Homo sapiens
agctctgccgtctctgg

SEQ ID NO: 5202823 - DNA, 15 bp, Homo sapiens
aggaggccacctctc

SEQ ID NO: 5202824 - DNA, 16 bp, Homo sapiens
aggaggccacctctcc

SEQ ID NO: 5202825 - DNA, 18 bp, Homo sapiens
aggaggccacctctccaa

SEQ ID NO: 5202826 - DNA, 23 bp, Homo sapiens
aggaggccacctctccaagggct

SEQ ID NO: 5202827 - DNA, 15 bp, Homo sapiens
aggaggccagccttg

SEQ ID NO: 5202828 - DNA, 13 bp, Homo sapiens
aggaggccaggcc

SEQ ID NO: 5202829 - DNA, 16 bp, Homo sapiens
aggaggccaggccacc

SEQ ID NO: 5202830 - DNA, 22 bp, Homo sapiens
aggaggccaggccggcgagccc

SEQ ID NO: 5202831 - DNA, 14 bp, Homo sapiens
aggaggccatgccc

SEQ ID NO: 5202832 - DNA, 13 bp, Homo sapiens
aggaggcccactg

SEQ ID NO: 5202833 - DNA, 16 bp, Homo sapiens
aggaggccccctcctc

SEQ ID NO: 5202834 - DNA, 17 bp, Homo sapiens
aggaggcccctggccca

SEQ ID NO: 5202835 - DNA, 22 bp, Homo sapiens
aggaggccctggtgtcaggcag

SEQ ID NO: 5202836 - DNA, 19 bp, Homo sapiens
aggaggccctgttccctgg

SEQ ID NO: 5202837 - DNA, 20 bp, Homo sapiens
aggaggccgagtggctgccg

SEQ ID NO: 5202838 - DNA, 16 bp, Homo sapiens
aggaggccggggccgg

SEQ ID NO: 5202839 - DNA, 19 bp, Homo sapiens
aggaggcctcaaagcaacc

SEQ ID NO: 5202840 - DNA, 15 bp, Homo sapiens
aggaggcctccatct

SEQ ID NO: 5202841 - DNA, 11 bp, Homo sapiens
aggaggcctgg

SEQ ID NO: 5202842 - DNA, 14 bp, Homo sapiens
aggaggcctggacc

SEQ ID NO: 5202843 - DNA, 22 bp, Homo sapiens
aggaggcctggaccgagatgtg

SEQ ID NO: 5202844 - DNA, 24 bp, Homo sapiens
aggaggcctggaccgagatgtgag

SEQ ID NO: 5202845 - DNA, 13 bp, Homo sapiens
aggaggcctggcc

SEQ ID NO: 5202846 - DNA, 15 bp, Homo sapiens
aggaggcctggcctt

SEQ ID NO: 5202847 - DNA, 14 bp, Homo sapiens
aggaggcctgggag

SEQ ID NO: 5202848 - DNA, 18 bp, Homo sapiens
aggaggcctgggagggca

SEQ ID NO: 5202849 - DNA, 21 bp, Homo sapiens
aggaggcctgggccgcccaga

SEQ ID NO: 5202850 - DNA, 15 bp, Homo sapiens
aggaggcctgtccca

SEQ ID NO: 5202851 - DNA, 16 bp, Homo sapiens
aggaggcgcagcccga

SEQ ID NO: 5202852 - DNA, 17 bp, Homo sapiens
aggaggcgcagcccgaa

SEQ ID NO: 5202853 - DNA, 13 bp, Homo sapiens
aggaggcgcggcc

SEQ ID NO: 5202854 - DNA, 20 bp, Homo sapiens
aggaggcggaggttgcagtg

SEQ ID NO: 5202855 - DNA, 12 bp, Homo sapiens
aggaggcggggc

SEQ ID NO: 5202856 - DNA, 19 bp, Homo sapiens
aggaggcggggctctagga

SEQ ID NO: 5202857 - DNA, 21 bp, Homo sapiens
aggaggctatgctcaggggcc

SEQ ID NO: 5202858 - DNA, 21 bp, Homo sapiens
aggaggctcaggtgatctgtt

SEQ ID NO: 5202859 - DNA, 17 bp, Homo sapiens
aggaggctccagagggc

SEQ ID NO: 5202860 - DNA, 18 bp, Homo sapiens
aggaggctccagagggca

SEQ ID NO: 5202861 - DNA, 23 bp, Homo sapiens
aggaggctccatccttctcccca

SEQ ID NO: 5202862 - DNA, 12 bp, Homo sapiens
aggaggctccca

SEQ ID NO: 5202863 - DNA, 14 bp, Homo sapiens
aggaggctgaggca

SEQ ID NO: 5202864 - DNA, 17 bp, Homo sapiens
aggaggctgaggcagga

SEQ ID NO: 5202865 - DNA, 18 bp, Homo sapiens
aggaggctgaggcaggag

SEQ ID NO: 5202866 - DNA, 13 bp, Homo sapiens
aggaggctgaggt

SEQ ID NO: 5202867 - DNA, 23 bp, Homo sapiens
aggaggctgccctgaggggctgg

SEQ ID NO: 5202868 - DNA, 18 bp, Homo sapiens
aggaggctgccggaggga

SEQ ID NO: 5202869 - DNA, 12 bp, Homo sapiens
aggaggctggag

SEQ ID NO: 5202870 - DNA, 16 bp, Homo sapiens
aggaggctggcaggta

SEQ ID NO: 5202871 - DNA, 17 bp, Homo sapiens
aggaggctttctgggct

SEQ ID NO: 5202872 - DNA, 20 bp, Homo sapiens
aggaggctttctgggctctg

SEQ ID NO: 5202873 - DNA, 21 bp, Homo sapiens
aggagggaaagttccagcagt

SEQ ID NO: 5202874 - DNA, 15 bp, Homo sapiens
aggagggaaggagct

SEQ ID NO: 5202875 - DNA, 14 bp, Homo sapiens
aggagggacaagaa

SEQ ID NO: 5202876 - DNA, 23 bp, Homo sapiens
aggagggactctgtctggccagg

SEQ ID NO: 5202877 - DNA, 19 bp, Homo sapiens
aggagggactgtcgctgct

SEQ ID NO: 5202878 - DNA, 14 bp, Homo sapiens
aggagggacttggc

SEQ ID NO: 5202879 - DNA, 15 bp, Homo sapiens
aggagggacttggct

SEQ ID NO: 5202880 - DNA, 16 bp, Homo sapiens
aggagggagaagagaa

SEQ ID NO: 5202881 - DNA, 23 bp, Homo sapiens
aggagggagacactggcccctca

SEQ ID NO: 5202882 - DNA, 14 bp, Homo sapiens
aggagggagagccc

SEQ ID NO: 5202883 - DNA, 13 bp, Homo sapiens
aggagggagaggg

SEQ ID NO: 5202884 - DNA, 20 bp, Homo sapiens
aggagggagagtctcccagg

SEQ ID NO: 5202885 - DNA, 16 bp, Homo sapiens
aggagggagccttgtg

SEQ ID NO: 5202886 - DNA, 14 bp, Homo sapiens
aggagggagctgct

SEQ ID NO: 5202887 - DNA, 12 bp, Homo sapiens
aggagggaggcg

SEQ ID NO: 5202888 - DNA, 14 bp, Homo sapiens
aggagggaggcggg

SEQ ID NO: 5202889 - DNA, 15 bp, Homo sapiens
aggagggagggggct

SEQ ID NO: 5202890 - DNA, 15 bp, Homo sapiens
aggagggaggtgctt

SEQ ID NO: 5202891 - DNA, 16 bp, Homo sapiens
aggagggatgtgggta

SEQ ID NO: 5202892 - DNA, 20 bp, Homo sapiens
aggagggcaagggccatgct

SEQ ID NO: 5202893 - DNA, 15 bp, Homo sapiens
aggagggcacagcag

SEQ ID NO: 5202894 - DNA, 14 bp, Homo sapiens
aggagggcagcccg

SEQ ID NO: 5202895 - DNA, 12 bp, Homo sapiens
aggagggcaggc

SEQ ID NO: 5202896 - DNA, 21 bp, Homo sapiens
aggagggcaggctgaggtggg

SEQ ID NO: 5202897 - DNA, 14 bp, Homo sapiens
aggagggcatccat

SEQ ID NO: 5202898 - DNA, 17 bp, Homo sapiens
aggagggccctgaggaa

SEQ ID NO: 5202899 - DNA, 18 bp, Homo sapiens
aggagggccctgaggaat

SEQ ID NO: 5202900 - DNA, 16 bp, Homo sapiens
aggagggcctcagaga

SEQ ID NO: 5202901 - DNA, 18 bp, Homo sapiens
aggagggcctcagagaca

SEQ ID NO: 5202902 - DNA, 19 bp, Homo sapiens
aggagggcctcagagacag

SEQ ID NO: 5202903 - DNA, 14 bp, Homo sapiens
aggagggcgcccat

SEQ ID NO: 5202904 - DNA, 17 bp, Homo sapiens
aggagggcttgagagct

SEQ ID NO: 5202905 - DNA, 23 bp, Homo sapiens
aggagggctttgaatctgggact

SEQ ID NO: 5202906 - DNA, 14 bp, Homo sapiens
aggagggctttgtg

SEQ ID NO: 5202907 - DNA, 17 bp, Homo sapiens
aggaggggaaaaaaatg

SEQ ID NO: 5202908 - DNA, 19 bp, Homo sapiens
aggaggggaaaaaaatgtt

SEQ ID NO: 5202909 - DNA, 20 bp, Homo sapiens
aggaggggaacactgccctc

SEQ ID NO: 5202910 - DNA, 15 bp, Homo sapiens
aggaggggaagaggc

SEQ ID NO: 5202911 - DNA, 15 bp, Homo sapiens
aggaggggaagctgg

SEQ ID NO: 5202912 - DNA, 17 bp, Homo sapiens
aggaggggaagctgggc

SEQ ID NO: 5202913 - DNA, 17 bp, Homo sapiens
aggaggggaaggggctg

SEQ ID NO: 5202914 - DNA, 19 bp, Homo sapiens
aggaggggaaggggctgag

SEQ ID NO: 5202915 - DNA, 20 bp, Homo sapiens
aggaggggaaggggctgagg

SEQ ID NO: 5202916 - DNA, 20 bp, Homo sapiens
aggaggggacgggacagacg

SEQ ID NO: 5202917 - DNA, 21 bp, Homo sapiens
aggaggggagagacaggcagc

SEQ ID NO: 5202918 - DNA, 19 bp, Homo sapiens
aggaggggagcaaggctgc

SEQ ID NO: 5202919 - DNA, 19 bp, Homo sapiens
aggaggggagcgtctggga

SEQ ID NO: 5202920 - DNA, 14 bp, Homo sapiens
aggaggggagggta

SEQ ID NO: 5202921 - DNA, 17 bp, Homo sapiens
aggaggggatagagaga

SEQ ID NO: 5202922 - DNA, 14 bp, Homo sapiens
aggaggggcacctg

SEQ ID NO: 5202923 - DNA, 13 bp, Homo sapiens
aggaggggccgct

SEQ ID NO: 5202924 - DNA, 12 bp, Homo sapiens
aggaggggcctc

SEQ ID NO: 5202925 - DNA, 14 bp, Homo sapiens
aggaggggcctggg

SEQ ID NO: 5202926 - DNA, 20 bp, Homo sapiens
aggaggggcctgggcagccc

SEQ ID NO: 5202927 - DNA, 19 bp, Homo sapiens
aggaggggctgcagcagag

SEQ ID NO: 5202928 - DNA, 14 bp, Homo sapiens
aggagggggagggt

SEQ ID NO: 5202929 - DNA, 16 bp, Homo sapiens
aggagggggcccggct

SEQ ID NO: 5202930 - DNA, 17 bp, Homo sapiens
aggagggggcccggctg

SEQ ID NO: 5202931 - DNA, 17 bp, Homo sapiens
aggagggggcctcattg

SEQ ID NO: 5202932 - DNA, 21 bp, Homo sapiens
aggaggggggagggaagggag

SEQ ID NO: 5202933 - DNA, 23 bp, Homo sapiens
aggaggggggagggaagggagcc

SEQ ID NO: 5202934 - DNA, 17 bp, Homo sapiens
aggaggggtaaatatat

SEQ ID NO: 5202935 - DNA, 22 bp, Homo sapiens
aggaggggtgagtcccctactc

SEQ ID NO: 5202936 - DNA, 13 bp, Homo sapiens
aggaggggtgtgg

SEQ ID NO: 5202937 - DNA, 17 bp, Homo sapiens
aggagggtaacagaaga

SEQ ID NO: 5202938 - DNA, 15 bp, Homo sapiens
aggagggtacagctg

SEQ ID NO: 5202939 - DNA, 18 bp, Homo sapiens
aggagggtacagctgggc

SEQ ID NO: 5202940 - DNA, 19 bp, Homo sapiens
aggagggtacagctgggct

SEQ ID NO: 5202941 - DNA, 21 bp, Homo sapiens
aggagggtcggtgccttcaag

SEQ ID NO: 5202942 - DNA, 21 bp, Homo sapiens
aggagggtctccacactgctg

SEQ ID NO: 5202943 - DNA, 18 bp, Homo sapiens
aggagggtgacgcccagc

SEQ ID NO: 5202944 - DNA, 17 bp, Homo sapiens
aggagggtgcccctggg

SEQ ID NO: 5202945 - DNA, 19 bp, Homo sapiens
aggagggtgcccctgggaa

SEQ ID NO: 5202946 - DNA, 15 bp, Homo sapiens
aggagggtggaggaa

SEQ ID NO: 5202947 - DNA, 16 bp, Homo sapiens
aggagggtggaggaag

SEQ ID NO: 5202948 - DNA, 16 bp, Homo sapiens
aggagggtgtaatgga

SEQ ID NO: 5202949 - DNA, 18 bp, Homo sapiens
aggagggttagggagggg

SEQ ID NO: 5202950 - DNA, 15 bp, Homo sapiens
aggagggttggagtg

SEQ ID NO: 5202951 - DNA, 22 bp, Homo sapiens
aggagggttgggcgtgctacct

SEQ ID NO: 5202952 - DNA, 16 bp, Homo sapiens
aggagggtttgggcag

SEQ ID NO: 5202953 - DNA, 19 bp, Homo sapiens
aggagggtttgggcagagc

SEQ ID NO: 5202954 - DNA, 15 bp, Homo sapiens
aggaggtcaagcctg

SEQ ID NO: 5202955 - DNA, 18 bp, Homo sapiens
aggaggtcacctgccgcc

SEQ ID NO: 5202956 - DNA, 21 bp, Homo sapiens
aggaggtcacctgccgccctg

SEQ ID NO: 5202957 - DNA, 17 bp, Homo sapiens
aggaggtcatctgacct

SEQ ID NO: 5202958 - DNA, 15 bp, Homo sapiens
aggaggtcccaggaa

SEQ ID NO: 5202959 - DNA, 23 bp, Homo sapiens
aggaggtccttaggcctctgaga

SEQ ID NO: 5202960 - DNA, 17 bp, Homo sapiens
aggaggtccttggagtg

SEQ ID NO: 5202961 - DNA, 19 bp, Homo sapiens
aggaggtcgtttatgtgtg

SEQ ID NO: 5202962 - DNA, 23 bp, Homo sapiens
aggaggtcgtttatgtgtgcaga

SEQ ID NO: 5202963 - DNA, 14 bp, Homo sapiens
aggaggtgagggat

SEQ ID NO: 5202964 - DNA, 14 bp, Homo sapiens
aggaggtgcctgga

SEQ ID NO: 5202965 - DNA, 20 bp, Homo sapiens
aggaggtgcttgaggccccg

SEQ ID NO: 5202966 - DNA, 13 bp, Homo sapiens
aggaggtggacat

SEQ ID NO: 5202967 - DNA, 14 bp, Homo sapiens
aggaggtggagaaa

SEQ ID NO: 5202968 - DNA, 13 bp, Homo sapiens
aggaggtggaggt

SEQ ID NO: 5202969 - DNA, 20 bp, Homo sapiens
aggaggtggaggttacagtg

SEQ ID NO: 5202970 - DNA, 14 bp, Homo sapiens
aggaggtggcagcc

SEQ ID NO: 5202971 - DNA, 20 bp, Homo sapiens
aggaggtggcagccctgtag

SEQ ID NO: 5202972 - DNA, 21 bp, Homo sapiens
aggaggtggcagccctgtagg

SEQ ID NO: 5202973 - DNA, 15 bp, Homo sapiens
aggaggtggcttcat

SEQ ID NO: 5202974 - DNA, 21 bp, Homo sapiens
aggaggtgtctcaggctgcct

SEQ ID NO: 5202975 - DNA, 22 bp, Homo sapiens
aggaggtgtctggggtgaggga

SEQ ID NO: 5202976 - DNA, 20 bp, Homo sapiens
aggaggtgtgatagagcctt

SEQ ID NO: 5202977 - DNA, 16 bp, Homo sapiens
aggaggtgtggagtgg

SEQ ID NO: 5202978 - DNA, 18 bp, Homo sapiens
aggaggtgtggagtggag

SEQ ID NO: 5202979 - DNA, 18 bp, Homo sapiens
aggaggttctgggcctct

SEQ ID NO: 5202980 - DNA, 16 bp, Homo sapiens
aggaggttgaggctgc

SEQ ID NO: 5202981 - DNA, 20 bp, Homo sapiens
aggaggttgaggctgcagtg

SEQ ID NO: 5202982 - DNA, 17 bp, Homo sapiens
aggaggttggtgactga

SEQ ID NO: 5202983 - DNA, 18 bp, Homo sapiens
aggaggttgtggatgctc

SEQ ID NO: 5202984 - DNA, 21 bp, Homo sapiens
aggaggttgtggatgctccag

SEQ ID NO: 5202985 - DNA, 24 bp, Homo sapiens
aggaggttgtgtcactgactcagg

SEQ ID NO: 5202986 - DNA, 18 bp, Homo sapiens
aggaggtttaggtcaaga

SEQ ID NO: 5202987 - DNA, 14 bp, Homo sapiens
aggaggtttggatg

SEQ ID NO: 5202988 - DNA, 23 bp, Homo sapiens
aggaggtttggggtctgccacca

SEQ ID NO: 5202989 - DNA, 14 bp, Homo sapiens
aggaggtttgtata

SEQ ID NO: 5202990 - DNA, 11 bp, Homo sapiens
aggagtaacaa

SEQ ID NO: 5202991 - DNA, 17 bp, Homo sapiens
aggagtaagacaagtgg

SEQ ID NO: 5202992 - DNA, 17 bp, Homo sapiens
aggagtaagtgtacaat

SEQ ID NO: 5202993 - DNA, 20 bp, Homo sapiens
aggagtaatctgtgtacaaa

SEQ ID NO: 5202994 - DNA, 23 bp, Homo sapiens
aggagtagaatataaacacataa

SEQ ID NO: 5202995 - DNA, 13 bp, Homo sapiens
aggagtagctgag

SEQ ID NO: 5202996 - DNA, 18 bp, Homo sapiens
aggagtagctgagaggaa

SEQ ID NO: 5202997 - DNA, 16 bp, Homo sapiens
aggagtagctgagctc

SEQ ID NO: 5202998 - DNA, 15 bp, Homo sapiens
aggagtagtattttg

SEQ ID NO: 5202999 - DNA, 12 bp, Homo sapiens
aggagtattttg

SEQ ID NO: 5203000 - DNA, 13 bp, Homo sapiens
aggagtatttttg

SEQ ID NO: 5203001 - DNA, 16 bp, Homo sapiens
aggagtcaactggctg

SEQ ID NO: 5203002 - DNA, 23 bp, Homo sapiens
aggagtcaagtaatggaggtccc

SEQ ID NO: 5203003 - DNA, 14 bp, Homo sapiens
agctctgcgccagg

SEQ ID NO: 5203004 - DNA, 20 bp, Homo sapiens
agctctgcgccaggcagagc

SEQ ID NO: 5203005 - DNA, 21 bp, Homo sapiens
agctctgcgccaggcagagct

SEQ ID NO: 5203006 - DNA, 12 bp, Homo sapiens
agctctgctgct

SEQ ID NO: 5203007 - DNA, 13 bp, Homo sapiens
agctctgctggaa

SEQ ID NO: 5203008 - DNA, 12 bp, Homo sapiens
agctctgcttgc

SEQ ID NO: 5203009 - DNA, 19 bp, Homo sapiens
agctctggaattgttgaat

SEQ ID NO: 5203010 - DNA, 22 bp, Homo sapiens
agctctggaattgttgaatgta

SEQ ID NO: 5203011 - DNA, 18 bp, Homo sapiens
agctctggacagccccac

SEQ ID NO: 5203012 - DNA, 15 bp, Homo sapiens
agctctggaccagcc

SEQ ID NO: 5203013 - DNA, 16 bp, Homo sapiens
agctctggacgtgaaa

SEQ ID NO: 5203014 - DNA, 20 bp, Homo sapiens
agctctggacgtgaaatact

SEQ ID NO: 5203015 - DNA, 12 bp, Homo sapiens
agctctggagaa

SEQ ID NO: 5203016 - DNA, 17 bp, Homo sapiens
agctctggagcaagccc

SEQ ID NO: 5203017 - DNA, 22 bp, Homo sapiens
agctctggagcaagccctgacc

SEQ ID NO: 5203018 - DNA, 16 bp, Homo sapiens
agctctggagccacct

SEQ ID NO: 5203019 - DNA, 17 bp, Homo sapiens
agctctggagccacctg

SEQ ID NO: 5203020 - DNA, 12 bp, Homo sapiens
agctctggccac

SEQ ID NO: 5203021 - DNA, 22 bp, Homo sapiens
agctctggccccaggcttgtca

SEQ ID NO: 5203022 - DNA, 20 bp, Homo sapiens
agctctggctcacagactgg

SEQ ID NO: 5203023 - DNA, 23 bp, Homo sapiens
agctctggctctgcctcaggagg

SEQ ID NO: 5203024 - DNA, 12 bp, Homo sapiens
agctctggctga

SEQ ID NO: 5203025 - DNA, 20 bp, Homo sapiens
agctctggctgaaccctgtg

SEQ ID NO: 5203026 - DNA, 12 bp, Homo sapiens
agctctgggcct

SEQ ID NO: 5203027 - DNA, 13 bp, Homo sapiens
agctctgggcctc

SEQ ID NO: 5203028 - DNA, 23 bp, Homo sapiens
agctctgggcctctttttgccct

SEQ ID NO: 5203029 - DNA, 18 bp, Homo sapiens
agctctggggcagaggaa

SEQ ID NO: 5203030 - DNA, 11 bp, Homo sapiens
agctctggggg

SEQ ID NO: 5203031 - DNA, 18 bp, Homo sapiens
agctctggggggcagttg

SEQ ID NO: 5203032 - DNA, 17 bp, Homo sapiens
agctctggtccatagag

SEQ ID NO: 5203033 - DNA, 17 bp, Homo sapiens
agctctggtgacaccag

SEQ ID NO: 5203034 - DNA, 23 bp, Homo sapiens
agctctggtgagtcttggcggca

SEQ ID NO: 5203035 - DNA, 19 bp, Homo sapiens
agctctggtgggaggcccg

SEQ ID NO: 5203036 - DNA, 15 bp, Homo sapiens
agctctgtaacttac

SEQ ID NO: 5203037 - DNA, 16 bp, Homo sapiens
agctctgtagcctggt

SEQ ID NO: 5203038 - DNA, 19 bp, Homo sapiens
agctctgtagcctggtctg

SEQ ID NO: 5203039 - DNA, 21 bp, Homo sapiens
agctctgtagcctggtctgtg

SEQ ID NO: 5203040 - DNA, 13 bp, Homo sapiens
agctctgtagttt

SEQ ID NO: 5203041 - DNA, 12 bp, Homo sapiens
agctctgtatca

SEQ ID NO: 5203042 - DNA, 23 bp, Homo sapiens
agctctgtatcaggacccagagg

SEQ ID NO: 5203043 - DNA, 19 bp, Homo sapiens
agctctgtatggtcaggat

SEQ ID NO: 5203044 - DNA, 16 bp, Homo sapiens
agctctgtcaccctgg

SEQ ID NO: 5203045 - DNA, 21 bp, Homo sapiens
agctctgtcctgggagtgagc

SEQ ID NO: 5203046 - DNA, 21 bp, Homo sapiens
agctctgtcctgttaggccaa

SEQ ID NO: 5203047 - DNA, 13 bp, Homo sapiens
agctctgtctgct

SEQ ID NO: 5203048 - DNA, 13 bp, Homo sapiens
agctctgtggcct

SEQ ID NO: 5203049 - DNA, 20 bp, Homo sapiens
agctctgtggcctgtgtcca

SEQ ID NO: 5203050 - DNA, 22 bp, Homo sapiens
agctctgtgggaaaaaagaaaa

SEQ ID NO: 5203051 - DNA, 14 bp, Homo sapiens
agctctgtgggccc

SEQ ID NO: 5203052 - DNA, 20 bp, Homo sapiens
agctctgtgggtctctggaa

SEQ ID NO: 5203053 - DNA, 23 bp, Homo sapiens
agctctgtgttgccatgtgtgct

SEQ ID NO: 5203054 - DNA, 18 bp, Homo sapiens
agctctgttcttcctcag

SEQ ID NO: 5203055 - DNA, 21 bp, Homo sapiens
agctctgttcttcctcagcca

SEQ ID NO: 5203056 - DNA, 12 bp, Homo sapiens
agctctgttgaa

SEQ ID NO: 5203057 - DNA, 17 bp, Homo sapiens
agctctgtttataaaaa

SEQ ID NO: 5203058 - DNA, 19 bp, Homo sapiens
agctctgtttataaaaaca

SEQ ID NO: 5203059 - DNA, 19 bp, Homo sapiens
agctcttaaaaagacactt

SEQ ID NO: 5203060 - DNA, 16 bp, Homo sapiens
agctcttaactacagt

SEQ ID NO: 5203061 - DNA, 17 bp, Homo sapiens
agctcttaccaaaacag

SEQ ID NO: 5203062 - DNA, 19 bp, Homo sapiens
agctcttactctttcctat

SEQ ID NO: 5203063 - DNA, 21 bp, Homo sapiens
agctcttagtcctccctgctc

SEQ ID NO: 5203064 - DNA, 22 bp, Homo sapiens
agctcttagtcctccctgctca

SEQ ID NO: 5203065 - DNA, 18 bp, Homo sapiens
agctcttcacaccattca

SEQ ID NO: 5203066 - DNA, 15 bp, Homo sapiens
agctcttcacttcct

SEQ ID NO: 5203067 - DNA, 16 bp, Homo sapiens
agctcttcacttcctc

SEQ ID NO: 5203068 - DNA, 13 bp, Homo sapiens
agctcttcaggcc

SEQ ID NO: 5203069 - DNA, 18 bp, Homo sapiens
agctcttcatctgcccaa

SEQ ID NO: 5203070 - DNA, 19 bp, Homo sapiens
agctcttcatctgcccaac

SEQ ID NO: 5203071 - DNA, 14 bp, Homo sapiens
agctcttcattcca

SEQ ID NO: 5203072 - DNA, 20 bp, Homo sapiens
agctcttcattccattgact

SEQ ID NO: 5203073 - DNA, 14 bp, Homo sapiens
agctcttcatttct

SEQ ID NO: 5203074 - DNA, 23 bp, Homo sapiens
agctcttccatttcgtttagctg

SEQ ID NO: 5203075 - DNA, 21 bp, Homo sapiens
agctcttccccatctcactct

SEQ ID NO: 5203076 - DNA, 22 bp, Homo sapiens
agctcttccccatctcactctt

SEQ ID NO: 5203077 - DNA, 11 bp, Homo sapiens
agctcttccct

SEQ ID NO: 5203078 - DNA, 13 bp, Homo sapiens
agctcttccctta

SEQ ID NO: 5203079 - DNA, 14 bp, Homo sapiens
agctcttcccttgc

SEQ ID NO: 5203080 - DNA, 18 bp, Homo sapiens
agctcttcccttgctcat

SEQ ID NO: 5203081 - DNA, 19 bp, Homo sapiens
agctcttcccttgctcatg

SEQ ID NO: 5203082 - DNA, 22 bp, Homo sapiens
agctcttcccttgctcatgagc

SEQ ID NO: 5203083 - DNA, 22 bp, Homo sapiens
agctcttcctatccctctccta

SEQ ID NO: 5203084 - DNA, 12 bp, Homo sapiens
agctcttcctgg

SEQ ID NO: 5203085 - DNA, 20 bp, Homo sapiens
agctcttcctggacaggcca

SEQ ID NO: 5203086 - DNA, 22 bp, Homo sapiens
agctcttcctggacaggccagg

SEQ ID NO: 5203087 - DNA, 19 bp, Homo sapiens
agctcttcggtttctgagc

SEQ ID NO: 5203088 - DNA, 20 bp, Homo sapiens
agctcttcggtttctgagca

SEQ ID NO: 5203089 - DNA, 14 bp, Homo sapiens
agctcttctaagga

SEQ ID NO: 5203090 - DNA, 12 bp, Homo sapiens
agctcttctatt

SEQ ID NO: 5203091 - DNA, 22 bp, Homo sapiens
agctcttctatttaaaaaataa

SEQ ID NO: 5203092 - DNA, 14 bp, Homo sapiens
agctcttctcagtg

SEQ ID NO: 5203093 - DNA, 16 bp, Homo sapiens
agctcttctccaggct

SEQ ID NO: 5203094 - DNA, 17 bp, Homo sapiens
agctcttctccccaggt

SEQ ID NO: 5203095 - DNA, 14 bp, Homo sapiens
agctcttctcctca

SEQ ID NO: 5203096 - DNA, 18 bp, Homo sapiens
agctcttctcctcagctt

SEQ ID NO: 5203097 - DNA, 15 bp, Homo sapiens
agctcttctcttcct

SEQ ID NO: 5203098 - DNA, 17 bp, Homo sapiens
agctcttctcttcctag

SEQ ID NO: 5203099 - DNA, 16 bp, Homo sapiens
agctcttctggagttt

SEQ ID NO: 5203100 - DNA, 20 bp, Homo sapiens
agctcttctggagtttctct

SEQ ID NO: 5203101 - DNA, 22 bp, Homo sapiens
agctcttctggagtttctctaa

SEQ ID NO: 5203102 - DNA, 12 bp, Homo sapiens
agctcttctggg

SEQ ID NO: 5203103 - DNA, 13 bp, Homo sapiens
agctcttctgggc

SEQ ID NO: 5203104 - DNA, 21 bp, Homo sapiens
agctcttctgggcagagcctg

SEQ ID NO: 5203105 - DNA, 22 bp, Homo sapiens
agctcttctgggcagagcctgt

SEQ ID NO: 5203106 - DNA, 21 bp, Homo sapiens
agctcttctgtgccctggctc

SEQ ID NO: 5203107 - DNA, 16 bp, Homo sapiens
agctcttcttcccagc

SEQ ID NO: 5203108 - DNA, 21 bp, Homo sapiens
agctcttgccccactccctgg

SEQ ID NO: 5203109 - DNA, 14 bp, Homo sapiens
agctcttgcccttc

SEQ ID NO: 5203110 - DNA, 15 bp, Homo sapiens
agctcttgctaatca

SEQ ID NO: 5203111 - DNA, 18 bp, Homo sapiens
agctcttgctatctctca

SEQ ID NO: 5203112 - DNA, 19 bp, Homo sapiens
agctcttgctctcttgtga

SEQ ID NO: 5203113 - DNA, 12 bp, Homo sapiens
agctcttggaag

SEQ ID NO: 5203114 - DNA, 20 bp, Homo sapiens
agctcttggacaacagctct

SEQ ID NO: 5203115 - DNA, 13 bp, Homo sapiens
agctcttggcccg

SEQ ID NO: 5203116 - DNA, 16 bp, Homo sapiens
agctcttggctccact

SEQ ID NO: 5203117 - DNA, 14 bp, Homo sapiens
agctcttgggtcag

SEQ ID NO: 5203118 - DNA, 23 bp, Homo sapiens
agctcttgtgaatattgtggctc

SEQ ID NO: 5203119 - DNA, 17 bp, Homo sapiens
agctcttgtgaggaaag

SEQ ID NO: 5203120 - DNA, 21 bp, Homo sapiens
agctcttgtgaggaaagtcat

SEQ ID NO: 5203121 - DNA, 20 bp, Homo sapiens
agctcttgtgttcagaagaa

SEQ ID NO: 5203122 - DNA, 21 bp, Homo sapiens
agctcttgttccgtgccaggc

SEQ ID NO: 5203123 - DNA, 14 bp, Homo sapiens
agctcttgtttctg

SEQ ID NO: 5203124 - DNA, 12 bp, Homo sapiens
agctctttaaca

SEQ ID NO: 5203125 - DNA, 15 bp, Homo sapiens
agctctttccaaatt

SEQ ID NO: 5203126 - DNA, 16 bp, Homo sapiens
agctctttgtcaggga

SEQ ID NO: 5203127 - DNA, 19 bp, Homo sapiens
agctctttgtctcaccagc

SEQ ID NO: 5203128 - DNA, 15 bp, Homo sapiens
agctctttgttcagt

SEQ ID NO: 5203129 - DNA, 18 bp, Homo sapiens
agctcttttctcctgcag

SEQ ID NO: 5203130 - DNA, 19 bp, Homo sapiens
agctgaaaaaactatattt

SEQ ID NO: 5203131 - DNA, 16 bp, Homo sapiens
agctgaaaagggcact

SEQ ID NO: 5203132 - DNA, 17 bp, Homo sapiens
agctgaaaagggcactc

SEQ ID NO: 5203133 - DNA, 12 bp, Homo sapiens
agctgaaacatg

SEQ ID NO: 5203134 - DNA, 15 bp, Homo sapiens
agctgaaagaggagg

SEQ ID NO: 5203135 - DNA, 17 bp, Homo sapiens
agctgaaagttgggact

SEQ ID NO: 5203136 - DNA, 12 bp, Homo sapiens
agctgaaatact

SEQ ID NO: 5203137 - DNA, 18 bp, Homo sapiens
agctgaaatatgctggct

SEQ ID NO: 5203138 - DNA, 18 bp, Homo sapiens
agctgaaatgctgcattt

SEQ ID NO: 5203139 - DNA, 17 bp, Homo sapiens
agctgaaattcaccaag

SEQ ID NO: 5203140 - DNA, 13 bp, Homo sapiens
agctgaaattgaa

SEQ ID NO: 5203141 - DNA, 19 bp, Homo sapiens
agctgaaattgaaaagtta

SEQ ID NO: 5203142 - DNA, 12 bp, Homo sapiens
agctgaaattgt

SEQ ID NO: 5203143 - DNA, 13 bp, Homo sapiens
agctgaaatttta

SEQ ID NO: 5203144 - DNA, 20 bp, Homo sapiens
agctgaaattttagaaatat

SEQ ID NO: 5203145 - DNA, 22 bp, Homo sapiens
agctgaacaataggctgttccc

SEQ ID NO: 5203146 - DNA, 14 bp, Homo sapiens
agctgaacacattt

SEQ ID NO: 5203147 - DNA, 22 bp, Homo sapiens
agctgaacagccaaatgcatgg

SEQ ID NO: 5203148 - DNA, 24 bp, Homo sapiens
agctgaacagtgttggctttcatg

SEQ ID NO: 5203149 - DNA, 21 bp, Homo sapiens
agctgaaccaaagcctcttca

SEQ ID NO: 5203150 - DNA, 16 bp, Homo sapiens
agctgaaccacagaaa

SEQ ID NO: 5203151 - DNA, 16 bp, Homo sapiens
agctgaaccccctcca

SEQ ID NO: 5203152 - DNA, 19 bp, Homo sapiens
agctgaagaaaaaatcaga

SEQ ID NO: 5203153 - DNA, 16 bp, Homo sapiens
agctgaagaaaatgag

SEQ ID NO: 5203154 - DNA, 13 bp, Homo sapiens
agctgaagaaatt

SEQ ID NO: 5203155 - DNA, 13 bp, Homo sapiens
agctgaagagctg

SEQ ID NO: 5203156 - DNA, 20 bp, Homo sapiens
agctgaagagttgccccgtc

SEQ ID NO: 5203157 - DNA, 20 bp, Homo sapiens
agctgaagatccccaactgc

SEQ ID NO: 5203158 - DNA, 22 bp, Homo sapiens
agctgaagatccccaactgctc

SEQ ID NO: 5203159 - DNA, 17 bp, Homo sapiens
agctgaagccagctccc

SEQ ID NO: 5203160 - DNA, 19 bp, Homo sapiens
agctgaagcccccctttgg

SEQ ID NO: 5203161 - DNA, 14 bp, Homo sapiens
agctgaagccgcca

SEQ ID NO: 5203162 - DNA, 15 bp, Homo sapiens
agctgaagcctggac

SEQ ID NO: 5203163 - DNA, 17 bp, Homo sapiens
agctgaagcctggacgc

SEQ ID NO: 5203164 - DNA, 22 bp, Homo sapiens
agctgaagctacaggttgtgaa

SEQ ID NO: 5203165 - DNA, 12 bp, Homo sapiens
agctgaaggcag

SEQ ID NO: 5203166 - DNA, 19 bp, Homo sapiens
agctgaaggcagtggcagg

SEQ ID NO: 5203167 - DNA, 15 bp, Homo sapiens
agctgaagtgaagga

SEQ ID NO: 5203168 - DNA, 20 bp, Homo sapiens
agctgaagtgaaggagaaag

SEQ ID NO: 5203169 - DNA, 17 bp, Homo sapiens
agctgaagtgcatccaa

SEQ ID NO: 5203170 - DNA, 18 bp, Homo sapiens
agctgaatacattctgct

SEQ ID NO: 5203171 - DNA, 15 bp, Homo sapiens
agctgaatagaggga

SEQ ID NO: 5203172 - DNA, 20 bp, Homo sapiens
agctgaatattttttatttc

SEQ ID NO: 5203173 - DNA, 20 bp, Homo sapiens
agctgaatgagtctgctttc

SEQ ID NO: 5203174 - DNA, 22 bp, Homo sapiens
agctgaatgtttgtttcagtgc

SEQ ID NO: 5203175 - DNA, 16 bp, Homo sapiens
agctgaatgtttttct

SEQ ID NO: 5203176 - DNA, 17 bp, Homo sapiens
agctgaatgtttttcta

SEQ ID NO: 5203177 - DNA, 18 bp, Homo sapiens
agctgaatgtttttctaa

SEQ ID NO: 5203178 - DNA, 15 bp, Homo sapiens
agctgaattgagcct

SEQ ID NO: 5203179 - DNA, 21 bp, Homo sapiens
agctgaattgagcctaaaaat

SEQ ID NO: 5203180 - DNA, 13 bp, Homo sapiens
agctgaattttct

SEQ ID NO: 5203181 - DNA, 21 bp, Homo sapiens
agctgacaaaatacttgtctg

SEQ ID NO: 5203182 - DNA, 19 bp, Homo sapiens
aggagtcaatttgcctctg

SEQ ID NO: 5203183 - DNA, 15 bp, Homo sapiens
aggagtcactgagac

SEQ ID NO: 5203184 - DNA, 16 bp, Homo sapiens
aggagtcactgagacc

SEQ ID NO: 5203185 - DNA, 19 bp, Homo sapiens
aggagtccaaaccttctac

SEQ ID NO: 5203186 - DNA, 21 bp, Homo sapiens
aggagtccactgcctccatga

SEQ ID NO: 5203187 - DNA, 20 bp, Homo sapiens
aggagtccactttgtttcgt

SEQ ID NO: 5203188 - DNA, 14 bp, Homo sapiens
aggagtccagaccc

SEQ ID NO: 5203189 - DNA, 21 bp, Homo sapiens
aggagtccagaccccccagcc

SEQ ID NO: 5203190 - DNA, 11 bp, Homo sapiens
aggagtccagc

SEQ ID NO: 5203191 - DNA, 13 bp, Homo sapiens
aggagtccagcac

SEQ ID NO: 5203192 - DNA, 18 bp, Homo sapiens
aggagtccagcccctcct

SEQ ID NO: 5203193 - DNA, 21 bp, Homo sapiens
aggagtccagcccctcctccc

SEQ ID NO: 5203194 - DNA, 20 bp, Homo sapiens
aggagtccaggcccccagcc

SEQ ID NO: 5203195 - DNA, 16 bp, Homo sapiens
aggagtcccaaggaaa

SEQ ID NO: 5203196 - DNA, 17 bp, Homo sapiens
aggagtcccaaggaaag

SEQ ID NO: 5203197 - DNA, 21 bp, Homo sapiens
aggagtcccactccaagccag

SEQ ID NO: 5203198 - DNA, 21 bp, Homo sapiens
aggagtccctgccatcatgtt

SEQ ID NO: 5203199 - DNA, 14 bp, Homo sapiens
aggagtcctttctt

SEQ ID NO: 5203200 - DNA, 15 bp, Homo sapiens
aggagtctattttgt

SEQ ID NO: 5203201 - DNA, 15 bp, Homo sapiens
aggagtctctgccac

SEQ ID NO: 5203202 - DNA, 19 bp, Homo sapiens
aggagtctctgccacccac

SEQ ID NO: 5203203 - DNA, 20 bp, Homo sapiens
aggagtctctgccacccact

SEQ ID NO: 5203204 - DNA, 16 bp, Homo sapiens
aggagtctctgccagt

SEQ ID NO: 5203205 - DNA, 17 bp, Homo sapiens
aggagtctgaggtcctg

SEQ ID NO: 5203206 - DNA, 18 bp, Homo sapiens
aggagtctgaggtcctga

SEQ ID NO: 5203207 - DNA, 21 bp, Homo sapiens
aggagtctgaggtcctgagca

SEQ ID NO: 5203208 - DNA, 16 bp, Homo sapiens
aggagtctgattgcag

SEQ ID NO: 5203209 - DNA, 24 bp, Homo sapiens
aggagtctgcacatgcagctgcac

SEQ ID NO: 5203210 - DNA, 14 bp, Homo sapiens
aggagtctgccact

SEQ ID NO: 5203211 - DNA, 21 bp, Homo sapiens
aggagtgaaacatcatagaaa

SEQ ID NO: 5203212 - DNA, 22 bp, Homo sapiens
aggagtgaaacctttagggcag

SEQ ID NO: 5203213 - DNA, 23 bp, Homo sapiens
aggagtgaaacctttagggcagc

SEQ ID NO: 5203214 - DNA, 15 bp, Homo sapiens
aggagtgaccgggca

SEQ ID NO: 5203215 - DNA, 18 bp, Homo sapiens
aggagtgactaggtgggt

SEQ ID NO: 5203216 - DNA, 20 bp, Homo sapiens
aggagtgactctggctgcca

SEQ ID NO: 5203217 - DNA, 17 bp, Homo sapiens
aggagtgagaggggaca

SEQ ID NO: 5203218 - DNA, 21 bp, Homo sapiens
aggagtgagatcattttctta

SEQ ID NO: 5203219 - DNA, 22 bp, Homo sapiens
aggagtgagtgtatgtgtgtgt

SEQ ID NO: 5203220 - DNA, 17 bp, Homo sapiens
aggagtgcagccttctc

SEQ ID NO: 5203221 - DNA, 14 bp, Homo sapiens
aggagtgcatggcc

SEQ ID NO: 5203222 - DNA, 16 bp, Homo sapiens
aggagtgcatggccac

SEQ ID NO: 5203223 - DNA, 19 bp, Homo sapiens
aggagtgcatggccacagc

SEQ ID NO: 5203224 - DNA, 23 bp, Homo sapiens
aggagtgcatggccacagccacc

SEQ ID NO: 5203225 - DNA, 15 bp, Homo sapiens
aggagtgccaggacc

SEQ ID NO: 5203226 - DNA, 19 bp, Homo sapiens
aggagtgccaggaccagcc

SEQ ID NO: 5203227 - DNA, 21 bp, Homo sapiens
aggagtgccgtgtgttgcatg

SEQ ID NO: 5203228 - DNA, 18 bp, Homo sapiens
aggagtggaggaggcctg

SEQ ID NO: 5203229 - DNA, 19 bp, Homo sapiens
aggagtggattcctcccca

SEQ ID NO: 5203230 - DNA, 21 bp, Homo sapiens
aggagtggattcctccccacc

SEQ ID NO: 5203231 - DNA, 18 bp, Homo sapiens
aggagtggccacagcacc

SEQ ID NO: 5203232 - DNA, 19 bp, Homo sapiens
aggagtggccggggaagct

SEQ ID NO: 5203233 - DNA, 16 bp, Homo sapiens
aggagtgggacagaca

SEQ ID NO: 5203234 - DNA, 20 bp, Homo sapiens
aggagtgggtgacaagagcc

SEQ ID NO: 5203235 - DNA, 21 bp, Homo sapiens
aggagtgggtgggacacagag

SEQ ID NO: 5203236 - DNA, 15 bp, Homo sapiens
aggagtgggtgggga

SEQ ID NO: 5203237 - DNA, 22 bp, Homo sapiens
aggagtgggtggggagtggggg

SEQ ID NO: 5203238 - DNA, 18 bp, Homo sapiens
aggagtgggttgatttca

SEQ ID NO: 5203239 - DNA, 21 bp, Homo sapiens
aggagtggttgggctgtgcct

SEQ ID NO: 5203240 - DNA, 14 bp, Homo sapiens
aggagtgtcctctt

SEQ ID NO: 5203241 - DNA, 20 bp, Homo sapiens
aggagtgtcctgtctgctgg

SEQ ID NO: 5203242 - DNA, 16 bp, Homo sapiens
aggagtgtggccacgt

SEQ ID NO: 5203243 - DNA, 20 bp, Homo sapiens
aggagtgtgtgacattccag

SEQ ID NO: 5203244 - DNA, 13 bp, Homo sapiens
aggagtgtgtgtg

SEQ ID NO: 5203245 - DNA, 20 bp, Homo sapiens
aggagttaaagagcagcctg

SEQ ID NO: 5203246 - DNA, 22 bp, Homo sapiens
aggagttaaagagcagcctggc

SEQ ID NO: 5203247 - DNA, 18 bp, Homo sapiens
aggagttacagggaagtg

SEQ ID NO: 5203248 - DNA, 20 bp, Homo sapiens
aggagttagaaccacagcag

SEQ ID NO: 5203249 - DNA, 17 bp, Homo sapiens
aggagttagaggccagc

SEQ ID NO: 5203250 - DNA, 13 bp, Homo sapiens
aggagttagccaa

SEQ ID NO: 5203251 - DNA, 15 bp, Homo sapiens
aggagttagccaaac

SEQ ID NO: 5203252 - DNA, 20 bp, Homo sapiens
aggagttcaagaccagcctg

SEQ ID NO: 5203253 - DNA, 22 bp, Homo sapiens
aggagttcaagaccagcctggc

SEQ ID NO: 5203254 - DNA, 17 bp, Homo sapiens
aggagttcaagaccagt

SEQ ID NO: 5203255 - DNA, 21 bp, Homo sapiens
aggagttcaagactagcctgg

SEQ ID NO: 5203256 - DNA, 12 bp, Homo sapiens
aggagttcaatg

SEQ ID NO: 5203257 - DNA, 13 bp, Homo sapiens
aggagttcaatga

SEQ ID NO: 5203258 - DNA, 18 bp, Homo sapiens
aggagttcaatgatctag

SEQ ID NO: 5203259 - DNA, 19 bp, Homo sapiens
aggagttcaggaacccttc

SEQ ID NO: 5203260 - DNA, 21 bp, Homo sapiens
aggagttcaggaacccttctc

SEQ ID NO: 5203261 - DNA, 19 bp, Homo sapiens
aggagttcctaaccagcct

SEQ ID NO: 5203262 - DNA, 20 bp, Homo sapiens
aggagttccttgatctgtat

SEQ ID NO: 5203263 - DNA, 16 bp, Homo sapiens
aggagttcgagaccaa

SEQ ID NO: 5203264 - DNA, 21 bp, Homo sapiens
aggagttcgagaccagcctcg

SEQ ID NO: 5203265 - DNA, 21 bp, Homo sapiens
aggagttcgagaccagcctgg

SEQ ID NO: 5203266 - DNA, 19 bp, Homo sapiens
aggagttctaacacatttc

SEQ ID NO: 5203267 - DNA, 18 bp, Homo sapiens
aggagttctctgatgcag

SEQ ID NO: 5203268 - DNA, 22 bp, Homo sapiens
aggagttctctgatgcagaaat

SEQ ID NO: 5203269 - DNA, 23 bp, Homo sapiens
aggagttctctgatgcagaaatt

SEQ ID NO: 5203270 - DNA, 14 bp, Homo sapiens
aggagttctcttcc

SEQ ID NO: 5203271 - DNA, 23 bp, Homo sapiens
aggagttctcttccgcagcccct

SEQ ID NO: 5203272 - DNA, 13 bp, Homo sapiens
aggagttctgaag

SEQ ID NO: 5203273 - DNA, 17 bp, Homo sapiens
aggagttctgacattca

SEQ ID NO: 5203274 - DNA, 19 bp, Homo sapiens
aggagttctttggctctat

SEQ ID NO: 5203275 - DNA, 20 bp, Homo sapiens
aggagttgagtacagtgagg

SEQ ID NO: 5203276 - DNA, 14 bp, Homo sapiens
aggagttgccaggg

SEQ ID NO: 5203277 - DNA, 16 bp, Homo sapiens
aggagttgccagggaa

SEQ ID NO: 5203278 - DNA, 14 bp, Homo sapiens
aggagttgcctgac

SEQ ID NO: 5203279 - DNA, 14 bp, Homo sapiens
aggagttgctgttt

SEQ ID NO: 5203280 - DNA, 16 bp, Homo sapiens
aggagttgtctgtcct

SEQ ID NO: 5203281 - DNA, 21 bp, Homo sapiens
aggagttgtgagccctctagg

SEQ ID NO: 5203282 - DNA, 13 bp, Homo sapiens
aggagttgtgtct

SEQ ID NO: 5203283 - DNA, 22 bp, Homo sapiens
aggagttgtttctgacccactg

SEQ ID NO: 5203284 - DNA, 17 bp, Homo sapiens
aggagtttattacaatg

SEQ ID NO: 5203285 - DNA, 22 bp, Homo sapiens
aggagtttattacaatgtatct

SEQ ID NO: 5203286 - DNA, 18 bp, Homo sapiens
aggagtttcgttttcaaa

SEQ ID NO: 5203287 - DNA, 22 bp, Homo sapiens
aggagtttctttagctgacaga

SEQ ID NO: 5203288 - DNA, 15 bp, Homo sapiens
aggagtttgaatcca

SEQ ID NO: 5203289 - DNA, 23 bp, Homo sapiens
aggagtttgagacaagccctggc

SEQ ID NO: 5203290 - DNA, 16 bp, Homo sapiens
aggagtttgagaccag

SEQ ID NO: 5203291 - DNA, 20 bp, Homo sapiens
aggagtttgaggctgcaatg

SEQ ID NO: 5203292 - DNA, 18 bp, Homo sapiens
aggagtttggccagaagt

SEQ ID NO: 5203293 - DNA, 18 bp, Homo sapiens
aggagttttactgcctgt

SEQ ID NO: 5203294 - DNA, 19 bp, Homo sapiens
aggataaaaagccagggct

SEQ ID NO: 5203295 - DNA, 22 bp, Homo sapiens
aggataaaaagccagggctgga

SEQ ID NO: 5203296 - DNA, 17 bp, Homo sapiens
aggataaaaaggaagga

SEQ ID NO: 5203297 - DNA, 13 bp, Homo sapiens
aggataaaccaat

SEQ ID NO: 5203298 - DNA, 18 bp, Homo sapiens
aggataaacttttagaaa

SEQ ID NO: 5203299 - DNA, 19 bp, Homo sapiens
aggataaattaatgagttt

SEQ ID NO: 5203300 - DNA, 17 bp, Homo sapiens
aggataaattgccataa

SEQ ID NO: 5203301 - DNA, 19 bp, Homo sapiens
aggataaattgccataata

SEQ ID NO: 5203302 - DNA, 23 bp, Homo sapiens
aggataacttccttgcccctgct

SEQ ID NO: 5203303 - DNA, 15 bp, Homo sapiens
aggataactttttaa

SEQ ID NO: 5203304 - DNA, 21 bp, Homo sapiens
aggataagaaagcctaaaatt

SEQ ID NO: 5203305 - DNA, 18 bp, Homo sapiens
aggataagttatagagca

SEQ ID NO: 5203306 - DNA, 18 bp, Homo sapiens
aggataatgaaataatca

SEQ ID NO: 5203307 - DNA, 12 bp, Homo sapiens
aggataatggtg

SEQ ID NO: 5203308 - DNA, 22 bp, Homo sapiens
aggataattatccaataaaaaa

SEQ ID NO: 5203309 - DNA, 15 bp, Homo sapiens
aggatacagaggaga

SEQ ID NO: 5203310 - DNA, 14 bp, Homo sapiens
aggatacagctctt

SEQ ID NO: 5203311 - DNA, 16 bp, Homo sapiens
aggatacagggagccg

SEQ ID NO: 5203312 - DNA, 20 bp, Homo sapiens
aggatacccggtggcttctg

SEQ ID NO: 5203313 - DNA, 23 bp, Homo sapiens
aggatacccggtggcttctggca

SEQ ID NO: 5203314 - DNA, 16 bp, Homo sapiens
aggataccttcttatt

SEQ ID NO: 5203315 - DNA, 20 bp, Homo sapiens
aggatacgacagtacactgt

SEQ ID NO: 5203316 - DNA, 17 bp, Homo sapiens
aggatacgctgctctca

SEQ ID NO: 5203317 - DNA, 16 bp, Homo sapiens
aggatactcaaagtgg

SEQ ID NO: 5203318 - DNA, 13 bp, Homo sapiens
aggatactctgtc

SEQ ID NO: 5203319 - DNA, 14 bp, Homo sapiens
aggatactcttaat

SEQ ID NO: 5203320 - DNA, 23 bp, Homo sapiens
aggatactgcgggcaccagaatg

SEQ ID NO: 5203321 - DNA, 18 bp, Homo sapiens
aggatactgtaacacttt

SEQ ID NO: 5203322 - DNA, 13 bp, Homo sapiens
aggatacttattt

SEQ ID NO: 5203323 - DNA, 15 bp, Homo sapiens
aggatacttatttaa

SEQ ID NO: 5203324 - DNA, 15 bp, Homo sapiens
aggatagacactgga

SEQ ID NO: 5203325 - DNA, 16 bp, Homo sapiens
aggatagacactggac

SEQ ID NO: 5203326 - DNA, 18 bp, Homo sapiens
aggatagacactggacat

SEQ ID NO: 5203327 - DNA, 21 bp, Homo sapiens
aggatagacactggacatggc

SEQ ID NO: 5203328 - DNA, 14 bp, Homo sapiens
aggatagatgctgg

SEQ ID NO: 5203329 - DNA, 13 bp, Homo sapiens
aggatagcctttg

SEQ ID NO: 5203330 - DNA, 16 bp, Homo sapiens
aggatagcctttgtag

SEQ ID NO: 5203331 - DNA, 16 bp, Homo sapiens
aggataggagttcact

SEQ ID NO: 5203332 - DNA, 19 bp, Homo sapiens
aggatagggaaagggtgga

SEQ ID NO: 5203333 - DNA, 16 bp, Homo sapiens
aggatagtatttttat

SEQ ID NO: 5203334 - DNA, 15 bp, Homo sapiens
aggatataaaaggat

SEQ ID NO: 5203335 - DNA, 22 bp, Homo sapiens
aggatataagagggctttttaa

SEQ ID NO: 5203336 - DNA, 15 bp, Homo sapiens
aggatatactgcagc

SEQ ID NO: 5203337 - DNA, 17 bp, Homo sapiens
aggatatccccagggaa

SEQ ID NO: 5203338 - DNA, 15 bp, Homo sapiens
aggatatcttctcca

SEQ ID NO: 5203339 - DNA, 18 bp, Homo sapiens
aggatatgccctcctggt

SEQ ID NO: 5203340 - DNA, 20 bp, Homo sapiens
aggatatgctttaagacaga

SEQ ID NO: 5203341 - DNA, 20 bp, Homo sapiens
aggatatggcagggaagctt

SEQ ID NO: 5203342 - DNA, 17 bp, Homo sapiens
aggatattcactctgtg

SEQ ID NO: 5203343 - DNA, 14 bp, Homo sapiens
aggatattccaaaa

SEQ ID NO: 5203344 - DNA, 13 bp, Homo sapiens
aggatattctact

SEQ ID NO: 5203345 - DNA, 14 bp, Homo sapiens
aggatattgctaat

SEQ ID NO: 5203346 - DNA, 17 bp, Homo sapiens
aggatattgctaattgt

SEQ ID NO: 5203347 - DNA, 15 bp, Homo sapiens
aggatattggcattt

SEQ ID NO: 5203348 - DNA, 17 bp, Homo sapiens
aggatatttcaaatgat

SEQ ID NO: 5203349 - DNA, 20 bp, Homo sapiens
aggatatttctacaaggtgt

SEQ ID NO: 5203350 - DNA, 19 bp, Homo sapiens
aggatcaaagacacacagg

SEQ ID NO: 5203351 - DNA, 18 bp, Homo sapiens
aggatcacagtgctgaga

SEQ ID NO: 5203352 - DNA, 15 bp, Homo sapiens
aggatcaccagtgca

SEQ ID NO: 5203353 - DNA, 14 bp, Homo sapiens
aggatcacctgagg

SEQ ID NO: 5203354 - DNA, 18 bp, Homo sapiens
aggatcacctgaggtcag

SEQ ID NO: 5203355 - DNA, 17 bp, Homo sapiens
aggatcactctctgctg

SEQ ID NO: 5203356 - DNA, 19 bp, Homo sapiens
aggatcactctctgctggc

SEQ ID NO: 5203357 - DNA, 20 bp, Homo sapiens
aggatcactctctgctggca

SEQ ID NO: 5203358 - DNA, 22 bp, Homo sapiens
aggatcactggagcccaggagt

SEQ ID NO: 5203359 - DNA, 20 bp, Homo sapiens
agctgacacaaacctgcctg

SEQ ID NO: 5203360 - DNA, 18 bp, Homo sapiens
agctgacagagccagagg

SEQ ID NO: 5203361 - DNA, 20 bp, Homo sapiens
agctgacagagccagaggca

SEQ ID NO: 5203362 - DNA, 14 bp, Homo sapiens
agctgacagctgct

SEQ ID NO: 5203363 - DNA, 21 bp, Homo sapiens
agctgacagtcctctccacct

SEQ ID NO: 5203364 - DNA, 15 bp, Homo sapiens
agctgacatcttgaa

SEQ ID NO: 5203365 - DNA, 16 bp, Homo sapiens
agctgacatcttgaat

SEQ ID NO: 5203366 - DNA, 12 bp, Homo sapiens
agctgacatgga

SEQ ID NO: 5203367 - DNA, 16 bp, Homo sapiens
agctgaccacaggcag

SEQ ID NO: 5203368 - DNA, 16 bp, Homo sapiens
agctgaccagaagtgg

SEQ ID NO: 5203369 - DNA, 20 bp, Homo sapiens
agctgaccagaagtggcagg

SEQ ID NO: 5203370 - DNA, 22 bp, Homo sapiens
agctgaccagccgtgagcatgt

SEQ ID NO: 5203371 - DNA, 17 bp, Homo sapiens
agctgacccagagtgga

SEQ ID NO: 5203372 - DNA, 21 bp, Homo sapiens
agctgacccagagtggagtct

SEQ ID NO: 5203373 - DNA, 22 bp, Homo sapiens
agctgacccagagtggagtctg

SEQ ID NO: 5203374 - DNA, 13 bp, Homo sapiens
agctgaccccctc

SEQ ID NO: 5203375 - DNA, 19 bp, Homo sapiens
agctgaccccctcccccca

SEQ ID NO: 5203376 - DNA, 17 bp, Homo sapiens
agctgaccccgagaagt

SEQ ID NO: 5203377 - DNA, 22 bp, Homo sapiens
agctgaccccgagaagtgctct

SEQ ID NO: 5203378 - DNA, 19 bp, Homo sapiens
agctgacccggcctctctg

SEQ ID NO: 5203379 - DNA, 12 bp, Homo sapiens
agctgacctctg

SEQ ID NO: 5203380 - DNA, 21 bp, Homo sapiens
agctgacctctgttgtcctcc

SEQ ID NO: 5203381 - DNA, 21 bp, Homo sapiens
agctgacctttaactgagggc

SEQ ID NO: 5203382 - DNA, 19 bp, Homo sapiens
agctgacgaacttccatgg

SEQ ID NO: 5203383 - DNA, 20 bp, Homo sapiens
agctgacgggaggccccagc

SEQ ID NO: 5203384 - DNA, 21 bp, Homo sapiens
agctgacggtttctccccgga

SEQ ID NO: 5203385 - DNA, 13 bp, Homo sapiens
agctgactcacac

SEQ ID NO: 5203386 - DNA, 13 bp, Homo sapiens
agctgactgttct

SEQ ID NO: 5203387 - DNA, 18 bp, Homo sapiens
agctgacttggcacttaa

SEQ ID NO: 5203388 - DNA, 19 bp, Homo sapiens
agctgacttggctggtgtg

SEQ ID NO: 5203389 - DNA, 20 bp, Homo sapiens
agctgacttggttctgaagc

SEQ ID NO: 5203390 - DNA, 14 bp, Homo sapiens
agctgactttgttg

SEQ ID NO: 5203391 - DNA, 11 bp, Homo sapiens
agctgagaaga

SEQ ID NO: 5203392 - DNA, 13 bp, Homo sapiens
agctgagaagaag

SEQ ID NO: 5203393 - DNA, 15 bp, Homo sapiens
agctgagaagaatga

SEQ ID NO: 5203394 - DNA, 19 bp, Homo sapiens
agctgagaagaggaggagg

SEQ ID NO: 5203395 - DNA, 20 bp, Homo sapiens
agctgagaatagaaggaaac

SEQ ID NO: 5203396 - DNA, 15 bp, Homo sapiens
agctgagaccactga

SEQ ID NO: 5203397 - DNA, 14 bp, Homo sapiens
agctgagaccaggg

SEQ ID NO: 5203398 - DNA, 22 bp, Homo sapiens
agctgagacccttatttaaaac

SEQ ID NO: 5203399 - DNA, 16 bp, Homo sapiens
agctgagagaaaataa

SEQ ID NO: 5203400 - DNA, 20 bp, Homo sapiens
agctgagagaccctggcctc

SEQ ID NO: 5203401 - DNA, 21 bp, Homo sapiens
agctgagagaccctggcctca

SEQ ID NO: 5203402 - DNA, 14 bp, Homo sapiens
agctgagagccctg

SEQ ID NO: 5203403 - DNA, 22 bp, Homo sapiens
agctgagagccctgctgtggga

SEQ ID NO: 5203404 - DNA, 13 bp, Homo sapiens
agctgagaggaag

SEQ ID NO: 5203405 - DNA, 14 bp, Homo sapiens
agctgagatgtgga

SEQ ID NO: 5203406 - DNA, 20 bp, Homo sapiens
agctgagcaaatcaccacaa

SEQ ID NO: 5203407 - DNA, 12 bp, Homo sapiens
agctgagcagcc

SEQ ID NO: 5203408 - DNA, 15 bp, Homo sapiens
agctgagcagcctct

SEQ ID NO: 5203409 - DNA, 20 bp, Homo sapiens
agctgagcaggacagccagc

SEQ ID NO: 5203410 - DNA, 21 bp, Homo sapiens
agctgagcaggacagccagca

SEQ ID NO: 5203411 - DNA, 22 bp, Homo sapiens
agctgagcaggacagccagcag

SEQ ID NO: 5203412 - DNA, 23 bp, Homo sapiens
agctgagcaggacagccagcagc

SEQ ID NO: 5203413 - DNA, 15 bp, Homo sapiens
agctgagcaggccac

SEQ ID NO: 5203414 - DNA, 18 bp, Homo sapiens
agctgagcaggcccgaca

SEQ ID NO: 5203415 - DNA, 14 bp, Homo sapiens
agctgagcagggcc

SEQ ID NO: 5203416 - DNA, 14 bp, Homo sapiens
agctgagcaggtgt

SEQ ID NO: 5203417 - DNA, 15 bp, Homo sapiens
agctgagcatggaga

SEQ ID NO: 5203418 - DNA, 18 bp, Homo sapiens
agctgagcatggagacag

SEQ ID NO: 5203419 - DNA, 10 bp, Homo sapiens
agctgagcca

SEQ ID NO: 5203420 - DNA, 11 bp, Homo sapiens
agctgagccac

SEQ ID NO: 5203421 - DNA, 12 bp, Homo sapiens
agctgagccagg

SEQ ID NO: 5203422 - DNA, 13 bp, Homo sapiens
agctgagccaggc

SEQ ID NO: 5203423 - DNA, 14 bp, Homo sapiens
agctgagccaggct

SEQ ID NO: 5203424 - DNA, 11 bp, Homo sapiens
agctgagccct

SEQ ID NO: 5203425 - DNA, 12 bp, Homo sapiens
agctgagccctg

SEQ ID NO: 5203426 - DNA, 13 bp, Homo sapiens
agctgagcctctc

SEQ ID NO: 5203427 - DNA, 14 bp, Homo sapiens
agctgagcctctca

SEQ ID NO: 5203428 - DNA, 14 bp, Homo sapiens
agctgagcctgcag

SEQ ID NO: 5203429 - DNA, 17 bp, Homo sapiens
agctgagcctgcaggga

SEQ ID NO: 5203430 - DNA, 15 bp, Homo sapiens
agctgagctacctgg

SEQ ID NO: 5203431 - DNA, 17 bp, Homo sapiens
agctgagctcacaaggc

SEQ ID NO: 5203432 - DNA, 18 bp, Homo sapiens
agctgagctcacaaggca

SEQ ID NO: 5203433 - DNA, 19 bp, Homo sapiens
agctgagctcacaaggcag

SEQ ID NO: 5203434 - DNA, 20 bp, Homo sapiens
agctgagctcacaaggcagc

SEQ ID NO: 5203435 - DNA, 21 bp, Homo sapiens
agctgagctcacaaggcagca

SEQ ID NO: 5203436 - DNA, 19 bp, Homo sapiens
agctgagctggaaggggcc

SEQ ID NO: 5203437 - DNA, 20 bp, Homo sapiens
agctgagctggaaggggcca

SEQ ID NO: 5203438 - DNA, 15 bp, Homo sapiens
agctgagcttgagct

SEQ ID NO: 5203439 - DNA, 22 bp, Homo sapiens
agctgagcttgagctcccctgg

SEQ ID NO: 5203440 - DNA, 15 bp, Homo sapiens
agctgaggaccctca

SEQ ID NO: 5203441 - DNA, 15 bp, Homo sapiens
agctgaggactctgc

SEQ ID NO: 5203442 - DNA, 17 bp, Homo sapiens
agctgaggatttcctgg

SEQ ID NO: 5203443 - DNA, 23 bp, Homo sapiens
agctgaggatttcctggagtgcc

SEQ ID NO: 5203444 - DNA, 16 bp, Homo sapiens
agctgaggcaggggga

SEQ ID NO: 5203445 - DNA, 21 bp, Homo sapiens
agctgaggccacactcagcac

SEQ ID NO: 5203446 - DNA, 22 bp, Homo sapiens
agctgaggccacactcagcaca

SEQ ID NO: 5203447 - DNA, 19 bp, Homo sapiens
agctgaggccattccctgt

SEQ ID NO: 5203448 - DNA, 13 bp, Homo sapiens
agctgaggcccat

SEQ ID NO: 5203449 - DNA, 18 bp, Homo sapiens
agctgaggcccatggcca

SEQ ID NO: 5203450 - DNA, 22 bp, Homo sapiens
agctgaggccccagggctgtgg

SEQ ID NO: 5203451 - DNA, 23 bp, Homo sapiens
agctgaggccccagggctgtggg

SEQ ID NO: 5203452 - DNA, 15 bp, Homo sapiens
agctgaggcctccct

SEQ ID NO: 5203453 - DNA, 14 bp, Homo sapiens
agctgaggctgctg

SEQ ID NO: 5203454 - DNA, 19 bp, Homo sapiens
agctgaggctgctgccagg

SEQ ID NO: 5203455 - DNA, 12 bp, Homo sapiens
agctgagggagg

SEQ ID NO: 5203456 - DNA, 13 bp, Homo sapiens
agctgagggaggg

SEQ ID NO: 5203457 - DNA, 16 bp, Homo sapiens
agctgagggagggagc

SEQ ID NO: 5203458 - DNA, 21 bp, Homo sapiens
agctgagggagggagccatgg

SEQ ID NO: 5203459 - DNA, 17 bp, Homo sapiens
agctgagggccctgtgg

SEQ ID NO: 5203460 - DNA, 19 bp, Homo sapiens
agctgaggggacgggcaag

SEQ ID NO: 5203461 - DNA, 13 bp, Homo sapiens
agctgaggggggc

SEQ ID NO: 5203462 - DNA, 20 bp, Homo sapiens
agctgaggtttagtaatcta

SEQ ID NO: 5203463 - DNA, 18 bp, Homo sapiens
agctgaggtttcaccctt

SEQ ID NO: 5203464 - DNA, 16 bp, Homo sapiens
agctgagtcacctcct

SEQ ID NO: 5203465 - DNA, 14 bp, Homo sapiens
agctgagtcctggg

SEQ ID NO: 5203466 - DNA, 15 bp, Homo sapiens
agctgagtcctgggg

SEQ ID NO: 5203467 - DNA, 16 bp, Homo sapiens
agctgagtcctggggt

SEQ ID NO: 5203468 - DNA, 20 bp, Homo sapiens
agctgagtctccctaaggca

SEQ ID NO: 5203469 - DNA, 19 bp, Homo sapiens
agctgagtgagtgggagag

SEQ ID NO: 5203470 - DNA, 20 bp, Homo sapiens
agctgagttacttgtctgag

SEQ ID NO: 5203471 - DNA, 22 bp, Homo sapiens
agctgagttacttgtctgaggc

SEQ ID NO: 5203472 - DNA, 23 bp, Homo sapiens
agctgagttacttgtctgaggcc

SEQ ID NO: 5203473 - DNA, 15 bp, Homo sapiens
agctgagttgggggt

SEQ ID NO: 5203474 - DNA, 13 bp, Homo sapiens
agctgagtttcct

SEQ ID NO: 5203475 - DNA, 14 bp, Homo sapiens
agctgagtttccta

SEQ ID NO: 5203476 - DNA, 19 bp, Homo sapiens
agctgataaggaaacttta

SEQ ID NO: 5203477 - DNA, 20 bp, Homo sapiens
agctgataaggaaactttat

SEQ ID NO: 5203478 - DNA, 13 bp, Homo sapiens
agctgatagtgtt

SEQ ID NO: 5203479 - DNA, 14 bp, Homo sapiens
agctgatataaatt

SEQ ID NO: 5203480 - DNA, 16 bp, Homo sapiens
agctgatataaattct

SEQ ID NO: 5203481 - DNA, 18 bp, Homo sapiens
agctgatataaattctgt

SEQ ID NO: 5203482 - DNA, 17 bp, Homo sapiens
agctgatattatttctt

SEQ ID NO: 5203483 - DNA, 13 bp, Homo sapiens
agctgatcagttt

SEQ ID NO: 5203484 - DNA, 20 bp, Homo sapiens
agctgatcataagtgaattt

SEQ ID NO: 5203485 - DNA, 16 bp, Homo sapiens
agctgatccataggac

SEQ ID NO: 5203486 - DNA, 22 bp, Homo sapiens
agctgatccttcaactctgtga

SEQ ID NO: 5203487 - DNA, 20 bp, Homo sapiens
agctgatcgcttctccccca

SEQ ID NO: 5203488 - DNA, 22 bp, Homo sapiens
agctgatctgcggatctcagct

SEQ ID NO: 5203489 - DNA, 12 bp, Homo sapiens
agctgatgaaac

SEQ ID NO: 5203490 - DNA, 23 bp, Homo sapiens
agctgatgaaactcacaaatgat

SEQ ID NO: 5203491 - DNA, 22 bp, Homo sapiens
agctgatgaacttattctgtag

SEQ ID NO: 5203492 - DNA, 23 bp, Homo sapiens
agctgatgatgtctcttgtagaa

SEQ ID NO: 5203493 - DNA, 20 bp, Homo sapiens
agctgatgccccttctcccc

SEQ ID NO: 5203494 - DNA, 15 bp, Homo sapiens
agctgatgcctcctt

SEQ ID NO: 5203495 - DNA, 14 bp, Homo sapiens
agctgatggagaag

SEQ ID NO: 5203496 - DNA, 14 bp, Homo sapiens
agctgatggcagct

SEQ ID NO: 5203497 - DNA, 21 bp, Homo sapiens
agctgatgtgagtgtgtgtga

SEQ ID NO: 5203498 - DNA, 23 bp, Homo sapiens
agctgatgttttgtattttgtgt

SEQ ID NO: 5203499 - DNA, 16 bp, Homo sapiens
agctgattaaatgaca

SEQ ID NO: 5203500 - DNA, 20 bp, Homo sapiens
agctgattactgtcaataaa

SEQ ID NO: 5203501 - DNA, 22 bp, Homo sapiens
agctgattactgtcaataaaca

SEQ ID NO: 5203502 - DNA, 17 bp, Homo sapiens
agctgattcccagagca

SEQ ID NO: 5203503 - DNA, 18 bp, Homo sapiens
agctgattcccagagcag

SEQ ID NO: 5203504 - DNA, 22 bp, Homo sapiens
agctgattgtttatttttctat

SEQ ID NO: 5203505 - DNA, 23 bp, Homo sapiens
agctgatttaacttgtattttgt

SEQ ID NO: 5203506 - DNA, 20 bp, Homo sapiens
agctgatttccaggcccctg

SEQ ID NO: 5203507 - DNA, 23 bp, Homo sapiens
agctgatttccaggcccctgagg

SEQ ID NO: 5203508 - DNA, 18 bp, Homo sapiens
agctgatttggtcacctt

SEQ ID NO: 5203509 - DNA, 15 bp, Homo sapiens
agctgattttaacaa

SEQ ID NO: 5203510 - DNA, 19 bp, Homo sapiens
agctgattttaacaataac

SEQ ID NO: 5203511 - DNA, 13 bp, Homo sapiens
agctgattttatt

SEQ ID NO: 5203512 - DNA, 23 bp, Homo sapiens
agctgattttcatgaaaatctgc

SEQ ID NO: 5203513 - DNA, 21 bp, Homo sapiens
agctgattttttttttaactt

SEQ ID NO: 5203514 - DNA, 17 bp, Homo sapiens
agctgcaaaaggcctgt

SEQ ID NO: 5203515 - DNA, 19 bp, Homo sapiens
agctgcaaaaggcctgtga

SEQ ID NO: 5203516 - DNA, 15 bp, Homo sapiens
agctgcaaaggacag

SEQ ID NO: 5203517 - DNA, 16 bp, Homo sapiens
agctgcaaatctgatg

SEQ ID NO: 5203518 - DNA, 11 bp, Homo sapiens
agctgcaataa

SEQ ID NO: 5203519 - DNA, 22 bp, Homo sapiens
agctgcacagggcagctgggcc

SEQ ID NO: 5203520 - DNA, 23 bp, Homo sapiens
agctgcacagggcagctgggccc

SEQ ID NO: 5203521 - DNA, 24 bp, Homo sapiens
agctgcacagggcagctgggccca

SEQ ID NO: 5203522 - DNA, 18 bp, Homo sapiens
agctgcacattcctggcc

SEQ ID NO: 5203523 - DNA, 15 bp, Homo sapiens
agctgcaccagagca

SEQ ID NO: 5203524 - DNA, 13 bp, Homo sapiens
agctgcacccctt

SEQ ID NO: 5203525 - DNA, 15 bp, Homo sapiens
agctgcaccccttcc

SEQ ID NO: 5203526 - DNA, 17 bp, Homo sapiens
agctgcaccccttcctg

SEQ ID NO: 5203527 - DNA, 20 bp, Homo sapiens
agctgcaccctcaggcaggt

SEQ ID NO: 5203528 - DNA, 21 bp, Homo sapiens
agctgcacctgccagcctggc

SEQ ID NO: 5203529 - DNA, 19 bp, Homo sapiens
agctgcactgatcacccaa

SEQ ID NO: 5203530 - DNA, 22 bp, Homo sapiens
agctgcactgatgctgcccctc

SEQ ID NO: 5203531 - DNA, 14 bp, Homo sapiens
agctgcactgtgaa

SEQ ID NO: 5203532 - DNA, 15 bp, Homo sapiens
agctgcactgtgaac

SEQ ID NO: 5203533 - DNA, 16 bp, Homo sapiens
agctgcactgtgaacc

SEQ ID NO: 5203534 - DNA, 17 bp, Homo sapiens
agctgcacttggcctca

SEQ ID NO: 5203535 - DNA, 20 bp, Homo sapiens
agctgcacttggcctcagct

SEQ ID NO: 5203536 - DNA, 22 bp, Homo sapiens
agctgcacttggcctcagctgg

SEQ ID NO: 5203537 - DNA, 19 bp, Homo sapiens
aggatcacttaagcccagg

SEQ ID NO: 5203538 - DNA, 19 bp, Homo sapiens
aggatcacttgagcccaga

SEQ ID NO: 5203539 - DNA, 18 bp, Homo sapiens
aggatcacttgggcccag

SEQ ID NO: 5203540 - DNA, 19 bp, Homo sapiens
aggatcactttaggcctgg

SEQ ID NO: 5203541 - DNA, 18 bp, Homo sapiens
aggatcagggctcctagg

SEQ ID NO: 5203542 - DNA, 17 bp, Homo sapiens
aggatcagttaactatt

SEQ ID NO: 5203543 - DNA, 13 bp, Homo sapiens
aggatcagttttt

SEQ ID NO: 5203544 - DNA, 22 bp, Homo sapiens
aggatcagttttttgttttaca

SEQ ID NO: 5203545 - DNA, 15 bp, Homo sapiens
aggatcatggtgtaa

SEQ ID NO: 5203546 - DNA, 21 bp, Homo sapiens
aggatcatttgttggaatgaa

SEQ ID NO: 5203547 - DNA, 14 bp, Homo sapiens
aggatccagagagc

SEQ ID NO: 5203548 - DNA, 16 bp, Homo sapiens
aggatccagagagcag

SEQ ID NO: 5203549 - DNA, 11 bp, Homo sapiens
aggatccaggc

SEQ ID NO: 5203550 - DNA, 21 bp, Homo sapiens
aggatccagggcagcaggcca

SEQ ID NO: 5203551 - DNA, 22 bp, Homo sapiens
aggatccagggcagcaggccag

SEQ ID NO: 5203552 - DNA, 13 bp, Homo sapiens
aggatcccccttc

SEQ ID NO: 5203553 - DNA, 16 bp, Homo sapiens
aggatcccctccaagc

SEQ ID NO: 5203554 - DNA, 13 bp, Homo sapiens
aggatcccctgct

SEQ ID NO: 5203555 - DNA, 14 bp, Homo sapiens
aggatcccctgtcc

SEQ ID NO: 5203556 - DNA, 18 bp, Homo sapiens
aggatcccctgtcccctg

SEQ ID NO: 5203557 - DNA, 23 bp, Homo sapiens
aggatcccctgtcccctggggct

SEQ ID NO: 5203558 - DNA, 17 bp, Homo sapiens
aggatccctcctgagct

SEQ ID NO: 5203559 - DNA, 18 bp, Homo sapiens
aggatccctcctgagctc

SEQ ID NO: 5203560 - DNA, 12 bp, Homo sapiens
aggatccgctgc

SEQ ID NO: 5203561 - DNA, 16 bp, Homo sapiens
aggatccgctgccacc

SEQ ID NO: 5203562 - DNA, 14 bp, Homo sapiens
aggatccggaaaga

SEQ ID NO: 5203563 - DNA, 21 bp, Homo sapiens
aggatccgggctttggactcc

SEQ ID NO: 5203564 - DNA, 20 bp, Homo sapiens
aggatcctcacaggagcaga

SEQ ID NO: 5203565 - DNA, 15 bp, Homo sapiens
aggatcctcctggag

SEQ ID NO: 5203566 - DNA, 13 bp, Homo sapiens
aggatcctctcca

SEQ ID NO: 5203567 - DNA, 18 bp, Homo sapiens
aggatcctgagccagatt

SEQ ID NO: 5203568 - DNA, 16 bp, Homo sapiens
aggatcctgcaggaac

SEQ ID NO: 5203569 - DNA, 13 bp, Homo sapiens
aggatcctggcct

SEQ ID NO: 5203570 - DNA, 15 bp, Homo sapiens
aggatcctggcctga

SEQ ID NO: 5203571 - DNA, 19 bp, Homo sapiens
aggatcctggtattgtaat

SEQ ID NO: 5203572 - DNA, 14 bp, Homo sapiens
aggatcgaggcatg

SEQ ID NO: 5203573 - DNA, 21 bp, Homo sapiens
aggatcgaggcatggggcatg

SEQ ID NO: 5203574 - DNA, 16 bp, Homo sapiens
aggatcggcttcctca

SEQ ID NO: 5203575 - DNA, 20 bp, Homo sapiens
aggatcgtagtgtgtttaaa

SEQ ID NO: 5203576 - DNA, 14 bp, Homo sapiens
aggatcgtggccaa

SEQ ID NO: 5203577 - DNA, 16 bp, Homo sapiens
aggatctaaggctgtt

SEQ ID NO: 5203578 - DNA, 14 bp, Homo sapiens
aggatctacttttt

SEQ ID NO: 5203579 - DNA, 19 bp, Homo sapiens
aggatctataggcagcttc

SEQ ID NO: 5203580 - DNA, 15 bp, Homo sapiens
aggatctatgcaatt

SEQ ID NO: 5203581 - DNA, 19 bp, Homo sapiens
aggatctatttttggaggt

SEQ ID NO: 5203582 - DNA, 17 bp, Homo sapiens
aggatctcaagccagcc

SEQ ID NO: 5203583 - DNA, 18 bp, Homo sapiens
aggatctcaagccagccc

SEQ ID NO: 5203584 - DNA, 23 bp, Homo sapiens
aggatctcaccaggcagcctctg

SEQ ID NO: 5203585 - DNA, 16 bp, Homo sapiens
aggatctccttttttc

SEQ ID NO: 5203586 - DNA, 19 bp, Homo sapiens
aggatctcgcctggaaaca

SEQ ID NO: 5203587 - DNA, 14 bp, Homo sapiens
aggatctctaaaga

SEQ ID NO: 5203588 - DNA, 17 bp, Homo sapiens
aggatctctaaagagca

SEQ ID NO: 5203589 - DNA, 15 bp, Homo sapiens
aggatctctcaggag

SEQ ID NO: 5203590 - DNA, 20 bp, Homo sapiens
aggatctctcaggagcacag

SEQ ID NO: 5203591 - DNA, 21 bp, Homo sapiens
aggatctctcaggagcacagg

SEQ ID NO: 5203592 - DNA, 19 bp, Homo sapiens
aggatctcttgagcctggg

SEQ ID NO: 5203593 - DNA, 19 bp, Homo sapiens
aggatctgaggacaaggaa

SEQ ID NO: 5203594 - DNA, 19 bp, Homo sapiens
aggatctgctccaacagaa

SEQ ID NO: 5203595 - DNA, 13 bp, Homo sapiens
aggatctgctgag

SEQ ID NO: 5203596 - DNA, 18 bp, Homo sapiens
aggatctgctgaggccca

SEQ ID NO: 5203597 - DNA, 19 bp, Homo sapiens
aggatctgctgaggcccag

SEQ ID NO: 5203598 - DNA, 21 bp, Homo sapiens
aggatctgctgaggcccagtg

SEQ ID NO: 5203599 - DNA, 22 bp, Homo sapiens
aggatctgctgaggcccagtgc

SEQ ID NO: 5203600 - DNA, 16 bp, Homo sapiens
aggatctgtctgtgca

SEQ ID NO: 5203601 - DNA, 17 bp, Homo sapiens
aggatctgtctgtgcac

SEQ ID NO: 5203602 - DNA, 23 bp, Homo sapiens
aggatctgtttttaaaaatcata

SEQ ID NO: 5203603 - DNA, 12 bp, Homo sapiens
aggatcttattt

SEQ ID NO: 5203604 - DNA, 16 bp, Homo sapiens
aggatcttcactgtct

SEQ ID NO: 5203605 - DNA, 22 bp, Homo sapiens
aggatctttcacccacagaaag

SEQ ID NO: 5203606 - DNA, 15 bp, Homo sapiens
aggatctttgactga

SEQ ID NO: 5203607 - DNA, 18 bp, Homo sapiens
aggatctttgtggccaag

SEQ ID NO: 5203608 - DNA, 17 bp, Homo sapiens
aggatctttgttcctct

SEQ ID NO: 5203609 - DNA, 13 bp, Homo sapiens
aggatcttttgaa

SEQ ID NO: 5203610 - DNA, 19 bp, Homo sapiens
aggatcttttggacctggc

SEQ ID NO: 5203611 - DNA, 13 bp, Homo sapiens
aggatcttttgta

SEQ ID NO: 5203612 - DNA, 15 bp, Homo sapiens
aggatgaactagcca

SEQ ID NO: 5203613 - DNA, 18 bp, Homo sapiens
aggatgaactagccatga

SEQ ID NO: 5203614 - DNA, 19 bp, Homo sapiens
aggatgaagaacacagcat

SEQ ID NO: 5203615 - DNA, 13 bp, Homo sapiens
aggatgaaggaag

SEQ ID NO: 5203616 - DNA, 19 bp, Homo sapiens
aggatgaatgaggtcccag

SEQ ID NO: 5203617 - DNA, 12 bp, Homo sapiens
aggatgaatgta

SEQ ID NO: 5203618 - DNA, 17 bp, Homo sapiens
aggatgaattttctgca

SEQ ID NO: 5203619 - DNA, 20 bp, Homo sapiens
aggatgaattttctgcagct

SEQ ID NO: 5203620 - DNA, 19 bp, Homo sapiens
aggatgacaggctctcctg

SEQ ID NO: 5203621 - DNA, 16 bp, Homo sapiens
aggatgaccaggacta

SEQ ID NO: 5203622 - DNA, 20 bp, Homo sapiens
aggatgacggtattatgctt

SEQ ID NO: 5203623 - DNA, 23 bp, Homo sapiens
aggatgacggtattatgcttctt

SEQ ID NO: 5203624 - DNA, 23 bp, Homo sapiens
aggatgactaacaagatttgtaa

SEQ ID NO: 5203625 - DNA, 11 bp, Homo sapiens
aggatgacttt

SEQ ID NO: 5203626 - DNA, 19 bp, Homo sapiens
aggatgactttttttctga

SEQ ID NO: 5203627 - DNA, 15 bp, Homo sapiens
aggatgagaatgtga

SEQ ID NO: 5203628 - DNA, 16 bp, Homo sapiens
aggatgagaatgtgac

SEQ ID NO: 5203629 - DNA, 17 bp, Homo sapiens
aggatgagacccagccc

SEQ ID NO: 5203630 - DNA, 19 bp, Homo sapiens
aggatgagacccagcccct

SEQ ID NO: 5203631 - DNA, 19 bp, Homo sapiens
aggatgagagcccagaggt

SEQ ID NO: 5203632 - DNA, 16 bp, Homo sapiens
aggatgagcaaaacat

SEQ ID NO: 5203633 - DNA, 13 bp, Homo sapiens
aggatgagcagca

SEQ ID NO: 5203634 - DNA, 19 bp, Homo sapiens
aggatgagctctacccagg

SEQ ID NO: 5203635 - DNA, 13 bp, Homo sapiens
aggatgagctgga

SEQ ID NO: 5203636 - DNA, 13 bp, Homo sapiens
aggatgaggcccc

SEQ ID NO: 5203637 - DNA, 14 bp, Homo sapiens
aggatgaggccccg

SEQ ID NO: 5203638 - DNA, 18 bp, Homo sapiens
aggatgaggccccgcctt

SEQ ID NO: 5203639 - DNA, 13 bp, Homo sapiens
aggatgagggaag

SEQ ID NO: 5203640 - DNA, 14 bp, Homo sapiens
aggatgagggaagc

SEQ ID NO: 5203641 - DNA, 14 bp, Homo sapiens
aggatgaggtctcg

SEQ ID NO: 5203642 - DNA, 19 bp, Homo sapiens
aggatgaggtctcgaccct

SEQ ID NO: 5203643 - DNA, 18 bp, Homo sapiens
aggatgataagttccttt

SEQ ID NO: 5203644 - DNA, 16 bp, Homo sapiens
aggatgatctaggaag

SEQ ID NO: 5203645 - DNA, 20 bp, Homo sapiens
aggatgatctaggaagactt

SEQ ID NO: 5203646 - DNA, 23 bp, Homo sapiens
aggatgatctaggaagactttgg

SEQ ID NO: 5203647 - DNA, 14 bp, Homo sapiens
aggatgatggaaaa

SEQ ID NO: 5203648 - DNA, 14 bp, Homo sapiens
aggatgatgtaatt

SEQ ID NO: 5203649 - DNA, 15 bp, Homo sapiens
aggatgattgtacag

SEQ ID NO: 5203650 - DNA, 16 bp, Homo sapiens
aggatgcacatataca

SEQ ID NO: 5203651 - DNA, 17 bp, Homo sapiens
aggatgcactggcctgt

SEQ ID NO: 5203652 - DNA, 18 bp, Homo sapiens
aggatgcagagtcagcag

SEQ ID NO: 5203653 - DNA, 17 bp, Homo sapiens
aggatgcatattaaaga

SEQ ID NO: 5203654 - DNA, 19 bp, Homo sapiens
aggatgcatgcagggcccc

SEQ ID NO: 5203655 - DNA, 17 bp, Homo sapiens
aggatgcattctgatag

SEQ ID NO: 5203656 - DNA, 13 bp, Homo sapiens
aggatgccacagc

SEQ ID NO: 5203657 - DNA, 14 bp, Homo sapiens
aggatgccacagcc

SEQ ID NO: 5203658 - DNA, 18 bp, Homo sapiens
aggatgccacagccccac

SEQ ID NO: 5203659 - DNA, 19 bp, Homo sapiens
aggatgccacagccccaca

SEQ ID NO: 5203660 - DNA, 16 bp, Homo sapiens
aggatgccacgcctgg

SEQ ID NO: 5203661 - DNA, 16 bp, Homo sapiens
aggatgccagcccctg

SEQ ID NO: 5203662 - DNA, 17 bp, Homo sapiens
aggatgccagcccctgc

SEQ ID NO: 5203663 - DNA, 22 bp, Homo sapiens
aggatgccagcccctgcctggg

SEQ ID NO: 5203664 - DNA, 14 bp, Homo sapiens
aggatgcccaaaga

SEQ ID NO: 5203665 - DNA, 19 bp, Homo sapiens
aggatgcccagacatcagc

SEQ ID NO: 5203666 - DNA, 17 bp, Homo sapiens
aggatgcctgagccccc

SEQ ID NO: 5203667 - DNA, 16 bp, Homo sapiens
aggatgccttttctgt

SEQ ID NO: 5203668 - DNA, 17 bp, Homo sapiens
aggatgccttttctgtg

SEQ ID NO: 5203669 - DNA, 18 bp, Homo sapiens
aggatgcggctttctctg

SEQ ID NO: 5203670 - DNA, 20 bp, Homo sapiens
aggatgcggctttctctgcc

SEQ ID NO: 5203671 - DNA, 24 bp, Homo sapiens
aggatgcggctttctctgcctctg

SEQ ID NO: 5203672 - DNA, 15 bp, Homo sapiens
aggatgctaaagatg

SEQ ID NO: 5203673 - DNA, 19 bp, Homo sapiens
aggatgctaacatctaaaa

SEQ ID NO: 5203674 - DNA, 22 bp, Homo sapiens
aggatgctaacatctaaaaata

SEQ ID NO: 5203675 - DNA, 22 bp, Homo sapiens
aggatgctcccccagggaagaa

SEQ ID NO: 5203676 - DNA, 13 bp, Homo sapiens
aggatgctctttc

SEQ ID NO: 5203677 - DNA, 21 bp, Homo sapiens
aggatgctctttcccaggacg

SEQ ID NO: 5203678 - DNA, 18 bp, Homo sapiens
aggatgctctttcccttt

SEQ ID NO: 5203679 - DNA, 22 bp, Homo sapiens
aggatgctgacatcatttgtat

SEQ ID NO: 5203680 - DNA, 13 bp, Homo sapiens
aggatgctgagct

SEQ ID NO: 5203681 - DNA, 21 bp, Homo sapiens
aggatgctgctgttgaagctt

SEQ ID NO: 5203682 - DNA, 13 bp, Homo sapiens
aggatgctgggtg

SEQ ID NO: 5203683 - DNA, 14 bp, Homo sapiens
aggatgctgggtgg

SEQ ID NO: 5203684 - DNA, 13 bp, Homo sapiens
aggatgctgtcag

SEQ ID NO: 5203685 - DNA, 18 bp, Homo sapiens
aggatgctgtgcctccca

SEQ ID NO: 5203686 - DNA, 22 bp, Homo sapiens
aggatgcttagtcttaaaataa

SEQ ID NO: 5203687 - DNA, 23 bp, Homo sapiens
aggatgcttgtacataatgcgtg

SEQ ID NO: 5203688 - DNA, 14 bp, Homo sapiens
aggatggaagaaag

SEQ ID NO: 5203689 - DNA, 15 bp, Homo sapiens
aggatggaagaaaga

SEQ ID NO: 5203690 - DNA, 20 bp, Homo sapiens
aggatggaagaaagaagcat

SEQ ID NO: 5203691 - DNA, 22 bp, Homo sapiens
aggatggacgaacaggggccaa

SEQ ID NO: 5203692 - DNA, 15 bp, Homo sapiens
aggatggagagaggg

SEQ ID NO: 5203693 - DNA, 19 bp, Homo sapiens
aggatggagcaagctcttc

SEQ ID NO: 5203694 - DNA, 21 bp, Homo sapiens
aggatggatgagtcagacacg

SEQ ID NO: 5203695 - DNA, 12 bp, Homo sapiens
aggatggatggc

SEQ ID NO: 5203696 - DNA, 19 bp, Homo sapiens
aggatggattgcagtcccc

SEQ ID NO: 5203697 - DNA, 15 bp, Homo sapiens
aggatggcaggacgt

SEQ ID NO: 5203698 - DNA, 12 bp, Homo sapiens
aggatggcctgg

SEQ ID NO: 5203699 - DNA, 14 bp, Homo sapiens
aggatggcctggaa

SEQ ID NO: 5203700 - DNA, 13 bp, Homo sapiens
aggatggcctggc

SEQ ID NO: 5203701 - DNA, 17 bp, Homo sapiens
aggatggcctggccagg

SEQ ID NO: 5203702 - DNA, 20 bp, Homo sapiens
aggatggcctttccttccct

SEQ ID NO: 5203703 - DNA, 21 bp, Homo sapiens
aggatggcctttccttccctc

SEQ ID NO: 5203704 - DNA, 22 bp, Homo sapiens
aggatggcctttccttccctct

SEQ ID NO: 5203705 - DNA, 14 bp, Homo sapiens
aggatggcgtgtcc

SEQ ID NO: 5203706 - DNA, 18 bp, Homo sapiens
aggatggcgtgtcccctg

SEQ ID NO: 5203707 - DNA, 18 bp, Homo sapiens
aggatggctttgaatgcg

SEQ ID NO: 5203708 - DNA, 17 bp, Homo sapiens
aggatgggaaggaggga

SEQ ID NO: 5203709 - DNA, 15 bp, Homo sapiens
aggatgggaatcagg

SEQ ID NO: 5203710 - DNA, 17 bp, Homo sapiens
aggatgggatctttctg

SEQ ID NO: 5203711 - DNA, 17 bp, Homo sapiens
aggatgggatgggttcc

SEQ ID NO: 5203712 - DNA, 20 bp, Homo sapiens
aggatgggatgggttccaga

SEQ ID NO: 5203713 - DNA, 21 bp, Homo sapiens
aggatgggatgggttccagag

SEQ ID NO: 5203714 - DNA, 20 bp, Homo sapiens
aggatgggcataagcaaact

SEQ ID NO: 5203715 - DNA, 20 bp, Homo sapiens
aggatgggcatggtgttctc

SEQ ID NO: 5203716 - DNA, 24 bp, Homo sapiens
agctgcactttaaccctagaaggt

SEQ ID NO: 5203717 - DNA, 11 bp, Homo sapiens
agctgcagaac

SEQ ID NO: 5203718 - DNA, 18 bp, Homo sapiens
agctgcagaaccagtccc

SEQ ID NO: 5203719 - DNA, 19 bp, Homo sapiens
agctgcagaccatgccaga

SEQ ID NO: 5203720 - DNA, 15 bp, Homo sapiens
agctgcagagacaga

SEQ ID NO: 5203721 - DNA, 18 bp, Homo sapiens
agctgcagagacagagag

SEQ ID NO: 5203722 - DNA, 19 bp, Homo sapiens
agctgcagagagcacctgg

SEQ ID NO: 5203723 - DNA, 22 bp, Homo sapiens
agctgcagagagcacctggtgg

SEQ ID NO: 5203724 - DNA, 19 bp, Homo sapiens
agctgcagataagtggcct

SEQ ID NO: 5203725 - DNA, 17 bp, Homo sapiens
agctgcagatgcctctg

SEQ ID NO: 5203726 - DNA, 13 bp, Homo sapiens
agctgcagcccat

SEQ ID NO: 5203727 - DNA, 18 bp, Homo sapiens
agctgcagcctggttggc

SEQ ID NO: 5203728 - DNA, 21 bp, Homo sapiens
agctgcagcctggttggcagc

SEQ ID NO: 5203729 - DNA, 22 bp, Homo sapiens
agctgcagcctggttggcagca

SEQ ID NO: 5203730 - DNA, 12 bp, Homo sapiens
agctgcagctgg

SEQ ID NO: 5203731 - DNA, 16 bp, Homo sapiens
agctgcagctgggccc

SEQ ID NO: 5203732 - DNA, 14 bp, Homo sapiens
agctgcagcttcct

SEQ ID NO: 5203733 - DNA, 22 bp, Homo sapiens
agctgcaggaatcaaaaattga

SEQ ID NO: 5203734 - DNA, 20 bp, Homo sapiens
agctgcaggcacacacgcct

SEQ ID NO: 5203735 - DNA, 12 bp, Homo sapiens
agctgcagggca

SEQ ID NO: 5203736 - DNA, 13 bp, Homo sapiens
agctgcagggcac

SEQ ID NO: 5203737 - DNA, 15 bp, Homo sapiens
agctgcaggtgccca

SEQ ID NO: 5203738 - DNA, 22 bp, Homo sapiens
agctgcaggtttgtaatgcaaa

SEQ ID NO: 5203739 - DNA, 13 bp, Homo sapiens
agctgcagtgagc

SEQ ID NO: 5203740 - DNA, 19 bp, Homo sapiens
agctgcagttagcacagag

SEQ ID NO: 5203741 - DNA, 20 bp, Homo sapiens
agctgcatcatccttgcagg

SEQ ID NO: 5203742 - DNA, 15 bp, Homo sapiens
agctgcatctactca

SEQ ID NO: 5203743 - DNA, 18 bp, Homo sapiens
agctgcatggacgcctgg

SEQ ID NO: 5203744 - DNA, 16 bp, Homo sapiens
agctgcatggagcctg

SEQ ID NO: 5203745 - DNA, 18 bp, Homo sapiens
agctgcatgttaagtgcc

SEQ ID NO: 5203746 - DNA, 19 bp, Homo sapiens
agctgcatgttaagtgcca

SEQ ID NO: 5203747 - DNA, 16 bp, Homo sapiens
agctgcattccagagc

SEQ ID NO: 5203748 - DNA, 15 bp, Homo sapiens
agctgcattccgcag

SEQ ID NO: 5203749 - DNA, 14 bp, Homo sapiens
agctgcatttaaat

SEQ ID NO: 5203750 - DNA, 17 bp, Homo sapiens
agctgcatttaaatcaa

SEQ ID NO: 5203751 - DNA, 18 bp, Homo sapiens
agctgcatttggggtggg

SEQ ID NO: 5203752 - DNA, 15 bp, Homo sapiens
agctgccaaaaagaa

SEQ ID NO: 5203753 - DNA, 16 bp, Homo sapiens
agctgccaagccccat

SEQ ID NO: 5203754 - DNA, 22 bp, Homo sapiens
agctgccaagtaaatagcaaca

SEQ ID NO: 5203755 - DNA, 14 bp, Homo sapiens
agctgccacattga

SEQ ID NO: 5203756 - DNA, 13 bp, Homo sapiens
agctgccacctgc

SEQ ID NO: 5203757 - DNA, 13 bp, Homo sapiens
agctgccagcacc

SEQ ID NO: 5203758 - DNA, 14 bp, Homo sapiens
agctgccagcacca

SEQ ID NO: 5203759 - DNA, 20 bp, Homo sapiens
agctgccaggcggccctggg

SEQ ID NO: 5203760 - DNA, 12 bp, Homo sapiens
agctgccaggga

SEQ ID NO: 5203761 - DNA, 15 bp, Homo sapiens
agctgccagggaaga

SEQ ID NO: 5203762 - DNA, 20 bp, Homo sapiens
agctgccagggaagacagag

SEQ ID NO: 5203763 - DNA, 19 bp, Homo sapiens
agctgccaggtgagaaact

SEQ ID NO: 5203764 - DNA, 18 bp, Homo sapiens
agctgccatccttgctgc

SEQ ID NO: 5203765 - DNA, 16 bp, Homo sapiens
agctgccatcttgctt

SEQ ID NO: 5203766 - DNA, 16 bp, Homo sapiens
agctgccatttccctt

SEQ ID NO: 5203767 - DNA, 17 bp, Homo sapiens
agctgcccacaagccat

SEQ ID NO: 5203768 - DNA, 14 bp, Homo sapiens
agctgcccagacac

SEQ ID NO: 5203769 - DNA, 14 bp, Homo sapiens
agctgcccagagtt

SEQ ID NO: 5203770 - DNA, 18 bp, Homo sapiens
agctgcccagagttgctg

SEQ ID NO: 5203771 - DNA, 15 bp, Homo sapiens
agctgcccagcccct

SEQ ID NO: 5203772 - DNA, 18 bp, Homo sapiens
agctgcccagcccctcct

SEQ ID NO: 5203773 - DNA, 22 bp, Homo sapiens
agctgcccagcccctcctccct

SEQ ID NO: 5203774 - DNA, 14 bp, Homo sapiens
agctgcccagccct

SEQ ID NO: 5203775 - DNA, 16 bp, Homo sapiens
agctgcccagccctgg

SEQ ID NO: 5203776 - DNA, 18 bp, Homo sapiens
agctgcccatcccagtcc

SEQ ID NO: 5203777 - DNA, 16 bp, Homo sapiens
agctgccccagccaga

SEQ ID NO: 5203778 - DNA, 19 bp, Homo sapiens
agctgcccccgctcatggg

SEQ ID NO: 5203779 - DNA, 16 bp, Homo sapiens
agctgccccggcccct

SEQ ID NO: 5203780 - DNA, 12 bp, Homo sapiens
agctgcccctcc

SEQ ID NO: 5203781 - DNA, 15 bp, Homo sapiens
agctgcccctcctgg

SEQ ID NO: 5203782 - DNA, 18 bp, Homo sapiens
agctgcccctcctggagc

SEQ ID NO: 5203783 - DNA, 23 bp, Homo sapiens
agctgcccctcctggagcagaaa

SEQ ID NO: 5203784 - DNA, 16 bp, Homo sapiens
agctgcccctctctgg

SEQ ID NO: 5203785 - DNA, 18 bp, Homo sapiens
agctgcccctctctgggc

SEQ ID NO: 5203786 - DNA, 17 bp, Homo sapiens
agctgcccctgctgctt

SEQ ID NO: 5203787 - DNA, 20 bp, Homo sapiens
agctgcccctggcacctgtg

SEQ ID NO: 5203788 - DNA, 16 bp, Homo sapiens
agctgcccggcgcctg

SEQ ID NO: 5203789 - DNA, 19 bp, Homo sapiens
agctgcccggcgcctgccc

SEQ ID NO: 5203790 - DNA, 20 bp, Homo sapiens
agctgcccggcgcctgccct

SEQ ID NO: 5203791 - DNA, 22 bp, Homo sapiens
agctgcccggcgcctgccctgc

SEQ ID NO: 5203792 - DNA, 15 bp, Homo sapiens
agctgccctagctga

SEQ ID NO: 5203793 - DNA, 18 bp, Homo sapiens
agctgccctagctgaccc

SEQ ID NO: 5203794 - DNA, 13 bp, Homo sapiens
agctgccctctcc

SEQ ID NO: 5203795 - DNA, 15 bp, Homo sapiens
agctgccctctcctg

SEQ ID NO: 5203796 - DNA, 16 bp, Homo sapiens
agctgccctctcctgg

SEQ ID NO: 5203797 - DNA, 12 bp, Homo sapiens
agctgccctgct

SEQ ID NO: 5203798 - DNA, 19 bp, Homo sapiens
agctgccctgctgccacag

SEQ ID NO: 5203799 - DNA, 21 bp, Homo sapiens
agctgccctgctgccacagca

SEQ ID NO: 5203800 - DNA, 13 bp, Homo sapiens
agctgccctggct

SEQ ID NO: 5203801 - DNA, 17 bp, Homo sapiens
agctgcccttgcagggt

SEQ ID NO: 5203802 - DNA, 15 bp, Homo sapiens
agctgccctttctca

SEQ ID NO: 5203803 - DNA, 16 bp, Homo sapiens
agctgccctttctcag

SEQ ID NO: 5203804 - DNA, 18 bp, Homo sapiens
agctgccgaccagagccc

SEQ ID NO: 5203805 - DNA, 22 bp, Homo sapiens
agctgccgcaccagcccgaaca

SEQ ID NO: 5203806 - DNA, 18 bp, Homo sapiens
agctgccgcccccggact

SEQ ID NO: 5203807 - DNA, 22 bp, Homo sapiens
agctgccgtgcctgtgtcctga

SEQ ID NO: 5203808 - DNA, 13 bp, Homo sapiens
agctgcctaccta

SEQ ID NO: 5203809 - DNA, 22 bp, Homo sapiens
agctgcctagcaagctggcctc

SEQ ID NO: 5203810 - DNA, 22 bp, Homo sapiens
agctgcctaggtcccccaagca

SEQ ID NO: 5203811 - DNA, 14 bp, Homo sapiens
agctgcctccagcc

SEQ ID NO: 5203812 - DNA, 16 bp, Homo sapiens
agctgcctccagcctg

SEQ ID NO: 5203813 - DNA, 16 bp, Homo sapiens
agctgcctccccaatc

SEQ ID NO: 5203814 - DNA, 17 bp, Homo sapiens
agctgcctcccctcctc

SEQ ID NO: 5203815 - DNA, 19 bp, Homo sapiens
agctgcctcccctcctctg

SEQ ID NO: 5203816 - DNA, 22 bp, Homo sapiens
agctgcctcccctcctctgctt

SEQ ID NO: 5203817 - DNA, 20 bp, Homo sapiens
agctgcctctgacagcagcc

SEQ ID NO: 5203818 - DNA, 16 bp, Homo sapiens
agctgcctctgctccc

SEQ ID NO: 5203819 - DNA, 14 bp, Homo sapiens
agctgcctctttgc

SEQ ID NO: 5203820 - DNA, 19 bp, Homo sapiens
agctgcctctttgctgctt

SEQ ID NO: 5203821 - DNA, 19 bp, Homo sapiens
agctgcctgaaaatcaaga

SEQ ID NO: 5203822 - DNA, 18 bp, Homo sapiens
agctgcctgaaacagcca

SEQ ID NO: 5203823 - DNA, 10 bp, Homo sapiens
agctgcctgc

SEQ ID NO: 5203824 - DNA, 17 bp, Homo sapiens
agctgcctgctctgcag

SEQ ID NO: 5203825 - DNA, 18 bp, Homo sapiens
agctgcctgctctgcagc

SEQ ID NO: 5203826 - DNA, 19 bp, Homo sapiens
agctgcctgctctgcagcc

SEQ ID NO: 5203827 - DNA, 20 bp, Homo sapiens
agctgcctgctctgcagccc

SEQ ID NO: 5203828 - DNA, 21 bp, Homo sapiens
agctgcctggaagagcagccc

SEQ ID NO: 5203829 - DNA, 13 bp, Homo sapiens
agctgcctggacc

SEQ ID NO: 5203830 - DNA, 12 bp, Homo sapiens
agctgcctggag

SEQ ID NO: 5203831 - DNA, 14 bp, Homo sapiens
agctgcctggccat

SEQ ID NO: 5203832 - DNA, 17 bp, Homo sapiens
agctgcctggccatgct

SEQ ID NO: 5203833 - DNA, 19 bp, Homo sapiens
agctgcctgggatccctca

SEQ ID NO: 5203834 - DNA, 13 bp, Homo sapiens
agctgcctgggcc

SEQ ID NO: 5203835 - DNA, 15 bp, Homo sapiens
agctgcctgggcccg

SEQ ID NO: 5203836 - DNA, 13 bp, Homo sapiens
agctgcctggggc

SEQ ID NO: 5203837 - DNA, 14 bp, Homo sapiens
agctgcctggggcc

SEQ ID NO: 5203838 - DNA, 15 bp, Homo sapiens
agctgcctggggccc

SEQ ID NO: 5203839 - DNA, 16 bp, Homo sapiens
agctgcctggggccca

SEQ ID NO: 5203840 - DNA, 15 bp, Homo sapiens
agctgcctggtatat

SEQ ID NO: 5203841 - DNA, 10 bp, Homo sapiens
agctgcctgt

SEQ ID NO: 5203842 - DNA, 15 bp, Homo sapiens
agctgcctgtagtta

SEQ ID NO: 5203843 - DNA, 15 bp, Homo sapiens
agctgcctgtgccat

SEQ ID NO: 5203844 - DNA, 16 bp, Homo sapiens
agctgcctgtgccatg

SEQ ID NO: 5203845 - DNA, 19 bp, Homo sapiens
agctgcctgtgccatgccc

SEQ ID NO: 5203846 - DNA, 13 bp, Homo sapiens
agctgcctgttca

SEQ ID NO: 5203847 - DNA, 17 bp, Homo sapiens
agctgccttagcttcag

SEQ ID NO: 5203848 - DNA, 17 bp, Homo sapiens
agctgccttccctagct

SEQ ID NO: 5203849 - DNA, 22 bp, Homo sapiens
agctgccttgagccttaaaacc

SEQ ID NO: 5203850 - DNA, 17 bp, Homo sapiens
agctgccttggctcaga

SEQ ID NO: 5203851 - DNA, 17 bp, Homo sapiens
agctgcggccaggcctg

SEQ ID NO: 5203852 - DNA, 18 bp, Homo sapiens
agctgcggccaggcctgc

SEQ ID NO: 5203853 - DNA, 22 bp, Homo sapiens
agctgcgggctccctggcagga

SEQ ID NO: 5203854 - DNA, 14 bp, Homo sapiens
agctgcgggctgag

SEQ ID NO: 5203855 - DNA, 18 bp, Homo sapiens
agctgcgggctgagggca

SEQ ID NO: 5203856 - DNA, 18 bp, Homo sapiens
agctgcgggtctgaagga

SEQ ID NO: 5203857 - DNA, 13 bp, Homo sapiens
agctgcggtccac

SEQ ID NO: 5203858 - DNA, 16 bp, Homo sapiens
agctgcggtccaccca

SEQ ID NO: 5203859 - DNA, 21 bp, Homo sapiens
agctgcggtccacccaggagc

SEQ ID NO: 5203860 - DNA, 14 bp, Homo sapiens
agctgcgtcataag

SEQ ID NO: 5203861 - DNA, 20 bp, Homo sapiens
agctgcgtttttttatagta

SEQ ID NO: 5203862 - DNA, 23 bp, Homo sapiens
agctgctaactacatgaacacaa

SEQ ID NO: 5203863 - DNA, 18 bp, Homo sapiens
agctgctaagctaaagaa

SEQ ID NO: 5203864 - DNA, 19 bp, Homo sapiens
agctgctaagctaaagaaa

SEQ ID NO: 5203865 - DNA, 14 bp, Homo sapiens
agctgctaccttct

SEQ ID NO: 5203866 - DNA, 15 bp, Homo sapiens
agctgctatagcctg

SEQ ID NO: 5203867 - DNA, 21 bp, Homo sapiens
agctgctatagcctggggtgg

SEQ ID NO: 5203868 - DNA, 22 bp, Homo sapiens
agctgctatccccatctccctg

SEQ ID NO: 5203869 - DNA, 23 bp, Homo sapiens
agctgctatgctaaacctcctgc

SEQ ID NO: 5203870 - DNA, 19 bp, Homo sapiens
agctgctatttattttcct

SEQ ID NO: 5203871 - DNA, 20 bp, Homo sapiens
agctgctatttattttccta

SEQ ID NO: 5203872 - DNA, 14 bp, Homo sapiens
agctgctcaaatca

SEQ ID NO: 5203873 - DNA, 20 bp, Homo sapiens
agctgctcaacttgcaaaat

SEQ ID NO: 5203874 - DNA, 23 bp, Homo sapiens
agctgctcactacctcctcaggg

SEQ ID NO: 5203875 - DNA, 19 bp, Homo sapiens
agctgctcagatcccactt

SEQ ID NO: 5203876 - DNA, 14 bp, Homo sapiens
agctgctccccacg

SEQ ID NO: 5203877 - DNA, 13 bp, Homo sapiens
agctgctccccag

SEQ ID NO: 5203878 - DNA, 12 bp, Homo sapiens
agctgctcccct

SEQ ID NO: 5203879 - DNA, 19 bp, Homo sapiens
agctgctcccctccctcct

SEQ ID NO: 5203880 - DNA, 14 bp, Homo sapiens
agctgctcccctgc

SEQ ID NO: 5203881 - DNA, 18 bp, Homo sapiens
agctgctcccctgccacg

SEQ ID NO: 5203882 - DNA, 16 bp, Homo sapiens
agctgctcccctggag

SEQ ID NO: 5203883 - DNA, 13 bp, Homo sapiens
agctgctcctaga

SEQ ID NO: 5203884 - DNA, 18 bp, Homo sapiens
agctgctcctagagggag

SEQ ID NO: 5203885 - DNA, 22 bp, Homo sapiens
agctgctcctagagggaggggc

SEQ ID NO: 5203886 - DNA, 21 bp, Homo sapiens
agctgctcctttaccctcttg

SEQ ID NO: 5203887 - DNA, 18 bp, Homo sapiens
agctgctctaagcccagg

SEQ ID NO: 5203888 - DNA, 19 bp, Homo sapiens
agctgctctaagcccagga

SEQ ID NO: 5203889 - DNA, 15 bp, Homo sapiens
agctgctctccttca

SEQ ID NO: 5203890 - DNA, 14 bp, Homo sapiens
agctgctctgaggt

SEQ ID NO: 5203891 - DNA, 12 bp, Homo sapiens
agctgctctgcc

SEQ ID NO: 5203892 - DNA, 16 bp, Homo sapiens
agctgctctgcccaga

SEQ ID NO: 5203893 - DNA, 17 bp, Homo sapiens
agctgctctgcccagag

SEQ ID NO: 5203894 - DNA, 21 bp, Homo sapiens
agctgctctgcccagagctgg

SEQ ID NO: 5203895 - DNA, 17 bp, Homo sapiens
agctgctctgccccttg

SEQ ID NO: 5203896 - DNA, 19 bp, Homo sapiens
aggatgggccaaacccaga

SEQ ID NO: 5203897 - DNA, 22 bp, Homo sapiens
aggatgggctgagctagcctcc

SEQ ID NO: 5203898 - DNA, 18 bp, Homo sapiens
aggatggggaggggctct

SEQ ID NO: 5203899 - DNA, 19 bp, Homo sapiens
aggatgggggagaggggga

SEQ ID NO: 5203900 - DNA, 15 bp, Homo sapiens
aggatgggggctcct

SEQ ID NO: 5203901 - DNA, 19 bp, Homo sapiens
aggatgggggctggcctct

SEQ ID NO: 5203902 - DNA, 17 bp, Homo sapiens
aggatggggttctggaa

SEQ ID NO: 5203903 - DNA, 16 bp, Homo sapiens
aggatgggtcagagct

SEQ ID NO: 5203904 - DNA, 21 bp, Homo sapiens
aggatgggtgaaaccacatgg

SEQ ID NO: 5203905 - DNA, 21 bp, Homo sapiens
aggatggtaattcttattctt

SEQ ID NO: 5203906 - DNA, 21 bp, Homo sapiens
aggatggtctcgatctcctga

SEQ ID NO: 5203907 - DNA, 18 bp, Homo sapiens
aggatggtcttacagcag

SEQ ID NO: 5203908 - DNA, 22 bp, Homo sapiens
aggatggtcttgatctcctgag

SEQ ID NO: 5203909 - DNA, 15 bp, Homo sapiens
aggatggtgcaggat

SEQ ID NO: 5203910 - DNA, 21 bp, Homo sapiens
aggatggtgctgagtaaacat

SEQ ID NO: 5203911 - DNA, 24 bp, Homo sapiens
aggatggtggcaggaaaatggaca

SEQ ID NO: 5203912 - DNA, 15 bp, Homo sapiens
aggatggtggggccc

SEQ ID NO: 5203913 - DNA, 17 bp, Homo sapiens
aggatggtgtcctgagg

SEQ ID NO: 5203914 - DNA, 23 bp, Homo sapiens
aggatggttcccttgatgaagaa

SEQ ID NO: 5203915 - DNA, 16 bp, Homo sapiens
aggatggttctgtgac

SEQ ID NO: 5203916 - DNA, 23 bp, Homo sapiens
aggatggttttgggactagaggc

SEQ ID NO: 5203917 - DNA, 21 bp, Homo sapiens
aggatgtaaggccttagccat

SEQ ID NO: 5203918 - DNA, 21 bp, Homo sapiens
aggatgtactgttgaaaaaga

SEQ ID NO: 5203919 - DNA, 18 bp, Homo sapiens
aggatgtagcttttcacc

SEQ ID NO: 5203920 - DNA, 22 bp, Homo sapiens
aggatgtagttctgccaggcaa

SEQ ID NO: 5203921 - DNA, 21 bp, Homo sapiens
aggatgtatattttatataaa

SEQ ID NO: 5203922 - DNA, 17 bp, Homo sapiens
aggatgtccctgggcca

SEQ ID NO: 5203923 - DNA, 21 bp, Homo sapiens
aggatgtccctgggccagggt

SEQ ID NO: 5203924 - DNA, 23 bp, Homo sapiens
aggatgtccctgggccagggtct

SEQ ID NO: 5203925 - DNA, 20 bp, Homo sapiens
aggatgtccgttccaggagc

SEQ ID NO: 5203926 - DNA, 19 bp, Homo sapiens
aggatgtcctttgtgtcca

SEQ ID NO: 5203927 - DNA, 13 bp, Homo sapiens
aggatgtctgggc

SEQ ID NO: 5203928 - DNA, 18 bp, Homo sapiens
aggatgtgatatataagt

SEQ ID NO: 5203929 - DNA, 21 bp, Homo sapiens
aggatgtgatatataagtgta

SEQ ID NO: 5203930 - DNA, 16 bp, Homo sapiens
aggatgtggaaagcac

SEQ ID NO: 5203931 - DNA, 16 bp, Homo sapiens
aggatgtggaagagca

SEQ ID NO: 5203932 - DNA, 16 bp, Homo sapiens
aggatgtggatggagg

SEQ ID NO: 5203933 - DNA, 21 bp, Homo sapiens
aggatgtggcacaaagttggt

SEQ ID NO: 5203934 - DNA, 14 bp, Homo sapiens
aggatgtggcactg

SEQ ID NO: 5203935 - DNA, 17 bp, Homo sapiens
aggatgtggcaggggca

SEQ ID NO: 5203936 - DNA, 21 bp, Homo sapiens
aggatgtggcaggggcagtgg

SEQ ID NO: 5203937 - DNA, 14 bp, Homo sapiens
aggatgtgggcagc

SEQ ID NO: 5203938 - DNA, 15 bp, Homo sapiens
aggatgtgggcagct

SEQ ID NO: 5203939 - DNA, 21 bp, Homo sapiens
aggatgtgtcccatctaggga

SEQ ID NO: 5203940 - DNA, 19 bp, Homo sapiens
aggatgtgtttgctttctg

SEQ ID NO: 5203941 - DNA, 20 bp, Homo sapiens
aggatgttaacttggttctc

SEQ ID NO: 5203942 - DNA, 19 bp, Homo sapiens
aggatgttgctccatcctt

SEQ ID NO: 5203943 - DNA, 20 bp, Homo sapiens
aggatgttgcttctgaatca

SEQ ID NO: 5203944 - DNA, 20 bp, Homo sapiens
aggatgtttagcagtggctg

SEQ ID NO: 5203945 - DNA, 21 bp, Homo sapiens
aggatgtttagcagtggctgg

SEQ ID NO: 5203946 - DNA, 22 bp, Homo sapiens
aggatgttttgtcccatttcct

SEQ ID NO: 5203947 - DNA, 23 bp, Homo sapiens
aggatgttttgtcccatttcctt

SEQ ID NO: 5203948 - DNA, 20 bp, Homo sapiens
aggattaaaatggatttaat

SEQ ID NO: 5203949 - DNA, 13 bp, Homo sapiens
aggattaaacaca

SEQ ID NO: 5203950 - DNA, 17 bp, Homo sapiens
aggattaactaaagaag

SEQ ID NO: 5203951 - DNA, 21 bp, Homo sapiens
aggattaagatacactcctgc

SEQ ID NO: 5203952 - DNA, 23 bp, Homo sapiens
aggattaagggacgggggtggga

SEQ ID NO: 5203953 - DNA, 20 bp, Homo sapiens
aggattaatctctaaaattc

SEQ ID NO: 5203954 - DNA, 13 bp, Homo sapiens
aggattaatttat

SEQ ID NO: 5203955 - DNA, 16 bp, Homo sapiens
aggattacagaaactg

SEQ ID NO: 5203956 - DNA, 17 bp, Homo sapiens
aggattacagaaactga

SEQ ID NO: 5203957 - DNA, 19 bp, Homo sapiens
aggattacagaaactgatg

SEQ ID NO: 5203958 - DNA, 15 bp, Homo sapiens
aggattacaggcctt

SEQ ID NO: 5203959 - DNA, 15 bp, Homo sapiens
aggattagaaaattt

SEQ ID NO: 5203960 - DNA, 22 bp, Homo sapiens
aggattagacagtaagagttta

SEQ ID NO: 5203961 - DNA, 13 bp, Homo sapiens
aggattaggcaaa

SEQ ID NO: 5203962 - DNA, 15 bp, Homo sapiens
aggattagtttagaa

SEQ ID NO: 5203963 - DNA, 17 bp, Homo sapiens
aggattagtttagaaca

SEQ ID NO: 5203964 - DNA, 15 bp, Homo sapiens
aggattatggaaaaa

SEQ ID NO: 5203965 - DNA, 24 bp, Homo sapiens
aggattattactaattctatttct

SEQ ID NO: 5203966 - DNA, 14 bp, Homo sapiens
aggattattggaaa

SEQ ID NO: 5203967 - DNA, 19 bp, Homo sapiens
aggattatttagaatatgt

SEQ ID NO: 5203968 - DNA, 17 bp, Homo sapiens
aggattcacaccccacc

SEQ ID NO: 5203969 - DNA, 20 bp, Homo sapiens
aggattcacaccccacctgc

SEQ ID NO: 5203970 - DNA, 21 bp, Homo sapiens
aggattcacaccccacctgcg

SEQ ID NO: 5203971 - DNA, 14 bp, Homo sapiens
aggattcagccgga

SEQ ID NO: 5203972 - DNA, 16 bp, Homo sapiens
aggattcaggcctctg

SEQ ID NO: 5203973 - DNA, 20 bp, Homo sapiens
aggattcaggcctctgagga

SEQ ID NO: 5203974 - DNA, 15 bp, Homo sapiens
aggattcaggggctg

SEQ ID NO: 5203975 - DNA, 19 bp, Homo sapiens
aggattccaaagttttgaa

SEQ ID NO: 5203976 - DNA, 13 bp, Homo sapiens
aggattcccagag

SEQ ID NO: 5203977 - DNA, 17 bp, Homo sapiens
aggattccccctgccct

SEQ ID NO: 5203978 - DNA, 23 bp, Homo sapiens
aggattccccctgccctgtgccg

SEQ ID NO: 5203979 - DNA, 14 bp, Homo sapiens
aggattcccttctg

SEQ ID NO: 5203980 - DNA, 18 bp, Homo sapiens
aggattcctctctcaggt

SEQ ID NO: 5203981 - DNA, 15 bp, Homo sapiens
aggattcctcttttc

SEQ ID NO: 5203982 - DNA, 14 bp, Homo sapiens
aggattctaaaatg

SEQ ID NO: 5203983 - DNA, 22 bp, Homo sapiens
aggattctcaccagctgtgtcc

SEQ ID NO: 5203984 - DNA, 14 bp, Homo sapiens
aggattctcctttt

SEQ ID NO: 5203985 - DNA, 15 bp, Homo sapiens
aggattctctgcagc

SEQ ID NO: 5203986 - DNA, 13 bp, Homo sapiens
aggattctgctgg

SEQ ID NO: 5203987 - DNA, 21 bp, Homo sapiens
aggattctgctggcctctgcg

SEQ ID NO: 5203988 - DNA, 20 bp, Homo sapiens
aggattctgtgcctccagga

SEQ ID NO: 5203989 - DNA, 21 bp, Homo sapiens
aggattctgttctgcaactcc

SEQ ID NO: 5203990 - DNA, 16 bp, Homo sapiens
aggattcttcctccct

SEQ ID NO: 5203991 - DNA, 18 bp, Homo sapiens
aggattctttccccagag

SEQ ID NO: 5203992 - DNA, 22 bp, Homo sapiens
aggattcttttttcaatgtact

SEQ ID NO: 5203993 - DNA, 21 bp, Homo sapiens
aggattgaaaatgtccaggaa

SEQ ID NO: 5203994 - DNA, 15 bp, Homo sapiens
aggattgaaagggag

SEQ ID NO: 5203995 - DNA, 14 bp, Homo sapiens
aggattgaagagca

SEQ ID NO: 5203996 - DNA, 22 bp, Homo sapiens
aggattgaagagcattgcatgg

SEQ ID NO: 5203997 - DNA, 20 bp, Homo sapiens
aggattgacattctacagtt

SEQ ID NO: 5203998 - DNA, 17 bp, Homo sapiens
aggattgattatgcaga

SEQ ID NO: 5203999 - DNA, 22 bp, Homo sapiens
aggattgccaggtatttttcta

SEQ ID NO: 5204000 - DNA, 13 bp, Homo sapiens
aggattgcctttg

SEQ ID NO: 5204001 - DNA, 15 bp, Homo sapiens
aggattgcgagagat

SEQ ID NO: 5204002 - DNA, 21 bp, Homo sapiens
aggattgcgagagatgtgtgt

SEQ ID NO: 5204003 - DNA, 13 bp, Homo sapiens
aggattgctgcca

SEQ ID NO: 5204004 - DNA, 24 bp, Homo sapiens
aggattgctgccagagaagtctgg

SEQ ID NO: 5204005 - DNA, 19 bp, Homo sapiens
aggattgcttgagcccagg

SEQ ID NO: 5204006 - DNA, 21 bp, Homo sapiens
aggattgcttgagcccaggag

SEQ ID NO: 5204007 - DNA, 22 bp, Homo sapiens
aggattggatgttgtgtattgt

SEQ ID NO: 5204008 - DNA, 23 bp, Homo sapiens
aggattggcacaagctccctggt

SEQ ID NO: 5204009 - DNA, 15 bp, Homo sapiens
aggattggcctgtgt

SEQ ID NO: 5204010 - DNA, 17 bp, Homo sapiens
aggattggcctgtgtct

SEQ ID NO: 5204011 - DNA, 13 bp, Homo sapiens
aggattgggccaa

SEQ ID NO: 5204012 - DNA, 21 bp, Homo sapiens
aggattggggaagagagcctg

SEQ ID NO: 5204013 - DNA, 19 bp, Homo sapiens
aggattgggggatgtgaag

SEQ ID NO: 5204014 - DNA, 23 bp, Homo sapiens
aggattgtaaaaaaaaatgcctt

SEQ ID NO: 5204015 - DNA, 18 bp, Homo sapiens
aggattgtacgtgggaga

SEQ ID NO: 5204016 - DNA, 20 bp, Homo sapiens
aggattgtctggggccgagg

SEQ ID NO: 5204017 - DNA, 12 bp, Homo sapiens
aggattgtgctg

SEQ ID NO: 5204018 - DNA, 20 bp, Homo sapiens
aggattgttgaatctatttc

SEQ ID NO: 5204019 - DNA, 16 bp, Homo sapiens
aggatttaaaaactgg

SEQ ID NO: 5204020 - DNA, 19 bp, Homo sapiens
aggatttaaaaactggaac

SEQ ID NO: 5204021 - DNA, 21 bp, Homo sapiens
aggatttaacagtcatttaaa

SEQ ID NO: 5204022 - DNA, 15 bp, Homo sapiens
aggatttataaagca

SEQ ID NO: 5204023 - DNA, 19 bp, Homo sapiens
aggatttatgtattttgaa

SEQ ID NO: 5204024 - DNA, 14 bp, Homo sapiens
aggatttcaagcct

SEQ ID NO: 5204025 - DNA, 15 bp, Homo sapiens
aggatttcaagcctg

SEQ ID NO: 5204026 - DNA, 18 bp, Homo sapiens
aggatttcaccagaagtt

SEQ ID NO: 5204027 - DNA, 20 bp, Homo sapiens
aggatttcatgatttcattt

SEQ ID NO: 5204028 - DNA, 17 bp, Homo sapiens
aggatttcctggagtgc

SEQ ID NO: 5204029 - DNA, 14 bp, Homo sapiens
aggatttctgctta

SEQ ID NO: 5204030 - DNA, 12 bp, Homo sapiens
aggatttctggg

SEQ ID NO: 5204031 - DNA, 19 bp, Homo sapiens
aggatttcttattttcttg

SEQ ID NO: 5204032 - DNA, 15 bp, Homo sapiens
aggatttgaaaacac

SEQ ID NO: 5204033 - DNA, 16 bp, Homo sapiens
aggatttgacagcatt

SEQ ID NO: 5204034 - DNA, 19 bp, Homo sapiens
aggatttgatgcttttctc

SEQ ID NO: 5204035 - DNA, 22 bp, Homo sapiens
aggatttggccacactggggct

SEQ ID NO: 5204036 - DNA, 19 bp, Homo sapiens
aggatttggtttttctctt

SEQ ID NO: 5204037 - DNA, 23 bp, Homo sapiens
aggatttgtgttttacagtatat

SEQ ID NO: 5204038 - DNA, 14 bp, Homo sapiens
aggattttaaacat

SEQ ID NO: 5204039 - DNA, 14 bp, Homo sapiens
aggattttaatttc

SEQ ID NO: 5204040 - DNA, 20 bp, Homo sapiens
aggattttaatttcaggaaa

SEQ ID NO: 5204041 - DNA, 21 bp, Homo sapiens
aggattttaatttcaggaaaa

SEQ ID NO: 5204042 - DNA, 17 bp, Homo sapiens
aggattttaccaaagca

SEQ ID NO: 5204043 - DNA, 19 bp, Homo sapiens
aggattttgatccaagctg

SEQ ID NO: 5204044 - DNA, 21 bp, Homo sapiens
aggattttggatgttgagagg

SEQ ID NO: 5204045 - DNA, 15 bp, Homo sapiens
aggatttttatcttt

SEQ ID NO: 5204046 - DNA, 18 bp, Homo sapiens
aggatttttccatggaca

SEQ ID NO: 5204047 - DNA, 17 bp, Homo sapiens
aggatttttccatgtgt

SEQ ID NO: 5204048 - DNA, 16 bp, Homo sapiens
aggatttttttctgag

SEQ ID NO: 5204049 - DNA, 21 bp, Homo sapiens
aggattttttttaatgtttaa

SEQ ID NO: 5204050 - DNA, 21 bp, Homo sapiens
aggcaaaacacgcaagggcat

SEQ ID NO: 5204051 - DNA, 14 bp, Homo sapiens
aggcaaaaccttgt

SEQ ID NO: 5204052 - DNA, 12 bp, Homo sapiens
aggcaaaagact

SEQ ID NO: 5204053 - DNA, 13 bp, Homo sapiens
aggcaaaagactg

SEQ ID NO: 5204054 - DNA, 17 bp, Homo sapiens
aggcaaaattgcaaatc

SEQ ID NO: 5204055 - DNA, 20 bp, Homo sapiens
aggcaaacgaataaagatag

SEQ ID NO: 5204056 - DNA, 15 bp, Homo sapiens
aggcaaagcccctgg

SEQ ID NO: 5204057 - DNA, 16 bp, Homo sapiens
aggcaaagcccctgga

SEQ ID NO: 5204058 - DNA, 18 bp, Homo sapiens
aggcaaagcccctggaaa

SEQ ID NO: 5204059 - DNA, 13 bp, Homo sapiens
aggcaaaggcctg

SEQ ID NO: 5204060 - DNA, 16 bp, Homo sapiens
aggcaaagggtccaga

SEQ ID NO: 5204061 - DNA, 16 bp, Homo sapiens
aggcaaagtacaaaat

SEQ ID NO: 5204062 - DNA, 22 bp, Homo sapiens
aggcaaagtacattgtaaaata

SEQ ID NO: 5204063 - DNA, 13 bp, Homo sapiens
aggcaaagtttta

SEQ ID NO: 5204064 - DNA, 12 bp, Homo sapiens
aggcaaatattg

SEQ ID NO: 5204065 - DNA, 15 bp, Homo sapiens
aggcaaatgactttg

SEQ ID NO: 5204066 - DNA, 15 bp, Homo sapiens
aggcaaatgcccaag

SEQ ID NO: 5204067 - DNA, 14 bp, Homo sapiens
aggcaaatgtccaa

SEQ ID NO: 5204068 - DNA, 19 bp, Homo sapiens
aggcaaatgtttaaacatt

SEQ ID NO: 5204069 - DNA, 22 bp, Homo sapiens
aggcaacactggaacatggcta

SEQ ID NO: 5204070 - DNA, 20 bp, Homo sapiens
aggcaacagtgttctgagcc

SEQ ID NO: 5204071 - DNA, 20 bp, Homo sapiens
aggcaacattacaaacaaag

SEQ ID NO: 5204072 - DNA, 21 bp, Homo sapiens
agctgctctgccccttgggca

SEQ ID NO: 5204073 - DNA, 14 bp, Homo sapiens
agctgctctggaaa

SEQ ID NO: 5204074 - DNA, 15 bp, Homo sapiens
agctgctctggaaaa

SEQ ID NO: 5204075 - DNA, 20 bp, Homo sapiens
agctgctcttagtgcccgcc

SEQ ID NO: 5204076 - DNA, 14 bp, Homo sapiens
agctgctgaaacaa

SEQ ID NO: 5204077 - DNA, 13 bp, Homo sapiens
agctgctgaagag

SEQ ID NO: 5204078 - DNA, 14 bp, Homo sapiens
agctgctgaaggga

SEQ ID NO: 5204079 - DNA, 17 bp, Homo sapiens
agctgctgaagggaggg

SEQ ID NO: 5204080 - DNA, 18 bp, Homo sapiens
agctgctgaagttctgag

SEQ ID NO: 5204081 - DNA, 20 bp, Homo sapiens
agctgctgaatgcattcagg

SEQ ID NO: 5204082 - DNA, 12 bp, Homo sapiens
agctgctgacag

SEQ ID NO: 5204083 - DNA, 13 bp, Homo sapiens
agctgctgacagt

SEQ ID NO: 5204084 - DNA, 17 bp, Homo sapiens
agctgctgaccaattgt

SEQ ID NO: 5204085 - DNA, 16 bp, Homo sapiens
agctgctgagccgcag

SEQ ID NO: 5204086 - DNA, 14 bp, Homo sapiens
agctgctgaggccc

SEQ ID NO: 5204087 - DNA, 16 bp, Homo sapiens
agctgctgccactctg

SEQ ID NO: 5204088 - DNA, 22 bp, Homo sapiens
agctgctgccactctgctgcct

SEQ ID NO: 5204089 - DNA, 14 bp, Homo sapiens
agctgctggagact

SEQ ID NO: 5204090 - DNA, 11 bp, Homo sapiens
agctgctggcc

SEQ ID NO: 5204091 - DNA, 12 bp, Homo sapiens
agctgctggcca

SEQ ID NO: 5204092 - DNA, 16 bp, Homo sapiens
agctgctggccatggc

SEQ ID NO: 5204093 - DNA, 16 bp, Homo sapiens
agctgctggctgacct

SEQ ID NO: 5204094 - DNA, 23 bp, Homo sapiens
agctgctggctgacctgggccca

SEQ ID NO: 5204095 - DNA, 18 bp, Homo sapiens
agctgctggctgtgacaa

SEQ ID NO: 5204096 - DNA, 21 bp, Homo sapiens
agctgctgggacccacctccc

SEQ ID NO: 5204097 - DNA, 14 bp, Homo sapiens
agctgctgggccag

SEQ ID NO: 5204098 - DNA, 19 bp, Homo sapiens
agctgctgggccagtggca

SEQ ID NO: 5204099 - DNA, 16 bp, Homo sapiens
agctgctggttttggt

SEQ ID NO: 5204100 - DNA, 22 bp, Homo sapiens
agctgctgtatttgaggaaact

SEQ ID NO: 5204101 - DNA, 12 bp, Homo sapiens
agctgctgtcag

SEQ ID NO: 5204102 - DNA, 13 bp, Homo sapiens
agctgctgtctct

SEQ ID NO: 5204103 - DNA, 14 bp, Homo sapiens
agctgctgtctcta

SEQ ID NO: 5204104 - DNA, 12 bp, Homo sapiens
agctgctgtctt

SEQ ID NO: 5204105 - DNA, 21 bp, Homo sapiens
agctgctgtgactgtgtcccc

SEQ ID NO: 5204106 - DNA, 16 bp, Homo sapiens
agctgctgtgccagga

SEQ ID NO: 5204107 - DNA, 17 bp, Homo sapiens
agctgctgtgcccagcc

SEQ ID NO: 5204108 - DNA, 21 bp, Homo sapiens
agctgctgttccaacagacag

SEQ ID NO: 5204109 - DNA, 13 bp, Homo sapiens
agctgctgttgaa

SEQ ID NO: 5204110 - DNA, 17 bp, Homo sapiens
agctgctgttgaacttt

SEQ ID NO: 5204111 - DNA, 20 bp, Homo sapiens
agctgctgttgaacttttta

SEQ ID NO: 5204112 - DNA, 19 bp, Homo sapiens
agctgcttaacagttgctt

SEQ ID NO: 5204113 - DNA, 18 bp, Homo sapiens
agctgcttccccaggctg

SEQ ID NO: 5204114 - DNA, 15 bp, Homo sapiens
agctgcttcctggac

SEQ ID NO: 5204115 - DNA, 16 bp, Homo sapiens
agctgcttctcccccc

SEQ ID NO: 5204116 - DNA, 18 bp, Homo sapiens
agctgcttctccccccat

SEQ ID NO: 5204117 - DNA, 21 bp, Homo sapiens
agctgcttctccccccatccc

SEQ ID NO: 5204118 - DNA, 24 bp, Homo sapiens
agctgcttctccccccatcccagg

SEQ ID NO: 5204119 - DNA, 19 bp, Homo sapiens
agctgcttctctttataga

SEQ ID NO: 5204120 - DNA, 14 bp, Homo sapiens
agctgcttctgccc

SEQ ID NO: 5204121 - DNA, 15 bp, Homo sapiens
agctgcttctgccca

SEQ ID NO: 5204122 - DNA, 19 bp, Homo sapiens
agctgcttctgcccacccc

SEQ ID NO: 5204123 - DNA, 17 bp, Homo sapiens
agctgcttctgctgcct

SEQ ID NO: 5204124 - DNA, 17 bp, Homo sapiens
agctgcttgacctagct

SEQ ID NO: 5204125 - DNA, 19 bp, Homo sapiens
agctgcttgacctagctct

SEQ ID NO: 5204126 - DNA, 14 bp, Homo sapiens
agctgcttgactat

SEQ ID NO: 5204127 - DNA, 19 bp, Homo sapiens
agctgcttgactatcacat

SEQ ID NO: 5204128 - DNA, 20 bp, Homo sapiens
agctgcttgcccaagtcaca

SEQ ID NO: 5204129 - DNA, 19 bp, Homo sapiens
agctgcttgtcctgctctc

SEQ ID NO: 5204130 - DNA, 14 bp, Homo sapiens
agctgcttgtgtcc

SEQ ID NO: 5204131 - DNA, 15 bp, Homo sapiens
agctgcttgtgtccc

SEQ ID NO: 5204132 - DNA, 20 bp, Homo sapiens
agctgcttgtgtccctcctg

SEQ ID NO: 5204133 - DNA, 16 bp, Homo sapiens
agctgctttaaatcta

SEQ ID NO: 5204134 - DNA, 20 bp, Homo sapiens
agctgctttctgttgtcatt

SEQ ID NO: 5204135 - DNA, 14 bp, Homo sapiens
agctgctttcttct

SEQ ID NO: 5204136 - DNA, 19 bp, Homo sapiens
agctgctttcttctctgcc

SEQ ID NO: 5204137 - DNA, 20 bp, Homo sapiens
agctgctttcttctctgcct

SEQ ID NO: 5204138 - DNA, 22 bp, Homo sapiens
agctgctttcttctctgcctcc

SEQ ID NO: 5204139 - DNA, 20 bp, Homo sapiens
agctgctttgttaccttaaa

SEQ ID NO: 5204140 - DNA, 22 bp, Homo sapiens
agctgcttttgtctatgggact

SEQ ID NO: 5204141 - DNA, 17 bp, Homo sapiens
agctgctttttttgaaa

SEQ ID NO: 5204142 - DNA, 17 bp, Homo sapiens
agctggaaagttgggcc

SEQ ID NO: 5204143 - DNA, 21 bp, Homo sapiens
agctggaaagttgggcccctg

SEQ ID NO: 5204144 - DNA, 12 bp, Homo sapiens
agctggaagcac

SEQ ID NO: 5204145 - DNA, 16 bp, Homo sapiens
agctggaaggcagggc

SEQ ID NO: 5204146 - DNA, 20 bp, Homo sapiens
agctggaaggcagggcagag

SEQ ID NO: 5204147 - DNA, 21 bp, Homo sapiens
agctggaaggcagggcagagg

SEQ ID NO: 5204148 - DNA, 16 bp, Homo sapiens
agctggaagtctacct

SEQ ID NO: 5204149 - DNA, 20 bp, Homo sapiens
agctggaagtctacctgctg

SEQ ID NO: 5204150 - DNA, 17 bp, Homo sapiens
agctggaatgtgccaca

SEQ ID NO: 5204151 - DNA, 21 bp, Homo sapiens
agctggaattctaaatgctgg

SEQ ID NO: 5204152 - DNA, 19 bp, Homo sapiens
agctggaattgctgctctc

SEQ ID NO: 5204153 - DNA, 21 bp, Homo sapiens
agctggaattttttattcttg

SEQ ID NO: 5204154 - DNA, 17 bp, Homo sapiens
agctggacaagaagctg

SEQ ID NO: 5204155 - DNA, 19 bp, Homo sapiens
agctggacacccccttggt

SEQ ID NO: 5204156 - DNA, 18 bp, Homo sapiens
agctggacagaggggact

SEQ ID NO: 5204157 - DNA, 18 bp, Homo sapiens
agctggacagcggcagtg

SEQ ID NO: 5204158 - DNA, 14 bp, Homo sapiens
agctggaccatctc

SEQ ID NO: 5204159 - DNA, 14 bp, Homo sapiens
agctggaccctgct

SEQ ID NO: 5204160 - DNA, 18 bp, Homo sapiens
agctggaccctgcttcac

SEQ ID NO: 5204161 - DNA, 13 bp, Homo sapiens
agctggactagtg

SEQ ID NO: 5204162 - DNA, 15 bp, Homo sapiens
agctggactagtgtc

SEQ ID NO: 5204163 - DNA, 11 bp, Homo sapiens
agctggactga

SEQ ID NO: 5204164 - DNA, 18 bp, Homo sapiens
agctggactgggtgggcc

SEQ ID NO: 5204165 - DNA, 18 bp, Homo sapiens
agctggacttctgtgggc

SEQ ID NO: 5204166 - DNA, 22 bp, Homo sapiens
agctggacttctgtgggcccct

SEQ ID NO: 5204167 - DNA, 15 bp, Homo sapiens
agctggagaaatggc

SEQ ID NO: 5204168 - DNA, 15 bp, Homo sapiens
agctggagaggagcc

SEQ ID NO: 5204169 - DNA, 16 bp, Homo sapiens
agctggagaggagccc

SEQ ID NO: 5204170 - DNA, 18 bp, Homo sapiens
agctggagaggagccctg

SEQ ID NO: 5204171 - DNA, 15 bp, Homo sapiens
agctggagatactga

SEQ ID NO: 5204172 - DNA, 16 bp, Homo sapiens
agctggagatactgat

SEQ ID NO: 5204173 - DNA, 19 bp, Homo sapiens
agctggagatgaggccaga

SEQ ID NO: 5204174 - DNA, 20 bp, Homo sapiens
agctggagatgaggccagac

SEQ ID NO: 5204175 - DNA, 19 bp, Homo sapiens
agctggagatgaggctgag

SEQ ID NO: 5204176 - DNA, 19 bp, Homo sapiens
agctggagccaatggtgag

SEQ ID NO: 5204177 - DNA, 22 bp, Homo sapiens
agctggagcccagcgtcagaag

SEQ ID NO: 5204178 - DNA, 24 bp, Homo sapiens
agctggagcccagcgtcagaagtc

SEQ ID NO: 5204179 - DNA, 14 bp, Homo sapiens
agctggagccccgc

SEQ ID NO: 5204180 - DNA, 17 bp, Homo sapiens
agctggagcctggtgcc

SEQ ID NO: 5204181 - DNA, 16 bp, Homo sapiens
agctggagctcttgga

SEQ ID NO: 5204182 - DNA, 17 bp, Homo sapiens
agctggagctcttggaa

SEQ ID NO: 5204183 - DNA, 21 bp, Homo sapiens
agctggaggaatacattttat

SEQ ID NO: 5204184 - DNA, 22 bp, Homo sapiens
agctggaggactagaacctgga

SEQ ID NO: 5204185 - DNA, 17 bp, Homo sapiens
agctggaggcaggggct

SEQ ID NO: 5204186 - DNA, 23 bp, Homo sapiens
agctggaggcaggggcttcctgg

SEQ ID NO: 5204187 - DNA, 18 bp, Homo sapiens
agctggaggggtggggag

SEQ ID NO: 5204188 - DNA, 20 bp, Homo sapiens
agctggaggggtggggagct

SEQ ID NO: 5204189 - DNA, 13 bp, Homo sapiens
agctggagtctgg

SEQ ID NO: 5204190 - DNA, 19 bp, Homo sapiens
agctggagtctgggctcct

SEQ ID NO: 5204191 - DNA, 21 bp, Homo sapiens
agctggagtgagggcctcaga

SEQ ID NO: 5204192 - DNA, 22 bp, Homo sapiens
agctggagtgagggcctcagag

SEQ ID NO: 5204193 - DNA, 16 bp, Homo sapiens
agctggagtgctgctt

SEQ ID NO: 5204194 - DNA, 20 bp, Homo sapiens
agctggagtgctgcttgtgc

SEQ ID NO: 5204195 - DNA, 22 bp, Homo sapiens
agctggagtgctgcttgtgcct

SEQ ID NO: 5204196 - DNA, 14 bp, Homo sapiens
agctggatgagaat

SEQ ID NO: 5204197 - DNA, 15 bp, Homo sapiens
agctggatgcagtgg

SEQ ID NO: 5204198 - DNA, 17 bp, Homo sapiens
agctggatgcagtggct

SEQ ID NO: 5204199 - DNA, 19 bp, Homo sapiens
agctggcaaaggtggctct

SEQ ID NO: 5204200 - DNA, 21 bp, Homo sapiens
agctggcaatgccctacctgc

SEQ ID NO: 5204201 - DNA, 14 bp, Homo sapiens
agctggcacaaaag

SEQ ID NO: 5204202 - DNA, 14 bp, Homo sapiens
agctggcactgaca

SEQ ID NO: 5204203 - DNA, 20 bp, Homo sapiens
agctggcactgacagcctgg

SEQ ID NO: 5204204 - DNA, 22 bp, Homo sapiens
agctggcactgacagcctgggg

SEQ ID NO: 5204205 - DNA, 13 bp, Homo sapiens
agctggcagcact

SEQ ID NO: 5204206 - DNA, 21 bp, Homo sapiens
agctggcagcactcagtgagg

SEQ ID NO: 5204207 - DNA, 23 bp, Homo sapiens
agctggcagcctccagtgggagg

SEQ ID NO: 5204208 - DNA, 15 bp, Homo sapiens
agctggcagcgcctc

SEQ ID NO: 5204209 - DNA, 11 bp, Homo sapiens
agctggcagga

SEQ ID NO: 5204210 - DNA, 15 bp, Homo sapiens
agctggcaggagaca

SEQ ID NO: 5204211 - DNA, 19 bp, Homo sapiens
agctggcaggagacactgg

SEQ ID NO: 5204212 - DNA, 15 bp, Homo sapiens
agctggcaggagggt

SEQ ID NO: 5204213 - DNA, 22 bp, Homo sapiens
agctggcagtgtgcggagctga

SEQ ID NO: 5204214 - DNA, 19 bp, Homo sapiens
agctggccaaagagccttt

SEQ ID NO: 5204215 - DNA, 21 bp, Homo sapiens
agctggccaaagagcctttcc

SEQ ID NO: 5204216 - DNA, 22 bp, Homo sapiens
agctggccaaagagcctttcca

SEQ ID NO: 5204217 - DNA, 13 bp, Homo sapiens
agctggccaaagt

SEQ ID NO: 5204218 - DNA, 17 bp, Homo sapiens
agctggccaaagtcact

SEQ ID NO: 5204219 - DNA, 19 bp, Homo sapiens
agctggccagatttcctca

SEQ ID NO: 5204220 - DNA, 20 bp, Homo sapiens
agctggccaggccctgagag

SEQ ID NO: 5204221 - DNA, 21 bp, Homo sapiens
agctggccaggccctgagagt

SEQ ID NO: 5204222 - DNA, 15 bp, Homo sapiens
agctggcccactgct

SEQ ID NO: 5204223 - DNA, 11 bp, Homo sapiens
agctggcccag

SEQ ID NO: 5204224 - DNA, 12 bp, Homo sapiens
agctggcccagg

SEQ ID NO: 5204225 - DNA, 20 bp, Homo sapiens
agctggcccccagccctggg

SEQ ID NO: 5204226 - DNA, 21 bp, Homo sapiens
agctggcccccagccctgggg

SEQ ID NO: 5204227 - DNA, 13 bp, Homo sapiens
agctggccccgcc

SEQ ID NO: 5204228 - DNA, 15 bp, Homo sapiens
agctggcccgtgaca

SEQ ID NO: 5204229 - DNA, 14 bp, Homo sapiens
agctggccctcagc

SEQ ID NO: 5204230 - DNA, 19 bp, Homo sapiens
agctggccctcagctccct

SEQ ID NO: 5204231 - DNA, 21 bp, Homo sapiens
agctggccctcagctccctga

SEQ ID NO: 5204232 - DNA, 12 bp, Homo sapiens
agctggccctgc

SEQ ID NO: 5204233 - DNA, 19 bp, Homo sapiens
agctggccctgcctcctgg

SEQ ID NO: 5204234 - DNA, 23 bp, Homo sapiens
agctggccctgcctcctgggaag

SEQ ID NO: 5204235 - DNA, 21 bp, Homo sapiens
agctggccgagggtcctggct

SEQ ID NO: 5204236 - DNA, 23 bp, Homo sapiens
agctggccgagggtcctggctcc

SEQ ID NO: 5204237 - DNA, 22 bp, Homo sapiens
agctggccgcgccaaataatgt

SEQ ID NO: 5204238 - DNA, 16 bp, Homo sapiens
agctggccggaaggag

SEQ ID NO: 5204239 - DNA, 17 bp, Homo sapiens
agctggccggaaggaga

SEQ ID NO: 5204240 - DNA, 23 bp, Homo sapiens
agctggccgggttggaggcctca

SEQ ID NO: 5204241 - DNA, 22 bp, Homo sapiens
agctggcctaggtgggagccac

SEQ ID NO: 5204242 - DNA, 11 bp, Homo sapiens
agctggcctcc

SEQ ID NO: 5204243 - DNA, 16 bp, Homo sapiens
agctggcctcccccaa

SEQ ID NO: 5204244 - DNA, 11 bp, Homo sapiens
agctggcctct

SEQ ID NO: 5204245 - DNA, 13 bp, Homo sapiens
agctggcctggtt

SEQ ID NO: 5204246 - DNA, 12 bp, Homo sapiens
agctggcctgtc

SEQ ID NO: 5204247 - DNA, 15 bp, Homo sapiens
agctggcctgtggca

SEQ ID NO: 5204248 - DNA, 21 bp, Homo sapiens
agctggcctgtggcacagccc

SEQ ID NO: 5204249 - DNA, 23 bp, Homo sapiens
agctggcctgtggcacagccctg

SEQ ID NO: 5204250 - DNA, 10 bp, Homo sapiens
aaactgtgac

SEQ ID NO: 5204251 - DNA, 12 bp, Homo sapiens
aaactgtgacat

SEQ ID NO: 5204252 - DNA, 22 bp, Homo sapiens
aaactgtgcaactttttaaagt

SEQ ID NO: 5204253 - DNA, 17 bp, Homo sapiens
aaactgtgcttctctat

SEQ ID NO: 5204254 - DNA, 19 bp, Homo sapiens
aaactgtgcttctctatga

SEQ ID NO: 5204255 - DNA, 14 bp, Homo sapiens
aaactgtggttaaa

SEQ ID NO: 5204256 - DNA, 13 bp, Homo sapiens
aaactgtgtaaac

SEQ ID NO: 5204257 - DNA, 20 bp, Homo sapiens
aaactgtgtacataactgaa

SEQ ID NO: 5204258 - DNA, 22 bp, Homo sapiens
aaactgtgtatagcttacctga

SEQ ID NO: 5204259 - DNA, 23 bp, Homo sapiens
aaactgtgtatcattaaaatata

SEQ ID NO: 5204260 - DNA, 19 bp, Homo sapiens
aaactgtgtcacgcaggct

SEQ ID NO: 5204261 - DNA, 16 bp, Homo sapiens
aaactgtgttgccaca

SEQ ID NO: 5204262 - DNA, 23 bp, Homo sapiens
aaactgttactgtcctgttttct

SEQ ID NO: 5204263 - DNA, 21 bp, Homo sapiens
aaactgttagcactgttgatg

SEQ ID NO: 5204264 - DNA, 22 bp, Homo sapiens
aaactgttagcactgttgatgt

SEQ ID NO: 5204265 - DNA, 14 bp, Homo sapiens
aaactgttcacgtt

SEQ ID NO: 5204266 - DNA, 14 bp, Homo sapiens
aaactgttctctat

SEQ ID NO: 5204267 - DNA, 20 bp, Homo sapiens
aaactgttctctttaaaata

SEQ ID NO: 5204268 - DNA, 12 bp, Homo sapiens
aaactgttcttc

SEQ ID NO: 5204269 - DNA, 12 bp, Homo sapiens
aaactgttcttt

SEQ ID NO: 5204270 - DNA, 18 bp, Homo sapiens
aaactgttggaagttcac

SEQ ID NO: 5204271 - DNA, 20 bp, Homo sapiens
aaactgttgtctagtataca

SEQ ID NO: 5204272 - DNA, 20 bp, Homo sapiens
aaactgtttatggtattttc

SEQ ID NO: 5204273 - DNA, 12 bp, Homo sapiens
aaactgtttctt

SEQ ID NO: 5204274 - DNA, 19 bp, Homo sapiens
aaactgtttgacttctcaa

SEQ ID NO: 5204275 - DNA, 14 bp, Homo sapiens
aaactgttttcatg

SEQ ID NO: 5204276 - DNA, 15 bp, Homo sapiens
aaactgtttttacta

SEQ ID NO: 5204277 - DNA, 14 bp, Homo sapiens
aaacttaaaaacaa

SEQ ID NO: 5204278 - DNA, 20 bp, Homo sapiens
aaacttaaaagtattcatac

SEQ ID NO: 5204279 - DNA, 13 bp, Homo sapiens
aaacttaaaataa

SEQ ID NO: 5204280 - DNA, 17 bp, Homo sapiens
aaacttaaaataaaatt

SEQ ID NO: 5204281 - DNA, 14 bp, Homo sapiens
aaacttaaacaaaa

SEQ ID NO: 5204282 - DNA, 14 bp, Homo sapiens
aaacttaaagcaaa

SEQ ID NO: 5204283 - DNA, 17 bp, Homo sapiens
aaacttaaatgttatta

SEQ ID NO: 5204284 - DNA, 17 bp, Homo sapiens
aaacttaacatggaaga

SEQ ID NO: 5204285 - DNA, 20 bp, Homo sapiens
aaacttaaccgcatcagaag

SEQ ID NO: 5204286 - DNA, 17 bp, Homo sapiens
aaacttaacgtgatcat

SEQ ID NO: 5204287 - DNA, 13 bp, Homo sapiens
aaacttaagaatt

SEQ ID NO: 5204288 - DNA, 15 bp, Homo sapiens
aaacttaagaattga

SEQ ID NO: 5204289 - DNA, 14 bp, Homo sapiens
aaacttaagcataa

SEQ ID NO: 5204290 - DNA, 16 bp, Homo sapiens
aaacttaagcataaaa

SEQ ID NO: 5204291 - DNA, 15 bp, Homo sapiens
aaacttaagccaatt

SEQ ID NO: 5204292 - DNA, 14 bp, Homo sapiens
aaacttaagggcaa

SEQ ID NO: 5204293 - DNA, 15 bp, Homo sapiens
aaacttacactgttt

SEQ ID NO: 5204294 - DNA, 23 bp, Homo sapiens
aaacttacactgtttcatctcag

SEQ ID NO: 5204295 - DNA, 21 bp, Homo sapiens
aaacttaccaattgatgtttt

SEQ ID NO: 5204296 - DNA, 22 bp, Homo sapiens
aaacttaccaattgatgtttta

SEQ ID NO: 5204297 - DNA, 20 bp, Homo sapiens
aaacttacctaagtgacatt

SEQ ID NO: 5204298 - DNA, 22 bp, Homo sapiens
aaacttacctataaattaagaa

SEQ ID NO: 5204299 - DNA, 14 bp, Homo sapiens
aaacttactgtcag

SEQ ID NO: 5204300 - DNA, 18 bp, Homo sapiens
aaacttagaataaaattg

SEQ ID NO: 5204301 - DNA, 13 bp, Homo sapiens
aaacttagaggaa

SEQ ID NO: 5204302 - DNA, 15 bp, Homo sapiens
aaacttagaggaaaa

SEQ ID NO: 5204303 - DNA, 16 bp, Homo sapiens
aaacttagaggaaaat

SEQ ID NO: 5204304 - DNA, 15 bp, Homo sapiens
aaacttagcttttga

SEQ ID NO: 5204305 - DNA, 16 bp, Homo sapiens
aaacttataatttcca

SEQ ID NO: 5204306 - DNA, 19 bp, Homo sapiens
aaacttataatttccaaac

SEQ ID NO: 5204307 - DNA, 20 bp, Homo sapiens
aaacttatcttacaaagtgt

SEQ ID NO: 5204308 - DNA, 12 bp, Homo sapiens
aaacttatgaat

SEQ ID NO: 5204309 - DNA, 17 bp, Homo sapiens
aaacttatgaatgtttc

SEQ ID NO: 5204310 - DNA, 13 bp, Homo sapiens
aaacttatgctag

SEQ ID NO: 5204311 - DNA, 22 bp, Homo sapiens
aaacttattaacaactgtgaat

SEQ ID NO: 5204312 - DNA, 22 bp, Homo sapiens
aaacttattttatattttccct

SEQ ID NO: 5204313 - DNA, 13 bp, Homo sapiens
aaacttatttttt

SEQ ID NO: 5204314 - DNA, 15 bp, Homo sapiens
aaacttcaaagctga

SEQ ID NO: 5204315 - DNA, 17 bp, Homo sapiens
aaacttcaaagctgaat

SEQ ID NO: 5204316 - DNA, 16 bp, Homo sapiens
aaacttcaagcaccag

SEQ ID NO: 5204317 - DNA, 19 bp, Homo sapiens
aaacttcaaggaaaataag

SEQ ID NO: 5204318 - DNA, 18 bp, Homo sapiens
aaacttcagagaaattat

SEQ ID NO: 5204319 - DNA, 16 bp, Homo sapiens
aaacttcagcaaccct

SEQ ID NO: 5204320 - DNA, 20 bp, Homo sapiens
aaacttcagttgatcttctt

SEQ ID NO: 5204321 - DNA, 15 bp, Homo sapiens
aaacttcagttttac

SEQ ID NO: 5204322 - DNA, 16 bp, Homo sapiens
aaacttcattcagagg

SEQ ID NO: 5204323 - DNA, 18 bp, Homo sapiens
aaacttccaaagaaagtt

SEQ ID NO: 5204324 - DNA, 15 bp, Homo sapiens
aaacttccaaagctt

SEQ ID NO: 5204325 - DNA, 20 bp, Homo sapiens
aaacttccacaagagtgaat

SEQ ID NO: 5204326 - DNA, 21 bp, Homo sapiens
aaacttccctttctgcttgtg

SEQ ID NO: 5204327 - DNA, 15 bp, Homo sapiens
aaacttcgctgtccc

SEQ ID NO: 5204328 - DNA, 16 bp, Homo sapiens
aaacttctactgagca

SEQ ID NO: 5204329 - DNA, 13 bp, Homo sapiens
aaacttctcattt

SEQ ID NO: 5204330 - DNA, 19 bp, Homo sapiens
aaacttctcatttatgtta

SEQ ID NO: 5204331 - DNA, 20 bp, Homo sapiens
aaacttctcatttatgttat

SEQ ID NO: 5204332 - DNA, 19 bp, Homo sapiens
aaacttctcgcaactgaag

SEQ ID NO: 5204333 - DNA, 12 bp, Homo sapiens
aaacttctgctc

SEQ ID NO: 5204334 - DNA, 18 bp, Homo sapiens
aaacttctgtaaggggca

SEQ ID NO: 5204335 - DNA, 15 bp, Homo sapiens
aaacttcttaaatat

SEQ ID NO: 5204336 - DNA, 14 bp, Homo sapiens
aaacttcttttctc

SEQ ID NO: 5204337 - DNA, 11 bp, Homo sapiens
aaacttgaaag

SEQ ID NO: 5204338 - DNA, 20 bp, Homo sapiens
aaacttgaaatatataatat

SEQ ID NO: 5204339 - DNA, 13 bp, Homo sapiens
aaacttgaagcag

SEQ ID NO: 5204340 - DNA, 19 bp, Homo sapiens
aaacttgaattcatagaaa

SEQ ID NO: 5204341 - DNA, 13 bp, Homo sapiens
aaacttgacccag

SEQ ID NO: 5204342 - DNA, 15 bp, Homo sapiens
aaacttgattatatt

SEQ ID NO: 5204343 - DNA, 16 bp, Homo sapiens
aaacttgcaactttga

SEQ ID NO: 5204344 - DNA, 18 bp, Homo sapiens
aaacttgcacatttgaat

SEQ ID NO: 5204345 - DNA, 23 bp, Homo sapiens
aaacttgcagcttggtattgcag

SEQ ID NO: 5204346 - DNA, 16 bp, Homo sapiens
aaacttggaatcaagg

SEQ ID NO: 5204347 - DNA, 21 bp, Homo sapiens
aaacttggacatttatgtaca

SEQ ID NO: 5204348 - DNA, 22 bp, Homo sapiens
aaacttggacatttatgtacaa

SEQ ID NO: 5204349 - DNA, 23 bp, Homo sapiens
aaacttggacatttatgtacaaa

SEQ ID NO: 5204350 - DNA, 17 bp, Homo sapiens
aaacttggatacttgga

SEQ ID NO: 5204351 - DNA, 19 bp, Homo sapiens
aaacttggatacttggatt

SEQ ID NO: 5204352 - DNA, 20 bp, Homo sapiens
aaacttggatacttggattt

SEQ ID NO: 5204353 - DNA, 24 bp, Homo sapiens
aaacttggctcgaatctctgtgcc

SEQ ID NO: 5204354 - DNA, 16 bp, Homo sapiens
aaacttggctggaatt

SEQ ID NO: 5204355 - DNA, 19 bp, Homo sapiens
aaacttgggccgctgcacc

SEQ ID NO: 5204356 - DNA, 11 bp, Homo sapiens
aaacttgtaaa

SEQ ID NO: 5204357 - DNA, 16 bp, Homo sapiens
aaacttgtaatttttt

SEQ ID NO: 5204358 - DNA, 23 bp, Homo sapiens
aaacttgtacttacactgaaatc

SEQ ID NO: 5204359 - DNA, 22 bp, Homo sapiens
aaacttgtatctgaagacctac

SEQ ID NO: 5204360 - DNA, 20 bp, Homo sapiens
aaacttgtcacttgcatgtc

SEQ ID NO: 5204361 - DNA, 13 bp, Homo sapiens
aaacttgtcagaa

SEQ ID NO: 5204362 - DNA, 13 bp, Homo sapiens
aaacttgtgtatt

SEQ ID NO: 5204363 - DNA, 23 bp, Homo sapiens
aaacttgtgttcaatctgtgaag

SEQ ID NO: 5204364 - DNA, 18 bp, Homo sapiens
aaacttgttattgtgaat

SEQ ID NO: 5204365 - DNA, 21 bp, Homo sapiens
aaacttgttattgtgaatgat

SEQ ID NO: 5204366 - DNA, 15 bp, Homo sapiens
aaacttgttgaattt

SEQ ID NO: 5204367 - DNA, 16 bp, Homo sapiens
aaacttgtttcactga

SEQ ID NO: 5204368 - DNA, 18 bp, Homo sapiens
aaacttgtttcactgaaa

SEQ ID NO: 5204369 - DNA, 20 bp, Homo sapiens
aaacttgtttgctgtgaaca

SEQ ID NO: 5204370 - DNA, 21 bp, Homo sapiens
aaactttaaaaaatatttatt

SEQ ID NO: 5204371 - DNA, 22 bp, Homo sapiens
aaactttaaagcgtttgcacag

SEQ ID NO: 5204372 - DNA, 13 bp, Homo sapiens
aaactttaacttc

SEQ ID NO: 5204373 - DNA, 14 bp, Homo sapiens
aaactttacctttt

SEQ ID NO: 5204374 - DNA, 19 bp, Homo sapiens
aaactttactaagatgaca

SEQ ID NO: 5204375 - DNA, 12 bp, Homo sapiens
aaactttactat

SEQ ID NO: 5204376 - DNA, 21 bp, Homo sapiens
aaactttagagtagcatgaga

SEQ ID NO: 5204377 - DNA, 13 bp, Homo sapiens
aaactttataaat

SEQ ID NO: 5204378 - DNA, 16 bp, Homo sapiens
aaactttatacattag

SEQ ID NO: 5204379 - DNA, 19 bp, Homo sapiens
aaactttatgctaagtgaa

SEQ ID NO: 5204380 - DNA, 15 bp, Homo sapiens
aaactttattaaaag

SEQ ID NO: 5204381 - DNA, 19 bp, Homo sapiens
aaactttattgggttttta

SEQ ID NO: 5204382 - DNA, 20 bp, Homo sapiens
aaactttattgggtttttat

SEQ ID NO: 5204383 - DNA, 11 bp, Homo sapiens
aaactttattt

SEQ ID NO: 5204384 - DNA, 12 bp, Homo sapiens
aaactttatttt

SEQ ID NO: 5204385 - DNA, 15 bp, Homo sapiens
aaactttattttata

SEQ ID NO: 5204386 - DNA, 19 bp, Homo sapiens
aaactttattttatataat

SEQ ID NO: 5204387 - DNA, 20 bp, Homo sapiens
aaactttcattccttcagat

SEQ ID NO: 5204388 - DNA, 18 bp, Homo sapiens
aaactttcctcgcctgac

SEQ ID NO: 5204389 - DNA, 17 bp, Homo sapiens
aaactttcctttaactc

SEQ ID NO: 5204390 - DNA, 15 bp, Homo sapiens
aaactttctccattt

SEQ ID NO: 5204391 - DNA, 14 bp, Homo sapiens
aaactttctctgca

SEQ ID NO: 5204392 - DNA, 22 bp, Homo sapiens
aaactttctctttgccatttct

SEQ ID NO: 5204393 - DNA, 12 bp, Homo sapiens
aaactttgaaat

SEQ ID NO: 5204394 - DNA, 19 bp, Homo sapiens
aaactttgaataaaagaat

SEQ ID NO: 5204395 - DNA, 20 bp, Homo sapiens
aaactttgagatctaaaaat

SEQ ID NO: 5204396 - DNA, 21 bp, Homo sapiens
aaactttgagatctaaaaata

SEQ ID NO: 5204397 - DNA, 18 bp, Homo sapiens
aaactttgagtacagata

SEQ ID NO: 5204398 - DNA, 19 bp, Homo sapiens
aaactttgagtacagatac

SEQ ID NO: 5204399 - DNA, 13 bp, Homo sapiens
aaactttgctcca

SEQ ID NO: 5204400 - DNA, 19 bp, Homo sapiens
aaactttggaaccagactc

SEQ ID NO: 5204401 - DNA, 21 bp, Homo sapiens
aaactttggagaactcatttc

SEQ ID NO: 5204402 - DNA, 22 bp, Homo sapiens
aaactttggagagggaaaatct

SEQ ID NO: 5204403 - DNA, 16 bp, Homo sapiens
aaactttggcctttgt

SEQ ID NO: 5204404 - DNA, 20 bp, Homo sapiens
aaactttgtagacattttga

SEQ ID NO: 5204405 - DNA, 12 bp, Homo sapiens
aaactttgtagt

SEQ ID NO: 5204406 - DNA, 15 bp, Homo sapiens
aaactttgtcacttc

SEQ ID NO: 5204407 - DNA, 15 bp, Homo sapiens
aaactttgtgccttt

SEQ ID NO: 5204408 - DNA, 19 bp, Homo sapiens
aaactttgtgtataagttg

SEQ ID NO: 5204409 - DNA, 20 bp, Homo sapiens
aaactttgttatatatatca

SEQ ID NO: 5204410 - DNA, 14 bp, Homo sapiens
aaacttttaaacta

SEQ ID NO: 5204411 - DNA, 22 bp, Homo sapiens
aaacttttacatttttctgatg

SEQ ID NO: 5204412 - DNA, 15 bp, Homo sapiens
aaacttttagaaact

SEQ ID NO: 5204413 - DNA, 19 bp, Homo sapiens
aaacttttaggttgttacc

SEQ ID NO: 5204414 - DNA, 13 bp, Homo sapiens
aaacttttataaa

SEQ ID NO: 5204415 - DNA, 17 bp, Homo sapiens
aaacttttataaatgtt

SEQ ID NO: 5204416 - DNA, 21 bp, Homo sapiens
aaacttttataaatgttttaa

SEQ ID NO: 5204417 - DNA, 22 bp, Homo sapiens
aaacttttatgcaggcagatta

SEQ ID NO: 5204418 - DNA, 21 bp, Homo sapiens
aaacttttatgcgcaaataca

SEQ ID NO: 5204419 - DNA, 14 bp, Homo sapiens
aaacttttcatttc

SEQ ID NO: 5204420 - DNA, 19 bp, Homo sapiens
aaacttttcatttcagatt

SEQ ID NO: 5204421 - DNA, 21 bp, Homo sapiens
aaacttttcatttcagatttt

SEQ ID NO: 5204422 - DNA, 15 bp, Homo sapiens
aaacttttctaaagt

SEQ ID NO: 5204423 - DNA, 12 bp, Homo sapiens
aaacttttctag

SEQ ID NO: 5204424 - DNA, 14 bp, Homo sapiens
aaacttttctcaga

SEQ ID NO: 5204425 - DNA, 11 bp, Homo sapiens
aaacttttctg

SEQ ID NO: 5204426 - DNA, 13 bp, Homo sapiens
aaacttttctgat

SEQ ID NO: 5204427 - DNA, 14 bp, Homo sapiens
aaacttttctgata

SEQ ID NO: 5204428 - DNA, 20 bp, Homo sapiens
aaacttttctttcttttctt

SEQ ID NO: 5204429 - DNA, 12 bp, Homo sapiens
aaacttttgtaa

SEQ ID NO: 5204430 - DNA, 16 bp, Homo sapiens
agctggcgactgcagc

SEQ ID NO: 5204431 - DNA, 16 bp, Homo sapiens
agctggcgctcagcag

SEQ ID NO: 5204432 - DNA, 18 bp, Homo sapiens
agctggcgctcagcagcc

SEQ ID NO: 5204433 - DNA, 20 bp, Homo sapiens
agctggcggaacctggctgc

SEQ ID NO: 5204434 - DNA, 21 bp, Homo sapiens
agctggcggaacctggctgcg

SEQ ID NO: 5204435 - DNA, 23 bp, Homo sapiens
agctggcggaacctggctgcgaa

SEQ ID NO: 5204436 - DNA, 21 bp, Homo sapiens
agctggcgtcatgcaaagtca

SEQ ID NO: 5204437 - DNA, 15 bp, Homo sapiens
agctggctagcattc

SEQ ID NO: 5204438 - DNA, 22 bp, Homo sapiens
agctggctagcattcctcagga

SEQ ID NO: 5204439 - DNA, 18 bp, Homo sapiens
agctggctagtcctttct

SEQ ID NO: 5204440 - DNA, 21 bp, Homo sapiens
agctggctagtcctttctgtg

SEQ ID NO: 5204441 - DNA, 15 bp, Homo sapiens
agctggctccagcct

SEQ ID NO: 5204442 - DNA, 18 bp, Homo sapiens
agctggctccagcctgga

SEQ ID NO: 5204443 - DNA, 20 bp, Homo sapiens
agctggctcctctataggag

SEQ ID NO: 5204444 - DNA, 22 bp, Homo sapiens
agctggctctataaggcagcct

SEQ ID NO: 5204445 - DNA, 14 bp, Homo sapiens
agctggctctgagc

SEQ ID NO: 5204446 - DNA, 21 bp, Homo sapiens
agctggctctgcagcacattg

SEQ ID NO: 5204447 - DNA, 20 bp, Homo sapiens
agctggctctgtgagggtgc

SEQ ID NO: 5204448 - DNA, 16 bp, Homo sapiens
agctggctgactaagc

SEQ ID NO: 5204449 - DNA, 19 bp, Homo sapiens
agctggctgctgacaggat

SEQ ID NO: 5204450 - DNA, 14 bp, Homo sapiens
agctggctgggctg

SEQ ID NO: 5204451 - DNA, 13 bp, Homo sapiens
agctggctggggt

SEQ ID NO: 5204452 - DNA, 19 bp, Homo sapiens
agctggctgggtcgcccct

SEQ ID NO: 5204453 - DNA, 21 bp, Homo sapiens
agctggctgggtcgcccctcc

SEQ ID NO: 5204454 - DNA, 22 bp, Homo sapiens
agctggctgtacctgttcctcc

SEQ ID NO: 5204455 - DNA, 14 bp, Homo sapiens
agctggctgtactg

SEQ ID NO: 5204456 - DNA, 21 bp, Homo sapiens
agctggctgtactgccaaggt

SEQ ID NO: 5204457 - DNA, 16 bp, Homo sapiens
agctggctgtgcctgc

SEQ ID NO: 5204458 - DNA, 15 bp, Homo sapiens
agctggcttctgtga

SEQ ID NO: 5204459 - DNA, 21 bp, Homo sapiens
agctggctttgaaacctcagg

SEQ ID NO: 5204460 - DNA, 18 bp, Homo sapiens
agctggctttgcacttga

SEQ ID NO: 5204461 - DNA, 13 bp, Homo sapiens
agctgggaaacag

SEQ ID NO: 5204462 - DNA, 20 bp, Homo sapiens
agctgggaaacagggagccc

SEQ ID NO: 5204463 - DNA, 16 bp, Homo sapiens
agctgggaactgacat

SEQ ID NO: 5204464 - DNA, 14 bp, Homo sapiens
agctgggaacttct

SEQ ID NO: 5204465 - DNA, 18 bp, Homo sapiens
agctgggaagctgtactc

SEQ ID NO: 5204466 - DNA, 21 bp, Homo sapiens
agctgggacaccccgactttt

SEQ ID NO: 5204467 - DNA, 23 bp, Homo sapiens
agctgggaccacaggtgcacgcc

SEQ ID NO: 5204468 - DNA, 15 bp, Homo sapiens
agctgggaccagtac

SEQ ID NO: 5204469 - DNA, 21 bp, Homo sapiens
agctgggacctaatgctggcc

SEQ ID NO: 5204470 - DNA, 23 bp, Homo sapiens
agctgggacctaatgctggcctg

SEQ ID NO: 5204471 - DNA, 18 bp, Homo sapiens
agctgggactacaggcac

SEQ ID NO: 5204472 - DNA, 17 bp, Homo sapiens
agctgggactacaggtg

SEQ ID NO: 5204473 - DNA, 23 bp, Homo sapiens
agctgggactacaggtgtgcacc

SEQ ID NO: 5204474 - DNA, 14 bp, Homo sapiens
agctgggagacaaa

SEQ ID NO: 5204475 - DNA, 20 bp, Homo sapiens
agctgggagaccctccccac

SEQ ID NO: 5204476 - DNA, 13 bp, Homo sapiens
agctgggagccag

SEQ ID NO: 5204477 - DNA, 16 bp, Homo sapiens
agctgggagccaggct

SEQ ID NO: 5204478 - DNA, 15 bp, Homo sapiens
agctgggagccagtg

SEQ ID NO: 5204479 - DNA, 15 bp, Homo sapiens
agctgggagccgggc

SEQ ID NO: 5204480 - DNA, 12 bp, Homo sapiens
agctgggaggaa

SEQ ID NO: 5204481 - DNA, 17 bp, Homo sapiens
agctgggaggcaagagg

SEQ ID NO: 5204482 - DNA, 14 bp, Homo sapiens
agctgggaggcatg

SEQ ID NO: 5204483 - DNA, 20 bp, Homo sapiens
agctgggaggcatggccctg

SEQ ID NO: 5204484 - DNA, 22 bp, Homo sapiens
agctgggaggcatggccctggg

SEQ ID NO: 5204485 - DNA, 13 bp, Homo sapiens
agctgggagggag

SEQ ID NO: 5204486 - DNA, 23 bp, Homo sapiens
agctgggaggtagaaggggagga

SEQ ID NO: 5204487 - DNA, 17 bp, Homo sapiens
agctgggagtacaggcg

SEQ ID NO: 5204488 - DNA, 14 bp, Homo sapiens
agctgggatacaca

SEQ ID NO: 5204489 - DNA, 23 bp, Homo sapiens
agctgggatcacagctgcaggcc

SEQ ID NO: 5204490 - DNA, 23 bp, Homo sapiens
agctgggatcccacagccctagt

SEQ ID NO: 5204491 - DNA, 14 bp, Homo sapiens
agctgggatctgac

SEQ ID NO: 5204492 - DNA, 18 bp, Homo sapiens
agctgggattacaggctc

SEQ ID NO: 5204493 - DNA, 17 bp, Homo sapiens
agctgggattacaggtg

SEQ ID NO: 5204494 - DNA, 20 bp, Homo sapiens
agctgggcaaacccttctct

SEQ ID NO: 5204495 - DNA, 14 bp, Homo sapiens
agctgggcagacag

SEQ ID NO: 5204496 - DNA, 15 bp, Homo sapiens
agctgggcagacagg

SEQ ID NO: 5204497 - DNA, 16 bp, Homo sapiens
agctgggcagacaggt

SEQ ID NO: 5204498 - DNA, 23 bp, Homo sapiens
agctgggcagacaggtgggagat

SEQ ID NO: 5204499 - DNA, 15 bp, Homo sapiens
agctgggcagggtga

SEQ ID NO: 5204500 - DNA, 23 bp, Homo sapiens
agctgggcaggtctcctctggga

SEQ ID NO: 5204501 - DNA, 14 bp, Homo sapiens
agctgggcaggttg

SEQ ID NO: 5204502 - DNA, 16 bp, Homo sapiens
agctgggcagtgccag

SEQ ID NO: 5204503 - DNA, 21 bp, Homo sapiens
agctgggccactcctcttcac

SEQ ID NO: 5204504 - DNA, 10 bp, Homo sapiens
agctgggccc

SEQ ID NO: 5204505 - DNA, 20 bp, Homo sapiens
agctgggcccaaaggcccag

SEQ ID NO: 5204506 - DNA, 14 bp, Homo sapiens
agctgggcccacag

SEQ ID NO: 5204507 - DNA, 21 bp, Homo sapiens
agctgggcccacagcccccac

SEQ ID NO: 5204508 - DNA, 13 bp, Homo sapiens
agctgggcccagc

SEQ ID NO: 5204509 - DNA, 14 bp, Homo sapiens
agctgggcccagcc

SEQ ID NO: 5204510 - DNA, 16 bp, Homo sapiens
agctgggcccagcccc

SEQ ID NO: 5204511 - DNA, 18 bp, Homo sapiens
agctgggcccagcccctc

SEQ ID NO: 5204512 - DNA, 20 bp, Homo sapiens
agctgggcccagcccctcca

SEQ ID NO: 5204513 - DNA, 17 bp, Homo sapiens
agctgggccccacctac

SEQ ID NO: 5204514 - DNA, 14 bp, Homo sapiens
agctgggccccagc

SEQ ID NO: 5204515 - DNA, 21 bp, Homo sapiens
agctgggccccatgctctgcc

SEQ ID NO: 5204516 - DNA, 22 bp, Homo sapiens
agctgggccccatgctctgccc

SEQ ID NO: 5204517 - DNA, 14 bp, Homo sapiens
agctgggcccctgc

SEQ ID NO: 5204518 - DNA, 22 bp, Homo sapiens
agctgggcccgacatggctccg

SEQ ID NO: 5204519 - DNA, 15 bp, Homo sapiens
agctgggccctgcct

SEQ ID NO: 5204520 - DNA, 17 bp, Homo sapiens
agctgggccctgcctgc

SEQ ID NO: 5204521 - DNA, 18 bp, Homo sapiens
agctgggccctgcctgca

SEQ ID NO: 5204522 - DNA, 20 bp, Homo sapiens
agctgggccctgcctgcagc

SEQ ID NO: 5204523 - DNA, 12 bp, Homo sapiens
agctgggccggc

SEQ ID NO: 5204524 - DNA, 18 bp, Homo sapiens
agctgggccggccagcct

SEQ ID NO: 5204525 - DNA, 15 bp, Homo sapiens
agctgggccgggacc

SEQ ID NO: 5204526 - DNA, 18 bp, Homo sapiens
agctgggccgggacccag

SEQ ID NO: 5204527 - DNA, 19 bp, Homo sapiens
agctgggcctcctgcctcc

SEQ ID NO: 5204528 - DNA, 20 bp, Homo sapiens
agctgggcctcctgcctccg

SEQ ID NO: 5204529 - DNA, 15 bp, Homo sapiens
agctgggcctgtgca

SEQ ID NO: 5204530 - DNA, 22 bp, Homo sapiens
agctgggcggggctcgaggctg

SEQ ID NO: 5204531 - DNA, 12 bp, Homo sapiens
agctgggctccc

SEQ ID NO: 5204532 - DNA, 10 bp, Homo sapiens
agctgggctg

SEQ ID NO: 5204533 - DNA, 16 bp, Homo sapiens
agctgggctgttggct

SEQ ID NO: 5204534 - DNA, 21 bp, Homo sapiens
agctgggcttggcctggagag

SEQ ID NO: 5204535 - DNA, 17 bp, Homo sapiens
agctggggacagagaag

SEQ ID NO: 5204536 - DNA, 12 bp, Homo sapiens
agctggggagat

SEQ ID NO: 5204537 - DNA, 13 bp, Homo sapiens
agctggggagatg

SEQ ID NO: 5204538 - DNA, 17 bp, Homo sapiens
agctggggagatggggg

SEQ ID NO: 5204539 - DNA, 20 bp, Homo sapiens
agctggggagatgggggctt

SEQ ID NO: 5204540 - DNA, 18 bp, Homo sapiens
agctggggaggtgggagg

SEQ ID NO: 5204541 - DNA, 23 bp, Homo sapiens
agctggggaggtgggaggccagg

SEQ ID NO: 5204542 - DNA, 15 bp, Homo sapiens
agctggggatccctc

SEQ ID NO: 5204543 - DNA, 22 bp, Homo sapiens
agctggggcaaggggcagccag

SEQ ID NO: 5204544 - DNA, 23 bp, Homo sapiens
agctggggccaccctggcccggc

SEQ ID NO: 5204545 - DNA, 15 bp, Homo sapiens
agctggggccagagg

SEQ ID NO: 5204546 - DNA, 20 bp, Homo sapiens
agctggggccagaggctggg

SEQ ID NO: 5204547 - DNA, 18 bp, Homo sapiens
agctggggcccctcggct

SEQ ID NO: 5204548 - DNA, 18 bp, Homo sapiens
agctggggcctggagagg

SEQ ID NO: 5204549 - DNA, 22 bp, Homo sapiens
agctggggcctggagaggggcc

SEQ ID NO: 5204550 - DNA, 23 bp, Homo sapiens
agctggggcctggagaggggcct

SEQ ID NO: 5204551 - DNA, 16 bp, Homo sapiens
agctggggcgtgggga

SEQ ID NO: 5204552 - DNA, 13 bp, Homo sapiens
agctggggctgaa

SEQ ID NO: 5204553 - DNA, 17 bp, Homo sapiens
agctggggctgagggat

SEQ ID NO: 5204554 - DNA, 20 bp, Homo sapiens
agctggggctgccagcctga

SEQ ID NO: 5204555 - DNA, 22 bp, Homo sapiens
agctggggcttcaccagtctgt

SEQ ID NO: 5204556 - DNA, 20 bp, Homo sapiens
agctggggcttctttctgct

SEQ ID NO: 5204557 - DNA, 15 bp, Homo sapiens
agctgggggaagggt

SEQ ID NO: 5204558 - DNA, 20 bp, Homo sapiens
agctgggggccatgagctcc

SEQ ID NO: 5204559 - DNA, 17 bp, Homo sapiens
agctggggggctgtcct

SEQ ID NO: 5204560 - DNA, 19 bp, Homo sapiens
agctggggggttggcagcc

SEQ ID NO: 5204561 - DNA, 20 bp, Homo sapiens
agctggggggttggcagccc

SEQ ID NO: 5204562 - DNA, 14 bp, Homo sapiens
agctgggggtgggg

SEQ ID NO: 5204563 - DNA, 22 bp, Homo sapiens
agctggggtctgggcagtgcca

SEQ ID NO: 5204564 - DNA, 14 bp, Homo sapiens
agctggggtgcagg

SEQ ID NO: 5204565 - DNA, 15 bp, Homo sapiens
agctggggtgcaggg

SEQ ID NO: 5204566 - DNA, 18 bp, Homo sapiens
agctggggtgcagggatg

SEQ ID NO: 5204567 - DNA, 22 bp, Homo sapiens
agctggggtgcagggatgtggg

SEQ ID NO: 5204568 - DNA, 19 bp, Homo sapiens
agctggggtgggagctcct

SEQ ID NO: 5204569 - DNA, 20 bp, Homo sapiens
agctgggtaatcgatggggg

SEQ ID NO: 5204570 - DNA, 15 bp, Homo sapiens
agctgggtcaggcag

SEQ ID NO: 5204571 - DNA, 16 bp, Homo sapiens
agctgggtgcagaagc

SEQ ID NO: 5204572 - DNA, 18 bp, Homo sapiens
agctgggtgccccaggga

SEQ ID NO: 5204573 - DNA, 18 bp, Homo sapiens
agctgggtggcactgcca

SEQ ID NO: 5204574 - DNA, 20 bp, Homo sapiens
agctgggttccgggaggcag

SEQ ID NO: 5204575 - DNA, 14 bp, Homo sapiens
agctgggttggaaa

SEQ ID NO: 5204576 - DNA, 18 bp, Homo sapiens
agctgggtttagcccgag

SEQ ID NO: 5204577 - DNA, 19 bp, Homo sapiens
agctggtagttagtagcat

SEQ ID NO: 5204578 - DNA, 22 bp, Homo sapiens
agctggtagttagtagcatgtt

SEQ ID NO: 5204579 - DNA, 14 bp, Homo sapiens
agctggtcagtctt

SEQ ID NO: 5204580 - DNA, 18 bp, Homo sapiens
agctggtcagtctttgct

SEQ ID NO: 5204581 - DNA, 19 bp, Homo sapiens
agctggtcccctctatata

SEQ ID NO: 5204582 - DNA, 21 bp, Homo sapiens
agctggtcctgaccaggatgg

SEQ ID NO: 5204583 - DNA, 14 bp, Homo sapiens
agctggtcgagcag

SEQ ID NO: 5204584 - DNA, 17 bp, Homo sapiens
agctggtcgagcagctt

SEQ ID NO: 5204585 - DNA, 15 bp, Homo sapiens
agctggtcttttctc

SEQ ID NO: 5204586 - DNA, 18 bp, Homo sapiens
agctggtgactttgggga

SEQ ID NO: 5204587 - DNA, 19 bp, Homo sapiens
agctggtgactttggggac

SEQ ID NO: 5204588 - DNA, 18 bp, Homo sapiens
agctggtgagtgatgcgg

SEQ ID NO: 5204589 - DNA, 20 bp, Homo sapiens
agctggtgcaaattcagaac

SEQ ID NO: 5204590 - DNA, 22 bp, Homo sapiens
agctggtgccaaatagccccag

SEQ ID NO: 5204591 - DNA, 18 bp, Homo sapiens
agctggtgccccacctgc

SEQ ID NO: 5204592 - DNA, 15 bp, Homo sapiens
agctggtgcccccag

SEQ ID NO: 5204593 - DNA, 16 bp, Homo sapiens
agctggtgcccccaga

SEQ ID NO: 5204594 - DNA, 17 bp, Homo sapiens
agctggtgcccccagac

SEQ ID NO: 5204595 - DNA, 14 bp, Homo sapiens
agctggtgcctgct

SEQ ID NO: 5204596 - DNA, 17 bp, Homo sapiens
agctggtggaacatatg

SEQ ID NO: 5204597 - DNA, 15 bp, Homo sapiens
agctggtggacccag

SEQ ID NO: 5204598 - DNA, 15 bp, Homo sapiens
agctggtggcagagt

SEQ ID NO: 5204599 - DNA, 16 bp, Homo sapiens
agctggtggccctgtg

SEQ ID NO: 5204600 - DNA, 22 bp, Homo sapiens
agctggtggccctgtgcctggg

SEQ ID NO: 5204601 - DNA, 23 bp, Homo sapiens
agctggtggccctgtgcctgggc

SEQ ID NO: 5204602 - DNA, 15 bp, Homo sapiens
agctggtggctaggt

SEQ ID NO: 5204603 - DNA, 13 bp, Homo sapiens
agctggtgggaag

SEQ ID NO: 5204604 - DNA, 12 bp, Homo sapiens
agctggtggttt

SEQ ID NO: 5204605 - DNA, 20 bp, Homo sapiens
agctggtgtagctacagaga

SEQ ID NO: 5204606 - DNA, 23 bp, Homo sapiens
agctggtgtagctacagagaaac

SEQ ID NO: 5204607 - DNA, 18 bp, Homo sapiens
aggcaaccatttttagaa

SEQ ID NO: 5204608 - DNA, 14 bp, Homo sapiens
aggcaacctcccat

SEQ ID NO: 5204609 - DNA, 18 bp, Homo sapiens
aggcaacggcaccattgg

SEQ ID NO: 5204610 - DNA, 15 bp, Homo sapiens
aggcaactcttgtaa

SEQ ID NO: 5204611 - DNA, 17 bp, Homo sapiens
aggcaactgaacaaaaa

SEQ ID NO: 5204612 - DNA, 19 bp, Homo sapiens
aggcaactgaacaaaaaaa

SEQ ID NO: 5204613 - DNA, 17 bp, Homo sapiens
aggcaacttcagtcctg

SEQ ID NO: 5204614 - DNA, 19 bp, Homo sapiens
aggcaacttcagtcctggg

SEQ ID NO: 5204615 - DNA, 20 bp, Homo sapiens
aggcaacttttcatttttgc

SEQ ID NO: 5204616 - DNA, 14 bp, Homo sapiens
aggcaagaaaagga

SEQ ID NO: 5204617 - DNA, 15 bp, Homo sapiens
aggcaagaaaaggac

SEQ ID NO: 5204618 - DNA, 14 bp, Homo sapiens
aggcaagaaagctt

SEQ ID NO: 5204619 - DNA, 15 bp, Homo sapiens
aggcaagaagtggga

SEQ ID NO: 5204620 - DNA, 19 bp, Homo sapiens
aggcaagactctgccttaa

SEQ ID NO: 5204621 - DNA, 15 bp, Homo sapiens
aggcaagagaaatga

SEQ ID NO: 5204622 - DNA, 15 bp, Homo sapiens
aggcaagagacagaa

SEQ ID NO: 5204623 - DNA, 17 bp, Homo sapiens
aggcaagagacagaatg

SEQ ID NO: 5204624 - DNA, 13 bp, Homo sapiens
aggcaagagatga

SEQ ID NO: 5204625 - DNA, 15 bp, Homo sapiens
aggcaagagggaggg

SEQ ID NO: 5204626 - DNA, 20 bp, Homo sapiens
aggcaagatccccgccaccc

SEQ ID NO: 5204627 - DNA, 17 bp, Homo sapiens
aggcaagcacctcctgc

SEQ ID NO: 5204628 - DNA, 18 bp, Homo sapiens
aggcaagcacctcctgcc

SEQ ID NO: 5204629 - DNA, 19 bp, Homo sapiens
aggcaagcacctcctgcct

SEQ ID NO: 5204630 - DNA, 20 bp, Homo sapiens
aggcaagcacctcctgcctc

SEQ ID NO: 5204631 - DNA, 12 bp, Homo sapiens
aggcaagcagga

SEQ ID NO: 5204632 - DNA, 14 bp, Homo sapiens
aggcaagcatgttg

SEQ ID NO: 5204633 - DNA, 14 bp, Homo sapiens
aggcaagccaggct

SEQ ID NO: 5204634 - DNA, 16 bp, Homo sapiens
aggcaagcccctcagc

SEQ ID NO: 5204635 - DNA, 17 bp, Homo sapiens
aggcaagcccctcagcc

SEQ ID NO: 5204636 - DNA, 18 bp, Homo sapiens
aggcaagcccctcagccc

SEQ ID NO: 5204637 - DNA, 21 bp, Homo sapiens
aggcaagcccctcagcccttg

SEQ ID NO: 5204638 - DNA, 12 bp, Homo sapiens
aggcaagccctg

SEQ ID NO: 5204639 - DNA, 20 bp, Homo sapiens
aggcaagcgaccgaggccct

SEQ ID NO: 5204640 - DNA, 21 bp, Homo sapiens
aggcaagctgaaattttagaa

SEQ ID NO: 5204641 - DNA, 15 bp, Homo sapiens
aggcaagctggcagg

SEQ ID NO: 5204642 - DNA, 22 bp, Homo sapiens
aggcaaggaaattaagaactga

SEQ ID NO: 5204643 - DNA, 22 bp, Homo sapiens
aggcaaggatgaaagacaaaga

SEQ ID NO: 5204644 - DNA, 22 bp, Homo sapiens
aggcaaggatggtggggccccc

SEQ ID NO: 5204645 - DNA, 20 bp, Homo sapiens
aggcaaggcaggtgcctcca

SEQ ID NO: 5204646 - DNA, 14 bp, Homo sapiens
aggcaaggcccaga

SEQ ID NO: 5204647 - DNA, 22 bp, Homo sapiens
aggcaaggcccagacctggcct

SEQ ID NO: 5204648 - DNA, 18 bp, Homo sapiens
aggcaaggctatgtgatt

SEQ ID NO: 5204649 - DNA, 14 bp, Homo sapiens
aggcaaggctgccg

SEQ ID NO: 5204650 - DNA, 15 bp, Homo sapiens
aggcaaggctgccgg

SEQ ID NO: 5204651 - DNA, 18 bp, Homo sapiens
aggcaaggggtgcctggg

SEQ ID NO: 5204652 - DNA, 13 bp, Homo sapiens
aggcaaggtctgg

SEQ ID NO: 5204653 - DNA, 17 bp, Homo sapiens
aggcaagtccaccccat

SEQ ID NO: 5204654 - DNA, 17 bp, Homo sapiens
aggcaagtgaagaaaag

SEQ ID NO: 5204655 - DNA, 14 bp, Homo sapiens
aggcaagtggtagg

SEQ ID NO: 5204656 - DNA, 20 bp, Homo sapiens
aggcaagttaagagaaactt

SEQ ID NO: 5204657 - DNA, 15 bp, Homo sapiens
aggcaagtttctagc

SEQ ID NO: 5204658 - DNA, 14 bp, Homo sapiens
aggcaataaaaatc

SEQ ID NO: 5204659 - DNA, 18 bp, Homo sapiens
aggcaatagtgttgagga

SEQ ID NO: 5204660 - DNA, 21 bp, Homo sapiens
aggcaatcaagagcttccaga

SEQ ID NO: 5204661 - DNA, 22 bp, Homo sapiens
aggcaatcgtggatgtctctga

SEQ ID NO: 5204662 - DNA, 19 bp, Homo sapiens
aggcaatcgttctgctggc

SEQ ID NO: 5204663 - DNA, 15 bp, Homo sapiens
aggcaatgactgtga

SEQ ID NO: 5204664 - DNA, 22 bp, Homo sapiens
aggcaatgattgttaatttaca

SEQ ID NO: 5204665 - DNA, 15 bp, Homo sapiens
aggcaatgccctgcg

SEQ ID NO: 5204666 - DNA, 22 bp, Homo sapiens
aggcaatgccctgcggctctgg

SEQ ID NO: 5204667 - DNA, 23 bp, Homo sapiens
aggcaatgccctgcggctctgga

SEQ ID NO: 5204668 - DNA, 15 bp, Homo sapiens
aggcaatgctggctg

SEQ ID NO: 5204669 - DNA, 18 bp, Homo sapiens
aggcacaaaaccagaagt

SEQ ID NO: 5204670 - DNA, 17 bp, Homo sapiens
aggcacaaaatgatgga

SEQ ID NO: 5204671 - DNA, 16 bp, Homo sapiens
aggcacaaagggcagg

SEQ ID NO: 5204672 - DNA, 14 bp, Homo sapiens
aggcacaaatcact

SEQ ID NO: 5204673 - DNA, 15 bp, Homo sapiens
aggcacaaatcactg

SEQ ID NO: 5204674 - DNA, 19 bp, Homo sapiens
aggcacaaatcttgggtct

SEQ ID NO: 5204675 - DNA, 14 bp, Homo sapiens
aggcacaatatggg

SEQ ID NO: 5204676 - DNA, 18 bp, Homo sapiens
aggcacacacagccccta

SEQ ID NO: 5204677 - DNA, 21 bp, Homo sapiens
aggcacacaccaccatgctca

SEQ ID NO: 5204678 - DNA, 16 bp, Homo sapiens
aggcacacactgtgct

SEQ ID NO: 5204679 - DNA, 19 bp, Homo sapiens
aggcacacagagattctgg

SEQ ID NO: 5204680 - DNA, 16 bp, Homo sapiens
aggcacacagcagccc

SEQ ID NO: 5204681 - DNA, 21 bp, Homo sapiens
aggcacacagcagccccccag

SEQ ID NO: 5204682 - DNA, 15 bp, Homo sapiens
aggcacacagctact

SEQ ID NO: 5204683 - DNA, 14 bp, Homo sapiens
aggcacacagctgc

SEQ ID NO: 5204684 - DNA, 12 bp, Homo sapiens
aggcacacttct

SEQ ID NO: 5204685 - DNA, 18 bp, Homo sapiens
aggcacagaggaggtcag

SEQ ID NO: 5204686 - DNA, 11 bp, Homo sapiens
aggcacagcag

SEQ ID NO: 5204687 - DNA, 20 bp, Homo sapiens
aggcacagccggggcctgcc

SEQ ID NO: 5204688 - DNA, 13 bp, Homo sapiens
aggcacaggcagg

SEQ ID NO: 5204689 - DNA, 19 bp, Homo sapiens
aggcacaggcaggaagaga

SEQ ID NO: 5204690 - DNA, 22 bp, Homo sapiens
aggcacaggcaggaagagagag

SEQ ID NO: 5204691 - DNA, 14 bp, Homo sapiens
aggcacaggcaggg

SEQ ID NO: 5204692 - DNA, 18 bp, Homo sapiens
aggcacaggcagggcagg

SEQ ID NO: 5204693 - DNA, 13 bp, Homo sapiens
aggcacaggctcc

SEQ ID NO: 5204694 - DNA, 13 bp, Homo sapiens
aggcacagggccc

SEQ ID NO: 5204695 - DNA, 16 bp, Homo sapiens
aggcacagggcccgca

SEQ ID NO: 5204696 - DNA, 16 bp, Homo sapiens
aggcacagtcttctga

SEQ ID NO: 5204697 - DNA, 17 bp, Homo sapiens
aggcacagtgaaggctg

SEQ ID NO: 5204698 - DNA, 19 bp, Homo sapiens
aggcacagtgggagctgag

SEQ ID NO: 5204699 - DNA, 21 bp, Homo sapiens
aggcacatggaatatatttta

SEQ ID NO: 5204700 - DNA, 13 bp, Homo sapiens
aggcacatggagg

SEQ ID NO: 5204701 - DNA, 21 bp, Homo sapiens
aggcacatgttgttctcattg

SEQ ID NO: 5204702 - DNA, 23 bp, Homo sapiens
aggcacatgttgttctcattgac

SEQ ID NO: 5204703 - DNA, 16 bp, Homo sapiens
aggcaccacagagaag

SEQ ID NO: 5204704 - DNA, 14 bp, Homo sapiens
aggcaccacagata

SEQ ID NO: 5204705 - DNA, 13 bp, Homo sapiens
aggcaccacagcc

SEQ ID NO: 5204706 - DNA, 14 bp, Homo sapiens
aggcaccacagcct

SEQ ID NO: 5204707 - DNA, 13 bp, Homo sapiens
aggcaccaccagg

SEQ ID NO: 5204708 - DNA, 22 bp, Homo sapiens
aggcaccacctctgtcacgttc

SEQ ID NO: 5204709 - DNA, 16 bp, Homo sapiens
aggcaccagcatccac

SEQ ID NO: 5204710 - DNA, 13 bp, Homo sapiens
aggcaccagctct

SEQ ID NO: 5204711 - DNA, 16 bp, Homo sapiens
aggcaccagctctgtg

SEQ ID NO: 5204712 - DNA, 13 bp, Homo sapiens
aggcaccaggaag

SEQ ID NO: 5204713 - DNA, 14 bp, Homo sapiens
aggcaccaggaagc

SEQ ID NO: 5204714 - DNA, 15 bp, Homo sapiens
aggcaccagtccagc

SEQ ID NO: 5204715 - DNA, 16 bp, Homo sapiens
aggcaccagtccagca

SEQ ID NO: 5204716 - DNA, 18 bp, Homo sapiens
aggcaccagtccagcaaa

SEQ ID NO: 5204717 - DNA, 14 bp, Homo sapiens
aggcaccatctccc

SEQ ID NO: 5204718 - DNA, 15 bp, Homo sapiens
aggcaccatctgcca

SEQ ID NO: 5204719 - DNA, 18 bp, Homo sapiens
aggcaccatctgccaatg

SEQ ID NO: 5204720 - DNA, 13 bp, Homo sapiens
aggcaccatgcaa

SEQ ID NO: 5204721 - DNA, 17 bp, Homo sapiens
aggcaccatgctgggcc

SEQ ID NO: 5204722 - DNA, 19 bp, Homo sapiens
aggcaccattcaggaacct

SEQ ID NO: 5204723 - DNA, 14 bp, Homo sapiens
aggcaccattgctt

SEQ ID NO: 5204724 - DNA, 16 bp, Homo sapiens
aggcacccacatcccc

SEQ ID NO: 5204725 - DNA, 15 bp, Homo sapiens
aggcacccaccatca

SEQ ID NO: 5204726 - DNA, 21 bp, Homo sapiens
aggcacccaccatcatgtctg

SEQ ID NO: 5204727 - DNA, 21 bp, Homo sapiens
aggcacccatcctagagaaaa

SEQ ID NO: 5204728 - DNA, 14 bp, Homo sapiens
aggcacccatctgt

SEQ ID NO: 5204729 - DNA, 22 bp, Homo sapiens
aggcacccccaggattcccaga

SEQ ID NO: 5204730 - DNA, 17 bp, Homo sapiens
aggcaccccctggagag

SEQ ID NO: 5204731 - DNA, 23 bp, Homo sapiens
aggcaccccctggcttgaacctt

SEQ ID NO: 5204732 - DNA, 22 bp, Homo sapiens
aggcacccctccgtgtggagca

SEQ ID NO: 5204733 - DNA, 19 bp, Homo sapiens
aggcacccctttccccagc

SEQ ID NO: 5204734 - DNA, 14 bp, Homo sapiens
aggcaccctcaggg

SEQ ID NO: 5204735 - DNA, 17 bp, Homo sapiens
aggcaccctcagggagc

SEQ ID NO: 5204736 - DNA, 22 bp, Homo sapiens
aggcaccgccacgtcccagcat

SEQ ID NO: 5204737 - DNA, 17 bp, Homo sapiens
aggcaccgctgatgggg

SEQ ID NO: 5204738 - DNA, 21 bp, Homo sapiens
aggcaccggacgctggagacc

SEQ ID NO: 5204739 - DNA, 13 bp, Homo sapiens
aggcaccggcgct

SEQ ID NO: 5204740 - DNA, 20 bp, Homo sapiens
aggcaccggcgctgcaggta

SEQ ID NO: 5204741 - DNA, 16 bp, Homo sapiens
aggcaccgggctggct

SEQ ID NO: 5204742 - DNA, 19 bp, Homo sapiens
aggcaccgggctggctgct

SEQ ID NO: 5204743 - DNA, 18 bp, Homo sapiens
aggcaccgtccaggcccc

SEQ ID NO: 5204744 - DNA, 21 bp, Homo sapiens
aggcacctacactcacctgca

SEQ ID NO: 5204745 - DNA, 17 bp, Homo sapiens
aggcacctagcaattcc

SEQ ID NO: 5204746 - DNA, 18 bp, Homo sapiens
aggcacctcaagaagaag

SEQ ID NO: 5204747 - DNA, 18 bp, Homo sapiens
aggcacctctcctgcccc

SEQ ID NO: 5204748 - DNA, 13 bp, Homo sapiens
aggcacctcttcc

SEQ ID NO: 5204749 - DNA, 18 bp, Homo sapiens
aggcacctgcaggttggg

SEQ ID NO: 5204750 - DNA, 14 bp, Homo sapiens
aggcacctgcattt

SEQ ID NO: 5204751 - DNA, 16 bp, Homo sapiens
aggcacctgcccccac

SEQ ID NO: 5204752 - DNA, 23 bp, Homo sapiens
aggcacctgcccccacagctcct

SEQ ID NO: 5204753 - DNA, 11 bp, Homo sapiens
aggcacctgct

SEQ ID NO: 5204754 - DNA, 12 bp, Homo sapiens
aggcacctgctc

SEQ ID NO: 5204755 - DNA, 14 bp, Homo sapiens
aggcacctggcctg

SEQ ID NO: 5204756 - DNA, 17 bp, Homo sapiens
aggcacctggcctgctg

SEQ ID NO: 5204757 - DNA, 19 bp, Homo sapiens
aggcacctggcctgctggg

SEQ ID NO: 5204758 - DNA, 21 bp, Homo sapiens
aggcacctggcctgctgggaa

SEQ ID NO: 5204759 - DNA, 20 bp, Homo sapiens
aggcacctggtggccatgct

SEQ ID NO: 5204760 - DNA, 19 bp, Homo sapiens
aggcaccttaactggagac

SEQ ID NO: 5204761 - DNA, 16 bp, Homo sapiens
aggcaccttttactgt

SEQ ID NO: 5204762 - DNA, 19 bp, Homo sapiens
aggcacgaacccacctgct

SEQ ID NO: 5204763 - DNA, 21 bp, Homo sapiens
aggcacgaacccacctgctga

SEQ ID NO: 5204764 - DNA, 14 bp, Homo sapiens
aggcacgcaccact

SEQ ID NO: 5204765 - DNA, 16 bp, Homo sapiens
aggcacgcaccactgc

SEQ ID NO: 5204766 - DNA, 14 bp, Homo sapiens
aggcacggccacgt

SEQ ID NO: 5204767 - DNA, 15 bp, Homo sapiens
aggcacgggtccctg

SEQ ID NO: 5204768 - DNA, 16 bp, Homo sapiens
aggcacgtctcctgct

SEQ ID NO: 5204769 - DNA, 18 bp, Homo sapiens
aggcacgtctcctgctgc

SEQ ID NO: 5204770 - DNA, 19 bp, Homo sapiens
aggcacgtttggcatttct

SEQ ID NO: 5204771 - DNA, 20 bp, Homo sapiens
aggcacgtttggcatttctc

SEQ ID NO: 5204772 - DNA, 22 bp, Homo sapiens
aggcactaagaggggctggacc

SEQ ID NO: 5204773 - DNA, 21 bp, Homo sapiens
aggcactaagtcatggtcctg

SEQ ID NO: 5204774 - DNA, 22 bp, Homo sapiens
aggcactaagtctctagcctct

SEQ ID NO: 5204775 - DNA, 16 bp, Homo sapiens
aggcactacatgaaat

SEQ ID NO: 5204776 - DNA, 15 bp, Homo sapiens
aggcactagtcaccg

SEQ ID NO: 5204777 - DNA, 13 bp, Homo sapiens
aggcactcagtga

SEQ ID NO: 5204778 - DNA, 20 bp, Homo sapiens
aggcactcagtgagcctcct

SEQ ID NO: 5204779 - DNA, 23 bp, Homo sapiens
aggcactcgctgttatcaaatag

SEQ ID NO: 5204780 - DNA, 23 bp, Homo sapiens
aggcactctcatcaccccagagg

SEQ ID NO: 5204781 - DNA, 23 bp, Homo sapiens
aggcactctggggctggcaccag

SEQ ID NO: 5204782 - DNA, 16 bp, Homo sapiens
aggcactctgttattt

SEQ ID NO: 5204783 - DNA, 13 bp, Homo sapiens
aggcactgaagcc

SEQ ID NO: 5204784 - DNA, 15 bp, Homo sapiens
aggcactgaagcccg

SEQ ID NO: 5204785 - DNA, 23 bp, Homo sapiens
aggcactgagataccagcgagga

SEQ ID NO: 5204786 - DNA, 14 bp, Homo sapiens
aggcactgagcagg

SEQ ID NO: 5204787 - DNA, 18 bp, Homo sapiens
agctggtgtcactctgcc

SEQ ID NO: 5204788 - DNA, 21 bp, Homo sapiens
agctggtgtcactctgcctct

SEQ ID NO: 5204789 - DNA, 22 bp, Homo sapiens
agctggtgtcactctgcctcta

SEQ ID NO: 5204790 - DNA, 24 bp, Homo sapiens
agctggtgtcagcccctcttccct

SEQ ID NO: 5204791 - DNA, 19 bp, Homo sapiens
agctggttcctgctagaaa

SEQ ID NO: 5204792 - DNA, 21 bp, Homo sapiens
agctggtttcctcattcctga

SEQ ID NO: 5204793 - DNA, 15 bp, Homo sapiens
agctggtttcctgcc

SEQ ID NO: 5204794 - DNA, 12 bp, Homo sapiens
agctgtaaaacg

SEQ ID NO: 5204795 - DNA, 14 bp, Homo sapiens
agctgtaaaccaga

SEQ ID NO: 5204796 - DNA, 17 bp, Homo sapiens
agctgtaaaccagagag

SEQ ID NO: 5204797 - DNA, 19 bp, Homo sapiens
agctgtaaatacatgtgtg

SEQ ID NO: 5204798 - DNA, 20 bp, Homo sapiens
agctgtaaatacatgtgtgg

SEQ ID NO: 5204799 - DNA, 15 bp, Homo sapiens
agctgtaacagttct

SEQ ID NO: 5204800 - DNA, 17 bp, Homo sapiens
agctgtaacagttcttt

SEQ ID NO: 5204801 - DNA, 17 bp, Homo sapiens
agctgtaagaagagact

SEQ ID NO: 5204802 - DNA, 14 bp, Homo sapiens
agctgtaagcaagt

SEQ ID NO: 5204803 - DNA, 13 bp, Homo sapiens
agctgtaaggcat

SEQ ID NO: 5204804 - DNA, 24 bp, Homo sapiens
agctgtaagggcagtgcccatgtg

SEQ ID NO: 5204805 - DNA, 19 bp, Homo sapiens
agctgtaatgtttcacaga

SEQ ID NO: 5204806 - DNA, 20 bp, Homo sapiens
agctgtaatttcgccttaaa

SEQ ID NO: 5204807 - DNA, 13 bp, Homo sapiens
agctgtacaaatc

SEQ ID NO: 5204808 - DNA, 18 bp, Homo sapiens
agctgtaccggccactgc

SEQ ID NO: 5204809 - DNA, 20 bp, Homo sapiens
agctgtaccggccactgcaa

SEQ ID NO: 5204810 - DNA, 22 bp, Homo sapiens
agctgtaccggccactgcaacc

SEQ ID NO: 5204811 - DNA, 19 bp, Homo sapiens
agctgtacgcgtttgtctc

SEQ ID NO: 5204812 - DNA, 20 bp, Homo sapiens
agctgtactataagtagttg

SEQ ID NO: 5204813 - DNA, 16 bp, Homo sapiens
agctgtactcagagca

SEQ ID NO: 5204814 - DNA, 18 bp, Homo sapiens
agctgtactcagagcaga

SEQ ID NO: 5204815 - DNA, 16 bp, Homo sapiens
agctgtactgagttct

SEQ ID NO: 5204816 - DNA, 20 bp, Homo sapiens
agctgtacttcttgaatata

SEQ ID NO: 5204817 - DNA, 15 bp, Homo sapiens
agctgtacttttacc

SEQ ID NO: 5204818 - DNA, 15 bp, Homo sapiens
agctgtagaaatgta

SEQ ID NO: 5204819 - DNA, 21 bp, Homo sapiens
agctgtagaactctgcaggca

SEQ ID NO: 5204820 - DNA, 22 bp, Homo sapiens
agctgtagaactctgcaggcag

SEQ ID NO: 5204821 - DNA, 13 bp, Homo sapiens
agctgtagaggac

SEQ ID NO: 5204822 - DNA, 14 bp, Homo sapiens
agctgtagccatgg

SEQ ID NO: 5204823 - DNA, 16 bp, Homo sapiens
agctgtagccatggct

SEQ ID NO: 5204824 - DNA, 21 bp, Homo sapiens
agctgtagctacaagggaagc

SEQ ID NO: 5204825 - DNA, 16 bp, Homo sapiens
agctgtagctcccgag

SEQ ID NO: 5204826 - DNA, 13 bp, Homo sapiens
agctgtaggagag

SEQ ID NO: 5204827 - DNA, 19 bp, Homo sapiens
agctgtagttttccctgca

SEQ ID NO: 5204828 - DNA, 19 bp, Homo sapiens
agctgtataactgtgcaga

SEQ ID NO: 5204829 - DNA, 21 bp, Homo sapiens
agctgtatatatatatgtgtg

SEQ ID NO: 5204830 - DNA, 22 bp, Homo sapiens
agctgtatatatatatgtgtgt

SEQ ID NO: 5204831 - DNA, 23 bp, Homo sapiens
agctgtatatttgaaactgctaa

SEQ ID NO: 5204832 - DNA, 11 bp, Homo sapiens
agctgtatcaa

SEQ ID NO: 5204833 - DNA, 17 bp, Homo sapiens
agctgtatgaaagggac

SEQ ID NO: 5204834 - DNA, 14 bp, Homo sapiens
agctgtatgatttg

SEQ ID NO: 5204835 - DNA, 16 bp, Homo sapiens
agctgtatgatttgtt

SEQ ID NO: 5204836 - DNA, 20 bp, Homo sapiens
agctgtatgatttgttttga

SEQ ID NO: 5204837 - DNA, 11 bp, Homo sapiens
agctgtattaa

SEQ ID NO: 5204838 - DNA, 13 bp, Homo sapiens
agctgtattaagt

SEQ ID NO: 5204839 - DNA, 20 bp, Homo sapiens
agctgtattaagtgactgac

SEQ ID NO: 5204840 - DNA, 20 bp, Homo sapiens
agctgtattcatatattgca

SEQ ID NO: 5204841 - DNA, 21 bp, Homo sapiens
agctgtattcatatattgcat

SEQ ID NO: 5204842 - DNA, 15 bp, Homo sapiens
agctgtattccttta

SEQ ID NO: 5204843 - DNA, 12 bp, Homo sapiens
agctgtatttat

SEQ ID NO: 5204844 - DNA, 14 bp, Homo sapiens
agctgtatttatat

SEQ ID NO: 5204845 - DNA, 23 bp, Homo sapiens
agctgtattttggctttctccct

SEQ ID NO: 5204846 - DNA, 18 bp, Homo sapiens
agctgtcacaacttgtgt

SEQ ID NO: 5204847 - DNA, 24 bp, Homo sapiens
agctgtcaccactacagtaagctg

SEQ ID NO: 5204848 - DNA, 16 bp, Homo sapiens
agctgtcacctgctca

SEQ ID NO: 5204849 - DNA, 17 bp, Homo sapiens
agctgtcacctgctcac

SEQ ID NO: 5204850 - DNA, 21 bp, Homo sapiens
agctgtcacctgctcacaggg

SEQ ID NO: 5204851 - DNA, 18 bp, Homo sapiens
agctgtcagaagtttcta

SEQ ID NO: 5204852 - DNA, 17 bp, Homo sapiens
agctgtcatcaacattc

SEQ ID NO: 5204853 - DNA, 21 bp, Homo sapiens
agctgtcatcaacattcttgt

SEQ ID NO: 5204854 - DNA, 10 bp, Homo sapiens
agctgtcatg

SEQ ID NO: 5204855 - DNA, 20 bp, Homo sapiens
agctgtcatggaaaagccca

SEQ ID NO: 5204856 - DNA, 14 bp, Homo sapiens
agctgtccagagaa

SEQ ID NO: 5204857 - DNA, 11 bp, Homo sapiens
agctgtcccaa

SEQ ID NO: 5204858 - DNA, 16 bp, Homo sapiens
agctgtcccctctgtc

SEQ ID NO: 5204859 - DNA, 13 bp, Homo sapiens
agctgtccctgca

SEQ ID NO: 5204860 - DNA, 15 bp, Homo sapiens
agctgtccctgccct

SEQ ID NO: 5204861 - DNA, 15 bp, Homo sapiens
agctgtccctgtcac

SEQ ID NO: 5204862 - DNA, 18 bp, Homo sapiens
agctgtccctgtcaccaa

SEQ ID NO: 5204863 - DNA, 20 bp, Homo sapiens
agctgtccctgtcaccaagc

SEQ ID NO: 5204864 - DNA, 14 bp, Homo sapiens
agctgtcccttgct

SEQ ID NO: 5204865 - DNA, 17 bp, Homo sapiens
agctgtcctccctccac

SEQ ID NO: 5204866 - DNA, 15 bp, Homo sapiens
agctgtcctcctggc

SEQ ID NO: 5204867 - DNA, 17 bp, Homo sapiens
agctgtcctcctggcac

SEQ ID NO: 5204868 - DNA, 22 bp, Homo sapiens
agctgtcctgcagcaaacactc

SEQ ID NO: 5204869 - DNA, 14 bp, Homo sapiens
agctgtcctggagg

SEQ ID NO: 5204870 - DNA, 15 bp, Homo sapiens
agctgtcctggaggt

SEQ ID NO: 5204871 - DNA, 13 bp, Homo sapiens
agctgtcgcatct

SEQ ID NO: 5204872 - DNA, 14 bp, Homo sapiens
agctgtcgctgcct

SEQ ID NO: 5204873 - DNA, 17 bp, Homo sapiens
agctgtcggagggctgg

SEQ ID NO: 5204874 - DNA, 18 bp, Homo sapiens
agctgtcggagggctgga

SEQ ID NO: 5204875 - DNA, 20 bp, Homo sapiens
agctgtcggagggctggaca

SEQ ID NO: 5204876 - DNA, 13 bp, Homo sapiens
agctgtcgtctga

SEQ ID NO: 5204877 - DNA, 22 bp, Homo sapiens
agctgtctaacccccagctggg

SEQ ID NO: 5204878 - DNA, 14 bp, Homo sapiens
agctgtctccagga

SEQ ID NO: 5204879 - DNA, 17 bp, Homo sapiens
agctgtctctcttgttg

SEQ ID NO: 5204880 - DNA, 18 bp, Homo sapiens
agctgtctcttcggcagg

SEQ ID NO: 5204881 - DNA, 17 bp, Homo sapiens
agctgtctgaagcccaa

SEQ ID NO: 5204882 - DNA, 15 bp, Homo sapiens
agctgtctgccaggc

SEQ ID NO: 5204883 - DNA, 16 bp, Homo sapiens
agctgtctgccaggca

SEQ ID NO: 5204884 - DNA, 15 bp, Homo sapiens
agctgtctgtctcta

SEQ ID NO: 5204885 - DNA, 16 bp, Homo sapiens
agctgtctgtggcttc

SEQ ID NO: 5204886 - DNA, 16 bp, Homo sapiens
agctgtcttcccctga

SEQ ID NO: 5204887 - DNA, 19 bp, Homo sapiens
agctgtcttgtcatctttt

SEQ ID NO: 5204888 - DNA, 14 bp, Homo sapiens
agctgtcttttgga

SEQ ID NO: 5204889 - DNA, 17 bp, Homo sapiens
agctgtcttttggagga

SEQ ID NO: 5204890 - DNA, 19 bp, Homo sapiens
agctgtcttttggaggacg

SEQ ID NO: 5204891 - DNA, 14 bp, Homo sapiens
agctgtgaaatcca

SEQ ID NO: 5204892 - DNA, 17 bp, Homo sapiens
agctgtgaaattgaagt

SEQ ID NO: 5204893 - DNA, 15 bp, Homo sapiens
agctgtgaacaggct

SEQ ID NO: 5204894 - DNA, 20 bp, Homo sapiens
agctgtgaactcagagcccc

SEQ ID NO: 5204895 - DNA, 16 bp, Homo sapiens
agctgtgaatggctgt

SEQ ID NO: 5204896 - DNA, 14 bp, Homo sapiens
agctgtgacccaga

SEQ ID NO: 5204897 - DNA, 16 bp, Homo sapiens
agctgtgacccagagg

SEQ ID NO: 5204898 - DNA, 14 bp, Homo sapiens
agctgtgacctgct

SEQ ID NO: 5204899 - DNA, 16 bp, Homo sapiens
agctgtgacctgctga

SEQ ID NO: 5204900 - DNA, 23 bp, Homo sapiens
agctgtgactgagggcctggtca

SEQ ID NO: 5204901 - DNA, 18 bp, Homo sapiens
agctgtgagacagtggga

SEQ ID NO: 5204902 - DNA, 19 bp, Homo sapiens
agctgtgagacagtgggaa

SEQ ID NO: 5204903 - DNA, 21 bp, Homo sapiens
agctgtgagccatgcctccct

SEQ ID NO: 5204904 - DNA, 15 bp, Homo sapiens
agctgtgagccttgg

SEQ ID NO: 5204905 - DNA, 18 bp, Homo sapiens
agctgtgattatgccatt

SEQ ID NO: 5204906 - DNA, 15 bp, Homo sapiens
agctgtgcacaaagt

SEQ ID NO: 5204907 - DNA, 13 bp, Homo sapiens
agctgtgcagagg

SEQ ID NO: 5204908 - DNA, 15 bp, Homo sapiens
agctgtgcagcacgt

SEQ ID NO: 5204909 - DNA, 23 bp, Homo sapiens
agctgtgcagcacgtctcagaga

SEQ ID NO: 5204910 - DNA, 12 bp, Homo sapiens
agctgtgcaggt

SEQ ID NO: 5204911 - DNA, 19 bp, Homo sapiens
agctgtgcaggtggggaga

SEQ ID NO: 5204912 - DNA, 20 bp, Homo sapiens
agctgtgcatccaatttatt

SEQ ID NO: 5204913 - DNA, 13 bp, Homo sapiens
agctgtgccaccc

SEQ ID NO: 5204914 - DNA, 19 bp, Homo sapiens
agctgtgccaccctgggct

SEQ ID NO: 5204915 - DNA, 21 bp, Homo sapiens
agctgtgccaccctgggctct

SEQ ID NO: 5204916 - DNA, 11 bp, Homo sapiens
agctgtgccag

SEQ ID NO: 5204917 - DNA, 13 bp, Homo sapiens
agctgtgcccctc

SEQ ID NO: 5204918 - DNA, 14 bp, Homo sapiens
agctgtgcctgctc

SEQ ID NO: 5204919 - DNA, 21 bp, Homo sapiens
agctgtgcctgctcagcagcc

SEQ ID NO: 5204920 - DNA, 16 bp, Homo sapiens
agctgtgccttccctt

SEQ ID NO: 5204921 - DNA, 19 bp, Homo sapiens
agctgtgctccacactcag

SEQ ID NO: 5204922 - DNA, 21 bp, Homo sapiens
agctgtgctccacactcagaa

SEQ ID NO: 5204923 - DNA, 22 bp, Homo sapiens
agctgtgctccacactcagaaa

SEQ ID NO: 5204924 - DNA, 23 bp, Homo sapiens
agctgtgctcgggtgctgccagc

SEQ ID NO: 5204925 - DNA, 17 bp, Homo sapiens
agctgtgctctggacag

SEQ ID NO: 5204926 - DNA, 21 bp, Homo sapiens
agctgtgctgggaagcccgga

SEQ ID NO: 5204927 - DNA, 16 bp, Homo sapiens
agctgtgctgggaggt

SEQ ID NO: 5204928 - DNA, 21 bp, Homo sapiens
agctgtgctgggaggtcccag

SEQ ID NO: 5204929 - DNA, 22 bp, Homo sapiens
agctgtgctgggaggtcccagg

SEQ ID NO: 5204930 - DNA, 19 bp, Homo sapiens
agctgtgcttatggtacca

SEQ ID NO: 5204931 - DNA, 15 bp, Homo sapiens
agctgtggaaatggt

SEQ ID NO: 5204932 - DNA, 19 bp, Homo sapiens
agctgtggactttgttcac

SEQ ID NO: 5204933 - DNA, 22 bp, Homo sapiens
agctgtggaggattgctatctg

SEQ ID NO: 5204934 - DNA, 19 bp, Homo sapiens
agctgtggcctcaccctga

SEQ ID NO: 5204935 - DNA, 22 bp, Homo sapiens
agctgtggctcaacacatgaga

SEQ ID NO: 5204936 - DNA, 14 bp, Homo sapiens
agctgtggctggag

SEQ ID NO: 5204937 - DNA, 15 bp, Homo sapiens
agctgtggctggagg

SEQ ID NO: 5204938 - DNA, 22 bp, Homo sapiens
agctgtgggcaaaagagtgtaa

SEQ ID NO: 5204939 - DNA, 23 bp, Homo sapiens
agctgtgggcaaaagagtgtaaa

SEQ ID NO: 5204940 - DNA, 20 bp, Homo sapiens
agctgtggggaacatggctg

SEQ ID NO: 5204941 - DNA, 21 bp, Homo sapiens
agctgtgggtacagagaggtc

SEQ ID NO: 5204942 - DNA, 20 bp, Homo sapiens
agctgtggtacaaatgtgat

SEQ ID NO: 5204943 - DNA, 16 bp, Homo sapiens
agctgtggtcccaccc

SEQ ID NO: 5204944 - DNA, 21 bp, Homo sapiens
agctgtggtcccacccaggaa

SEQ ID NO: 5204945 - DNA, 22 bp, Homo sapiens
agctgtggtcccacccaggaag

SEQ ID NO: 5204946 - DNA, 22 bp, Homo sapiens
agctgtggttttcttttgccat

SEQ ID NO: 5204947 - DNA, 13 bp, Homo sapiens
agctgtgtatctg

SEQ ID NO: 5204948 - DNA, 20 bp, Homo sapiens
agctgtgtccggcccagttt

SEQ ID NO: 5204949 - DNA, 16 bp, Homo sapiens
agctgtgtctctgtat

SEQ ID NO: 5204950 - DNA, 13 bp, Homo sapiens
agctgtgtctgag

SEQ ID NO: 5204951 - DNA, 15 bp, Homo sapiens
agctgtgtctgagcc

SEQ ID NO: 5204952 - DNA, 16 bp, Homo sapiens
agctgtgtctgagccc

SEQ ID NO: 5204953 - DNA, 14 bp, Homo sapiens
agctgtgtctgcca

SEQ ID NO: 5204954 - DNA, 13 bp, Homo sapiens
agctgtgtgaaat

SEQ ID NO: 5204955 - DNA, 14 bp, Homo sapiens
agctgtgtgaaata

SEQ ID NO: 5204956 - DNA, 16 bp, Homo sapiens
agctgtgtggcagtct

SEQ ID NO: 5204957 - DNA, 18 bp, Homo sapiens
agctgtgttacttgaagt

SEQ ID NO: 5204958 - DNA, 19 bp, Homo sapiens
agctgtgttacttgaagta

SEQ ID NO: 5204959 - DNA, 19 bp, Homo sapiens
agctgtgttattcctggtt

SEQ ID NO: 5204960 - DNA, 20 bp, Homo sapiens
agctgtgttgaaacagaaaa

SEQ ID NO: 5204961 - DNA, 20 bp, Homo sapiens
agctgttaaaatacataact

SEQ ID NO: 5204962 - DNA, 12 bp, Homo sapiens
agctgttaaact

SEQ ID NO: 5204963 - DNA, 14 bp, Homo sapiens
agctgttaaactgt

SEQ ID NO: 5204964 - DNA, 16 bp, Homo sapiens
agctgttaaactgtta

SEQ ID NO: 5204965 - DNA, 22 bp, Homo sapiens
agctgttaaactgttagcactg

SEQ ID NO: 5204966 - DNA, 15 bp, Homo sapiens
aggcactgcacataa

SEQ ID NO: 5204967 - DNA, 15 bp, Homo sapiens
aggcactgccttctc

SEQ ID NO: 5204968 - DNA, 16 bp, Homo sapiens
aggcactgctgcccag

SEQ ID NO: 5204969 - DNA, 15 bp, Homo sapiens
aggcactggtggcat

SEQ ID NO: 5204970 - DNA, 16 bp, Homo sapiens
aggcactggtggcatc

SEQ ID NO: 5204971 - DNA, 19 bp, Homo sapiens
aggcactgtagttctaaga

SEQ ID NO: 5204972 - DNA, 21 bp, Homo sapiens
aggcactgtagttctaagact

SEQ ID NO: 5204973 - DNA, 21 bp, Homo sapiens
aggcacttaaagccttttcct

SEQ ID NO: 5204974 - DNA, 16 bp, Homo sapiens
aggcacttattgtaaa

SEQ ID NO: 5204975 - DNA, 21 bp, Homo sapiens
aggcacttattgtaaatttta

SEQ ID NO: 5204976 - DNA, 14 bp, Homo sapiens
aggcacttcctccc

SEQ ID NO: 5204977 - DNA, 16 bp, Homo sapiens
aggcacttcctcccct

SEQ ID NO: 5204978 - DNA, 20 bp, Homo sapiens
aggcacttcctcccctcgcc

SEQ ID NO: 5204979 - DNA, 15 bp, Homo sapiens
aggcacttctgcctg

SEQ ID NO: 5204980 - DNA, 21 bp, Homo sapiens
aggcacttgaggctttcagtg

SEQ ID NO: 5204981 - DNA, 21 bp, Homo sapiens
aggcactttttaacattctca

SEQ ID NO: 5204982 - DNA, 15 bp, Homo sapiens
aggcagaaagataca

SEQ ID NO: 5204983 - DNA, 17 bp, Homo sapiens
aggcagaaagatacaga

SEQ ID NO: 5204984 - DNA, 20 bp, Homo sapiens
aggcagaaagatacagacat

SEQ ID NO: 5204985 - DNA, 22 bp, Homo sapiens
aggcagaaagatacagacattc

SEQ ID NO: 5204986 - DNA, 19 bp, Homo sapiens
aggcagaaagcaaaattat

SEQ ID NO: 5204987 - DNA, 16 bp, Homo sapiens
aggcagaaagcagagg

SEQ ID NO: 5204988 - DNA, 17 bp, Homo sapiens
aggcagaaagcagaggc

SEQ ID NO: 5204989 - DNA, 17 bp, Homo sapiens
aggcagaaagggtaggt

SEQ ID NO: 5204990 - DNA, 18 bp, Homo sapiens
aggcagaaatagttgtct

SEQ ID NO: 5204991 - DNA, 21 bp, Homo sapiens
aggcagaaatagttgtctgtg

SEQ ID NO: 5204992 - DNA, 22 bp, Homo sapiens
aggcagaaatagttgtctgtgc

SEQ ID NO: 5204993 - DNA, 14 bp, Homo sapiens
aggcagaaatataa

SEQ ID NO: 5204994 - DNA, 13 bp, Homo sapiens
aggcagaaccagc

SEQ ID NO: 5204995 - DNA, 18 bp, Homo sapiens
aggcagaaccggtcccag

SEQ ID NO: 5204996 - DNA, 23 bp, Homo sapiens
aggcagaaccggtcccagcctgg

SEQ ID NO: 5204997 - DNA, 15 bp, Homo sapiens
aggcagaagaagctg

SEQ ID NO: 5204998 - DNA, 20 bp, Homo sapiens
aggcagaagaatctttcttc

SEQ ID NO: 5204999 - DNA, 20 bp, Homo sapiens
aggcagaagcttggaggagg

SEQ ID NO: 5205000 - DNA, 18 bp, Homo sapiens
aggcagaataagaaaaca

SEQ ID NO: 5205001 - DNA, 14 bp, Homo sapiens
aggcagaatggctg

SEQ ID NO: 5205002 - DNA, 23 bp, Homo sapiens
aggcagaatggtgggctccagag

SEQ ID NO: 5205003 - DNA, 21 bp, Homo sapiens
aggcagacaaccttgtcccaa

SEQ ID NO: 5205004 - DNA, 16 bp, Homo sapiens
aggcagacaagagctg

SEQ ID NO: 5205005 - DNA, 14 bp, Homo sapiens
aggcagacacaggg

SEQ ID NO: 5205006 - DNA, 15 bp, Homo sapiens
aggcagacacaggga

SEQ ID NO: 5205007 - DNA, 14 bp, Homo sapiens
aggcagacagcagc

SEQ ID NO: 5205008 - DNA, 18 bp, Homo sapiens
aggcagacagcagctcag

SEQ ID NO: 5205009 - DNA, 15 bp, Homo sapiens
aggcagacaggaagg

SEQ ID NO: 5205010 - DNA, 16 bp, Homo sapiens
aggcagacaggaagga

SEQ ID NO: 5205011 - DNA, 18 bp, Homo sapiens
aggcagacaggaaggaag

SEQ ID NO: 5205012 - DNA, 19 bp, Homo sapiens
aggcagacgtctgtcaggg

SEQ ID NO: 5205013 - DNA, 23 bp, Homo sapiens
aggcagacgtctgtcaggggctt

SEQ ID NO: 5205014 - DNA, 18 bp, Homo sapiens
aggcagacgtggggaggg

SEQ ID NO: 5205015 - DNA, 22 bp, Homo sapiens
aggcagacgtggggagggtgga

SEQ ID NO: 5205016 - DNA, 15 bp, Homo sapiens
aggcagactcgaggg

SEQ ID NO: 5205017 - DNA, 20 bp, Homo sapiens
aggcagactctttatgcttg

SEQ ID NO: 5205018 - DNA, 9 bp, Homo sapiens
aggcagaga

SEQ ID NO: 5205019 - DNA, 16 bp, Homo sapiens
aggcagagaaaacaca

SEQ ID NO: 5205020 - DNA, 22 bp, Homo sapiens
aggcagagaaagaagagacagg

SEQ ID NO: 5205021 - DNA, 13 bp, Homo sapiens
aggcagagaaagg

SEQ ID NO: 5205022 - DNA, 22 bp, Homo sapiens
aggcagagaacagaactggagg

SEQ ID NO: 5205023 - DNA, 13 bp, Homo sapiens
aggcagagaagaa

SEQ ID NO: 5205024 - DNA, 15 bp, Homo sapiens
aggcagagaagaaag

SEQ ID NO: 5205025 - DNA, 14 bp, Homo sapiens
aggcagagaagtgg

SEQ ID NO: 5205026 - DNA, 16 bp, Homo sapiens
aggcagagaagtggag

SEQ ID NO: 5205027 - DNA, 21 bp, Homo sapiens
aggcagagacaataaaacatt

SEQ ID NO: 5205028 - DNA, 16 bp, Homo sapiens
aggcagagacctccaa

SEQ ID NO: 5205029 - DNA, 15 bp, Homo sapiens
aggcagagaggagtg

SEQ ID NO: 5205030 - DNA, 16 bp, Homo sapiens
aggcagagagtacaga

SEQ ID NO: 5205031 - DNA, 19 bp, Homo sapiens
aggcagagagtacagactg

SEQ ID NO: 5205032 - DNA, 23 bp, Homo sapiens
aggcagagagtacagactgcaga

SEQ ID NO: 5205033 - DNA, 15 bp, Homo sapiens
aggcagagcgggagg

SEQ ID NO: 5205034 - DNA, 17 bp, Homo sapiens
aggcagagcggggaggt

SEQ ID NO: 5205035 - DNA, 19 bp, Homo sapiens
aggcagagcggggaggtgc

SEQ ID NO: 5205036 - DNA, 23 bp, Homo sapiens
aggcagagcggggaggtgcctga

SEQ ID NO: 5205037 - DNA, 12 bp, Homo sapiens
aggcagagctga

SEQ ID NO: 5205038 - DNA, 21 bp, Homo sapiens
aggcagagctgacgggaggcc

SEQ ID NO: 5205039 - DNA, 13 bp, Homo sapiens
aggcagagctgag

SEQ ID NO: 5205040 - DNA, 15 bp, Homo sapiens
aggcagagctgaggg

SEQ ID NO: 5205041 - DNA, 20 bp, Homo sapiens
aggcagagctgagggccctg

SEQ ID NO: 5205042 - DNA, 12 bp, Homo sapiens
aggcagaggaat

SEQ ID NO: 5205043 - DNA, 21 bp, Homo sapiens
aggcagaggaatttggctgct

SEQ ID NO: 5205044 - DNA, 13 bp, Homo sapiens
aggcagaggacag

SEQ ID NO: 5205045 - DNA, 15 bp, Homo sapiens
aggcagaggagagta

SEQ ID NO: 5205046 - DNA, 17 bp, Homo sapiens
aggcagaggcccaggct

SEQ ID NO: 5205047 - DNA, 13 bp, Homo sapiens
aggcagaggctgc

SEQ ID NO: 5205048 - DNA, 17 bp, Homo sapiens
aggcagaggctggcacc

SEQ ID NO: 5205049 - DNA, 23 bp, Homo sapiens
aggcagagggatgaaatgccaag

SEQ ID NO: 5205050 - DNA, 12 bp, Homo sapiens
aggcagagggca

SEQ ID NO: 5205051 - DNA, 11 bp, Homo sapiens
aggcagagggt

SEQ ID NO: 5205052 - DNA, 20 bp, Homo sapiens
aggcagaggttgcagtgagt

SEQ ID NO: 5205053 - DNA, 15 bp, Homo sapiens
aggcagaggttttaa

SEQ ID NO: 5205054 - DNA, 23 bp, Homo sapiens
aggcagaggttttaatgtctgtt

SEQ ID NO: 5205055 - DNA, 22 bp, Homo sapiens
aggcagagtctcattctgttgc

SEQ ID NO: 5205056 - DNA, 22 bp, Homo sapiens
aggcagagtgaaataaaatgct

SEQ ID NO: 5205057 - DNA, 19 bp, Homo sapiens
aggcagagtgccccacctg

SEQ ID NO: 5205058 - DNA, 21 bp, Homo sapiens
aggcagagtggcgtggcctcc

SEQ ID NO: 5205059 - DNA, 19 bp, Homo sapiens
aggcagagtttgccttcct

SEQ ID NO: 5205060 - DNA, 18 bp, Homo sapiens
aggcagataactgctgta

SEQ ID NO: 5205061 - DNA, 16 bp, Homo sapiens
aggcagatctgtgccc

SEQ ID NO: 5205062 - DNA, 23 bp, Homo sapiens
aggcagatctgtgccccatgcct

SEQ ID NO: 5205063 - DNA, 17 bp, Homo sapiens
aggcagatgcccttgct

SEQ ID NO: 5205064 - DNA, 12 bp, Homo sapiens
aggcagatggag

SEQ ID NO: 5205065 - DNA, 17 bp, Homo sapiens
aggcagatggagcccat

SEQ ID NO: 5205066 - DNA, 18 bp, Homo sapiens
aggcagatggccactgct

SEQ ID NO: 5205067 - DNA, 20 bp, Homo sapiens
aggcagatggccactgctct

SEQ ID NO: 5205068 - DNA, 22 bp, Homo sapiens
aggcagatggccactgctcttg

SEQ ID NO: 5205069 - DNA, 18 bp, Homo sapiens
aggcagatgtggggctga

SEQ ID NO: 5205070 - DNA, 23 bp, Homo sapiens
aggcagatgtggggctgagctgg

SEQ ID NO: 5205071 - DNA, 15 bp, Homo sapiens
aggcagatgtttgcc

SEQ ID NO: 5205072 - DNA, 17 bp, Homo sapiens
aggcagattgaaaagga

SEQ ID NO: 5205073 - DNA, 20 bp, Homo sapiens
aggcagatttactgtcccag

SEQ ID NO: 5205074 - DNA, 14 bp, Homo sapiens
aggcagcaaagagg

SEQ ID NO: 5205075 - DNA, 14 bp, Homo sapiens
aggcagcaacagga

SEQ ID NO: 5205076 - DNA, 22 bp, Homo sapiens
aggcagcaacaggaccaggagc

SEQ ID NO: 5205077 - DNA, 15 bp, Homo sapiens
aggcagcaaggcccg

SEQ ID NO: 5205078 - DNA, 16 bp, Homo sapiens
aggcagcaaggtcatg

SEQ ID NO: 5205079 - DNA, 20 bp, Homo sapiens
aggcagcaagtcttaacaaa

SEQ ID NO: 5205080 - DNA, 21 bp, Homo sapiens
aggcagcaccacactgggtgc

SEQ ID NO: 5205081 - DNA, 23 bp, Homo sapiens
aggcagcaccacactgggtgcgt

SEQ ID NO: 5205082 - DNA, 22 bp, Homo sapiens
aggcagcaccaccacacagtca

SEQ ID NO: 5205083 - DNA, 16 bp, Homo sapiens
aggcagcacctggagc

SEQ ID NO: 5205084 - DNA, 23 bp, Homo sapiens
aggcagcagagagagaggacaga

SEQ ID NO: 5205085 - DNA, 14 bp, Homo sapiens
aggcagcaggggct

SEQ ID NO: 5205086 - DNA, 15 bp, Homo sapiens
aggcagcaggggctg

SEQ ID NO: 5205087 - DNA, 19 bp, Homo sapiens
aggcagcagtgtctgtacc

SEQ ID NO: 5205088 - DNA, 23 bp, Homo sapiens
aggcagcatcggggtggcccact

SEQ ID NO: 5205089 - DNA, 21 bp, Homo sapiens
aggcagcatgtatagttgctt

SEQ ID NO: 5205090 - DNA, 14 bp, Homo sapiens
aggcagccacaggg

SEQ ID NO: 5205091 - DNA, 18 bp, Homo sapiens
aggcagccacagggaagc

SEQ ID NO: 5205092 - DNA, 14 bp, Homo sapiens
aggcagccaccagt

SEQ ID NO: 5205093 - DNA, 13 bp, Homo sapiens
aggcagccacggc

SEQ ID NO: 5205094 - DNA, 12 bp, Homo sapiens
aggcagccagac

SEQ ID NO: 5205095 - DNA, 14 bp, Homo sapiens
aggcagccagatcc

SEQ ID NO: 5205096 - DNA, 16 bp, Homo sapiens
aggcagccagcatctg

SEQ ID NO: 5205097 - DNA, 20 bp, Homo sapiens
aggcagccagccgtggccag

SEQ ID NO: 5205098 - DNA, 18 bp, Homo sapiens
aggcagccaggccacaag

SEQ ID NO: 5205099 - DNA, 17 bp, Homo sapiens
aggcagccagtgccctg

SEQ ID NO: 5205100 - DNA, 22 bp, Homo sapiens
aggcagcccagcagtgtggaga

SEQ ID NO: 5205101 - DNA, 22 bp, Homo sapiens
aggcagcccagctcctgaataa

SEQ ID NO: 5205102 - DNA, 15 bp, Homo sapiens
aggcagcccaggaag

SEQ ID NO: 5205103 - DNA, 17 bp, Homo sapiens
aggcagcccaggaagtc

SEQ ID NO: 5205104 - DNA, 17 bp, Homo sapiens
aggcagccccattctgc

SEQ ID NO: 5205105 - DNA, 20 bp, Homo sapiens
aggcagccccattctgcctg

SEQ ID NO: 5205106 - DNA, 13 bp, Homo sapiens
aggcagccccctc

SEQ ID NO: 5205107 - DNA, 16 bp, Homo sapiens
aggcagccccctccac

SEQ ID NO: 5205108 - DNA, 17 bp, Homo sapiens
aggcagccccctccaca

SEQ ID NO: 5205109 - DNA, 21 bp, Homo sapiens
aggcagccccctccacaccag

SEQ ID NO: 5205110 - DNA, 18 bp, Homo sapiens
aggcagccctcacctctg

SEQ ID NO: 5205111 - DNA, 22 bp, Homo sapiens
aggcagccctcacctctgagga

SEQ ID NO: 5205112 - DNA, 13 bp, Homo sapiens
aggcagcctccag

SEQ ID NO: 5205113 - DNA, 15 bp, Homo sapiens
aggcagcctccagag

SEQ ID NO: 5205114 - DNA, 17 bp, Homo sapiens
aggcagcctccagagcc

SEQ ID NO: 5205115 - DNA, 18 bp, Homo sapiens
aggcagcctccagagcca

SEQ ID NO: 5205116 - DNA, 20 bp, Homo sapiens
aggcagcctccagagccagc

SEQ ID NO: 5205117 - DNA, 21 bp, Homo sapiens
aggcagcctccagagccagcc

SEQ ID NO: 5205118 - DNA, 23 bp, Homo sapiens
aggcagcctccagagccagcctg

SEQ ID NO: 5205119 - DNA, 21 bp, Homo sapiens
aggcagcctccagcctgccca

SEQ ID NO: 5205120 - DNA, 14 bp, Homo sapiens
aggcagcctctctg

SEQ ID NO: 5205121 - DNA, 14 bp, Homo sapiens
aggcagcctctggg

SEQ ID NO: 5205122 - DNA, 20 bp, Homo sapiens
aggcagcctctgtcaggcct

SEQ ID NO: 5205123 - DNA, 22 bp, Homo sapiens
aggcagcctgagagctggccca

SEQ ID NO: 5205124 - DNA, 11 bp, Homo sapiens
aggcagcctgc

SEQ ID NO: 5205125 - DNA, 12 bp, Homo sapiens
aggcagcctgcc

SEQ ID NO: 5205126 - DNA, 20 bp, Homo sapiens
aggcagcctggacatagaga

SEQ ID NO: 5205127 - DNA, 19 bp, Homo sapiens
aggcagcctgtgggtcctt

SEQ ID NO: 5205128 - DNA, 13 bp, Homo sapiens
aggcagcgacccc

SEQ ID NO: 5205129 - DNA, 15 bp, Homo sapiens
aggcagcgaccccag

SEQ ID NO: 5205130 - DNA, 21 bp, Homo sapiens
aggcagcgcattgttttgcat

SEQ ID NO: 5205131 - DNA, 14 bp, Homo sapiens
aggcagcgccaagc

SEQ ID NO: 5205132 - DNA, 23 bp, Homo sapiens
aggcagcgctggtcgtcacctgg

SEQ ID NO: 5205133 - DNA, 15 bp, Homo sapiens
aggcagcgtgccgag

SEQ ID NO: 5205134 - DNA, 19 bp, Homo sapiens
aggcagcgtgggctctgcc

SEQ ID NO: 5205135 - DNA, 19 bp, Homo sapiens
aggcagcgttagggctgct

SEQ ID NO: 5205136 - DNA, 17 bp, Homo sapiens
aggcagctaagatagaa

SEQ ID NO: 5205137 - DNA, 13 bp, Homo sapiens
aggcagctcaccc

SEQ ID NO: 5205138 - DNA, 11 bp, Homo sapiens
aggcagctcca

SEQ ID NO: 5205139 - DNA, 16 bp, Homo sapiens
aggcagctccaacagc

SEQ ID NO: 5205140 - DNA, 18 bp, Homo sapiens
aggcagctccaacagctt

SEQ ID NO: 5205141 - DNA, 13 bp, Homo sapiens
aggcagctccagc

SEQ ID NO: 5205142 - DNA, 13 bp, Homo sapiens
aggcagctccctc

SEQ ID NO: 5205143 - DNA, 13 bp, Homo sapiens
aggcagctcctgt

SEQ ID NO: 5205144 - DNA, 16 bp, Homo sapiens
agctgttactgcaagt

SEQ ID NO: 5205145 - DNA, 15 bp, Homo sapiens
agctgttactttctt

SEQ ID NO: 5205146 - DNA, 23 bp, Homo sapiens
agctgttactttctttcagatgt

SEQ ID NO: 5205147 - DNA, 15 bp, Homo sapiens
agctgttagggctga

SEQ ID NO: 5205148 - DNA, 16 bp, Homo sapiens
agctgttagggctgaa

SEQ ID NO: 5205149 - DNA, 20 bp, Homo sapiens
agctgttatgctgtttccta

SEQ ID NO: 5205150 - DNA, 13 bp, Homo sapiens
agctgttattctt

SEQ ID NO: 5205151 - DNA, 15 bp, Homo sapiens
agctgttatttcttc

SEQ ID NO: 5205152 - DNA, 18 bp, Homo sapiens
agctgttatttcttccct

SEQ ID NO: 5205153 - DNA, 13 bp, Homo sapiens
agctgttcagctg

SEQ ID NO: 5205154 - DNA, 18 bp, Homo sapiens
agctgttcagttgccact

SEQ ID NO: 5205155 - DNA, 19 bp, Homo sapiens
agctgttccacttctctag

SEQ ID NO: 5205156 - DNA, 20 bp, Homo sapiens
agctgttccattacaccaca

SEQ ID NO: 5205157 - DNA, 17 bp, Homo sapiens
agctgttctcattcctg

SEQ ID NO: 5205158 - DNA, 14 bp, Homo sapiens
agctgttctggact

SEQ ID NO: 5205159 - DNA, 13 bp, Homo sapiens
agctgttcttgaa

SEQ ID NO: 5205160 - DNA, 16 bp, Homo sapiens
agctgttcttttttgt

SEQ ID NO: 5205161 - DNA, 14 bp, Homo sapiens
agctgttgaccagg

SEQ ID NO: 5205162 - DNA, 13 bp, Homo sapiens
agctgttgactct

SEQ ID NO: 5205163 - DNA, 18 bp, Homo sapiens
agctgttgcaggcagtgt

SEQ ID NO: 5205164 - DNA, 23 bp, Homo sapiens
agctgttgcaggcagtgtcttaa

SEQ ID NO: 5205165 - DNA, 21 bp, Homo sapiens
agctgttggaatgttgttaaa

SEQ ID NO: 5205166 - DNA, 16 bp, Homo sapiens
agctgttggcctcgcc

SEQ ID NO: 5205167 - DNA, 20 bp, Homo sapiens
agctgttggcctcgcctggg

SEQ ID NO: 5205168 - DNA, 21 bp, Homo sapiens
agctgttggcctcgcctgggc

SEQ ID NO: 5205169 - DNA, 23 bp, Homo sapiens
agctgttggcctcgcctgggccc

SEQ ID NO: 5205170 - DNA, 15 bp, Homo sapiens
agctgttggcctggg

SEQ ID NO: 5205171 - DNA, 13 bp, Homo sapiens
agctgttggtgtt

SEQ ID NO: 5205172 - DNA, 16 bp, Homo sapiens
agctgttgtacattta

SEQ ID NO: 5205173 - DNA, 20 bp, Homo sapiens
agctgttgtacatttatgat

SEQ ID NO: 5205174 - DNA, 22 bp, Homo sapiens
agctgttgtacatttatgattt

SEQ ID NO: 5205175 - DNA, 16 bp, Homo sapiens
agctgttgtctcttct

SEQ ID NO: 5205176 - DNA, 20 bp, Homo sapiens
agctgttgtctcttctcctt

SEQ ID NO: 5205177 - DNA, 17 bp, Homo sapiens
agctgttgtgagctttg

SEQ ID NO: 5205178 - DNA, 21 bp, Homo sapiens
agctgttgtggtttttagtgc

SEQ ID NO: 5205179 - DNA, 12 bp, Homo sapiens
agctgtttaaga

SEQ ID NO: 5205180 - DNA, 15 bp, Homo sapiens
agctgtttacagaca

SEQ ID NO: 5205181 - DNA, 22 bp, Homo sapiens
agctgtttactagggatccctc

SEQ ID NO: 5205182 - DNA, 18 bp, Homo sapiens
agctgtttatagagaatg

SEQ ID NO: 5205183 - DNA, 17 bp, Homo sapiens
agctgtttatggcctca

SEQ ID NO: 5205184 - DNA, 21 bp, Homo sapiens
agctgtttatggcctcagctg

SEQ ID NO: 5205185 - DNA, 13 bp, Homo sapiens
agctgtttatgtt

SEQ ID NO: 5205186 - DNA, 17 bp, Homo sapiens
agctgtttatgttttta

SEQ ID NO: 5205187 - DNA, 18 bp, Homo sapiens
agctgtttatttattcac

SEQ ID NO: 5205188 - DNA, 20 bp, Homo sapiens
agctgtttatttattcactg

SEQ ID NO: 5205189 - DNA, 16 bp, Homo sapiens
agctgtttcaaagttg

SEQ ID NO: 5205190 - DNA, 23 bp, Homo sapiens
agctgtttgccaagctgaagcta

SEQ ID NO: 5205191 - DNA, 19 bp, Homo sapiens
agctgtttggatacagctg

SEQ ID NO: 5205192 - DNA, 13 bp, Homo sapiens
agctgtttgtcat

SEQ ID NO: 5205193 - DNA, 18 bp, Homo sapiens
agctgttttagttaaatt

SEQ ID NO: 5205194 - DNA, 18 bp, Homo sapiens
agctgttttccctgacct

SEQ ID NO: 5205195 - DNA, 14 bp, Homo sapiens
agctgttttggatg

SEQ ID NO: 5205196 - DNA, 19 bp, Homo sapiens
agctgttttggatgaatgc

SEQ ID NO: 5205197 - DNA, 15 bp, Homo sapiens
agctgttttgtgtat

SEQ ID NO: 5205198 - DNA, 18 bp, Homo sapiens
agcttaaaaaaattactg

SEQ ID NO: 5205199 - DNA, 19 bp, Homo sapiens
agcttaaaaaaattactgt

SEQ ID NO: 5205200 - DNA, 12 bp, Homo sapiens
agcttaaaacac

SEQ ID NO: 5205201 - DNA, 16 bp, Homo sapiens
agcttaaaacacttct

SEQ ID NO: 5205202 - DNA, 12 bp, Homo sapiens
agcttaaaactt

SEQ ID NO: 5205203 - DNA, 13 bp, Homo sapiens
agcttaaaacttt

SEQ ID NO: 5205204 - DNA, 14 bp, Homo sapiens
agcttaaaactttg

SEQ ID NO: 5205205 - DNA, 14 bp, Homo sapiens
agcttaaaataagt

SEQ ID NO: 5205206 - DNA, 14 bp, Homo sapiens
agcttaaaatacaa

SEQ ID NO: 5205207 - DNA, 20 bp, Homo sapiens
agcttaaaatacaagactgc

SEQ ID NO: 5205208 - DNA, 20 bp, Homo sapiens
agcttaaacccatacaatgt

SEQ ID NO: 5205209 - DNA, 13 bp, Homo sapiens
agcttaaactgaa

SEQ ID NO: 5205210 - DNA, 16 bp, Homo sapiens
agcttaaagagaaaaa

SEQ ID NO: 5205211 - DNA, 21 bp, Homo sapiens
agcttaaaggagggtgaataa

SEQ ID NO: 5205212 - DNA, 12 bp, Homo sapiens
agcttaaataaa

SEQ ID NO: 5205213 - DNA, 14 bp, Homo sapiens
agcttaaataaatt

SEQ ID NO: 5205214 - DNA, 21 bp, Homo sapiens
agcttaaataaattcaaacca

SEQ ID NO: 5205215 - DNA, 19 bp, Homo sapiens
agcttaaattcttcaagaa

SEQ ID NO: 5205216 - DNA, 14 bp, Homo sapiens
agcttaaattgtca

SEQ ID NO: 5205217 - DNA, 20 bp, Homo sapiens
agcttaaattgtcattattt

SEQ ID NO: 5205218 - DNA, 11 bp, Homo sapiens
agcttaaattt

SEQ ID NO: 5205219 - DNA, 12 bp, Homo sapiens
agcttaaatttt

SEQ ID NO: 5205220 - DNA, 14 bp, Homo sapiens
agcttaaattttat

SEQ ID NO: 5205221 - DNA, 13 bp, Homo sapiens
agcttaacaatgc

SEQ ID NO: 5205222 - DNA, 15 bp, Homo sapiens
agcttaactaatttg

SEQ ID NO: 5205223 - DNA, 23 bp, Homo sapiens
agcttaagccactgcctctccct

SEQ ID NO: 5205224 - DNA, 17 bp, Homo sapiens
agcttaagcgttcatat

SEQ ID NO: 5205225 - DNA, 14 bp, Homo sapiens
agcttaaggagagg

SEQ ID NO: 5205226 - DNA, 16 bp, Homo sapiens
agcttaaggagaggag

SEQ ID NO: 5205227 - DNA, 17 bp, Homo sapiens
agcttaaggagaggaga

SEQ ID NO: 5205228 - DNA, 19 bp, Homo sapiens
agcttaagggtcatatgtt

SEQ ID NO: 5205229 - DNA, 20 bp, Homo sapiens
agcttaagggtcatatgttt

SEQ ID NO: 5205230 - DNA, 19 bp, Homo sapiens
agcttaagtgtaaatgaag

SEQ ID NO: 5205231 - DNA, 20 bp, Homo sapiens
agcttaagtgtaaatgaagt

SEQ ID NO: 5205232 - DNA, 21 bp, Homo sapiens
agcttaatagtagttagctta

SEQ ID NO: 5205233 - DNA, 22 bp, Homo sapiens
agcttaatagtagttagcttaa

SEQ ID NO: 5205234 - DNA, 14 bp, Homo sapiens
agcttaatatattc

SEQ ID NO: 5205235 - DNA, 16 bp, Homo sapiens
agcttaatcttaatgt

SEQ ID NO: 5205236 - DNA, 19 bp, Homo sapiens
agcttaatcttaatgtctg

SEQ ID NO: 5205237 - DNA, 14 bp, Homo sapiens
agcttaatgctaca

SEQ ID NO: 5205238 - DNA, 20 bp, Homo sapiens
agcttaatgtctttgtgttt

SEQ ID NO: 5205239 - DNA, 13 bp, Homo sapiens
agcttaattctcc

SEQ ID NO: 5205240 - DNA, 21 bp, Homo sapiens
agcttaattctccttcccaga

SEQ ID NO: 5205241 - DNA, 15 bp, Homo sapiens
agcttaattttctgt

SEQ ID NO: 5205242 - DNA, 16 bp, Homo sapiens
agcttacacaaatcta

SEQ ID NO: 5205243 - DNA, 12 bp, Homo sapiens
agcttacactga

SEQ ID NO: 5205244 - DNA, 18 bp, Homo sapiens
agcttacactgaggactg

SEQ ID NO: 5205245 - DNA, 14 bp, Homo sapiens
agcttacaggaagc

SEQ ID NO: 5205246 - DNA, 21 bp, Homo sapiens
agcttacaggagccagcctgc

SEQ ID NO: 5205247 - DNA, 23 bp, Homo sapiens
agcttacaggagccagcctgctt

SEQ ID NO: 5205248 - DNA, 16 bp, Homo sapiens
agcttacatagtttta

SEQ ID NO: 5205249 - DNA, 17 bp, Homo sapiens
agcttacatagttttaa

SEQ ID NO: 5205250 - DNA, 14 bp, Homo sapiens
agcttacatgagaa

SEQ ID NO: 5205251 - DNA, 17 bp, Homo sapiens
agcttacattttcctga

SEQ ID NO: 5205252 - DNA, 14 bp, Homo sapiens
agcttacccttggt

SEQ ID NO: 5205253 - DNA, 16 bp, Homo sapiens
agcttacctgaacagg

SEQ ID NO: 5205254 - DNA, 13 bp, Homo sapiens
agcttacctgaca

SEQ ID NO: 5205255 - DNA, 13 bp, Homo sapiens
agcttacctgggc

SEQ ID NO: 5205256 - DNA, 14 bp, Homo sapiens
agcttacctgggca

SEQ ID NO: 5205257 - DNA, 22 bp, Homo sapiens
agcttacctgggcacaaacaga

SEQ ID NO: 5205258 - DNA, 14 bp, Homo sapiens
agcttactctctgc

SEQ ID NO: 5205259 - DNA, 17 bp, Homo sapiens
agcttactctctgcttc

SEQ ID NO: 5205260 - DNA, 23 bp, Homo sapiens
agcttactgagttatcaggtgca

SEQ ID NO: 5205261 - DNA, 14 bp, Homo sapiens
agcttactgcagca

SEQ ID NO: 5205262 - DNA, 14 bp, Homo sapiens
agcttagaagccac

SEQ ID NO: 5205263 - DNA, 15 bp, Homo sapiens
agcttagacctcagc

SEQ ID NO: 5205264 - DNA, 16 bp, Homo sapiens
agcttagacctcagcc

SEQ ID NO: 5205265 - DNA, 15 bp, Homo sapiens
agcttagagcctccc

SEQ ID NO: 5205266 - DNA, 20 bp, Homo sapiens
agcttagagtatacctccta

SEQ ID NO: 5205267 - DNA, 20 bp, Homo sapiens
agcttagagttcttctttct

SEQ ID NO: 5205268 - DNA, 14 bp, Homo sapiens
agcttagattctgt

SEQ ID NO: 5205269 - DNA, 15 bp, Homo sapiens
agcttagattctgta

SEQ ID NO: 5205270 - DNA, 13 bp, Homo sapiens
agcttagatttca

SEQ ID NO: 5205271 - DNA, 22 bp, Homo sapiens
agcttagattttctgtaaatga

SEQ ID NO: 5205272 - DNA, 19 bp, Homo sapiens
agcttagcggcaagaagcc

SEQ ID NO: 5205273 - DNA, 16 bp, Homo sapiens
agcttagctctgccct

SEQ ID NO: 5205274 - DNA, 18 bp, Homo sapiens
agcttagctttagaaaca

SEQ ID NO: 5205275 - DNA, 16 bp, Homo sapiens
agcttagggccctgga

SEQ ID NO: 5205276 - DNA, 16 bp, Homo sapiens
agcttagggtctcagg

SEQ ID NO: 5205277 - DNA, 14 bp, Homo sapiens
agcttagtcctggg

SEQ ID NO: 5205278 - DNA, 21 bp, Homo sapiens
agcttagttttttttaaaaaa

SEQ ID NO: 5205279 - DNA, 22 bp, Homo sapiens
agcttagttttttttaaaaaaa

SEQ ID NO: 5205280 - DNA, 21 bp, Homo sapiens
agcttataatgaaatctgttt

SEQ ID NO: 5205281 - DNA, 18 bp, Homo sapiens
agcttatacgaaataatt

SEQ ID NO: 5205282 - DNA, 16 bp, Homo sapiens
agcttatcaatttgtc

SEQ ID NO: 5205283 - DNA, 15 bp, Homo sapiens
agcttatcatgctgt

SEQ ID NO: 5205284 - DNA, 23 bp, Homo sapiens
agcttatctacttccaaactaat

SEQ ID NO: 5205285 - DNA, 14 bp, Homo sapiens
agcttatctcaggg

SEQ ID NO: 5205286 - DNA, 15 bp, Homo sapiens
agcttatctcagggg

SEQ ID NO: 5205287 - DNA, 18 bp, Homo sapiens
agcttatctcagttatga

SEQ ID NO: 5205288 - DNA, 15 bp, Homo sapiens
agcttatctcctcct

SEQ ID NO: 5205289 - DNA, 16 bp, Homo sapiens
agcttatctcctcctc

SEQ ID NO: 5205290 - DNA, 13 bp, Homo sapiens
agcttatctctga

SEQ ID NO: 5205291 - DNA, 17 bp, Homo sapiens
agcttatctgcccctcc

SEQ ID NO: 5205292 - DNA, 17 bp, Homo sapiens
agcttatctttctttcc

SEQ ID NO: 5205293 - DNA, 20 bp, Homo sapiens
agcttatgggatccttgtct

SEQ ID NO: 5205294 - DNA, 18 bp, Homo sapiens
agcttatggggtatttta

SEQ ID NO: 5205295 - DNA, 23 bp, Homo sapiens
agcttatgtacaaaactttttaa

SEQ ID NO: 5205296 - DNA, 20 bp, Homo sapiens
agcttatgttaactgacaag

SEQ ID NO: 5205297 - DNA, 14 bp, Homo sapiens
agcttatgtttctt

SEQ ID NO: 5205298 - DNA, 14 bp, Homo sapiens
agcttattaatgct

SEQ ID NO: 5205299 - DNA, 16 bp, Homo sapiens
agcttattaatgctaa

SEQ ID NO: 5205300 - DNA, 19 bp, Homo sapiens
agcttattatagaattgca

SEQ ID NO: 5205301 - DNA, 22 bp, Homo sapiens
agcttattatccaattcaaaaa

SEQ ID NO: 5205302 - DNA, 15 bp, Homo sapiens
agcttattgacatca

SEQ ID NO: 5205303 - DNA, 17 bp, Homo sapiens
agcttattgatcccaca

SEQ ID NO: 5205304 - DNA, 15 bp, Homo sapiens
agcttattggccact

SEQ ID NO: 5205305 - DNA, 16 bp, Homo sapiens
agcttattgtttttat

SEQ ID NO: 5205306 - DNA, 12 bp, Homo sapiens
agcttatttaat

SEQ ID NO: 5205307 - DNA, 12 bp, Homo sapiens
agcttatttcta

SEQ ID NO: 5205308 - DNA, 16 bp, Homo sapiens
agcttatttctaacta

SEQ ID NO: 5205309 - DNA, 15 bp, Homo sapiens
agcttattttgtaag

SEQ ID NO: 5205310 - DNA, 17 bp, Homo sapiens
agcttatttttttctac

SEQ ID NO: 5205311 - DNA, 15 bp, Homo sapiens
agcttcaaaacagaa

SEQ ID NO: 5205312 - DNA, 15 bp, Homo sapiens
agcttcaaagttggc

SEQ ID NO: 5205313 - DNA, 19 bp, Homo sapiens
agcttcaaccctcagcctt

SEQ ID NO: 5205314 - DNA, 21 bp, Homo sapiens
agcttcaactacttctcttgc

SEQ ID NO: 5205315 - DNA, 16 bp, Homo sapiens
agcttcaagtctgtgc

SEQ ID NO: 5205316 - DNA, 18 bp, Homo sapiens
agcttcaagtgatatatg

SEQ ID NO: 5205317 - DNA, 19 bp, Homo sapiens
agcttcaagtgatatatgt

SEQ ID NO: 5205318 - DNA, 20 bp, Homo sapiens
agcttcaagtgatatatgta

SEQ ID NO: 5205319 - DNA, 22 bp, Homo sapiens
agcttcaagtgatatatgtatt

SEQ ID NO: 5205320 - DNA, 17 bp, Homo sapiens
agcttcaagtgcctttt

SEQ ID NO: 5205321 - DNA, 13 bp, Homo sapiens
agcttcaatataa

SEQ ID NO: 5205322 - DNA, 18 bp, Homo sapiens
agcttcaatataagaagc

SEQ ID NO: 5205323 - DNA, 17 bp, Homo sapiens
agcttcaatatttttct

SEQ ID NO: 5205324 - DNA, 22 bp, Homo sapiens
agcttcacctctgggaccccag

SEQ ID NO: 5205325 - DNA, 14 bp, Homo sapiens
aggcagctcctgtt

SEQ ID NO: 5205326 - DNA, 18 bp, Homo sapiens
aggcagctcctgtttgga

SEQ ID NO: 5205327 - DNA, 13 bp, Homo sapiens
aggcagctctgag

SEQ ID NO: 5205328 - DNA, 16 bp, Homo sapiens
aggcagctctgagccg

SEQ ID NO: 5205329 - DNA, 12 bp, Homo sapiens
aggcagctcttc

SEQ ID NO: 5205330 - DNA, 16 bp, Homo sapiens
aggcagctgagaccag

SEQ ID NO: 5205331 - DNA, 17 bp, Homo sapiens
aggcagctgagaccagg

SEQ ID NO: 5205332 - DNA, 15 bp, Homo sapiens
aggcagctgcctctg

SEQ ID NO: 5205333 - DNA, 19 bp, Homo sapiens
aggcagctgcctctgctcc

SEQ ID NO: 5205334 - DNA, 21 bp, Homo sapiens
aggcagctgcctctgctccct

SEQ ID NO: 5205335 - DNA, 17 bp, Homo sapiens
aggcagctgcctgctct

SEQ ID NO: 5205336 - DNA, 23 bp, Homo sapiens
aggcagctgctcttagtgcccgc

SEQ ID NO: 5205337 - DNA, 14 bp, Homo sapiens
aggcagctggcagg

SEQ ID NO: 5205338 - DNA, 12 bp, Homo sapiens
aggcagctgtgt

SEQ ID NO: 5205339 - DNA, 13 bp, Homo sapiens
aggcagctgtgtc

SEQ ID NO: 5205340 - DNA, 17 bp, Homo sapiens
aggcagctgtgtctgag

SEQ ID NO: 5205341 - DNA, 20 bp, Homo sapiens
aggcagctgtgtctgagccc

SEQ ID NO: 5205342 - DNA, 22 bp, Homo sapiens
aggcagctgtgtctgagcccaa

SEQ ID NO: 5205343 - DNA, 13 bp, Homo sapiens
aggcagctgttgt

SEQ ID NO: 5205344 - DNA, 20 bp, Homo sapiens
aggcagctgttgtctcttct

SEQ ID NO: 5205345 - DNA, 21 bp, Homo sapiens
aggcagctgttgtctcttctc

SEQ ID NO: 5205346 - DNA, 20 bp, Homo sapiens
aggcagcttcaagtgccttt

SEQ ID NO: 5205347 - DNA, 14 bp, Homo sapiens
aggcagcttctctg

SEQ ID NO: 5205348 - DNA, 13 bp, Homo sapiens
aggcaggaagaga

SEQ ID NO: 5205349 - DNA, 13 bp, Homo sapiens
aggcaggaagccc

SEQ ID NO: 5205350 - DNA, 13 bp, Homo sapiens
aggcaggaaggat

SEQ ID NO: 5205351 - DNA, 17 bp, Homo sapiens
aggcaggaagggaagcg

SEQ ID NO: 5205352 - DNA, 20 bp, Homo sapiens
aggcaggaagtcaggagcca

SEQ ID NO: 5205353 - DNA, 21 bp, Homo sapiens
aggcaggaagtcaggagccag

SEQ ID NO: 5205354 - DNA, 22 bp, Homo sapiens
aggcaggaagtcaggagccagc

SEQ ID NO: 5205355 - DNA, 13 bp, Homo sapiens
aggcaggaatggg

SEQ ID NO: 5205356 - DNA, 23 bp, Homo sapiens
aggcaggacatgctgaagccaaa

SEQ ID NO: 5205357 - DNA, 21 bp, Homo sapiens
aggcaggaccttcgggctgtg

SEQ ID NO: 5205358 - DNA, 21 bp, Homo sapiens
aggcaggagaatcactcgaac

SEQ ID NO: 5205359 - DNA, 15 bp, Homo sapiens
aggcaggagaattgc

SEQ ID NO: 5205360 - DNA, 15 bp, Homo sapiens
aggcaggagagacag

SEQ ID NO: 5205361 - DNA, 19 bp, Homo sapiens
aggcaggaggccattccag

SEQ ID NO: 5205362 - DNA, 14 bp, Homo sapiens
aggcaggagggcat

SEQ ID NO: 5205363 - DNA, 17 bp, Homo sapiens
aggcaggaggtgggtga

SEQ ID NO: 5205364 - DNA, 14 bp, Homo sapiens
aggcaggatatccc

SEQ ID NO: 5205365 - DNA, 16 bp, Homo sapiens
aggcaggattgaaaat

SEQ ID NO: 5205366 - DNA, 19 bp, Homo sapiens
aggcaggattggggaagag

SEQ ID NO: 5205367 - DNA, 20 bp, Homo sapiens
aggcaggattggggaagaga

SEQ ID NO: 5205368 - DNA, 20 bp, Homo sapiens
aggcaggcagcctgagagct

SEQ ID NO: 5205369 - DNA, 14 bp, Homo sapiens
aggcaggcagggct

SEQ ID NO: 5205370 - DNA, 18 bp, Homo sapiens
aggcaggcagggctctcc

SEQ ID NO: 5205371 - DNA, 20 bp, Homo sapiens
aggcaggcagggctctcctg

SEQ ID NO: 5205372 - DNA, 22 bp, Homo sapiens
aggcaggcatagaggcttctcc

SEQ ID NO: 5205373 - DNA, 17 bp, Homo sapiens
aggcaggcatggccctg

SEQ ID NO: 5205374 - DNA, 18 bp, Homo sapiens
aggcaggcatggccctgg

SEQ ID NO: 5205375 - DNA, 23 bp, Homo sapiens
aggcaggcattgaggaagagtct

SEQ ID NO: 5205376 - DNA, 21 bp, Homo sapiens
aggcaggccaaggccttctcc

SEQ ID NO: 5205377 - DNA, 17 bp, Homo sapiens
aggcaggccaggctgcc

SEQ ID NO: 5205378 - DNA, 20 bp, Homo sapiens
aggcaggccaggctgcctcg

SEQ ID NO: 5205379 - DNA, 13 bp, Homo sapiens
aggcaggcccagc

SEQ ID NO: 5205380 - DNA, 19 bp, Homo sapiens
aggcaggcctatttcatca

SEQ ID NO: 5205381 - DNA, 21 bp, Homo sapiens
aggcaggcctccgtcttccca

SEQ ID NO: 5205382 - DNA, 14 bp, Homo sapiens
aggcaggcctttcc

SEQ ID NO: 5205383 - DNA, 13 bp, Homo sapiens
aggcaggcgggcc

SEQ ID NO: 5205384 - DNA, 22 bp, Homo sapiens
aggcaggcgggccggggcaggg

SEQ ID NO: 5205385 - DNA, 18 bp, Homo sapiens
aggcaggctaaggcgtgg

SEQ ID NO: 5205386 - DNA, 15 bp, Homo sapiens
aggcaggctcccagg

SEQ ID NO: 5205387 - DNA, 16 bp, Homo sapiens
aggcaggctcccaggg

SEQ ID NO: 5205388 - DNA, 15 bp, Homo sapiens
aggcaggctccccct

SEQ ID NO: 5205389 - DNA, 12 bp, Homo sapiens
aggcaggctggg

SEQ ID NO: 5205390 - DNA, 13 bp, Homo sapiens
aggcaggctggga

SEQ ID NO: 5205391 - DNA, 18 bp, Homo sapiens
aggcagggaaaggaaaag

SEQ ID NO: 5205392 - DNA, 23 bp, Homo sapiens
aggcagggaacatggggaggagg

SEQ ID NO: 5205393 - DNA, 12 bp, Homo sapiens
aggcagggaagt

SEQ ID NO: 5205394 - DNA, 20 bp, Homo sapiens
aggcagggaatgcctggagg

SEQ ID NO: 5205395 - DNA, 18 bp, Homo sapiens
aggcagggacagagatgg

SEQ ID NO: 5205396 - DNA, 15 bp, Homo sapiens
aggcagggagaaggg

SEQ ID NO: 5205397 - DNA, 14 bp, Homo sapiens
aggcagggagagag

SEQ ID NO: 5205398 - DNA, 16 bp, Homo sapiens
aggcagggaggcagcc

SEQ ID NO: 5205399 - DNA, 16 bp, Homo sapiens
aggcagggagggcctg

SEQ ID NO: 5205400 - DNA, 15 bp, Homo sapiens
aggcagggagggctt

SEQ ID NO: 5205401 - DNA, 14 bp, Homo sapiens
aggcagggatttga

SEQ ID NO: 5205402 - DNA, 16 bp, Homo sapiens
aggcagggatttgagg

SEQ ID NO: 5205403 - DNA, 18 bp, Homo sapiens
aggcagggcaaatgacat

SEQ ID NO: 5205404 - DNA, 24 bp, Homo sapiens
aggcagggcaaatgacatgcactg

SEQ ID NO: 5205405 - DNA, 12 bp, Homo sapiens
aggcagggcagc

SEQ ID NO: 5205406 - DNA, 21 bp, Homo sapiens
aggcagggcaggaccagccca

SEQ ID NO: 5205407 - DNA, 14 bp, Homo sapiens
aggcagggccctga

SEQ ID NO: 5205408 - DNA, 15 bp, Homo sapiens
aggcagggccctgaa

SEQ ID NO: 5205409 - DNA, 13 bp, Homo sapiens
aggcagggcctgg

SEQ ID NO: 5205410 - DNA, 15 bp, Homo sapiens
aggcagggcctggct

SEQ ID NO: 5205411 - DNA, 17 bp, Homo sapiens
aggcagggcctggctcc

SEQ ID NO: 5205412 - DNA, 19 bp, Homo sapiens
aggcagggccttgcccaga

SEQ ID NO: 5205413 - DNA, 20 bp, Homo sapiens
aggcagggccttgcccagag

SEQ ID NO: 5205414 - DNA, 24 bp, Homo sapiens
aggcagggctcctccctggagcta

SEQ ID NO: 5205415 - DNA, 15 bp, Homo sapiens
aggcagggctctcct

SEQ ID NO: 5205416 - DNA, 18 bp, Homo sapiens
aggcagggctctcctggc

SEQ ID NO: 5205417 - DNA, 22 bp, Homo sapiens
aggcagggctctctttccttct

SEQ ID NO: 5205418 - DNA, 18 bp, Homo sapiens
aggcaggggagtctgctt

SEQ ID NO: 5205419 - DNA, 21 bp, Homo sapiens
aggcaggggcccacttggggc

SEQ ID NO: 5205420 - DNA, 20 bp, Homo sapiens
aggcaggggccctgcagctc

SEQ ID NO: 5205421 - DNA, 22 bp, Homo sapiens
aggcaggggccctgcagctctc

SEQ ID NO: 5205422 - DNA, 15 bp, Homo sapiens
aggcaggggcctcca

SEQ ID NO: 5205423 - DNA, 13 bp, Homo sapiens
aggcaggggcgga

SEQ ID NO: 5205424 - DNA, 21 bp, Homo sapiens
aggcaggggctgggcagaggg

SEQ ID NO: 5205425 - DNA, 23 bp, Homo sapiens
aggcaggggctgggcagagggga

SEQ ID NO: 5205426 - DNA, 14 bp, Homo sapiens
aggcaggggcttcc

SEQ ID NO: 5205427 - DNA, 15 bp, Homo sapiens
aggcaggggcttcct

SEQ ID NO: 5205428 - DNA, 14 bp, Homo sapiens
aggcaggggcttgg

SEQ ID NO: 5205429 - DNA, 20 bp, Homo sapiens
aggcagggggtgaggggcag

SEQ ID NO: 5205430 - DNA, 17 bp, Homo sapiens
aggcaggggtcctgcag

SEQ ID NO: 5205431 - DNA, 21 bp, Homo sapiens
aggcaggggtcctgcaggtcc

SEQ ID NO: 5205432 - DNA, 14 bp, Homo sapiens
aggcaggggtgaga

SEQ ID NO: 5205433 - DNA, 19 bp, Homo sapiens
aggcaggggtgggagagcc

SEQ ID NO: 5205434 - DNA, 22 bp, Homo sapiens
aggcaggggtgggagagccagc

SEQ ID NO: 5205435 - DNA, 15 bp, Homo sapiens
aggcaggggtggggg

SEQ ID NO: 5205436 - DNA, 22 bp, Homo sapiens
aggcaggggtgggggtggaggc

SEQ ID NO: 5205437 - DNA, 23 bp, Homo sapiens
aggcaggggtgggggtggaggct

SEQ ID NO: 5205438 - DNA, 17 bp, Homo sapiens
aggcagggtcaggagag

SEQ ID NO: 5205439 - DNA, 23 bp, Homo sapiens
aggcagggtcaggagaggggcag

SEQ ID NO: 5205440 - DNA, 11 bp, Homo sapiens
aggcagggtct

SEQ ID NO: 5205441 - DNA, 19 bp, Homo sapiens
aggcagggtctcactctgt

SEQ ID NO: 5205442 - DNA, 19 bp, Homo sapiens
aggcagggtgtctgccccc

SEQ ID NO: 5205443 - DNA, 23 bp, Homo sapiens
aggcagggttttatctctgtcta

SEQ ID NO: 5205444 - DNA, 16 bp, Homo sapiens
aggcaggtaataataa

SEQ ID NO: 5205445 - DNA, 14 bp, Homo sapiens
aggcaggtacaggt

SEQ ID NO: 5205446 - DNA, 16 bp, Homo sapiens
aggcaggtagccaggg

SEQ ID NO: 5205447 - DNA, 16 bp, Homo sapiens
aggcaggtagggggtc

SEQ ID NO: 5205448 - DNA, 15 bp, Homo sapiens
aggcaggtcacagaa

SEQ ID NO: 5205449 - DNA, 14 bp, Homo sapiens
aggcaggtccaggg

SEQ ID NO: 5205450 - DNA, 14 bp, Homo sapiens
aggcaggtccccag

SEQ ID NO: 5205451 - DNA, 22 bp, Homo sapiens
aggcaggtcgggctgccagccc

SEQ ID NO: 5205452 - DNA, 23 bp, Homo sapiens
aggcaggtcgggctgccagccca

SEQ ID NO: 5205453 - DNA, 13 bp, Homo sapiens
aggcaggtctgca

SEQ ID NO: 5205454 - DNA, 23 bp, Homo sapiens
aggcaggtctgcaagggcccaga

SEQ ID NO: 5205455 - DNA, 17 bp, Homo sapiens
aggcaggtgacagtgag

SEQ ID NO: 5205456 - DNA, 19 bp, Homo sapiens
aggcaggtgagaacccaga

SEQ ID NO: 5205457 - DNA, 17 bp, Homo sapiens
aggcaggtgcctccagg

SEQ ID NO: 5205458 - DNA, 18 bp, Homo sapiens
aggcaggtgcctccaggt

SEQ ID NO: 5205459 - DNA, 21 bp, Homo sapiens
aggcaggtgcctccaggtgtg

SEQ ID NO: 5205460 - DNA, 21 bp, Homo sapiens
aggcaggtgcttttggcagag

SEQ ID NO: 5205461 - DNA, 20 bp, Homo sapiens
aggcaggtggacgctgcaga

SEQ ID NO: 5205462 - DNA, 20 bp, Homo sapiens
aggcaggtgggggctgcgtc

SEQ ID NO: 5205463 - DNA, 21 bp, Homo sapiens
aggcaggtttgccagtgaaga

SEQ ID NO: 5205464 - DNA, 15 bp, Homo sapiens
aggcagtaggccggt

SEQ ID NO: 5205465 - DNA, 22 bp, Homo sapiens
aggcagtaggccggtgtgcctg

SEQ ID NO: 5205466 - DNA, 16 bp, Homo sapiens
aggcagtataaagaat

SEQ ID NO: 5205467 - DNA, 15 bp, Homo sapiens
aggcagtatccttta

SEQ ID NO: 5205468 - DNA, 12 bp, Homo sapiens
aggcagtccaga

SEQ ID NO: 5205469 - DNA, 22 bp, Homo sapiens
aggcagtcccgggagaaaagac

SEQ ID NO: 5205470 - DNA, 20 bp, Homo sapiens
aggcagtcgggggctggcct

SEQ ID NO: 5205471 - DNA, 22 bp, Homo sapiens
aggcagtcgggggctggcctag

SEQ ID NO: 5205472 - DNA, 11 bp, Homo sapiens
aggcagtctga

SEQ ID NO: 5205473 - DNA, 19 bp, Homo sapiens
aggcagtgatgctggatgc

SEQ ID NO: 5205474 - DNA, 13 bp, Homo sapiens
aggcagtgcatgc

SEQ ID NO: 5205475 - DNA, 14 bp, Homo sapiens
aggcagtggcagca

SEQ ID NO: 5205476 - DNA, 17 bp, Homo sapiens
aggcagtggcccaggga

SEQ ID NO: 5205477 - DNA, 12 bp, Homo sapiens
aggcagtggcta

SEQ ID NO: 5205478 - DNA, 20 bp, Homo sapiens
aggcagtggggctggaagca

SEQ ID NO: 5205479 - DNA, 16 bp, Homo sapiens
aggcagtgggtcccac

SEQ ID NO: 5205480 - DNA, 16 bp, Homo sapiens
aggcagttaggtgctg

SEQ ID NO: 5205481 - DNA, 15 bp, Homo sapiens
aggcagttgaacctg

SEQ ID NO: 5205482 - DNA, 17 bp, Homo sapiens
aggcagttgcccagcct

SEQ ID NO: 5205483 - DNA, 18 bp, Homo sapiens
aggcagtttcagagatgg

SEQ ID NO: 5205484 - DNA, 13 bp, Homo sapiens
aggcagttttcta

SEQ ID NO: 5205485 - DNA, 14 bp, Homo sapiens
aggcagttttctaa

SEQ ID NO: 5205486 - DNA, 15 bp, Homo sapiens
aggcagtttttgttc

SEQ ID NO: 5205487 - DNA, 14 bp, Homo sapiens
aggcataaacctgt

SEQ ID NO: 5205488 - DNA, 22 bp, Homo sapiens
aggcataaattaaaatgtaaaa

SEQ ID NO: 5205489 - DNA, 17 bp, Homo sapiens
aggcatacactgtagtt

SEQ ID NO: 5205490 - DNA, 20 bp, Homo sapiens
aggcatacactgtagttttt

SEQ ID NO: 5205491 - DNA, 14 bp, Homo sapiens
aggcatactctcca

SEQ ID NO: 5205492 - DNA, 15 bp, Homo sapiens
aggcatactctccag

SEQ ID NO: 5205493 - DNA, 17 bp, Homo sapiens
aggcatactctccagga

SEQ ID NO: 5205494 - DNA, 23 bp, Homo sapiens
aggcatactgccttgtttaatgt

SEQ ID NO: 5205495 - DNA, 13 bp, Homo sapiens
aggcatactttta

SEQ ID NO: 5205496 - DNA, 17 bp, Homo sapiens
aggcatacttttcaaag

SEQ ID NO: 5205497 - DNA, 15 bp, Homo sapiens
aggcatagaggcttc

SEQ ID NO: 5205498 - DNA, 16 bp, Homo sapiens
aggcataggcctgggt

SEQ ID NO: 5205499 - DNA, 17 bp, Homo sapiens
aggcataggcctgggtg

SEQ ID NO: 5205500 - DNA, 18 bp, Homo sapiens
aggcataggtctctttgc

SEQ ID NO: 5205501 - DNA, 22 bp, Homo sapiens
aggcataggtctctttgctttc

SEQ ID NO: 5205502 - DNA, 18 bp, Homo sapiens
aggcatatgcttctttaa

SEQ ID NO: 5205503 - DNA, 19 bp, Homo sapiens
aggcatattccctgcacac

SEQ ID NO: 5205504 - DNA, 18 bp, Homo sapiens
agcttcactgtaaaataa

SEQ ID NO: 5205505 - DNA, 14 bp, Homo sapiens
agcttcacttctga

SEQ ID NO: 5205506 - DNA, 12 bp, Homo sapiens
agcttcagagcc

SEQ ID NO: 5205507 - DNA, 23 bp, Homo sapiens
agcttcagagcctagccacctcc

SEQ ID NO: 5205508 - DNA, 21 bp, Homo sapiens
agcttcagatggtgaagcatt

SEQ ID NO: 5205509 - DNA, 12 bp, Homo sapiens
agcttcagccag

SEQ ID NO: 5205510 - DNA, 13 bp, Homo sapiens
agcttcaggaacc

SEQ ID NO: 5205511 - DNA, 20 bp, Homo sapiens
agcttcaggacctggctacg

SEQ ID NO: 5205512 - DNA, 13 bp, Homo sapiens
agcttcaggcacc

SEQ ID NO: 5205513 - DNA, 16 bp, Homo sapiens
agcttcaggccccagg

SEQ ID NO: 5205514 - DNA, 14 bp, Homo sapiens
agcttcagggctgg

SEQ ID NO: 5205515 - DNA, 16 bp, Homo sapiens
agcttcaggtgagcca

SEQ ID NO: 5205516 - DNA, 23 bp, Homo sapiens
agcttcaggttatcgaaataaca

SEQ ID NO: 5205517 - DNA, 14 bp, Homo sapiens
agcttcagttgttc

SEQ ID NO: 5205518 - DNA, 15 bp, Homo sapiens
agcttcagtttcctg

SEQ ID NO: 5205519 - DNA, 16 bp, Homo sapiens
agcttcatacttcatg

SEQ ID NO: 5205520 - DNA, 17 bp, Homo sapiens
agcttcatataccagca

SEQ ID NO: 5205521 - DNA, 18 bp, Homo sapiens
agcttcatatctaattta

SEQ ID NO: 5205522 - DNA, 16 bp, Homo sapiens
agcttcatcaattttt

SEQ ID NO: 5205523 - DNA, 17 bp, Homo sapiens
agcttcatcaattttta

SEQ ID NO: 5205524 - DNA, 21 bp, Homo sapiens
agcttcatcaatttttataca

SEQ ID NO: 5205525 - DNA, 23 bp, Homo sapiens
agcttcatcaatttttatacata

SEQ ID NO: 5205526 - DNA, 15 bp, Homo sapiens
agcttcatccacagc

SEQ ID NO: 5205527 - DNA, 23 bp, Homo sapiens
agcttcatgcctcagtttcccca

SEQ ID NO: 5205528 - DNA, 20 bp, Homo sapiens
agcttcattatctgagttgc

SEQ ID NO: 5205529 - DNA, 15 bp, Homo sapiens
agcttcatttccgtg

SEQ ID NO: 5205530 - DNA, 13 bp, Homo sapiens
agcttcatttgtg

SEQ ID NO: 5205531 - DNA, 15 bp, Homo sapiens
agcttccaaaatata

SEQ ID NO: 5205532 - DNA, 15 bp, Homo sapiens
agcttccaaatctca

SEQ ID NO: 5205533 - DNA, 19 bp, Homo sapiens
agcttccaaatgtgtcaga

SEQ ID NO: 5205534 - DNA, 22 bp, Homo sapiens
agcttccaaggggcaaattttt

SEQ ID NO: 5205535 - DNA, 18 bp, Homo sapiens
agcttccacaaaattaga

SEQ ID NO: 5205536 - DNA, 19 bp, Homo sapiens
agcttccacaaaattagaa

SEQ ID NO: 5205537 - DNA, 18 bp, Homo sapiens
agcttccacctgtccctc

SEQ ID NO: 5205538 - DNA, 19 bp, Homo sapiens
agcttccagaactgtgaga

SEQ ID NO: 5205539 - DNA, 13 bp, Homo sapiens
agcttccagatgg

SEQ ID NO: 5205540 - DNA, 12 bp, Homo sapiens
agcttccagcag

SEQ ID NO: 5205541 - DNA, 16 bp, Homo sapiens
agcttccagcaggagg

SEQ ID NO: 5205542 - DNA, 17 bp, Homo sapiens
agcttccagcaggaggg

SEQ ID NO: 5205543 - DNA, 15 bp, Homo sapiens
agcttccagctctaa

SEQ ID NO: 5205544 - DNA, 22 bp, Homo sapiens
agcttccaggaaaaaggacagg

SEQ ID NO: 5205545 - DNA, 20 bp, Homo sapiens
agcttccaggctgcatagaa

SEQ ID NO: 5205546 - DNA, 15 bp, Homo sapiens
agcttccagtagagc

SEQ ID NO: 5205547 - DNA, 15 bp, Homo sapiens
agcttccataacatt

SEQ ID NO: 5205548 - DNA, 21 bp, Homo sapiens
agcttccatagctgctgccct

SEQ ID NO: 5205549 - DNA, 23 bp, Homo sapiens
agcttccatagctgctgccctag

SEQ ID NO: 5205550 - DNA, 19 bp, Homo sapiens
agcttccatgatgcacagt

SEQ ID NO: 5205551 - DNA, 20 bp, Homo sapiens
agcttccatgatgcacagta

SEQ ID NO: 5205552 - DNA, 24 bp, Homo sapiens
agcttccatgatgcacagtatctg

SEQ ID NO: 5205553 - DNA, 22 bp, Homo sapiens
agcttccatgattctatttata

SEQ ID NO: 5205554 - DNA, 15 bp, Homo sapiens
agcttccatgtttaa

SEQ ID NO: 5205555 - DNA, 20 bp, Homo sapiens
agcttccattttaattttaa

SEQ ID NO: 5205556 - DNA, 10 bp, Homo sapiens
agcttcccaa

SEQ ID NO: 5205557 - DNA, 15 bp, Homo sapiens
agcttcccaacaata

SEQ ID NO: 5205558 - DNA, 18 bp, Homo sapiens
agcttcccaacaatactt

SEQ ID NO: 5205559 - DNA, 19 bp, Homo sapiens
agcttcccacacctgcctg

SEQ ID NO: 5205560 - DNA, 17 bp, Homo sapiens
agcttcccagccatgcc

SEQ ID NO: 5205561 - DNA, 22 bp, Homo sapiens
agcttcccagccatgcccagga

SEQ ID NO: 5205562 - DNA, 23 bp, Homo sapiens
agcttcccagccatgcccaggac

SEQ ID NO: 5205563 - DNA, 16 bp, Homo sapiens
agcttcccctcgctgt

SEQ ID NO: 5205564 - DNA, 13 bp, Homo sapiens
agcttccctccat

SEQ ID NO: 5205565 - DNA, 23 bp, Homo sapiens
agcttccctcccgtgtgttctcc

SEQ ID NO: 5205566 - DNA, 18 bp, Homo sapiens
agcttccctccctgctgt

SEQ ID NO: 5205567 - DNA, 19 bp, Homo sapiens
agcttccgctttgaaagaa

SEQ ID NO: 5205568 - DNA, 20 bp, Homo sapiens
agcttccgctttgaaagaag

SEQ ID NO: 5205569 - DNA, 23 bp, Homo sapiens
agcttccgctttgaaagaagcaa

SEQ ID NO: 5205570 - DNA, 23 bp, Homo sapiens
agcttcctcacacccctgtccca

SEQ ID NO: 5205571 - DNA, 24 bp, Homo sapiens
agcttcctcacacccctgtcccac

SEQ ID NO: 5205572 - DNA, 22 bp, Homo sapiens
agcttcctccagacccctgtgg

SEQ ID NO: 5205573 - DNA, 23 bp, Homo sapiens
agcttcctccagacccctgtggc

SEQ ID NO: 5205574 - DNA, 18 bp, Homo sapiens
agcttcctccagaggagg

SEQ ID NO: 5205575 - DNA, 16 bp, Homo sapiens
agcttcctcggtagca

SEQ ID NO: 5205576 - DNA, 16 bp, Homo sapiens
agcttcctctgagccg

SEQ ID NO: 5205577 - DNA, 18 bp, Homo sapiens
agcttcctctgagccgca

SEQ ID NO: 5205578 - DNA, 13 bp, Homo sapiens
agcttcctgaggg

SEQ ID NO: 5205579 - DNA, 21 bp, Homo sapiens
agcttcctgctgctggggcca

SEQ ID NO: 5205580 - DNA, 14 bp, Homo sapiens
agcttcctggctct

SEQ ID NO: 5205581 - DNA, 17 bp, Homo sapiens
agcttcctggctctggg

SEQ ID NO: 5205582 - DNA, 16 bp, Homo sapiens
agcttcctgtctgttt

SEQ ID NO: 5205583 - DNA, 11 bp, Homo sapiens
agcttcctgtg

SEQ ID NO: 5205584 - DNA, 14 bp, Homo sapiens
agcttcctgtgcag

SEQ ID NO: 5205585 - DNA, 14 bp, Homo sapiens
agcttcctgtgccc

SEQ ID NO: 5205586 - DNA, 18 bp, Homo sapiens
agcttcctgtgccctcac

SEQ ID NO: 5205587 - DNA, 13 bp, Homo sapiens
agcttcctgtttc

SEQ ID NO: 5205588 - DNA, 14 bp, Homo sapiens
agcttcctgtttct

SEQ ID NO: 5205589 - DNA, 12 bp, Homo sapiens
agcttccttcag

SEQ ID NO: 5205590 - DNA, 13 bp, Homo sapiens
agcttccttcaga

SEQ ID NO: 5205591 - DNA, 15 bp, Homo sapiens
agcttccttcagaga

SEQ ID NO: 5205592 - DNA, 16 bp, Homo sapiens
agcttccttcagagag

SEQ ID NO: 5205593 - DNA, 23 bp, Homo sapiens
agcttcctttgtttttttttcct

SEQ ID NO: 5205594 - DNA, 18 bp, Homo sapiens
agcttctaataaattata

SEQ ID NO: 5205595 - DNA, 23 bp, Homo sapiens
agcttctaataaattatacaaat

SEQ ID NO: 5205596 - DNA, 16 bp, Homo sapiens
agcttctagaggctca

SEQ ID NO: 5205597 - DNA, 19 bp, Homo sapiens
agcttctagaggctcatgg

SEQ ID NO: 5205598 - DNA, 23 bp, Homo sapiens
agcttctagaggctcatggccct

SEQ ID NO: 5205599 - DNA, 18 bp, Homo sapiens
agcttctatcccaggagg

SEQ ID NO: 5205600 - DNA, 14 bp, Homo sapiens
agcttctattcatt

SEQ ID NO: 5205601 - DNA, 12 bp, Homo sapiens
agcttctccaac

SEQ ID NO: 5205602 - DNA, 16 bp, Homo sapiens
agcttctccaagcatc

SEQ ID NO: 5205603 - DNA, 13 bp, Homo sapiens
agcttctccagcc

SEQ ID NO: 5205604 - DNA, 12 bp, Homo sapiens
agcttctccagg

SEQ ID NO: 5205605 - DNA, 14 bp, Homo sapiens
agcttctccaggct

SEQ ID NO: 5205606 - DNA, 15 bp, Homo sapiens
agcttctccaggctc

SEQ ID NO: 5205607 - DNA, 14 bp, Homo sapiens
agcttctcctctgc

SEQ ID NO: 5205608 - DNA, 15 bp, Homo sapiens
agcttctcctctgct

SEQ ID NO: 5205609 - DNA, 17 bp, Homo sapiens
agcttctcctgaccagg

SEQ ID NO: 5205610 - DNA, 19 bp, Homo sapiens
agcttctcctgaccagggc

SEQ ID NO: 5205611 - DNA, 12 bp, Homo sapiens
agcttctcctgc

SEQ ID NO: 5205612 - DNA, 13 bp, Homo sapiens
agcttctcctgcg

SEQ ID NO: 5205613 - DNA, 14 bp, Homo sapiens
agcttctctctcca

SEQ ID NO: 5205614 - DNA, 21 bp, Homo sapiens
agcttctctctccctgtcaca

SEQ ID NO: 5205615 - DNA, 12 bp, Homo sapiens
agcttctctgca

SEQ ID NO: 5205616 - DNA, 18 bp, Homo sapiens
agcttctctgccaagccc

SEQ ID NO: 5205617 - DNA, 13 bp, Homo sapiens
agcttctctgggc

SEQ ID NO: 5205618 - DNA, 18 bp, Homo sapiens
agcttctgaaaggtgctt

SEQ ID NO: 5205619 - DNA, 13 bp, Homo sapiens
agcttctgagacg

SEQ ID NO: 5205620 - DNA, 19 bp, Homo sapiens
agcttctgagacgtcatga

SEQ ID NO: 5205621 - DNA, 19 bp, Homo sapiens
agcttctgccccctgcaga

SEQ ID NO: 5205622 - DNA, 15 bp, Homo sapiens
agcttctgctgggct

SEQ ID NO: 5205623 - DNA, 20 bp, Homo sapiens
agcttctgcttttctgccct

SEQ ID NO: 5205624 - DNA, 22 bp, Homo sapiens
agcttctgcttttctgccctgg

SEQ ID NO: 5205625 - DNA, 12 bp, Homo sapiens
agcttctggagc

SEQ ID NO: 5205626 - DNA, 19 bp, Homo sapiens
agcttctggagcagaactt

SEQ ID NO: 5205627 - DNA, 22 bp, Homo sapiens
agcttctgggagatttttttga

SEQ ID NO: 5205628 - DNA, 21 bp, Homo sapiens
agcttctggggtccccagggc

SEQ ID NO: 5205629 - DNA, 15 bp, Homo sapiens
agcttctggtactct

SEQ ID NO: 5205630 - DNA, 16 bp, Homo sapiens
agcttctggtactctc

SEQ ID NO: 5205631 - DNA, 20 bp, Homo sapiens
agcttctggtactctcctag

SEQ ID NO: 5205632 - DNA, 23 bp, Homo sapiens
agcttctggtactctcctagaga

SEQ ID NO: 5205633 - DNA, 12 bp, Homo sapiens
agcttctgtcct

SEQ ID NO: 5205634 - DNA, 22 bp, Homo sapiens
agcttctgttgctgcctcatgc

SEQ ID NO: 5205635 - DNA, 20 bp, Homo sapiens
agcttcttaatataactgcc

SEQ ID NO: 5205636 - DNA, 15 bp, Homo sapiens
agcttcttcagagtg

SEQ ID NO: 5205637 - DNA, 16 bp, Homo sapiens
agcttcttccgtttct

SEQ ID NO: 5205638 - DNA, 14 bp, Homo sapiens
agcttcttctgaaa

SEQ ID NO: 5205639 - DNA, 21 bp, Homo sapiens
agcttcttgcactccttccct

SEQ ID NO: 5205640 - DNA, 16 bp, Homo sapiens
agcttcttgctcctgt

SEQ ID NO: 5205641 - DNA, 18 bp, Homo sapiens
agcttcttgcttgtaaaa

SEQ ID NO: 5205642 - DNA, 22 bp, Homo sapiens
agcttcttgcttgtaaaaatat

SEQ ID NO: 5205643 - DNA, 13 bp, Homo sapiens
agcttcttgggct

SEQ ID NO: 5205644 - DNA, 14 bp, Homo sapiens
agcttcttgggctg

SEQ ID NO: 5205645 - DNA, 15 bp, Homo sapiens
agcttcttgggctga

SEQ ID NO: 5205646 - DNA, 16 bp, Homo sapiens
agcttcttgggctgag

SEQ ID NO: 5205647 - DNA, 19 bp, Homo sapiens
agcttcttgggctgagtgc

SEQ ID NO: 5205648 - DNA, 14 bp, Homo sapiens
agcttcttgtgatc

SEQ ID NO: 5205649 - DNA, 13 bp, Homo sapiens
agcttcttgtttc

SEQ ID NO: 5205650 - DNA, 14 bp, Homo sapiens
agcttcttgtttcc

SEQ ID NO: 5205651 - DNA, 17 bp, Homo sapiens
agcttgaaaactcactt

SEQ ID NO: 5205652 - DNA, 16 bp, Homo sapiens
agcttgaaagttttca

SEQ ID NO: 5205653 - DNA, 22 bp, Homo sapiens
agcttgaaagttttcagaacct

SEQ ID NO: 5205654 - DNA, 21 bp, Homo sapiens
agcttgaaatagtgtctgatg

SEQ ID NO: 5205655 - DNA, 14 bp, Homo sapiens
agcttgaacctgct

SEQ ID NO: 5205656 - DNA, 12 bp, Homo sapiens
agcttgaagatt

SEQ ID NO: 5205657 - DNA, 19 bp, Homo sapiens
agcttgaaggatctgtttt

SEQ ID NO: 5205658 - DNA, 18 bp, Homo sapiens
agcttgacacagtcagca

SEQ ID NO: 5205659 - DNA, 14 bp, Homo sapiens
agcttgaccagacc

SEQ ID NO: 5205660 - DNA, 23 bp, Homo sapiens
agcttgaccagacctagacctgg

SEQ ID NO: 5205661 - DNA, 19 bp, Homo sapiens
agcttgaccgtgaggccag

SEQ ID NO: 5205662 - DNA, 20 bp, Homo sapiens
agcttgactaatggaatgat

SEQ ID NO: 5205663 - DNA, 20 bp, Homo sapiens
agcttgactctactcccagc

SEQ ID NO: 5205664 - DNA, 22 bp, Homo sapiens
agcttgactctactcccagcgc

SEQ ID NO: 5205665 - DNA, 22 bp, Homo sapiens
agcttgactgcttttaaatgac

SEQ ID NO: 5205666 - DNA, 12 bp, Homo sapiens
agcttgagcctc

SEQ ID NO: 5205667 - DNA, 14 bp, Homo sapiens
agcttgaggcaatt

SEQ ID NO: 5205668 - DNA, 15 bp, Homo sapiens
agcttgaggccaaga

SEQ ID NO: 5205669 - DNA, 14 bp, Homo sapiens
agcttgagggttgg

SEQ ID NO: 5205670 - DNA, 18 bp, Homo sapiens
agcttgagggttgggctg

SEQ ID NO: 5205671 - DNA, 22 bp, Homo sapiens
agcttgagtctcaagggtggca

SEQ ID NO: 5205672 - DNA, 22 bp, Homo sapiens
agcttgagttctgcactccaga

SEQ ID NO: 5205673 - DNA, 14 bp, Homo sapiens
agcttgatgttata

SEQ ID NO: 5205674 - DNA, 22 bp, Homo sapiens
agcttgatgttggatctcaaga

SEQ ID NO: 5205675 - DNA, 23 bp, Homo sapiens
agcttgattttcctaatggtctc

SEQ ID NO: 5205676 - DNA, 18 bp, Homo sapiens
agcttgatttttctagca

SEQ ID NO: 5205677 - DNA, 13 bp, Homo sapiens
agcttgcaagaag

SEQ ID NO: 5205678 - DNA, 18 bp, Homo sapiens
agcttgcacatgaatgca

SEQ ID NO: 5205679 - DNA, 15 bp, Homo sapiens
agcttgcacatttgg

SEQ ID NO: 5205680 - DNA, 20 bp, Homo sapiens
agcttgcaccttttcatgta

SEQ ID NO: 5205681 - DNA, 20 bp, Homo sapiens
agcttgcagtccgttgctga

SEQ ID NO: 5205682 - DNA, 15 bp, Homo sapiens
agcttgccacactct

SEQ ID NO: 5205683 - DNA, 15 bp, Homo sapiens
aggcatatttccaat

SEQ ID NO: 5205684 - DNA, 17 bp, Homo sapiens
aggcatatttccaataa

SEQ ID NO: 5205685 - DNA, 17 bp, Homo sapiens
aggcatcaaaaaaacaa

SEQ ID NO: 5205686 - DNA, 22 bp, Homo sapiens
aggcatcagtatgtcactctgg

SEQ ID NO: 5205687 - DNA, 23 bp, Homo sapiens
aggcatcagtccccctgtgcata

SEQ ID NO: 5205688 - DNA, 20 bp, Homo sapiens
aggcatccaggccagggctc

SEQ ID NO: 5205689 - DNA, 15 bp, Homo sapiens
aggcatcccaagacc

SEQ ID NO: 5205690 - DNA, 23 bp, Homo sapiens
aggcatcccaagacctcatctgc

SEQ ID NO: 5205691 - DNA, 13 bp, Homo sapiens
aggcatcccagcc

SEQ ID NO: 5205692 - DNA, 14 bp, Homo sapiens
aggcatcccagcct

SEQ ID NO: 5205693 - DNA, 16 bp, Homo sapiens
aggcatcccagcctgg

SEQ ID NO: 5205694 - DNA, 18 bp, Homo sapiens
aggcatcccagcctgggg

SEQ ID NO: 5205695 - DNA, 22 bp, Homo sapiens
aggcatcccagcctgggggcca

SEQ ID NO: 5205696 - DNA, 18 bp, Homo sapiens
aggcatcccaggggacca

SEQ ID NO: 5205697 - DNA, 19 bp, Homo sapiens
aggcatccgtgaggcaggg

SEQ ID NO: 5205698 - DNA, 21 bp, Homo sapiens
aggcatcctctgactccactc

SEQ ID NO: 5205699 - DNA, 13 bp, Homo sapiens
aggcatcctgcct

SEQ ID NO: 5205700 - DNA, 14 bp, Homo sapiens
aggcatcctgcctg

SEQ ID NO: 5205701 - DNA, 16 bp, Homo sapiens
aggcatcctgcctggg

SEQ ID NO: 5205702 - DNA, 17 bp, Homo sapiens
aggcatcctgcctgggt

SEQ ID NO: 5205703 - DNA, 19 bp, Homo sapiens
aggcatcctgcctgggtgg

SEQ ID NO: 5205704 - DNA, 18 bp, Homo sapiens
aggcatccttcctcacac

SEQ ID NO: 5205705 - DNA, 17 bp, Homo sapiens
aggcatccttgtctttt

SEQ ID NO: 5205706 - DNA, 20 bp, Homo sapiens
aggcatccttgtcttttgag

SEQ ID NO: 5205707 - DNA, 17 bp, Homo sapiens
aggcatcgcaatgtaag

SEQ ID NO: 5205708 - DNA, 23 bp, Homo sapiens
aggcatcgtcatgcacagtattt

SEQ ID NO: 5205709 - DNA, 13 bp, Homo sapiens
aggcatctctctg

SEQ ID NO: 5205710 - DNA, 10 bp, Homo sapiens
aggcatctgc

SEQ ID NO: 5205711 - DNA, 11 bp, Homo sapiens
aggcatctgca

SEQ ID NO: 5205712 - DNA, 15 bp, Homo sapiens
aggcatctgctgtaa

SEQ ID NO: 5205713 - DNA, 19 bp, Homo sapiens
aggcatctgtgggcatggt

SEQ ID NO: 5205714 - DNA, 20 bp, Homo sapiens
aggcatgaaattcttcctaa

SEQ ID NO: 5205715 - DNA, 21 bp, Homo sapiens
aggcatgaagagcaaaaatat

SEQ ID NO: 5205716 - DNA, 19 bp, Homo sapiens
aggcatgacagctgttcca

SEQ ID NO: 5205717 - DNA, 13 bp, Homo sapiens
aggcatgaccctg

SEQ ID NO: 5205718 - DNA, 20 bp, Homo sapiens
aggcatgaccctggagcccg

SEQ ID NO: 5205719 - DNA, 20 bp, Homo sapiens
aggcatgactaatgcttttt

SEQ ID NO: 5205720 - DNA, 20 bp, Homo sapiens
aggcatgagccaccgcgcct

SEQ ID NO: 5205721 - DNA, 22 bp, Homo sapiens
aggcatgagccactgagcctgg

SEQ ID NO: 5205722 - DNA, 23 bp, Homo sapiens
aggcatgagccactgagcctggc

SEQ ID NO: 5205723 - DNA, 22 bp, Homo sapiens
aggcatgagccactgcacctga

SEQ ID NO: 5205724 - DNA, 11 bp, Homo sapiens
aggcatgagct

SEQ ID NO: 5205725 - DNA, 20 bp, Homo sapiens
aggcatgagggatcacaggg

SEQ ID NO: 5205726 - DNA, 22 bp, Homo sapiens
aggcatgcaccagtgccgcctg

SEQ ID NO: 5205727 - DNA, 12 bp, Homo sapiens
aggcatgcagct

SEQ ID NO: 5205728 - DNA, 14 bp, Homo sapiens
aggcatgcagctgc

SEQ ID NO: 5205729 - DNA, 18 bp, Homo sapiens
aggcatgcagctgcctgg

SEQ ID NO: 5205730 - DNA, 13 bp, Homo sapiens
aggcatgcctctg

SEQ ID NO: 5205731 - DNA, 14 bp, Homo sapiens
aggcatgcctctga

SEQ ID NO: 5205732 - DNA, 21 bp, Homo sapiens
aggcatgcctctgatatggga

SEQ ID NO: 5205733 - DNA, 14 bp, Homo sapiens
aggcatgcctggga

SEQ ID NO: 5205734 - DNA, 15 bp, Homo sapiens
aggcatgctcccagc

SEQ ID NO: 5205735 - DNA, 19 bp, Homo sapiens
aggcatgcttctcaccgtg

SEQ ID NO: 5205736 - DNA, 22 bp, Homo sapiens
aggcatggaaagatggggagct

SEQ ID NO: 5205737 - DNA, 15 bp, Homo sapiens
aggcatggagacagc

SEQ ID NO: 5205738 - DNA, 19 bp, Homo sapiens
aggcatggatgaataaatg

SEQ ID NO: 5205739 - DNA, 15 bp, Homo sapiens
aggcatggcaattct

SEQ ID NO: 5205740 - DNA, 17 bp, Homo sapiens
aggcatggcaattctgg

SEQ ID NO: 5205741 - DNA, 18 bp, Homo sapiens
aggcatggcaattctgga

SEQ ID NO: 5205742 - DNA, 21 bp, Homo sapiens
aggcatggcaattctggaagc

SEQ ID NO: 5205743 - DNA, 21 bp, Homo sapiens
aggcatggcccagcctggagc

SEQ ID NO: 5205744 - DNA, 15 bp, Homo sapiens
aggcatggccctggg

SEQ ID NO: 5205745 - DNA, 21 bp, Homo sapiens
aggcatggccctggggtccca

SEQ ID NO: 5205746 - DNA, 17 bp, Homo sapiens
aggcatggctcagagct

SEQ ID NO: 5205747 - DNA, 18 bp, Homo sapiens
aggcatggctcagagctt

SEQ ID NO: 5205748 - DNA, 13 bp, Homo sapiens
aggcatggctggg

SEQ ID NO: 5205749 - DNA, 17 bp, Homo sapiens
aggcatggctggtgcct

SEQ ID NO: 5205750 - DNA, 16 bp, Homo sapiens
aggcatgggggcccaa

SEQ ID NO: 5205751 - DNA, 21 bp, Homo sapiens
aggcatggggggtggggggag

SEQ ID NO: 5205752 - DNA, 19 bp, Homo sapiens
aggcatgggtgcaaggaaa

SEQ ID NO: 5205753 - DNA, 23 bp, Homo sapiens
aggcatggtcccttaaggcacag

SEQ ID NO: 5205754 - DNA, 15 bp, Homo sapiens
aggcatggtggccca

SEQ ID NO: 5205755 - DNA, 22 bp, Homo sapiens
aggcatgtcagaggaccccagg

SEQ ID NO: 5205756 - DNA, 22 bp, Homo sapiens
aggcatgtcccatgtgagctgc

SEQ ID NO: 5205757 - DNA, 18 bp, Homo sapiens
aggcatgttcccagaaag

SEQ ID NO: 5205758 - DNA, 19 bp, Homo sapiens
aggcatgttctctgaggac

SEQ ID NO: 5205759 - DNA, 22 bp, Homo sapiens
aggcatgttctctgaggacact

SEQ ID NO: 5205760 - DNA, 16 bp, Homo sapiens
aggcatgttggactct

SEQ ID NO: 5205761 - DNA, 13 bp, Homo sapiens
aggcattacaaat

SEQ ID NO: 5205762 - DNA, 21 bp, Homo sapiens
aggcattactggccttttcac

SEQ ID NO: 5205763 - DNA, 14 bp, Homo sapiens
aggcattatttaat

SEQ ID NO: 5205764 - DNA, 16 bp, Homo sapiens
aggcattatttaatgt

SEQ ID NO: 5205765 - DNA, 21 bp, Homo sapiens
aggcattatttggatgtgagt

SEQ ID NO: 5205766 - DNA, 23 bp, Homo sapiens
aggcattcagcaattaaagacat

SEQ ID NO: 5205767 - DNA, 20 bp, Homo sapiens
aggcattcagcagtttctga

SEQ ID NO: 5205768 - DNA, 21 bp, Homo sapiens
aggcattccccaggaggccag

SEQ ID NO: 5205769 - DNA, 23 bp, Homo sapiens
aggcattccccaggaggccagcc

SEQ ID NO: 5205770 - DNA, 20 bp, Homo sapiens
aggcattctggacctctggg

SEQ ID NO: 5205771 - DNA, 21 bp, Homo sapiens
aggcattctggacctctgggt

SEQ ID NO: 5205772 - DNA, 22 bp, Homo sapiens
aggcattctttagtctacatag

SEQ ID NO: 5205773 - DNA, 20 bp, Homo sapiens
aggcattgacataggtcata

SEQ ID NO: 5205774 - DNA, 18 bp, Homo sapiens
aggcattgcacagggaga

SEQ ID NO: 5205775 - DNA, 18 bp, Homo sapiens
aggcattgccaagggctt

SEQ ID NO: 5205776 - DNA, 14 bp, Homo sapiens
aggcattggatatt

SEQ ID NO: 5205777 - DNA, 18 bp, Homo sapiens
aggcattgtgatgtttag

SEQ ID NO: 5205778 - DNA, 18 bp, Homo sapiens
aggcattgtgggaagggg

SEQ ID NO: 5205779 - DNA, 20 bp, Homo sapiens
aggcattgttagtttagtgt

SEQ ID NO: 5205780 - DNA, 21 bp, Homo sapiens
aggcattgttagtttagtgtg

SEQ ID NO: 5205781 - DNA, 14 bp, Homo sapiens
aggcattgtttgag

SEQ ID NO: 5205782 - DNA, 17 bp, Homo sapiens
aggcatttaaaatggaa

SEQ ID NO: 5205783 - DNA, 12 bp, Homo sapiens
aggcatttcctg

SEQ ID NO: 5205784 - DNA, 20 bp, Homo sapiens
aggcatttcctgggtggcta

SEQ ID NO: 5205785 - DNA, 17 bp, Homo sapiens
aggcatttgagcagctg

SEQ ID NO: 5205786 - DNA, 18 bp, Homo sapiens
aggcatttgcagggtcct

SEQ ID NO: 5205787 - DNA, 21 bp, Homo sapiens
aggcatttgcagggtcctctt

SEQ ID NO: 5205788 - DNA, 21 bp, Homo sapiens
aggcatttgccaagggaggcg

SEQ ID NO: 5205789 - DNA, 21 bp, Homo sapiens
aggcatttgcctaattcctgg

SEQ ID NO: 5205790 - DNA, 20 bp, Homo sapiens
aggcatttgctaaggcagct

SEQ ID NO: 5205791 - DNA, 23 bp, Homo sapiens
aggcatttgctaaggcagctgat

SEQ ID NO: 5205792 - DNA, 16 bp, Homo sapiens
aggcatttgctgaata

SEQ ID NO: 5205793 - DNA, 19 bp, Homo sapiens
aggcatttggaacaacaaa

SEQ ID NO: 5205794 - DNA, 20 bp, Homo sapiens
aggcatttgtaaatattaaa

SEQ ID NO: 5205795 - DNA, 12 bp, Homo sapiens
aggcatttgtct

SEQ ID NO: 5205796 - DNA, 21 bp, Homo sapiens
aggcatttgtcttagagagag

SEQ ID NO: 5205797 - DNA, 18 bp, Homo sapiens
aggcatttgtttgaactg

SEQ ID NO: 5205798 - DNA, 20 bp, Homo sapiens
aggccaaaagaagtttaaag

SEQ ID NO: 5205799 - DNA, 23 bp, Homo sapiens
aggccaaaattaccaaaaatctt

SEQ ID NO: 5205800 - DNA, 17 bp, Homo sapiens
aggccaaacaggccctc

SEQ ID NO: 5205801 - DNA, 16 bp, Homo sapiens
aggccaaacatggcca

SEQ ID NO: 5205802 - DNA, 18 bp, Homo sapiens
aggccaaacctctgttca

SEQ ID NO: 5205803 - DNA, 22 bp, Homo sapiens
aggccaaacctctgttcagtgt

SEQ ID NO: 5205804 - DNA, 13 bp, Homo sapiens
aggccaaactgct

SEQ ID NO: 5205805 - DNA, 14 bp, Homo sapiens
aggccaaactgctg

SEQ ID NO: 5205806 - DNA, 13 bp, Homo sapiens
aggccaaagacaa

SEQ ID NO: 5205807 - DNA, 15 bp, Homo sapiens
aggccaaagacaaat

SEQ ID NO: 5205808 - DNA, 18 bp, Homo sapiens
aggccaaagacaaatagt

SEQ ID NO: 5205809 - DNA, 16 bp, Homo sapiens
aggccaaagacctccc

SEQ ID NO: 5205810 - DNA, 14 bp, Homo sapiens
aggccaaagcccca

SEQ ID NO: 5205811 - DNA, 17 bp, Homo sapiens
aggccaaagccccatgt

SEQ ID NO: 5205812 - DNA, 15 bp, Homo sapiens
aggccaaaggaagca

SEQ ID NO: 5205813 - DNA, 19 bp, Homo sapiens
aggccaaaggaagcacatg

SEQ ID NO: 5205814 - DNA, 23 bp, Homo sapiens
aggccaaaggaagcacatgcctc

SEQ ID NO: 5205815 - DNA, 20 bp, Homo sapiens
aggccaaaggccagtggaag

SEQ ID NO: 5205816 - DNA, 17 bp, Homo sapiens
aggccaaaggctggtgg

SEQ ID NO: 5205817 - DNA, 16 bp, Homo sapiens
aggccaaatattgatc

SEQ ID NO: 5205818 - DNA, 23 bp, Homo sapiens
aggccaaatattgatctgtatta

SEQ ID NO: 5205819 - DNA, 19 bp, Homo sapiens
aggccaaatctagaattta

SEQ ID NO: 5205820 - DNA, 19 bp, Homo sapiens
aggccaaatgagttccctt

SEQ ID NO: 5205821 - DNA, 17 bp, Homo sapiens
aggccaaatgcacaagc

SEQ ID NO: 5205822 - DNA, 22 bp, Homo sapiens
aggccaaatgcacaagctcaga

SEQ ID NO: 5205823 - DNA, 17 bp, Homo sapiens
aggccaacactgtgggt

SEQ ID NO: 5205824 - DNA, 23 bp, Homo sapiens
aggccaacactgtgggtgtgtga

SEQ ID NO: 5205825 - DNA, 15 bp, Homo sapiens
aggccaacagtagcc

SEQ ID NO: 5205826 - DNA, 13 bp, Homo sapiens
aggccaaccagcc

SEQ ID NO: 5205827 - DNA, 14 bp, Homo sapiens
aggccaaccagccc

SEQ ID NO: 5205828 - DNA, 15 bp, Homo sapiens
aggccaaccagcccg

SEQ ID NO: 5205829 - DNA, 19 bp, Homo sapiens
aggccaaccagcccgacag

SEQ ID NO: 5205830 - DNA, 13 bp, Homo sapiens
aggccaactgcct

SEQ ID NO: 5205831 - DNA, 15 bp, Homo sapiens
aggccaactgcctcc

SEQ ID NO: 5205832 - DNA, 21 bp, Homo sapiens
aggccaagaaagaaaccagac

SEQ ID NO: 5205833 - DNA, 18 bp, Homo sapiens
aggccaagaatattgcaa

SEQ ID NO: 5205834 - DNA, 14 bp, Homo sapiens
aggccaagaatcaa

SEQ ID NO: 5205835 - DNA, 20 bp, Homo sapiens
aggccaagagtggccccacc

SEQ ID NO: 5205836 - DNA, 14 bp, Homo sapiens
aggccaagatggct

SEQ ID NO: 5205837 - DNA, 17 bp, Homo sapiens
aggccaagatggctgct

SEQ ID NO: 5205838 - DNA, 19 bp, Homo sapiens
aggccaagatggctgctgc

SEQ ID NO: 5205839 - DNA, 21 bp, Homo sapiens
aggccaagatggctgctgcct

SEQ ID NO: 5205840 - DNA, 15 bp, Homo sapiens
aggccaagcctgcag

SEQ ID NO: 5205841 - DNA, 16 bp, Homo sapiens
aggccaagcctgcagc

SEQ ID NO: 5205842 - DNA, 15 bp, Homo sapiens
aggccaagctgaagt

SEQ ID NO: 5205843 - DNA, 20 bp, Homo sapiens
aggccaagctgaagtgaagg

SEQ ID NO: 5205844 - DNA, 14 bp, Homo sapiens
aggccaaggcaggt

SEQ ID NO: 5205845 - DNA, 20 bp, Homo sapiens
aggccaaggcgggtggatca

SEQ ID NO: 5205846 - DNA, 14 bp, Homo sapiens
aggccaaggtgcat

SEQ ID NO: 5205847 - DNA, 16 bp, Homo sapiens
aggccaaggtgggagg

SEQ ID NO: 5205848 - DNA, 14 bp, Homo sapiens
aggccaaggtgtcc

SEQ ID NO: 5205849 - DNA, 23 bp, Homo sapiens
aggccaagtccgcagaagccctg

SEQ ID NO: 5205850 - DNA, 23 bp, Homo sapiens
aggccaagtctaatgaagagaaa

SEQ ID NO: 5205851 - DNA, 21 bp, Homo sapiens
aggccaagtgcaggctggcac

SEQ ID NO: 5205852 - DNA, 16 bp, Homo sapiens
aggccaagttgtcagc

SEQ ID NO: 5205853 - DNA, 12 bp, Homo sapiens
aggccaataaaa

SEQ ID NO: 5205854 - DNA, 14 bp, Homo sapiens
aggccaataaaaag

SEQ ID NO: 5205855 - DNA, 23 bp, Homo sapiens
aggccaataaaaagttcagagtt

SEQ ID NO: 5205856 - DNA, 18 bp, Homo sapiens
aggccaatcccttctcca

SEQ ID NO: 5205857 - DNA, 16 bp, Homo sapiens
aggccaatgggctaga

SEQ ID NO: 5205858 - DNA, 22 bp, Homo sapiens
aggccaatgggctagagggtgc

SEQ ID NO: 5205859 - DNA, 16 bp, Homo sapiens
aggccacaagaccctt

SEQ ID NO: 5205860 - DNA, 18 bp, Homo sapiens
agcttgccacactcttct

SEQ ID NO: 5205861 - DNA, 15 bp, Homo sapiens
agcttgcctgcctgc

SEQ ID NO: 5205862 - DNA, 16 bp, Homo sapiens
agcttgcctgcctgcc

SEQ ID NO: 5205863 - DNA, 20 bp, Homo sapiens
agcttgcctgcctgcctgtg

SEQ ID NO: 5205864 - DNA, 19 bp, Homo sapiens
agcttgcctgtttcttctc

SEQ ID NO: 5205865 - DNA, 21 bp, Homo sapiens
agcttgcgcattctcatggag

SEQ ID NO: 5205866 - DNA, 17 bp, Homo sapiens
agcttgctcacatcttg

SEQ ID NO: 5205867 - DNA, 20 bp, Homo sapiens
agcttgctccagattctgat

SEQ ID NO: 5205868 - DNA, 22 bp, Homo sapiens
agcttgctccagattctgatgc

SEQ ID NO: 5205869 - DNA, 22 bp, Homo sapiens
agcttgctcttcagtgggagaa

SEQ ID NO: 5205870 - DNA, 22 bp, Homo sapiens
agcttgctgaggggcagggaga

SEQ ID NO: 5205871 - DNA, 14 bp, Homo sapiens
agcttgctgggctt

SEQ ID NO: 5205872 - DNA, 18 bp, Homo sapiens
agcttgctgggctttggg

SEQ ID NO: 5205873 - DNA, 19 bp, Homo sapiens
agcttgctgtcacttcttc

SEQ ID NO: 5205874 - DNA, 16 bp, Homo sapiens
agcttgcttctctgcc

SEQ ID NO: 5205875 - DNA, 12 bp, Homo sapiens
agcttgcttctt

SEQ ID NO: 5205876 - DNA, 21 bp, Homo sapiens
agcttgcttgctttctttttt

SEQ ID NO: 5205877 - DNA, 23 bp, Homo sapiens
agcttggaaactggatgaggtca

SEQ ID NO: 5205878 - DNA, 18 bp, Homo sapiens
agcttggaagagcctgca

SEQ ID NO: 5205879 - DNA, 18 bp, Homo sapiens
agcttggacatcagtgtt

SEQ ID NO: 5205880 - DNA, 22 bp, Homo sapiens
agcttggacatcagtgtttgtt

SEQ ID NO: 5205881 - DNA, 21 bp, Homo sapiens
agcttggagacaggattctga

SEQ ID NO: 5205882 - DNA, 23 bp, Homo sapiens
agcttggagagtcttgggcctgg

SEQ ID NO: 5205883 - DNA, 16 bp, Homo sapiens
agcttggaggaagtat

SEQ ID NO: 5205884 - DNA, 19 bp, Homo sapiens
agcttggaggtcacagctg

SEQ ID NO: 5205885 - DNA, 22 bp, Homo sapiens
agcttggagtgacctaaagcat

SEQ ID NO: 5205886 - DNA, 18 bp, Homo sapiens
agcttggattaaatacat

SEQ ID NO: 5205887 - DNA, 16 bp, Homo sapiens
agcttggcactcaggt

SEQ ID NO: 5205888 - DNA, 13 bp, Homo sapiens
agcttggcagccg

SEQ ID NO: 5205889 - DNA, 21 bp, Homo sapiens
agcttggcagccgagctcgtg

SEQ ID NO: 5205890 - DNA, 12 bp, Homo sapiens
agcttggccctg

SEQ ID NO: 5205891 - DNA, 14 bp, Homo sapiens
agcttggccctgcg

SEQ ID NO: 5205892 - DNA, 17 bp, Homo sapiens
agcttggccctttcctt

SEQ ID NO: 5205893 - DNA, 11 bp, Homo sapiens
agcttggctca

SEQ ID NO: 5205894 - DNA, 12 bp, Homo sapiens
agcttggctcac

SEQ ID NO: 5205895 - DNA, 20 bp, Homo sapiens
agcttggctcacaaggccca

SEQ ID NO: 5205896 - DNA, 17 bp, Homo sapiens
agcttgggactcaggtc

SEQ ID NO: 5205897 - DNA, 19 bp, Homo sapiens
agcttgggactcaggtctg

SEQ ID NO: 5205898 - DNA, 23 bp, Homo sapiens
agcttgggactcaggtctgtaac

SEQ ID NO: 5205899 - DNA, 15 bp, Homo sapiens
agcttgggagagccc

SEQ ID NO: 5205900 - DNA, 19 bp, Homo sapiens
agcttgggagagcccctgg

SEQ ID NO: 5205901 - DNA, 12 bp, Homo sapiens
agcttgggcagt

SEQ ID NO: 5205902 - DNA, 23 bp, Homo sapiens
agcttgggcagtgccccagggag

SEQ ID NO: 5205903 - DNA, 12 bp, Homo sapiens
agcttgggccca

SEQ ID NO: 5205904 - DNA, 16 bp, Homo sapiens
agcttgggcccagctg

SEQ ID NO: 5205905 - DNA, 17 bp, Homo sapiens
agcttgggcccagctgg

SEQ ID NO: 5205906 - DNA, 21 bp, Homo sapiens
agcttgggcccagctgggctc

SEQ ID NO: 5205907 - DNA, 13 bp, Homo sapiens
agcttgggctggc

SEQ ID NO: 5205908 - DNA, 22 bp, Homo sapiens
agcttgggctggcgggccctgg

SEQ ID NO: 5205909 - DNA, 16 bp, Homo sapiens
agcttgggcttcttcc

SEQ ID NO: 5205910 - DNA, 18 bp, Homo sapiens
agcttggggaacccatga

SEQ ID NO: 5205911 - DNA, 14 bp, Homo sapiens
agcttggggagagg

SEQ ID NO: 5205912 - DNA, 23 bp, Homo sapiens
agcttggggccaccaaagctgcc

SEQ ID NO: 5205913 - DNA, 22 bp, Homo sapiens
agcttgggtcaggttcttgcct

SEQ ID NO: 5205914 - DNA, 16 bp, Homo sapiens
agcttgggtccaccat

SEQ ID NO: 5205915 - DNA, 17 bp, Homo sapiens
agcttggtattgcagag

SEQ ID NO: 5205916 - DNA, 23 bp, Homo sapiens
agcttggtggctgagcttggccc

SEQ ID NO: 5205917 - DNA, 15 bp, Homo sapiens
agcttggttccagga

SEQ ID NO: 5205918 - DNA, 16 bp, Homo sapiens
agcttggttcctgccc

SEQ ID NO: 5205919 - DNA, 23 bp, Homo sapiens
agcttggttgactgatgttcatg

SEQ ID NO: 5205920 - DNA, 13 bp, Homo sapiens
agcttgtaaatac

SEQ ID NO: 5205921 - DNA, 18 bp, Homo sapiens
agcttgtaaatagctcag

SEQ ID NO: 5205922 - DNA, 18 bp, Homo sapiens
agcttgtaataaatactg

SEQ ID NO: 5205923 - DNA, 14 bp, Homo sapiens
agcttgtagccctg

SEQ ID NO: 5205924 - DNA, 16 bp, Homo sapiens
agcttgtagccctgga

SEQ ID NO: 5205925 - DNA, 17 bp, Homo sapiens
agcttgtaggagctgag

SEQ ID NO: 5205926 - DNA, 21 bp, Homo sapiens
agcttgtatatacatattata

SEQ ID NO: 5205927 - DNA, 17 bp, Homo sapiens
agcttgtatgcaatgga

SEQ ID NO: 5205928 - DNA, 12 bp, Homo sapiens
agcttgtatttt

SEQ ID NO: 5205929 - DNA, 15 bp, Homo sapiens
agcttgtcaaagatg

SEQ ID NO: 5205930 - DNA, 23 bp, Homo sapiens
agcttgtctcaaaaaccattaca

SEQ ID NO: 5205931 - DNA, 18 bp, Homo sapiens
agcttgtctcttgcctgc

SEQ ID NO: 5205932 - DNA, 23 bp, Homo sapiens
agcttgtctcttgcctgccactg

SEQ ID NO: 5205933 - DNA, 22 bp, Homo sapiens
agcttgtctgtgatctctgctg

SEQ ID NO: 5205934 - DNA, 16 bp, Homo sapiens
agcttgtctttaaagt

SEQ ID NO: 5205935 - DNA, 17 bp, Homo sapiens
agcttgtcttttctgct

SEQ ID NO: 5205936 - DNA, 20 bp, Homo sapiens
agcttgtcttttctgctgag

SEQ ID NO: 5205937 - DNA, 23 bp, Homo sapiens
agcttgtcttttctgctgaggag

SEQ ID NO: 5205938 - DNA, 21 bp, Homo sapiens
agcttgtgaaaaaataaagaa

SEQ ID NO: 5205939 - DNA, 15 bp, Homo sapiens
agcttgtgagagctg

SEQ ID NO: 5205940 - DNA, 12 bp, Homo sapiens
agcttgtgagct

SEQ ID NO: 5205941 - DNA, 14 bp, Homo sapiens
agcttgtgattcct

SEQ ID NO: 5205942 - DNA, 22 bp, Homo sapiens
agcttgtgctgagcctgcccag

SEQ ID NO: 5205943 - DNA, 17 bp, Homo sapiens
agcttgtggagccccac

SEQ ID NO: 5205944 - DNA, 18 bp, Homo sapiens
agcttgtggagccccaca

SEQ ID NO: 5205945 - DNA, 13 bp, Homo sapiens
agcttgtggccaa

SEQ ID NO: 5205946 - DNA, 17 bp, Homo sapiens
agcttgtggtggggcag

SEQ ID NO: 5205947 - DNA, 20 bp, Homo sapiens
agcttgtggtgttcctgaag

SEQ ID NO: 5205948 - DNA, 23 bp, Homo sapiens
agcttgtggtgttcctgaagcaa

SEQ ID NO: 5205949 - DNA, 14 bp, Homo sapiens
agcttgtgtatctt

SEQ ID NO: 5205950 - DNA, 20 bp, Homo sapiens
agcttgtgtgcaaaagcagt

SEQ ID NO: 5205951 - DNA, 14 bp, Homo sapiens
agcttgttctagaa

SEQ ID NO: 5205952 - DNA, 15 bp, Homo sapiens
agcttgttctgggct

SEQ ID NO: 5205953 - DNA, 20 bp, Homo sapiens
agcttgttgaaaacccagac

SEQ ID NO: 5205954 - DNA, 23 bp, Homo sapiens
agcttgttgaaaacccagactgt

SEQ ID NO: 5205955 - DNA, 23 bp, Homo sapiens
agcttgttgtcccaatgaaatac

SEQ ID NO: 5205956 - DNA, 18 bp, Homo sapiens
agcttgtttaacggcagt

SEQ ID NO: 5205957 - DNA, 18 bp, Homo sapiens
agcttgtttacatgctta

SEQ ID NO: 5205958 - DNA, 23 bp, Homo sapiens
agcttgtttacatgcttattcca

SEQ ID NO: 5205959 - DNA, 16 bp, Homo sapiens
agcttgtttccctgct

SEQ ID NO: 5205960 - DNA, 17 bp, Homo sapiens
agcttgtttccctgctg

SEQ ID NO: 5205961 - DNA, 19 bp, Homo sapiens
agcttgtttccctgctggc

SEQ ID NO: 5205962 - DNA, 12 bp, Homo sapiens
agcttgtttcta

SEQ ID NO: 5205963 - DNA, 19 bp, Homo sapiens
agcttgtttctatactgtt

SEQ ID NO: 5205964 - DNA, 20 bp, Homo sapiens
agcttgttttggactttgtt

SEQ ID NO: 5205965 - DNA, 23 bp, Homo sapiens
agcttgttttggactttgttaca

SEQ ID NO: 5205966 - DNA, 13 bp, Homo sapiens
agctttaaaaaaa

SEQ ID NO: 5205967 - DNA, 13 bp, Homo sapiens
agctttaaaagaa

SEQ ID NO: 5205968 - DNA, 17 bp, Homo sapiens
agctttaaaagtatctt

SEQ ID NO: 5205969 - DNA, 19 bp, Homo sapiens
agctttaaaagtatcttta

SEQ ID NO: 5205970 - DNA, 21 bp, Homo sapiens
agctttaaactcagggacaga

SEQ ID NO: 5205971 - DNA, 14 bp, Homo sapiens
agctttaaatgaca

SEQ ID NO: 5205972 - DNA, 17 bp, Homo sapiens
agctttaaatgacagta

SEQ ID NO: 5205973 - DNA, 22 bp, Homo sapiens
agctttaaatgacagtaatatt

SEQ ID NO: 5205974 - DNA, 22 bp, Homo sapiens
agctttaaccattaaaactgaa

SEQ ID NO: 5205975 - DNA, 21 bp, Homo sapiens
agctttaatgatatgcttgta

SEQ ID NO: 5205976 - DNA, 20 bp, Homo sapiens
agctttacacacacagatgt

SEQ ID NO: 5205977 - DNA, 13 bp, Homo sapiens
agctttacatttt

SEQ ID NO: 5205978 - DNA, 16 bp, Homo sapiens
agctttactactgtgg

SEQ ID NO: 5205979 - DNA, 17 bp, Homo sapiens
agctttactactgtgga

SEQ ID NO: 5205980 - DNA, 21 bp, Homo sapiens
agctttactggagttgggggc

SEQ ID NO: 5205981 - DNA, 21 bp, Homo sapiens
agctttactggggctggggaa

SEQ ID NO: 5205982 - DNA, 15 bp, Homo sapiens
agctttactgtggct

SEQ ID NO: 5205983 - DNA, 19 bp, Homo sapiens
agctttactgtttctcaag

SEQ ID NO: 5205984 - DNA, 15 bp, Homo sapiens
agctttactgtttgt

SEQ ID NO: 5205985 - DNA, 18 bp, Homo sapiens
agctttagaatcccagcc

SEQ ID NO: 5205986 - DNA, 18 bp, Homo sapiens
agctttagagaagccata

SEQ ID NO: 5205987 - DNA, 19 bp, Homo sapiens
agctttagagaagccataa

SEQ ID NO: 5205988 - DNA, 15 bp, Homo sapiens
agctttataaacttt

SEQ ID NO: 5205989 - DNA, 16 bp, Homo sapiens
agctttataataaact

SEQ ID NO: 5205990 - DNA, 17 bp, Homo sapiens
agctttatacagttgaa

SEQ ID NO: 5205991 - DNA, 18 bp, Homo sapiens
agctttatacgtgtagct

SEQ ID NO: 5205992 - DNA, 15 bp, Homo sapiens
agctttatactctct

SEQ ID NO: 5205993 - DNA, 17 bp, Homo sapiens
agctttatatatggaca

SEQ ID NO: 5205994 - DNA, 18 bp, Homo sapiens
agctttatatatggacat

SEQ ID NO: 5205995 - DNA, 15 bp, Homo sapiens
agctttatctgtctt

SEQ ID NO: 5205996 - DNA, 13 bp, Homo sapiens
agctttatctttg

SEQ ID NO: 5205997 - DNA, 15 bp, Homo sapiens
agctttatctttgtg

SEQ ID NO: 5205998 - DNA, 16 bp, Homo sapiens
agctttatctttgtgt

SEQ ID NO: 5205999 - DNA, 14 bp, Homo sapiens
agctttatgatttt

SEQ ID NO: 5206000 - DNA, 17 bp, Homo sapiens
agctttatgattttcat

SEQ ID NO: 5206001 - DNA, 18 bp, Homo sapiens
agctttatgattttcata

SEQ ID NO: 5206002 - DNA, 16 bp, Homo sapiens
agctttatgtaataat

SEQ ID NO: 5206003 - DNA, 22 bp, Homo sapiens
agctttattatggcttgtgaac

SEQ ID NO: 5206004 - DNA, 19 bp, Homo sapiens
agctttattgctgcatttt

SEQ ID NO: 5206005 - DNA, 23 bp, Homo sapiens
agctttattgtgattacgtgtat

SEQ ID NO: 5206006 - DNA, 23 bp, Homo sapiens
agctttattgttcacacaaagcc

SEQ ID NO: 5206007 - DNA, 14 bp, Homo sapiens
agctttatttcaaa

SEQ ID NO: 5206008 - DNA, 21 bp, Homo sapiens
agctttattttgagatgtaaa

SEQ ID NO: 5206009 - DNA, 16 bp, Homo sapiens
agctttatttttcttt

SEQ ID NO: 5206010 - DNA, 16 bp, Homo sapiens
agctttcaaagcattt

SEQ ID NO: 5206011 - DNA, 15 bp, Homo sapiens
agctttcaattccgt

SEQ ID NO: 5206012 - DNA, 13 bp, Homo sapiens
agctttcagagcc

SEQ ID NO: 5206013 - DNA, 19 bp, Homo sapiens
agctttcagagccagtgaa

SEQ ID NO: 5206014 - DNA, 18 bp, Homo sapiens
agctttccaaggaagcag

SEQ ID NO: 5206015 - DNA, 20 bp, Homo sapiens
agctttccacatttgtcaca

SEQ ID NO: 5206016 - DNA, 13 bp, Homo sapiens
agctttccagtta

SEQ ID NO: 5206017 - DNA, 17 bp, Homo sapiens
agctttccatctgagga

SEQ ID NO: 5206018 - DNA, 17 bp, Homo sapiens
agctttccatgttgctg

SEQ ID NO: 5206019 - DNA, 12 bp, Homo sapiens
agctttcccagg

SEQ ID NO: 5206020 - DNA, 12 bp, Homo sapiens
agctttccctgc

SEQ ID NO: 5206021 - DNA, 16 bp, Homo sapiens
agctttccctgccagg

SEQ ID NO: 5206022 - DNA, 17 bp, Homo sapiens
agctttccctggctcag

SEQ ID NO: 5206023 - DNA, 19 bp, Homo sapiens
agctttccctggctcaggg

SEQ ID NO: 5206024 - DNA, 20 bp, Homo sapiens
agctttccctggctcaggga

SEQ ID NO: 5206025 - DNA, 14 bp, Homo sapiens
agctttccctgtgc

SEQ ID NO: 5206026 - DNA, 13 bp, Homo sapiens
agctttcctggaa

SEQ ID NO: 5206027 - DNA, 14 bp, Homo sapiens
agctttcctggaag

SEQ ID NO: 5206028 - DNA, 22 bp, Homo sapiens
agctttcctggaagtcaaataa

SEQ ID NO: 5206029 - DNA, 19 bp, Homo sapiens
agctttcctgggtctggat

SEQ ID NO: 5206030 - DNA, 12 bp, Homo sapiens
agctttcctggt

SEQ ID NO: 5206031 - DNA, 23 bp, Homo sapiens
agctttcctgttgaatgacaaag

SEQ ID NO: 5206032 - DNA, 20 bp, Homo sapiens
agctttcctgtttccagggt

SEQ ID NO: 5206033 - DNA, 23 bp, Homo sapiens
agctttccttctccaggaatact

SEQ ID NO: 5206034 - DNA, 20 bp, Homo sapiens
agctttcctttacagctgtt

SEQ ID NO: 5206035 - DNA, 16 bp, Homo sapiens
agctttctaactcaca

SEQ ID NO: 5206036 - DNA, 21 bp, Homo sapiens
agctttctaagagaagcaatt

SEQ ID NO: 5206037 - DNA, 17 bp, Homo sapiens
aggccacaagacccttg

SEQ ID NO: 5206038 - DNA, 20 bp, Homo sapiens
aggccacacgcactggtgcc

SEQ ID NO: 5206039 - DNA, 18 bp, Homo sapiens
aggccacacgctgcccag

SEQ ID NO: 5206040 - DNA, 20 bp, Homo sapiens
aggccacacgctgcccaggc

SEQ ID NO: 5206041 - DNA, 14 bp, Homo sapiens
aggccacactttct

SEQ ID NO: 5206042 - DNA, 20 bp, Homo sapiens
aggccacactttctgggaaa

SEQ ID NO: 5206043 - DNA, 15 bp, Homo sapiens
aggccacagagaacc

SEQ ID NO: 5206044 - DNA, 11 bp, Homo sapiens
aggccacagcc

SEQ ID NO: 5206045 - DNA, 13 bp, Homo sapiens
aggccacagccag

SEQ ID NO: 5206046 - DNA, 14 bp, Homo sapiens
aggccacagccagg

SEQ ID NO: 5206047 - DNA, 15 bp, Homo sapiens
aggccacagccgcct

SEQ ID NO: 5206048 - DNA, 19 bp, Homo sapiens
aggccacagtggggctgca

SEQ ID NO: 5206049 - DNA, 21 bp, Homo sapiens
aggccacatacctctctgaga

SEQ ID NO: 5206050 - DNA, 22 bp, Homo sapiens
aggccacatggggctgggcagc

SEQ ID NO: 5206051 - DNA, 15 bp, Homo sapiens
aggccacatgtcacc

SEQ ID NO: 5206052 - DNA, 18 bp, Homo sapiens
aggccaccagctgctgga

SEQ ID NO: 5206053 - DNA, 13 bp, Homo sapiens
aggccaccaggat

SEQ ID NO: 5206054 - DNA, 22 bp, Homo sapiens
aggccaccatattcagtgctgt

SEQ ID NO: 5206055 - DNA, 22 bp, Homo sapiens
aggccaccatctgtaccctgct

SEQ ID NO: 5206056 - DNA, 16 bp, Homo sapiens
aggccacccactgacc

SEQ ID NO: 5206057 - DNA, 16 bp, Homo sapiens
aggccacccccacctc

SEQ ID NO: 5206058 - DNA, 21 bp, Homo sapiens
aggccacccccatggaagcaa

SEQ ID NO: 5206059 - DNA, 19 bp, Homo sapiens
aggccaccccgctgatgga

SEQ ID NO: 5206060 - DNA, 23 bp, Homo sapiens
aggccaccccgctgatggagccc

SEQ ID NO: 5206061 - DNA, 14 bp, Homo sapiens
aggccaccctccac

SEQ ID NO: 5206062 - DNA, 18 bp, Homo sapiens
aggccaccgggacagacc

SEQ ID NO: 5206063 - DNA, 19 bp, Homo sapiens
aggccaccgggacagacct

SEQ ID NO: 5206064 - DNA, 22 bp, Homo sapiens
aggccaccgggacagacctgga

SEQ ID NO: 5206065 - DNA, 20 bp, Homo sapiens
aggccacctccaaggactct

SEQ ID NO: 5206066 - DNA, 23 bp, Homo sapiens
aggccacctcccactcctgctgc

SEQ ID NO: 5206067 - DNA, 24 bp, Homo sapiens
aggccacctcccactcctgctgca

SEQ ID NO: 5206068 - DNA, 14 bp, Homo sapiens
aggccacctctcca

SEQ ID NO: 5206069 - DNA, 17 bp, Homo sapiens
aggccacctctccaagg

SEQ ID NO: 5206070 - DNA, 23 bp, Homo sapiens
aggccacctctccaagggcttct

SEQ ID NO: 5206071 - DNA, 14 bp, Homo sapiens
aggccacctctgcc

SEQ ID NO: 5206072 - DNA, 13 bp, Homo sapiens
aggccacctgccc

SEQ ID NO: 5206073 - DNA, 14 bp, Homo sapiens
aggccacctgcccc

SEQ ID NO: 5206074 - DNA, 17 bp, Homo sapiens
aggccacctgccccctt

SEQ ID NO: 5206075 - DNA, 17 bp, Homo sapiens
aggccaccttggaggag

SEQ ID NO: 5206076 - DNA, 18 bp, Homo sapiens
aggccaccttggaggagg

SEQ ID NO: 5206077 - DNA, 19 bp, Homo sapiens
aggccaccttggaggagga

SEQ ID NO: 5206078 - DNA, 16 bp, Homo sapiens
aggccacgctcctctg

SEQ ID NO: 5206079 - DNA, 19 bp, Homo sapiens
aggccacgctcctctgttc

SEQ ID NO: 5206080 - DNA, 15 bp, Homo sapiens
aggccacgggggagg

SEQ ID NO: 5206081 - DNA, 14 bp, Homo sapiens
aggccacgtccagg

SEQ ID NO: 5206082 - DNA, 16 bp, Homo sapiens
aggccacgtcccaccc

SEQ ID NO: 5206083 - DNA, 18 bp, Homo sapiens
aggccacgtcccacccca

SEQ ID NO: 5206084 - DNA, 23 bp, Homo sapiens
aggccacgtgatgtggagggcac

SEQ ID NO: 5206085 - DNA, 18 bp, Homo sapiens
aggccactcagaggcccc

SEQ ID NO: 5206086 - DNA, 14 bp, Homo sapiens
aggccactcctcca

SEQ ID NO: 5206087 - DNA, 19 bp, Homo sapiens
aggccactcctccaaagga

SEQ ID NO: 5206088 - DNA, 12 bp, Homo sapiens
aggccactgaag

SEQ ID NO: 5206089 - DNA, 13 bp, Homo sapiens
aggccactgaaga

SEQ ID NO: 5206090 - DNA, 17 bp, Homo sapiens
aggccactgaagaggag

SEQ ID NO: 5206091 - DNA, 21 bp, Homo sapiens
aggccactgcaaaccctgctg

SEQ ID NO: 5206092 - DNA, 18 bp, Homo sapiens
aggccactgtggccagag

SEQ ID NO: 5206093 - DNA, 21 bp, Homo sapiens
aggccactgtggccagagctg

SEQ ID NO: 5206094 - DNA, 23 bp, Homo sapiens
aggccactgtggccagagctgga

SEQ ID NO: 5206095 - DNA, 16 bp, Homo sapiens
aggccactgtgggtga

SEQ ID NO: 5206096 - DNA, 19 bp, Homo sapiens
aggccactgtgttccttcc

SEQ ID NO: 5206097 - DNA, 13 bp, Homo sapiens
aggccagaaaaag

SEQ ID NO: 5206098 - DNA, 18 bp, Homo sapiens
aggccagaaaaagaagaa

SEQ ID NO: 5206099 - DNA, 19 bp, Homo sapiens
aggccagaaaaagaagaag

SEQ ID NO: 5206100 - DNA, 23 bp, Homo sapiens
aggccagaaaaggcagccagatc

SEQ ID NO: 5206101 - DNA, 12 bp, Homo sapiens
aggccagaaagg

SEQ ID NO: 5206102 - DNA, 13 bp, Homo sapiens
aggccagaaaggt

SEQ ID NO: 5206103 - DNA, 18 bp, Homo sapiens
aggccagacacaggccgt

SEQ ID NO: 5206104 - DNA, 16 bp, Homo sapiens
aggccagaccatggac

SEQ ID NO: 5206105 - DNA, 18 bp, Homo sapiens
aggccagaccatggacac

SEQ ID NO: 5206106 - DNA, 11 bp, Homo sapiens
aggccagagaa

SEQ ID NO: 5206107 - DNA, 13 bp, Homo sapiens
aggccagagaaag

SEQ ID NO: 5206108 - DNA, 16 bp, Homo sapiens
aggccagagagggaaa

SEQ ID NO: 5206109 - DNA, 20 bp, Homo sapiens
aggccagagcaaacagaaaa

SEQ ID NO: 5206110 - DNA, 21 bp, Homo sapiens
aggccagagccatgccaggct

SEQ ID NO: 5206111 - DNA, 17 bp, Homo sapiens
aggccagagcccactcc

SEQ ID NO: 5206112 - DNA, 15 bp, Homo sapiens
aggccagaggaaggg

SEQ ID NO: 5206113 - DNA, 23 bp, Homo sapiens
aggccagaggaagggaggcctga

SEQ ID NO: 5206114 - DNA, 22 bp, Homo sapiens
aggccagaggcccccagcccag

SEQ ID NO: 5206115 - DNA, 14 bp, Homo sapiens
aggccagagggagt

SEQ ID NO: 5206116 - DNA, 20 bp, Homo sapiens
aggccagagggagtgacaga

SEQ ID NO: 5206117 - DNA, 14 bp, Homo sapiens
aggccagaggtgaa

SEQ ID NO: 5206118 - DNA, 21 bp, Homo sapiens
aggccagagtcaccttttctg

SEQ ID NO: 5206119 - DNA, 17 bp, Homo sapiens
aggccagagtctcccag

SEQ ID NO: 5206120 - DNA, 22 bp, Homo sapiens
aggccagagtggcctggccagg

SEQ ID NO: 5206121 - DNA, 20 bp, Homo sapiens
aggccagatggcccctccac

SEQ ID NO: 5206122 - DNA, 14 bp, Homo sapiens
aggccagcaacatt

SEQ ID NO: 5206123 - DNA, 14 bp, Homo sapiens
aggccagcaacgct

SEQ ID NO: 5206124 - DNA, 24 bp, Homo sapiens
aggccagcaaggtggagtggatgc

SEQ ID NO: 5206125 - DNA, 22 bp, Homo sapiens
aggccagcactcgctagcagtg

SEQ ID NO: 5206126 - DNA, 12 bp, Homo sapiens
aggccagcagcc

SEQ ID NO: 5206127 - DNA, 18 bp, Homo sapiens
aggccagcagccttccag

SEQ ID NO: 5206128 - DNA, 19 bp, Homo sapiens
aggccagcagccttccagt

SEQ ID NO: 5206129 - DNA, 21 bp, Homo sapiens
aggccagcaggcgggctcctt

SEQ ID NO: 5206130 - DNA, 23 bp, Homo sapiens
aggccagcaggcgggctcctttg

SEQ ID NO: 5206131 - DNA, 13 bp, Homo sapiens
aggccagcagggg

SEQ ID NO: 5206132 - DNA, 15 bp, Homo sapiens
aggccagcaggggct

SEQ ID NO: 5206133 - DNA, 15 bp, Homo sapiens
aggccagccacacca

SEQ ID NO: 5206134 - DNA, 19 bp, Homo sapiens
aggccagccacaccacagg

SEQ ID NO: 5206135 - DNA, 12 bp, Homo sapiens
aggccagcccac

SEQ ID NO: 5206136 - DNA, 14 bp, Homo sapiens
aggccagcccactg

SEQ ID NO: 5206137 - DNA, 16 bp, Homo sapiens
aggccagcccactggg

SEQ ID NO: 5206138 - DNA, 19 bp, Homo sapiens
aggccagcccactgggccc

SEQ ID NO: 5206139 - DNA, 20 bp, Homo sapiens
aggccagcccactgggccct

SEQ ID NO: 5206140 - DNA, 21 bp, Homo sapiens
aggccagcccactgggccctg

SEQ ID NO: 5206141 - DNA, 11 bp, Homo sapiens
aggccagcccc

SEQ ID NO: 5206142 - DNA, 16 bp, Homo sapiens
aggccagccccaccca

SEQ ID NO: 5206143 - DNA, 17 bp, Homo sapiens
aggccagccccacccag

SEQ ID NO: 5206144 - DNA, 18 bp, Homo sapiens
aggccagccccatcttgg

SEQ ID NO: 5206145 - DNA, 20 bp, Homo sapiens
aggccagcccccccacccac

SEQ ID NO: 5206146 - DNA, 22 bp, Homo sapiens
aggccagcccccccacccaccc

SEQ ID NO: 5206147 - DNA, 23 bp, Homo sapiens
aggccagcccccccacccacccc

SEQ ID NO: 5206148 - DNA, 20 bp, Homo sapiens
aggccagccctccctggctg

SEQ ID NO: 5206149 - DNA, 22 bp, Homo sapiens
aggccagccctccctggctgtg

SEQ ID NO: 5206150 - DNA, 16 bp, Homo sapiens
aggccagccctggttc

SEQ ID NO: 5206151 - DNA, 13 bp, Homo sapiens
aggccagcctccg

SEQ ID NO: 5206152 - DNA, 22 bp, Homo sapiens
aggccagcctccgagagggaga

SEQ ID NO: 5206153 - DNA, 15 bp, Homo sapiens
aggccagcctggcct

SEQ ID NO: 5206154 - DNA, 14 bp, Homo sapiens
aggccagccttggc

SEQ ID NO: 5206155 - DNA, 22 bp, Homo sapiens
aggccagccttgtacagtctgc

SEQ ID NO: 5206156 - DNA, 19 bp, Homo sapiens
aggccagcgtgaaggacct

SEQ ID NO: 5206157 - DNA, 15 bp, Homo sapiens
aggccagctatctgc

SEQ ID NO: 5206158 - DNA, 21 bp, Homo sapiens
aggccagctatctgcctgaca

SEQ ID NO: 5206159 - DNA, 14 bp, Homo sapiens
aggccagctcagga

SEQ ID NO: 5206160 - DNA, 15 bp, Homo sapiens
aggccagctgcggcc

SEQ ID NO: 5206161 - DNA, 14 bp, Homo sapiens
aggccagctgcttg

SEQ ID NO: 5206162 - DNA, 18 bp, Homo sapiens
aggccagctggcagcaga

SEQ ID NO: 5206163 - DNA, 19 bp, Homo sapiens
aggccagcttcgtgctgga

SEQ ID NO: 5206164 - DNA, 17 bp, Homo sapiens
aggccaggaatctgcca

SEQ ID NO: 5206165 - DNA, 18 bp, Homo sapiens
aggccaggaatctgccat

SEQ ID NO: 5206166 - DNA, 17 bp, Homo sapiens
aggccaggaccaagggc

SEQ ID NO: 5206167 - DNA, 20 bp, Homo sapiens
aggccaggaccaagggcaga

SEQ ID NO: 5206168 - DNA, 22 bp, Homo sapiens
aggccaggaccaagggcagagg

SEQ ID NO: 5206169 - DNA, 15 bp, Homo sapiens
aggccaggaccacac

SEQ ID NO: 5206170 - DNA, 20 bp, Homo sapiens
aggccaggaccacacagtcc

SEQ ID NO: 5206171 - DNA, 23 bp, Homo sapiens
aggccaggaccacacagtcccca

SEQ ID NO: 5206172 - DNA, 21 bp, Homo sapiens
aggccaggacgggccacacgt

SEQ ID NO: 5206173 - DNA, 17 bp, Homo sapiens
aggccaggacgtctggg

SEQ ID NO: 5206174 - DNA, 15 bp, Homo sapiens
aggccaggactctgc

SEQ ID NO: 5206175 - DNA, 17 bp, Homo sapiens
aggccaggactctgcag

SEQ ID NO: 5206176 - DNA, 22 bp, Homo sapiens
aggccaggactttgagaccagc

SEQ ID NO: 5206177 - DNA, 16 bp, Homo sapiens
aggccaggagttccca

SEQ ID NO: 5206178 - DNA, 14 bp, Homo sapiens
aggccaggatgcct

SEQ ID NO: 5206179 - DNA, 17 bp, Homo sapiens
aggccaggatgcctgag

SEQ ID NO: 5206180 - DNA, 20 bp, Homo sapiens
aggccaggatgcctgagccc

SEQ ID NO: 5206181 - DNA, 11 bp, Homo sapiens
aggccaggcat

SEQ ID NO: 5206182 - DNA, 23 bp, Homo sapiens
aggccaggcatggcccagcctgg

SEQ ID NO: 5206183 - DNA, 19 bp, Homo sapiens
aggccaggccaccaggatg

SEQ ID NO: 5206184 - DNA, 14 bp, Homo sapiens
aggccaggccagct

SEQ ID NO: 5206185 - DNA, 15 bp, Homo sapiens
aggccaggccagctg

SEQ ID NO: 5206186 - DNA, 16 bp, Homo sapiens
aggccaggccagcttc

SEQ ID NO: 5206187 - DNA, 15 bp, Homo sapiens
aggccaggccctcct

SEQ ID NO: 5206188 - DNA, 17 bp, Homo sapiens
aggccaggccctcctgc

SEQ ID NO: 5206189 - DNA, 12 bp, Homo sapiens
aggccaggccgg

SEQ ID NO: 5206190 - DNA, 17 bp, Homo sapiens
aggccaggcgagcctga

SEQ ID NO: 5206191 - DNA, 11 bp, Homo sapiens
aggccaggctc

SEQ ID NO: 5206192 - DNA, 22 bp, Homo sapiens
aggccaggctccttcctgtctt

SEQ ID NO: 5206193 - DNA, 16 bp, Homo sapiens
aggccaggctgcctcg

SEQ ID NO: 5206194 - DNA, 15 bp, Homo sapiens
aggccagggcagagt

SEQ ID NO: 5206195 - DNA, 13 bp, Homo sapiens
aggccagggcctc

SEQ ID NO: 5206196 - DNA, 14 bp, Homo sapiens
aggccagggcctct

SEQ ID NO: 5206197 - DNA, 14 bp, Homo sapiens
aggccagggctcac

SEQ ID NO: 5206198 - DNA, 16 bp, Homo sapiens
aggccagggctgatgg

SEQ ID NO: 5206199 - DNA, 14 bp, Homo sapiens
aggccagggctggg

SEQ ID NO: 5206200 - DNA, 15 bp, Homo sapiens
aggccagggctgggt

SEQ ID NO: 5206201 - DNA, 16 bp, Homo sapiens
aggccagggctgggtc

SEQ ID NO: 5206202 - DNA, 22 bp, Homo sapiens
aggccagggctgggtcacagga

SEQ ID NO: 5206203 - DNA, 13 bp, Homo sapiens
aggccaggggctt

SEQ ID NO: 5206204 - DNA, 16 bp, Homo sapiens
aggccaggggcttttg

SEQ ID NO: 5206205 - DNA, 10 bp, Homo sapiens
aggccaggta

SEQ ID NO: 5206206 - DNA, 16 bp, Homo sapiens
aggccaggtccagaga

SEQ ID NO: 5206207 - DNA, 21 bp, Homo sapiens
aggccaggtccctggaccagc

SEQ ID NO: 5206208 - DNA, 24 bp, Homo sapiens
aggccaggtccctggaccagcctc

SEQ ID NO: 5206209 - DNA, 17 bp, Homo sapiens
aggccaggtgaggtcca

SEQ ID NO: 5206210 - DNA, 11 bp, Homo sapiens
aggccaggtgc

SEQ ID NO: 5206211 - DNA, 21 bp, Homo sapiens
aggccaggtgcccaggaaagg

SEQ ID NO: 5206212 - DNA, 19 bp, Homo sapiens
aggccagtaatcccagtga

SEQ ID NO: 5206213 - DNA, 19 bp, Homo sapiens
aggccagtagggggaggga

SEQ ID NO: 5206214 - DNA, 16 bp, Homo sapiens
aggccagtcaccctgt

SEQ ID NO: 5206215 - DNA, 22 bp, Homo sapiens
aggccagtcagacgccaggcac

SEQ ID NO: 5206216 - DNA, 23 bp, Homo sapiens
agctttctaagctttcttacaat

SEQ ID NO: 5206217 - DNA, 14 bp, Homo sapiens
agctttctcaatgt

SEQ ID NO: 5206218 - DNA, 21 bp, Homo sapiens
agctttctcaatgtcttccca

SEQ ID NO: 5206219 - DNA, 23 bp, Homo sapiens
agctttctcagggggtcagcaga

SEQ ID NO: 5206220 - DNA, 13 bp, Homo sapiens
agctttctccccg

SEQ ID NO: 5206221 - DNA, 22 bp, Homo sapiens
agctttctcctcatccatttct

SEQ ID NO: 5206222 - DNA, 13 bp, Homo sapiens
agctttctctcag

SEQ ID NO: 5206223 - DNA, 14 bp, Homo sapiens
agctttctctcaga

SEQ ID NO: 5206224 - DNA, 15 bp, Homo sapiens
agctttctctgcttc

SEQ ID NO: 5206225 - DNA, 19 bp, Homo sapiens
agctttctctgcttcagct

SEQ ID NO: 5206226 - DNA, 16 bp, Homo sapiens
agctttctgaacagct

SEQ ID NO: 5206227 - DNA, 19 bp, Homo sapiens
agctttctgaacagctggt

SEQ ID NO: 5206228 - DNA, 14 bp, Homo sapiens
agctttctgagcaa

SEQ ID NO: 5206229 - DNA, 18 bp, Homo sapiens
agctttctgccttagcct

SEQ ID NO: 5206230 - DNA, 20 bp, Homo sapiens
agctttctgggatgtcacag

SEQ ID NO: 5206231 - DNA, 15 bp, Homo sapiens
agctttctgtgcatg

SEQ ID NO: 5206232 - DNA, 17 bp, Homo sapiens
agctttctgtgcatgtg

SEQ ID NO: 5206233 - DNA, 12 bp, Homo sapiens
agctttcttcag

SEQ ID NO: 5206234 - DNA, 17 bp, Homo sapiens
agctttcttcagctgcc

SEQ ID NO: 5206235 - DNA, 21 bp, Homo sapiens
agctttcttctacaaccagag

SEQ ID NO: 5206236 - DNA, 17 bp, Homo sapiens
agctttcttgctccctt

SEQ ID NO: 5206237 - DNA, 16 bp, Homo sapiens
agctttcttgtttctt

SEQ ID NO: 5206238 - DNA, 17 bp, Homo sapiens
agctttcttgtttctta

SEQ ID NO: 5206239 - DNA, 14 bp, Homo sapiens
agctttcttttgta

SEQ ID NO: 5206240 - DNA, 12 bp, Homo sapiens
agctttgaaaat

SEQ ID NO: 5206241 - DNA, 19 bp, Homo sapiens
agctttgaaataaaataac

SEQ ID NO: 5206242 - DNA, 16 bp, Homo sapiens
agctttgaacaattgt

SEQ ID NO: 5206243 - DNA, 21 bp, Homo sapiens
agctttgaaggctggattcta

SEQ ID NO: 5206244 - DNA, 18 bp, Homo sapiens
agctttgaatacccccag

SEQ ID NO: 5206245 - DNA, 19 bp, Homo sapiens
agctttgaatacccccaga

SEQ ID NO: 5206246 - DNA, 16 bp, Homo sapiens
agctttgacagttctt

SEQ ID NO: 5206247 - DNA, 21 bp, Homo sapiens
agctttgactggagggtccat

SEQ ID NO: 5206248 - DNA, 19 bp, Homo sapiens
agctttgagaagccttcag

SEQ ID NO: 5206249 - DNA, 15 bp, Homo sapiens
agctttgaggaacat

SEQ ID NO: 5206250 - DNA, 21 bp, Homo sapiens
agctttgaggctctgtcactg

SEQ ID NO: 5206251 - DNA, 14 bp, Homo sapiens
agctttgataatgt

SEQ ID NO: 5206252 - DNA, 19 bp, Homo sapiens
agctttgatttagattgag

SEQ ID NO: 5206253 - DNA, 19 bp, Homo sapiens
agctttgcaaaatgagact

SEQ ID NO: 5206254 - DNA, 20 bp, Homo sapiens
agctttgcaattctttttgg

SEQ ID NO: 5206255 - DNA, 15 bp, Homo sapiens
agctttgcacccctt

SEQ ID NO: 5206256 - DNA, 20 bp, Homo sapiens
agctttgcagccaaggtgct

SEQ ID NO: 5206257 - DNA, 21 bp, Homo sapiens
agctttgcagccaaggtgcta

SEQ ID NO: 5206258 - DNA, 12 bp, Homo sapiens
agctttgcagtg

SEQ ID NO: 5206259 - DNA, 16 bp, Homo sapiens
agctttgccagctgct

SEQ ID NO: 5206260 - DNA, 19 bp, Homo sapiens
agctttgccagctgctgct

SEQ ID NO: 5206261 - DNA, 17 bp, Homo sapiens
agctttgctacaaattt

SEQ ID NO: 5206262 - DNA, 10 bp, Homo sapiens
agctttgctc

SEQ ID NO: 5206263 - DNA, 19 bp, Homo sapiens
agctttgctcatatttccc

SEQ ID NO: 5206264 - DNA, 19 bp, Homo sapiens
agctttgctccgctcccac

SEQ ID NO: 5206265 - DNA, 22 bp, Homo sapiens
agctttgctccgctcccaccgc

SEQ ID NO: 5206266 - DNA, 17 bp, Homo sapiens
agctttgctccttcagt

SEQ ID NO: 5206267 - DNA, 16 bp, Homo sapiens
agctttgctctttaga

SEQ ID NO: 5206268 - DNA, 23 bp, Homo sapiens
agctttgctctttggtagaaaag

SEQ ID NO: 5206269 - DNA, 20 bp, Homo sapiens
agctttggaaagttactgta

SEQ ID NO: 5206270 - DNA, 16 bp, Homo sapiens
agctttggaagcagca

SEQ ID NO: 5206271 - DNA, 18 bp, Homo sapiens
agctttggaagcagcaag

SEQ ID NO: 5206272 - DNA, 13 bp, Homo sapiens
agctttggaatat

SEQ ID NO: 5206273 - DNA, 15 bp, Homo sapiens
agctttggaatattt

SEQ ID NO: 5206274 - DNA, 21 bp, Homo sapiens
agctttggacacacacagctt

SEQ ID NO: 5206275 - DNA, 18 bp, Homo sapiens
agctttggacctaatcca

SEQ ID NO: 5206276 - DNA, 21 bp, Homo sapiens
agctttggacgcacacagctt

SEQ ID NO: 5206277 - DNA, 19 bp, Homo sapiens
agctttgggcagatttgca

SEQ ID NO: 5206278 - DNA, 17 bp, Homo sapiens
agctttgggtcattttt

SEQ ID NO: 5206279 - DNA, 16 bp, Homo sapiens
agctttgggtgaccag

SEQ ID NO: 5206280 - DNA, 16 bp, Homo sapiens
agctttggttatgaaa

SEQ ID NO: 5206281 - DNA, 15 bp, Homo sapiens
agctttgtaattcag

SEQ ID NO: 5206282 - DNA, 15 bp, Homo sapiens
agctttgtatgttta

SEQ ID NO: 5206283 - DNA, 13 bp, Homo sapiens
agctttgtcactt

SEQ ID NO: 5206284 - DNA, 21 bp, Homo sapiens
agctttgtcacttgccacatg

SEQ ID NO: 5206285 - DNA, 16 bp, Homo sapiens
agctttgtcccctgct

SEQ ID NO: 5206286 - DNA, 18 bp, Homo sapiens
agctttgtcccctgcttc

SEQ ID NO: 5206287 - DNA, 15 bp, Homo sapiens
agctttgtcgtattt

SEQ ID NO: 5206288 - DNA, 16 bp, Homo sapiens
agctttgtctccaaag

SEQ ID NO: 5206289 - DNA, 11 bp, Homo sapiens
agctttgtgaa

SEQ ID NO: 5206290 - DNA, 17 bp, Homo sapiens
agctttgtgtttggttt

SEQ ID NO: 5206291 - DNA, 21 bp, Homo sapiens
agctttgtgtttggtttacat

SEQ ID NO: 5206292 - DNA, 23 bp, Homo sapiens
agctttgtgtttggtttacattt

SEQ ID NO: 5206293 - DNA, 15 bp, Homo sapiens
agctttgttctggga

SEQ ID NO: 5206294 - DNA, 16 bp, Homo sapiens
agctttgttgtcctcc

SEQ ID NO: 5206295 - DNA, 19 bp, Homo sapiens
agctttgttgtcctcccag

SEQ ID NO: 5206296 - DNA, 13 bp, Homo sapiens
agctttgtttgtt

SEQ ID NO: 5206297 - DNA, 14 bp, Homo sapiens
agcttttaaaaaat

SEQ ID NO: 5206298 - DNA, 15 bp, Homo sapiens
agcttttaaaaaata

SEQ ID NO: 5206299 - DNA, 16 bp, Homo sapiens
agcttttaaaagattt

SEQ ID NO: 5206300 - DNA, 21 bp, Homo sapiens
agcttttaaaattatttttgg

SEQ ID NO: 5206301 - DNA, 18 bp, Homo sapiens
agcttttaccttaaatgc

SEQ ID NO: 5206302 - DNA, 22 bp, Homo sapiens
agcttttacgtagtaaaagtca

SEQ ID NO: 5206303 - DNA, 16 bp, Homo sapiens
agcttttactccctga

SEQ ID NO: 5206304 - DNA, 15 bp, Homo sapiens
agcttttagcctggc

SEQ ID NO: 5206305 - DNA, 17 bp, Homo sapiens
agcttttagcctggctg

SEQ ID NO: 5206306 - DNA, 20 bp, Homo sapiens
agcttttagtatccacagga

SEQ ID NO: 5206307 - DNA, 13 bp, Homo sapiens
agcttttatggat

SEQ ID NO: 5206308 - DNA, 15 bp, Homo sapiens
agcttttatgtgaaa

SEQ ID NO: 5206309 - DNA, 15 bp, Homo sapiens
agcttttatgtgata

SEQ ID NO: 5206310 - DNA, 22 bp, Homo sapiens
agcttttatgtgatatgtttta

SEQ ID NO: 5206311 - DNA, 19 bp, Homo sapiens
agcttttattgagtaatat

SEQ ID NO: 5206312 - DNA, 21 bp, Homo sapiens
agcttttattgagtaatatta

SEQ ID NO: 5206313 - DNA, 17 bp, Homo sapiens
agcttttattgtataaa

SEQ ID NO: 5206314 - DNA, 14 bp, Homo sapiens
agcttttatttctt

SEQ ID NO: 5206315 - DNA, 12 bp, Homo sapiens
agcttttcaaac

SEQ ID NO: 5206316 - DNA, 23 bp, Homo sapiens
agcttttcattttaatatataat

SEQ ID NO: 5206317 - DNA, 18 bp, Homo sapiens
agcttttcccaaaagccc

SEQ ID NO: 5206318 - DNA, 15 bp, Homo sapiens
agcttttcccttttt

SEQ ID NO: 5206319 - DNA, 14 bp, Homo sapiens
agcttttcctccct

SEQ ID NO: 5206320 - DNA, 18 bp, Homo sapiens
agcttttcctgttaaggc

SEQ ID NO: 5206321 - DNA, 20 bp, Homo sapiens
agcttttcttattccttttt

SEQ ID NO: 5206322 - DNA, 15 bp, Homo sapiens
agcttttcttgccag

SEQ ID NO: 5206323 - DNA, 15 bp, Homo sapiens
agcttttgcatagaa

SEQ ID NO: 5206324 - DNA, 18 bp, Homo sapiens
agcttttgcatagaataa

SEQ ID NO: 5206325 - DNA, 16 bp, Homo sapiens
agcttttgcatttcct

SEQ ID NO: 5206326 - DNA, 18 bp, Homo sapiens
agcttttgccagtattat

SEQ ID NO: 5206327 - DNA, 21 bp, Homo sapiens
agcttttgcctgcaagagaat

SEQ ID NO: 5206328 - DNA, 13 bp, Homo sapiens
agcttttgctcat

SEQ ID NO: 5206329 - DNA, 12 bp, Homo sapiens
agcttttggaag

SEQ ID NO: 5206330 - DNA, 15 bp, Homo sapiens
agcttttggttaata

SEQ ID NO: 5206331 - DNA, 16 bp, Homo sapiens
agcttttgttctagac

SEQ ID NO: 5206332 - DNA, 23 bp, Homo sapiens
agcttttgttctagacttcccca

SEQ ID NO: 5206333 - DNA, 13 bp, Homo sapiens
agcttttgttgtt

SEQ ID NO: 5206334 - DNA, 22 bp, Homo sapiens
agcttttgttttttaaatgact

SEQ ID NO: 5206335 - DNA, 12 bp, Homo sapiens
agctttttaatg

SEQ ID NO: 5206336 - DNA, 16 bp, Homo sapiens
agctttttaatgctgt

SEQ ID NO: 5206337 - DNA, 23 bp, Homo sapiens
agctttttaatgctgtaaaatat

SEQ ID NO: 5206338 - DNA, 21 bp, Homo sapiens
agctttttaattgttgtttct

SEQ ID NO: 5206339 - DNA, 22 bp, Homo sapiens
agctttttaccgttcacttccc

SEQ ID NO: 5206340 - DNA, 16 bp, Homo sapiens
agctttttattccctg

SEQ ID NO: 5206341 - DNA, 18 bp, Homo sapiens
agctttttattccctgcc

SEQ ID NO: 5206342 - DNA, 22 bp, Homo sapiens
agctttttattcctcctgctca

SEQ ID NO: 5206343 - DNA, 23 bp, Homo sapiens
agctttttctgtggaggacagac

SEQ ID NO: 5206344 - DNA, 15 bp, Homo sapiens
agctttttgaaaacc

SEQ ID NO: 5206345 - DNA, 21 bp, Homo sapiens
agctttttgatgtataaaact

SEQ ID NO: 5206346 - DNA, 13 bp, Homo sapiens
agctttttggaat

SEQ ID NO: 5206347 - DNA, 14 bp, Homo sapiens
agctttttggaatc

SEQ ID NO: 5206348 - DNA, 17 bp, Homo sapiens
agctttttgtcttttct

SEQ ID NO: 5206349 - DNA, 17 bp, Homo sapiens
agctttttgtgagaaag

SEQ ID NO: 5206350 - DNA, 19 bp, Homo sapiens
agctttttgtgagaaagag

SEQ ID NO: 5206351 - DNA, 19 bp, Homo sapiens
agctttttgttccctcatt

SEQ ID NO: 5206352 - DNA, 22 bp, Homo sapiens
agctttttgttccctcattctg

SEQ ID NO: 5206353 - DNA, 22 bp, Homo sapiens
agctttttgtttgcatcattta

SEQ ID NO: 5206354 - DNA, 16 bp, Homo sapiens
agcttttttattttaa

SEQ ID NO: 5206355 - DNA, 16 bp, Homo sapiens
agcttttttcctcctt

SEQ ID NO: 5206356 - DNA, 20 bp, Homo sapiens
agcttttttcctcctttctc

SEQ ID NO: 5206357 - DNA, 23 bp, Homo sapiens
agcttttttcctcctttctctgt

SEQ ID NO: 5206358 - DNA, 23 bp, Homo sapiens
agcttttttcctgttggtttcat

SEQ ID NO: 5206359 - DNA, 19 bp, Homo sapiens
agcttttttctctgataca

SEQ ID NO: 5206360 - DNA, 22 bp, Homo sapiens
agcttttttctctgatacagaa

SEQ ID NO: 5206361 - DNA, 14 bp, Homo sapiens
agcttttttcttta

SEQ ID NO: 5206362 - DNA, 13 bp, Homo sapiens
agcttttttgcat

SEQ ID NO: 5206363 - DNA, 21 bp, Homo sapiens
agcttttttttcagccattca

SEQ ID NO: 5206364 - DNA, 19 bp, Homo sapiens
aggaaaaaaaaacagccac

SEQ ID NO: 5206365 - DNA, 13 bp, Homo sapiens
aggaaaaaaaacg

SEQ ID NO: 5206366 - DNA, 18 bp, Homo sapiens
aggaaaaaaaataatgta

SEQ ID NO: 5206367 - DNA, 22 bp, Homo sapiens
aggaaaaaaactgggataactg

SEQ ID NO: 5206368 - DNA, 22 bp, Homo sapiens
aggaaaaaaatcgtccagggag

SEQ ID NO: 5206369 - DNA, 16 bp, Homo sapiens
aggaaaaaaattacaa

SEQ ID NO: 5206370 - DNA, 21 bp, Homo sapiens
aggaaaaaaattacaaagaaa

SEQ ID NO: 5206371 - DNA, 23 bp, Homo sapiens
aggaaaaaaattacaaagaaaat

SEQ ID NO: 5206372 - DNA, 15 bp, Homo sapiens
aggaaaaaagaacca

SEQ ID NO: 5206373 - DNA, 14 bp, Homo sapiens
aggaaaaaaggagg

SEQ ID NO: 5206374 - DNA, 15 bp, Homo sapiens
aggaaaaaaggagga

SEQ ID NO: 5206375 - DNA, 14 bp, Homo sapiens
aggaaaaaatggta

SEQ ID NO: 5206376 - DNA, 15 bp, Homo sapiens
aggaaaaaattgaaa

SEQ ID NO: 5206377 - DNA, 12 bp, Homo sapiens
aggaaaaacaac

SEQ ID NO: 5206378 - DNA, 16 bp, Homo sapiens
aggaaaaacaacaaat

SEQ ID NO: 5206379 - DNA, 18 bp, Homo sapiens
aggaaaaacaacaaataa

SEQ ID NO: 5206380 - DNA, 19 bp, Homo sapiens
aggaaaaacacaagcaaaa

SEQ ID NO: 5206381 - DNA, 23 bp, Homo sapiens
aggaaaaacagggaaaaaaagaa

SEQ ID NO: 5206382 - DNA, 13 bp, Homo sapiens
aggaaaaacaggt

SEQ ID NO: 5206383 - DNA, 16 bp, Homo sapiens
aggaaaaacctgtggg

SEQ ID NO: 5206384 - DNA, 23 bp, Homo sapiens
aggaaaaagaaaaacatttcctc

SEQ ID NO: 5206385 - DNA, 22 bp, Homo sapiens
aggaaaaagcaagttcgtctgt

SEQ ID NO: 5206386 - DNA, 16 bp, Homo sapiens
aggaaaaaggctggtg

SEQ ID NO: 5206387 - DNA, 23 bp, Homo sapiens
aggaaaaaggctggtggacagac

SEQ ID NO: 5206388 - DNA, 13 bp, Homo sapiens
aggaaaaataatc

SEQ ID NO: 5206389 - DNA, 13 bp, Homo sapiens
aggaaaaatatgt

SEQ ID NO: 5206390 - DNA, 15 bp, Homo sapiens
aggaaaaatatgtga

SEQ ID NO: 5206391 - DNA, 17 bp, Homo sapiens
aggaaaaatatgtgaag

SEQ ID NO: 5206392 - DNA, 20 bp, Homo sapiens
aggaaaaatgaggaatccaa

SEQ ID NO: 5206393 - DNA, 21 bp, Homo sapiens
aggaaaaatgggagccaggag

SEQ ID NO: 5206394 - DNA, 14 bp, Homo sapiens
aggccagtcccacg

SEQ ID NO: 5206395 - DNA, 20 bp, Homo sapiens
aggccagtcccacggctctg

SEQ ID NO: 5206396 - DNA, 14 bp, Homo sapiens
aggccagtccccat

SEQ ID NO: 5206397 - DNA, 15 bp, Homo sapiens
aggccagtgagctgt

SEQ ID NO: 5206398 - DNA, 22 bp, Homo sapiens
aggccagtgccaggacagctgg

SEQ ID NO: 5206399 - DNA, 24 bp, Homo sapiens
aggccagtgccaggacagctggct

SEQ ID NO: 5206400 - DNA, 23 bp, Homo sapiens
aggccagtggactctgaggactc

SEQ ID NO: 5206401 - DNA, 19 bp, Homo sapiens
aggccagtggcccccgggc

SEQ ID NO: 5206402 - DNA, 13 bp, Homo sapiens
aggccagtgggcc

SEQ ID NO: 5206403 - DNA, 22 bp, Homo sapiens
aggccagtgggcgggccatgag

SEQ ID NO: 5206404 - DNA, 18 bp, Homo sapiens
aggccagtgttgtgggct

SEQ ID NO: 5206405 - DNA, 20 bp, Homo sapiens
aggccagtgttgtgggcttc

SEQ ID NO: 5206406 - DNA, 22 bp, Homo sapiens
aggccagtgttgtgggcttcct

SEQ ID NO: 5206407 - DNA, 16 bp, Homo sapiens
aggccataaaacaggt

SEQ ID NO: 5206408 - DNA, 18 bp, Homo sapiens
aggccatattttaaaaaa

SEQ ID NO: 5206409 - DNA, 16 bp, Homo sapiens
aggccatcagggccct

SEQ ID NO: 5206410 - DNA, 21 bp, Homo sapiens
aggccatcatcagtggagcca

SEQ ID NO: 5206411 - DNA, 18 bp, Homo sapiens
aggccatctcagcttgct

SEQ ID NO: 5206412 - DNA, 17 bp, Homo sapiens
aggccatctcaggagat

SEQ ID NO: 5206413 - DNA, 11 bp, Homo sapiens
aggccatctgg

SEQ ID NO: 5206414 - DNA, 14 bp, Homo sapiens
aggccatctggaga

SEQ ID NO: 5206415 - DNA, 22 bp, Homo sapiens
aggccatctgggctcctccagg

SEQ ID NO: 5206416 - DNA, 16 bp, Homo sapiens
aggccatctgtaaata

SEQ ID NO: 5206417 - DNA, 17 bp, Homo sapiens
aggccatctgtaaatat

SEQ ID NO: 5206418 - DNA, 18 bp, Homo sapiens
aggccatctgtaaatatc

SEQ ID NO: 5206419 - DNA, 19 bp, Homo sapiens
aggccatgaaaaaaatgat

SEQ ID NO: 5206420 - DNA, 21 bp, Homo sapiens
aggccatgattcgcccaaagc

SEQ ID NO: 5206421 - DNA, 13 bp, Homo sapiens
aggccatggactc

SEQ ID NO: 5206422 - DNA, 16 bp, Homo sapiens
aggccatggaggcagt

SEQ ID NO: 5206423 - DNA, 20 bp, Homo sapiens
aggccatggccaaggggcca

SEQ ID NO: 5206424 - DNA, 23 bp, Homo sapiens
aggccatgggcactgtgggtaga

SEQ ID NO: 5206425 - DNA, 18 bp, Homo sapiens
aggccatgggggcccctc

SEQ ID NO: 5206426 - DNA, 12 bp, Homo sapiens
aggccatgtgaa

SEQ ID NO: 5206427 - DNA, 15 bp, Homo sapiens
aggccatgtggcctg

SEQ ID NO: 5206428 - DNA, 16 bp, Homo sapiens
aggccatgtggcctgc

SEQ ID NO: 5206429 - DNA, 21 bp, Homo sapiens
aggccatgtggcctgcccagc

SEQ ID NO: 5206430 - DNA, 23 bp, Homo sapiens
aggccatgtggcctgcccagcct

SEQ ID NO: 5206431 - DNA, 13 bp, Homo sapiens
aggccattccctg

SEQ ID NO: 5206432 - DNA, 15 bp, Homo sapiens
aggccattctttccc

SEQ ID NO: 5206433 - DNA, 15 bp, Homo sapiens
aggccattgggtttg

SEQ ID NO: 5206434 - DNA, 21 bp, Homo sapiens
aggccattgggtttggggcca

SEQ ID NO: 5206435 - DNA, 23 bp, Homo sapiens
aggccattgggtttggggccatg

SEQ ID NO: 5206436 - DNA, 19 bp, Homo sapiens
aggccatttgctgccctgg

SEQ ID NO: 5206437 - DNA, 23 bp, Homo sapiens
aggccatttgctgccctggggca

SEQ ID NO: 5206438 - DNA, 17 bp, Homo sapiens
aggccatttgttacagt

SEQ ID NO: 5206439 - DNA, 21 bp, Homo sapiens
aggccatttgttacagtttct

SEQ ID NO: 5206440 - DNA, 15 bp, Homo sapiens
aggcccaaaacagtt

SEQ ID NO: 5206441 - DNA, 19 bp, Homo sapiens
aggcccaaagcacttgctt

SEQ ID NO: 5206442 - DNA, 13 bp, Homo sapiens
aggcccaaatgat

SEQ ID NO: 5206443 - DNA, 14 bp, Homo sapiens
aggcccaaatgatg

SEQ ID NO: 5206444 - DNA, 23 bp, Homo sapiens
aggcccaaattatcaagctaata

SEQ ID NO: 5206445 - DNA, 19 bp, Homo sapiens
aggcccaaccaccagatga

SEQ ID NO: 5206446 - DNA, 12 bp, Homo sapiens
aggcccaagaga

SEQ ID NO: 5206447 - DNA, 17 bp, Homo sapiens
aggcccaagagccctgt

SEQ ID NO: 5206448 - DNA, 14 bp, Homo sapiens
aggcccaaggagct

SEQ ID NO: 5206449 - DNA, 17 bp, Homo sapiens
aggcccaaggagggtcc

SEQ ID NO: 5206450 - DNA, 15 bp, Homo sapiens
aggcccaaggctccc

SEQ ID NO: 5206451 - DNA, 17 bp, Homo sapiens
aggcccaaggtcccctc

SEQ ID NO: 5206452 - DNA, 18 bp, Homo sapiens
aggcccaaggtcccctcc

SEQ ID NO: 5206453 - DNA, 19 bp, Homo sapiens
aggcccaaggtcccctcca

SEQ ID NO: 5206454 - DNA, 23 bp, Homo sapiens
aggcccaagtctcctaggggctt

SEQ ID NO: 5206455 - DNA, 22 bp, Homo sapiens
aggcccaatgaggtggctcatg

SEQ ID NO: 5206456 - DNA, 13 bp, Homo sapiens
aggcccaatgctg

SEQ ID NO: 5206457 - DNA, 16 bp, Homo sapiens
aggcccaatgctgctt

SEQ ID NO: 5206458 - DNA, 11 bp, Homo sapiens
aggcccacaca

SEQ ID NO: 5206459 - DNA, 13 bp, Homo sapiens
aggcccaccctgc

SEQ ID NO: 5206460 - DNA, 14 bp, Homo sapiens
aggcccaccctgct

SEQ ID NO: 5206461 - DNA, 14 bp, Homo sapiens
aggcccacgaggag

SEQ ID NO: 5206462 - DNA, 16 bp, Homo sapiens
aggcccacgaggagca

SEQ ID NO: 5206463 - DNA, 22 bp, Homo sapiens
aggcccactagagggcccatca

SEQ ID NO: 5206464 - DNA, 13 bp, Homo sapiens
aggcccactcagg

SEQ ID NO: 5206465 - DNA, 16 bp, Homo sapiens
aggcccactgtgcctc

SEQ ID NO: 5206466 - DNA, 22 bp, Homo sapiens
aggcccagacctggcctctgcc

SEQ ID NO: 5206467 - DNA, 15 bp, Homo sapiens
aggcccagagagctg

SEQ ID NO: 5206468 - DNA, 21 bp, Homo sapiens
aggcccagagaggaaggtggc

SEQ ID NO: 5206469 - DNA, 19 bp, Homo sapiens
aggcccagagggcctgcaa

SEQ ID NO: 5206470 - DNA, 21 bp, Homo sapiens
aggcccagagggcctgcaagg

SEQ ID NO: 5206471 - DNA, 16 bp, Homo sapiens
aggcccagcagagccg

SEQ ID NO: 5206472 - DNA, 13 bp, Homo sapiens
aggcccagcatgc

SEQ ID NO: 5206473 - DNA, 19 bp, Homo sapiens
aggcccagcatgcaggtgg

SEQ ID NO: 5206474 - DNA, 22 bp, Homo sapiens
aggcccagcattgctggttcta

SEQ ID NO: 5206475 - DNA, 12 bp, Homo sapiens
aggcccagccag

SEQ ID NO: 5206476 - DNA, 13 bp, Homo sapiens
aggcccagccctc

SEQ ID NO: 5206477 - DNA, 14 bp, Homo sapiens
aggcccagccctcc

SEQ ID NO: 5206478 - DNA, 16 bp, Homo sapiens
aggcccagccctcctt

SEQ ID NO: 5206479 - DNA, 14 bp, Homo sapiens
aggcccagccctgg

SEQ ID NO: 5206480 - DNA, 17 bp, Homo sapiens
aggcccagccctgggca

SEQ ID NO: 5206481 - DNA, 18 bp, Homo sapiens
aggcccagccgaccccct

SEQ ID NO: 5206482 - DNA, 20 bp, Homo sapiens
aggcccagccgaccccctct

SEQ ID NO: 5206483 - DNA, 16 bp, Homo sapiens
aggcccagccgcagga

SEQ ID NO: 5206484 - DNA, 13 bp, Homo sapiens
aggcccagcctct

SEQ ID NO: 5206485 - DNA, 17 bp, Homo sapiens
aggcccagcctctctgg

SEQ ID NO: 5206486 - DNA, 19 bp, Homo sapiens
aggcccagcctctctggct

SEQ ID NO: 5206487 - DNA, 16 bp, Homo sapiens
aggcccagcctctgcc

SEQ ID NO: 5206488 - DNA, 17 bp, Homo sapiens
aggcccagcctctgccc

SEQ ID NO: 5206489 - DNA, 14 bp, Homo sapiens
aggcccagcctctt

SEQ ID NO: 5206490 - DNA, 17 bp, Homo sapiens
aggcccagcctggcccc

SEQ ID NO: 5206491 - DNA, 15 bp, Homo sapiens
aggcccagcgcggcc

SEQ ID NO: 5206492 - DNA, 18 bp, Homo sapiens
aggcccagcgcggccagc

SEQ ID NO: 5206493 - DNA, 19 bp, Homo sapiens
aggcccagcgcggccagcg

SEQ ID NO: 5206494 - DNA, 16 bp, Homo sapiens
aggcccagcgggcaga

SEQ ID NO: 5206495 - DNA, 12 bp, Homo sapiens
aggcccagctgc

SEQ ID NO: 5206496 - DNA, 14 bp, Homo sapiens
aggcccagctgcca

SEQ ID NO: 5206497 - DNA, 15 bp, Homo sapiens
aggcccagctgctcc

SEQ ID NO: 5206498 - DNA, 23 bp, Homo sapiens
aggcccaggaatcggagcgaagc

SEQ ID NO: 5206499 - DNA, 11 bp, Homo sapiens
aggcccaggag

SEQ ID NO: 5206500 - DNA, 20 bp, Homo sapiens
aggcccaggagacctccagc

SEQ ID NO: 5206501 - DNA, 13 bp, Homo sapiens
aggcccaggagtc

SEQ ID NO: 5206502 - DNA, 16 bp, Homo sapiens
aggcccaggagtccag

SEQ ID NO: 5206503 - DNA, 17 bp, Homo sapiens
aggcccaggagtccagg

SEQ ID NO: 5206504 - DNA, 15 bp, Homo sapiens
aggcccaggcaccac

SEQ ID NO: 5206505 - DNA, 18 bp, Homo sapiens
aggcccaggcaccaccag

SEQ ID NO: 5206506 - DNA, 21 bp, Homo sapiens
aggcccaggcaccaccaggag

SEQ ID NO: 5206507 - DNA, 14 bp, Homo sapiens
aggcccaggcagag

SEQ ID NO: 5206508 - DNA, 15 bp, Homo sapiens
aggcccaggcagagc

SEQ ID NO: 5206509 - DNA, 14 bp, Homo sapiens
aggcccaggccagc

SEQ ID NO: 5206510 - DNA, 16 bp, Homo sapiens
aggcccaggccagccc

SEQ ID NO: 5206511 - DNA, 21 bp, Homo sapiens
aggcccaggccagccccccca

SEQ ID NO: 5206512 - DNA, 17 bp, Homo sapiens
aggcccaggcctcacca

SEQ ID NO: 5206513 - DNA, 13 bp, Homo sapiens
aggcccaggctgc

SEQ ID NO: 5206514 - DNA, 16 bp, Homo sapiens
aggcccaggctgggaa

SEQ ID NO: 5206515 - DNA, 15 bp, Homo sapiens
aggcccagggagcaa

SEQ ID NO: 5206516 - DNA, 20 bp, Homo sapiens
aggcccagggagcaatggga

SEQ ID NO: 5206517 - DNA, 21 bp, Homo sapiens
aggcccagggagcaatgggag

SEQ ID NO: 5206518 - DNA, 16 bp, Homo sapiens
aggcccagggaggcag

SEQ ID NO: 5206519 - DNA, 17 bp, Homo sapiens
aggcccagggaggcagc

SEQ ID NO: 5206520 - DNA, 20 bp, Homo sapiens
aggcccagggaggcagcgtg

SEQ ID NO: 5206521 - DNA, 13 bp, Homo sapiens
aggcccagtgaga

SEQ ID NO: 5206522 - DNA, 21 bp, Homo sapiens
aggcccatctcaggtgccact

SEQ ID NO: 5206523 - DNA, 16 bp, Homo sapiens
aggcccatgccaaggc

SEQ ID NO: 5206524 - DNA, 20 bp, Homo sapiens
aggcccatgccaaggcctcc

SEQ ID NO: 5206525 - DNA, 13 bp, Homo sapiens
aggcccatgcccc

SEQ ID NO: 5206526 - DNA, 18 bp, Homo sapiens
aggcccatgggaggctgg

SEQ ID NO: 5206527 - DNA, 23 bp, Homo sapiens
aggcccattgtcctccttttcac

SEQ ID NO: 5206528 - DNA, 19 bp, Homo sapiens
aggcccatttgagaagctg

SEQ ID NO: 5206529 - DNA, 21 bp, Homo sapiens
aggccccaaaggaaaaagcac

SEQ ID NO: 5206530 - DNA, 21 bp, Homo sapiens
aggccccaaggggtttctgtt

SEQ ID NO: 5206531 - DNA, 16 bp, Homo sapiens
aggccccaatacccca

SEQ ID NO: 5206532 - DNA, 22 bp, Homo sapiens
aggccccaatcttgcccactgg

SEQ ID NO: 5206533 - DNA, 23 bp, Homo sapiens
aggccccaatcttgcccactggc

SEQ ID NO: 5206534 - DNA, 20 bp, Homo sapiens
aggccccacaaggcctggtc

SEQ ID NO: 5206535 - DNA, 21 bp, Homo sapiens
aggccccaccaagagggtgga

SEQ ID NO: 5206536 - DNA, 12 bp, Homo sapiens
aggccccacccc

SEQ ID NO: 5206537 - DNA, 13 bp, Homo sapiens
aggccccacccct

SEQ ID NO: 5206538 - DNA, 17 bp, Homo sapiens
aggccccaccggccagg

SEQ ID NO: 5206539 - DNA, 13 bp, Homo sapiens
aggccccacctga

SEQ ID NO: 5206540 - DNA, 14 bp, Homo sapiens
aggccccactgatg

SEQ ID NO: 5206541 - DNA, 13 bp, Homo sapiens
aggccccagacag

SEQ ID NO: 5206542 - DNA, 14 bp, Homo sapiens
aggccccagagact

SEQ ID NO: 5206543 - DNA, 22 bp, Homo sapiens
aggccccagagactcagaggga

SEQ ID NO: 5206544 - DNA, 16 bp, Homo sapiens
aggccccagaggccct

SEQ ID NO: 5206545 - DNA, 18 bp, Homo sapiens
aggccccagaggccctgg

SEQ ID NO: 5206546 - DNA, 19 bp, Homo sapiens
aggccccagaggccctgga

SEQ ID NO: 5206547 - DNA, 20 bp, Homo sapiens
aggccccagaggccctggag

SEQ ID NO: 5206548 - DNA, 21 bp, Homo sapiens
aggccccagcaacacgtcatt

SEQ ID NO: 5206549 - DNA, 12 bp, Homo sapiens
aggccccagcct

SEQ ID NO: 5206550 - DNA, 13 bp, Homo sapiens
aggccccagcctc

SEQ ID NO: 5206551 - DNA, 18 bp, Homo sapiens
aggccccagcctccaggc

SEQ ID NO: 5206552 - DNA, 13 bp, Homo sapiens
aggccccagctct

SEQ ID NO: 5206553 - DNA, 14 bp, Homo sapiens
aggccccaggccct

SEQ ID NO: 5206554 - DNA, 13 bp, Homo sapiens
aggccccaggctg

SEQ ID NO: 5206555 - DNA, 15 bp, Homo sapiens
aggccccaggctgga

SEQ ID NO: 5206556 - DNA, 20 bp, Homo sapiens
aggccccaggctggatgctg

SEQ ID NO: 5206557 - DNA, 21 bp, Homo sapiens
aggccccagggacagaggcca

SEQ ID NO: 5206558 - DNA, 17 bp, Homo sapiens
aggccccagggctgtgg

SEQ ID NO: 5206559 - DNA, 13 bp, Homo sapiens
aggccccatggag

SEQ ID NO: 5206560 - DNA, 19 bp, Homo sapiens
aggcccccaacccctcctc

SEQ ID NO: 5206561 - DNA, 21 bp, Homo sapiens
aggcccccaacccctcctccc

SEQ ID NO: 5206562 - DNA, 13 bp, Homo sapiens
aggcccccaagcc

SEQ ID NO: 5206563 - DNA, 13 bp, Homo sapiens
aggcccccaccac

SEQ ID NO: 5206564 - DNA, 17 bp, Homo sapiens
aggcccccaccacacat

SEQ ID NO: 5206565 - DNA, 21 bp, Homo sapiens
aggcccccaccacacatccca

SEQ ID NO: 5206566 - DNA, 18 bp, Homo sapiens
aggcccccacctggctca

SEQ ID NO: 5206567 - DNA, 14 bp, Homo sapiens
aggcccccacttct

SEQ ID NO: 5206568 - DNA, 12 bp, Homo sapiens
aggcccccagcc

SEQ ID NO: 5206569 - DNA, 22 bp, Homo sapiens
aggcccccagtgatctcgactc

SEQ ID NO: 5206570 - DNA, 14 bp, Homo sapiens
aggcccccagtggg

SEQ ID NO: 5206571 - DNA, 21 bp, Homo sapiens
aggccccccagaaagctgcca

SEQ ID NO: 5206572 - DNA, 18 bp, Homo sapiens
aggcccccccagaagcaa

SEQ ID NO: 5206573 - DNA, 19 bp, Homo sapiens
aggcccccccagaagcaag

SEQ ID NO: 5206574 - DNA, 15 bp, Homo sapiens
aggaaaaatgtgtaa

SEQ ID NO: 5206575 - DNA, 12 bp, Homo sapiens
aggaaaaattca

SEQ ID NO: 5206576 - DNA, 13 bp, Homo sapiens
aggaaaacaaaaa

SEQ ID NO: 5206577 - DNA, 16 bp, Homo sapiens
aggaaaacacagcctc

SEQ ID NO: 5206578 - DNA, 21 bp, Homo sapiens
aggaaaacacagcctccctga

SEQ ID NO: 5206579 - DNA, 16 bp, Homo sapiens
aggaaaacacctttat

SEQ ID NO: 5206580 - DNA, 12 bp, Homo sapiens
aggaaaacagta

SEQ ID NO: 5206581 - DNA, 20 bp, Homo sapiens
aggaaaaccaagccgtggct

SEQ ID NO: 5206582 - DNA, 18 bp, Homo sapiens
aggaaaaccagggatagc

SEQ ID NO: 5206583 - DNA, 16 bp, Homo sapiens
aggaaaacctgcagag

SEQ ID NO: 5206584 - DNA, 13 bp, Homo sapiens
aggaaaactacct

SEQ ID NO: 5206585 - DNA, 18 bp, Homo sapiens
aggaaaactcaccatttc

SEQ ID NO: 5206586 - DNA, 19 bp, Homo sapiens
aggaaaactcaccatttca

SEQ ID NO: 5206587 - DNA, 20 bp, Homo sapiens
aggaaaactcaccatttcat

SEQ ID NO: 5206588 - DNA, 11 bp, Homo sapiens
aggaaaactgc

SEQ ID NO: 5206589 - DNA, 14 bp, Homo sapiens
aggaaaactgcatg

SEQ ID NO: 5206590 - DNA, 12 bp, Homo sapiens
aggaaaactgcc

SEQ ID NO: 5206591 - DNA, 14 bp, Homo sapiens
aggaaaagaaacct

SEQ ID NO: 5206592 - DNA, 12 bp, Homo sapiens
aggaaaagaaat

SEQ ID NO: 5206593 - DNA, 15 bp, Homo sapiens
aggaaaagagggaga

SEQ ID NO: 5206594 - DNA, 13 bp, Homo sapiens
aggaaaagagtaa

SEQ ID NO: 5206595 - DNA, 12 bp, Homo sapiens
aggaaaagcaag

SEQ ID NO: 5206596 - DNA, 13 bp, Homo sapiens
aggaaaagcacaa

SEQ ID NO: 5206597 - DNA, 12 bp, Homo sapiens
aggaaaagcatc

SEQ ID NO: 5206598 - DNA, 17 bp, Homo sapiens
aggaaaagcctctgtgt

SEQ ID NO: 5206599 - DNA, 16 bp, Homo sapiens
aggaaaagctgcctct

SEQ ID NO: 5206600 - DNA, 14 bp, Homo sapiens
aggaaaaggaggag

SEQ ID NO: 5206601 - DNA, 15 bp, Homo sapiens
aggaaaaggaggagg

SEQ ID NO: 5206602 - DNA, 13 bp, Homo sapiens
aggaaaaggctgg

SEQ ID NO: 5206603 - DNA, 14 bp, Homo sapiens
aggaaaaggctggc

SEQ ID NO: 5206604 - DNA, 15 bp, Homo sapiens
aggaaaaggctggca

SEQ ID NO: 5206605 - DNA, 16 bp, Homo sapiens
aggaaaaggctggcaa

SEQ ID NO: 5206606 - DNA, 21 bp, Homo sapiens
aggaaaaggcttgagtctgga

SEQ ID NO: 5206607 - DNA, 16 bp, Homo sapiens
aggaaaagggagctat

SEQ ID NO: 5206608 - DNA, 17 bp, Homo sapiens
aggaaaagtaagggaat

SEQ ID NO: 5206609 - DNA, 15 bp, Homo sapiens
aggaaaagttaaact

SEQ ID NO: 5206610 - DNA, 14 bp, Homo sapiens
aggaaaataagaat

SEQ ID NO: 5206611 - DNA, 14 bp, Homo sapiens
aggaaaataatgta

SEQ ID NO: 5206612 - DNA, 13 bp, Homo sapiens
aggaaaatacatt

SEQ ID NO: 5206613 - DNA, 16 bp, Homo sapiens
aggaaaatagtaatgt

SEQ ID NO: 5206614 - DNA, 16 bp, Homo sapiens
aggaaaatatttcatt

SEQ ID NO: 5206615 - DNA, 13 bp, Homo sapiens
aggaaaatatttt

SEQ ID NO: 5206616 - DNA, 15 bp, Homo sapiens
aggaaaatattttga

SEQ ID NO: 5206617 - DNA, 22 bp, Homo sapiens
aggaaaatattttgatcttcaa

SEQ ID NO: 5206618 - DNA, 15 bp, Homo sapiens
aggaaaatctgtgat

SEQ ID NO: 5206619 - DNA, 14 bp, Homo sapiens
aggaaaatgaataa

SEQ ID NO: 5206620 - DNA, 17 bp, Homo sapiens
aggaaaatgacttgtaa

SEQ ID NO: 5206621 - DNA, 21 bp, Homo sapiens
aggaaaatgagaggagaacag

SEQ ID NO: 5206622 - DNA, 15 bp, Homo sapiens
aggaaaatgatctga

SEQ ID NO: 5206623 - DNA, 21 bp, Homo sapiens
aggaaaatgtatccagaggaa

SEQ ID NO: 5206624 - DNA, 22 bp, Homo sapiens
aggaaaatgtatccagaggaat

SEQ ID NO: 5206625 - DNA, 20 bp, Homo sapiens
aggaaaatgtattgattcaa

SEQ ID NO: 5206626 - DNA, 19 bp, Homo sapiens
aggaaaatgtgaggggaat

SEQ ID NO: 5206627 - DNA, 15 bp, Homo sapiens
aggaaaattaaacca

SEQ ID NO: 5206628 - DNA, 23 bp, Homo sapiens
aggaaaattagaagcaagctgga

SEQ ID NO: 5206629 - DNA, 21 bp, Homo sapiens
aggaaaattattctataattt

SEQ ID NO: 5206630 - DNA, 19 bp, Homo sapiens
aggaaaattccattagaga

SEQ ID NO: 5206631 - DNA, 13 bp, Homo sapiens
aggaaaattgaaa

SEQ ID NO: 5206632 - DNA, 19 bp, Homo sapiens
aggaaacaaaccttgcctt

SEQ ID NO: 5206633 - DNA, 17 bp, Homo sapiens
aggaaacaacaaaggaa

SEQ ID NO: 5206634 - DNA, 21 bp, Homo sapiens
aggaaacaacaaaggaagtga

SEQ ID NO: 5206635 - DNA, 14 bp, Homo sapiens
aggaaacaacagct

SEQ ID NO: 5206636 - DNA, 15 bp, Homo sapiens
aggaaacaacagctt

SEQ ID NO: 5206637 - DNA, 13 bp, Homo sapiens
aggaaacaagctt

SEQ ID NO: 5206638 - DNA, 18 bp, Homo sapiens
aggaaacaagggaagggg

SEQ ID NO: 5206639 - DNA, 14 bp, Homo sapiens
aggaaacaagtgaa

SEQ ID NO: 5206640 - DNA, 17 bp, Homo sapiens
aggaaacaatatttata

SEQ ID NO: 5206641 - DNA, 21 bp, Homo sapiens
aggaaacacgtttagaaatga

SEQ ID NO: 5206642 - DNA, 15 bp, Homo sapiens
aggaaacagaaaaga

SEQ ID NO: 5206643 - DNA, 20 bp, Homo sapiens
aggaaacagaaaagagaaga

SEQ ID NO: 5206644 - DNA, 22 bp, Homo sapiens
aggaaacagaaaagagaagaaa

SEQ ID NO: 5206645 - DNA, 15 bp, Homo sapiens
aggaaacaggctcca

SEQ ID NO: 5206646 - DNA, 19 bp, Homo sapiens
aggaaacagttctcactgg

SEQ ID NO: 5206647 - DNA, 20 bp, Homo sapiens
aggaaacagttgcatgtagt

SEQ ID NO: 5206648 - DNA, 19 bp, Homo sapiens
aggaaacatagaaagacat

SEQ ID NO: 5206649 - DNA, 13 bp, Homo sapiens
aggaaacatttta

SEQ ID NO: 5206650 - DNA, 18 bp, Homo sapiens
aggaaacattttatcatt

SEQ ID NO: 5206651 - DNA, 12 bp, Homo sapiens
aggaaaccacaa

SEQ ID NO: 5206652 - DNA, 16 bp, Homo sapiens
aggaaaccacagctgc

SEQ ID NO: 5206653 - DNA, 17 bp, Homo sapiens
aggaaaccaccctgagg

SEQ ID NO: 5206654 - DNA, 22 bp, Homo sapiens
aggaaacccaaggaacaagaga

SEQ ID NO: 5206655 - DNA, 17 bp, Homo sapiens
aggaaacccagctctgg

SEQ ID NO: 5206656 - DNA, 18 bp, Homo sapiens
aggaaacccagctctggt

SEQ ID NO: 5206657 - DNA, 20 bp, Homo sapiens
aggaaacccagctctggtcc

SEQ ID NO: 5206658 - DNA, 20 bp, Homo sapiens
aggaaaccccccaatgtctg

SEQ ID NO: 5206659 - DNA, 22 bp, Homo sapiens
aggaaaccgacgaaaaagtcac

SEQ ID NO: 5206660 - DNA, 16 bp, Homo sapiens
aggaaaccttttcttg

SEQ ID NO: 5206661 - DNA, 16 bp, Homo sapiens
aggaaacgctacctct

SEQ ID NO: 5206662 - DNA, 17 bp, Homo sapiens
aggaaactcacctgctg

SEQ ID NO: 5206663 - DNA, 20 bp, Homo sapiens
aggaaactcacctgctggcc

SEQ ID NO: 5206664 - DNA, 21 bp, Homo sapiens
aggaaactcacctgctggccc

SEQ ID NO: 5206665 - DNA, 18 bp, Homo sapiens
aggaaactcttatctcag

SEQ ID NO: 5206666 - DNA, 18 bp, Homo sapiens
aggaaactgaggcccaga

SEQ ID NO: 5206667 - DNA, 14 bp, Homo sapiens
aggaaactgagtca

SEQ ID NO: 5206668 - DNA, 19 bp, Homo sapiens
aggaaactgggttcctgca

SEQ ID NO: 5206669 - DNA, 14 bp, Homo sapiens
aggaaactttgaac

SEQ ID NO: 5206670 - DNA, 19 bp, Homo sapiens
aggaaactttttaattgtg

SEQ ID NO: 5206671 - DNA, 13 bp, Homo sapiens
aggaaagaaaaca

SEQ ID NO: 5206672 - DNA, 18 bp, Homo sapiens
aggaaagaaaactaacaa

SEQ ID NO: 5206673 - DNA, 13 bp, Homo sapiens
aggaaagaaaata

SEQ ID NO: 5206674 - DNA, 17 bp, Homo sapiens
aggaaagaaagaaggaa

SEQ ID NO: 5206675 - DNA, 16 bp, Homo sapiens
aggaaagaagcatttc

SEQ ID NO: 5206676 - DNA, 11 bp, Homo sapiens
aggaaagaagg

SEQ ID NO: 5206677 - DNA, 18 bp, Homo sapiens
aggaaagaagggggccct

SEQ ID NO: 5206678 - DNA, 23 bp, Homo sapiens
aggaaagaagggggccctgctac

SEQ ID NO: 5206679 - DNA, 20 bp, Homo sapiens
aggaaagaatgaaagagtaa

SEQ ID NO: 5206680 - DNA, 14 bp, Homo sapiens
aggaaagacacaga

SEQ ID NO: 5206681 - DNA, 13 bp, Homo sapiens
aggaaagagaact

SEQ ID NO: 5206682 - DNA, 19 bp, Homo sapiens
aggaaagagaacttccaga

SEQ ID NO: 5206683 - DNA, 12 bp, Homo sapiens
aggaaagagagc

SEQ ID NO: 5206684 - DNA, 12 bp, Homo sapiens
aggaaagagagt

SEQ ID NO: 5206685 - DNA, 13 bp, Homo sapiens
aggaaagagagtt

SEQ ID NO: 5206686 - DNA, 18 bp, Homo sapiens
aggaaagagagtttgtaa

SEQ ID NO: 5206687 - DNA, 19 bp, Homo sapiens
aggaaagagctaggaaccc

SEQ ID NO: 5206688 - DNA, 13 bp, Homo sapiens
aggaaagaggctc

SEQ ID NO: 5206689 - DNA, 16 bp, Homo sapiens
aggaaagatcccaagt

SEQ ID NO: 5206690 - DNA, 20 bp, Homo sapiens
aggaaagatcccaagtcaaa

SEQ ID NO: 5206691 - DNA, 21 bp, Homo sapiens
aggaaagatgatgctcagttt

SEQ ID NO: 5206692 - DNA, 13 bp, Homo sapiens
aggaaagatgtcc

SEQ ID NO: 5206693 - DNA, 21 bp, Homo sapiens
aggaaagatgtcccacaggga

SEQ ID NO: 5206694 - DNA, 22 bp, Homo sapiens
aggaaagatgtcccacagggac

SEQ ID NO: 5206695 - DNA, 23 bp, Homo sapiens
aggaaagcaaatcagtttggttg

SEQ ID NO: 5206696 - DNA, 16 bp, Homo sapiens
aggaaagcagtgcagt

SEQ ID NO: 5206697 - DNA, 12 bp, Homo sapiens
aggaaagccaca

SEQ ID NO: 5206698 - DNA, 13 bp, Homo sapiens
aggaaagccacat

SEQ ID NO: 5206699 - DNA, 19 bp, Homo sapiens
aggaaagccccagcactaa

SEQ ID NO: 5206700 - DNA, 23 bp, Homo sapiens
aggaaagccctcccccttcccct

SEQ ID NO: 5206701 - DNA, 21 bp, Homo sapiens
aggaaagcttgagtaaaataa

SEQ ID NO: 5206702 - DNA, 10 bp, Homo sapiens
aggaaaggag

SEQ ID NO: 5206703 - DNA, 20 bp, Homo sapiens
aggaaaggagagtactttgg

SEQ ID NO: 5206704 - DNA, 12 bp, Homo sapiens
aggaaaggagga

SEQ ID NO: 5206705 - DNA, 15 bp, Homo sapiens
aggaaaggccagctg

SEQ ID NO: 5206706 - DNA, 17 bp, Homo sapiens
aggaaaggctcatttaa

SEQ ID NO: 5206707 - DNA, 18 bp, Homo sapiens
aggaaaggctcatttaaa

SEQ ID NO: 5206708 - DNA, 16 bp, Homo sapiens
aggaaaggctccagga

SEQ ID NO: 5206709 - DNA, 22 bp, Homo sapiens
aggaaaggctccaggagcagcc

SEQ ID NO: 5206710 - DNA, 23 bp, Homo sapiens
aggaaaggctccaggagcagcca

SEQ ID NO: 5206711 - DNA, 16 bp, Homo sapiens
aggaaaggcttggctg

SEQ ID NO: 5206712 - DNA, 13 bp, Homo sapiens
aggaaagggaaga

SEQ ID NO: 5206713 - DNA, 14 bp, Homo sapiens
aggaaagggaagcc

SEQ ID NO: 5206714 - DNA, 15 bp, Homo sapiens
aggaaagggaagcct

SEQ ID NO: 5206715 - DNA, 13 bp, Homo sapiens
aggaaagggcctg

SEQ ID NO: 5206716 - DNA, 15 bp, Homo sapiens
aggaaagggcctggc

SEQ ID NO: 5206717 - DNA, 22 bp, Homo sapiens
aggaaagggcctggccagtcct

SEQ ID NO: 5206718 - DNA, 18 bp, Homo sapiens
aggaaaggggagaaggga

SEQ ID NO: 5206719 - DNA, 21 bp, Homo sapiens
aggaaaggtgacttcctctgg

SEQ ID NO: 5206720 - DNA, 18 bp, Homo sapiens
aggaaagtcaagaagaat

SEQ ID NO: 5206721 - DNA, 16 bp, Homo sapiens
aggaaagtggatgcca

SEQ ID NO: 5206722 - DNA, 17 bp, Homo sapiens
aggaaagttcagagttt

SEQ ID NO: 5206723 - DNA, 22 bp, Homo sapiens
aggaaagttcagagttttctgg

SEQ ID NO: 5206724 - DNA, 22 bp, Homo sapiens
aggaaagttctattatctgggt

SEQ ID NO: 5206725 - DNA, 15 bp, Homo sapiens
aggaaagtttcttca

SEQ ID NO: 5206726 - DNA, 22 bp, Homo sapiens
aggaaataaaacctttcaaatt

SEQ ID NO: 5206727 - DNA, 12 bp, Homo sapiens
aggaaataaagg

SEQ ID NO: 5206728 - DNA, 21 bp, Homo sapiens
aggaaataaagggataaagaa

SEQ ID NO: 5206729 - DNA, 14 bp, Homo sapiens
aggaaataaaggta

SEQ ID NO: 5206730 - DNA, 20 bp, Homo sapiens
aggaaataaaggtaaaatca

SEQ ID NO: 5206731 - DNA, 23 bp, Homo sapiens
aggaaataaaggtaaaatcactt

SEQ ID NO: 5206732 - DNA, 17 bp, Homo sapiens
aggaaataacagagaga

SEQ ID NO: 5206733 - DNA, 17 bp, Homo sapiens
aggaaataccaactgaa

SEQ ID NO: 5206734 - DNA, 19 bp, Homo sapiens
aggaaataccaactgaagt

SEQ ID NO: 5206735 - DNA, 14 bp, Homo sapiens
aggaaatagtgttc

SEQ ID NO: 5206736 - DNA, 23 bp, Homo sapiens
aggaaatagtgttctttttaaaa

SEQ ID NO: 5206737 - DNA, 12 bp, Homo sapiens
aggaaatatcat

SEQ ID NO: 5206738 - DNA, 15 bp, Homo sapiens
aggaaatatcatcgt

SEQ ID NO: 5206739 - DNA, 16 bp, Homo sapiens
aggaaatatctgtgaa

SEQ ID NO: 5206740 - DNA, 21 bp, Homo sapiens
aggaaatatctgtgaaggact

SEQ ID NO: 5206741 - DNA, 22 bp, Homo sapiens
aggaaatatctgtgaaggactt

SEQ ID NO: 5206742 - DNA, 22 bp, Homo sapiens
aggaaatattgagagagaagtc

SEQ ID NO: 5206743 - DNA, 13 bp, Homo sapiens
aggaaatatttca

SEQ ID NO: 5206744 - DNA, 19 bp, Homo sapiens
aggaaatcaaatatgcaaa

SEQ ID NO: 5206745 - DNA, 21 bp, Homo sapiens
aggaaatcaaatatgcaaagc

SEQ ID NO: 5206746 - DNA, 13 bp, Homo sapiens
aggaaatcaaatg

SEQ ID NO: 5206747 - DNA, 21 bp, Homo sapiens
aggaaatcaacttgcttatca

SEQ ID NO: 5206748 - DNA, 19 bp, Homo sapiens
aggaaatcaccgaaaacgt

SEQ ID NO: 5206749 - DNA, 16 bp, Homo sapiens
aggaaatcagagctgg

SEQ ID NO: 5206750 - DNA, 19 bp, Homo sapiens
aggaaatccaaaaaagcaa

SEQ ID NO: 5206751 - DNA, 15 bp, Homo sapiens
aggaaatccagggtg

SEQ ID NO: 5206752 - DNA, 18 bp, Homo sapiens
aggaaatcccttcatact

SEQ ID NO: 5206753 - DNA, 16 bp, Homo sapiens
aggaaatctcacccca

SEQ ID NO: 5206754 - DNA, 15 bp, Homo sapiens
aggaaatctcctctt

SEQ ID NO: 5206755 - DNA, 14 bp, Homo sapiens
aggccccccgcagc

SEQ ID NO: 5206756 - DNA, 17 bp, Homo sapiens
aggccccccgcagcacc

SEQ ID NO: 5206757 - DNA, 19 bp, Homo sapiens
aggcccccctctgcctttg

SEQ ID NO: 5206758 - DNA, 20 bp, Homo sapiens
aggcccccctctgcctttga

SEQ ID NO: 5206759 - DNA, 21 bp, Homo sapiens
aggcccccctctgcctttgag

SEQ ID NO: 5206760 - DNA, 23 bp, Homo sapiens
aggcccccgcacgcaagcctcag

SEQ ID NO: 5206761 - DNA, 16 bp, Homo sapiens
aggcccccgctggctc

SEQ ID NO: 5206762 - DNA, 13 bp, Homo sapiens
aggcccccggagg

SEQ ID NO: 5206763 - DNA, 21 bp, Homo sapiens
aggcccccggaggcgcccacc

SEQ ID NO: 5206764 - DNA, 21 bp, Homo sapiens
aggcccccggctttcctccgg

SEQ ID NO: 5206765 - DNA, 23 bp, Homo sapiens
aggcccccgggtgtgaagcacag

SEQ ID NO: 5206766 - DNA, 18 bp, Homo sapiens
aggcccccgttgaagccg

SEQ ID NO: 5206767 - DNA, 21 bp, Homo sapiens
aggcccccgttgaagccgctc

SEQ ID NO: 5206768 - DNA, 15 bp, Homo sapiens
aggccccctgcctgc

SEQ ID NO: 5206769 - DNA, 14 bp, Homo sapiens
aggccccctttcta

SEQ ID NO: 5206770 - DNA, 20 bp, Homo sapiens
aggccccgaggacccagacc

SEQ ID NO: 5206771 - DNA, 21 bp, Homo sapiens
aggccccgaggacccagaccc

SEQ ID NO: 5206772 - DNA, 22 bp, Homo sapiens
aggccccgaggctcgagctcgg

SEQ ID NO: 5206773 - DNA, 22 bp, Homo sapiens
aggccccgatggactcctgacc

SEQ ID NO: 5206774 - DNA, 14 bp, Homo sapiens
aggccccgcccagg

SEQ ID NO: 5206775 - DNA, 16 bp, Homo sapiens
aggccccgcccaggct

SEQ ID NO: 5206776 - DNA, 20 bp, Homo sapiens
aggccccgcttgtccagcgc

SEQ ID NO: 5206777 - DNA, 17 bp, Homo sapiens
aggccccgtggtgacat

SEQ ID NO: 5206778 - DNA, 22 bp, Homo sapiens
aggccccgtggtgacatttccc

SEQ ID NO: 5206779 - DNA, 20 bp, Homo sapiens
aggcccctaggtgcccaggg

SEQ ID NO: 5206780 - DNA, 13 bp, Homo sapiens
aggcccctcccag

SEQ ID NO: 5206781 - DNA, 11 bp, Homo sapiens
aggcccctctc

SEQ ID NO: 5206782 - DNA, 13 bp, Homo sapiens
aggcccctctcct

SEQ ID NO: 5206783 - DNA, 14 bp, Homo sapiens
aggcccctctcctc

SEQ ID NO: 5206784 - DNA, 21 bp, Homo sapiens
aggcccctctgtggagcgccc

SEQ ID NO: 5206785 - DNA, 16 bp, Homo sapiens
aggcccctgaggactg

SEQ ID NO: 5206786 - DNA, 21 bp, Homo sapiens
aggcccctgaggactggagac

SEQ ID NO: 5206787 - DNA, 17 bp, Homo sapiens
aggcccctgaggcagcc

SEQ ID NO: 5206788 - DNA, 12 bp, Homo sapiens
aggcccctgcaa

SEQ ID NO: 5206789 - DNA, 12 bp, Homo sapiens
aggcccctgcca

SEQ ID NO: 5206790 - DNA, 17 bp, Homo sapiens
aggcccctgccaccctg

SEQ ID NO: 5206791 - DNA, 17 bp, Homo sapiens
aggcccctggacaagca

SEQ ID NO: 5206792 - DNA, 16 bp, Homo sapiens
aggcccctggagccag

SEQ ID NO: 5206793 - DNA, 12 bp, Homo sapiens
aggcccctggcc

SEQ ID NO: 5206794 - DNA, 15 bp, Homo sapiens
aggcccctggcccag

SEQ ID NO: 5206795 - DNA, 16 bp, Homo sapiens
aggcccctgggctctc

SEQ ID NO: 5206796 - DNA, 16 bp, Homo sapiens
aggcccctgggtttct

SEQ ID NO: 5206797 - DNA, 14 bp, Homo sapiens
aggcccctggtggc

SEQ ID NO: 5206798 - DNA, 14 bp, Homo sapiens
aggcccctgtgcag

SEQ ID NO: 5206799 - DNA, 12 bp, Homo sapiens
aggcccctgtgt

SEQ ID NO: 5206800 - DNA, 14 bp, Homo sapiens
aggccccttccctg

SEQ ID NO: 5206801 - DNA, 15 bp, Homo sapiens
aggccccttccctgg

SEQ ID NO: 5206802 - DNA, 19 bp, Homo sapiens
aggccccttctctccctgc

SEQ ID NO: 5206803 - DNA, 18 bp, Homo sapiens
aggccccttgctgctggc

SEQ ID NO: 5206804 - DNA, 20 bp, Homo sapiens
aggccccttgctgctggctc

SEQ ID NO: 5206805 - DNA, 17 bp, Homo sapiens
aggcccctttggacctg

SEQ ID NO: 5206806 - DNA, 18 bp, Homo sapiens
aggcccgacagagagatg

SEQ ID NO: 5206807 - DNA, 15 bp, Homo sapiens
aggcccgagcagctg

SEQ ID NO: 5206808 - DNA, 18 bp, Homo sapiens
aggcccgagcagctgagc

SEQ ID NO: 5206809 - DNA, 13 bp, Homo sapiens
aggcccgaggagg

SEQ ID NO: 5206810 - DNA, 21 bp, Homo sapiens
aggcccgaggaggccgactgg

SEQ ID NO: 5206811 - DNA, 21 bp, Homo sapiens
aggcccgcaccccggcctcag

SEQ ID NO: 5206812 - DNA, 23 bp, Homo sapiens
aggcccgcaccccggcctcaggg

SEQ ID NO: 5206813 - DNA, 16 bp, Homo sapiens
aggcccgcactggggg

SEQ ID NO: 5206814 - DNA, 20 bp, Homo sapiens
aggcccgccctctgcctcct

SEQ ID NO: 5206815 - DNA, 14 bp, Homo sapiens
aggcccgccctgcc

SEQ ID NO: 5206816 - DNA, 16 bp, Homo sapiens
aggcccgccctgcccg

SEQ ID NO: 5206817 - DNA, 17 bp, Homo sapiens
aggcccgccctgcccgc

SEQ ID NO: 5206818 - DNA, 21 bp, Homo sapiens
aggcccgccctgcccgggctc

SEQ ID NO: 5206819 - DNA, 23 bp, Homo sapiens
aggcccggaagcgccaggctgga

SEQ ID NO: 5206820 - DNA, 18 bp, Homo sapiens
aggcccggatgcagaggc

SEQ ID NO: 5206821 - DNA, 19 bp, Homo sapiens
aggcccggcccagcctagg

SEQ ID NO: 5206822 - DNA, 16 bp, Homo sapiens
aggcccggctccaggc

SEQ ID NO: 5206823 - DNA, 17 bp, Homo sapiens
aggcccggctccaggct

SEQ ID NO: 5206824 - DNA, 19 bp, Homo sapiens
aggcccggctgagcccccc

SEQ ID NO: 5206825 - DNA, 20 bp, Homo sapiens
aggcccggctgagcccccca

SEQ ID NO: 5206826 - DNA, 15 bp, Homo sapiens
aggcccgggcccctg

SEQ ID NO: 5206827 - DNA, 18 bp, Homo sapiens
aggcccgggcccctggca

SEQ ID NO: 5206828 - DNA, 19 bp, Homo sapiens
aggcccggggcccttcctc

SEQ ID NO: 5206829 - DNA, 13 bp, Homo sapiens
aggcccggggctg

SEQ ID NO: 5206830 - DNA, 15 bp, Homo sapiens
aggcccggggctggc

SEQ ID NO: 5206831 - DNA, 14 bp, Homo sapiens
aggcccggtgcagc

SEQ ID NO: 5206832 - DNA, 18 bp, Homo sapiens
aggcccgtcagcatcact

SEQ ID NO: 5206833 - DNA, 20 bp, Homo sapiens
aggcccgtcagcatcactga

SEQ ID NO: 5206834 - DNA, 18 bp, Homo sapiens
aggcccgtcggagctgcc

SEQ ID NO: 5206835 - DNA, 19 bp, Homo sapiens
aggcccgtcggagctgcct

SEQ ID NO: 5206836 - DNA, 22 bp, Homo sapiens
aggcccgtcggagctgcctgca

SEQ ID NO: 5206837 - DNA, 16 bp, Homo sapiens
aggcccgtctgtccat

SEQ ID NO: 5206838 - DNA, 16 bp, Homo sapiens
aggcccgtgggcgcaa

SEQ ID NO: 5206839 - DNA, 15 bp, Homo sapiens
aggccctagaccctc

SEQ ID NO: 5206840 - DNA, 18 bp, Homo sapiens
aggccctagctaataaac

SEQ ID NO: 5206841 - DNA, 12 bp, Homo sapiens
aggccctaggcg

SEQ ID NO: 5206842 - DNA, 23 bp, Homo sapiens
aggccctcaagtctttctctttc

SEQ ID NO: 5206843 - DNA, 20 bp, Homo sapiens
aggccctcaatccaccttca

SEQ ID NO: 5206844 - DNA, 17 bp, Homo sapiens
aggccctcactgagcct

SEQ ID NO: 5206845 - DNA, 13 bp, Homo sapiens
aggccctccagca

SEQ ID NO: 5206846 - DNA, 17 bp, Homo sapiens
aggccctccatgggcta

SEQ ID NO: 5206847 - DNA, 18 bp, Homo sapiens
aggccctccatgggctag

SEQ ID NO: 5206848 - DNA, 12 bp, Homo sapiens
aggccctcccac

SEQ ID NO: 5206849 - DNA, 19 bp, Homo sapiens
aggccctcccaccacccca

SEQ ID NO: 5206850 - DNA, 14 bp, Homo sapiens
aggccctccctcta

SEQ ID NO: 5206851 - DNA, 22 bp, Homo sapiens
aggccctccctctactcttcct

SEQ ID NO: 5206852 - DNA, 22 bp, Homo sapiens
aggccctccctgactccctgtg

SEQ ID NO: 5206853 - DNA, 23 bp, Homo sapiens
aggccctcctccctcccagctcc

SEQ ID NO: 5206854 - DNA, 17 bp, Homo sapiens
aggccctcctgctggct

SEQ ID NO: 5206855 - DNA, 17 bp, Homo sapiens
aggccctcctgtgctgg

SEQ ID NO: 5206856 - DNA, 15 bp, Homo sapiens
aggccctcgggccca

SEQ ID NO: 5206857 - DNA, 17 bp, Homo sapiens
aggccctcgggcccagc

SEQ ID NO: 5206858 - DNA, 20 bp, Homo sapiens
aggccctcgggcccagcccc

SEQ ID NO: 5206859 - DNA, 17 bp, Homo sapiens
aggccctcggtcagcga

SEQ ID NO: 5206860 - DNA, 17 bp, Homo sapiens
aggccctctctgcagtc

SEQ ID NO: 5206861 - DNA, 20 bp, Homo sapiens
aggccctctgcccactccct

SEQ ID NO: 5206862 - DNA, 13 bp, Homo sapiens
aggccctctgcct

SEQ ID NO: 5206863 - DNA, 14 bp, Homo sapiens
aggccctctgcctg

SEQ ID NO: 5206864 - DNA, 21 bp, Homo sapiens
aggccctctgcctgcactccc

SEQ ID NO: 5206865 - DNA, 16 bp, Homo sapiens
aggccctctgtggcct

SEQ ID NO: 5206866 - DNA, 13 bp, Homo sapiens
aggccctgaagcc

SEQ ID NO: 5206867 - DNA, 20 bp, Homo sapiens
aggccctgactcctctggct

SEQ ID NO: 5206868 - DNA, 21 bp, Homo sapiens
aggccctgactcctctggctt

SEQ ID NO: 5206869 - DNA, 22 bp, Homo sapiens
aggccctgactcctctggcttt

SEQ ID NO: 5206870 - DNA, 15 bp, Homo sapiens
aggccctgagacagg

SEQ ID NO: 5206871 - DNA, 21 bp, Homo sapiens
aggccctgaggcggaggctgt

SEQ ID NO: 5206872 - DNA, 13 bp, Homo sapiens
aggccctgcactg

SEQ ID NO: 5206873 - DNA, 18 bp, Homo sapiens
aggccctgcactgtcctg

SEQ ID NO: 5206874 - DNA, 21 bp, Homo sapiens
aggccctgcactgtcctgctc

SEQ ID NO: 5206875 - DNA, 11 bp, Homo sapiens
aggccctgcag

SEQ ID NO: 5206876 - DNA, 12 bp, Homo sapiens
aggccctgcagt

SEQ ID NO: 5206877 - DNA, 12 bp, Homo sapiens
aggccctgcatc

SEQ ID NO: 5206878 - DNA, 20 bp, Homo sapiens
aggccctgcatctgtctgct

SEQ ID NO: 5206879 - DNA, 21 bp, Homo sapiens
aggccctgcatctgtctgctc

SEQ ID NO: 5206880 - DNA, 22 bp, Homo sapiens
aggccctgcatctgtctgctct

SEQ ID NO: 5206881 - DNA, 10 bp, Homo sapiens
aggccctgcc

SEQ ID NO: 5206882 - DNA, 16 bp, Homo sapiens
aggccctgccacgtcc

SEQ ID NO: 5206883 - DNA, 17 bp, Homo sapiens
aggccctgccagagcag

SEQ ID NO: 5206884 - DNA, 20 bp, Homo sapiens
aggccctgccagagcagggg

SEQ ID NO: 5206885 - DNA, 21 bp, Homo sapiens
aggccctgccattggcctctt

SEQ ID NO: 5206886 - DNA, 13 bp, Homo sapiens
aggccctgcccag

SEQ ID NO: 5206887 - DNA, 17 bp, Homo sapiens
aggccctgcccagccag

SEQ ID NO: 5206888 - DNA, 13 bp, Homo sapiens
aggccctgccccc

SEQ ID NO: 5206889 - DNA, 15 bp, Homo sapiens
aggccctgccctgcc

SEQ ID NO: 5206890 - DNA, 22 bp, Homo sapiens
aggccctgcctccgggaggtca

SEQ ID NO: 5206891 - DNA, 16 bp, Homo sapiens
aggccctgctcctgca

SEQ ID NO: 5206892 - DNA, 18 bp, Homo sapiens
aggccctgctttttttct

SEQ ID NO: 5206893 - DNA, 19 bp, Homo sapiens
aggccctgctttttttctt

SEQ ID NO: 5206894 - DNA, 20 bp, Homo sapiens
aggccctgctttttttctta

SEQ ID NO: 5206895 - DNA, 22 bp, Homo sapiens
aggccctgctttttttcttaaa

SEQ ID NO: 5206896 - DNA, 16 bp, Homo sapiens
aggccctggagggcag

SEQ ID NO: 5206897 - DNA, 18 bp, Homo sapiens
aggccctggagggcagag

SEQ ID NO: 5206898 - DNA, 13 bp, Homo sapiens
aggccctggcaga

SEQ ID NO: 5206899 - DNA, 12 bp, Homo sapiens
aggccctggccc

SEQ ID NO: 5206900 - DNA, 14 bp, Homo sapiens
aggccctggccctt

SEQ ID NO: 5206901 - DNA, 14 bp, Homo sapiens
aggccctgggcctc

SEQ ID NO: 5206902 - DNA, 20 bp, Homo sapiens
aggccctgggcctccacctc

SEQ ID NO: 5206903 - DNA, 21 bp, Homo sapiens
aggccctgggcctccacctct

SEQ ID NO: 5206904 - DNA, 23 bp, Homo sapiens
aggccctgggcctccacctctgt

SEQ ID NO: 5206905 - DNA, 20 bp, Homo sapiens
aggccctgggctgggtgctg

SEQ ID NO: 5206906 - DNA, 13 bp, Homo sapiens
aggccctgggtct

SEQ ID NO: 5206907 - DNA, 16 bp, Homo sapiens
aggccctggttcctgc

SEQ ID NO: 5206908 - DNA, 17 bp, Homo sapiens
aggccctggttcctgct

SEQ ID NO: 5206909 - DNA, 23 bp, Homo sapiens
aggccctggttcctgctgtcctg

SEQ ID NO: 5206910 - DNA, 14 bp, Homo sapiens
aggccctgtccagc

SEQ ID NO: 5206911 - DNA, 19 bp, Homo sapiens
aggccctgtccagccccca

SEQ ID NO: 5206912 - DNA, 12 bp, Homo sapiens
aggccctgtccc

SEQ ID NO: 5206913 - DNA, 15 bp, Homo sapiens
aggccctgtcccagc

SEQ ID NO: 5206914 - DNA, 16 bp, Homo sapiens
aggccctgtcccagca

SEQ ID NO: 5206915 - DNA, 22 bp, Homo sapiens
aggccctgtcccagcagaagag

SEQ ID NO: 5206916 - DNA, 14 bp, Homo sapiens
aggccctgtctctg

SEQ ID NO: 5206917 - DNA, 20 bp, Homo sapiens
aggccctgtctctggctact

SEQ ID NO: 5206918 - DNA, 13 bp, Homo sapiens
aggccctgtgagc

SEQ ID NO: 5206919 - DNA, 14 bp, Homo sapiens
aggccctgtgagca

SEQ ID NO: 5206920 - DNA, 20 bp, Homo sapiens
aggccctgtggtccccgaga

SEQ ID NO: 5206921 - DNA, 14 bp, Homo sapiens
aggccctgttccct

SEQ ID NO: 5206922 - DNA, 22 bp, Homo sapiens
aggcccttattttcaagaaact

SEQ ID NO: 5206923 - DNA, 13 bp, Homo sapiens
aggcccttcctct

SEQ ID NO: 5206924 - DNA, 19 bp, Homo sapiens
aggcccttcctctccactg

SEQ ID NO: 5206925 - DNA, 15 bp, Homo sapiens
aggcccttctctcca

SEQ ID NO: 5206926 - DNA, 21 bp, Homo sapiens
aggcccttctctccagcccct

SEQ ID NO: 5206927 - DNA, 16 bp, Homo sapiens
aggcccttggctgcag

SEQ ID NO: 5206928 - DNA, 17 bp, Homo sapiens
aggcccttggctgcagg

SEQ ID NO: 5206929 - DNA, 18 bp, Homo sapiens
aggcccttggctgcaggc

SEQ ID NO: 5206930 - DNA, 14 bp, Homo sapiens
aggcccttgtcctg

SEQ ID NO: 5206931 - DNA, 21 bp, Homo sapiens
aggcccttgtcctgccagctg

SEQ ID NO: 5206932 - DNA, 22 bp, Homo sapiens
aggcccttgtcctgccagctgc

SEQ ID NO: 5206933 - DNA, 15 bp, Homo sapiens
aggccctttaacttg

SEQ ID NO: 5206934 - DNA, 11 bp, Homo sapiens
aggaaatctgt

SEQ ID NO: 5206935 - DNA, 23 bp, Homo sapiens
aggaaatgctattgttgtgggct

SEQ ID NO: 5206936 - DNA, 22 bp, Homo sapiens
aggaaatgctgacccatgggca

SEQ ID NO: 5206937 - DNA, 18 bp, Homo sapiens
aggaaatggaatactgaa

SEQ ID NO: 5206938 - DNA, 13 bp, Homo sapiens
aggaaatgtgctc

SEQ ID NO: 5206939 - DNA, 14 bp, Homo sapiens
aggaaatgtggaaa

SEQ ID NO: 5206940 - DNA, 17 bp, Homo sapiens
aggaaattaaataattt

SEQ ID NO: 5206941 - DNA, 18 bp, Homo sapiens
aggaaattaagaactgaa

SEQ ID NO: 5206942 - DNA, 21 bp, Homo sapiens
aggaaattagcattccttaat

SEQ ID NO: 5206943 - DNA, 16 bp, Homo sapiens
aggaaattagtctttt

SEQ ID NO: 5206944 - DNA, 14 bp, Homo sapiens
aggaaattccaaat

SEQ ID NO: 5206945 - DNA, 16 bp, Homo sapiens
aggaaattgcaaagaa

SEQ ID NO: 5206946 - DNA, 21 bp, Homo sapiens
aggaaattgcaaagaaaattc

SEQ ID NO: 5206947 - DNA, 23 bp, Homo sapiens
aggaaattgtacataagtacctc

SEQ ID NO: 5206948 - DNA, 17 bp, Homo sapiens
aggaaatttatacaaag

SEQ ID NO: 5206949 - DNA, 18 bp, Homo sapiens
aggaaatttatacaaaga

SEQ ID NO: 5206950 - DNA, 22 bp, Homo sapiens
aggaaatttatacaaagaaact

SEQ ID NO: 5206951 - DNA, 16 bp, Homo sapiens
aggaaatttgtttgta

SEQ ID NO: 5206952 - DNA, 17 bp, Homo sapiens
aggaaatttgtttgtat

SEQ ID NO: 5206953 - DNA, 11 bp, Homo sapiens
aggaaattttt

SEQ ID NO: 5206954 - DNA, 21 bp, Homo sapiens
aggaacaaaaattacaaagaa

SEQ ID NO: 5206955 - DNA, 13 bp, Homo sapiens
aggaacaaacagg

SEQ ID NO: 5206956 - DNA, 14 bp, Homo sapiens
aggaacaaatcttc

SEQ ID NO: 5206957 - DNA, 15 bp, Homo sapiens
aggaacaagaaggtg

SEQ ID NO: 5206958 - DNA, 13 bp, Homo sapiens
aggaacaagaccc

SEQ ID NO: 5206959 - DNA, 13 bp, Homo sapiens
aggaacaagagaa

SEQ ID NO: 5206960 - DNA, 23 bp, Homo sapiens
aggaacaagagaaaaaactagag

SEQ ID NO: 5206961 - DNA, 12 bp, Homo sapiens
aggaacaaggca

SEQ ID NO: 5206962 - DNA, 13 bp, Homo sapiens
aggaacaaggcaa

SEQ ID NO: 5206963 - DNA, 19 bp, Homo sapiens
aggaacaatctttgctgta

SEQ ID NO: 5206964 - DNA, 13 bp, Homo sapiens
aggaacaatgccg

SEQ ID NO: 5206965 - DNA, 14 bp, Homo sapiens
aggaacacatgcac

SEQ ID NO: 5206966 - DNA, 15 bp, Homo sapiens
aggaacacatgcaca

SEQ ID NO: 5206967 - DNA, 13 bp, Homo sapiens
aggaacacccagc

SEQ ID NO: 5206968 - DNA, 23 bp, Homo sapiens
aggaacacccgactcctcaaaag

SEQ ID NO: 5206969 - DNA, 22 bp, Homo sapiens
aggaacacctgatcttacagaa

SEQ ID NO: 5206970 - DNA, 22 bp, Homo sapiens
aggaacacgtgggtgagcgtgt

SEQ ID NO: 5206971 - DNA, 21 bp, Homo sapiens
aggaacacgtttttacatact

SEQ ID NO: 5206972 - DNA, 23 bp, Homo sapiens
aggaacactggaaaataaatttt

SEQ ID NO: 5206973 - DNA, 13 bp, Homo sapiens
aggaacagaacac

SEQ ID NO: 5206974 - DNA, 17 bp, Homo sapiens
aggaacagaagtgagga

SEQ ID NO: 5206975 - DNA, 23 bp, Homo sapiens
aggaacagaagtgaggatgagac

SEQ ID NO: 5206976 - DNA, 14 bp, Homo sapiens
aggaacagagactc

SEQ ID NO: 5206977 - DNA, 16 bp, Homo sapiens
aggaacagagactctg

SEQ ID NO: 5206978 - DNA, 18 bp, Homo sapiens
aggaacagagactctgga

SEQ ID NO: 5206979 - DNA, 23 bp, Homo sapiens
aggaacagagactctggaagccc

SEQ ID NO: 5206980 - DNA, 14 bp, Homo sapiens
aggaacagcagtgt

SEQ ID NO: 5206981 - DNA, 15 bp, Homo sapiens
aggaacagcagtgtt

SEQ ID NO: 5206982 - DNA, 12 bp, Homo sapiens
aggaacagctcc

SEQ ID NO: 5206983 - DNA, 15 bp, Homo sapiens
aggaacaggtttaaa

SEQ ID NO: 5206984 - DNA, 19 bp, Homo sapiens
aggaacaggtttaaaaatc

SEQ ID NO: 5206985 - DNA, 17 bp, Homo sapiens
aggaacagtattacagt

SEQ ID NO: 5206986 - DNA, 17 bp, Homo sapiens
aggaacagtcctgttca

SEQ ID NO: 5206987 - DNA, 18 bp, Homo sapiens
aggaacagtggccttgct

SEQ ID NO: 5206988 - DNA, 18 bp, Homo sapiens
aggaacagtggctgggtg

SEQ ID NO: 5206989 - DNA, 18 bp, Homo sapiens
aggaacagttaccctgct

SEQ ID NO: 5206990 - DNA, 17 bp, Homo sapiens
aggaacatttaggggca

SEQ ID NO: 5206991 - DNA, 15 bp, Homo sapiens
aggaaccaaagcgaa

SEQ ID NO: 5206992 - DNA, 21 bp, Homo sapiens
aggaaccaacaatcttcctgt

SEQ ID NO: 5206993 - DNA, 17 bp, Homo sapiens
aggaaccacaccacatc

SEQ ID NO: 5206994 - DNA, 19 bp, Homo sapiens
aggaaccacatataacact

SEQ ID NO: 5206995 - DNA, 21 bp, Homo sapiens
aggaaccacatataacactta

SEQ ID NO: 5206996 - DNA, 24 bp, Homo sapiens
aggaaccacatataacacttaact

SEQ ID NO: 5206997 - DNA, 23 bp, Homo sapiens
aggaaccatagttgacagttcca

SEQ ID NO: 5206998 - DNA, 16 bp, Homo sapiens
aggaaccatggacctg

SEQ ID NO: 5206999 - DNA, 14 bp, Homo sapiens
aggaacccagccag

SEQ ID NO: 5207000 - DNA, 14 bp, Homo sapiens
aggaacccccacca

SEQ ID NO: 5207001 - DNA, 15 bp, Homo sapiens
aggaacccggtccca

SEQ ID NO: 5207002 - DNA, 20 bp, Homo sapiens
aggaacccggtcccaggccg

SEQ ID NO: 5207003 - DNA, 16 bp, Homo sapiens
aggaaccctcaggcca

SEQ ID NO: 5207004 - DNA, 19 bp, Homo sapiens
aggaacccttacagtagga

SEQ ID NO: 5207005 - DNA, 14 bp, Homo sapiens
aggaaccgcccagt

SEQ ID NO: 5207006 - DNA, 17 bp, Homo sapiens
aggaaccgcccagtgca

SEQ ID NO: 5207007 - DNA, 19 bp, Homo sapiens
aggaaccgcccagtgcagg

SEQ ID NO: 5207008 - DNA, 16 bp, Homo sapiens
aggaacctaattgaaa

SEQ ID NO: 5207009 - DNA, 18 bp, Homo sapiens
aggaacctaattgaaatt

SEQ ID NO: 5207010 - DNA, 20 bp, Homo sapiens
aggaacctcgaagctgttct

SEQ ID NO: 5207011 - DNA, 16 bp, Homo sapiens
aggaacctcgagtact

SEQ ID NO: 5207012 - DNA, 23 bp, Homo sapiens
aggaacctgtactgggttatttt

SEQ ID NO: 5207013 - DNA, 20 bp, Homo sapiens
aggaaccttccttcctgctt

SEQ ID NO: 5207014 - DNA, 15 bp, Homo sapiens
aggaacgctctcctc

SEQ ID NO: 5207015 - DNA, 13 bp, Homo sapiens
aggaacggccctg

SEQ ID NO: 5207016 - DNA, 18 bp, Homo sapiens
aggaacgggcagccacag

SEQ ID NO: 5207017 - DNA, 23 bp, Homo sapiens
aggaacgggcagcctgggcctgg

SEQ ID NO: 5207018 - DNA, 20 bp, Homo sapiens
aggaacggtaaatttctgtg

SEQ ID NO: 5207019 - DNA, 15 bp, Homo sapiens
aggaactactgagga

SEQ ID NO: 5207020 - DNA, 13 bp, Homo sapiens
aggaactcccagc

SEQ ID NO: 5207021 - DNA, 23 bp, Homo sapiens
aggaactcccagcaacacaagct

SEQ ID NO: 5207022 - DNA, 17 bp, Homo sapiens
aggaactccttgcacac

SEQ ID NO: 5207023 - DNA, 14 bp, Homo sapiens
aggaactccttggc

SEQ ID NO: 5207024 - DNA, 22 bp, Homo sapiens
aggaactcgcacctgtgctgga

SEQ ID NO: 5207025 - DNA, 15 bp, Homo sapiens
aggaactcgcctcag

SEQ ID NO: 5207026 - DNA, 16 bp, Homo sapiens
aggaactctcctgtgg

SEQ ID NO: 5207027 - DNA, 13 bp, Homo sapiens
aggaactctggac

SEQ ID NO: 5207028 - DNA, 19 bp, Homo sapiens
aggaactctggcttccagg

SEQ ID NO: 5207029 - DNA, 22 bp, Homo sapiens
aggaactctgggcagctggagg

SEQ ID NO: 5207030 - DNA, 13 bp, Homo sapiens
aggaactctgtgt

SEQ ID NO: 5207031 - DNA, 18 bp, Homo sapiens
aggaactctgtgtgagag

SEQ ID NO: 5207032 - DNA, 23 bp, Homo sapiens
aggaactctgtgtgagagagagg

SEQ ID NO: 5207033 - DNA, 17 bp, Homo sapiens
aggaactgaaaaccagt

SEQ ID NO: 5207034 - DNA, 15 bp, Homo sapiens
aggaactgagtatgt

SEQ ID NO: 5207035 - DNA, 13 bp, Homo sapiens
aggaactgcagca

SEQ ID NO: 5207036 - DNA, 14 bp, Homo sapiens
aggaactgcctggg

SEQ ID NO: 5207037 - DNA, 12 bp, Homo sapiens
aggaactggaac

SEQ ID NO: 5207038 - DNA, 12 bp, Homo sapiens
aggaactggctc

SEQ ID NO: 5207039 - DNA, 22 bp, Homo sapiens
aggaactggctcctttgcctct

SEQ ID NO: 5207040 - DNA, 14 bp, Homo sapiens
aggaactggtccag

SEQ ID NO: 5207041 - DNA, 21 bp, Homo sapiens
aggaactggtccaggccaggc

SEQ ID NO: 5207042 - DNA, 13 bp, Homo sapiens
aggaactgtacag

SEQ ID NO: 5207043 - DNA, 17 bp, Homo sapiens
aggaactgtccagagag

SEQ ID NO: 5207044 - DNA, 18 bp, Homo sapiens
aggaactgtccagagagc

SEQ ID NO: 5207045 - DNA, 15 bp, Homo sapiens
aggaacttcatgctt

SEQ ID NO: 5207046 - DNA, 21 bp, Homo sapiens
aggaacttgccctgagcactc

SEQ ID NO: 5207047 - DNA, 14 bp, Homo sapiens
aggaacttgctgct

SEQ ID NO: 5207048 - DNA, 14 bp, Homo sapiens
aggaagaaaaatca

SEQ ID NO: 5207049 - DNA, 16 bp, Homo sapiens
aggaagaaaaatcagt

SEQ ID NO: 5207050 - DNA, 20 bp, Homo sapiens
aggaagaaaacggaaatgtg

SEQ ID NO: 5207051 - DNA, 13 bp, Homo sapiens
aggaagaaaatgt

SEQ ID NO: 5207052 - DNA, 16 bp, Homo sapiens
aggaagaaaatttcct

SEQ ID NO: 5207053 - DNA, 14 bp, Homo sapiens
aggaagaaaccatt

SEQ ID NO: 5207054 - DNA, 15 bp, Homo sapiens
aggaagaaatcacag

SEQ ID NO: 5207055 - DNA, 22 bp, Homo sapiens
aggaagaaattcaggtacagaa

SEQ ID NO: 5207056 - DNA, 20 bp, Homo sapiens
aggaagaacaacaaagacat

SEQ ID NO: 5207057 - DNA, 19 bp, Homo sapiens
aggaagaactgaaaggctt

SEQ ID NO: 5207058 - DNA, 20 bp, Homo sapiens
aggaagaagaaatctttctc

SEQ ID NO: 5207059 - DNA, 11 bp, Homo sapiens
aggaagaagac

SEQ ID NO: 5207060 - DNA, 17 bp, Homo sapiens
aggaagaagagatgcac

SEQ ID NO: 5207061 - DNA, 18 bp, Homo sapiens
aggaagaagtggtactag

SEQ ID NO: 5207062 - DNA, 23 bp, Homo sapiens
aggaagaatgggctgcagaagat

SEQ ID NO: 5207063 - DNA, 17 bp, Homo sapiens
aggaagaattttaaaaa

SEQ ID NO: 5207064 - DNA, 23 bp, Homo sapiens
aggaagaattttaaaaatgaatc

SEQ ID NO: 5207065 - DNA, 16 bp, Homo sapiens
aggaagacaacttgct

SEQ ID NO: 5207066 - DNA, 18 bp, Homo sapiens
aggaagacataaaacttt

SEQ ID NO: 5207067 - DNA, 19 bp, Homo sapiens
aggaagaccaaggcctcgg

SEQ ID NO: 5207068 - DNA, 17 bp, Homo sapiens
aggaagaccattctgtg

SEQ ID NO: 5207069 - DNA, 16 bp, Homo sapiens
aggaagacgagacagg

SEQ ID NO: 5207070 - DNA, 18 bp, Homo sapiens
aggaagactctggagcca

SEQ ID NO: 5207071 - DNA, 19 bp, Homo sapiens
aggaagacttcatccctct

SEQ ID NO: 5207072 - DNA, 18 bp, Homo sapiens
aggaagacttggcccagg

SEQ ID NO: 5207073 - DNA, 15 bp, Homo sapiens
aggaagagaagacat

SEQ ID NO: 5207074 - DNA, 13 bp, Homo sapiens
aggaagagagaga

SEQ ID NO: 5207075 - DNA, 14 bp, Homo sapiens
aggaagagagagag

SEQ ID NO: 5207076 - DNA, 20 bp, Homo sapiens
aggaagagaggacccatcct

SEQ ID NO: 5207077 - DNA, 16 bp, Homo sapiens
aggaagagatgctcta

SEQ ID NO: 5207078 - DNA, 12 bp, Homo sapiens
aggaagagccac

SEQ ID NO: 5207079 - DNA, 14 bp, Homo sapiens
aggaagagccacct

SEQ ID NO: 5207080 - DNA, 18 bp, Homo sapiens
aggaagagccacctgcaa

SEQ ID NO: 5207081 - DNA, 21 bp, Homo sapiens
aggaagagccacctgcaagat

SEQ ID NO: 5207082 - DNA, 15 bp, Homo sapiens
aggaagagccttcca

SEQ ID NO: 5207083 - DNA, 16 bp, Homo sapiens
aggaagagctaataaa

SEQ ID NO: 5207084 - DNA, 21 bp, Homo sapiens
aggaagaggccgctgcagggt

SEQ ID NO: 5207085 - DNA, 14 bp, Homo sapiens
aggaagagggacag

SEQ ID NO: 5207086 - DNA, 19 bp, Homo sapiens
aggaagagggctgagctga

SEQ ID NO: 5207087 - DNA, 19 bp, Homo sapiens
aggaagaggggtcttttat

SEQ ID NO: 5207088 - DNA, 22 bp, Homo sapiens
aggaagaggttgcagtgagctg

SEQ ID NO: 5207089 - DNA, 21 bp, Homo sapiens
aggaagagtagcatttcattc

SEQ ID NO: 5207090 - DNA, 22 bp, Homo sapiens
aggaagatatacatgaaaattt

SEQ ID NO: 5207091 - DNA, 20 bp, Homo sapiens
aggaagatatcatgaaagaa

SEQ ID NO: 5207092 - DNA, 14 bp, Homo sapiens
aggaagatcaggcc

SEQ ID NO: 5207093 - DNA, 17 bp, Homo sapiens
aggaagatcccccagaa

SEQ ID NO: 5207094 - DNA, 21 bp, Homo sapiens
aggaagatctctgcagggccg

SEQ ID NO: 5207095 - DNA, 16 bp, Homo sapiens
aggaagatcttaaatt

SEQ ID NO: 5207096 - DNA, 19 bp, Homo sapiens
aggaagatcttgagagctg

SEQ ID NO: 5207097 - DNA, 15 bp, Homo sapiens
aggaagatgaaagag

SEQ ID NO: 5207098 - DNA, 19 bp, Homo sapiens
aggaagatgaagagaagct

SEQ ID NO: 5207099 - DNA, 20 bp, Homo sapiens
aggaagatgttcaatagaac

SEQ ID NO: 5207100 - DNA, 15 bp, Homo sapiens
aggaagatgtttaca

SEQ ID NO: 5207101 - DNA, 19 bp, Homo sapiens
aggaagattaaaaccacag

SEQ ID NO: 5207102 - DNA, 19 bp, Homo sapiens
aggaagcaaatagaagaga

SEQ ID NO: 5207103 - DNA, 19 bp, Homo sapiens
aggaagcaacgaagggaaa

SEQ ID NO: 5207104 - DNA, 21 bp, Homo sapiens
aggaagcaagatcgctgtgct

SEQ ID NO: 5207105 - DNA, 15 bp, Homo sapiens
aggaagcaagcttaa

SEQ ID NO: 5207106 - DNA, 17 bp, Homo sapiens
aggaagcaagcttaatg

SEQ ID NO: 5207107 - DNA, 14 bp, Homo sapiens
aggaagcaaggcca

SEQ ID NO: 5207108 - DNA, 15 bp, Homo sapiens
aggaagcaaggccag

SEQ ID NO: 5207109 - DNA, 19 bp, Homo sapiens
aggaagcaaggccagccct

SEQ ID NO: 5207110 - DNA, 18 bp, Homo sapiens
aggaagcacaaaagacaa

SEQ ID NO: 5207111 - DNA, 12 bp, Homo sapiens
aggaagcacaag

SEQ ID NO: 5207112 - DNA, 11 bp, Homo sapiens
aggaagcacag

SEQ ID NO: 5207113 - DNA, 21 bp, Homo sapiens
aggccctttgaagcctcagct

SEQ ID NO: 5207114 - DNA, 16 bp, Homo sapiens
aggccctttgctgtcc

SEQ ID NO: 5207115 - DNA, 12 bp, Homo sapiens
aggccctttggc

SEQ ID NO: 5207116 - DNA, 18 bp, Homo sapiens
aggccctttggcttctga

SEQ ID NO: 5207117 - DNA, 16 bp, Homo sapiens
aggcccttttctggct

SEQ ID NO: 5207118 - DNA, 20 bp, Homo sapiens
aggcccttttctggctcctg

SEQ ID NO: 5207119 - DNA, 18 bp, Homo sapiens
aggccgaagaagggtcct

SEQ ID NO: 5207120 - DNA, 14 bp, Homo sapiens
aggccgaagctctg

SEQ ID NO: 5207121 - DNA, 23 bp, Homo sapiens
aggccgaagctctggctgaaccc

SEQ ID NO: 5207122 - DNA, 19 bp, Homo sapiens
aggccgactgggctgctgg

SEQ ID NO: 5207123 - DNA, 19 bp, Homo sapiens
aggccgagaagcaagaaag

SEQ ID NO: 5207124 - DNA, 24 bp, Homo sapiens
aggccgagccaggttcacactcag

SEQ ID NO: 5207125 - DNA, 13 bp, Homo sapiens
aggccgagcccac

SEQ ID NO: 5207126 - DNA, 16 bp, Homo sapiens
aggccgagcccacacc

SEQ ID NO: 5207127 - DNA, 16 bp, Homo sapiens
aggccgagcctcccct

SEQ ID NO: 5207128 - DNA, 17 bp, Homo sapiens
aggccgagcgttcccag

SEQ ID NO: 5207129 - DNA, 17 bp, Homo sapiens
aggccgaggaccaccag

SEQ ID NO: 5207130 - DNA, 19 bp, Homo sapiens
aggccgaggaccaccagca

SEQ ID NO: 5207131 - DNA, 14 bp, Homo sapiens
aggccgagggccag

SEQ ID NO: 5207132 - DNA, 20 bp, Homo sapiens
aggccgagtctgtcctggaa

SEQ ID NO: 5207133 - DNA, 19 bp, Homo sapiens
aggccgatttgggaaccaa

SEQ ID NO: 5207134 - DNA, 16 bp, Homo sapiens
aggccgcaagaggcat

SEQ ID NO: 5207135 - DNA, 20 bp, Homo sapiens
aggccgcagctccattttct

SEQ ID NO: 5207136 - DNA, 18 bp, Homo sapiens
aggccgcagctcttgccc

SEQ ID NO: 5207137 - DNA, 22 bp, Homo sapiens
aggccgcagctcttgcccttcc

SEQ ID NO: 5207138 - DNA, 14 bp, Homo sapiens
aggccgcatctttc

SEQ ID NO: 5207139 - DNA, 12 bp, Homo sapiens
aggccgcccacc

SEQ ID NO: 5207140 - DNA, 16 bp, Homo sapiens
aggccgcccacctgca

SEQ ID NO: 5207141 - DNA, 14 bp, Homo sapiens
aggccgcgcccagc

SEQ ID NO: 5207142 - DNA, 13 bp, Homo sapiens
aggccgcggccca

SEQ ID NO: 5207143 - DNA, 13 bp, Homo sapiens
aggccgcggcctc

SEQ ID NO: 5207144 - DNA, 15 bp, Homo sapiens
aggccgcggcctccc

SEQ ID NO: 5207145 - DNA, 17 bp, Homo sapiens
aggccgctagaggcctg

SEQ ID NO: 5207146 - DNA, 18 bp, Homo sapiens
aggccgctagaggcctga

SEQ ID NO: 5207147 - DNA, 21 bp, Homo sapiens
aggccgctagaggcctgagga

SEQ ID NO: 5207148 - DNA, 17 bp, Homo sapiens
aggccgctatgcagggt

SEQ ID NO: 5207149 - DNA, 16 bp, Homo sapiens
aggccgctgcccctga

SEQ ID NO: 5207150 - DNA, 20 bp, Homo sapiens
aggccgctgcccctgagttc

SEQ ID NO: 5207151 - DNA, 15 bp, Homo sapiens
aggccgctgctgacc

SEQ ID NO: 5207152 - DNA, 20 bp, Homo sapiens
aggccgctgttcacccacag

SEQ ID NO: 5207153 - DNA, 15 bp, Homo sapiens
aggccggaaccacag

SEQ ID NO: 5207154 - DNA, 22 bp, Homo sapiens
aggccggaaccacagggccaga

SEQ ID NO: 5207155 - DNA, 22 bp, Homo sapiens
aggccggagagctggtgacttt

SEQ ID NO: 5207156 - DNA, 14 bp, Homo sapiens
aggccggagcccag

SEQ ID NO: 5207157 - DNA, 16 bp, Homo sapiens
aggccggagcccagat

SEQ ID NO: 5207158 - DNA, 15 bp, Homo sapiens
aggccggcagcccca

SEQ ID NO: 5207159 - DNA, 23 bp, Homo sapiens
aggccggcagccccagcctgcta

SEQ ID NO: 5207160 - DNA, 13 bp, Homo sapiens
aggccggccagcc

SEQ ID NO: 5207161 - DNA, 14 bp, Homo sapiens
aggccggccagcct

SEQ ID NO: 5207162 - DNA, 13 bp, Homo sapiens
aggccggcccaga

SEQ ID NO: 5207163 - DNA, 14 bp, Homo sapiens
aggccggcccagat

SEQ ID NO: 5207164 - DNA, 16 bp, Homo sapiens
aggccggccctgcccc

SEQ ID NO: 5207165 - DNA, 17 bp, Homo sapiens
aggccggccctgcccct

SEQ ID NO: 5207166 - DNA, 18 bp, Homo sapiens
aggccggccctgcccctc

SEQ ID NO: 5207167 - DNA, 23 bp, Homo sapiens
aggccggccctgcccctccctag

SEQ ID NO: 5207168 - DNA, 19 bp, Homo sapiens
aggccggcgagccctgtgg

SEQ ID NO: 5207169 - DNA, 19 bp, Homo sapiens
aggccggcttgccacaccc

SEQ ID NO: 5207170 - DNA, 21 bp, Homo sapiens
aggccggcttgccacaccccc

SEQ ID NO: 5207171 - DNA, 14 bp, Homo sapiens
aggccgggaaaaag

SEQ ID NO: 5207172 - DNA, 18 bp, Homo sapiens
aggccgggaaaaagccca

SEQ ID NO: 5207173 - DNA, 20 bp, Homo sapiens
aggccgggaagagccacctg

SEQ ID NO: 5207174 - DNA, 20 bp, Homo sapiens
aggccgggagaggatgtctt

SEQ ID NO: 5207175 - DNA, 17 bp, Homo sapiens
aggccgggcctgtacag

SEQ ID NO: 5207176 - DNA, 19 bp, Homo sapiens
aggccggggccgggtactg

SEQ ID NO: 5207177 - DNA, 13 bp, Homo sapiens
aggccggggctgg

SEQ ID NO: 5207178 - DNA, 14 bp, Homo sapiens
aggccggggctgga

SEQ ID NO: 5207179 - DNA, 19 bp, Homo sapiens
aggccggtgggaagagggc

SEQ ID NO: 5207180 - DNA, 22 bp, Homo sapiens
aggccggtgggaagagggcagg

SEQ ID NO: 5207181 - DNA, 15 bp, Homo sapiens
aggccgtcatttcat

SEQ ID NO: 5207182 - DNA, 16 bp, Homo sapiens
aggccgtcatttcatt

SEQ ID NO: 5207183 - DNA, 15 bp, Homo sapiens
aggccgtgcctggtg

SEQ ID NO: 5207184 - DNA, 20 bp, Homo sapiens
aggccgtggctgcccacaca

SEQ ID NO: 5207185 - DNA, 20 bp, Homo sapiens
aggccgtggctgctgtggga

SEQ ID NO: 5207186 - DNA, 19 bp, Homo sapiens
aggccgtgggacccaggct

SEQ ID NO: 5207187 - DNA, 20 bp, Homo sapiens
aggccgtgggacccaggctc

SEQ ID NO: 5207188 - DNA, 20 bp, Homo sapiens
aggccgtgtccccttgttct

SEQ ID NO: 5207189 - DNA, 16 bp, Homo sapiens
aggccgtgtctctgag

SEQ ID NO: 5207190 - DNA, 22 bp, Homo sapiens
aggccgtgtgtttagaagccta

SEQ ID NO: 5207191 - DNA, 18 bp, Homo sapiens
aggccgttgctgacttag

SEQ ID NO: 5207192 - DNA, 23 bp, Homo sapiens
aggccgttgctgacttagaatcc

SEQ ID NO: 5207193 - DNA, 14 bp, Homo sapiens
aggccgtttctcat

SEQ ID NO: 5207194 - DNA, 17 bp, Homo sapiens
aggcctaaaagtaaaca

SEQ ID NO: 5207195 - DNA, 14 bp, Homo sapiens
aggcctaaggaagc

SEQ ID NO: 5207196 - DNA, 19 bp, Homo sapiens
aggcctaattctatgcctg

SEQ ID NO: 5207197 - DNA, 13 bp, Homo sapiens
aggcctacagagg

SEQ ID NO: 5207198 - DNA, 21 bp, Homo sapiens
aggcctacagaggaggcctca

SEQ ID NO: 5207199 - DNA, 17 bp, Homo sapiens
aggcctacagccacatc

SEQ ID NO: 5207200 - DNA, 18 bp, Homo sapiens
aggcctacagccacatcc

SEQ ID NO: 5207201 - DNA, 16 bp, Homo sapiens
aggcctaccccgcaga

SEQ ID NO: 5207202 - DNA, 22 bp, Homo sapiens
aggcctaccccgcagacacctt

SEQ ID NO: 5207203 - DNA, 19 bp, Homo sapiens
aggcctacctcaagttctt

SEQ ID NO: 5207204 - DNA, 15 bp, Homo sapiens
aggcctacctgctcc

SEQ ID NO: 5207205 - DNA, 16 bp, Homo sapiens
aggcctacctgctccc

SEQ ID NO: 5207206 - DNA, 14 bp, Homo sapiens
aggcctactcctgt

SEQ ID NO: 5207207 - DNA, 14 bp, Homo sapiens
aggcctagactctg

SEQ ID NO: 5207208 - DNA, 15 bp, Homo sapiens
aggcctagagtggca

SEQ ID NO: 5207209 - DNA, 16 bp, Homo sapiens
aggcctagagtggcag

SEQ ID NO: 5207210 - DNA, 21 bp, Homo sapiens
aggcctagagtggcagccaag

SEQ ID NO: 5207211 - DNA, 21 bp, Homo sapiens
aggcctaggagggtcctctga

SEQ ID NO: 5207212 - DNA, 15 bp, Homo sapiens
aggcctaggattcta

SEQ ID NO: 5207213 - DNA, 17 bp, Homo sapiens
aggcctaggattctaaa

SEQ ID NO: 5207214 - DNA, 17 bp, Homo sapiens
aggcctaggctaggacg

SEQ ID NO: 5207215 - DNA, 23 bp, Homo sapiens
aggcctaggctaggacgttggcc

SEQ ID NO: 5207216 - DNA, 17 bp, Homo sapiens
aggcctaggtgcagctc

SEQ ID NO: 5207217 - DNA, 22 bp, Homo sapiens
aggcctaggtgcagctcctcag

SEQ ID NO: 5207218 - DNA, 21 bp, Homo sapiens
aggcctagtaaccaaggccct

SEQ ID NO: 5207219 - DNA, 17 bp, Homo sapiens
aggcctagtacaatctt

SEQ ID NO: 5207220 - DNA, 17 bp, Homo sapiens
aggcctagtcctgcgaa

SEQ ID NO: 5207221 - DNA, 21 bp, Homo sapiens
aggcctataaaattaaatgcc

SEQ ID NO: 5207222 - DNA, 21 bp, Homo sapiens
aggcctatttaacaagatgtt

SEQ ID NO: 5207223 - DNA, 13 bp, Homo sapiens
aggcctatttcat

SEQ ID NO: 5207224 - DNA, 21 bp, Homo sapiens
aggcctcaaagcaacccgctg

SEQ ID NO: 5207225 - DNA, 17 bp, Homo sapiens
aggcctcaaatgacagt

SEQ ID NO: 5207226 - DNA, 20 bp, Homo sapiens
aggcctcacccctcccctgg

SEQ ID NO: 5207227 - DNA, 21 bp, Homo sapiens
aggcctcacccctcccctggg

SEQ ID NO: 5207228 - DNA, 23 bp, Homo sapiens
aggcctcacccctcccctgggac

SEQ ID NO: 5207229 - DNA, 18 bp, Homo sapiens
aggcctcaccctgcttgg

SEQ ID NO: 5207230 - DNA, 13 bp, Homo sapiens
aggcctcacctcc

SEQ ID NO: 5207231 - DNA, 19 bp, Homo sapiens
aggcctcacctcccagggc

SEQ ID NO: 5207232 - DNA, 13 bp, Homo sapiens
aggcctcacctgg

SEQ ID NO: 5207233 - DNA, 17 bp, Homo sapiens
aggcctcacctggcttc

SEQ ID NO: 5207234 - DNA, 18 bp, Homo sapiens
aggcctcacctggcttcc

SEQ ID NO: 5207235 - DNA, 21 bp, Homo sapiens
aggcctcacctggcttcccag

SEQ ID NO: 5207236 - DNA, 20 bp, Homo sapiens
aggcctcactggctcatgcc

SEQ ID NO: 5207237 - DNA, 13 bp, Homo sapiens
aggcctcaggaga

SEQ ID NO: 5207238 - DNA, 18 bp, Homo sapiens
aggcctcagggaccaagg

SEQ ID NO: 5207239 - DNA, 21 bp, Homo sapiens
aggcctcagggaccaaggaga

SEQ ID NO: 5207240 - DNA, 18 bp, Homo sapiens
aggcctcagggctccttg

SEQ ID NO: 5207241 - DNA, 14 bp, Homo sapiens
aggcctcaggtgct

SEQ ID NO: 5207242 - DNA, 16 bp, Homo sapiens
aggcctcagtggactt

SEQ ID NO: 5207243 - DNA, 11 bp, Homo sapiens
aggcctcagtt

SEQ ID NO: 5207244 - DNA, 18 bp, Homo sapiens
aggcctcatttctttgtc

SEQ ID NO: 5207245 - DNA, 20 bp, Homo sapiens
aggcctccaacgcccctgtg

SEQ ID NO: 5207246 - DNA, 24 bp, Homo sapiens
aggcctccaacgcccctgtggcca

SEQ ID NO: 5207247 - DNA, 11 bp, Homo sapiens
aggcctccagc

SEQ ID NO: 5207248 - DNA, 15 bp, Homo sapiens
aggcctccagctcag

SEQ ID NO: 5207249 - DNA, 16 bp, Homo sapiens
aggcctccagctcagc

SEQ ID NO: 5207250 - DNA, 17 bp, Homo sapiens
aggcctccagctcagca

SEQ ID NO: 5207251 - DNA, 14 bp, Homo sapiens
aggcctcccaagct

SEQ ID NO: 5207252 - DNA, 21 bp, Homo sapiens
aggcctcccaagctgatggac

SEQ ID NO: 5207253 - DNA, 12 bp, Homo sapiens
aggcctcccaca

SEQ ID NO: 5207254 - DNA, 14 bp, Homo sapiens
aggcctcccacagt

SEQ ID NO: 5207255 - DNA, 18 bp, Homo sapiens
aggcctcccacagtgact

SEQ ID NO: 5207256 - DNA, 19 bp, Homo sapiens
aggcctcccccagccagga

SEQ ID NO: 5207257 - DNA, 21 bp, Homo sapiens
aggcctcccgcatgctgcctg

SEQ ID NO: 5207258 - DNA, 22 bp, Homo sapiens
aggcctcccgcatgctgcctgc

SEQ ID NO: 5207259 - DNA, 18 bp, Homo sapiens
aggcctccctcaggctct

SEQ ID NO: 5207260 - DNA, 15 bp, Homo sapiens
aggcctccctctctc

SEQ ID NO: 5207261 - DNA, 22 bp, Homo sapiens
aggcctccctctctcttctgct

SEQ ID NO: 5207262 - DNA, 16 bp, Homo sapiens
aggcctccctgcctca

SEQ ID NO: 5207263 - DNA, 17 bp, Homo sapiens
aggcctccctgcctcag

SEQ ID NO: 5207264 - DNA, 12 bp, Homo sapiens
aggcctccctgt

SEQ ID NO: 5207265 - DNA, 14 bp, Homo sapiens
aggcctccctgttt

SEQ ID NO: 5207266 - DNA, 12 bp, Homo sapiens
aggcctcctagg

SEQ ID NO: 5207267 - DNA, 14 bp, Homo sapiens
aggcctcctccccc

SEQ ID NO: 5207268 - DNA, 15 bp, Homo sapiens
aggcctcctccccca

SEQ ID NO: 5207269 - DNA, 20 bp, Homo sapiens
aggcctcctcccccacccct

SEQ ID NO: 5207270 - DNA, 22 bp, Homo sapiens
aggcctcctgtggcctgccagt

SEQ ID NO: 5207271 - DNA, 21 bp, Homo sapiens
aggcctcgcacttgcagagga

SEQ ID NO: 5207272 - DNA, 14 bp, Homo sapiens
aggcctcgcaggaa

SEQ ID NO: 5207273 - DNA, 12 bp, Homo sapiens
aggcctcgcctg

SEQ ID NO: 5207274 - DNA, 16 bp, Homo sapiens
aggcctcgcctgccct

SEQ ID NO: 5207275 - DNA, 17 bp, Homo sapiens
aggcctcgcctgccctc

SEQ ID NO: 5207276 - DNA, 18 bp, Homo sapiens
aggcctcgcctgccctcc

SEQ ID NO: 5207277 - DNA, 21 bp, Homo sapiens
aggcctcgcctgccctcctct

SEQ ID NO: 5207278 - DNA, 22 bp, Homo sapiens
aggcctcggcagaactctctgt

SEQ ID NO: 5207279 - DNA, 16 bp, Homo sapiens
aggcctcggctgtctc

SEQ ID NO: 5207280 - DNA, 17 bp, Homo sapiens
aggcctcgtaccagcca

SEQ ID NO: 5207281 - DNA, 18 bp, Homo sapiens
aggcctcgtaccagccag

SEQ ID NO: 5207282 - DNA, 19 bp, Homo sapiens
aggcctcgtaccagccagg

SEQ ID NO: 5207283 - DNA, 21 bp, Homo sapiens
aggcctcgtaccagccaggat

SEQ ID NO: 5207284 - DNA, 22 bp, Homo sapiens
aggcctcgtaccagccaggatc

SEQ ID NO: 5207285 - DNA, 19 bp, Homo sapiens
aggcctctactaggtctgc

SEQ ID NO: 5207286 - DNA, 21 bp, Homo sapiens
aggcctctactaggtctgctc

SEQ ID NO: 5207287 - DNA, 23 bp, Homo sapiens
aggcctctactaggtctgctcct

SEQ ID NO: 5207288 - DNA, 22 bp, Homo sapiens
aggcctctcaccccacttccca

SEQ ID NO: 5207289 - DNA, 17 bp, Homo sapiens
aggcctctcagacccag

SEQ ID NO: 5207290 - DNA, 21 bp, Homo sapiens
aggcctctcattccagaggaa

SEQ ID NO: 5207291 - DNA, 12 bp, Homo sapiens
aggaagcacagg

SEQ ID NO: 5207292 - DNA, 13 bp, Homo sapiens
aggaagcacaggc

SEQ ID NO: 5207293 - DNA, 16 bp, Homo sapiens
aggaagcacaggtcca

SEQ ID NO: 5207294 - DNA, 22 bp, Homo sapiens
aggaagcacaggtccaaggctg

SEQ ID NO: 5207295 - DNA, 16 bp, Homo sapiens
aggaagcacatgcctc

SEQ ID NO: 5207296 - DNA, 12 bp, Homo sapiens
aggaagcagaat

SEQ ID NO: 5207297 - DNA, 17 bp, Homo sapiens
aggaagcagaataaagc

SEQ ID NO: 5207298 - DNA, 22 bp, Homo sapiens
aggaagcagaggtcttcagggc

SEQ ID NO: 5207299 - DNA, 20 bp, Homo sapiens
aggaagcagcctcagagtgg

SEQ ID NO: 5207300 - DNA, 11 bp, Homo sapiens
aggaagcaggg

SEQ ID NO: 5207301 - DNA, 13 bp, Homo sapiens
aggaagcagggag

SEQ ID NO: 5207302 - DNA, 15 bp, Homo sapiens
aggaagcagggagag

SEQ ID NO: 5207303 - DNA, 19 bp, Homo sapiens
aggaagcagttggggccct

SEQ ID NO: 5207304 - DNA, 20 bp, Homo sapiens
aggaagcagttggggccctc

SEQ ID NO: 5207305 - DNA, 21 bp, Homo sapiens
aggaagcagttggggccctct

SEQ ID NO: 5207306 - DNA, 22 bp, Homo sapiens
aggaagcagttggggccctctt

SEQ ID NO: 5207307 - DNA, 16 bp, Homo sapiens
aggaagcatgagtgct

SEQ ID NO: 5207308 - DNA, 23 bp, Homo sapiens
aggaagcattgcttttggacaag

SEQ ID NO: 5207309 - DNA, 17 bp, Homo sapiens
aggaagcattgtaaaat

SEQ ID NO: 5207310 - DNA, 22 bp, Homo sapiens
aggaagccacgtgctggagagt

SEQ ID NO: 5207311 - DNA, 19 bp, Homo sapiens
aggaagccagagccccaag

SEQ ID NO: 5207312 - DNA, 14 bp, Homo sapiens
aggaagccagcagg

SEQ ID NO: 5207313 - DNA, 17 bp, Homo sapiens
aggaagccagcaggctc

SEQ ID NO: 5207314 - DNA, 21 bp, Homo sapiens
aggaagccagcaggctctcag

SEQ ID NO: 5207315 - DNA, 14 bp, Homo sapiens
aggaagccaggctg

SEQ ID NO: 5207316 - DNA, 14 bp, Homo sapiens
aggaagccagtgga

SEQ ID NO: 5207317 - DNA, 16 bp, Homo sapiens
aggaagcccacactat

SEQ ID NO: 5207318 - DNA, 15 bp, Homo sapiens
aggaagcccacatat

SEQ ID NO: 5207319 - DNA, 17 bp, Homo sapiens
aggaagcccacatattc

SEQ ID NO: 5207320 - DNA, 21 bp, Homo sapiens
aggaagcccaccaatctgccc

SEQ ID NO: 5207321 - DNA, 19 bp, Homo sapiens
aggaagcccactgcctcct

SEQ ID NO: 5207322 - DNA, 20 bp, Homo sapiens
aggaagcccaggagcctcac

SEQ ID NO: 5207323 - DNA, 18 bp, Homo sapiens
aggaagccccgctcaggt

SEQ ID NO: 5207324 - DNA, 21 bp, Homo sapiens
aggaagcccctgagtcctgag

SEQ ID NO: 5207325 - DNA, 14 bp, Homo sapiens
aggaagccctctca

SEQ ID NO: 5207326 - DNA, 19 bp, Homo sapiens
aggaagccctctcagatca

SEQ ID NO: 5207327 - DNA, 20 bp, Homo sapiens
aggaagccgctggggccagt

SEQ ID NO: 5207328 - DNA, 19 bp, Homo sapiens
aggaagccggggaagagat

SEQ ID NO: 5207329 - DNA, 14 bp, Homo sapiens
aggaagccgtcctg

SEQ ID NO: 5207330 - DNA, 21 bp, Homo sapiens
aggaagccgtgccctgccccc

SEQ ID NO: 5207331 - DNA, 20 bp, Homo sapiens
aggaagccgttgaatctggg

SEQ ID NO: 5207332 - DNA, 21 bp, Homo sapiens
aggaagccgttgaatctggga

SEQ ID NO: 5207333 - DNA, 13 bp, Homo sapiens
aggaagcctcaag

SEQ ID NO: 5207334 - DNA, 20 bp, Homo sapiens
aggaagcctcagattccttc

SEQ ID NO: 5207335 - DNA, 16 bp, Homo sapiens
aggaagcctcctgctg

SEQ ID NO: 5207336 - DNA, 15 bp, Homo sapiens
aggaagcctgaggca

SEQ ID NO: 5207337 - DNA, 21 bp, Homo sapiens
aggaagcctgattaaagaatg

SEQ ID NO: 5207338 - DNA, 16 bp, Homo sapiens
aggaagctcagactgg

SEQ ID NO: 5207339 - DNA, 14 bp, Homo sapiens
aggaagctcagcct

SEQ ID NO: 5207340 - DNA, 17 bp, Homo sapiens
aggaagctcagccttct

SEQ ID NO: 5207341 - DNA, 14 bp, Homo sapiens
aggaagctcagggc

SEQ ID NO: 5207342 - DNA, 15 bp, Homo sapiens
aggaagctcagggcc

SEQ ID NO: 5207343 - DNA, 22 bp, Homo sapiens
aggaagctcagggcctggctca

SEQ ID NO: 5207344 - DNA, 20 bp, Homo sapiens
aggaagctgtgttgaaacag

SEQ ID NO: 5207345 - DNA, 17 bp, Homo sapiens
aggaagctttctctgct

SEQ ID NO: 5207346 - DNA, 21 bp, Homo sapiens
aggaagctttctctgcttcag

SEQ ID NO: 5207347 - DNA, 14 bp, Homo sapiens
aggaagctttggaa

SEQ ID NO: 5207348 - DNA, 21 bp, Homo sapiens
aggaagctttggaagcagcaa

SEQ ID NO: 5207349 - DNA, 24 bp, Homo sapiens
aggaaggaaacatagaaagacatg

SEQ ID NO: 5207350 - DNA, 15 bp, Homo sapiens
aggaaggaacaaaga

SEQ ID NO: 5207351 - DNA, 12 bp, Homo sapiens
aggaaggaagca

SEQ ID NO: 5207352 - DNA, 20 bp, Homo sapiens
aggaaggacagactggccgg

SEQ ID NO: 5207353 - DNA, 23 bp, Homo sapiens
aggaaggaccaggctggggccag

SEQ ID NO: 5207354 - DNA, 18 bp, Homo sapiens
aggaaggacccctcacca

SEQ ID NO: 5207355 - DNA, 19 bp, Homo sapiens
aggaaggacttacccagta

SEQ ID NO: 5207356 - DNA, 19 bp, Homo sapiens
aggaaggagactcacctct

SEQ ID NO: 5207357 - DNA, 21 bp, Homo sapiens
aggaaggagagaaggggagga

SEQ ID NO: 5207358 - DNA, 21 bp, Homo sapiens
aggaaggagagatgaccccta

SEQ ID NO: 5207359 - DNA, 15 bp, Homo sapiens
aggaaggagagcctg

SEQ ID NO: 5207360 - DNA, 15 bp, Homo sapiens
aggaaggagattcca

SEQ ID NO: 5207361 - DNA, 15 bp, Homo sapiens
aggaaggagccagct

SEQ ID NO: 5207362 - DNA, 18 bp, Homo sapiens
aggaaggagccagctccc

SEQ ID NO: 5207363 - DNA, 21 bp, Homo sapiens
aggaaggagcggcgccctgga

SEQ ID NO: 5207364 - DNA, 12 bp, Homo sapiens
aggaaggagctg

SEQ ID NO: 5207365 - DNA, 13 bp, Homo sapiens
aggaaggagctgc

SEQ ID NO: 5207366 - DNA, 16 bp, Homo sapiens
aggaaggagctgcctg

SEQ ID NO: 5207367 - DNA, 19 bp, Homo sapiens
aggaaggagctgcctggac

SEQ ID NO: 5207368 - DNA, 14 bp, Homo sapiens
aggaaggaggcaga

SEQ ID NO: 5207369 - DNA, 14 bp, Homo sapiens
aggaaggagggcac

SEQ ID NO: 5207370 - DNA, 17 bp, Homo sapiens
aggaaggatgagcattt

SEQ ID NO: 5207371 - DNA, 14 bp, Homo sapiens
aggaaggattgtaa

SEQ ID NO: 5207372 - DNA, 15 bp, Homo sapiens
aggaaggattgtaaa

SEQ ID NO: 5207373 - DNA, 17 bp, Homo sapiens
aggaaggattgtaaaaa

SEQ ID NO: 5207374 - DNA, 14 bp, Homo sapiens
aggaaggcaagagg

SEQ ID NO: 5207375 - DNA, 16 bp, Homo sapiens
aggaaggcagcattcc

SEQ ID NO: 5207376 - DNA, 15 bp, Homo sapiens
aggaaggcaggaggg

SEQ ID NO: 5207377 - DNA, 16 bp, Homo sapiens
aggaaggcagggagga

SEQ ID NO: 5207378 - DNA, 18 bp, Homo sapiens
aggaaggcagggaggagg

SEQ ID NO: 5207379 - DNA, 20 bp, Homo sapiens
aggaaggcagggaggaggca

SEQ ID NO: 5207380 - DNA, 22 bp, Homo sapiens
aggaaggcagggaggaggcaga

SEQ ID NO: 5207381 - DNA, 21 bp, Homo sapiens
aggaaggccaaaatcaagagt

SEQ ID NO: 5207382 - DNA, 13 bp, Homo sapiens
aggaaggcctggg

SEQ ID NO: 5207383 - DNA, 12 bp, Homo sapiens
aggaaggccttt

SEQ ID NO: 5207384 - DNA, 18 bp, Homo sapiens
aggaaggcctttcttctg

SEQ ID NO: 5207385 - DNA, 21 bp, Homo sapiens
aggaaggcctttcttctgtgt

SEQ ID NO: 5207386 - DNA, 18 bp, Homo sapiens
aggaaggcggcaggcaga

SEQ ID NO: 5207387 - DNA, 19 bp, Homo sapiens
aggaaggcggcaggcagag

SEQ ID NO: 5207388 - DNA, 21 bp, Homo sapiens
aggaaggcggcaggcagagaa

SEQ ID NO: 5207389 - DNA, 18 bp, Homo sapiens
aggaaggcgtgtccagga

SEQ ID NO: 5207390 - DNA, 12 bp, Homo sapiens
aggaaggctctc

SEQ ID NO: 5207391 - DNA, 15 bp, Homo sapiens
aggaaggctgagagg

SEQ ID NO: 5207392 - DNA, 15 bp, Homo sapiens
aggaaggctgtctca

SEQ ID NO: 5207393 - DNA, 19 bp, Homo sapiens
aggaaggcttgttgtgctt

SEQ ID NO: 5207394 - DNA, 22 bp, Homo sapiens
aggaaggcttgttgtgctttta

SEQ ID NO: 5207395 - DNA, 13 bp, Homo sapiens
aggaagggaagcg

SEQ ID NO: 5207396 - DNA, 16 bp, Homo sapiens
aggaagggacacacac

SEQ ID NO: 5207397 - DNA, 23 bp, Homo sapiens
aggaagggaccaaggcaaggcag

SEQ ID NO: 5207398 - DNA, 17 bp, Homo sapiens
aggaagggactggtcca

SEQ ID NO: 5207399 - DNA, 20 bp, Homo sapiens
aggaagggactggtccaggc

SEQ ID NO: 5207400 - DNA, 13 bp, Homo sapiens
aggaagggaggcc

SEQ ID NO: 5207401 - DNA, 18 bp, Homo sapiens
aggaagggaggcctgagg

SEQ ID NO: 5207402 - DNA, 14 bp, Homo sapiens
aggaagggagtgag

SEQ ID NO: 5207403 - DNA, 19 bp, Homo sapiens
aggaagggagtgaggggct

SEQ ID NO: 5207404 - DNA, 16 bp, Homo sapiens
aggaagggatctgaga

SEQ ID NO: 5207405 - DNA, 17 bp, Homo sapiens
aggaagggatctgagaa

SEQ ID NO: 5207406 - DNA, 20 bp, Homo sapiens
aggaagggcatccttctgcc

SEQ ID NO: 5207407 - DNA, 20 bp, Homo sapiens
aggaagggccagagcctggt

SEQ ID NO: 5207408 - DNA, 13 bp, Homo sapiens
aggaagggccagg

SEQ ID NO: 5207409 - DNA, 14 bp, Homo sapiens
aggaagggccagga

SEQ ID NO: 5207410 - DNA, 17 bp, Homo sapiens
aggaagggccaggagag

SEQ ID NO: 5207411 - DNA, 18 bp, Homo sapiens
aggaagggccaggagaga

SEQ ID NO: 5207412 - DNA, 16 bp, Homo sapiens
aggaagggctgggcca

SEQ ID NO: 5207413 - DNA, 20 bp, Homo sapiens
aggaagggctgggccaccag

SEQ ID NO: 5207414 - DNA, 18 bp, Homo sapiens
aggaaggggccagaggct

SEQ ID NO: 5207415 - DNA, 16 bp, Homo sapiens
aggaaggggctggact

SEQ ID NO: 5207416 - DNA, 17 bp, Homo sapiens
aggaaggggctggactg

SEQ ID NO: 5207417 - DNA, 20 bp, Homo sapiens
aggaaggggtgctgtgaggc

SEQ ID NO: 5207418 - DNA, 15 bp, Homo sapiens
aggaaggtactgtat

SEQ ID NO: 5207419 - DNA, 18 bp, Homo sapiens
aggaaggtactgtatgat

SEQ ID NO: 5207420 - DNA, 16 bp, Homo sapiens
aggaaggtagcccagc

SEQ ID NO: 5207421 - DNA, 16 bp, Homo sapiens
aggaaggtcatttcca

SEQ ID NO: 5207422 - DNA, 19 bp, Homo sapiens
aggaaggtgaatctgccct

SEQ ID NO: 5207423 - DNA, 16 bp, Homo sapiens
aggaaggtgcctggcc

SEQ ID NO: 5207424 - DNA, 14 bp, Homo sapiens
aggaaggtgtgatg

SEQ ID NO: 5207425 - DNA, 23 bp, Homo sapiens
aggaagtaattttcttctcattc

SEQ ID NO: 5207426 - DNA, 15 bp, Homo sapiens
aggaagtagcacagg

SEQ ID NO: 5207427 - DNA, 15 bp, Homo sapiens
aggaagtagtccagc

SEQ ID NO: 5207428 - DNA, 22 bp, Homo sapiens
aggaagtagtccagccttccag

SEQ ID NO: 5207429 - DNA, 18 bp, Homo sapiens
aggaagtatgagtgctga

SEQ ID NO: 5207430 - DNA, 21 bp, Homo sapiens
aggaagtcaggagccagcagg

SEQ ID NO: 5207431 - DNA, 17 bp, Homo sapiens
aggaagtctaggagctg

SEQ ID NO: 5207432 - DNA, 14 bp, Homo sapiens
aggaagtcttcaaa

SEQ ID NO: 5207433 - DNA, 15 bp, Homo sapiens
aggaagtcttcaaat

SEQ ID NO: 5207434 - DNA, 16 bp, Homo sapiens
aggaagtcttcaaatt

SEQ ID NO: 5207435 - DNA, 23 bp, Homo sapiens
aggaagtgacttgaatgtacaaa

SEQ ID NO: 5207436 - DNA, 22 bp, Homo sapiens
aggaagtgagcagtcgcctgcc

SEQ ID NO: 5207437 - DNA, 18 bp, Homo sapiens
aggaagtgagccagcagt

SEQ ID NO: 5207438 - DNA, 16 bp, Homo sapiens
aggaagtgctaatggg

SEQ ID NO: 5207439 - DNA, 20 bp, Homo sapiens
aggaagtgcttattctctca

SEQ ID NO: 5207440 - DNA, 17 bp, Homo sapiens
aggaagtggctcagacc

SEQ ID NO: 5207441 - DNA, 12 bp, Homo sapiens
aggaagtggctg

SEQ ID NO: 5207442 - DNA, 22 bp, Homo sapiens
aggaagtggctggtctggagtc

SEQ ID NO: 5207443 - DNA, 14 bp, Homo sapiens
aggaagtgggagaa

SEQ ID NO: 5207444 - DNA, 17 bp, Homo sapiens
aggaagtgggagaagtg

SEQ ID NO: 5207445 - DNA, 24 bp, Homo sapiens
aggaagtgggggccgctggcccag

SEQ ID NO: 5207446 - DNA, 17 bp, Homo sapiens
aggaagtgtaacagctg

SEQ ID NO: 5207447 - DNA, 18 bp, Homo sapiens
aggaagtgtaacagctga

SEQ ID NO: 5207448 - DNA, 21 bp, Homo sapiens
aggaagttctccagcttcagc

SEQ ID NO: 5207449 - DNA, 23 bp, Homo sapiens
aggaagttgacttatagtacatg

SEQ ID NO: 5207450 - DNA, 17 bp, Homo sapiens
aggaagttggctgagcc

SEQ ID NO: 5207451 - DNA, 15 bp, Homo sapiens
aggaagttttgtcta

SEQ ID NO: 5207452 - DNA, 16 bp, Homo sapiens
aggaagttttttctac

SEQ ID NO: 5207453 - DNA, 11 bp, Homo sapiens
aggaataaaga

SEQ ID NO: 5207454 - DNA, 18 bp, Homo sapiens
aggaataaagctgtgagc

SEQ ID NO: 5207455 - DNA, 17 bp, Homo sapiens
aggaataaagcttctct

SEQ ID NO: 5207456 - DNA, 20 bp, Homo sapiens
aggaataaagcttctctctg

SEQ ID NO: 5207457 - DNA, 22 bp, Homo sapiens
aggaataaagcttctctctgag

SEQ ID NO: 5207458 - DNA, 16 bp, Homo sapiens
aggaataaatgccttt

SEQ ID NO: 5207459 - DNA, 19 bp, Homo sapiens
aggaataaggcccagagcg

SEQ ID NO: 5207460 - DNA, 14 bp, Homo sapiens
aggaataaggcctt

SEQ ID NO: 5207461 - DNA, 14 bp, Homo sapiens
aggaataataaatt

SEQ ID NO: 5207462 - DNA, 16 bp, Homo sapiens
aggaataataaattca

SEQ ID NO: 5207463 - DNA, 17 bp, Homo sapiens
aggaataataaattcat

SEQ ID NO: 5207464 - DNA, 16 bp, Homo sapiens
aggaataattatttat

SEQ ID NO: 5207465 - DNA, 18 bp, Homo sapiens
aggaataattatttattt

SEQ ID NO: 5207466 - DNA, 13 bp, Homo sapiens
aggaatacatttt

SEQ ID NO: 5207467 - DNA, 16 bp, Homo sapiens
aggaatacattttatt

SEQ ID NO: 5207468 - DNA, 18 bp, Homo sapiens
aggaatacattttattct

SEQ ID NO: 5207469 - DNA, 15 bp, Homo sapiens
aggaatacctgtccc

SEQ ID NO: 5207470 - DNA, 19 bp, Homo sapiens
aggcctctccatttgctct

SEQ ID NO: 5207471 - DNA, 23 bp, Homo sapiens
aggcctctcggtgctccatctcc

SEQ ID NO: 5207472 - DNA, 12 bp, Homo sapiens
aggcctctctca

SEQ ID NO: 5207473 - DNA, 15 bp, Homo sapiens
aggcctctctctgcc

SEQ ID NO: 5207474 - DNA, 18 bp, Homo sapiens
aggcctctcttttccccg

SEQ ID NO: 5207475 - DNA, 17 bp, Homo sapiens
aggcctctgagcccaag

SEQ ID NO: 5207476 - DNA, 18 bp, Homo sapiens
aggcctctgagcccaagc

SEQ ID NO: 5207477 - DNA, 12 bp, Homo sapiens
aggcctctgagg

SEQ ID NO: 5207478 - DNA, 14 bp, Homo sapiens
aggcctctgaggag

SEQ ID NO: 5207479 - DNA, 12 bp, Homo sapiens
aggcctctgcag

SEQ ID NO: 5207480 - DNA, 15 bp, Homo sapiens
aggcctctgcagaag

SEQ ID NO: 5207481 - DNA, 12 bp, Homo sapiens
aggcctctgcct

SEQ ID NO: 5207482 - DNA, 14 bp, Homo sapiens
aggcctctgcctgc

SEQ ID NO: 5207483 - DNA, 21 bp, Homo sapiens
aggcctctgcctgctggggat

SEQ ID NO: 5207484 - DNA, 13 bp, Homo sapiens
aggcctctgctgg

SEQ ID NO: 5207485 - DNA, 20 bp, Homo sapiens
aggcctctgctggctcagga

SEQ ID NO: 5207486 - DNA, 15 bp, Homo sapiens
aggcctctggccctc

SEQ ID NO: 5207487 - DNA, 14 bp, Homo sapiens
aggcctctgtgtcc

SEQ ID NO: 5207488 - DNA, 20 bp, Homo sapiens
aggcctcttgctgaaagcca

SEQ ID NO: 5207489 - DNA, 18 bp, Homo sapiens
aggcctcttggacctctg

SEQ ID NO: 5207490 - DNA, 21 bp, Homo sapiens
aggcctcttggacctctgctc

SEQ ID NO: 5207491 - DNA, 15 bp, Homo sapiens
aggcctcttgtgctc

SEQ ID NO: 5207492 - DNA, 23 bp, Homo sapiens
aggcctgaaagaggctgaggcct

SEQ ID NO: 5207493 - DNA, 18 bp, Homo sapiens
aggcctgaaatcctggtt

SEQ ID NO: 5207494 - DNA, 20 bp, Homo sapiens
aggcctgaaatgacatttca

SEQ ID NO: 5207495 - DNA, 21 bp, Homo sapiens
aggcctgaactaggtgctggc

SEQ ID NO: 5207496 - DNA, 19 bp, Homo sapiens
aggcctgaagccagctgcc

SEQ ID NO: 5207497 - DNA, 20 bp, Homo sapiens
aggcctgaatccaaaagaaa

SEQ ID NO: 5207498 - DNA, 21 bp, Homo sapiens
aggcctgacacaggccagcct

SEQ ID NO: 5207499 - DNA, 14 bp, Homo sapiens
aggcctgacccacg

SEQ ID NO: 5207500 - DNA, 17 bp, Homo sapiens
aggcctgacccacgggg

SEQ ID NO: 5207501 - DNA, 16 bp, Homo sapiens
aggcctgactactgcc

SEQ ID NO: 5207502 - DNA, 16 bp, Homo sapiens
aggcctgactgccaag

SEQ ID NO: 5207503 - DNA, 14 bp, Homo sapiens
aggcctgagaatga

SEQ ID NO: 5207504 - DNA, 19 bp, Homo sapiens
aggcctgagaatgagtggg

SEQ ID NO: 5207505 - DNA, 21 bp, Homo sapiens
aggcctgagaatgagtgggaa

SEQ ID NO: 5207506 - DNA, 23 bp, Homo sapiens
aggcctgagaatgagtgggaatc

SEQ ID NO: 5207507 - DNA, 14 bp, Homo sapiens
aggcctgagaccca

SEQ ID NO: 5207508 - DNA, 17 bp, Homo sapiens
aggcctgagacccagga

SEQ ID NO: 5207509 - DNA, 22 bp, Homo sapiens
aggcctgagatttcatctgctc

SEQ ID NO: 5207510 - DNA, 13 bp, Homo sapiens
aggcctgagcccc

SEQ ID NO: 5207511 - DNA, 22 bp, Homo sapiens
aggcctgagcgctcctgccgca

SEQ ID NO: 5207512 - DNA, 12 bp, Homo sapiens
aggcctgagctg

SEQ ID NO: 5207513 - DNA, 14 bp, Homo sapiens
aggcctgaggatga

SEQ ID NO: 5207514 - DNA, 18 bp, Homo sapiens
aggcctgagggaagccca

SEQ ID NO: 5207515 - DNA, 14 bp, Homo sapiens
aggcctgaggggca

SEQ ID NO: 5207516 - DNA, 16 bp, Homo sapiens
aggcctgaggggcaga

SEQ ID NO: 5207517 - DNA, 19 bp, Homo sapiens
aggcctgaggttactggaa

SEQ ID NO: 5207518 - DNA, 19 bp, Homo sapiens
aggcctgagttagctgttt

SEQ ID NO: 5207519 - DNA, 23 bp, Homo sapiens
aggcctgatcttgcctgtctggc

SEQ ID NO: 5207520 - DNA, 22 bp, Homo sapiens
aggcctgattcactggcctggc

SEQ ID NO: 5207521 - DNA, 13 bp, Homo sapiens
aggcctgcacaca

SEQ ID NO: 5207522 - DNA, 13 bp, Homo sapiens
aggcctgcagccc

SEQ ID NO: 5207523 - DNA, 15 bp, Homo sapiens
aggcctgcagcccct

SEQ ID NO: 5207524 - DNA, 16 bp, Homo sapiens
aggcctgcagccccta

SEQ ID NO: 5207525 - DNA, 22 bp, Homo sapiens
aggcctgccaatgccacagcca

SEQ ID NO: 5207526 - DNA, 12 bp, Homo sapiens
aggcctgccagc

SEQ ID NO: 5207527 - DNA, 16 bp, Homo sapiens
aggcctgccagcccct

SEQ ID NO: 5207528 - DNA, 16 bp, Homo sapiens
aggcctgccccccttc

SEQ ID NO: 5207529 - DNA, 14 bp, Homo sapiens
aggcctgccccctg

SEQ ID NO: 5207530 - DNA, 22 bp, Homo sapiens
aggcctgccctcacgctctcca

SEQ ID NO: 5207531 - DNA, 17 bp, Homo sapiens
aggcctgccctcaggga

SEQ ID NO: 5207532 - DNA, 12 bp, Homo sapiens
aggcctgccctg

SEQ ID NO: 5207533 - DNA, 14 bp, Homo sapiens
aggcctgccctgct

SEQ ID NO: 5207534 - DNA, 19 bp, Homo sapiens
aggcctgcctccagggctg

SEQ ID NO: 5207535 - DNA, 14 bp, Homo sapiens
aggcctgcctgcat

SEQ ID NO: 5207536 - DNA, 15 bp, Homo sapiens
aggcctgccttctca

SEQ ID NO: 5207537 - DNA, 17 bp, Homo sapiens
aggcctgccttctcagg

SEQ ID NO: 5207538 - DNA, 17 bp, Homo sapiens
aggcctgcgaccctggg

SEQ ID NO: 5207539 - DNA, 18 bp, Homo sapiens
aggcctgcgggcccctgg

SEQ ID NO: 5207540 - DNA, 20 bp, Homo sapiens
aggcctgcgggcccctggtg

SEQ ID NO: 5207541 - DNA, 17 bp, Homo sapiens
aggcctgcgtgcgctgg

SEQ ID NO: 5207542 - DNA, 19 bp, Homo sapiens
aggcctgcgtgtgtctgtg

SEQ ID NO: 5207543 - DNA, 18 bp, Homo sapiens
aggcctgctagtcactgg

SEQ ID NO: 5207544 - DNA, 19 bp, Homo sapiens
aggcctgctagtcactgga

SEQ ID NO: 5207545 - DNA, 23 bp, Homo sapiens
aggcctgctccctgtagggtcca

SEQ ID NO: 5207546 - DNA, 17 bp, Homo sapiens
aggcctgctgccagtgc

SEQ ID NO: 5207547 - DNA, 16 bp, Homo sapiens
aggcctgctggcatca

SEQ ID NO: 5207548 - DNA, 19 bp, Homo sapiens
aggcctgcttgactttcca

SEQ ID NO: 5207549 - DNA, 20 bp, Homo sapiens
aggcctggacgggccctcct

SEQ ID NO: 5207550 - DNA, 21 bp, Homo sapiens
aggcctggacgggccctcctt

SEQ ID NO: 5207551 - DNA, 22 bp, Homo sapiens
aggcctggacgggccctccttc

SEQ ID NO: 5207552 - DNA, 19 bp, Homo sapiens
aggcctggactttcctgca

SEQ ID NO: 5207553 - DNA, 22 bp, Homo sapiens
aggcctggactttcctgcaact

SEQ ID NO: 5207554 - DNA, 20 bp, Homo sapiens
aggcctggagcgtttgctgt

SEQ ID NO: 5207555 - DNA, 18 bp, Homo sapiens
aggcctggagttgggctg

SEQ ID NO: 5207556 - DNA, 18 bp, Homo sapiens
aggcctggcacagtgtct

SEQ ID NO: 5207557 - DNA, 23 bp, Homo sapiens
aggcctggcacagtgtctgggct

SEQ ID NO: 5207558 - DNA, 22 bp, Homo sapiens
aggcctggcatcttctggagaa

SEQ ID NO: 5207559 - DNA, 20 bp, Homo sapiens
aggcctggccaatgcggccc

SEQ ID NO: 5207560 - DNA, 13 bp, Homo sapiens
aggcctggccaga

SEQ ID NO: 5207561 - DNA, 16 bp, Homo sapiens
aggcctggccagatgc

SEQ ID NO: 5207562 - DNA, 14 bp, Homo sapiens
aggcctggccaggc

SEQ ID NO: 5207563 - DNA, 19 bp, Homo sapiens
aggcctggcccagccagca

SEQ ID NO: 5207564 - DNA, 13 bp, Homo sapiens
aggcctggccctt

SEQ ID NO: 5207565 - DNA, 15 bp, Homo sapiens
aggcctggccctttc

SEQ ID NO: 5207566 - DNA, 16 bp, Homo sapiens
aggcctggcctcaact

SEQ ID NO: 5207567 - DNA, 17 bp, Homo sapiens
aggcctggcctcatctc

SEQ ID NO: 5207568 - DNA, 19 bp, Homo sapiens
aggcctggcctcgcctgcc

SEQ ID NO: 5207569 - DNA, 17 bp, Homo sapiens
aggcctggcctctgggc

SEQ ID NO: 5207570 - DNA, 15 bp, Homo sapiens
aggcctggccttgtc

SEQ ID NO: 5207571 - DNA, 21 bp, Homo sapiens
aggcctggccttgtcaggacc

SEQ ID NO: 5207572 - DNA, 23 bp, Homo sapiens
aggcctggccttgtcaggaccca

SEQ ID NO: 5207573 - DNA, 21 bp, Homo sapiens
aggcctggcgtagcacccaca

SEQ ID NO: 5207574 - DNA, 20 bp, Homo sapiens
aggcctggctcattctgcac

SEQ ID NO: 5207575 - DNA, 22 bp, Homo sapiens
aggcctggctcattctgcacct

SEQ ID NO: 5207576 - DNA, 15 bp, Homo sapiens
aggcctggctccccg

SEQ ID NO: 5207577 - DNA, 16 bp, Homo sapiens
aggcctggctccccga

SEQ ID NO: 5207578 - DNA, 12 bp, Homo sapiens
aggcctggctgg

SEQ ID NO: 5207579 - DNA, 14 bp, Homo sapiens
aggcctggctggaa

SEQ ID NO: 5207580 - DNA, 16 bp, Homo sapiens
aggcctgggacccagc

SEQ ID NO: 5207581 - DNA, 17 bp, Homo sapiens
aggcctgggacccagct

SEQ ID NO: 5207582 - DNA, 18 bp, Homo sapiens
aggcctgggacccagcta

SEQ ID NO: 5207583 - DNA, 20 bp, Homo sapiens
aggcctgggacccagctact

SEQ ID NO: 5207584 - DNA, 17 bp, Homo sapiens
aggcctgggagggcaag

SEQ ID NO: 5207585 - DNA, 18 bp, Homo sapiens
aggcctgggatgcagtga

SEQ ID NO: 5207586 - DNA, 18 bp, Homo sapiens
aggcctgggcaggaccct

SEQ ID NO: 5207587 - DNA, 20 bp, Homo sapiens
aggcctgggccgctgccacg

SEQ ID NO: 5207588 - DNA, 21 bp, Homo sapiens
aggcctgggccgctgccacgt

SEQ ID NO: 5207589 - DNA, 23 bp, Homo sapiens
aggcctgggggacccctggctct

SEQ ID NO: 5207590 - DNA, 23 bp, Homo sapiens
aggcctgggggctgggcagagga

SEQ ID NO: 5207591 - DNA, 18 bp, Homo sapiens
aggcctggggtgggacag

SEQ ID NO: 5207592 - DNA, 21 bp, Homo sapiens
aggcctgggtcacgctcaagg

SEQ ID NO: 5207593 - DNA, 17 bp, Homo sapiens
aggcctgggtctgtgtc

SEQ ID NO: 5207594 - DNA, 22 bp, Homo sapiens
aggcctgggtgatctgctgctg

SEQ ID NO: 5207595 - DNA, 23 bp, Homo sapiens
aggcctgggtgctggctgcccag

SEQ ID NO: 5207596 - DNA, 23 bp, Homo sapiens
aggcctgggtgtgacctgacacc

SEQ ID NO: 5207597 - DNA, 15 bp, Homo sapiens
aggcctggtcagcag

SEQ ID NO: 5207598 - DNA, 17 bp, Homo sapiens
aggcctggtcagcagag

SEQ ID NO: 5207599 - DNA, 19 bp, Homo sapiens
aggcctggtcagcagagcc

SEQ ID NO: 5207600 - DNA, 22 bp, Homo sapiens
aggcctggtcagcagagccgcc

SEQ ID NO: 5207601 - DNA, 12 bp, Homo sapiens
aggcctggtctg

SEQ ID NO: 5207602 - DNA, 17 bp, Homo sapiens
aggcctggtgccctggc

SEQ ID NO: 5207603 - DNA, 15 bp, Homo sapiens
aggcctgtccaccct

SEQ ID NO: 5207604 - DNA, 18 bp, Homo sapiens
aggcctgtcccaattctg

SEQ ID NO: 5207605 - DNA, 14 bp, Homo sapiens
aggcctgtccctgg

SEQ ID NO: 5207606 - DNA, 23 bp, Homo sapiens
aggcctgtccctggccatctctg

SEQ ID NO: 5207607 - DNA, 18 bp, Homo sapiens
aggcctgtccctgggagt

SEQ ID NO: 5207608 - DNA, 18 bp, Homo sapiens
aggcctgtcccttgcctc

SEQ ID NO: 5207609 - DNA, 19 bp, Homo sapiens
aggcctgtcccttgcctct

SEQ ID NO: 5207610 - DNA, 17 bp, Homo sapiens
aggcctgtctgtgacct

SEQ ID NO: 5207611 - DNA, 16 bp, Homo sapiens
aggcctgtgatccagg

SEQ ID NO: 5207612 - DNA, 13 bp, Homo sapiens
aggcctgtgccca

SEQ ID NO: 5207613 - DNA, 19 bp, Homo sapiens
aggcctgtgcccactccct

SEQ ID NO: 5207614 - DNA, 19 bp, Homo sapiens
aggcctgtgctagaagctc

SEQ ID NO: 5207615 - DNA, 20 bp, Homo sapiens
aggcctgtggggagccgagg

SEQ ID NO: 5207616 - DNA, 21 bp, Homo sapiens
aggcctgtgtagctgtgacct

SEQ ID NO: 5207617 - DNA, 24 bp, Homo sapiens
aggcctgtgtagctgtgacctgct

SEQ ID NO: 5207618 - DNA, 12 bp, Homo sapiens
aggcctgtgtgt

SEQ ID NO: 5207619 - DNA, 23 bp, Homo sapiens
aggcctgtgtgtaagctgactgg

SEQ ID NO: 5207620 - DNA, 22 bp, Homo sapiens
aggccttaatggacattgactt

SEQ ID NO: 5207621 - DNA, 18 bp, Homo sapiens
aggccttatcattcattc

SEQ ID NO: 5207622 - DNA, 20 bp, Homo sapiens
aggccttatcattcattctt

SEQ ID NO: 5207623 - DNA, 17 bp, Homo sapiens
aggccttatctgaaagg

SEQ ID NO: 5207624 - DNA, 21 bp, Homo sapiens
aggccttatctgaaaggccag

SEQ ID NO: 5207625 - DNA, 22 bp, Homo sapiens
aggccttatctgaaaggccagc

SEQ ID NO: 5207626 - DNA, 16 bp, Homo sapiens
aggccttcagacacat

SEQ ID NO: 5207627 - DNA, 18 bp, Homo sapiens
aggccttcatcctcctcc

SEQ ID NO: 5207628 - DNA, 16 bp, Homo sapiens
aggccttccagctgct

SEQ ID NO: 5207629 - DNA, 17 bp, Homo sapiens
aggccttccagctgctg

SEQ ID NO: 5207630 - DNA, 17 bp, Homo sapiens
aggccttcccctggcac

SEQ ID NO: 5207631 - DNA, 14 bp, Homo sapiens
aggccttccctgtc

SEQ ID NO: 5207632 - DNA, 14 bp, Homo sapiens
aggccttccgccag

SEQ ID NO: 5207633 - DNA, 18 bp, Homo sapiens
aggccttcctctctccag

SEQ ID NO: 5207634 - DNA, 19 bp, Homo sapiens
aggccttcctctctccaga

SEQ ID NO: 5207635 - DNA, 22 bp, Homo sapiens
aggccttctcctccccacccgc

SEQ ID NO: 5207636 - DNA, 22 bp, Homo sapiens
aggccttctcttgaggcctgtg

SEQ ID NO: 5207637 - DNA, 18 bp, Homo sapiens
aggccttctgtggggctg

SEQ ID NO: 5207638 - DNA, 22 bp, Homo sapiens
aggccttctgtggggctgggca

SEQ ID NO: 5207639 - DNA, 13 bp, Homo sapiens
aggccttcttgtg

SEQ ID NO: 5207640 - DNA, 23 bp, Homo sapiens
aggccttgagacttgaaaccaga

SEQ ID NO: 5207641 - DNA, 14 bp, Homo sapiens
aggccttgagcaca

SEQ ID NO: 5207642 - DNA, 18 bp, Homo sapiens
aggccttgccagttttcc

SEQ ID NO: 5207643 - DNA, 15 bp, Homo sapiens
aggccttgcctggcc

SEQ ID NO: 5207644 - DNA, 18 bp, Homo sapiens
aggccttgcctggcctga

SEQ ID NO: 5207645 - DNA, 19 bp, Homo sapiens
aggccttgcggctcctcag

SEQ ID NO: 5207646 - DNA, 15 bp, Homo sapiens
aggccttgctcactc

SEQ ID NO: 5207647 - DNA, 17 bp, Homo sapiens
aggaatactgaacatct

SEQ ID NO: 5207648 - DNA, 18 bp, Homo sapiens
aggaatactgttttatct

SEQ ID NO: 5207649 - DNA, 23 bp, Homo sapiens
aggaatagatgtggtccttagga

SEQ ID NO: 5207650 - DNA, 14 bp, Homo sapiens
aggaatagccagag

SEQ ID NO: 5207651 - DNA, 12 bp, Homo sapiens
aggaatagcttt

SEQ ID NO: 5207652 - DNA, 15 bp, Homo sapiens
aggaataggcaaaat

SEQ ID NO: 5207653 - DNA, 17 bp, Homo sapiens
aggaataggcaaaatgt

SEQ ID NO: 5207654 - DNA, 16 bp, Homo sapiens
aggaatagtggacatg

SEQ ID NO: 5207655 - DNA, 11 bp, Homo sapiens
aggaatataca

SEQ ID NO: 5207656 - DNA, 12 bp, Homo sapiens
aggaatatatgg

SEQ ID NO: 5207657 - DNA, 22 bp, Homo sapiens
aggaatatcaatataatgtttt

SEQ ID NO: 5207658 - DNA, 23 bp, Homo sapiens
aggaatatcccaaacttcggaaa

SEQ ID NO: 5207659 - DNA, 23 bp, Homo sapiens
aggaatatctgttcccagcccct

SEQ ID NO: 5207660 - DNA, 20 bp, Homo sapiens
aggaatatgacggaagaaca

SEQ ID NO: 5207661 - DNA, 22 bp, Homo sapiens
aggaatatgacggaagaacata

SEQ ID NO: 5207662 - DNA, 16 bp, Homo sapiens
aggaatatgactgttt

SEQ ID NO: 5207663 - DNA, 22 bp, Homo sapiens
aggaatatgcatcccacagcca

SEQ ID NO: 5207664 - DNA, 20 bp, Homo sapiens
aggaatattatatttggatg

SEQ ID NO: 5207665 - DNA, 22 bp, Homo sapiens
aggaatcaaatcttacaaaatc

SEQ ID NO: 5207666 - DNA, 16 bp, Homo sapiens
aggaatcaagagctgc

SEQ ID NO: 5207667 - DNA, 16 bp, Homo sapiens
aggaatcaattattta

SEQ ID NO: 5207668 - DNA, 15 bp, Homo sapiens
aggaatcacccctct

SEQ ID NO: 5207669 - DNA, 20 bp, Homo sapiens
aggaatcacccctctgcccc

SEQ ID NO: 5207670 - DNA, 15 bp, Homo sapiens
aggaatcaccctcct

SEQ ID NO: 5207671 - DNA, 18 bp, Homo sapiens
aggaatcactcttgtgga

SEQ ID NO: 5207672 - DNA, 22 bp, Homo sapiens
aggaatcactttagaaagccag

SEQ ID NO: 5207673 - DNA, 20 bp, Homo sapiens
aggaatcatcaggaacgttt

SEQ ID NO: 5207674 - DNA, 16 bp, Homo sapiens
aggaatcatgatctga

SEQ ID NO: 5207675 - DNA, 22 bp, Homo sapiens
aggaatcatgtcaggcctgtgt

SEQ ID NO: 5207676 - DNA, 17 bp, Homo sapiens
aggaatcattctgtaaa

SEQ ID NO: 5207677 - DNA, 18 bp, Homo sapiens
aggaatcattctgtaaag

SEQ ID NO: 5207678 - DNA, 15 bp, Homo sapiens
aggaatccatgaaga

SEQ ID NO: 5207679 - DNA, 15 bp, Homo sapiens
aggaatcccagaggt

SEQ ID NO: 5207680 - DNA, 19 bp, Homo sapiens
aggaatcccggctccagag

SEQ ID NO: 5207681 - DNA, 20 bp, Homo sapiens
aggaatcccggctccagagc

SEQ ID NO: 5207682 - DNA, 23 bp, Homo sapiens
aggaatcctacgctatgtagaat

SEQ ID NO: 5207683 - DNA, 15 bp, Homo sapiens
aggaatcctggcagc

SEQ ID NO: 5207684 - DNA, 19 bp, Homo sapiens
aggaatcctggcagcccag

SEQ ID NO: 5207685 - DNA, 19 bp, Homo sapiens
aggaatctacctgtggtga

SEQ ID NO: 5207686 - DNA, 22 bp, Homo sapiens
aggaatctctgttccttctctg

SEQ ID NO: 5207687 - DNA, 22 bp, Homo sapiens
aggaatctgtgggtctgggagt

SEQ ID NO: 5207688 - DNA, 22 bp, Homo sapiens
aggaatctttaaaagatgcttt

SEQ ID NO: 5207689 - DNA, 13 bp, Homo sapiens
aggaatctttaag

SEQ ID NO: 5207690 - DNA, 21 bp, Homo sapiens
aggaatcttttactgtggagg

SEQ ID NO: 5207691 - DNA, 17 bp, Homo sapiens
aggaatgaagaactgtt

SEQ ID NO: 5207692 - DNA, 20 bp, Homo sapiens
aggaatgaagaactgttgcc

SEQ ID NO: 5207693 - DNA, 15 bp, Homo sapiens
aggaatgaagacctt

SEQ ID NO: 5207694 - DNA, 19 bp, Homo sapiens
aggaatgaagataccatca

SEQ ID NO: 5207695 - DNA, 15 bp, Homo sapiens
aggaatgaagtaaag

SEQ ID NO: 5207696 - DNA, 22 bp, Homo sapiens
aggaatgaccacgggcctcagt

SEQ ID NO: 5207697 - DNA, 23 bp, Homo sapiens
aggaatgacccttttgtgtctat

SEQ ID NO: 5207698 - DNA, 23 bp, Homo sapiens
aggaatgactcatgcctctgagc

SEQ ID NO: 5207699 - DNA, 13 bp, Homo sapiens
aggaatgagaagt

SEQ ID NO: 5207700 - DNA, 16 bp, Homo sapiens
aggaatgatattgctg

SEQ ID NO: 5207701 - DNA, 15 bp, Homo sapiens
aggaatgcaagagaa

SEQ ID NO: 5207702 - DNA, 13 bp, Homo sapiens
aggaatgcctgtg

SEQ ID NO: 5207703 - DNA, 15 bp, Homo sapiens
aggaatgcctgtgcc

SEQ ID NO: 5207704 - DNA, 18 bp, Homo sapiens
aggaatgctcaatgtgct

SEQ ID NO: 5207705 - DNA, 12 bp, Homo sapiens
aggaatgctccc

SEQ ID NO: 5207706 - DNA, 13 bp, Homo sapiens
aggaatgctcccc

SEQ ID NO: 5207707 - DNA, 14 bp, Homo sapiens
aggaatgctccccc

SEQ ID NO: 5207708 - DNA, 20 bp, Homo sapiens
aggaatgctcccccatcctc

SEQ ID NO: 5207709 - DNA, 14 bp, Homo sapiens
aggaatgctctgtg

SEQ ID NO: 5207710 - DNA, 17 bp, Homo sapiens
aggaatgctctgtgcca

SEQ ID NO: 5207711 - DNA, 16 bp, Homo sapiens
aggaatgctggactgg

SEQ ID NO: 5207712 - DNA, 17 bp, Homo sapiens
aggaatgctggactgga

SEQ ID NO: 5207713 - DNA, 14 bp, Homo sapiens
aggaatgcttccga

SEQ ID NO: 5207714 - DNA, 16 bp, Homo sapiens
aggaatggaatcttct

SEQ ID NO: 5207715 - DNA, 20 bp, Homo sapiens
aggaatggacagacagagga

SEQ ID NO: 5207716 - DNA, 16 bp, Homo sapiens
aggaatggacatttct

SEQ ID NO: 5207717 - DNA, 13 bp, Homo sapiens
aggaatggaggag

SEQ ID NO: 5207718 - DNA, 21 bp, Homo sapiens
aggaatggaggagccaggccc

SEQ ID NO: 5207719 - DNA, 18 bp, Homo sapiens
aggaatggaggctctaat

SEQ ID NO: 5207720 - DNA, 17 bp, Homo sapiens
aggaatggccctcattc

SEQ ID NO: 5207721 - DNA, 23 bp, Homo sapiens
aggaatggctgcacctttttgca

SEQ ID NO: 5207722 - DNA, 23 bp, Homo sapiens
aggaatggggggcgggccagggt

SEQ ID NO: 5207723 - DNA, 15 bp, Homo sapiens
aggaatgtagaagtc

SEQ ID NO: 5207724 - DNA, 18 bp, Homo sapiens
aggaatgtagctggtttc

SEQ ID NO: 5207725 - DNA, 15 bp, Homo sapiens
aggaatgtcagggcc

SEQ ID NO: 5207726 - DNA, 16 bp, Homo sapiens
aggaatgtcagggcca

SEQ ID NO: 5207727 - DNA, 19 bp, Homo sapiens
aggaatgtcagggccaggt

SEQ ID NO: 5207728 - DNA, 20 bp, Homo sapiens
aggaatgtcagggccaggtg

SEQ ID NO: 5207729 - DNA, 23 bp, Homo sapiens
aggaatgtgaaatttaaataata

SEQ ID NO: 5207730 - DNA, 16 bp, Homo sapiens
aggaatgtgtggcctg

SEQ ID NO: 5207731 - DNA, 22 bp, Homo sapiens
aggaatgttttgtagctctagg

SEQ ID NO: 5207732 - DNA, 17 bp, Homo sapiens
aggaattaaataatgta

SEQ ID NO: 5207733 - DNA, 23 bp, Homo sapiens
aggaattaagttagggaatggca

SEQ ID NO: 5207734 - DNA, 14 bp, Homo sapiens
aggaattactttat

SEQ ID NO: 5207735 - DNA, 21 bp, Homo sapiens
aggaattactttattataaaa

SEQ ID NO: 5207736 - DNA, 12 bp, Homo sapiens
aggaattatgtc

SEQ ID NO: 5207737 - DNA, 22 bp, Homo sapiens
aggaattcccagcccaaagctg

SEQ ID NO: 5207738 - DNA, 23 bp, Homo sapiens
aggaattcccagcccaaagctgt

SEQ ID NO: 5207739 - DNA, 20 bp, Homo sapiens
aggaattccccaaagaatgt

SEQ ID NO: 5207740 - DNA, 15 bp, Homo sapiens
aggaattctgtatag

SEQ ID NO: 5207741 - DNA, 16 bp, Homo sapiens
aggaattctgtataga

SEQ ID NO: 5207742 - DNA, 23 bp, Homo sapiens
aggaattctgtatagattagaat

SEQ ID NO: 5207743 - DNA, 20 bp, Homo sapiens
aggaattgaagatgtaagga

SEQ ID NO: 5207744 - DNA, 21 bp, Homo sapiens
aggaattgacttcagcagggg

SEQ ID NO: 5207745 - DNA, 22 bp, Homo sapiens
aggaattgattgtcagccacct

SEQ ID NO: 5207746 - DNA, 23 bp, Homo sapiens
aggaattgattgtcagccacctc

SEQ ID NO: 5207747 - DNA, 19 bp, Homo sapiens
aggaattggggtttctggt

SEQ ID NO: 5207748 - DNA, 18 bp, Homo sapiens
aggaattggtaaggcctc

SEQ ID NO: 5207749 - DNA, 11 bp, Homo sapiens
aggaatttaaa

SEQ ID NO: 5207750 - DNA, 13 bp, Homo sapiens
aggaatttaaaat

SEQ ID NO: 5207751 - DNA, 14 bp, Homo sapiens
aggaatttaaaatt

SEQ ID NO: 5207752 - DNA, 19 bp, Homo sapiens
aggaatttaaaattaagta

SEQ ID NO: 5207753 - DNA, 17 bp, Homo sapiens
aggaatttaagaatttg

SEQ ID NO: 5207754 - DNA, 13 bp, Homo sapiens
aggaatttacttt

SEQ ID NO: 5207755 - DNA, 17 bp, Homo sapiens
aggaatttactttcttc

SEQ ID NO: 5207756 - DNA, 14 bp, Homo sapiens
aggaatttatacct

SEQ ID NO: 5207757 - DNA, 15 bp, Homo sapiens
aggaatttatacctc

SEQ ID NO: 5207758 - DNA, 17 bp, Homo sapiens
aggaatttcccaggacc

SEQ ID NO: 5207759 - DNA, 19 bp, Homo sapiens
aggaatttcccaggaccct

SEQ ID NO: 5207760 - DNA, 13 bp, Homo sapiens
aggaatttcttaa

SEQ ID NO: 5207761 - DNA, 23 bp, Homo sapiens
aggaatttcttaacttcttgctt

SEQ ID NO: 5207762 - DNA, 17 bp, Homo sapiens
aggaatttgaagctcag

SEQ ID NO: 5207763 - DNA, 15 bp, Homo sapiens
aggaatttgattgct

SEQ ID NO: 5207764 - DNA, 15 bp, Homo sapiens
aggaatttggctgct

SEQ ID NO: 5207765 - DNA, 15 bp, Homo sapiens
aggaatttgtacttc

SEQ ID NO: 5207766 - DNA, 20 bp, Homo sapiens
aggaatttgtacttcttatt

SEQ ID NO: 5207767 - DNA, 16 bp, Homo sapiens
aggaatttgtattttg

SEQ ID NO: 5207768 - DNA, 14 bp, Homo sapiens
aggaattttaaaaa

SEQ ID NO: 5207769 - DNA, 23 bp, Homo sapiens
aggaattttattttgctgagttg

SEQ ID NO: 5207770 - DNA, 19 bp, Homo sapiens
aggaattttctccaatttt

SEQ ID NO: 5207771 - DNA, 16 bp, Homo sapiens
aggaattttctttgtg

SEQ ID NO: 5207772 - DNA, 18 bp, Homo sapiens
aggaatttttttcagtat

SEQ ID NO: 5207773 - DNA, 22 bp, Homo sapiens
aggaatttttttcagtattatt

SEQ ID NO: 5207774 - DNA, 19 bp, Homo sapiens
aggacaaaaagaccttctc

SEQ ID NO: 5207775 - DNA, 22 bp, Homo sapiens
aggacaaaataaagtgtgtgtg

SEQ ID NO: 5207776 - DNA, 14 bp, Homo sapiens
aggacaaaatgtta

SEQ ID NO: 5207777 - DNA, 18 bp, Homo sapiens
aggacaaagagaataaag

SEQ ID NO: 5207778 - DNA, 18 bp, Homo sapiens
aggacaaagtctccagcc

SEQ ID NO: 5207779 - DNA, 18 bp, Homo sapiens
aggacaaagtgccaaaga

SEQ ID NO: 5207780 - DNA, 15 bp, Homo sapiens
aggacaaataaaaca

SEQ ID NO: 5207781 - DNA, 16 bp, Homo sapiens
aggacaaataaagcaa

SEQ ID NO: 5207782 - DNA, 14 bp, Homo sapiens
aggacaaataagaa

SEQ ID NO: 5207783 - DNA, 23 bp, Homo sapiens
aggacaaatctaaaatgcaaaga

SEQ ID NO: 5207784 - DNA, 20 bp, Homo sapiens
aggacaaatctgcaaagcat

SEQ ID NO: 5207785 - DNA, 21 bp, Homo sapiens
aggacaaatctgcaaagcatg

SEQ ID NO: 5207786 - DNA, 22 bp, Homo sapiens
aggacaaattagcatgcaagct

SEQ ID NO: 5207787 - DNA, 18 bp, Homo sapiens
aggacaaattgagacagt

SEQ ID NO: 5207788 - DNA, 23 bp, Homo sapiens
aggacaaccatgcaaattgtgaa

SEQ ID NO: 5207789 - DNA, 21 bp, Homo sapiens
aggacaacctgcccctcccca

SEQ ID NO: 5207790 - DNA, 14 bp, Homo sapiens
aggacaacgaggaa

SEQ ID NO: 5207791 - DNA, 17 bp, Homo sapiens
aggacaacgaggaagcc

SEQ ID NO: 5207792 - DNA, 22 bp, Homo sapiens
aggacaaggccttgctcactca

SEQ ID NO: 5207793 - DNA, 14 bp, Homo sapiens
aggacaaggctaga

SEQ ID NO: 5207794 - DNA, 19 bp, Homo sapiens
aggacaaggctgtgccagg

SEQ ID NO: 5207795 - DNA, 20 bp, Homo sapiens
aggacaaggctgtgccaggc

SEQ ID NO: 5207796 - DNA, 20 bp, Homo sapiens
aggacaaggtgcaggcaggc

SEQ ID NO: 5207797 - DNA, 14 bp, Homo sapiens
aggacaagttttag

SEQ ID NO: 5207798 - DNA, 15 bp, Homo sapiens
aggacaagttttagt

SEQ ID NO: 5207799 - DNA, 18 bp, Homo sapiens
aggacaagttttagttaa

SEQ ID NO: 5207800 - DNA, 21 bp, Homo sapiens
aggacaagttttagttaaaac

SEQ ID NO: 5207801 - DNA, 22 bp, Homo sapiens
aggacaagttttagttaaaact

SEQ ID NO: 5207802 - DNA, 17 bp, Homo sapiens
aggacaatcagtcccct

SEQ ID NO: 5207803 - DNA, 20 bp, Homo sapiens
aggacaatcagtcccctccc

SEQ ID NO: 5207804 - DNA, 21 bp, Homo sapiens
aggacaatgaaatactccagc

SEQ ID NO: 5207805 - DNA, 19 bp, Homo sapiens
aggacaatgccttgggaga

SEQ ID NO: 5207806 - DNA, 19 bp, Homo sapiens
aggacaattgtcagttttg

SEQ ID NO: 5207807 - DNA, 16 bp, Homo sapiens
aggacaatttcaaaaa

SEQ ID NO: 5207808 - DNA, 13 bp, Homo sapiens
aggacacaatggc

SEQ ID NO: 5207809 - DNA, 20 bp, Homo sapiens
aggacacaatggcacctctg

SEQ ID NO: 5207810 - DNA, 22 bp, Homo sapiens
aggacacacagtctcagtccag

SEQ ID NO: 5207811 - DNA, 23 bp, Homo sapiens
aggacacactaatcgaactatga

SEQ ID NO: 5207812 - DNA, 12 bp, Homo sapiens
aggacacagcac

SEQ ID NO: 5207813 - DNA, 14 bp, Homo sapiens
aggacacagcacaa

SEQ ID NO: 5207814 - DNA, 16 bp, Homo sapiens
aggacacagtgatgaa

SEQ ID NO: 5207815 - DNA, 17 bp, Homo sapiens
aggacacagtgatgaat

SEQ ID NO: 5207816 - DNA, 15 bp, Homo sapiens
aggacacagttcctg

SEQ ID NO: 5207817 - DNA, 18 bp, Homo sapiens
aggacacagttcctggga

SEQ ID NO: 5207818 - DNA, 19 bp, Homo sapiens
aggacacatcccggcctct

SEQ ID NO: 5207819 - DNA, 20 bp, Homo sapiens
aggacacatcccggcctctt

SEQ ID NO: 5207820 - DNA, 13 bp, Homo sapiens
aggacacatgtcc

SEQ ID NO: 5207821 - DNA, 17 bp, Homo sapiens
aggacaccacacccagc

SEQ ID NO: 5207822 - DNA, 19 bp, Homo sapiens
aggacaccacacccagcct

SEQ ID NO: 5207823 - DNA, 16 bp, Homo sapiens
aggacaccagtgaaag

SEQ ID NO: 5207824 - DNA, 20 bp, Homo sapiens
aggccttgctggggtccagg

SEQ ID NO: 5207825 - DNA, 21 bp, Homo sapiens
aggccttgctggggtccaggg

SEQ ID NO: 5207826 - DNA, 23 bp, Homo sapiens
aggccttgctggggtccagggct

SEQ ID NO: 5207827 - DNA, 22 bp, Homo sapiens
aggccttggcttgatggaagtg

SEQ ID NO: 5207828 - DNA, 23 bp, Homo sapiens
aggccttggggtgggggccaggc

SEQ ID NO: 5207829 - DNA, 21 bp, Homo sapiens
aggccttggtggagcagccag

SEQ ID NO: 5207830 - DNA, 21 bp, Homo sapiens
aggccttgtgtgtcaggccct

SEQ ID NO: 5207831 - DNA, 14 bp, Homo sapiens
aggcctttaaaatt

SEQ ID NO: 5207832 - DNA, 23 bp, Homo sapiens
aggcctttagttataaaggaatc

SEQ ID NO: 5207833 - DNA, 15 bp, Homo sapiens
aggcctttcaggaag

SEQ ID NO: 5207834 - DNA, 14 bp, Homo sapiens
aggcctttccctaa

SEQ ID NO: 5207835 - DNA, 15 bp, Homo sapiens
aggcctttccctaag

SEQ ID NO: 5207836 - DNA, 16 bp, Homo sapiens
aggcctttccctgccg

SEQ ID NO: 5207837 - DNA, 14 bp, Homo sapiens
aggcctttcctctg

SEQ ID NO: 5207838 - DNA, 19 bp, Homo sapiens
aggcctttcctctgcacgc

SEQ ID NO: 5207839 - DNA, 13 bp, Homo sapiens
aggcctttcttct

SEQ ID NO: 5207840 - DNA, 20 bp, Homo sapiens
aggcctttggaggggaaatg

SEQ ID NO: 5207841 - DNA, 11 bp, Homo sapiens
aggcctttggg

SEQ ID NO: 5207842 - DNA, 19 bp, Homo sapiens
aggccttttatgtaatttc

SEQ ID NO: 5207843 - DNA, 23 bp, Homo sapiens
aggcctttttcaaccagatttag

SEQ ID NO: 5207844 - DNA, 17 bp, Homo sapiens
aggcctttttgagccaa

SEQ ID NO: 5207845 - DNA, 18 bp, Homo sapiens
aggcgaagcgttgtcctc

SEQ ID NO: 5207846 - DNA, 14 bp, Homo sapiens
aggcgaagggtggt

SEQ ID NO: 5207847 - DNA, 15 bp, Homo sapiens
aggcgaataaatgtt

SEQ ID NO: 5207848 - DNA, 16 bp, Homo sapiens
aggcgaataaatgttc

SEQ ID NO: 5207849 - DNA, 18 bp, Homo sapiens
aggcgaataaatgttcaa

SEQ ID NO: 5207850 - DNA, 19 bp, Homo sapiens
aggcgaataaatgttcaaa

SEQ ID NO: 5207851 - DNA, 15 bp, Homo sapiens
aggcgaccgggcctc

SEQ ID NO: 5207852 - DNA, 22 bp, Homo sapiens
aggcgaccgggcctcccctcca

SEQ ID NO: 5207853 - DNA, 23 bp, Homo sapiens
aggcgacgcggttttttcacttc

SEQ ID NO: 5207854 - DNA, 19 bp, Homo sapiens
aggcgagaagggctgcttc

SEQ ID NO: 5207855 - DNA, 14 bp, Homo sapiens
aggcgagcctgact

SEQ ID NO: 5207856 - DNA, 15 bp, Homo sapiens
aggcgaggctgcctc

SEQ ID NO: 5207857 - DNA, 16 bp, Homo sapiens
aggcgaggctgcctct

SEQ ID NO: 5207858 - DNA, 13 bp, Homo sapiens
aggcgagtccagg

SEQ ID NO: 5207859 - DNA, 24 bp, Homo sapiens
aggcgagtgccaggactccccagg

SEQ ID NO: 5207860 - DNA, 15 bp, Homo sapiens
aggcgagtttcccca

SEQ ID NO: 5207861 - DNA, 23 bp, Homo sapiens
aggcgatccacctgtctcagcct

SEQ ID NO: 5207862 - DNA, 15 bp, Homo sapiens
aggcgatgccagcct

SEQ ID NO: 5207863 - DNA, 19 bp, Homo sapiens
aggcgcacagtgtgagccc

SEQ ID NO: 5207864 - DNA, 21 bp, Homo sapiens
aggcgcactttcctcctggca

SEQ ID NO: 5207865 - DNA, 20 bp, Homo sapiens
aggcgcagcccgaagcccag

SEQ ID NO: 5207866 - DNA, 18 bp, Homo sapiens
aggcgcagccctagtggg

SEQ ID NO: 5207867 - DNA, 21 bp, Homo sapiens
aggcgcaggcgaccgggcctc

SEQ ID NO: 5207868 - DNA, 21 bp, Homo sapiens
aggcgcagggacatggggcaa

SEQ ID NO: 5207869 - DNA, 22 bp, Homo sapiens
aggcgcagggacatggggcaag

SEQ ID NO: 5207870 - DNA, 22 bp, Homo sapiens
aggcgcatgagtatctgtggga

SEQ ID NO: 5207871 - DNA, 18 bp, Homo sapiens
aggcgcatgtctgcacct

SEQ ID NO: 5207872 - DNA, 19 bp, Homo sapiens
aggcgcatgtctgcacctc

SEQ ID NO: 5207873 - DNA, 18 bp, Homo sapiens
aggcgcccacctgcccag

SEQ ID NO: 5207874 - DNA, 21 bp, Homo sapiens
aggcgcccacctgcccagtta

SEQ ID NO: 5207875 - DNA, 22 bp, Homo sapiens
aggcgccccaacccgtggaggc

SEQ ID NO: 5207876 - DNA, 11 bp, Homo sapiens
aggcgcccccg

SEQ ID NO: 5207877 - DNA, 13 bp, Homo sapiens
aggcgcccccgcc

SEQ ID NO: 5207878 - DNA, 16 bp, Homo sapiens
aggcgcccccgcccca

SEQ ID NO: 5207879 - DNA, 23 bp, Homo sapiens
aggcgcctcaactctgctgaggg

SEQ ID NO: 5207880 - DNA, 15 bp, Homo sapiens
aggcgcgcaccgccc

SEQ ID NO: 5207881 - DNA, 16 bp, Homo sapiens
aggcgcgctcagatgc

SEQ ID NO: 5207882 - DNA, 20 bp, Homo sapiens
aggcgcgtctgccccaccct

SEQ ID NO: 5207883 - DNA, 13 bp, Homo sapiens
aggcgctaacttg

SEQ ID NO: 5207884 - DNA, 15 bp, Homo sapiens
aggcgctaacttgct

SEQ ID NO: 5207885 - DNA, 18 bp, Homo sapiens
aggcgctcagaggccgct

SEQ ID NO: 5207886 - DNA, 19 bp, Homo sapiens
aggcgctgcatacagggga

SEQ ID NO: 5207887 - DNA, 14 bp, Homo sapiens
aggcggaaaccttg

SEQ ID NO: 5207888 - DNA, 16 bp, Homo sapiens
aggcggaaaccttgca

SEQ ID NO: 5207889 - DNA, 18 bp, Homo sapiens
aggcggaaaccttgcagc

SEQ ID NO: 5207890 - DNA, 19 bp, Homo sapiens
aggcggaaaccttgcagca

SEQ ID NO: 5207891 - DNA, 20 bp, Homo sapiens
aggcggaaaccttgcagcat

SEQ ID NO: 5207892 - DNA, 15 bp, Homo sapiens
aggcggacgttccag

SEQ ID NO: 5207893 - DNA, 17 bp, Homo sapiens
aggcggacgttccagcc

SEQ ID NO: 5207894 - DNA, 15 bp, Homo sapiens
aggcggagagtacag

SEQ ID NO: 5207895 - DNA, 19 bp, Homo sapiens
aggcggaggcgctcctccc

SEQ ID NO: 5207896 - DNA, 22 bp, Homo sapiens
aggcggaggctgtgctccgcca

SEQ ID NO: 5207897 - DNA, 21 bp, Homo sapiens
aggcggaggggcttggagcag

SEQ ID NO: 5207898 - DNA, 23 bp, Homo sapiens
aggcggaggggcttggagcagag

SEQ ID NO: 5207899 - DNA, 22 bp, Homo sapiens
aggcggagggtctccctgggca

SEQ ID NO: 5207900 - DNA, 20 bp, Homo sapiens
aggcggaggttgcagtgagc

SEQ ID NO: 5207901 - DNA, 19 bp, Homo sapiens
aggcggcagatcctgccct

SEQ ID NO: 5207902 - DNA, 22 bp, Homo sapiens
aggcggcagctcttctgggcag

SEQ ID NO: 5207903 - DNA, 18 bp, Homo sapiens
aggcggcagctggggccg

SEQ ID NO: 5207904 - DNA, 18 bp, Homo sapiens
aggcggcaggcagagaag

SEQ ID NO: 5207905 - DNA, 13 bp, Homo sapiens
aggcggccagggc

SEQ ID NO: 5207906 - DNA, 19 bp, Homo sapiens
aggcggccagggcggccag

SEQ ID NO: 5207907 - DNA, 12 bp, Homo sapiens
aggcggcccctc

SEQ ID NO: 5207908 - DNA, 19 bp, Homo sapiens
aggcggccggccgcactgg

SEQ ID NO: 5207909 - DNA, 21 bp, Homo sapiens
aggcgggaaccctctggggcc

SEQ ID NO: 5207910 - DNA, 15 bp, Homo sapiens
aggcgggaaggaggg

SEQ ID NO: 5207911 - DNA, 21 bp, Homo sapiens
aggcgggatttatgtgcactg

SEQ ID NO: 5207912 - DNA, 21 bp, Homo sapiens
aggcgggcatggcgtggagga

SEQ ID NO: 5207913 - DNA, 12 bp, Homo sapiens
aggcgggccagc

SEQ ID NO: 5207914 - DNA, 14 bp, Homo sapiens
aggcgggccagcca

SEQ ID NO: 5207915 - DNA, 23 bp, Homo sapiens
aggcgggccagccaggcgggctc

SEQ ID NO: 5207916 - DNA, 19 bp, Homo sapiens
aggcgggccggggcaggga

SEQ ID NO: 5207917 - DNA, 21 bp, Homo sapiens
aggcggggaggaggagctgcc

SEQ ID NO: 5207918 - DNA, 15 bp, Homo sapiens
aggcggggaggaggc

SEQ ID NO: 5207919 - DNA, 13 bp, Homo sapiens
aggcggggcagta

SEQ ID NO: 5207920 - DNA, 22 bp, Homo sapiens
aggcggggcagtatgtgatgga

SEQ ID NO: 5207921 - DNA, 18 bp, Homo sapiens
aggcggggcgccccaaga

SEQ ID NO: 5207922 - DNA, 20 bp, Homo sapiens
aggcggggcgccccaagagc

SEQ ID NO: 5207923 - DNA, 14 bp, Homo sapiens
aggcggggctcctc

SEQ ID NO: 5207924 - DNA, 16 bp, Homo sapiens
aggcggggctcctcct

SEQ ID NO: 5207925 - DNA, 19 bp, Homo sapiens
aggcggggctcctcctgaa

SEQ ID NO: 5207926 - DNA, 19 bp, Homo sapiens
aggcggggcttgccttctg

SEQ ID NO: 5207927 - DNA, 18 bp, Homo sapiens
aggcgggggagcctggag

SEQ ID NO: 5207928 - DNA, 19 bp, Homo sapiens
aggcgggggagcctggagc

SEQ ID NO: 5207929 - DNA, 17 bp, Homo sapiens
aggcgggggatcctgga

SEQ ID NO: 5207930 - DNA, 19 bp, Homo sapiens
aggcgggggatcctggagc

SEQ ID NO: 5207931 - DNA, 22 bp, Homo sapiens
aggcgggggatcctggagcccc

SEQ ID NO: 5207932 - DNA, 23 bp, Homo sapiens
aggcgggggatcctggagcccct

SEQ ID NO: 5207933 - DNA, 19 bp, Homo sapiens
aggcggggtattcccactc

SEQ ID NO: 5207934 - DNA, 15 bp, Homo sapiens
aggcgggtggctggt

SEQ ID NO: 5207935 - DNA, 23 bp, Homo sapiens
aggcggtcactgcccacctgcca

SEQ ID NO: 5207936 - DNA, 17 bp, Homo sapiens
aggcggtcatgtgtgca

SEQ ID NO: 5207937 - DNA, 20 bp, Homo sapiens
aggcggtcatgtgtgcatgt

SEQ ID NO: 5207938 - DNA, 22 bp, Homo sapiens
aggcggtcatgtgtgcatgtga

SEQ ID NO: 5207939 - DNA, 22 bp, Homo sapiens
aggcggtgcggcagggaagagg

SEQ ID NO: 5207940 - DNA, 16 bp, Homo sapiens
aggcggtgggcctggt

SEQ ID NO: 5207941 - DNA, 19 bp, Homo sapiens
aggcgtactacccagctct

SEQ ID NO: 5207942 - DNA, 13 bp, Homo sapiens
aggcgtagggcca

SEQ ID NO: 5207943 - DNA, 14 bp, Homo sapiens
aggcgtagggccag

SEQ ID NO: 5207944 - DNA, 16 bp, Homo sapiens
aggcgtagggccaggg

SEQ ID NO: 5207945 - DNA, 14 bp, Homo sapiens
aggcgtgactcagc

SEQ ID NO: 5207946 - DNA, 18 bp, Homo sapiens
aggcgtgagccaccatgc

SEQ ID NO: 5207947 - DNA, 18 bp, Homo sapiens
aggcgtgagccacctcgc

SEQ ID NO: 5207948 - DNA, 12 bp, Homo sapiens
aggcgtgatcca

SEQ ID NO: 5207949 - DNA, 12 bp, Homo sapiens
aggcgtgccccc

SEQ ID NO: 5207950 - DNA, 13 bp, Homo sapiens
aggcgtgcccccc

SEQ ID NO: 5207951 - DNA, 17 bp, Homo sapiens
aggcgtgcccccctcct

SEQ ID NO: 5207952 - DNA, 23 bp, Homo sapiens
aggcgtgcccccctcctccagta

SEQ ID NO: 5207953 - DNA, 15 bp, Homo sapiens
aggcgtggagctgcc

SEQ ID NO: 5207954 - DNA, 13 bp, Homo sapiens
aggcgtggaggag

SEQ ID NO: 5207955 - DNA, 21 bp, Homo sapiens
aggcgtggaggagaggagact

SEQ ID NO: 5207956 - DNA, 13 bp, Homo sapiens
aggcgtgtggcag

SEQ ID NO: 5207957 - DNA, 16 bp, Homo sapiens
aggcgtgtggcagcca

SEQ ID NO: 5207958 - DNA, 19 bp, Homo sapiens
aggcgttcttcgaggtgga

SEQ ID NO: 5207959 - DNA, 15 bp, Homo sapiens
aggcgttgctttcac

SEQ ID NO: 5207960 - DNA, 16 bp, Homo sapiens
aggcgttggtgccact

SEQ ID NO: 5207961 - DNA, 16 bp, Homo sapiens
aggctaaaaacatttt

SEQ ID NO: 5207962 - DNA, 19 bp, Homo sapiens
aggctaaaaacattttaaa

SEQ ID NO: 5207963 - DNA, 15 bp, Homo sapiens
aggctaaaaagcaac

SEQ ID NO: 5207964 - DNA, 16 bp, Homo sapiens
aggctaaaacaaatct

SEQ ID NO: 5207965 - DNA, 18 bp, Homo sapiens
aggctaaaaggtcttgca

SEQ ID NO: 5207966 - DNA, 12 bp, Homo sapiens
aggctaaaatgt

SEQ ID NO: 5207967 - DNA, 15 bp, Homo sapiens
aggctaaaatgtttt

SEQ ID NO: 5207968 - DNA, 18 bp, Homo sapiens
aggctaaccctgatccat

SEQ ID NO: 5207969 - DNA, 15 bp, Homo sapiens
aggctaagaaagaaa

SEQ ID NO: 5207970 - DNA, 17 bp, Homo sapiens
aggctaagagatgtgac

SEQ ID NO: 5207971 - DNA, 13 bp, Homo sapiens
aggctaagcctgg

SEQ ID NO: 5207972 - DNA, 15 bp, Homo sapiens
aggctaagcctggac

SEQ ID NO: 5207973 - DNA, 23 bp, Homo sapiens
aggctaaggcgtggagctgcctg

SEQ ID NO: 5207974 - DNA, 22 bp, Homo sapiens
aggctaatcaatacccttggca

SEQ ID NO: 5207975 - DNA, 19 bp, Homo sapiens
aggctaatgttggcagatg

SEQ ID NO: 5207976 - DNA, 22 bp, Homo sapiens
aggctaatgttggcagatgcag

SEQ ID NO: 5207977 - DNA, 23 bp, Homo sapiens
aggctaattagaggatgtggcag

SEQ ID NO: 5207978 - DNA, 20 bp, Homo sapiens
aggctaattcagtgtcacat

SEQ ID NO: 5207979 - DNA, 23 bp, Homo sapiens
aggctaatttttttgtattttag

SEQ ID NO: 5207980 - DNA, 20 bp, Homo sapiens
aggctacaacaaaaatcacc

SEQ ID NO: 5207981 - DNA, 18 bp, Homo sapiens
aggctacagagaagcctt

SEQ ID NO: 5207982 - DNA, 13 bp, Homo sapiens
aggctacagctcc

SEQ ID NO: 5207983 - DNA, 21 bp, Homo sapiens
aggctacagctccacacgccc

SEQ ID NO: 5207984 - DNA, 14 bp, Homo sapiens
aggctacaggtgcc

SEQ ID NO: 5207985 - DNA, 18 bp, Homo sapiens
aggctacagttgatattt

SEQ ID NO: 5207986 - DNA, 23 bp, Homo sapiens
aggctaccaacttgtatccaggc

SEQ ID NO: 5207987 - DNA, 16 bp, Homo sapiens
aggctacccttgccaa

SEQ ID NO: 5207988 - DNA, 16 bp, Homo sapiens
aggctaccttattgta

SEQ ID NO: 5207989 - DNA, 14 bp, Homo sapiens
aggctactacagag

SEQ ID NO: 5207990 - DNA, 20 bp, Homo sapiens
aggctactacagagaaggct

SEQ ID NO: 5207991 - DNA, 16 bp, Homo sapiens
aggctactctgcccac

SEQ ID NO: 5207992 - DNA, 23 bp, Homo sapiens
aggctactgtaaggcaatcatgg

SEQ ID NO: 5207993 - DNA, 15 bp, Homo sapiens
aggctactgtaatgc

SEQ ID NO: 5207994 - DNA, 16 bp, Homo sapiens
aggctactgttcttga

SEQ ID NO: 5207995 - DNA, 22 bp, Homo sapiens
aggctacttcggggctgggaag

SEQ ID NO: 5207996 - DNA, 14 bp, Homo sapiens
aggctacttttcag

SEQ ID NO: 5207997 - DNA, 19 bp, Homo sapiens
aggctagaacctggcaagc

SEQ ID NO: 5207998 - DNA, 15 bp, Homo sapiens
aggctagacttagat

SEQ ID NO: 5207999 - DNA, 23 bp, Homo sapiens
aggctagagacagatgctggtgg

SEQ ID NO: 5208000 - DNA, 20 bp, Homo sapiens
aggctagagtgcagtggcat

SEQ ID NO: 5208001 - DNA, 12 bp, Homo sapiens
aggacacccctc

SEQ ID NO: 5208002 - DNA, 10 bp, Homo sapiens
aggacacctg

SEQ ID NO: 5208003 - DNA, 13 bp, Homo sapiens
aggacacctgccc

SEQ ID NO: 5208004 - DNA, 17 bp, Homo sapiens
aggacacctgccccagc

SEQ ID NO: 5208005 - DNA, 19 bp, Homo sapiens
aggacacctgccccagcgc

SEQ ID NO: 5208006 - DNA, 20 bp, Homo sapiens
aggacacctgccccagcgcg

SEQ ID NO: 5208007 - DNA, 22 bp, Homo sapiens
aggacacctgccccagcgcggc

SEQ ID NO: 5208008 - DNA, 23 bp, Homo sapiens
aggacacctgccccagcgcggct

SEQ ID NO: 5208009 - DNA, 18 bp, Homo sapiens
aggacacctgtactggag

SEQ ID NO: 5208010 - DNA, 23 bp, Homo sapiens
aggacacgcgcccccctcccaga

SEQ ID NO: 5208011 - DNA, 18 bp, Homo sapiens
aggacacgggcctgtcca

SEQ ID NO: 5208012 - DNA, 15 bp, Homo sapiens
aggacactaagagga

SEQ ID NO: 5208013 - DNA, 21 bp, Homo sapiens
aggacactaagaggaggcagg

SEQ ID NO: 5208014 - DNA, 18 bp, Homo sapiens
aggacactaatgggaaga

SEQ ID NO: 5208015 - DNA, 17 bp, Homo sapiens
aggacactaccctgaga

SEQ ID NO: 5208016 - DNA, 20 bp, Homo sapiens
aggacactaggagactggtt

SEQ ID NO: 5208017 - DNA, 18 bp, Homo sapiens
aggacactgatgggtcct

SEQ ID NO: 5208018 - DNA, 19 bp, Homo sapiens
aggacactgcctttgctgc

SEQ ID NO: 5208019 - DNA, 20 bp, Homo sapiens
aggacactgcctttgctgcc

SEQ ID NO: 5208020 - DNA, 13 bp, Homo sapiens
aggacactggatc

SEQ ID NO: 5208021 - DNA, 14 bp, Homo sapiens
aggacactggatca

SEQ ID NO: 5208022 - DNA, 16 bp, Homo sapiens
aggacactggggtctg

SEQ ID NO: 5208023 - DNA, 16 bp, Homo sapiens
aggacacttcctgcct

SEQ ID NO: 5208024 - DNA, 23 bp, Homo sapiens
aggacagaaccaacgggtctgtg

SEQ ID NO: 5208025 - DNA, 21 bp, Homo sapiens
aggacagaaggctcctgcccc

SEQ ID NO: 5208026 - DNA, 17 bp, Homo sapiens
aggacagacagaaggca

SEQ ID NO: 5208027 - DNA, 13 bp, Homo sapiens
aggacagacagca

SEQ ID NO: 5208028 - DNA, 15 bp, Homo sapiens
aggacagacttagga

SEQ ID NO: 5208029 - DNA, 17 bp, Homo sapiens
aggacagagaagatgac

SEQ ID NO: 5208030 - DNA, 15 bp, Homo sapiens
aggacagagagaaat

SEQ ID NO: 5208031 - DNA, 23 bp, Homo sapiens
aggacagaggccggggtccaggc

SEQ ID NO: 5208032 - DNA, 21 bp, Homo sapiens
aggacagagggaagccagtca

SEQ ID NO: 5208033 - DNA, 16 bp, Homo sapiens
aggacagagtgccctg

SEQ ID NO: 5208034 - DNA, 17 bp, Homo sapiens
aggacagagtgccctgg

SEQ ID NO: 5208035 - DNA, 20 bp, Homo sapiens
aggacagagttcacaggagg

SEQ ID NO: 5208036 - DNA, 23 bp, Homo sapiens
aggacagagttcacaggaggcca

SEQ ID NO: 5208037 - DNA, 19 bp, Homo sapiens
aggacagatccagggactg

SEQ ID NO: 5208038 - DNA, 21 bp, Homo sapiens
aggacagatgcctccttcctc

SEQ ID NO: 5208039 - DNA, 18 bp, Homo sapiens
aggacagcaaagcagcag

SEQ ID NO: 5208040 - DNA, 20 bp, Homo sapiens
aggacagcaaagcagcagtg

SEQ ID NO: 5208041 - DNA, 15 bp, Homo sapiens
aggacagcacagact

SEQ ID NO: 5208042 - DNA, 18 bp, Homo sapiens
aggacagcccttttgtga

SEQ ID NO: 5208043 - DNA, 16 bp, Homo sapiens
aggacagccgcctgga

SEQ ID NO: 5208044 - DNA, 15 bp, Homo sapiens
aggacagcctgcctc

SEQ ID NO: 5208045 - DNA, 18 bp, Homo sapiens
aggacagcctgcctctgc

SEQ ID NO: 5208046 - DNA, 19 bp, Homo sapiens
aggacagcctgcctctgcc

SEQ ID NO: 5208047 - DNA, 20 bp, Homo sapiens
aggacagcctgcctctgcca

SEQ ID NO: 5208048 - DNA, 21 bp, Homo sapiens
aggacagcctgcctctgccac

SEQ ID NO: 5208049 - DNA, 12 bp, Homo sapiens
aggacagctcct

SEQ ID NO: 5208050 - DNA, 15 bp, Homo sapiens
aggacagctcttgat

SEQ ID NO: 5208051 - DNA, 12 bp, Homo sapiens
aggacagctgca

SEQ ID NO: 5208052 - DNA, 19 bp, Homo sapiens
aggacagctgcaggtgccc

SEQ ID NO: 5208053 - DNA, 20 bp, Homo sapiens
aggacagctgcaggtgccca

SEQ ID NO: 5208054 - DNA, 21 bp, Homo sapiens
aggacagctgcaggtgcccat

SEQ ID NO: 5208055 - DNA, 12 bp, Homo sapiens
aggacagctggc

SEQ ID NO: 5208056 - DNA, 13 bp, Homo sapiens
aggacagctggct

SEQ ID NO: 5208057 - DNA, 15 bp, Homo sapiens
aggacagctggctgc

SEQ ID NO: 5208058 - DNA, 22 bp, Homo sapiens
aggacagctggctgctgacagg

SEQ ID NO: 5208059 - DNA, 13 bp, Homo sapiens
aggacagctgtcc

SEQ ID NO: 5208060 - DNA, 15 bp, Homo sapiens
aggacagcttcccca

SEQ ID NO: 5208061 - DNA, 14 bp, Homo sapiens
aggacaggaagctg

SEQ ID NO: 5208062 - DNA, 18 bp, Homo sapiens
aggacaggaagctggcag

SEQ ID NO: 5208063 - DNA, 17 bp, Homo sapiens
aggacaggaccctcagg

SEQ ID NO: 5208064 - DNA, 20 bp, Homo sapiens
aggacaggaggcggcccggc

SEQ ID NO: 5208065 - DNA, 20 bp, Homo sapiens
aggacaggatccaggccggc

SEQ ID NO: 5208066 - DNA, 14 bp, Homo sapiens
aggacaggcaggtg

SEQ ID NO: 5208067 - DNA, 21 bp, Homo sapiens
aggacaggccagtagggggag

SEQ ID NO: 5208068 - DNA, 13 bp, Homo sapiens
aggacagggctga

SEQ ID NO: 5208069 - DNA, 15 bp, Homo sapiens
aggacaggggttcct

SEQ ID NO: 5208070 - DNA, 16 bp, Homo sapiens
aggacaggggttcctt

SEQ ID NO: 5208071 - DNA, 21 bp, Homo sapiens
aggacaggtggaggcgagcca

SEQ ID NO: 5208072 - DNA, 19 bp, Homo sapiens
aggacagtaaactcactag

SEQ ID NO: 5208073 - DNA, 18 bp, Homo sapiens
aggacagtgctgacccca

SEQ ID NO: 5208074 - DNA, 21 bp, Homo sapiens
aggacagtgctgaccccagga

SEQ ID NO: 5208075 - DNA, 21 bp, Homo sapiens
aggacagtgcttcagcctgag

SEQ ID NO: 5208076 - DNA, 21 bp, Homo sapiens
aggacagtgcttgatacagga

SEQ ID NO: 5208077 - DNA, 20 bp, Homo sapiens
aggacagttcagagatcagg

SEQ ID NO: 5208078 - DNA, 20 bp, Homo sapiens
aggacagttgatggagcccc

SEQ ID NO: 5208079 - DNA, 18 bp, Homo sapiens
aggacagttgggctatgt

SEQ ID NO: 5208080 - DNA, 14 bp, Homo sapiens
aggacagtttagga

SEQ ID NO: 5208081 - DNA, 22 bp, Homo sapiens
aggacagtttatcctgtctgag

SEQ ID NO: 5208082 - DNA, 22 bp, Homo sapiens
aggacataaaatttaaaaactt

SEQ ID NO: 5208083 - DNA, 16 bp, Homo sapiens
aggacataaagagagc

SEQ ID NO: 5208084 - DNA, 16 bp, Homo sapiens
aggacatcagcaaaca

SEQ ID NO: 5208085 - DNA, 22 bp, Homo sapiens
aggacatcagcaaacaggatca

SEQ ID NO: 5208086 - DNA, 16 bp, Homo sapiens
aggacatctctgtaaa

SEQ ID NO: 5208087 - DNA, 13 bp, Homo sapiens
aggacatgaaact

SEQ ID NO: 5208088 - DNA, 18 bp, Homo sapiens
aggacatgaaactccacc

SEQ ID NO: 5208089 - DNA, 17 bp, Homo sapiens
aggacatgatgctttta

SEQ ID NO: 5208090 - DNA, 21 bp, Homo sapiens
aggacatgcatgacacttcca

SEQ ID NO: 5208091 - DNA, 22 bp, Homo sapiens
aggacatgcggtagccagcaca

SEQ ID NO: 5208092 - DNA, 19 bp, Homo sapiens
aggacatgcgtgtgtcagg

SEQ ID NO: 5208093 - DNA, 15 bp, Homo sapiens
aggacatggcttctg

SEQ ID NO: 5208094 - DNA, 22 bp, Homo sapiens
aggacatgggacttgcgtggac

SEQ ID NO: 5208095 - DNA, 14 bp, Homo sapiens
aggacatggggcat

SEQ ID NO: 5208096 - DNA, 22 bp, Homo sapiens
aggacatgtgctattgaactga

SEQ ID NO: 5208097 - DNA, 23 bp, Homo sapiens
aggacatgtttttgttttctttg

SEQ ID NO: 5208098 - DNA, 15 bp, Homo sapiens
aggacattatgtgtg

SEQ ID NO: 5208099 - DNA, 14 bp, Homo sapiens
aggacattccaaga

SEQ ID NO: 5208100 - DNA, 23 bp, Homo sapiens
aggacattgcggacagccacggc

SEQ ID NO: 5208101 - DNA, 22 bp, Homo sapiens
aggacattggccccgcagtgcc

SEQ ID NO: 5208102 - DNA, 15 bp, Homo sapiens
aggacatttcccagg

SEQ ID NO: 5208103 - DNA, 20 bp, Homo sapiens
aggacatttgtgggcaagca

SEQ ID NO: 5208104 - DNA, 17 bp, Homo sapiens
aggaccaaaaaaataag

SEQ ID NO: 5208105 - DNA, 20 bp, Homo sapiens
aggaccaaaaaacctcactg

SEQ ID NO: 5208106 - DNA, 21 bp, Homo sapiens
aggaccaactggcttctgtgc

SEQ ID NO: 5208107 - DNA, 16 bp, Homo sapiens
aggaccaagggcagag

SEQ ID NO: 5208108 - DNA, 13 bp, Homo sapiens
aggaccaaggggg

SEQ ID NO: 5208109 - DNA, 22 bp, Homo sapiens
aggaccacagtgggtggcacct

SEQ ID NO: 5208110 - DNA, 22 bp, Homo sapiens
aggaccaccagcaggcaggtgg

SEQ ID NO: 5208111 - DNA, 15 bp, Homo sapiens
aggaccaccctgcca

SEQ ID NO: 5208112 - DNA, 16 bp, Homo sapiens
aggaccacctcctctg

SEQ ID NO: 5208113 - DNA, 19 bp, Homo sapiens
aggaccactagctaagcaa

SEQ ID NO: 5208114 - DNA, 22 bp, Homo sapiens
aggaccactagctaagcaagcc

SEQ ID NO: 5208115 - DNA, 14 bp, Homo sapiens
aggaccactcagcc

SEQ ID NO: 5208116 - DNA, 17 bp, Homo sapiens
aggaccactcagcccct

SEQ ID NO: 5208117 - DNA, 19 bp, Homo sapiens
aggaccactcagcccctag

SEQ ID NO: 5208118 - DNA, 16 bp, Homo sapiens
aggaccactcctgtac

SEQ ID NO: 5208119 - DNA, 12 bp, Homo sapiens
aggaccagaagc

SEQ ID NO: 5208120 - DNA, 16 bp, Homo sapiens
aggaccagaagctccc

SEQ ID NO: 5208121 - DNA, 19 bp, Homo sapiens
aggaccagattgctctgcc

SEQ ID NO: 5208122 - DNA, 20 bp, Homo sapiens
aggaccagattgctctgccc

SEQ ID NO: 5208123 - DNA, 18 bp, Homo sapiens
aggaccagcccacgctga

SEQ ID NO: 5208124 - DNA, 14 bp, Homo sapiens
aggaccagctcagg

SEQ ID NO: 5208125 - DNA, 15 bp, Homo sapiens
aggaccagctcagga

SEQ ID NO: 5208126 - DNA, 19 bp, Homo sapiens
aggaccagctggggcgtgg

SEQ ID NO: 5208127 - DNA, 17 bp, Homo sapiens
aggaccaggacccaggg

SEQ ID NO: 5208128 - DNA, 19 bp, Homo sapiens
aggaccaggacccagggag

SEQ ID NO: 5208129 - DNA, 23 bp, Homo sapiens
aggaccaggactatagcccaggt

SEQ ID NO: 5208130 - DNA, 16 bp, Homo sapiens
aggaccaggagccagg

SEQ ID NO: 5208131 - DNA, 13 bp, Homo sapiens
aggaccaggcaat

SEQ ID NO: 5208132 - DNA, 15 bp, Homo sapiens
aggaccagggccttt

SEQ ID NO: 5208133 - DNA, 20 bp, Homo sapiens
aggaccagggccttttctgg

SEQ ID NO: 5208134 - DNA, 19 bp, Homo sapiens
aggaccagtcaacctgggc

SEQ ID NO: 5208135 - DNA, 22 bp, Homo sapiens
aggaccagtcaggatgaggccc

SEQ ID NO: 5208136 - DNA, 17 bp, Homo sapiens
aggaccagtcccagagc

SEQ ID NO: 5208137 - DNA, 12 bp, Homo sapiens
aggaccagtttt

SEQ ID NO: 5208138 - DNA, 12 bp, Homo sapiens
aggacccaagca

SEQ ID NO: 5208139 - DNA, 16 bp, Homo sapiens
aggacccacccatctt

SEQ ID NO: 5208140 - DNA, 20 bp, Homo sapiens
aggacccacccatcttcctg

SEQ ID NO: 5208141 - DNA, 15 bp, Homo sapiens
aggacccagagctgc

SEQ ID NO: 5208142 - DNA, 15 bp, Homo sapiens
aggacccagaggaag

SEQ ID NO: 5208143 - DNA, 14 bp, Homo sapiens
aggacccagccctc

SEQ ID NO: 5208144 - DNA, 12 bp, Homo sapiens
aggacccaggac

SEQ ID NO: 5208145 - DNA, 13 bp, Homo sapiens
aggacccaggaca

SEQ ID NO: 5208146 - DNA, 11 bp, Homo sapiens
aggacccaggc

SEQ ID NO: 5208147 - DNA, 12 bp, Homo sapiens
aggacccaggcc

SEQ ID NO: 5208148 - DNA, 16 bp, Homo sapiens
aggacccaggcgctgc

SEQ ID NO: 5208149 - DNA, 18 bp, Homo sapiens
aggacccaggcgctgcat

SEQ ID NO: 5208150 - DNA, 13 bp, Homo sapiens
aggacccagggct

SEQ ID NO: 5208151 - DNA, 12 bp, Homo sapiens
aggacccagggt

SEQ ID NO: 5208152 - DNA, 21 bp, Homo sapiens
aggacccagggtcccctcccc

SEQ ID NO: 5208153 - DNA, 20 bp, Homo sapiens
aggacccatcacgcctgtgc

SEQ ID NO: 5208154 - DNA, 14 bp, Homo sapiens
aggacccatccctg

SEQ ID NO: 5208155 - DNA, 16 bp, Homo sapiens
aggacccatccctgcc

SEQ ID NO: 5208156 - DNA, 23 bp, Homo sapiens
aggacccatccctgcctggaggc

SEQ ID NO: 5208157 - DNA, 19 bp, Homo sapiens
aggacccatgaaacagcag

SEQ ID NO: 5208158 - DNA, 14 bp, Homo sapiens
aggaccccagctct

SEQ ID NO: 5208159 - DNA, 14 bp, Homo sapiens
aggaccccagggtg

SEQ ID NO: 5208160 - DNA, 18 bp, Homo sapiens
aggaccccaggtcagggg

SEQ ID NO: 5208161 - DNA, 21 bp, Homo sapiens
aggaccccagtttgggaactc

SEQ ID NO: 5208162 - DNA, 18 bp, Homo sapiens
aggaccccatctgctgag

SEQ ID NO: 5208163 - DNA, 22 bp, Homo sapiens
aggaccccatctgctgagctct

SEQ ID NO: 5208164 - DNA, 19 bp, Homo sapiens
aggaccccattctgggact

SEQ ID NO: 5208165 - DNA, 20 bp, Homo sapiens
aggacccccccagtccgccc

SEQ ID NO: 5208166 - DNA, 22 bp, Homo sapiens
aggacccccgaggggagggcag

SEQ ID NO: 5208167 - DNA, 17 bp, Homo sapiens
aggaccccctccccaac

SEQ ID NO: 5208168 - DNA, 15 bp, Homo sapiens
aggacccccttcccc

SEQ ID NO: 5208169 - DNA, 16 bp, Homo sapiens
aggacccccttcccct

SEQ ID NO: 5208170 - DNA, 17 bp, Homo sapiens
aggacccccttccccta

SEQ ID NO: 5208171 - DNA, 12 bp, Homo sapiens
aggacccctcac

SEQ ID NO: 5208172 - DNA, 13 bp, Homo sapiens
aggacccctcacc

SEQ ID NO: 5208173 - DNA, 16 bp, Homo sapiens
aggacccctgccctcg

SEQ ID NO: 5208174 - DNA, 14 bp, Homo sapiens
aggacccctgcctt

SEQ ID NO: 5208175 - DNA, 18 bp, Homo sapiens
aggacccctgccttcctc

SEQ ID NO: 5208176 - DNA, 19 bp, Homo sapiens
aggacccctgccttcctct

SEQ ID NO: 5208177 - DNA, 22 bp, Homo sapiens
aggacccctgccttcctctgag

SEQ ID NO: 5208178 - DNA, 17 bp, Homo sapiens
aggacccgccagccccg

SEQ ID NO: 5208179 - DNA, 15 bp, Homo sapiens
aggctagatcatgaa

SEQ ID NO: 5208180 - DNA, 13 bp, Homo sapiens
aggctagatcccc

SEQ ID NO: 5208181 - DNA, 12 bp, Homo sapiens
aggctagcccca

SEQ ID NO: 5208182 - DNA, 14 bp, Homo sapiens
aggctagctgtgct

SEQ ID NO: 5208183 - DNA, 15 bp, Homo sapiens
aggctagcttctgct

SEQ ID NO: 5208184 - DNA, 18 bp, Homo sapiens
aggctagcttctgctttt

SEQ ID NO: 5208185 - DNA, 19 bp, Homo sapiens
aggctaggacgttggcctc

SEQ ID NO: 5208186 - DNA, 20 bp, Homo sapiens
aggctaggccagcaggggct

SEQ ID NO: 5208187 - DNA, 21 bp, Homo sapiens
aggctaggtgggttgaaagcc

SEQ ID NO: 5208188 - DNA, 23 bp, Homo sapiens
aggctaggtgggttgaaagccaa

SEQ ID NO: 5208189 - DNA, 18 bp, Homo sapiens
aggctagtccggacccac

SEQ ID NO: 5208190 - DNA, 20 bp, Homo sapiens
aggctagtctcttctcagag

SEQ ID NO: 5208191 - DNA, 23 bp, Homo sapiens
aggctagtgtggtgtttcctggc

SEQ ID NO: 5208192 - DNA, 15 bp, Homo sapiens
aggctataagaagta

SEQ ID NO: 5208193 - DNA, 23 bp, Homo sapiens
aggctatacttgtcttgttcacc

SEQ ID NO: 5208194 - DNA, 17 bp, Homo sapiens
aggctatcggagcagtt

SEQ ID NO: 5208195 - DNA, 22 bp, Homo sapiens
aggctatgaggaaactgagtca

SEQ ID NO: 5208196 - DNA, 22 bp, Homo sapiens
aggctatggacagggcatgcca

SEQ ID NO: 5208197 - DNA, 19 bp, Homo sapiens
aggctatggggatagatgt

SEQ ID NO: 5208198 - DNA, 21 bp, Homo sapiens
aggctatggggatagatgtgt

SEQ ID NO: 5208199 - DNA, 18 bp, Homo sapiens
aggctatggttgccaccc

SEQ ID NO: 5208200 - DNA, 17 bp, Homo sapiens
aggctatgtataaaata

SEQ ID NO: 5208201 - DNA, 18 bp, Homo sapiens
aggctatgtataaaatac

SEQ ID NO: 5208202 - DNA, 21 bp, Homo sapiens
aggctatgtataaaatacata

SEQ ID NO: 5208203 - DNA, 18 bp, Homo sapiens
aggctattattttcactg

SEQ ID NO: 5208204 - DNA, 21 bp, Homo sapiens
aggctattgtcccctaaacca

SEQ ID NO: 5208205 - DNA, 13 bp, Homo sapiens
aggctatttaaaa

SEQ ID NO: 5208206 - DNA, 11 bp, Homo sapiens
aggctatttgt

SEQ ID NO: 5208207 - DNA, 13 bp, Homo sapiens
aggctcaaaacag

SEQ ID NO: 5208208 - DNA, 23 bp, Homo sapiens
aggctcaaacaatgacaaagcag

SEQ ID NO: 5208209 - DNA, 15 bp, Homo sapiens
aggctcaacaataaa

SEQ ID NO: 5208210 - DNA, 23 bp, Homo sapiens
aggctcaaccttccaacttcctg

SEQ ID NO: 5208211 - DNA, 22 bp, Homo sapiens
aggctcaagaggcccagggagc

SEQ ID NO: 5208212 - DNA, 16 bp, Homo sapiens
aggctcacaactgttt

SEQ ID NO: 5208213 - DNA, 23 bp, Homo sapiens
aggctcacccccttctccatcca

SEQ ID NO: 5208214 - DNA, 22 bp, Homo sapiens
aggctcactgcaacttctgcct

SEQ ID NO: 5208215 - DNA, 14 bp, Homo sapiens
aggctcactgcagc

SEQ ID NO: 5208216 - DNA, 13 bp, Homo sapiens
aggctcactgcca

SEQ ID NO: 5208217 - DNA, 15 bp, Homo sapiens
aggctcactgccagg

SEQ ID NO: 5208218 - DNA, 11 bp, Homo sapiens
aggctcagaga

SEQ ID NO: 5208219 - DNA, 21 bp, Homo sapiens
aggctcagagatgtgcaccca

SEQ ID NO: 5208220 - DNA, 18 bp, Homo sapiens
aggctcagagggtgtcct

SEQ ID NO: 5208221 - DNA, 19 bp, Homo sapiens
aggctcagagggtgtcctg

SEQ ID NO: 5208222 - DNA, 20 bp, Homo sapiens
aggctcagagggtgtcctgc

SEQ ID NO: 5208223 - DNA, 12 bp, Homo sapiens
aggctcagccct

SEQ ID NO: 5208224 - DNA, 22 bp, Homo sapiens
aggctcagccctagccctcagc

SEQ ID NO: 5208225 - DNA, 12 bp, Homo sapiens
aggctcagcctt

SEQ ID NO: 5208226 - DNA, 15 bp, Homo sapiens
aggctcagccttgga

SEQ ID NO: 5208227 - DNA, 19 bp, Homo sapiens
aggctcagccttggaagca

SEQ ID NO: 5208228 - DNA, 18 bp, Homo sapiens
aggctcagcggcgaccgc

SEQ ID NO: 5208229 - DNA, 21 bp, Homo sapiens
aggctcaggacggaaggtcag

SEQ ID NO: 5208230 - DNA, 18 bp, Homo sapiens
aggctcaggagaagccag

SEQ ID NO: 5208231 - DNA, 22 bp, Homo sapiens
aggctcaggagaagccagtgtc

SEQ ID NO: 5208232 - DNA, 23 bp, Homo sapiens
aggctcaggagaagccagtgtct

SEQ ID NO: 5208233 - DNA, 14 bp, Homo sapiens
aggctcaggcaggg

SEQ ID NO: 5208234 - DNA, 17 bp, Homo sapiens
aggctcaggctgcccag

SEQ ID NO: 5208235 - DNA, 18 bp, Homo sapiens
aggctcaggctgcccagc

SEQ ID NO: 5208236 - DNA, 10 bp, Homo sapiens
aggctcaggt

SEQ ID NO: 5208237 - DNA, 17 bp, Homo sapiens
aggctcagtctcaggag

SEQ ID NO: 5208238 - DNA, 22 bp, Homo sapiens
aggctcagtggtagctctggct

SEQ ID NO: 5208239 - DNA, 20 bp, Homo sapiens
aggctcagtggtgggagaga

SEQ ID NO: 5208240 - DNA, 22 bp, Homo sapiens
aggctcatagggaagacctgct

SEQ ID NO: 5208241 - DNA, 22 bp, Homo sapiens
aggctcatctttctgcccggct

SEQ ID NO: 5208242 - DNA, 13 bp, Homo sapiens
aggctcatggccc

SEQ ID NO: 5208243 - DNA, 16 bp, Homo sapiens
aggctcatggccctgt

SEQ ID NO: 5208244 - DNA, 17 bp, Homo sapiens
aggctcatttaaaacag

SEQ ID NO: 5208245 - DNA, 18 bp, Homo sapiens
aggctccaagaggctgag

SEQ ID NO: 5208246 - DNA, 19 bp, Homo sapiens
aggctccaagaggctgagg

SEQ ID NO: 5208247 - DNA, 23 bp, Homo sapiens
aggctccaccttaactgtgctca

SEQ ID NO: 5208248 - DNA, 17 bp, Homo sapiens
aggctccacttggtctg

SEQ ID NO: 5208249 - DNA, 22 bp, Homo sapiens
aggctccacttggtctgtgaga

SEQ ID NO: 5208250 - DNA, 16 bp, Homo sapiens
aggctccagacaggag

SEQ ID NO: 5208251 - DNA, 13 bp, Homo sapiens
aggctccagaggg

SEQ ID NO: 5208252 - DNA, 15 bp, Homo sapiens
aggctccagagggca

SEQ ID NO: 5208253 - DNA, 20 bp, Homo sapiens
aggctccagcacatccccct

SEQ ID NO: 5208254 - DNA, 16 bp, Homo sapiens
aggctccagctctggc

SEQ ID NO: 5208255 - DNA, 17 bp, Homo sapiens
aggctccaggactccac

SEQ ID NO: 5208256 - DNA, 23 bp, Homo sapiens
aggctccaggactccactggaca

SEQ ID NO: 5208257 - DNA, 13 bp, Homo sapiens
aggctccaggagc

SEQ ID NO: 5208258 - DNA, 16 bp, Homo sapiens
aggctccaggagcagc

SEQ ID NO: 5208259 - DNA, 18 bp, Homo sapiens
aggctccaggagcagcca

SEQ ID NO: 5208260 - DNA, 19 bp, Homo sapiens
aggctccaggagcagccac

SEQ ID NO: 5208261 - DNA, 20 bp, Homo sapiens
aggctccatccttctcccca

SEQ ID NO: 5208262 - DNA, 17 bp, Homo sapiens
aggctccatgcacctcc

SEQ ID NO: 5208263 - DNA, 14 bp, Homo sapiens
aggctccatgggga

SEQ ID NO: 5208264 - DNA, 14 bp, Homo sapiens
aggctccattagga

SEQ ID NO: 5208265 - DNA, 18 bp, Homo sapiens
aggctcccaatcagcttt

SEQ ID NO: 5208266 - DNA, 20 bp, Homo sapiens
aggctcccagacccagggca

SEQ ID NO: 5208267 - DNA, 21 bp, Homo sapiens
aggctcccagacccagggcag

SEQ ID NO: 5208268 - DNA, 13 bp, Homo sapiens
aggctcccagcct

SEQ ID NO: 5208269 - DNA, 16 bp, Homo sapiens
aggctcccagcctaag

SEQ ID NO: 5208270 - DNA, 17 bp, Homo sapiens
aggctcccagcctaagg

SEQ ID NO: 5208271 - DNA, 15 bp, Homo sapiens
aggctcccagggaca

SEQ ID NO: 5208272 - DNA, 15 bp, Homo sapiens
aggctcccatgggct

SEQ ID NO: 5208273 - DNA, 14 bp, Homo sapiens
aggctccccaagac

SEQ ID NO: 5208274 - DNA, 15 bp, Homo sapiens
aggctccccaccccg

SEQ ID NO: 5208275 - DNA, 21 bp, Homo sapiens
aggctccccagaactggctgg

SEQ ID NO: 5208276 - DNA, 12 bp, Homo sapiens
aggctccccagg

SEQ ID NO: 5208277 - DNA, 13 bp, Homo sapiens
aggctccccaggg

SEQ ID NO: 5208278 - DNA, 14 bp, Homo sapiens
aggctccccagtgc

SEQ ID NO: 5208279 - DNA, 16 bp, Homo sapiens
aggctccccgcctcca

SEQ ID NO: 5208280 - DNA, 17 bp, Homo sapiens
aggctccccgcctccac

SEQ ID NO: 5208281 - DNA, 19 bp, Homo sapiens
aggctccccgcctccactc

SEQ ID NO: 5208282 - DNA, 15 bp, Homo sapiens
aggctcccctgagga

SEQ ID NO: 5208283 - DNA, 13 bp, Homo sapiens
aggctccccttct

SEQ ID NO: 5208284 - DNA, 22 bp, Homo sapiens
aggctcccggggcctggacagg

SEQ ID NO: 5208285 - DNA, 19 bp, Homo sapiens
aggctcccgttccgtggga

SEQ ID NO: 5208286 - DNA, 18 bp, Homo sapiens
aggctccctccctcccag

SEQ ID NO: 5208287 - DNA, 14 bp, Homo sapiens
aggctccctgacca

SEQ ID NO: 5208288 - DNA, 20 bp, Homo sapiens
aggctccctgaccaccctgc

SEQ ID NO: 5208289 - DNA, 21 bp, Homo sapiens
aggctccctgaccaccctgcc

SEQ ID NO: 5208290 - DNA, 22 bp, Homo sapiens
aggctccctgaccaccctgcct

SEQ ID NO: 5208291 - DNA, 18 bp, Homo sapiens
aggctccgggcaccaggg

SEQ ID NO: 5208292 - DNA, 19 bp, Homo sapiens
aggctccgggcaccagggg

SEQ ID NO: 5208293 - DNA, 15 bp, Homo sapiens
aggctccgtgagccc

SEQ ID NO: 5208294 - DNA, 18 bp, Homo sapiens
aggctccgtgagcccttg

SEQ ID NO: 5208295 - DNA, 19 bp, Homo sapiens
aggctcctacctgtctgct

SEQ ID NO: 5208296 - DNA, 16 bp, Homo sapiens
aggctcctcagccctc

SEQ ID NO: 5208297 - DNA, 17 bp, Homo sapiens
aggctcctcagccctct

SEQ ID NO: 5208298 - DNA, 20 bp, Homo sapiens
aggctcctcagccctctctt

SEQ ID NO: 5208299 - DNA, 22 bp, Homo sapiens
aggctcctcagccctctcttgc

SEQ ID NO: 5208300 - DNA, 14 bp, Homo sapiens
aggctcctccctct

SEQ ID NO: 5208301 - DNA, 15 bp, Homo sapiens
aggctcctccctctg

SEQ ID NO: 5208302 - DNA, 17 bp, Homo sapiens
aggctcctccctctgcc

SEQ ID NO: 5208303 - DNA, 23 bp, Homo sapiens
aggctcctccctctgcctcatcc

SEQ ID NO: 5208304 - DNA, 13 bp, Homo sapiens
aggctcctctagg

SEQ ID NO: 5208305 - DNA, 18 bp, Homo sapiens
aggctcctctaggccctg

SEQ ID NO: 5208306 - DNA, 11 bp, Homo sapiens
aggctcctctt

SEQ ID NO: 5208307 - DNA, 22 bp, Homo sapiens
aggctcctgaccccgccatgca

SEQ ID NO: 5208308 - DNA, 18 bp, Homo sapiens
aggctcctgagacacatg

SEQ ID NO: 5208309 - DNA, 12 bp, Homo sapiens
aggctcctggag

SEQ ID NO: 5208310 - DNA, 17 bp, Homo sapiens
aggctcctggctgtgcc

SEQ ID NO: 5208311 - DNA, 22 bp, Homo sapiens
aggctcctgggaggccctggca

SEQ ID NO: 5208312 - DNA, 13 bp, Homo sapiens
aggctcctgtgct

SEQ ID NO: 5208313 - DNA, 16 bp, Homo sapiens
aggctcctgttttgca

SEQ ID NO: 5208314 - DNA, 14 bp, Homo sapiens
aggctccttcctgt

SEQ ID NO: 5208315 - DNA, 23 bp, Homo sapiens
aggctccttcctgtcttcctgca

SEQ ID NO: 5208316 - DNA, 15 bp, Homo sapiens
aggctccttcctgtg

SEQ ID NO: 5208317 - DNA, 19 bp, Homo sapiens
aggctcgattttgtatctg

SEQ ID NO: 5208318 - DNA, 22 bp, Homo sapiens
aggctcgattttgtatctgcag

SEQ ID NO: 5208319 - DNA, 15 bp, Homo sapiens
aggctcgccaaggcc

SEQ ID NO: 5208320 - DNA, 17 bp, Homo sapiens
aggctcgccaaggccta

SEQ ID NO: 5208321 - DNA, 14 bp, Homo sapiens
aggctcggaatgtt

SEQ ID NO: 5208322 - DNA, 17 bp, Homo sapiens
aggctcggcctgccccc

SEQ ID NO: 5208323 - DNA, 18 bp, Homo sapiens
aggctcggggctccccac

SEQ ID NO: 5208324 - DNA, 20 bp, Homo sapiens
aggctcggggctccccacgc

SEQ ID NO: 5208325 - DNA, 15 bp, Homo sapiens
aggctctagagagag

SEQ ID NO: 5208326 - DNA, 19 bp, Homo sapiens
aggctctatgagtctagat

SEQ ID NO: 5208327 - DNA, 23 bp, Homo sapiens
aggctctatttcggaaatacact

SEQ ID NO: 5208328 - DNA, 12 bp, Homo sapiens
aggctctcaggc

SEQ ID NO: 5208329 - DNA, 16 bp, Homo sapiens
aggctctcaggccagc

SEQ ID NO: 5208330 - DNA, 19 bp, Homo sapiens
aggctctcaggccagctgc

SEQ ID NO: 5208331 - DNA, 19 bp, Homo sapiens
aggctctcatgtctctttg

SEQ ID NO: 5208332 - DNA, 22 bp, Homo sapiens
aggctctcccctctcgccccat

SEQ ID NO: 5208333 - DNA, 13 bp, Homo sapiens
aggctctccgggc

SEQ ID NO: 5208334 - DNA, 15 bp, Homo sapiens
aggctctctaagaaa

SEQ ID NO: 5208335 - DNA, 17 bp, Homo sapiens
aggctctctcctctctc

SEQ ID NO: 5208336 - DNA, 14 bp, Homo sapiens
aggctctctctgtc

SEQ ID NO: 5208337 - DNA, 18 bp, Homo sapiens
aggctctctgtaggcaca

SEQ ID NO: 5208338 - DNA, 18 bp, Homo sapiens
aggctctgaaagctgctt

SEQ ID NO: 5208339 - DNA, 18 bp, Homo sapiens
aggctctgaaatcttggg

SEQ ID NO: 5208340 - DNA, 12 bp, Homo sapiens
aggctctgaagg

SEQ ID NO: 5208341 - DNA, 17 bp, Homo sapiens
aggctctgagacacacc

SEQ ID NO: 5208342 - DNA, 14 bp, Homo sapiens
aggctctgagacta

SEQ ID NO: 5208343 - DNA, 13 bp, Homo sapiens
aggctctgagagt

SEQ ID NO: 5208344 - DNA, 14 bp, Homo sapiens
aggctctgccctgc

SEQ ID NO: 5208345 - DNA, 13 bp, Homo sapiens
aggctctgccctt

SEQ ID NO: 5208346 - DNA, 14 bp, Homo sapiens
aggctctgcccttg

SEQ ID NO: 5208347 - DNA, 11 bp, Homo sapiens
aggctctgcct

SEQ ID NO: 5208348 - DNA, 15 bp, Homo sapiens
aggctctgcctggag

SEQ ID NO: 5208349 - DNA, 17 bp, Homo sapiens
aggctctgctgacttct

SEQ ID NO: 5208350 - DNA, 22 bp, Homo sapiens
aggctctgctgacttctgagca

SEQ ID NO: 5208351 - DNA, 23 bp, Homo sapiens
aggctctggacagcagaagcctc

SEQ ID NO: 5208352 - DNA, 16 bp, Homo sapiens
aggctctggagccaga

SEQ ID NO: 5208353 - DNA, 17 bp, Homo sapiens
aggctctggagccagag

SEQ ID NO: 5208354 - DNA, 11 bp, Homo sapiens
aggctctggga

SEQ ID NO: 5208355 - DNA, 14 bp, Homo sapiens
aggctctgggcaca

SEQ ID NO: 5208356 - DNA, 15 bp, Homo sapiens
aggctctgggcacag

SEQ ID NO: 5208357 - DNA, 18 bp, Homo sapiens
aggctctgggcacagtgc

SEQ ID NO: 5208358 - DNA, 19 bp, Homo sapiens
aggacccgccagccccgct

SEQ ID NO: 5208359 - DNA, 22 bp, Homo sapiens
aggacccgccggatgacagcca

SEQ ID NO: 5208360 - DNA, 17 bp, Homo sapiens
aggacccgcctgctccc

SEQ ID NO: 5208361 - DNA, 21 bp, Homo sapiens
aggacccgcctgctcccatcc

SEQ ID NO: 5208362 - DNA, 17 bp, Homo sapiens
aggacccgggaccacag

SEQ ID NO: 5208363 - DNA, 22 bp, Homo sapiens
aggacccggggcccgcctcaca

SEQ ID NO: 5208364 - DNA, 20 bp, Homo sapiens
aggaccctcaggaattcagt

SEQ ID NO: 5208365 - DNA, 21 bp, Homo sapiens
aggaccctcaggaattcagtg

SEQ ID NO: 5208366 - DNA, 15 bp, Homo sapiens
aggaccctcccaggt

SEQ ID NO: 5208367 - DNA, 14 bp, Homo sapiens
aggaccctcgagag

SEQ ID NO: 5208368 - DNA, 17 bp, Homo sapiens
aggaccctcgagagcct

SEQ ID NO: 5208369 - DNA, 19 bp, Homo sapiens
aggaccctcgctggccccc

SEQ ID NO: 5208370 - DNA, 15 bp, Homo sapiens
aggaccctgaagggg

SEQ ID NO: 5208371 - DNA, 13 bp, Homo sapiens
aggaccctgacct

SEQ ID NO: 5208372 - DNA, 22 bp, Homo sapiens
aggaccctgacctccgcccctg

SEQ ID NO: 5208373 - DNA, 19 bp, Homo sapiens
aggaccctgagggtttcca

SEQ ID NO: 5208374 - DNA, 14 bp, Homo sapiens
aggaccctgagtcc

SEQ ID NO: 5208375 - DNA, 20 bp, Homo sapiens
aggaccctgagtccccacct

SEQ ID NO: 5208376 - DNA, 14 bp, Homo sapiens
aggaccctgccagg

SEQ ID NO: 5208377 - DNA, 15 bp, Homo sapiens
aggaccctgccaggc

SEQ ID NO: 5208378 - DNA, 14 bp, Homo sapiens
aggaccctgctgac

SEQ ID NO: 5208379 - DNA, 18 bp, Homo sapiens
aggaccctgtcctgcagt

SEQ ID NO: 5208380 - DNA, 19 bp, Homo sapiens
aggaccctgttttccacac

SEQ ID NO: 5208381 - DNA, 20 bp, Homo sapiens
aggacccttacgtgagaaat

SEQ ID NO: 5208382 - DNA, 19 bp, Homo sapiens
aggacccttcagaggtggc

SEQ ID NO: 5208383 - DNA, 20 bp, Homo sapiens
aggacccttcccttgagccc

SEQ ID NO: 5208384 - DNA, 14 bp, Homo sapiens
aggaccgccccaac

SEQ ID NO: 5208385 - DNA, 17 bp, Homo sapiens
aggaccgctgataagca

SEQ ID NO: 5208386 - DNA, 22 bp, Homo sapiens
aggaccgggagctttgggtgac

SEQ ID NO: 5208387 - DNA, 13 bp, Homo sapiens
aggaccgggctgg

SEQ ID NO: 5208388 - DNA, 17 bp, Homo sapiens
aggaccgtggccctgcc

SEQ ID NO: 5208389 - DNA, 19 bp, Homo sapiens
aggaccgtggccctgccct

SEQ ID NO: 5208390 - DNA, 18 bp, Homo sapiens
aggaccgttctctgtccc

SEQ ID NO: 5208391 - DNA, 22 bp, Homo sapiens
aggaccgttctctgtccccagg

SEQ ID NO: 5208392 - DNA, 16 bp, Homo sapiens
aggacctaaaacatct

SEQ ID NO: 5208393 - DNA, 18 bp, Homo sapiens
aggacctagagccgggca

SEQ ID NO: 5208394 - DNA, 21 bp, Homo sapiens
aggacctatcccaaatgtgga

SEQ ID NO: 5208395 - DNA, 13 bp, Homo sapiens
aggacctatgttg

SEQ ID NO: 5208396 - DNA, 13 bp, Homo sapiens
aggacctcaggcg

SEQ ID NO: 5208397 - DNA, 20 bp, Homo sapiens
aggacctccacctgggagat

SEQ ID NO: 5208398 - DNA, 23 bp, Homo sapiens
aggacctccacctgggagatgct

SEQ ID NO: 5208399 - DNA, 21 bp, Homo sapiens
aggacctccccctgtgtggcc

SEQ ID NO: 5208400 - DNA, 23 bp, Homo sapiens
aggacctccggagcgccctgcag

SEQ ID NO: 5208401 - DNA, 22 bp, Homo sapiens
aggacctcctcttcccccttcc

SEQ ID NO: 5208402 - DNA, 21 bp, Homo sapiens
aggacctcggatgaccatact

SEQ ID NO: 5208403 - DNA, 16 bp, Homo sapiens
aggacctcggggaata

SEQ ID NO: 5208404 - DNA, 23 bp, Homo sapiens
aggacctcggggaataaaacatt

SEQ ID NO: 5208405 - DNA, 13 bp, Homo sapiens
aggacctctgggc

SEQ ID NO: 5208406 - DNA, 14 bp, Homo sapiens
aggacctctgggct

SEQ ID NO: 5208407 - DNA, 18 bp, Homo sapiens
aggacctctgtaggcagc

SEQ ID NO: 5208408 - DNA, 19 bp, Homo sapiens
aggacctcttcagctgctg

SEQ ID NO: 5208409 - DNA, 17 bp, Homo sapiens
aggacctctttggggca

SEQ ID NO: 5208410 - DNA, 20 bp, Homo sapiens
aggacctgaaataaggtata

SEQ ID NO: 5208411 - DNA, 18 bp, Homo sapiens
aggacctgaaattccaaa

SEQ ID NO: 5208412 - DNA, 22 bp, Homo sapiens
aggacctgaccctactcccttg

SEQ ID NO: 5208413 - DNA, 14 bp, Homo sapiens
aggacctgagcctg

SEQ ID NO: 5208414 - DNA, 19 bp, Homo sapiens
aggacctgagcctgccgag

SEQ ID NO: 5208415 - DNA, 15 bp, Homo sapiens
aggacctgagcctgg

SEQ ID NO: 5208416 - DNA, 18 bp, Homo sapiens
aggacctgagcctggcca

SEQ ID NO: 5208417 - DNA, 21 bp, Homo sapiens
aggacctgagctggccaggcc

SEQ ID NO: 5208418 - DNA, 23 bp, Homo sapiens
aggacctgagctggccaggccct

SEQ ID NO: 5208419 - DNA, 13 bp, Homo sapiens
aggacctgcatcc

SEQ ID NO: 5208420 - DNA, 14 bp, Homo sapiens
aggacctgcatcct

SEQ ID NO: 5208421 - DNA, 19 bp, Homo sapiens
aggacctgcatccttcctg

SEQ ID NO: 5208422 - DNA, 12 bp, Homo sapiens
aggacctgcccc

SEQ ID NO: 5208423 - DNA, 20 bp, Homo sapiens
aggacctgcctagcatgggg

SEQ ID NO: 5208424 - DNA, 14 bp, Homo sapiens
aggacctgcctccc

SEQ ID NO: 5208425 - DNA, 16 bp, Homo sapiens
aggacctggagacagg

SEQ ID NO: 5208426 - DNA, 17 bp, Homo sapiens
aggacctggagacagga

SEQ ID NO: 5208427 - DNA, 19 bp, Homo sapiens
aggacctggcgtgctcaga

SEQ ID NO: 5208428 - DNA, 13 bp, Homo sapiens
aggacctggctgc

SEQ ID NO: 5208429 - DNA, 16 bp, Homo sapiens
aggacctggctgccat

SEQ ID NO: 5208430 - DNA, 17 bp, Homo sapiens
aggacctggctgccata

SEQ ID NO: 5208431 - DNA, 19 bp, Homo sapiens
aggacctgggacctcccct

SEQ ID NO: 5208432 - DNA, 17 bp, Homo sapiens
aggacctggggcacagt

SEQ ID NO: 5208433 - DNA, 16 bp, Homo sapiens
aggacctgtggccaag

SEQ ID NO: 5208434 - DNA, 18 bp, Homo sapiens
aggaccttcgggctgtgc

SEQ ID NO: 5208435 - DNA, 18 bp, Homo sapiens
aggaccttgcttccttct

SEQ ID NO: 5208436 - DNA, 20 bp, Homo sapiens
aggaccttgggcacatctgc

SEQ ID NO: 5208437 - DNA, 14 bp, Homo sapiens
aggaccttgggcca

SEQ ID NO: 5208438 - DNA, 16 bp, Homo sapiens
aggacctttctgagga

SEQ ID NO: 5208439 - DNA, 21 bp, Homo sapiens
aggacctttgggtctacaagt

SEQ ID NO: 5208440 - DNA, 19 bp, Homo sapiens
aggacgacgaatcttctca

SEQ ID NO: 5208441 - DNA, 14 bp, Homo sapiens
aggacgagaccccc

SEQ ID NO: 5208442 - DNA, 19 bp, Homo sapiens
aggacgagacccccatcca

SEQ ID NO: 5208443 - DNA, 21 bp, Homo sapiens
aggacgagacccccatccagc

SEQ ID NO: 5208444 - DNA, 22 bp, Homo sapiens
aggacgagacccccatccagcc

SEQ ID NO: 5208445 - DNA, 16 bp, Homo sapiens
aggacgagactcctcg

SEQ ID NO: 5208446 - DNA, 24 bp, Homo sapiens
aggacgcaccgccgccaccagccc

SEQ ID NO: 5208447 - DNA, 22 bp, Homo sapiens
aggacgcacgctcgctgccatc

SEQ ID NO: 5208448 - DNA, 14 bp, Homo sapiens
aggacgcatgcagg

SEQ ID NO: 5208449 - DNA, 13 bp, Homo sapiens
aggacgcattcca

SEQ ID NO: 5208450 - DNA, 15 bp, Homo sapiens
aggacgccacccagc

SEQ ID NO: 5208451 - DNA, 12 bp, Homo sapiens
aggacgccactc

SEQ ID NO: 5208452 - DNA, 18 bp, Homo sapiens
aggacgccactcatttca

SEQ ID NO: 5208453 - DNA, 19 bp, Homo sapiens
aggacgccactcatttcat

SEQ ID NO: 5208454 - DNA, 23 bp, Homo sapiens
aggacgccactcatttcatctca

SEQ ID NO: 5208455 - DNA, 22 bp, Homo sapiens
aggacgcctgcaggagagagca

SEQ ID NO: 5208456 - DNA, 13 bp, Homo sapiens
aggacgctctctg

SEQ ID NO: 5208457 - DNA, 19 bp, Homo sapiens
aggacgctctctggccttc

SEQ ID NO: 5208458 - DNA, 19 bp, Homo sapiens
aggacgctggctactgtct

SEQ ID NO: 5208459 - DNA, 19 bp, Homo sapiens
aggacgcttcacaggacag

SEQ ID NO: 5208460 - DNA, 13 bp, Homo sapiens
aggacggaagtgg

SEQ ID NO: 5208461 - DNA, 17 bp, Homo sapiens
aggacggagttcagagg

SEQ ID NO: 5208462 - DNA, 15 bp, Homo sapiens
aggacggccctgcct

SEQ ID NO: 5208463 - DNA, 16 bp, Homo sapiens
aggacggccctgcctg

SEQ ID NO: 5208464 - DNA, 23 bp, Homo sapiens
aggacggctcctcagagcgccag

SEQ ID NO: 5208465 - DNA, 13 bp, Homo sapiens
aggacggctgagc

SEQ ID NO: 5208466 - DNA, 14 bp, Homo sapiens
aggacggctgagca

SEQ ID NO: 5208467 - DNA, 15 bp, Homo sapiens
aggacggctgagcat

SEQ ID NO: 5208468 - DNA, 20 bp, Homo sapiens
aggacgggagtgagctgggg

SEQ ID NO: 5208469 - DNA, 16 bp, Homo sapiens
aggacggggccggcca

SEQ ID NO: 5208470 - DNA, 19 bp, Homo sapiens
aggacggggccggccaggt

SEQ ID NO: 5208471 - DNA, 20 bp, Homo sapiens
aggacggggccggccaggtg

SEQ ID NO: 5208472 - DNA, 16 bp, Homo sapiens
aggacggtgcaaccca

SEQ ID NO: 5208473 - DNA, 17 bp, Homo sapiens
aggacggtgccaagggc

SEQ ID NO: 5208474 - DNA, 19 bp, Homo sapiens
aggacggtgccaagggccc

SEQ ID NO: 5208475 - DNA, 21 bp, Homo sapiens
aggacggtgccaagggcccca

SEQ ID NO: 5208476 - DNA, 20 bp, Homo sapiens
aggacggttgtaagcagttg

SEQ ID NO: 5208477 - DNA, 21 bp, Homo sapiens
aggacggttgtaagcagttgt

SEQ ID NO: 5208478 - DNA, 15 bp, Homo sapiens
aggacgtaaaattta

SEQ ID NO: 5208479 - DNA, 14 bp, Homo sapiens
aggacgtacgtaat

SEQ ID NO: 5208480 - DNA, 16 bp, Homo sapiens
aggacgtatttataat

SEQ ID NO: 5208481 - DNA, 19 bp, Homo sapiens
aggacgtcctatctccccc

SEQ ID NO: 5208482 - DNA, 22 bp, Homo sapiens
aggacgtcctatctcccccaac

SEQ ID NO: 5208483 - DNA, 16 bp, Homo sapiens
aggacgttaggcccgg

SEQ ID NO: 5208484 - DNA, 15 bp, Homo sapiens
aggactaacaactgg

SEQ ID NO: 5208485 - DNA, 17 bp, Homo sapiens
aggactaacactcagaa

SEQ ID NO: 5208486 - DNA, 20 bp, Homo sapiens
aggactaacactcagaagcc

SEQ ID NO: 5208487 - DNA, 21 bp, Homo sapiens
aggactaacactcagaagcct

SEQ ID NO: 5208488 - DNA, 14 bp, Homo sapiens
aggactaaccatgt

SEQ ID NO: 5208489 - DNA, 21 bp, Homo sapiens
aggactaacgaacgttttaaa

SEQ ID NO: 5208490 - DNA, 21 bp, Homo sapiens
aggactaatccaatacctctt

SEQ ID NO: 5208491 - DNA, 21 bp, Homo sapiens
aggactacattttgctctgtg

SEQ ID NO: 5208492 - DNA, 16 bp, Homo sapiens
aggactactatttgaa

SEQ ID NO: 5208493 - DNA, 18 bp, Homo sapiens
aggactagaacctggagg

SEQ ID NO: 5208494 - DNA, 23 bp, Homo sapiens
aggactagagcacaacataattt

SEQ ID NO: 5208495 - DNA, 13 bp, Homo sapiens
aggactagatact

SEQ ID NO: 5208496 - DNA, 22 bp, Homo sapiens
aggactagatactactttctct

SEQ ID NO: 5208497 - DNA, 16 bp, Homo sapiens
aggactagggtcctgg

SEQ ID NO: 5208498 - DNA, 19 bp, Homo sapiens
aggactatagcccaggtcc

SEQ ID NO: 5208499 - DNA, 20 bp, Homo sapiens
aggactatatttgggcctgc

SEQ ID NO: 5208500 - DNA, 13 bp, Homo sapiens
aggactatttata

SEQ ID NO: 5208501 - DNA, 12 bp, Homo sapiens
aggactcaccct

SEQ ID NO: 5208502 - DNA, 19 bp, Homo sapiens
aggactcagctccccagag

SEQ ID NO: 5208503 - DNA, 20 bp, Homo sapiens
aggactcagctccccagagt

SEQ ID NO: 5208504 - DNA, 15 bp, Homo sapiens
aggactcaggcctgc

SEQ ID NO: 5208505 - DNA, 17 bp, Homo sapiens
aggactcaggcctgcca

SEQ ID NO: 5208506 - DNA, 17 bp, Homo sapiens
aggactccacccatcct

SEQ ID NO: 5208507 - DNA, 19 bp, Homo sapiens
aggactccactggacagac

SEQ ID NO: 5208508 - DNA, 23 bp, Homo sapiens
aggactccactggacagacccag

SEQ ID NO: 5208509 - DNA, 11 bp, Homo sapiens
aggactccagc

SEQ ID NO: 5208510 - DNA, 12 bp, Homo sapiens
aggactccagcc

SEQ ID NO: 5208511 - DNA, 23 bp, Homo sapiens
aggactccaggcagcagacacat

SEQ ID NO: 5208512 - DNA, 15 bp, Homo sapiens
aggactccaggccca

SEQ ID NO: 5208513 - DNA, 16 bp, Homo sapiens
aggactccaggcccaa

SEQ ID NO: 5208514 - DNA, 20 bp, Homo sapiens
aggactccaggcccaaggct

SEQ ID NO: 5208515 - DNA, 23 bp, Homo sapiens
aggactccaggcccaaggctccc

SEQ ID NO: 5208516 - DNA, 12 bp, Homo sapiens
aggactccaggg

SEQ ID NO: 5208517 - DNA, 21 bp, Homo sapiens
aggactccaggggctggggac

SEQ ID NO: 5208518 - DNA, 17 bp, Homo sapiens
aggactccatttctttc

SEQ ID NO: 5208519 - DNA, 18 bp, Homo sapiens
aggactccatttctttct

SEQ ID NO: 5208520 - DNA, 17 bp, Homo sapiens
aggactcccaaccctgg

SEQ ID NO: 5208521 - DNA, 19 bp, Homo sapiens
aggactcccaaccctggct

SEQ ID NO: 5208522 - DNA, 13 bp, Homo sapiens
aggactccccagg

SEQ ID NO: 5208523 - DNA, 16 bp, Homo sapiens
aggactccccaggcca

SEQ ID NO: 5208524 - DNA, 17 bp, Homo sapiens
aggactcccggagcctg

SEQ ID NO: 5208525 - DNA, 12 bp, Homo sapiens
aggactccctcc

SEQ ID NO: 5208526 - DNA, 13 bp, Homo sapiens
aggactccctcca

SEQ ID NO: 5208527 - DNA, 18 bp, Homo sapiens
aggactccctcctcacct

SEQ ID NO: 5208528 - DNA, 19 bp, Homo sapiens
aggactccctcctcacctc

SEQ ID NO: 5208529 - DNA, 23 bp, Homo sapiens
aggactccctcctcacctctgga

SEQ ID NO: 5208530 - DNA, 18 bp, Homo sapiens
aggactccgggaccattg

SEQ ID NO: 5208531 - DNA, 19 bp, Homo sapiens
aggactcctcctttttcca

SEQ ID NO: 5208532 - DNA, 14 bp, Homo sapiens
aggactcctggcag

SEQ ID NO: 5208533 - DNA, 18 bp, Homo sapiens
aggactcctggcagggcc

SEQ ID NO: 5208534 - DNA, 19 bp, Homo sapiens
aggactcctggcagggcca

SEQ ID NO: 5208535 - DNA, 12 bp, Homo sapiens
aggctctgggct

SEQ ID NO: 5208536 - DNA, 15 bp, Homo sapiens
aggctctgggctcag

SEQ ID NO: 5208537 - DNA, 16 bp, Homo sapiens
aggctctgggctcagg

SEQ ID NO: 5208538 - DNA, 19 bp, Homo sapiens
aggctctgggctcagggct

SEQ ID NO: 5208539 - DNA, 20 bp, Homo sapiens
aggctctgggctcagggctg

SEQ ID NO: 5208540 - DNA, 13 bp, Homo sapiens
aggctctggggca

SEQ ID NO: 5208541 - DNA, 14 bp, Homo sapiens
aggctctggggcag

SEQ ID NO: 5208542 - DNA, 19 bp, Homo sapiens
aggctctggggcagccccc

SEQ ID NO: 5208543 - DNA, 18 bp, Homo sapiens
aggctctgtgccttggtc

SEQ ID NO: 5208544 - DNA, 17 bp, Homo sapiens
aggctctgtgctgaccc

SEQ ID NO: 5208545 - DNA, 14 bp, Homo sapiens
aggctctgtggagg

SEQ ID NO: 5208546 - DNA, 19 bp, Homo sapiens
aggctctgtggagggcatt

SEQ ID NO: 5208547 - DNA, 16 bp, Homo sapiens
aggctctgttcctcaa

SEQ ID NO: 5208548 - DNA, 22 bp, Homo sapiens
aggctcttagcagcttccagat

SEQ ID NO: 5208549 - DNA, 19 bp, Homo sapiens
aggctcttatgtgtgcctt

SEQ ID NO: 5208550 - DNA, 15 bp, Homo sapiens
aggctcttcacatcc

SEQ ID NO: 5208551 - DNA, 16 bp, Homo sapiens
aggctcttcctggacc

SEQ ID NO: 5208552 - DNA, 16 bp, Homo sapiens
aggctcttctccccag

SEQ ID NO: 5208553 - DNA, 17 bp, Homo sapiens
aggctcttctccccaga

SEQ ID NO: 5208554 - DNA, 19 bp, Homo sapiens
aggctcttctccccagagt

SEQ ID NO: 5208555 - DNA, 13 bp, Homo sapiens
aggctcttctcct

SEQ ID NO: 5208556 - DNA, 15 bp, Homo sapiens
aggctgaaaagaagg

SEQ ID NO: 5208557 - DNA, 13 bp, Homo sapiens
aggctgaaaagtg

SEQ ID NO: 5208558 - DNA, 16 bp, Homo sapiens
aggctgaaaagtgctt

SEQ ID NO: 5208559 - DNA, 13 bp, Homo sapiens
aggctgaaagagg

SEQ ID NO: 5208560 - DNA, 17 bp, Homo sapiens
aggctgaaagaggccaa

SEQ ID NO: 5208561 - DNA, 22 bp, Homo sapiens
aggctgaaatatccacccagca

SEQ ID NO: 5208562 - DNA, 18 bp, Homo sapiens
aggctgaactcttcagaa

SEQ ID NO: 5208563 - DNA, 14 bp, Homo sapiens
aggctgaagagagg

SEQ ID NO: 5208564 - DNA, 18 bp, Homo sapiens
aggctgacattcactgag

SEQ ID NO: 5208565 - DNA, 20 bp, Homo sapiens
aggctgacattcactgagtg

SEQ ID NO: 5208566 - DNA, 15 bp, Homo sapiens
aggctgaccaagaga

SEQ ID NO: 5208567 - DNA, 13 bp, Homo sapiens
aggctgaccacag

SEQ ID NO: 5208568 - DNA, 22 bp, Homo sapiens
aggctgaccttgaactcctggg

SEQ ID NO: 5208569 - DNA, 16 bp, Homo sapiens
aggctgacgtgtgagg

SEQ ID NO: 5208570 - DNA, 16 bp, Homo sapiens
aggctgacttttccaa

SEQ ID NO: 5208571 - DNA, 18 bp, Homo sapiens
aggctgagacagtgaatt

SEQ ID NO: 5208572 - DNA, 14 bp, Homo sapiens
aggctgagactgca

SEQ ID NO: 5208573 - DNA, 17 bp, Homo sapiens
aggctgagactgcggga

SEQ ID NO: 5208574 - DNA, 23 bp, Homo sapiens
aggctgagagccagatgcctccc

SEQ ID NO: 5208575 - DNA, 12 bp, Homo sapiens
aggctgagcagg

SEQ ID NO: 5208576 - DNA, 13 bp, Homo sapiens
aggctgagcagga

SEQ ID NO: 5208577 - DNA, 14 bp, Homo sapiens
aggctgagcaggac

SEQ ID NO: 5208578 - DNA, 11 bp, Homo sapiens
aggctgagcca

SEQ ID NO: 5208579 - DNA, 15 bp, Homo sapiens
aggctgagccatgag

SEQ ID NO: 5208580 - DNA, 15 bp, Homo sapiens
aggctgagcccagcc

SEQ ID NO: 5208581 - DNA, 20 bp, Homo sapiens
aggctgagcccagccacctc

SEQ ID NO: 5208582 - DNA, 12 bp, Homo sapiens
aggctgagccct

SEQ ID NO: 5208583 - DNA, 11 bp, Homo sapiens
aggctgagcct

SEQ ID NO: 5208584 - DNA, 13 bp, Homo sapiens
aggctgagcctca

SEQ ID NO: 5208585 - DNA, 15 bp, Homo sapiens
aggctgagctggcat

SEQ ID NO: 5208586 - DNA, 14 bp, Homo sapiens
aggctgaggaaagg

SEQ ID NO: 5208587 - DNA, 19 bp, Homo sapiens
aggctgaggaaaggccagc

SEQ ID NO: 5208588 - DNA, 22 bp, Homo sapiens
aggctgaggaaaggccagctgg

SEQ ID NO: 5208589 - DNA, 18 bp, Homo sapiens
aggctgaggcaagagaat

SEQ ID NO: 5208590 - DNA, 13 bp, Homo sapiens
aggctgaggcaca

SEQ ID NO: 5208591 - DNA, 15 bp, Homo sapiens
aggctgaggcaccag

SEQ ID NO: 5208592 - DNA, 16 bp, Homo sapiens
aggctgaggcaggaga

SEQ ID NO: 5208593 - DNA, 17 bp, Homo sapiens
aggctgaggcaggagaa

SEQ ID NO: 5208594 - DNA, 14 bp, Homo sapiens
aggctgaggcaggc

SEQ ID NO: 5208595 - DNA, 15 bp, Homo sapiens
aggctgaggcctgga

SEQ ID NO: 5208596 - DNA, 16 bp, Homo sapiens
aggctgaggcctggac

SEQ ID NO: 5208597 - DNA, 17 bp, Homo sapiens
aggctgaggcctggact

SEQ ID NO: 5208598 - DNA, 17 bp, Homo sapiens
aggctgaggctggcaca

SEQ ID NO: 5208599 - DNA, 15 bp, Homo sapiens
aggctgagggctgcc

SEQ ID NO: 5208600 - DNA, 12 bp, Homo sapiens
aggctgaggtgg

SEQ ID NO: 5208601 - DNA, 22 bp, Homo sapiens
aggctgaggtggggaaggaggg

SEQ ID NO: 5208602 - DNA, 13 bp, Homo sapiens
aggctgaggtggt

SEQ ID NO: 5208603 - DNA, 24 bp, Homo sapiens
aggctgagtccagagcttgtgctc

SEQ ID NO: 5208604 - DNA, 22 bp, Homo sapiens
aggctgagtgagccacagacca

SEQ ID NO: 5208605 - DNA, 18 bp, Homo sapiens
aggctgagttctggttca

SEQ ID NO: 5208606 - DNA, 15 bp, Homo sapiens
aggctgatcatttgg

SEQ ID NO: 5208607 - DNA, 22 bp, Homo sapiens
aggctgatgccgtgcgggctaa

SEQ ID NO: 5208608 - DNA, 19 bp, Homo sapiens
aggctgatgggcaaaaaac

SEQ ID NO: 5208609 - DNA, 17 bp, Homo sapiens
aggctgattcctctcat

SEQ ID NO: 5208610 - DNA, 21 bp, Homo sapiens
aggctgattcctctcatttcc

SEQ ID NO: 5208611 - DNA, 22 bp, Homo sapiens
aggctgcaaagcaaaacagact

SEQ ID NO: 5208612 - DNA, 14 bp, Homo sapiens
aggctgcaacgctg

SEQ ID NO: 5208613 - DNA, 19 bp, Homo sapiens
aggctgcaacgctgattcc

SEQ ID NO: 5208614 - DNA, 18 bp, Homo sapiens
aggctgcaatgagccatg

SEQ ID NO: 5208615 - DNA, 18 bp, Homo sapiens
aggctgcacccctgggcc

SEQ ID NO: 5208616 - DNA, 16 bp, Homo sapiens
aggctgcactgcagtg

SEQ ID NO: 5208617 - DNA, 18 bp, Homo sapiens
aggctgcagaaggccaag

SEQ ID NO: 5208618 - DNA, 16 bp, Homo sapiens
aggctgcagagcccgg

SEQ ID NO: 5208619 - DNA, 18 bp, Homo sapiens
aggctgcagagctgaccc

SEQ ID NO: 5208620 - DNA, 18 bp, Homo sapiens
aggctgcagaggcacctc

SEQ ID NO: 5208621 - DNA, 21 bp, Homo sapiens
aggctgcagaggcacctcaac

SEQ ID NO: 5208622 - DNA, 20 bp, Homo sapiens
aggctgcagcaggcagagga

SEQ ID NO: 5208623 - DNA, 21 bp, Homo sapiens
aggctgcagcaggcagaggag

SEQ ID NO: 5208624 - DNA, 22 bp, Homo sapiens
aggctgcagcaggcagaggaga

SEQ ID NO: 5208625 - DNA, 20 bp, Homo sapiens
aggctgcagcaggtgctggg

SEQ ID NO: 5208626 - DNA, 23 bp, Homo sapiens
aggctgcagcaggtgctgggctg

SEQ ID NO: 5208627 - DNA, 14 bp, Homo sapiens
aggctgcagccagg

SEQ ID NO: 5208628 - DNA, 21 bp, Homo sapiens
aggctgcagccaggcctcgcc

SEQ ID NO: 5208629 - DNA, 23 bp, Homo sapiens
aggctgcagccaggcctcgcctg

SEQ ID NO: 5208630 - DNA, 20 bp, Homo sapiens
aggctgcagccgtggtccaa

SEQ ID NO: 5208631 - DNA, 12 bp, Homo sapiens
aggctgcagcct

SEQ ID NO: 5208632 - DNA, 17 bp, Homo sapiens
aggctgcagcctccact

SEQ ID NO: 5208633 - DNA, 23 bp, Homo sapiens
aggctgcagcgcccggtgctctg

SEQ ID NO: 5208634 - DNA, 17 bp, Homo sapiens
aggctgcagctaatttg

SEQ ID NO: 5208635 - DNA, 14 bp, Homo sapiens
aggctgcagctgga

SEQ ID NO: 5208636 - DNA, 20 bp, Homo sapiens
aggctgcagctggacagagg

SEQ ID NO: 5208637 - DNA, 14 bp, Homo sapiens
aggctgcagggaca

SEQ ID NO: 5208638 - DNA, 12 bp, Homo sapiens
aggctgcagtgc

SEQ ID NO: 5208639 - DNA, 15 bp, Homo sapiens
aggctgcatagaagg

SEQ ID NO: 5208640 - DNA, 16 bp, Homo sapiens
aggctgcatagaagga

SEQ ID NO: 5208641 - DNA, 17 bp, Homo sapiens
aggctgcatagaaggag

SEQ ID NO: 5208642 - DNA, 15 bp, Homo sapiens
aggctgcatgctctg

SEQ ID NO: 5208643 - DNA, 19 bp, Homo sapiens
aggctgcatgctctggaag

SEQ ID NO: 5208644 - DNA, 21 bp, Homo sapiens
aggctgcattgaaaagagctg

SEQ ID NO: 5208645 - DNA, 17 bp, Homo sapiens
aggctgccaaggccaga

SEQ ID NO: 5208646 - DNA, 15 bp, Homo sapiens
aggctgccagacatg

SEQ ID NO: 5208647 - DNA, 16 bp, Homo sapiens
aggctgccagacatgg

SEQ ID NO: 5208648 - DNA, 16 bp, Homo sapiens
aggctgccaggcacca

SEQ ID NO: 5208649 - DNA, 19 bp, Homo sapiens
aggctgccaggcaccatct

SEQ ID NO: 5208650 - DNA, 13 bp, Homo sapiens
aggctgccagtgc

SEQ ID NO: 5208651 - DNA, 14 bp, Homo sapiens
aggctgccagtgcc

SEQ ID NO: 5208652 - DNA, 19 bp, Homo sapiens
aggctgccagtgcctgggt

SEQ ID NO: 5208653 - DNA, 15 bp, Homo sapiens
aggctgcccaatctg

SEQ ID NO: 5208654 - DNA, 11 bp, Homo sapiens
aggctgcccag

SEQ ID NO: 5208655 - DNA, 15 bp, Homo sapiens
aggctgcccagagct

SEQ ID NO: 5208656 - DNA, 12 bp, Homo sapiens
aggctgcccagc

SEQ ID NO: 5208657 - DNA, 21 bp, Homo sapiens
aggctgcccagcggctcttcc

SEQ ID NO: 5208658 - DNA, 20 bp, Homo sapiens
aggctgccccacccctccat

SEQ ID NO: 5208659 - DNA, 12 bp, Homo sapiens
aggctgccccag

SEQ ID NO: 5208660 - DNA, 19 bp, Homo sapiens
aggctgccccaggccggag

SEQ ID NO: 5208661 - DNA, 20 bp, Homo sapiens
aggctgccccaggccggagc

SEQ ID NO: 5208662 - DNA, 21 bp, Homo sapiens
aggctgcccccaacactccag

SEQ ID NO: 5208663 - DNA, 16 bp, Homo sapiens
aggctgcccccatcca

SEQ ID NO: 5208664 - DNA, 12 bp, Homo sapiens
aggctgcccccg

SEQ ID NO: 5208665 - DNA, 15 bp, Homo sapiens
aggctgcccccggcc

SEQ ID NO: 5208666 - DNA, 23 bp, Homo sapiens
aggctgccccgggtccccagctc

SEQ ID NO: 5208667 - DNA, 12 bp, Homo sapiens
aggctgccctcc

SEQ ID NO: 5208668 - DNA, 15 bp, Homo sapiens
aggctgccctgaccc

SEQ ID NO: 5208669 - DNA, 16 bp, Homo sapiens
aggctgccctgagggg

SEQ ID NO: 5208670 - DNA, 17 bp, Homo sapiens
aggctgccctgaggggc

SEQ ID NO: 5208671 - DNA, 13 bp, Homo sapiens
aggctgccctggg

SEQ ID NO: 5208672 - DNA, 16 bp, Homo sapiens
aggctgccgctgctct

SEQ ID NO: 5208673 - DNA, 18 bp, Homo sapiens
aggctgccgctgctctcc

SEQ ID NO: 5208674 - DNA, 20 bp, Homo sapiens
aggctgccgctgctctccca

SEQ ID NO: 5208675 - DNA, 21 bp, Homo sapiens
aggctgccgctgctctcccag

SEQ ID NO: 5208676 - DNA, 22 bp, Homo sapiens
aggctgccggagggagccctga

SEQ ID NO: 5208677 - DNA, 14 bp, Homo sapiens
aggctgccggctgc

SEQ ID NO: 5208678 - DNA, 16 bp, Homo sapiens
aggctgccgtccccta

SEQ ID NO: 5208679 - DNA, 22 bp, Homo sapiens
aggctgccgtcccctagagtcc

SEQ ID NO: 5208680 - DNA, 17 bp, Homo sapiens
aggctgcctatgttggg

SEQ ID NO: 5208681 - DNA, 16 bp, Homo sapiens
aggctgcctcagccag

SEQ ID NO: 5208682 - DNA, 23 bp, Homo sapiens
aggctgcctcagccagtggcaca

SEQ ID NO: 5208683 - DNA, 19 bp, Homo sapiens
aggctgcctccgcacctga

SEQ ID NO: 5208684 - DNA, 14 bp, Homo sapiens
aggctgcctctggg

SEQ ID NO: 5208685 - DNA, 22 bp, Homo sapiens
aggctgcctctgggtgagtggc

SEQ ID NO: 5208686 - DNA, 19 bp, Homo sapiens
aggctgcctgagcacctcc

SEQ ID NO: 5208687 - DNA, 13 bp, Homo sapiens
aggctgcctgagt

SEQ ID NO: 5208688 - DNA, 24 bp, Homo sapiens
aggctgcctgagtcgtgacctgct

SEQ ID NO: 5208689 - DNA, 12 bp, Homo sapiens
aggctgcctgcc

SEQ ID NO: 5208690 - DNA, 16 bp, Homo sapiens
aggctgcctggagaaa

SEQ ID NO: 5208691 - DNA, 15 bp, Homo sapiens
aggctgcctgggcct

SEQ ID NO: 5208692 - DNA, 17 bp, Homo sapiens
aggctgcggcccctccc

SEQ ID NO: 5208693 - DNA, 18 bp, Homo sapiens
aggctgcggcccctcccc

SEQ ID NO: 5208694 - DNA, 16 bp, Homo sapiens
aggctgcgtccctccg

SEQ ID NO: 5208695 - DNA, 21 bp, Homo sapiens
aggctgcgtccctccgagctt

SEQ ID NO: 5208696 - DNA, 14 bp, Homo sapiens
aggctgctcagagg

SEQ ID NO: 5208697 - DNA, 17 bp, Homo sapiens
aggctgctccctgaggg

SEQ ID NO: 5208698 - DNA, 19 bp, Homo sapiens
aggctgctccctgagggcg

SEQ ID NO: 5208699 - DNA, 20 bp, Homo sapiens
aggctgctcggggtgcacag

SEQ ID NO: 5208700 - DNA, 16 bp, Homo sapiens
aggctgctctgcctgt

SEQ ID NO: 5208701 - DNA, 18 bp, Homo sapiens
aggctgctcttgaattcc

SEQ ID NO: 5208702 - DNA, 10 bp, Homo sapiens
aggctgctgc

SEQ ID NO: 5208703 - DNA, 13 bp, Homo sapiens
aggctgctgcaca

SEQ ID NO: 5208704 - DNA, 16 bp, Homo sapiens
aggctgctgccaggcc

SEQ ID NO: 5208705 - DNA, 13 bp, Homo sapiens
aggctgctgcccc

SEQ ID NO: 5208706 - DNA, 18 bp, Homo sapiens
aggctgctgccccctggc

SEQ ID NO: 5208707 - DNA, 19 bp, Homo sapiens
aggctgctgccccctggct

SEQ ID NO: 5208708 - DNA, 20 bp, Homo sapiens
aggctgctgccctgctgtgg

SEQ ID NO: 5208709 - DNA, 13 bp, Homo sapiens
aggctgctgccgg

SEQ ID NO: 5208710 - DNA, 14 bp, Homo sapiens
aggctgctgccgga

SEQ ID NO: 5208711 - DNA, 16 bp, Homo sapiens
aggctgctgctgtgac

SEQ ID NO: 5208712 - DNA, 12 bp, Homo sapiens
aggctgctggcg

SEQ ID NO: 5208713 - DNA, 14 bp, Homo sapiens
aggctgctggcgcc

SEQ ID NO: 5208714 - DNA, 21 bp, Homo sapiens
aggctgctggcttcagggagg

SEQ ID NO: 5208715 - DNA, 14 bp, Homo sapiens
aggctgctgggaga

SEQ ID NO: 5208716 - DNA, 15 bp, Homo sapiens
aggactcgcttgtaa

SEQ ID NO: 5208717 - DNA, 16 bp, Homo sapiens
aggactcgcttgtaaa

SEQ ID NO: 5208718 - DNA, 20 bp, Homo sapiens
aggactcgcttgtaaatacc

SEQ ID NO: 5208719 - DNA, 15 bp, Homo sapiens
aggactcggccactg

SEQ ID NO: 5208720 - DNA, 19 bp, Homo sapiens
aggactcggccactgtgtc

SEQ ID NO: 5208721 - DNA, 16 bp, Homo sapiens
aggactctatccctgg

SEQ ID NO: 5208722 - DNA, 19 bp, Homo sapiens
aggactctctttcttccac

SEQ ID NO: 5208723 - DNA, 13 bp, Homo sapiens
aggactctgaggc

SEQ ID NO: 5208724 - DNA, 17 bp, Homo sapiens
aggactctgaggctctt

SEQ ID NO: 5208725 - DNA, 13 bp, Homo sapiens
aggactctgcaga

SEQ ID NO: 5208726 - DNA, 14 bp, Homo sapiens
aggactctgcagcc

SEQ ID NO: 5208727 - DNA, 15 bp, Homo sapiens
aggactctgcccaga

SEQ ID NO: 5208728 - DNA, 17 bp, Homo sapiens
aggactctgccccttct

SEQ ID NO: 5208729 - DNA, 19 bp, Homo sapiens
aggactctgcctcctcttc

SEQ ID NO: 5208730 - DNA, 19 bp, Homo sapiens
aggactctgccttccaggc

SEQ ID NO: 5208731 - DNA, 14 bp, Homo sapiens
aggactctgccttt

SEQ ID NO: 5208732 - DNA, 14 bp, Homo sapiens
aggactctgcttaa

SEQ ID NO: 5208733 - DNA, 12 bp, Homo sapiens
aggactctggac

SEQ ID NO: 5208734 - DNA, 13 bp, Homo sapiens
aggactctggcct

SEQ ID NO: 5208735 - DNA, 21 bp, Homo sapiens
aggactctttccgactgccca

SEQ ID NO: 5208736 - DNA, 23 bp, Homo sapiens
aggactctttccgactgcccaga

SEQ ID NO: 5208737 - DNA, 15 bp, Homo sapiens
aggactgaactccat

SEQ ID NO: 5208738 - DNA, 12 bp, Homo sapiens
aggactgaagaa

SEQ ID NO: 5208739 - DNA, 20 bp, Homo sapiens
aggactgaattatgaaactt

SEQ ID NO: 5208740 - DNA, 19 bp, Homo sapiens
aggactgaattgtccccag

SEQ ID NO: 5208741 - DNA, 18 bp, Homo sapiens
aggactgacctgcccctg

SEQ ID NO: 5208742 - DNA, 16 bp, Homo sapiens
aggactgactgaggca

SEQ ID NO: 5208743 - DNA, 18 bp, Homo sapiens
aggactgactgaggcagt

SEQ ID NO: 5208744 - DNA, 20 bp, Homo sapiens
aggactgagcaccctctgga

SEQ ID NO: 5208745 - DNA, 13 bp, Homo sapiens
aggactgagcccc

SEQ ID NO: 5208746 - DNA, 16 bp, Homo sapiens
aggactgagcccccac

SEQ ID NO: 5208747 - DNA, 14 bp, Homo sapiens
aggactgagccctc

SEQ ID NO: 5208748 - DNA, 15 bp, Homo sapiens
aggactgagccctct

SEQ ID NO: 5208749 - DNA, 13 bp, Homo sapiens
aggactgagggca

SEQ ID NO: 5208750 - DNA, 23 bp, Homo sapiens
aggactgagtcccctccaggaag

SEQ ID NO: 5208751 - DNA, 22 bp, Homo sapiens
aggactgattgaattacggaaa

SEQ ID NO: 5208752 - DNA, 12 bp, Homo sapiens
aggactgcacca

SEQ ID NO: 5208753 - DNA, 19 bp, Homo sapiens
aggactgcaccattgctgc

SEQ ID NO: 5208754 - DNA, 15 bp, Homo sapiens
aggactgcagagcag

SEQ ID NO: 5208755 - DNA, 20 bp, Homo sapiens
aggactgcatggtaatttat

SEQ ID NO: 5208756 - DNA, 21 bp, Homo sapiens
aggactgcatggtaatttata

SEQ ID NO: 5208757 - DNA, 17 bp, Homo sapiens
aggactgccgaccgagg

SEQ ID NO: 5208758 - DNA, 20 bp, Homo sapiens
aggactgctggtttgtagtt

SEQ ID NO: 5208759 - DNA, 22 bp, Homo sapiens
aggactggaactgcaactccag

SEQ ID NO: 5208760 - DNA, 22 bp, Homo sapiens
aggactggagaccgcttcaccc

SEQ ID NO: 5208761 - DNA, 15 bp, Homo sapiens
aggactggctcaccc

SEQ ID NO: 5208762 - DNA, 23 bp, Homo sapiens
aggactggctgccccgtgacaca

SEQ ID NO: 5208763 - DNA, 16 bp, Homo sapiens
aggactgggagccccc

SEQ ID NO: 5208764 - DNA, 11 bp, Homo sapiens
aggactgggcc

SEQ ID NO: 5208765 - DNA, 19 bp, Homo sapiens
aggactgggtctgacctgg

SEQ ID NO: 5208766 - DNA, 21 bp, Homo sapiens
aggactggtactcaagccagc

SEQ ID NO: 5208767 - DNA, 22 bp, Homo sapiens
aggactggtgaatataaatgat

SEQ ID NO: 5208768 - DNA, 22 bp, Homo sapiens
aggactggtgcgaccccccacc

SEQ ID NO: 5208769 - DNA, 20 bp, Homo sapiens
aggactggttgtctctcttc

SEQ ID NO: 5208770 - DNA, 23 bp, Homo sapiens
aggactgtagtttaatacttttt

SEQ ID NO: 5208771 - DNA, 18 bp, Homo sapiens
aggactgtatagtttaaa

SEQ ID NO: 5208772 - DNA, 18 bp, Homo sapiens
aggactgtatttgtgact

SEQ ID NO: 5208773 - DNA, 14 bp, Homo sapiens
aggactgtcccctt

SEQ ID NO: 5208774 - DNA, 15 bp, Homo sapiens
aggactgtcctccca

SEQ ID NO: 5208775 - DNA, 17 bp, Homo sapiens
aggactgtgacaggcag

SEQ ID NO: 5208776 - DNA, 20 bp, Homo sapiens
aggactgtgacaggcagcag

SEQ ID NO: 5208777 - DNA, 22 bp, Homo sapiens
aggactgtgactcattcccagt

SEQ ID NO: 5208778 - DNA, 21 bp, Homo sapiens
aggactgtgataatcagaagc

SEQ ID NO: 5208779 - DNA, 20 bp, Homo sapiens
aggactgtgatgccctgccc

SEQ ID NO: 5208780 - DNA, 17 bp, Homo sapiens
aggactgtggaggggag

SEQ ID NO: 5208781 - DNA, 18 bp, Homo sapiens
aggactgtggaggggagc

SEQ ID NO: 5208782 - DNA, 20 bp, Homo sapiens
aggactgtggaggggagctg

SEQ ID NO: 5208783 - DNA, 15 bp, Homo sapiens
aggactgtggctgca

SEQ ID NO: 5208784 - DNA, 17 bp, Homo sapiens
aggactgtggctgcagg

SEQ ID NO: 5208785 - DNA, 23 bp, Homo sapiens
aggactgtgtttccaaaggttcc

SEQ ID NO: 5208786 - DNA, 18 bp, Homo sapiens
aggactgttggctgattg

SEQ ID NO: 5208787 - DNA, 21 bp, Homo sapiens
aggactgttttttcctgagct

SEQ ID NO: 5208788 - DNA, 11 bp, Homo sapiens
aggacttaaaa

SEQ ID NO: 5208789 - DNA, 20 bp, Homo sapiens
aggacttaaaattagtcttt

SEQ ID NO: 5208790 - DNA, 15 bp, Homo sapiens
aggacttaaccttga

SEQ ID NO: 5208791 - DNA, 17 bp, Homo sapiens
aggacttaacggctcca

SEQ ID NO: 5208792 - DNA, 18 bp, Homo sapiens
aggacttaagacaaatgg

SEQ ID NO: 5208793 - DNA, 18 bp, Homo sapiens
aggacttaatttagcagt

SEQ ID NO: 5208794 - DNA, 15 bp, Homo sapiens
aggacttacccagta

SEQ ID NO: 5208795 - DNA, 19 bp, Homo sapiens
aggacttatttaaactctg

SEQ ID NO: 5208796 - DNA, 22 bp, Homo sapiens
aggacttcaaagtgtgtctggg

SEQ ID NO: 5208797 - DNA, 22 bp, Homo sapiens
aggacttcccccaccccagaag

SEQ ID NO: 5208798 - DNA, 14 bp, Homo sapiens
aggacttcctgcta

SEQ ID NO: 5208799 - DNA, 22 bp, Homo sapiens
aggacttcctgctacagtagct

SEQ ID NO: 5208800 - DNA, 14 bp, Homo sapiens
aggacttctgcagc

SEQ ID NO: 5208801 - DNA, 15 bp, Homo sapiens
aggacttctgcctga

SEQ ID NO: 5208802 - DNA, 14 bp, Homo sapiens
aggacttctttaat

SEQ ID NO: 5208803 - DNA, 23 bp, Homo sapiens
aggacttctttaattttggaatt

SEQ ID NO: 5208804 - DNA, 16 bp, Homo sapiens
aggacttgaaagaaat

SEQ ID NO: 5208805 - DNA, 17 bp, Homo sapiens
aggacttgatgtacata

SEQ ID NO: 5208806 - DNA, 23 bp, Homo sapiens
aggacttgccacccccagttcct

SEQ ID NO: 5208807 - DNA, 23 bp, Homo sapiens
aggacttgccctcgtggtggaaa

SEQ ID NO: 5208808 - DNA, 19 bp, Homo sapiens
aggacttgctaaagcactt

SEQ ID NO: 5208809 - DNA, 24 bp, Homo sapiens
aggacttgctaaagcactttgcac

SEQ ID NO: 5208810 - DNA, 22 bp, Homo sapiens
aggacttgcttccaagcccttc

SEQ ID NO: 5208811 - DNA, 19 bp, Homo sapiens
aggacttgggggcagagca

SEQ ID NO: 5208812 - DNA, 16 bp, Homo sapiens
aggacttggggtcagg

SEQ ID NO: 5208813 - DNA, 20 bp, Homo sapiens
aggacttggtctgatttcag

SEQ ID NO: 5208814 - DNA, 14 bp, Homo sapiens
aggacttggtcttt

SEQ ID NO: 5208815 - DNA, 18 bp, Homo sapiens
aggacttggttgatgttt

SEQ ID NO: 5208816 - DNA, 14 bp, Homo sapiens
aggacttgttagat

SEQ ID NO: 5208817 - DNA, 17 bp, Homo sapiens
aggacttgttagatcta

SEQ ID NO: 5208818 - DNA, 18 bp, Homo sapiens
aggactttagggatctgg

SEQ ID NO: 5208819 - DNA, 16 bp, Homo sapiens
aggactttccagtgag

SEQ ID NO: 5208820 - DNA, 17 bp, Homo sapiens
aggactttcttctaaat

SEQ ID NO: 5208821 - DNA, 20 bp, Homo sapiens
aggactttggtcacccagac

SEQ ID NO: 5208822 - DNA, 13 bp, Homo sapiens
aggactttgtaca

SEQ ID NO: 5208823 - DNA, 15 bp, Homo sapiens
aggactttgtacatt

SEQ ID NO: 5208824 - DNA, 12 bp, Homo sapiens
aggactttgtta

SEQ ID NO: 5208825 - DNA, 19 bp, Homo sapiens
aggactttgttaacttcag

SEQ ID NO: 5208826 - DNA, 22 bp, Homo sapiens
aggacttttaaatggcagtatt

SEQ ID NO: 5208827 - DNA, 14 bp, Homo sapiens
aggactttttctta

SEQ ID NO: 5208828 - DNA, 21 bp, Homo sapiens
aggagaaaaaaaaagtgaaaa

SEQ ID NO: 5208829 - DNA, 13 bp, Homo sapiens
aggagaaaaagaa

SEQ ID NO: 5208830 - DNA, 14 bp, Homo sapiens
aggagaaaaagaag

SEQ ID NO: 5208831 - DNA, 17 bp, Homo sapiens
aggagaaaaagaagaaa

SEQ ID NO: 5208832 - DNA, 20 bp, Homo sapiens
aggagaaaaagaagaaaaga

SEQ ID NO: 5208833 - DNA, 22 bp, Homo sapiens
aggagaaaagtgggctgcagca

SEQ ID NO: 5208834 - DNA, 20 bp, Homo sapiens
aggagaaaatgcaatttgat

SEQ ID NO: 5208835 - DNA, 12 bp, Homo sapiens
aggagaaacaca

SEQ ID NO: 5208836 - DNA, 14 bp, Homo sapiens
aggagaaacacatc

SEQ ID NO: 5208837 - DNA, 18 bp, Homo sapiens
aggagaaacacattctta

SEQ ID NO: 5208838 - DNA, 14 bp, Homo sapiens
aggagaaacagaga

SEQ ID NO: 5208839 - DNA, 18 bp, Homo sapiens
aggagaaacagagacagg

SEQ ID NO: 5208840 - DNA, 18 bp, Homo sapiens
aggagaaactctagactg

SEQ ID NO: 5208841 - DNA, 19 bp, Homo sapiens
aggagaaactggaactctc

SEQ ID NO: 5208842 - DNA, 22 bp, Homo sapiens
aggagaaagaaagtacccagca

SEQ ID NO: 5208843 - DNA, 18 bp, Homo sapiens
aggagaaagcaaaataca

SEQ ID NO: 5208844 - DNA, 19 bp, Homo sapiens
aggagaaagcaaaatacat

SEQ ID NO: 5208845 - DNA, 16 bp, Homo sapiens
aggagaaaggagctct

SEQ ID NO: 5208846 - DNA, 23 bp, Homo sapiens
aggagaaaggggtgattgaaaga

SEQ ID NO: 5208847 - DNA, 14 bp, Homo sapiens
aggagaaatctcag

SEQ ID NO: 5208848 - DNA, 19 bp, Homo sapiens
aggagaaatgcaataactc

SEQ ID NO: 5208849 - DNA, 16 bp, Homo sapiens
aggagaaattttggtt

SEQ ID NO: 5208850 - DNA, 12 bp, Homo sapiens
aggagaacaaat

SEQ ID NO: 5208851 - DNA, 19 bp, Homo sapiens
aggagaaccaaatctggaa

SEQ ID NO: 5208852 - DNA, 16 bp, Homo sapiens
aggagaactgtgctct

SEQ ID NO: 5208853 - DNA, 17 bp, Homo sapiens
aggagaagacccctgcc

SEQ ID NO: 5208854 - DNA, 19 bp, Homo sapiens
aggagaagacccctgccca

SEQ ID NO: 5208855 - DNA, 20 bp, Homo sapiens
aggagaagacccctgcccaa

SEQ ID NO: 5208856 - DNA, 23 bp, Homo sapiens
aggagaagacccctgcccaagtg

SEQ ID NO: 5208857 - DNA, 15 bp, Homo sapiens
aggagaagagaggaa

SEQ ID NO: 5208858 - DNA, 18 bp, Homo sapiens
aggagaagaggaacatcc

SEQ ID NO: 5208859 - DNA, 14 bp, Homo sapiens
aggagaagcaatgg

SEQ ID NO: 5208860 - DNA, 12 bp, Homo sapiens
aggagaagccag

SEQ ID NO: 5208861 - DNA, 13 bp, Homo sapiens
aggagaagccagg

SEQ ID NO: 5208862 - DNA, 13 bp, Homo sapiens
aggagaagctcag

SEQ ID NO: 5208863 - DNA, 13 bp, Homo sapiens
aggagaagctgca

SEQ ID NO: 5208864 - DNA, 14 bp, Homo sapiens
aggagaagctgcat

SEQ ID NO: 5208865 - DNA, 17 bp, Homo sapiens
aggagaagctgcatcca

SEQ ID NO: 5208866 - DNA, 14 bp, Homo sapiens
aggagaaggaaaac

SEQ ID NO: 5208867 - DNA, 16 bp, Homo sapiens
aggagaaggaaggaga

SEQ ID NO: 5208868 - DNA, 12 bp, Homo sapiens
aggagaaggaga

SEQ ID NO: 5208869 - DNA, 17 bp, Homo sapiens
aggagaaggaggagaga

SEQ ID NO: 5208870 - DNA, 14 bp, Homo sapiens
aggagaaggagtgc

SEQ ID NO: 5208871 - DNA, 16 bp, Homo sapiens
aggagaaggctggaga

SEQ ID NO: 5208872 - DNA, 17 bp, Homo sapiens
aggagaaggctggagaa

SEQ ID NO: 5208873 - DNA, 19 bp, Homo sapiens
aggagaagggctgaaccct

SEQ ID NO: 5208874 - DNA, 18 bp, Homo sapiens
aggagaagggctggggcc

SEQ ID NO: 5208875 - DNA, 14 bp, Homo sapiens
aggagaaggggctt

SEQ ID NO: 5208876 - DNA, 14 bp, Homo sapiens
aggagaaggtcagc

SEQ ID NO: 5208877 - DNA, 23 bp, Homo sapiens
aggagaagtggggaccccacccc

SEQ ID NO: 5208878 - DNA, 11 bp, Homo sapiens
aggagaatatg

SEQ ID NO: 5208879 - DNA, 20 bp, Homo sapiens
aggagaatcacctgaacccc

SEQ ID NO: 5208880 - DNA, 20 bp, Homo sapiens
aggagaatcgcttgaacctg

SEQ ID NO: 5208881 - DNA, 23 bp, Homo sapiens
aggagaatcgcttgaacctggga

SEQ ID NO: 5208882 - DNA, 16 bp, Homo sapiens
aggagaatgaaatgta

SEQ ID NO: 5208883 - DNA, 14 bp, Homo sapiens
aggagaatgaatca

SEQ ID NO: 5208884 - DNA, 15 bp, Homo sapiens
aggagaatgagcctc

SEQ ID NO: 5208885 - DNA, 14 bp, Homo sapiens
aggagaatggcatg

SEQ ID NO: 5208886 - DNA, 20 bp, Homo sapiens
aggagaatggcatgaacccc

SEQ ID NO: 5208887 - DNA, 17 bp, Homo sapiens
aggagaatggcatggca

SEQ ID NO: 5208888 - DNA, 17 bp, Homo sapiens
aggagaatggggttcct

SEQ ID NO: 5208889 - DNA, 20 bp, Homo sapiens
aggagaatggggttcctgct

SEQ ID NO: 5208890 - DNA, 24 bp, Homo sapiens
aggagaatggggttcctgctgtgg

SEQ ID NO: 5208891 - DNA, 20 bp, Homo sapiens
aggagaatggtgtgaacccg

SEQ ID NO: 5208892 - DNA, 17 bp, Homo sapiens
aggagaattaggaaggc

SEQ ID NO: 5208893 - DNA, 15 bp, Homo sapiens
aggagaattgaattc

SEQ ID NO: 5208894 - DNA, 20 bp, Homo sapiens
aggagaattgcttgaaccca

SEQ ID NO: 5208895 - DNA, 22 bp, Homo sapiens
aggctgctggggcctcagacga

SEQ ID NO: 5208896 - DNA, 21 bp, Homo sapiens
aggctgctgtgaaaactctgg

SEQ ID NO: 5208897 - DNA, 12 bp, Homo sapiens
aggctgctgtgt

SEQ ID NO: 5208898 - DNA, 17 bp, Homo sapiens
aggctgctttccaaagc

SEQ ID NO: 5208899 - DNA, 18 bp, Homo sapiens
aggctgctttccaaagcc

SEQ ID NO: 5208900 - DNA, 19 bp, Homo sapiens
aggctgctttccaaagcca

SEQ ID NO: 5208901 - DNA, 19 bp, Homo sapiens
aggctggaaaagggctcag

SEQ ID NO: 5208902 - DNA, 15 bp, Homo sapiens
aggctggaaatagga

SEQ ID NO: 5208903 - DNA, 18 bp, Homo sapiens
aggctggaagatagctgt

SEQ ID NO: 5208904 - DNA, 22 bp, Homo sapiens
aggctggaagatagctgtgact

SEQ ID NO: 5208905 - DNA, 11 bp, Homo sapiens
aggctggaagg

SEQ ID NO: 5208906 - DNA, 17 bp, Homo sapiens
aggctggaaggaggaag

SEQ ID NO: 5208907 - DNA, 13 bp, Homo sapiens
aggctggaaggca

SEQ ID NO: 5208908 - DNA, 18 bp, Homo sapiens
aggctggaatgagggagg

SEQ ID NO: 5208909 - DNA, 20 bp, Homo sapiens
aggctggacaccctctgccg

SEQ ID NO: 5208910 - DNA, 18 bp, Homo sapiens
aggctggacatgctgact

SEQ ID NO: 5208911 - DNA, 11 bp, Homo sapiens
aggctggacca

SEQ ID NO: 5208912 - DNA, 15 bp, Homo sapiens
aggctggaccaactg

SEQ ID NO: 5208913 - DNA, 14 bp, Homo sapiens
aggctggactccag

SEQ ID NO: 5208914 - DNA, 15 bp, Homo sapiens
aggctggactccaga

SEQ ID NO: 5208915 - DNA, 21 bp, Homo sapiens
aggctggactccagatctgca

SEQ ID NO: 5208916 - DNA, 15 bp, Homo sapiens
aggctggagactgga

SEQ ID NO: 5208917 - DNA, 16 bp, Homo sapiens
aggctggagagcactg

SEQ ID NO: 5208918 - DNA, 14 bp, Homo sapiens
aggctggagatcct

SEQ ID NO: 5208919 - DNA, 18 bp, Homo sapiens
aggctggagctggcgtct

SEQ ID NO: 5208920 - DNA, 20 bp, Homo sapiens
aggctggaggacagtggcac

SEQ ID NO: 5208921 - DNA, 15 bp, Homo sapiens
aggctggaggcaggg

SEQ ID NO: 5208922 - DNA, 18 bp, Homo sapiens
aggctggaggcagggcct

SEQ ID NO: 5208923 - DNA, 20 bp, Homo sapiens
aggctggagggcagtggcac

SEQ ID NO: 5208924 - DNA, 22 bp, Homo sapiens
aggctggagggcagtggcacga

SEQ ID NO: 5208925 - DNA, 22 bp, Homo sapiens
aggctggagtgcaatggtgtga

SEQ ID NO: 5208926 - DNA, 20 bp, Homo sapiens
aggctggagtgcagtggcat

SEQ ID NO: 5208927 - DNA, 12 bp, Homo sapiens
aggctggagtgt

SEQ ID NO: 5208928 - DNA, 20 bp, Homo sapiens
aggctggagtgtagtggcac

SEQ ID NO: 5208929 - DNA, 17 bp, Homo sapiens
aggctggagttggggca

SEQ ID NO: 5208930 - DNA, 16 bp, Homo sapiens
aggctggataggagag

SEQ ID NO: 5208931 - DNA, 20 bp, Homo sapiens
aggctggatggcacctcagg

SEQ ID NO: 5208932 - DNA, 20 bp, Homo sapiens
aggctggatgtgctttcatc

SEQ ID NO: 5208933 - DNA, 13 bp, Homo sapiens
aggctggattcta

SEQ ID NO: 5208934 - DNA, 22 bp, Homo sapiens
aggctggattttgaattttctt

SEQ ID NO: 5208935 - DNA, 17 bp, Homo sapiens
aggctggcaagaaccag

SEQ ID NO: 5208936 - DNA, 18 bp, Homo sapiens
aggctggcaccatggtga

SEQ ID NO: 5208937 - DNA, 18 bp, Homo sapiens
aggctggcagctctccag

SEQ ID NO: 5208938 - DNA, 19 bp, Homo sapiens
aggctggcagctctccagt

SEQ ID NO: 5208939 - DNA, 12 bp, Homo sapiens
aggctggcaggt

SEQ ID NO: 5208940 - DNA, 15 bp, Homo sapiens
aggctggcaggtatg

SEQ ID NO: 5208941 - DNA, 11 bp, Homo sapiens
aggctggcatc

SEQ ID NO: 5208942 - DNA, 14 bp, Homo sapiens
aggctggcatcctg

SEQ ID NO: 5208943 - DNA, 15 bp, Homo sapiens
aggctggcatcctgg

SEQ ID NO: 5208944 - DNA, 19 bp, Homo sapiens
aggctggcatcctggctgg

SEQ ID NO: 5208945 - DNA, 14 bp, Homo sapiens
aggctggcatctcc

SEQ ID NO: 5208946 - DNA, 20 bp, Homo sapiens
aggctggcatctcccccacc

SEQ ID NO: 5208947 - DNA, 12 bp, Homo sapiens
aggctggcatga

SEQ ID NO: 5208948 - DNA, 19 bp, Homo sapiens
aggctggccaaggtgtcca

SEQ ID NO: 5208949 - DNA, 17 bp, Homo sapiens
aggctggccagccgctc

SEQ ID NO: 5208950 - DNA, 18 bp, Homo sapiens
aggctggccagtccaggc

SEQ ID NO: 5208951 - DNA, 19 bp, Homo sapiens
aggctggccagtccaggct

SEQ ID NO: 5208952 - DNA, 17 bp, Homo sapiens
aggctggccagtgctgc

SEQ ID NO: 5208953 - DNA, 15 bp, Homo sapiens
aggctggcccccacc

SEQ ID NO: 5208954 - DNA, 21 bp, Homo sapiens
aggctggcccccacccacctt

SEQ ID NO: 5208955 - DNA, 22 bp, Homo sapiens
aggctggcccccacccaccttc

SEQ ID NO: 5208956 - DNA, 22 bp, Homo sapiens
aggctggcctgatcttggctca

SEQ ID NO: 5208957 - DNA, 17 bp, Homo sapiens
aggctggcgagagtctg

SEQ ID NO: 5208958 - DNA, 20 bp, Homo sapiens
aggctggcgcagccaaggcc

SEQ ID NO: 5208959 - DNA, 18 bp, Homo sapiens
aggctggcgtgcagtggt

SEQ ID NO: 5208960 - DNA, 18 bp, Homo sapiens
aggctggctgagtggaat

SEQ ID NO: 5208961 - DNA, 22 bp, Homo sapiens
aggctggctggcccgtcatgtt

SEQ ID NO: 5208962 - DNA, 12 bp, Homo sapiens
aggctggctggg

SEQ ID NO: 5208963 - DNA, 14 bp, Homo sapiens
aggctggctggggg

SEQ ID NO: 5208964 - DNA, 20 bp, Homo sapiens
aggctggctgggggcaggac

SEQ ID NO: 5208965 - DNA, 12 bp, Homo sapiens
aggctggctgtt

SEQ ID NO: 5208966 - DNA, 20 bp, Homo sapiens
aggctggcttgtcccctcct

SEQ ID NO: 5208967 - DNA, 19 bp, Homo sapiens
aggctggctttcagagtag

SEQ ID NO: 5208968 - DNA, 20 bp, Homo sapiens
aggctgggagagccttccag

SEQ ID NO: 5208969 - DNA, 17 bp, Homo sapiens
aggctgggagcatagca

SEQ ID NO: 5208970 - DNA, 17 bp, Homo sapiens
aggctgggaggagcccc

SEQ ID NO: 5208971 - DNA, 15 bp, Homo sapiens
aggctgggaggctcg

SEQ ID NO: 5208972 - DNA, 20 bp, Homo sapiens
aggctgggaggctcggggct

SEQ ID NO: 5208973 - DNA, 18 bp, Homo sapiens
aggctgggaggttgggag

SEQ ID NO: 5208974 - DNA, 19 bp, Homo sapiens
aggctgggagtccctacct

SEQ ID NO: 5208975 - DNA, 23 bp, Homo sapiens
aggctgggcacggctccgagggc

SEQ ID NO: 5208976 - DNA, 15 bp, Homo sapiens
aggctgggcagggcc

SEQ ID NO: 5208977 - DNA, 17 bp, Homo sapiens
aggctgggcagggcctg

SEQ ID NO: 5208978 - DNA, 13 bp, Homo sapiens
aggctgggccagc

SEQ ID NO: 5208979 - DNA, 14 bp, Homo sapiens
aggctgggccagcc

SEQ ID NO: 5208980 - DNA, 15 bp, Homo sapiens
aggctgggccagcct

SEQ ID NO: 5208981 - DNA, 21 bp, Homo sapiens
aggctgggccagcctcagctc

SEQ ID NO: 5208982 - DNA, 16 bp, Homo sapiens
aggctgggcccagagg

SEQ ID NO: 5208983 - DNA, 18 bp, Homo sapiens
aggctgggcccagaggca

SEQ ID NO: 5208984 - DNA, 19 bp, Homo sapiens
aggctgggcctcccctggg

SEQ ID NO: 5208985 - DNA, 13 bp, Homo sapiens
aggctgggctccc

SEQ ID NO: 5208986 - DNA, 19 bp, Homo sapiens
aggctgggctgggcactgc

SEQ ID NO: 5208987 - DNA, 21 bp, Homo sapiens
aggctgggctgggcactgctc

SEQ ID NO: 5208988 - DNA, 16 bp, Homo sapiens
aggctgggctgggtgg

SEQ ID NO: 5208989 - DNA, 18 bp, Homo sapiens
aggctgggcttcagtggc

SEQ ID NO: 5208990 - DNA, 23 bp, Homo sapiens
aggctgggcttcagtggcagctg

SEQ ID NO: 5208991 - DNA, 16 bp, Homo sapiens
aggctggggaagtcct

SEQ ID NO: 5208992 - DNA, 12 bp, Homo sapiens
aggctggggaca

SEQ ID NO: 5208993 - DNA, 18 bp, Homo sapiens
aggctggggacacaggat

SEQ ID NO: 5208994 - DNA, 15 bp, Homo sapiens
aggctggggacccag

SEQ ID NO: 5208995 - DNA, 18 bp, Homo sapiens
aggctggggaggccagtg

SEQ ID NO: 5208996 - DNA, 16 bp, Homo sapiens
aggctggggaggtgct

SEQ ID NO: 5208997 - DNA, 20 bp, Homo sapiens
aggctggggaggtgctgggg

SEQ ID NO: 5208998 - DNA, 10 bp, Homo sapiens
aggctggggc

SEQ ID NO: 5208999 - DNA, 12 bp, Homo sapiens
aggctggggcca

SEQ ID NO: 5209000 - DNA, 12 bp, Homo sapiens
aggctggggcct

SEQ ID NO: 5209001 - DNA, 16 bp, Homo sapiens
aggctggggcctggcc

SEQ ID NO: 5209002 - DNA, 12 bp, Homo sapiens
aggctggggcgg

SEQ ID NO: 5209003 - DNA, 22 bp, Homo sapiens
aggctggggcggggcccaggag

SEQ ID NO: 5209004 - DNA, 17 bp, Homo sapiens
aggctgggggagagccg

SEQ ID NO: 5209005 - DNA, 22 bp, Homo sapiens
aggctgggggcgggggagccaa

SEQ ID NO: 5209006 - DNA, 22 bp, Homo sapiens
aggctggggtcttgggttcctg

SEQ ID NO: 5209007 - DNA, 20 bp, Homo sapiens
aggctgggtaatgtgaaggc

SEQ ID NO: 5209008 - DNA, 10 bp, Homo sapiens
aggctgggtc

SEQ ID NO: 5209009 - DNA, 19 bp, Homo sapiens
aggctgggtcctgccagct

SEQ ID NO: 5209010 - DNA, 18 bp, Homo sapiens
aggctgggtcgccctgga

SEQ ID NO: 5209011 - DNA, 16 bp, Homo sapiens
aggctgggtgcccaca

SEQ ID NO: 5209012 - DNA, 17 bp, Homo sapiens
aggctgggtgcccacag

SEQ ID NO: 5209013 - DNA, 22 bp, Homo sapiens
aggctgggtggccggccctgcc

SEQ ID NO: 5209014 - DNA, 17 bp, Homo sapiens
aggctggtaagggacct

SEQ ID NO: 5209015 - DNA, 21 bp, Homo sapiens
aggctggtaagggaccttcag

SEQ ID NO: 5209016 - DNA, 22 bp, Homo sapiens
aggctggtaagggaccttcagg

SEQ ID NO: 5209017 - DNA, 17 bp, Homo sapiens
aggctggtcctatggcc

SEQ ID NO: 5209018 - DNA, 23 bp, Homo sapiens
aggctggtcctatggcctcatgt

SEQ ID NO: 5209019 - DNA, 19 bp, Homo sapiens
aggctggtctcgaactcct

SEQ ID NO: 5209020 - DNA, 23 bp, Homo sapiens
aggctggtctcgaactcctgacc

SEQ ID NO: 5209021 - DNA, 11 bp, Homo sapiens
aggctggtctt

SEQ ID NO: 5209022 - DNA, 21 bp, Homo sapiens
aggctggtcttgaactcctgg

SEQ ID NO: 5209023 - DNA, 19 bp, Homo sapiens
aggctggtcttgaagtcct

SEQ ID NO: 5209024 - DNA, 17 bp, Homo sapiens
aggctggtgaggtcctg

SEQ ID NO: 5209025 - DNA, 15 bp, Homo sapiens
aggctggtgccaggc

SEQ ID NO: 5209026 - DNA, 18 bp, Homo sapiens
aggctggtgccaggcgcg

SEQ ID NO: 5209027 - DNA, 13 bp, Homo sapiens
aggctggtggccc

SEQ ID NO: 5209028 - DNA, 17 bp, Homo sapiens
aggctggtggcccagga

SEQ ID NO: 5209029 - DNA, 17 bp, Homo sapiens
aggctggtgggaggggc

SEQ ID NO: 5209030 - DNA, 19 bp, Homo sapiens
aggctggtggttttcagag

SEQ ID NO: 5209031 - DNA, 23 bp, Homo sapiens
aggctggtggttttcagagcagg

SEQ ID NO: 5209032 - DNA, 20 bp, Homo sapiens
aggctggtgtatgcactgct

SEQ ID NO: 5209033 - DNA, 24 bp, Homo sapiens
aggctggtgttctgtctgggctca

SEQ ID NO: 5209034 - DNA, 21 bp, Homo sapiens
aggctggtttcaaactcctga

SEQ ID NO: 5209035 - DNA, 17 bp, Homo sapiens
aggctgtaactgagaga

SEQ ID NO: 5209036 - DNA, 20 bp, Homo sapiens
aggctgtaactgagagaaag

SEQ ID NO: 5209037 - DNA, 21 bp, Homo sapiens
aggctgtaactgagagaaaga

SEQ ID NO: 5209038 - DNA, 22 bp, Homo sapiens
aggctgtaagcattctgagctg

SEQ ID NO: 5209039 - DNA, 15 bp, Homo sapiens
aggctgtacatagtc

SEQ ID NO: 5209040 - DNA, 18 bp, Homo sapiens
aggctgtacatagtcctt

SEQ ID NO: 5209041 - DNA, 23 bp, Homo sapiens
aggctgtagaaaggggagaatgt

SEQ ID NO: 5209042 - DNA, 13 bp, Homo sapiens
aggctgtatccca

SEQ ID NO: 5209043 - DNA, 20 bp, Homo sapiens
aggctgtattttcttttata

SEQ ID NO: 5209044 - DNA, 21 bp, Homo sapiens
aggctgtcaattacaggaagt

SEQ ID NO: 5209045 - DNA, 18 bp, Homo sapiens
aggctgtcagcgcctcaa

SEQ ID NO: 5209046 - DNA, 23 bp, Homo sapiens
aggctgtcccaagctcccaagag

SEQ ID NO: 5209047 - DNA, 11 bp, Homo sapiens
aggctgtcccc

SEQ ID NO: 5209048 - DNA, 16 bp, Homo sapiens
aggctgtcctgtacat

SEQ ID NO: 5209049 - DNA, 19 bp, Homo sapiens
aggctgtctgtgccatggc

SEQ ID NO: 5209050 - DNA, 21 bp, Homo sapiens
aggctgtcttctcaggctctg

SEQ ID NO: 5209051 - DNA, 22 bp, Homo sapiens
aggctgtcttctcaggctctgc

SEQ ID NO: 5209052 - DNA, 20 bp, Homo sapiens
aggctgtcttctcccagagc

SEQ ID NO: 5209053 - DNA, 11 bp, Homo sapiens
aggctgtgagc

SEQ ID NO: 5209054 - DNA, 16 bp, Homo sapiens
aggctgtgccaggctg

SEQ ID NO: 5209055 - DNA, 19 bp, Homo sapiens
aggctgtgctccgccatgg

SEQ ID NO: 5209056 - DNA, 17 bp, Homo sapiens
aggctgtgctcttcctc

SEQ ID NO: 5209057 - DNA, 19 bp, Homo sapiens
aggctgtgctcttcctctg

SEQ ID NO: 5209058 - DNA, 15 bp, Homo sapiens
aggctgtgctgccct

SEQ ID NO: 5209059 - DNA, 18 bp, Homo sapiens
aggctgtgcttacctgtg

SEQ ID NO: 5209060 - DNA, 15 bp, Homo sapiens
aggctgtggaagggc

SEQ ID NO: 5209061 - DNA, 18 bp, Homo sapiens
aggctgtggggtctggct

SEQ ID NO: 5209062 - DNA, 19 bp, Homo sapiens
aggctgtggggtctggctg

SEQ ID NO: 5209063 - DNA, 22 bp, Homo sapiens
aggctgtggggtctggctgtgt

SEQ ID NO: 5209064 - DNA, 16 bp, Homo sapiens
aggctgtggggtgggc

SEQ ID NO: 5209065 - DNA, 19 bp, Homo sapiens
aggctgtgggtagatgtgc

SEQ ID NO: 5209066 - DNA, 15 bp, Homo sapiens
aggctgtggtcagag

SEQ ID NO: 5209067 - DNA, 19 bp, Homo sapiens
aggctgtggtcagagaggg

SEQ ID NO: 5209068 - DNA, 22 bp, Homo sapiens
aggctgtggtggctgtctctgt

SEQ ID NO: 5209069 - DNA, 22 bp, Homo sapiens
aggctgtgtccctgctggggtc

SEQ ID NO: 5209070 - DNA, 14 bp, Homo sapiens
aggctgtgtctctg

SEQ ID NO: 5209071 - DNA, 16 bp, Homo sapiens
aggctgtgtctctgcc

SEQ ID NO: 5209072 - DNA, 22 bp, Homo sapiens
aggctgtgtggccaaccaggac

SEQ ID NO: 5209073 - DNA, 19 bp, Homo sapiens
aggagaattgcttgaaccg

SEQ ID NO: 5209074 - DNA, 21 bp, Homo sapiens
aggagacaaacagcccttcct

SEQ ID NO: 5209075 - DNA, 18 bp, Homo sapiens
aggagacaaagcaggagt

SEQ ID NO: 5209076 - DNA, 11 bp, Homo sapiens
aggagacacaa

SEQ ID NO: 5209077 - DNA, 19 bp, Homo sapiens
aggagacacaacaactcct

SEQ ID NO: 5209078 - DNA, 14 bp, Homo sapiens
aggagacacagatg

SEQ ID NO: 5209079 - DNA, 13 bp, Homo sapiens
aggagacagaaag

SEQ ID NO: 5209080 - DNA, 14 bp, Homo sapiens
aggagacagaaagc

SEQ ID NO: 5209081 - DNA, 15 bp, Homo sapiens
aggagacagaaagcc

SEQ ID NO: 5209082 - DNA, 16 bp, Homo sapiens
aggagacagaaagcct

SEQ ID NO: 5209083 - DNA, 18 bp, Homo sapiens
aggagacagacacacact

SEQ ID NO: 5209084 - DNA, 15 bp, Homo sapiens
aggagacagagccaa

SEQ ID NO: 5209085 - DNA, 20 bp, Homo sapiens
aggagacagcagcacccacc

SEQ ID NO: 5209086 - DNA, 12 bp, Homo sapiens
aggagacaggaa

SEQ ID NO: 5209087 - DNA, 14 bp, Homo sapiens
aggagacaggaagc

SEQ ID NO: 5209088 - DNA, 19 bp, Homo sapiens
aggagacagtcaggaagcc

SEQ ID NO: 5209089 - DNA, 18 bp, Homo sapiens
aggagacatatcactgct

SEQ ID NO: 5209090 - DNA, 14 bp, Homo sapiens
aggagaccaccccc

SEQ ID NO: 5209091 - DNA, 23 bp, Homo sapiens
aggagaccacccccgagcttgcc

SEQ ID NO: 5209092 - DNA, 15 bp, Homo sapiens
aggagaccagaagtg

SEQ ID NO: 5209093 - DNA, 14 bp, Homo sapiens
aggagaccagctca

SEQ ID NO: 5209094 - DNA, 14 bp, Homo sapiens
aggagacccacagg

SEQ ID NO: 5209095 - DNA, 15 bp, Homo sapiens
aggagacccacctga

SEQ ID NO: 5209096 - DNA, 19 bp, Homo sapiens
aggagacccgccccagggc

SEQ ID NO: 5209097 - DNA, 18 bp, Homo sapiens
aggagaccctcccctgcc

SEQ ID NO: 5209098 - DNA, 13 bp, Homo sapiens
aggagaccctgga

SEQ ID NO: 5209099 - DNA, 14 bp, Homo sapiens
aggagaccctggaa

SEQ ID NO: 5209100 - DNA, 17 bp, Homo sapiens
aggagaccctgtctttg

SEQ ID NO: 5209101 - DNA, 16 bp, Homo sapiens
aggagacggaggggag

SEQ ID NO: 5209102 - DNA, 14 bp, Homo sapiens
aggagactcacctc

SEQ ID NO: 5209103 - DNA, 17 bp, Homo sapiens
aggagactcacctctgc

SEQ ID NO: 5209104 - DNA, 19 bp, Homo sapiens
aggagactccaaggagcta

SEQ ID NO: 5209105 - DNA, 20 bp, Homo sapiens
aggagactgggcacccctgc

SEQ ID NO: 5209106 - DNA, 22 bp, Homo sapiens
aggagactgggcacccctgcct

SEQ ID NO: 5209107 - DNA, 16 bp, Homo sapiens
aggagactggtaggag

SEQ ID NO: 5209108 - DNA, 23 bp, Homo sapiens
aggagactggtaggaggaggcat

SEQ ID NO: 5209109 - DNA, 12 bp, Homo sapiens
aggagacttgta

SEQ ID NO: 5209110 - DNA, 14 bp, Homo sapiens
aggagacttgtaca

SEQ ID NO: 5209111 - DNA, 14 bp, Homo sapiens
aggagacttgtagt

SEQ ID NO: 5209112 - DNA, 23 bp, Homo sapiens
aggagagaaagcaaaacattttg

SEQ ID NO: 5209113 - DNA, 14 bp, Homo sapiens
aggagagaagaatg

SEQ ID NO: 5209114 - DNA, 17 bp, Homo sapiens
aggagagaaggggagga

SEQ ID NO: 5209115 - DNA, 21 bp, Homo sapiens
aggagagaaggggaggagggc

SEQ ID NO: 5209116 - DNA, 22 bp, Homo sapiens
aggagagaatgagagagtgtgg

SEQ ID NO: 5209117 - DNA, 13 bp, Homo sapiens
aggagagacagga

SEQ ID NO: 5209118 - DNA, 22 bp, Homo sapiens
aggagagacaggattgggccaa

SEQ ID NO: 5209119 - DNA, 11 bp, Homo sapiens
aggagagaccg

SEQ ID NO: 5209120 - DNA, 23 bp, Homo sapiens
aggagagacggtgttgggagccc

SEQ ID NO: 5209121 - DNA, 20 bp, Homo sapiens
aggagagactcccatgaagc

SEQ ID NO: 5209122 - DNA, 21 bp, Homo sapiens
aggagagactcccatgaagcc

SEQ ID NO: 5209123 - DNA, 22 bp, Homo sapiens
aggagagactcccatgaagcct

SEQ ID NO: 5209124 - DNA, 16 bp, Homo sapiens
aggagagactgaaagc

SEQ ID NO: 5209125 - DNA, 19 bp, Homo sapiens
aggagagagaaagccaggc

SEQ ID NO: 5209126 - DNA, 21 bp, Homo sapiens
aggagagagaaagccaggcag

SEQ ID NO: 5209127 - DNA, 11 bp, Homo sapiens
aggagagagac

SEQ ID NO: 5209128 - DNA, 13 bp, Homo sapiens
aggagagagagag

SEQ ID NO: 5209129 - DNA, 21 bp, Homo sapiens
aggagagagagagagaaagaa

SEQ ID NO: 5209130 - DNA, 13 bp, Homo sapiens
aggagagagatct

SEQ ID NO: 5209131 - DNA, 18 bp, Homo sapiens
aggagagagatgctgctc

SEQ ID NO: 5209132 - DNA, 17 bp, Homo sapiens
aggagagagcagcttct

SEQ ID NO: 5209133 - DNA, 19 bp, Homo sapiens
aggagagagccttgggagc

SEQ ID NO: 5209134 - DNA, 18 bp, Homo sapiens
aggagagagcttcctgtt

SEQ ID NO: 5209135 - DNA, 10 bp, Homo sapiens
aggagagagg

SEQ ID NO: 5209136 - DNA, 13 bp, Homo sapiens
aggagagaggagg

SEQ ID NO: 5209137 - DNA, 13 bp, Homo sapiens
aggagagaggcag

SEQ ID NO: 5209138 - DNA, 17 bp, Homo sapiens
aggagagagggtctcca

SEQ ID NO: 5209139 - DNA, 19 bp, Homo sapiens
aggagagatagaagcctct

SEQ ID NO: 5209140 - DNA, 17 bp, Homo sapiens
aggagagatagcctgtg

SEQ ID NO: 5209141 - DNA, 18 bp, Homo sapiens
aggagagatagcctgtgg

SEQ ID NO: 5209142 - DNA, 19 bp, Homo sapiens
aggagagatagcctgtggc

SEQ ID NO: 5209143 - DNA, 20 bp, Homo sapiens
aggagagatgacccctaccc

SEQ ID NO: 5209144 - DNA, 20 bp, Homo sapiens
aggagagattattaaatcgt

SEQ ID NO: 5209145 - DNA, 21 bp, Homo sapiens
aggagagattgggagaaatca

SEQ ID NO: 5209146 - DNA, 11 bp, Homo sapiens
aggagagcagc

SEQ ID NO: 5209147 - DNA, 16 bp, Homo sapiens
aggagagccactgggc

SEQ ID NO: 5209148 - DNA, 12 bp, Homo sapiens
aggagagccaga

SEQ ID NO: 5209149 - DNA, 15 bp, Homo sapiens
aggagagccagagaa

SEQ ID NO: 5209150 - DNA, 21 bp, Homo sapiens
aggagagccagagaagtgaca

SEQ ID NO: 5209151 - DNA, 23 bp, Homo sapiens
aggagagccagagaagtgacagg

SEQ ID NO: 5209152 - DNA, 16 bp, Homo sapiens
aggagagccagccctc

SEQ ID NO: 5209153 - DNA, 18 bp, Homo sapiens
aggagagcccaggcctgc

SEQ ID NO: 5209154 - DNA, 21 bp, Homo sapiens
aggagagcccccaccagcagc

SEQ ID NO: 5209155 - DNA, 18 bp, Homo sapiens
aggagagcctgctgcatg

SEQ ID NO: 5209156 - DNA, 20 bp, Homo sapiens
aggagagcctgctgcatggg

SEQ ID NO: 5209157 - DNA, 12 bp, Homo sapiens
aggagagcctgg

SEQ ID NO: 5209158 - DNA, 13 bp, Homo sapiens
aggagagcctggt

SEQ ID NO: 5209159 - DNA, 16 bp, Homo sapiens
aggagagcggaggagg

SEQ ID NO: 5209160 - DNA, 15 bp, Homo sapiens
aggagagctagcagc

SEQ ID NO: 5209161 - DNA, 19 bp, Homo sapiens
aggagagcttcaggcccca

SEQ ID NO: 5209162 - DNA, 13 bp, Homo sapiens
aggagaggactgg

SEQ ID NO: 5209163 - DNA, 16 bp, Homo sapiens
aggagaggagacagac

SEQ ID NO: 5209164 - DNA, 17 bp, Homo sapiens
aggagaggagacagaca

SEQ ID NO: 5209165 - DNA, 19 bp, Homo sapiens
aggagaggagacagacaca

SEQ ID NO: 5209166 - DNA, 13 bp, Homo sapiens
aggagaggagagc

SEQ ID NO: 5209167 - DNA, 15 bp, Homo sapiens
aggagaggagagggg

SEQ ID NO: 5209168 - DNA, 13 bp, Homo sapiens
aggagaggagggt

SEQ ID NO: 5209169 - DNA, 13 bp, Homo sapiens
aggagaggagtgc

SEQ ID NO: 5209170 - DNA, 20 bp, Homo sapiens
aggagaggatgagagcccag

SEQ ID NO: 5209171 - DNA, 23 bp, Homo sapiens
aggagaggatgagagcccagagg

SEQ ID NO: 5209172 - DNA, 20 bp, Homo sapiens
aggagaggcaacatccaaaa

SEQ ID NO: 5209173 - DNA, 21 bp, Homo sapiens
aggagaggcaacatccaaaat

SEQ ID NO: 5209174 - DNA, 14 bp, Homo sapiens
aggagaggctgctg

SEQ ID NO: 5209175 - DNA, 13 bp, Homo sapiens
aggagaggctggg

SEQ ID NO: 5209176 - DNA, 16 bp, Homo sapiens
aggagaggctgggctg

SEQ ID NO: 5209177 - DNA, 23 bp, Homo sapiens
aggagagggagtacaaagacagg

SEQ ID NO: 5209178 - DNA, 19 bp, Homo sapiens
aggagaggggaagggccag

SEQ ID NO: 5209179 - DNA, 16 bp, Homo sapiens
aggagaggggcacagg

SEQ ID NO: 5209180 - DNA, 13 bp, Homo sapiens
aggagaggggcag

SEQ ID NO: 5209181 - DNA, 19 bp, Homo sapiens
aggagaggggcagaacagc

SEQ ID NO: 5209182 - DNA, 18 bp, Homo sapiens
aggagagtaaaaattcat

SEQ ID NO: 5209183 - DNA, 20 bp, Homo sapiens
aggagagtacccccctgaga

SEQ ID NO: 5209184 - DNA, 17 bp, Homo sapiens
aggagagtagaacagat

SEQ ID NO: 5209185 - DNA, 17 bp, Homo sapiens
aggagagtcacagaaca

SEQ ID NO: 5209186 - DNA, 17 bp, Homo sapiens
aggagagtcccagagca

SEQ ID NO: 5209187 - DNA, 21 bp, Homo sapiens
aggagagtcccagagcaggag

SEQ ID NO: 5209188 - DNA, 18 bp, Homo sapiens
aggagagtcggtctgctt

SEQ ID NO: 5209189 - DNA, 21 bp, Homo sapiens
aggagagtcttgcagtgatta

SEQ ID NO: 5209190 - DNA, 19 bp, Homo sapiens
aggagagtgagtgcctttc

SEQ ID NO: 5209191 - DNA, 14 bp, Homo sapiens
aggagagtggccat

SEQ ID NO: 5209192 - DNA, 17 bp, Homo sapiens
aggagagtggcctgggt

SEQ ID NO: 5209193 - DNA, 18 bp, Homo sapiens
aggagagtggcctgggtc

SEQ ID NO: 5209194 - DNA, 20 bp, Homo sapiens
aggagagtggttgttgccaa

SEQ ID NO: 5209195 - DNA, 23 bp, Homo sapiens
aggagagtgtatatgaatgaata

SEQ ID NO: 5209196 - DNA, 22 bp, Homo sapiens
aggagagtgtgcaactggccag

SEQ ID NO: 5209197 - DNA, 22 bp, Homo sapiens
aggagagttcaagcctgtggga

SEQ ID NO: 5209198 - DNA, 16 bp, Homo sapiens
aggagagtttggggtt

SEQ ID NO: 5209199 - DNA, 15 bp, Homo sapiens
aggagataaactgaa

SEQ ID NO: 5209200 - DNA, 21 bp, Homo sapiens
aggagataaatctagtataca

SEQ ID NO: 5209201 - DNA, 16 bp, Homo sapiens
aggagataagaaagca

SEQ ID NO: 5209202 - DNA, 16 bp, Homo sapiens
aggagataaggtggct

SEQ ID NO: 5209203 - DNA, 22 bp, Homo sapiens
aggagataatgtggattaaaac

SEQ ID NO: 5209204 - DNA, 21 bp, Homo sapiens
aggagatagctttctttccct

SEQ ID NO: 5209205 - DNA, 15 bp, Homo sapiens
aggagatataaaatc

SEQ ID NO: 5209206 - DNA, 14 bp, Homo sapiens
aggagatatctgag

SEQ ID NO: 5209207 - DNA, 20 bp, Homo sapiens
aggagatatctgagggagga

SEQ ID NO: 5209208 - DNA, 23 bp, Homo sapiens
aggagatatctgagggaggaggc

SEQ ID NO: 5209209 - DNA, 14 bp, Homo sapiens
aggagatcagcagc

SEQ ID NO: 5209210 - DNA, 22 bp, Homo sapiens
aggagatccagggcaaggccat

SEQ ID NO: 5209211 - DNA, 20 bp, Homo sapiens
aggagatcgagaccatcctg

SEQ ID NO: 5209212 - DNA, 16 bp, Homo sapiens
aggagatgaaactggt

SEQ ID NO: 5209213 - DNA, 19 bp, Homo sapiens
aggagatgaaactggttcc

SEQ ID NO: 5209214 - DNA, 19 bp, Homo sapiens
aggagatgaatagaagaaa

SEQ ID NO: 5209215 - DNA, 17 bp, Homo sapiens
aggagatgaccagggat

SEQ ID NO: 5209216 - DNA, 18 bp, Homo sapiens
aggagatgaccagggatg

SEQ ID NO: 5209217 - DNA, 22 bp, Homo sapiens
aggagatgaccagggatgctgg

SEQ ID NO: 5209218 - DNA, 16 bp, Homo sapiens
aggagatgaggctgga

SEQ ID NO: 5209219 - DNA, 17 bp, Homo sapiens
aggagatgaggctggat

SEQ ID NO: 5209220 - DNA, 16 bp, Homo sapiens
aggagatgctccttgg

SEQ ID NO: 5209221 - DNA, 17 bp, Homo sapiens
aggagatgctccttggg

SEQ ID NO: 5209222 - DNA, 18 bp, Homo sapiens
aggagatgctccttgggc

SEQ ID NO: 5209223 - DNA, 15 bp, Homo sapiens
aggagatgctgtgcc

SEQ ID NO: 5209224 - DNA, 16 bp, Homo sapiens
aggagatggaatatca

SEQ ID NO: 5209225 - DNA, 14 bp, Homo sapiens
aggagatgggcctt

SEQ ID NO: 5209226 - DNA, 17 bp, Homo sapiens
aggagatggggacaggg

SEQ ID NO: 5209227 - DNA, 16 bp, Homo sapiens
aggagatgggtccagg

SEQ ID NO: 5209228 - DNA, 22 bp, Homo sapiens
aggagatgtaagagctttacaa

SEQ ID NO: 5209229 - DNA, 20 bp, Homo sapiens
aggagatgtgatcaggcccc

SEQ ID NO: 5209230 - DNA, 18 bp, Homo sapiens
aggagatgttgaggggag

SEQ ID NO: 5209231 - DNA, 21 bp, Homo sapiens
aggagatgttgaggggaggag

SEQ ID NO: 5209232 - DNA, 21 bp, Homo sapiens
aggagattaacacactgaacc

SEQ ID NO: 5209233 - DNA, 15 bp, Homo sapiens
aggagattcccacct

SEQ ID NO: 5209234 - DNA, 20 bp, Homo sapiens
aggagattctgcctttgcca

SEQ ID NO: 5209235 - DNA, 22 bp, Homo sapiens
aggagattctgcctttgccagg

SEQ ID NO: 5209236 - DNA, 20 bp, Homo sapiens
aggagattctgtgtattaac

SEQ ID NO: 5209237 - DNA, 15 bp, Homo sapiens
aggagattgagaagg

SEQ ID NO: 5209238 - DNA, 17 bp, Homo sapiens
aggagattgagaaggag

SEQ ID NO: 5209239 - DNA, 21 bp, Homo sapiens
aggagattgagaaggagagaa

SEQ ID NO: 5209240 - DNA, 22 bp, Homo sapiens
aggagattgagaaggagagaaa

SEQ ID NO: 5209241 - DNA, 16 bp, Homo sapiens
aggagattgctctggg

SEQ ID NO: 5209242 - DNA, 14 bp, Homo sapiens
aggagattggccag

SEQ ID NO: 5209243 - DNA, 14 bp, Homo sapiens
aggagattttcctt

SEQ ID NO: 5209244 - DNA, 18 bp, Homo sapiens
aggagattttccttccta

SEQ ID NO: 5209245 - DNA, 16 bp, Homo sapiens
aggagcaaacactgaa

SEQ ID NO: 5209246 - DNA, 13 bp, Homo sapiens
aggagcaaagcag

SEQ ID NO: 5209247 - DNA, 13 bp, Homo sapiens
aggagcaaagcct

SEQ ID NO: 5209248 - DNA, 15 bp, Homo sapiens
aggagcaaagcctgt

SEQ ID NO: 5209249 - DNA, 15 bp, Homo sapiens
aggagcaaagttaaa

SEQ ID NO: 5209250 - DNA, 18 bp, Homo sapiens
aggagcaaccgtgcagcc

SEQ ID NO: 5209251 - DNA, 14 bp, Homo sapiens
aggagcaacgccag

SEQ ID NO: 5209252 - DNA, 21 bp, Homo sapiens
aggctgtgtgtcttctgcccc

SEQ ID NO: 5209253 - DNA, 11 bp, Homo sapiens
aggctgtgttt

SEQ ID NO: 5209254 - DNA, 17 bp, Homo sapiens
aggctgtgtttagattg

SEQ ID NO: 5209255 - DNA, 22 bp, Homo sapiens
aggctgtgtttggctttcaggg

SEQ ID NO: 5209256 - DNA, 23 bp, Homo sapiens
aggctgttaaatacaggaaacag

SEQ ID NO: 5209257 - DNA, 14 bp, Homo sapiens
aggctgttattatg

SEQ ID NO: 5209258 - DNA, 19 bp, Homo sapiens
aggctgttccttgtactct

SEQ ID NO: 5209259 - DNA, 21 bp, Homo sapiens
aggctgttccttgtactctta

SEQ ID NO: 5209260 - DNA, 16 bp, Homo sapiens
aggctgttctccaggc

SEQ ID NO: 5209261 - DNA, 18 bp, Homo sapiens
aggctgttctgcactgaa

SEQ ID NO: 5209262 - DNA, 19 bp, Homo sapiens
aggctgttctgcactgaaa

SEQ ID NO: 5209263 - DNA, 21 bp, Homo sapiens
aggctgttctgcactgaaaag

SEQ ID NO: 5209264 - DNA, 16 bp, Homo sapiens
aggctgttctgtagct

SEQ ID NO: 5209265 - DNA, 19 bp, Homo sapiens
aggctgttgaatggaattt

SEQ ID NO: 5209266 - DNA, 23 bp, Homo sapiens
aggctgttggaaaatccagaact

SEQ ID NO: 5209267 - DNA, 23 bp, Homo sapiens
aggctgttggcgtgtcccagcac

SEQ ID NO: 5209268 - DNA, 18 bp, Homo sapiens
aggctgttttaacggcct

SEQ ID NO: 5209269 - DNA, 13 bp, Homo sapiens
aggctgttttctt

SEQ ID NO: 5209270 - DNA, 17 bp, Homo sapiens
aggctgtttttggctgt

SEQ ID NO: 5209271 - DNA, 14 bp, Homo sapiens
aggcttaagaactg

SEQ ID NO: 5209272 - DNA, 20 bp, Homo sapiens
aggcttaagagagagagcct

SEQ ID NO: 5209273 - DNA, 20 bp, Homo sapiens
aggcttaagcgattctcatg

SEQ ID NO: 5209274 - DNA, 23 bp, Homo sapiens
aggcttaaggagaggagaaactg

SEQ ID NO: 5209275 - DNA, 19 bp, Homo sapiens
aggcttaataaaaatgaca

SEQ ID NO: 5209276 - DNA, 17 bp, Homo sapiens
aggcttaccaaagtatt

SEQ ID NO: 5209277 - DNA, 23 bp, Homo sapiens
aggcttacgctgctctcctgaca

SEQ ID NO: 5209278 - DNA, 21 bp, Homo sapiens
aggcttagctttctggatggc

SEQ ID NO: 5209279 - DNA, 20 bp, Homo sapiens
aggcttagctttgctctgcc

SEQ ID NO: 5209280 - DNA, 11 bp, Homo sapiens
aggcttaggac

SEQ ID NO: 5209281 - DNA, 16 bp, Homo sapiens
aggcttaggcctctct

SEQ ID NO: 5209282 - DNA, 18 bp, Homo sapiens
aggcttaggtgccaggct

SEQ ID NO: 5209283 - DNA, 23 bp, Homo sapiens
aggcttagtcactgagacagccc

SEQ ID NO: 5209284 - DNA, 18 bp, Homo sapiens
aggcttagtgatgtaatt

SEQ ID NO: 5209285 - DNA, 19 bp, Homo sapiens
aggcttataagttaaaaca

SEQ ID NO: 5209286 - DNA, 21 bp, Homo sapiens
aggcttataagttaaaacaaa

SEQ ID NO: 5209287 - DNA, 17 bp, Homo sapiens
aggcttatacaaattta

SEQ ID NO: 5209288 - DNA, 18 bp, Homo sapiens
aggcttatacaaatttaa

SEQ ID NO: 5209289 - DNA, 22 bp, Homo sapiens
aggcttatatttgtgtaatttt

SEQ ID NO: 5209290 - DNA, 16 bp, Homo sapiens
aggcttatcaaaatct

SEQ ID NO: 5209291 - DNA, 14 bp, Homo sapiens
aggcttatctctgc

SEQ ID NO: 5209292 - DNA, 14 bp, Homo sapiens
aggcttatgagatc

SEQ ID NO: 5209293 - DNA, 23 bp, Homo sapiens
aggcttatgggttaataaatgaa

SEQ ID NO: 5209294 - DNA, 23 bp, Homo sapiens
aggcttattcagttcttacacat

SEQ ID NO: 5209295 - DNA, 22 bp, Homo sapiens
aggcttatttttaaaataaaaa

SEQ ID NO: 5209296 - DNA, 19 bp, Homo sapiens
aggcttcaaaatgttatct

SEQ ID NO: 5209297 - DNA, 18 bp, Homo sapiens
aggcttcaattggtggaa

SEQ ID NO: 5209298 - DNA, 15 bp, Homo sapiens
aggcttcacagtctg

SEQ ID NO: 5209299 - DNA, 20 bp, Homo sapiens
aggcttcagttaccgctggc

SEQ ID NO: 5209300 - DNA, 15 bp, Homo sapiens
aggcttccaagcatt

SEQ ID NO: 5209301 - DNA, 19 bp, Homo sapiens
aggcttccaagcattactt

SEQ ID NO: 5209302 - DNA, 16 bp, Homo sapiens
aggcttccagctcagt

SEQ ID NO: 5209303 - DNA, 12 bp, Homo sapiens
aggcttccaggc

SEQ ID NO: 5209304 - DNA, 20 bp, Homo sapiens
aggcttccaggctcttcctg

SEQ ID NO: 5209305 - DNA, 22 bp, Homo sapiens
aggcttcccaaaccaagtgcct

SEQ ID NO: 5209306 - DNA, 16 bp, Homo sapiens
aggcttccccctttac

SEQ ID NO: 5209307 - DNA, 15 bp, Homo sapiens
aggcttccctacaca

SEQ ID NO: 5209308 - DNA, 16 bp, Homo sapiens
aggcttccctacacag

SEQ ID NO: 5209309 - DNA, 20 bp, Homo sapiens
aggcttccctacacagggcc

SEQ ID NO: 5209310 - DNA, 22 bp, Homo sapiens
aggcttccctacacagggcctg

SEQ ID NO: 5209311 - DNA, 18 bp, Homo sapiens
aggcttccgcgcccagcg

SEQ ID NO: 5209312 - DNA, 20 bp, Homo sapiens
aggcttccgcgcccagcgct

SEQ ID NO: 5209313 - DNA, 22 bp, Homo sapiens
aggcttccggctgagctgtgcc

SEQ ID NO: 5209314 - DNA, 23 bp, Homo sapiens
aggcttccggctgagctgtgcca

SEQ ID NO: 5209315 - DNA, 20 bp, Homo sapiens
aggcttccgtgtcctctccc

SEQ ID NO: 5209316 - DNA, 23 bp, Homo sapiens
aggcttccgtgtcctctccccca

SEQ ID NO: 5209317 - DNA, 19 bp, Homo sapiens
aggcttcctgactgacaca

SEQ ID NO: 5209318 - DNA, 21 bp, Homo sapiens
aggcttcctgactgacacagg

SEQ ID NO: 5209319 - DNA, 14 bp, Homo sapiens
aggcttcctgccct

SEQ ID NO: 5209320 - DNA, 15 bp, Homo sapiens
aggcttcctgcccta

SEQ ID NO: 5209321 - DNA, 16 bp, Homo sapiens
aggcttcctggtgaga

SEQ ID NO: 5209322 - DNA, 20 bp, Homo sapiens
aggcttcctggtgagaactg

SEQ ID NO: 5209323 - DNA, 16 bp, Homo sapiens
aggcttccttcatttc

SEQ ID NO: 5209324 - DNA, 19 bp, Homo sapiens
aggcttccttcatttcctc

SEQ ID NO: 5209325 - DNA, 23 bp, Homo sapiens
aggcttcggacagtgcccatgca

SEQ ID NO: 5209326 - DNA, 18 bp, Homo sapiens
aggcttcgtctcagaagg

SEQ ID NO: 5209327 - DNA, 13 bp, Homo sapiens
aggcttctaataa

SEQ ID NO: 5209328 - DNA, 22 bp, Homo sapiens
aggcttctccaattctgcccaa

SEQ ID NO: 5209329 - DNA, 14 bp, Homo sapiens
aggcttctcccgga

SEQ ID NO: 5209330 - DNA, 18 bp, Homo sapiens
aggcttctcccggacctg

SEQ ID NO: 5209331 - DNA, 15 bp, Homo sapiens
aggcttctccgccag

SEQ ID NO: 5209332 - DNA, 16 bp, Homo sapiens
aggcttctccgccagc

SEQ ID NO: 5209333 - DNA, 18 bp, Homo sapiens
aggcttctccgccagcct

SEQ ID NO: 5209334 - DNA, 22 bp, Homo sapiens
aggcttctccgccagcctcctc

SEQ ID NO: 5209335 - DNA, 18 bp, Homo sapiens
aggcttctcctgttttat

SEQ ID NO: 5209336 - DNA, 12 bp, Homo sapiens
aggcttctctct

SEQ ID NO: 5209337 - DNA, 13 bp, Homo sapiens
aggcttctctctc

SEQ ID NO: 5209338 - DNA, 14 bp, Homo sapiens
aggcttctctctca

SEQ ID NO: 5209339 - DNA, 16 bp, Homo sapiens
aggcttctctctgtgg

SEQ ID NO: 5209340 - DNA, 15 bp, Homo sapiens
aggcttctgagcagc

SEQ ID NO: 5209341 - DNA, 14 bp, Homo sapiens
aggcttctgctggg

SEQ ID NO: 5209342 - DNA, 16 bp, Homo sapiens
aggcttcttcctggat

SEQ ID NO: 5209343 - DNA, 18 bp, Homo sapiens
aggcttcttcctggatgg

SEQ ID NO: 5209344 - DNA, 20 bp, Homo sapiens
aggcttcttccttcttgtca

SEQ ID NO: 5209345 - DNA, 20 bp, Homo sapiens
aggcttgagggagggctggg

SEQ ID NO: 5209346 - DNA, 12 bp, Homo sapiens
aggcttgcagaa

SEQ ID NO: 5209347 - DNA, 18 bp, Homo sapiens
aggcttgcataataagct

SEQ ID NO: 5209348 - DNA, 21 bp, Homo sapiens
aggcttgccgcacatgaaaca

SEQ ID NO: 5209349 - DNA, 22 bp, Homo sapiens
aggcttgccgcacatgaaacat

SEQ ID NO: 5209350 - DNA, 15 bp, Homo sapiens
aggcttgcctgcagg

SEQ ID NO: 5209351 - DNA, 21 bp, Homo sapiens
aggcttgctgtatgacccctg

SEQ ID NO: 5209352 - DNA, 16 bp, Homo sapiens
aggcttggaatgaatt

SEQ ID NO: 5209353 - DNA, 22 bp, Homo sapiens
aggcttggagggaagggagaaa

SEQ ID NO: 5209354 - DNA, 16 bp, Homo sapiens
aggcttggctgccctg

SEQ ID NO: 5209355 - DNA, 17 bp, Homo sapiens
aggcttggctgccctgt

SEQ ID NO: 5209356 - DNA, 20 bp, Homo sapiens
aggcttgggcccagtagccc

SEQ ID NO: 5209357 - DNA, 17 bp, Homo sapiens
aggcttggggctggaga

SEQ ID NO: 5209358 - DNA, 20 bp, Homo sapiens
aggcttgggggttttcaatg

SEQ ID NO: 5209359 - DNA, 23 bp, Homo sapiens
aggcttgggggttttcaatgtga

SEQ ID NO: 5209360 - DNA, 18 bp, Homo sapiens
aggcttggtgtctgcggg

SEQ ID NO: 5209361 - DNA, 14 bp, Homo sapiens
aggcttggttcctt

SEQ ID NO: 5209362 - DNA, 20 bp, Homo sapiens
aggcttggttccttcccaat

SEQ ID NO: 5209363 - DNA, 16 bp, Homo sapiens
aggcttgtcagagctg

SEQ ID NO: 5209364 - DNA, 17 bp, Homo sapiens
aggcttgtcagagctgg

SEQ ID NO: 5209365 - DNA, 20 bp, Homo sapiens
aggcttgtcagagctgggag

SEQ ID NO: 5209366 - DNA, 14 bp, Homo sapiens
aggcttgttgtgct

SEQ ID NO: 5209367 - DNA, 16 bp, Homo sapiens
aggcttgttgtgcttt

SEQ ID NO: 5209368 - DNA, 13 bp, Homo sapiens
aggctttacttag

SEQ ID NO: 5209369 - DNA, 19 bp, Homo sapiens
aggctttacttagcttatc

SEQ ID NO: 5209370 - DNA, 14 bp, Homo sapiens
aggctttagaagag

SEQ ID NO: 5209371 - DNA, 18 bp, Homo sapiens
aggctttagtgtatttat

SEQ ID NO: 5209372 - DNA, 23 bp, Homo sapiens
aggctttatgataatagattctc

SEQ ID NO: 5209373 - DNA, 12 bp, Homo sapiens
aggctttcagct

SEQ ID NO: 5209374 - DNA, 21 bp, Homo sapiens
aggctttcagctgtgcttttt

SEQ ID NO: 5209375 - DNA, 20 bp, Homo sapiens
aggctttcggaattcctgca

SEQ ID NO: 5209376 - DNA, 17 bp, Homo sapiens
aggctttctattggcat

SEQ ID NO: 5209377 - DNA, 17 bp, Homo sapiens
aggctttctgggctctg

SEQ ID NO: 5209378 - DNA, 19 bp, Homo sapiens
aggctttgattagttttct

SEQ ID NO: 5209379 - DNA, 19 bp, Homo sapiens
aggctttgccatgggcctg

SEQ ID NO: 5209380 - DNA, 13 bp, Homo sapiens
aggctttgccctg

SEQ ID NO: 5209381 - DNA, 20 bp, Homo sapiens
aggctttgccctgctgccct

SEQ ID NO: 5209382 - DNA, 19 bp, Homo sapiens
aggctttggatttgacatt

SEQ ID NO: 5209383 - DNA, 13 bp, Homo sapiens
aggctttggccca

SEQ ID NO: 5209384 - DNA, 14 bp, Homo sapiens
aggctttggcccaa

SEQ ID NO: 5209385 - DNA, 22 bp, Homo sapiens
aggctttgggagagcaggaatg

SEQ ID NO: 5209386 - DNA, 18 bp, Homo sapiens
aggctttggtaactgcgg

SEQ ID NO: 5209387 - DNA, 20 bp, Homo sapiens
aggctttgtgatagtgacat

SEQ ID NO: 5209388 - DNA, 15 bp, Homo sapiens
aggctttgtgttgta

SEQ ID NO: 5209389 - DNA, 13 bp, Homo sapiens
aggcttttaccat

SEQ ID NO: 5209390 - DNA, 20 bp, Homo sapiens
aggcttttatatatgaagtt

SEQ ID NO: 5209391 - DNA, 21 bp, Homo sapiens
aggcttttatatatgaagttg

SEQ ID NO: 5209392 - DNA, 14 bp, Homo sapiens
aggcttttccagtg

SEQ ID NO: 5209393 - DNA, 14 bp, Homo sapiens
aggctttttcagtg

SEQ ID NO: 5209394 - DNA, 15 bp, Homo sapiens
aggctttttcagtga

SEQ ID NO: 5209395 - DNA, 13 bp, Homo sapiens
aggctttttccat

SEQ ID NO: 5209396 - DNA, 15 bp, Homo sapiens
aggcttttttatcat

SEQ ID NO: 5209397 - DNA, 18 bp, Homo sapiens
aggcttttttatcatgtg

SEQ ID NO: 5209398 - DNA, 18 bp, Homo sapiens
agggaaaaaaaacaggag

SEQ ID NO: 5209399 - DNA, 24 bp, Homo sapiens
agggaaaaaaaatgtagcgacagc

SEQ ID NO: 5209400 - DNA, 13 bp, Homo sapiens
agggaaaaaagaa

SEQ ID NO: 5209401 - DNA, 15 bp, Homo sapiens
agggaaaaaagaaag

SEQ ID NO: 5209402 - DNA, 17 bp, Homo sapiens
agggaaaaaagaaagaa

SEQ ID NO: 5209403 - DNA, 20 bp, Homo sapiens
agggaaaaaagaaagaaaaa

SEQ ID NO: 5209404 - DNA, 14 bp, Homo sapiens
agggaaaaagacct

SEQ ID NO: 5209405 - DNA, 12 bp, Homo sapiens
agggaaaaagag

SEQ ID NO: 5209406 - DNA, 13 bp, Homo sapiens
agggaaaaatata

SEQ ID NO: 5209407 - DNA, 14 bp, Homo sapiens
agggaaaaatatat

SEQ ID NO: 5209408 - DNA, 14 bp, Homo sapiens
agggaaaacagaaa

SEQ ID NO: 5209409 - DNA, 15 bp, Homo sapiens
agggaaaacattcca

SEQ ID NO: 5209410 - DNA, 16 bp, Homo sapiens
agggaaaagcagctct

SEQ ID NO: 5209411 - DNA, 10 bp, Homo sapiens
agggaaaagg

SEQ ID NO: 5209412 - DNA, 14 bp, Homo sapiens
agggaaaagggaag

SEQ ID NO: 5209413 - DNA, 22 bp, Homo sapiens
agggaaaataaaaaaagaaaaa

SEQ ID NO: 5209414 - DNA, 18 bp, Homo sapiens
agggaaaattatttgcat

SEQ ID NO: 5209415 - DNA, 19 bp, Homo sapiens
agggaaacagcctctctct

SEQ ID NO: 5209416 - DNA, 18 bp, Homo sapiens
agggaaaccttggagagg

SEQ ID NO: 5209417 - DNA, 21 bp, Homo sapiens
agggaaaccttggagaggaga

SEQ ID NO: 5209418 - DNA, 12 bp, Homo sapiens
agggaaaccttt

SEQ ID NO: 5209419 - DNA, 18 bp, Homo sapiens
agggaaactcagatgtcc

SEQ ID NO: 5209420 - DNA, 19 bp, Homo sapiens
agggaaactgcagctggga

SEQ ID NO: 5209421 - DNA, 22 bp, Homo sapiens
agggaaactgcagctgggaaga

SEQ ID NO: 5209422 - DNA, 14 bp, Homo sapiens
agggaaactgccag

SEQ ID NO: 5209423 - DNA, 23 bp, Homo sapiens
agggaaactgccagcaacgcagg

SEQ ID NO: 5209424 - DNA, 15 bp, Homo sapiens
agggaaactgggaaa

SEQ ID NO: 5209425 - DNA, 16 bp, Homo sapiens
agggaaactgggaaac

SEQ ID NO: 5209426 - DNA, 16 bp, Homo sapiens
agggaaagactggcaa

SEQ ID NO: 5209427 - DNA, 18 bp, Homo sapiens
agggaaaggatattttct

SEQ ID NO: 5209428 - DNA, 17 bp, Homo sapiens
agggaaaggcaagcttg

SEQ ID NO: 5209429 - DNA, 18 bp, Homo sapiens
aggagcaagagagggcaa

SEQ ID NO: 5209430 - DNA, 16 bp, Homo sapiens
aggagcaatcacagga

SEQ ID NO: 5209431 - DNA, 18 bp, Homo sapiens
aggagcaatcacaggaaa

SEQ ID NO: 5209432 - DNA, 15 bp, Homo sapiens
aggagcaatgggact

SEQ ID NO: 5209433 - DNA, 17 bp, Homo sapiens
aggagcaatgggactgg

SEQ ID NO: 5209434 - DNA, 21 bp, Homo sapiens
aggagcaatgggactggagtc

SEQ ID NO: 5209435 - DNA, 22 bp, Homo sapiens
aggagcacacatccaagaggga

SEQ ID NO: 5209436 - DNA, 20 bp, Homo sapiens
aggagcacacggccctgccc

SEQ ID NO: 5209437 - DNA, 23 bp, Homo sapiens
aggagcacacggccctgccccat

SEQ ID NO: 5209438 - DNA, 14 bp, Homo sapiens
aggagcacagccat

SEQ ID NO: 5209439 - DNA, 16 bp, Homo sapiens
aggagcacagccatag

SEQ ID NO: 5209440 - DNA, 16 bp, Homo sapiens
aggagcacaggtccca

SEQ ID NO: 5209441 - DNA, 17 bp, Homo sapiens
aggagcacaggtcccac

SEQ ID NO: 5209442 - DNA, 14 bp, Homo sapiens
aggagcacccccag

SEQ ID NO: 5209443 - DNA, 16 bp, Homo sapiens
aggagcacccccagcc

SEQ ID NO: 5209444 - DNA, 17 bp, Homo sapiens
aggagcacccccagcct

SEQ ID NO: 5209445 - DNA, 23 bp, Homo sapiens
aggagcacccccagcctccccca

SEQ ID NO: 5209446 - DNA, 16 bp, Homo sapiens
aggagcaccctgtctt

SEQ ID NO: 5209447 - DNA, 16 bp, Homo sapiens
aggagcacctgaaccc

SEQ ID NO: 5209448 - DNA, 15 bp, Homo sapiens
aggagcacggctctg

SEQ ID NO: 5209449 - DNA, 16 bp, Homo sapiens
aggagcacggctctgt

SEQ ID NO: 5209450 - DNA, 20 bp, Homo sapiens
aggagcactggggtgggggt

SEQ ID NO: 5209451 - DNA, 17 bp, Homo sapiens
aggagcacttccaaaat

SEQ ID NO: 5209452 - DNA, 13 bp, Homo sapiens
aggagcagaataa

SEQ ID NO: 5209453 - DNA, 16 bp, Homo sapiens
aggagcagacagagaa

SEQ ID NO: 5209454 - DNA, 18 bp, Homo sapiens
aggagcagacagagaaat

SEQ ID NO: 5209455 - DNA, 12 bp, Homo sapiens
aggagcagacca

SEQ ID NO: 5209456 - DNA, 16 bp, Homo sapiens
aggagcagagggcagg

SEQ ID NO: 5209457 - DNA, 16 bp, Homo sapiens
aggagcagagggccta

SEQ ID NO: 5209458 - DNA, 14 bp, Homo sapiens
aggagcagcagcca

SEQ ID NO: 5209459 - DNA, 16 bp, Homo sapiens
aggagcagcagcgctc

SEQ ID NO: 5209460 - DNA, 13 bp, Homo sapiens
aggagcagcattg

SEQ ID NO: 5209461 - DNA, 14 bp, Homo sapiens
aggagcagccacat

SEQ ID NO: 5209462 - DNA, 23 bp, Homo sapiens
aggagcagcccacctgctgcccg

SEQ ID NO: 5209463 - DNA, 15 bp, Homo sapiens
aggagcagcctcgag

SEQ ID NO: 5209464 - DNA, 19 bp, Homo sapiens
aggagcagcctcgaggctg

SEQ ID NO: 5209465 - DNA, 21 bp, Homo sapiens
aggagcagcctcgaggctggt

SEQ ID NO: 5209466 - DNA, 22 bp, Homo sapiens
aggagcagcctcgaggctggtg

SEQ ID NO: 5209467 - DNA, 15 bp, Homo sapiens
aggagcagcgggaac

SEQ ID NO: 5209468 - DNA, 10 bp, Homo sapiens
aggagcagct

SEQ ID NO: 5209469 - DNA, 14 bp, Homo sapiens
aggagcagctgggg

SEQ ID NO: 5209470 - DNA, 16 bp, Homo sapiens
aggagcagctgtgctg

SEQ ID NO: 5209471 - DNA, 16 bp, Homo sapiens
aggagcagcttcagtt

SEQ ID NO: 5209472 - DNA, 19 bp, Homo sapiens
aggagcagcttccttctgg

SEQ ID NO: 5209473 - DNA, 22 bp, Homo sapiens
aggagcagcttccttctgggac

SEQ ID NO: 5209474 - DNA, 15 bp, Homo sapiens
aggagcaggaacaga

SEQ ID NO: 5209475 - DNA, 18 bp, Homo sapiens
aggagcaggaagcaaggc

SEQ ID NO: 5209476 - DNA, 23 bp, Homo sapiens
aggagcaggaagcaaggccagcc

SEQ ID NO: 5209477 - DNA, 16 bp, Homo sapiens
aggagcaggcacgggt

SEQ ID NO: 5209478 - DNA, 21 bp, Homo sapiens
aggagcaggccctgggcctcc

SEQ ID NO: 5209479 - DNA, 12 bp, Homo sapiens
aggagcaggctt

SEQ ID NO: 5209480 - DNA, 13 bp, Homo sapiens
aggagcaggcttg

SEQ ID NO: 5209481 - DNA, 14 bp, Homo sapiens
aggagcaggcttgt

SEQ ID NO: 5209482 - DNA, 19 bp, Homo sapiens
aggagcagtatcatgaagc

SEQ ID NO: 5209483 - DNA, 16 bp, Homo sapiens
aggagcagtgcaggca

SEQ ID NO: 5209484 - DNA, 13 bp, Homo sapiens
aggagcagtgggc

SEQ ID NO: 5209485 - DNA, 22 bp, Homo sapiens
aggagcagtgggccctggctct

SEQ ID NO: 5209486 - DNA, 18 bp, Homo sapiens
aggagcatagaagccaca

SEQ ID NO: 5209487 - DNA, 12 bp, Homo sapiens
aggagcatcctt

SEQ ID NO: 5209488 - DNA, 22 bp, Homo sapiens
aggagcatgtcctatccctgga

SEQ ID NO: 5209489 - DNA, 16 bp, Homo sapiens
aggagcattaagccca

SEQ ID NO: 5209490 - DNA, 23 bp, Homo sapiens
aggagcattgcagtcactttgac

SEQ ID NO: 5209491 - DNA, 17 bp, Homo sapiens
aggagcattttgtgtct

SEQ ID NO: 5209492 - DNA, 18 bp, Homo sapiens
aggagcattttgtgtctt

SEQ ID NO: 5209493 - DNA, 18 bp, Homo sapiens
aggagcattttttaaaaa

SEQ ID NO: 5209494 - DNA, 22 bp, Homo sapiens
aggagcatttttttattcagca

SEQ ID NO: 5209495 - DNA, 14 bp, Homo sapiens
aggagccaccagtt

SEQ ID NO: 5209496 - DNA, 20 bp, Homo sapiens
aggagccagcctgcttccca

SEQ ID NO: 5209497 - DNA, 13 bp, Homo sapiens
aggagccaggcaa

SEQ ID NO: 5209498 - DNA, 16 bp, Homo sapiens
aggagccaggccccac

SEQ ID NO: 5209499 - DNA, 24 bp, Homo sapiens
aggagcccacggctaagaggctgc

SEQ ID NO: 5209500 - DNA, 18 bp, Homo sapiens
aggagcccagccagaaag

SEQ ID NO: 5209501 - DNA, 18 bp, Homo sapiens
aggagcccagccttgcgc

SEQ ID NO: 5209502 - DNA, 14 bp, Homo sapiens
aggagcccaggcca

SEQ ID NO: 5209503 - DNA, 18 bp, Homo sapiens
aggagcccaggccaggac

SEQ ID NO: 5209504 - DNA, 11 bp, Homo sapiens
aggagcccagt

SEQ ID NO: 5209505 - DNA, 20 bp, Homo sapiens
aggagcccagtgggctgcac

SEQ ID NO: 5209506 - DNA, 23 bp, Homo sapiens
aggagcccagtgggctgcacgct

SEQ ID NO: 5209507 - DNA, 22 bp, Homo sapiens
aggagcccatttggagggcctg

SEQ ID NO: 5209508 - DNA, 19 bp, Homo sapiens
aggagccccagccagccct

SEQ ID NO: 5209509 - DNA, 20 bp, Homo sapiens
aggagccccagccagccctt

SEQ ID NO: 5209510 - DNA, 14 bp, Homo sapiens
aggagccccagcta

SEQ ID NO: 5209511 - DNA, 14 bp, Homo sapiens
aggagccccagctt

SEQ ID NO: 5209512 - DNA, 14 bp, Homo sapiens
aggagccccaggca

SEQ ID NO: 5209513 - DNA, 16 bp, Homo sapiens
aggagccccaggcagg

SEQ ID NO: 5209514 - DNA, 16 bp, Homo sapiens
aggagccccattcctg

SEQ ID NO: 5209515 - DNA, 19 bp, Homo sapiens
aggagccccattcctggga

SEQ ID NO: 5209516 - DNA, 17 bp, Homo sapiens
aggagccccgaggcctt

SEQ ID NO: 5209517 - DNA, 14 bp, Homo sapiens
aggagccccgccac

SEQ ID NO: 5209518 - DNA, 21 bp, Homo sapiens
aggagccccgccaggtgcccg

SEQ ID NO: 5209519 - DNA, 22 bp, Homo sapiens
aggagcccgtcaggccacagcc

SEQ ID NO: 5209520 - DNA, 18 bp, Homo sapiens
aggagccctactgaaggg

SEQ ID NO: 5209521 - DNA, 11 bp, Homo sapiens
aggagccctgc

SEQ ID NO: 5209522 - DNA, 14 bp, Homo sapiens
aggagccctgcctc

SEQ ID NO: 5209523 - DNA, 14 bp, Homo sapiens
aggagccctggccc

SEQ ID NO: 5209524 - DNA, 23 bp, Homo sapiens
aggagcccttctatacccaccca

SEQ ID NO: 5209525 - DNA, 21 bp, Homo sapiens
aggagccggacacttctcagg

SEQ ID NO: 5209526 - DNA, 19 bp, Homo sapiens
aggagccggaccaagatgg

SEQ ID NO: 5209527 - DNA, 19 bp, Homo sapiens
aggagcctagcggagccca

SEQ ID NO: 5209528 - DNA, 21 bp, Homo sapiens
aggagcctagcggagcccagc

SEQ ID NO: 5209529 - DNA, 13 bp, Homo sapiens
aggagcctcagaa

SEQ ID NO: 5209530 - DNA, 20 bp, Homo sapiens
aggagcctcagaagaaaaca

SEQ ID NO: 5209531 - DNA, 23 bp, Homo sapiens
aggagcctcgtgtcctgctagct

SEQ ID NO: 5209532 - DNA, 14 bp, Homo sapiens
aggagcctctgcag

SEQ ID NO: 5209533 - DNA, 16 bp, Homo sapiens
aggagcctctggcttc

SEQ ID NO: 5209534 - DNA, 18 bp, Homo sapiens
aggagcctgcggctgctg

SEQ ID NO: 5209535 - DNA, 20 bp, Homo sapiens
aggagcctgcggctgctggc

SEQ ID NO: 5209536 - DNA, 12 bp, Homo sapiens
aggagcctgcta

SEQ ID NO: 5209537 - DNA, 15 bp, Homo sapiens
aggagcctgctaagg

SEQ ID NO: 5209538 - DNA, 20 bp, Homo sapiens
aggagcctgctaaggaacaa

SEQ ID NO: 5209539 - DNA, 14 bp, Homo sapiens
aggagcctgctggt

SEQ ID NO: 5209540 - DNA, 13 bp, Homo sapiens
aggagcctggagt

SEQ ID NO: 5209541 - DNA, 14 bp, Homo sapiens
aggagcctggccag

SEQ ID NO: 5209542 - DNA, 17 bp, Homo sapiens
aggagcctggccaggca

SEQ ID NO: 5209543 - DNA, 20 bp, Homo sapiens
aggagcctggccaggcaggg

SEQ ID NO: 5209544 - DNA, 22 bp, Homo sapiens
aggagcctggccaggcagggag

SEQ ID NO: 5209545 - DNA, 13 bp, Homo sapiens
aggagcctggcct

SEQ ID NO: 5209546 - DNA, 17 bp, Homo sapiens
aggagcctgggggctcc

SEQ ID NO: 5209547 - DNA, 19 bp, Homo sapiens
aggagcctggtccttccct

SEQ ID NO: 5209548 - DNA, 16 bp, Homo sapiens
aggagcctgtcctgcc

SEQ ID NO: 5209549 - DNA, 17 bp, Homo sapiens
aggagcctgtgaaccca

SEQ ID NO: 5209550 - DNA, 19 bp, Homo sapiens
aggagcctgtgaacccagg

SEQ ID NO: 5209551 - DNA, 13 bp, Homo sapiens
aggagcctgtgac

SEQ ID NO: 5209552 - DNA, 21 bp, Homo sapiens
aggagccttgataatacttga

SEQ ID NO: 5209553 - DNA, 17 bp, Homo sapiens
aggagccttgctgggcc

SEQ ID NO: 5209554 - DNA, 22 bp, Homo sapiens
aggagccttgctgggccaggga

SEQ ID NO: 5209555 - DNA, 13 bp, Homo sapiens
aggagccttggag

SEQ ID NO: 5209556 - DNA, 16 bp, Homo sapiens
aggagccttttgctct

SEQ ID NO: 5209557 - DNA, 13 bp, Homo sapiens
aggagcgcaagat

SEQ ID NO: 5209558 - DNA, 13 bp, Homo sapiens
aggagcgcaggca

SEQ ID NO: 5209559 - DNA, 22 bp, Homo sapiens
aggagcgcgcgtgatagaagaa

SEQ ID NO: 5209560 - DNA, 17 bp, Homo sapiens
aggagcggcgccctgga

SEQ ID NO: 5209561 - DNA, 19 bp, Homo sapiens
aggagcggcgccctggact

SEQ ID NO: 5209562 - DNA, 21 bp, Homo sapiens
aggagcggcgccctggacttg

SEQ ID NO: 5209563 - DNA, 22 bp, Homo sapiens
aggagcggcgccctggacttgg

SEQ ID NO: 5209564 - DNA, 16 bp, Homo sapiens
aggagcgggacctgtg

SEQ ID NO: 5209565 - DNA, 19 bp, Homo sapiens
aggagcgtgaaggacttag

SEQ ID NO: 5209566 - DNA, 13 bp, Homo sapiens
aggagcgtggact

SEQ ID NO: 5209567 - DNA, 15 bp, Homo sapiens
aggagcgtggactct

SEQ ID NO: 5209568 - DNA, 14 bp, Homo sapiens
aggagctaaggctc

SEQ ID NO: 5209569 - DNA, 22 bp, Homo sapiens
aggagctacccttttcctttgt

SEQ ID NO: 5209570 - DNA, 12 bp, Homo sapiens
aggagctacctg

SEQ ID NO: 5209571 - DNA, 22 bp, Homo sapiens
aggagctacctgtgtggacagg

SEQ ID NO: 5209572 - DNA, 18 bp, Homo sapiens
aggagctagtaggaatgt

SEQ ID NO: 5209573 - DNA, 21 bp, Homo sapiens
aggagctagtgttaatccaga

SEQ ID NO: 5209574 - DNA, 18 bp, Homo sapiens
aggagctcaccctgcccg

SEQ ID NO: 5209575 - DNA, 19 bp, Homo sapiens
aggagctcagccgtgcact

SEQ ID NO: 5209576 - DNA, 20 bp, Homo sapiens
aggagctcagggctggattg

SEQ ID NO: 5209577 - DNA, 22 bp, Homo sapiens
aggagctcaggtggggagtcca

SEQ ID NO: 5209578 - DNA, 15 bp, Homo sapiens
aggagctcccctccc

SEQ ID NO: 5209579 - DNA, 17 bp, Homo sapiens
aggagctcccctcccca

SEQ ID NO: 5209580 - DNA, 21 bp, Homo sapiens
aggagctcccctccccaactg

SEQ ID NO: 5209581 - DNA, 22 bp, Homo sapiens
aggagctcccctgtttgcatga

SEQ ID NO: 5209582 - DNA, 13 bp, Homo sapiens
aggagctcccttt

SEQ ID NO: 5209583 - DNA, 20 bp, Homo sapiens
aggagctcgcggggcagcaa

SEQ ID NO: 5209584 - DNA, 20 bp, Homo sapiens
aggagctctaccctgctccc

SEQ ID NO: 5209585 - DNA, 21 bp, Homo sapiens
aggagctctaccctgctccct

SEQ ID NO: 5209586 - DNA, 23 bp, Homo sapiens
aggagctctaccctgctccctgc

SEQ ID NO: 5209587 - DNA, 12 bp, Homo sapiens
aggagctctctg

SEQ ID NO: 5209588 - DNA, 17 bp, Homo sapiens
aggagctctctgctgag

SEQ ID NO: 5209589 - DNA, 22 bp, Homo sapiens
aggagctgacagagccagaggc

SEQ ID NO: 5209590 - DNA, 13 bp, Homo sapiens
aggagctgagaat

SEQ ID NO: 5209591 - DNA, 14 bp, Homo sapiens
aggagctgagaata

SEQ ID NO: 5209592 - DNA, 15 bp, Homo sapiens
aggagctgagaatag

SEQ ID NO: 5209593 - DNA, 16 bp, Homo sapiens
aggagctgagaataga

SEQ ID NO: 5209594 - DNA, 17 bp, Homo sapiens
aggagctgagaatagaa

SEQ ID NO: 5209595 - DNA, 20 bp, Homo sapiens
aggagctgagggagggagcc

SEQ ID NO: 5209596 - DNA, 21 bp, Homo sapiens
aggagctgaggtttcaccctt

SEQ ID NO: 5209597 - DNA, 18 bp, Homo sapiens
aggagctgagttggcaga

SEQ ID NO: 5209598 - DNA, 20 bp, Homo sapiens
aggagctgagttggcagacc

SEQ ID NO: 5209599 - DNA, 15 bp, Homo sapiens
aggagctgatggcag

SEQ ID NO: 5209600 - DNA, 18 bp, Homo sapiens
aggagctgatggcagctg

SEQ ID NO: 5209601 - DNA, 19 bp, Homo sapiens
aggagctgatggcagctgg

SEQ ID NO: 5209602 - DNA, 15 bp, Homo sapiens
aggagctgcactgat

SEQ ID NO: 5209603 - DNA, 14 bp, Homo sapiens
aggagctgcccaga

SEQ ID NO: 5209604 - DNA, 21 bp, Homo sapiens
aggagctgccgcaaggccctg

SEQ ID NO: 5209605 - DNA, 12 bp, Homo sapiens
aggagctgcctg

SEQ ID NO: 5209606 - DNA, 15 bp, Homo sapiens
aggagctgcctggac

SEQ ID NO: 5209607 - DNA, 19 bp, Homo sapiens
aggagctgccttggctcag

SEQ ID NO: 5209608 - DNA, 13 bp, Homo sapiens
agggaaaggccag

SEQ ID NO: 5209609 - DNA, 18 bp, Homo sapiens
agggaaaggccagcactc

SEQ ID NO: 5209610 - DNA, 19 bp, Homo sapiens
agggaaaggggtgctttta

SEQ ID NO: 5209611 - DNA, 22 bp, Homo sapiens
agggaaagtattagcatgagct

SEQ ID NO: 5209612 - DNA, 19 bp, Homo sapiens
agggaaagttttgttctgt

SEQ ID NO: 5209613 - DNA, 22 bp, Homo sapiens
agggaaagttttgttctgtata

SEQ ID NO: 5209614 - DNA, 15 bp, Homo sapiens
agggaaagttttttt

SEQ ID NO: 5209615 - DNA, 15 bp, Homo sapiens
agggaaatcaattta

SEQ ID NO: 5209616 - DNA, 21 bp, Homo sapiens
agggaaatcaatttaaaggaa

SEQ ID NO: 5209617 - DNA, 20 bp, Homo sapiens
agggaaatcttggtgtaact

SEQ ID NO: 5209618 - DNA, 21 bp, Homo sapiens
agggaaatcttggtgtaactt

SEQ ID NO: 5209619 - DNA, 13 bp, Homo sapiens
agggaaatggagg

SEQ ID NO: 5209620 - DNA, 15 bp, Homo sapiens
agggaaatggagggt

SEQ ID NO: 5209621 - DNA, 14 bp, Homo sapiens
agggaaatggcctt

SEQ ID NO: 5209622 - DNA, 16 bp, Homo sapiens
agggaaatgtacactt

SEQ ID NO: 5209623 - DNA, 20 bp, Homo sapiens
agggaaatgtatgtgtgtct

SEQ ID NO: 5209624 - DNA, 22 bp, Homo sapiens
agggaaatgtgactggttcaga

SEQ ID NO: 5209625 - DNA, 14 bp, Homo sapiens
agggaaatgtgtat

SEQ ID NO: 5209626 - DNA, 17 bp, Homo sapiens
agggaaattcacactgt

SEQ ID NO: 5209627 - DNA, 22 bp, Homo sapiens
agggaaattgtaaatcctgtgt

SEQ ID NO: 5209628 - DNA, 17 bp, Homo sapiens
agggaaatttcaataac

SEQ ID NO: 5209629 - DNA, 21 bp, Homo sapiens
agggaacaatttggcaatttt

SEQ ID NO: 5209630 - DNA, 10 bp, Homo sapiens
agggaacaca

SEQ ID NO: 5209631 - DNA, 19 bp, Homo sapiens
agggaacacggcctactga

SEQ ID NO: 5209632 - DNA, 19 bp, Homo sapiens
agggaacactcatccctgg

SEQ ID NO: 5209633 - DNA, 18 bp, Homo sapiens
agggaacagacaggagaa

SEQ ID NO: 5209634 - DNA, 14 bp, Homo sapiens
agggaacagcccca

SEQ ID NO: 5209635 - DNA, 14 bp, Homo sapiens
agggaacagggcgg

SEQ ID NO: 5209636 - DNA, 21 bp, Homo sapiens
agggaacatttccgaataaag

SEQ ID NO: 5209637 - DNA, 17 bp, Homo sapiens
agggaaccaccagcgtt

SEQ ID NO: 5209638 - DNA, 18 bp, Homo sapiens
agggaaccaccagcgttc

SEQ ID NO: 5209639 - DNA, 22 bp, Homo sapiens
agggaaccagccctccagagca

SEQ ID NO: 5209640 - DNA, 22 bp, Homo sapiens
agggaacccagctctaatacat

SEQ ID NO: 5209641 - DNA, 19 bp, Homo sapiens
agggaaccccagggggcaa

SEQ ID NO: 5209642 - DNA, 19 bp, Homo sapiens
agggaaccgtctgttttta

SEQ ID NO: 5209643 - DNA, 22 bp, Homo sapiens
agggaaccgttattataattgt

SEQ ID NO: 5209644 - DNA, 19 bp, Homo sapiens
agggaacggggtccttcaa

SEQ ID NO: 5209645 - DNA, 14 bp, Homo sapiens
agggaactagataa

SEQ ID NO: 5209646 - DNA, 14 bp, Homo sapiens
agggaactgaccct

SEQ ID NO: 5209647 - DNA, 15 bp, Homo sapiens
agggaactgcttgcc

SEQ ID NO: 5209648 - DNA, 19 bp, Homo sapiens
agggaactgcttgcccagg

SEQ ID NO: 5209649 - DNA, 22 bp, Homo sapiens
agggaactgcttgcccagggtg

SEQ ID NO: 5209650 - DNA, 21 bp, Homo sapiens
agggaactgggaagatgctgg

SEQ ID NO: 5209651 - DNA, 22 bp, Homo sapiens
agggaactgggaagatgctggc

SEQ ID NO: 5209652 - DNA, 15 bp, Homo sapiens
agggaactttctgga

SEQ ID NO: 5209653 - DNA, 15 bp, Homo sapiens
agggaagaaaaagca

SEQ ID NO: 5209654 - DNA, 12 bp, Homo sapiens
agggaagaaact

SEQ ID NO: 5209655 - DNA, 19 bp, Homo sapiens
agggaagaaaggaggcagc

SEQ ID NO: 5209656 - DNA, 13 bp, Homo sapiens
agggaagaacatt

SEQ ID NO: 5209657 - DNA, 14 bp, Homo sapiens
agggaagaactatt

SEQ ID NO: 5209658 - DNA, 19 bp, Homo sapiens
agggaagaataaagagctg

SEQ ID NO: 5209659 - DNA, 14 bp, Homo sapiens
agggaagacagagc

SEQ ID NO: 5209660 - DNA, 15 bp, Homo sapiens
agggaagacagagca

SEQ ID NO: 5209661 - DNA, 15 bp, Homo sapiens
agggaagacaggtct

SEQ ID NO: 5209662 - DNA, 16 bp, Homo sapiens
agggaagacatttctt

SEQ ID NO: 5209663 - DNA, 12 bp, Homo sapiens
agggaagaccag

SEQ ID NO: 5209664 - DNA, 14 bp, Homo sapiens
agggaagacctgaa

SEQ ID NO: 5209665 - DNA, 21 bp, Homo sapiens
agggaagagtcttccaaggcc

SEQ ID NO: 5209666 - DNA, 17 bp, Homo sapiens
agggaagcagagcctgg

SEQ ID NO: 5209667 - DNA, 18 bp, Homo sapiens
agggaagcagagcctggg

SEQ ID NO: 5209668 - DNA, 18 bp, Homo sapiens
agggaagcagcagcctcg

SEQ ID NO: 5209669 - DNA, 12 bp, Homo sapiens
agggaagcaggg

SEQ ID NO: 5209670 - DNA, 14 bp, Homo sapiens
agggaagcagggac

SEQ ID NO: 5209671 - DNA, 20 bp, Homo sapiens
agggaagcatagagaacggg

SEQ ID NO: 5209672 - DNA, 15 bp, Homo sapiens
agggaagcccacccg

SEQ ID NO: 5209673 - DNA, 17 bp, Homo sapiens
agggaagcccacccgcc

SEQ ID NO: 5209674 - DNA, 18 bp, Homo sapiens
agggaagcccacccgccc

SEQ ID NO: 5209675 - DNA, 14 bp, Homo sapiens
agggaagcccagcc

SEQ ID NO: 5209676 - DNA, 18 bp, Homo sapiens
agggaagcccagctccag

SEQ ID NO: 5209677 - DNA, 12 bp, Homo sapiens
agggaagccctc

SEQ ID NO: 5209678 - DNA, 15 bp, Homo sapiens
agggaagcctcttca

SEQ ID NO: 5209679 - DNA, 16 bp, Homo sapiens
agggaagcctgaaaaa

SEQ ID NO: 5209680 - DNA, 17 bp, Homo sapiens
agggaagcctgactgct

SEQ ID NO: 5209681 - DNA, 19 bp, Homo sapiens
agggaagccttttgcaaat

SEQ ID NO: 5209682 - DNA, 23 bp, Homo sapiens
agggaagctcacacatcctgtca

SEQ ID NO: 5209683 - DNA, 18 bp, Homo sapiens
agggaagctcatcaaagc

SEQ ID NO: 5209684 - DNA, 23 bp, Homo sapiens
agggaagctggcctgagagggga

SEQ ID NO: 5209685 - DNA, 13 bp, Homo sapiens
agggaagctggct

SEQ ID NO: 5209686 - DNA, 15 bp, Homo sapiens
agggaagctgtcctg

SEQ ID NO: 5209687 - DNA, 22 bp, Homo sapiens
agggaagctttcaccagccaca

SEQ ID NO: 5209688 - DNA, 21 bp, Homo sapiens
agggaaggacaatcccaggaa

SEQ ID NO: 5209689 - DNA, 13 bp, Homo sapiens
agggaaggacaga

SEQ ID NO: 5209690 - DNA, 17 bp, Homo sapiens
agggaaggacagtccct

SEQ ID NO: 5209691 - DNA, 20 bp, Homo sapiens
agggaaggacagtccctgct

SEQ ID NO: 5209692 - DNA, 16 bp, Homo sapiens
agggaaggagacacca

SEQ ID NO: 5209693 - DNA, 13 bp, Homo sapiens
agggaaggagctg

SEQ ID NO: 5209694 - DNA, 22 bp, Homo sapiens
agggaaggaggccactttgaga

SEQ ID NO: 5209695 - DNA, 15 bp, Homo sapiens
agggaaggagggtag

SEQ ID NO: 5209696 - DNA, 22 bp, Homo sapiens
agggaaggcaaaggcagaggaa

SEQ ID NO: 5209697 - DNA, 16 bp, Homo sapiens
agggaaggcaggcagg

SEQ ID NO: 5209698 - DNA, 17 bp, Homo sapiens
agggaaggccacctgca

SEQ ID NO: 5209699 - DNA, 12 bp, Homo sapiens
agggaaggccca

SEQ ID NO: 5209700 - DNA, 13 bp, Homo sapiens
agggaaggcctga

SEQ ID NO: 5209701 - DNA, 16 bp, Homo sapiens
agggaaggcctgactt

SEQ ID NO: 5209702 - DNA, 14 bp, Homo sapiens
agggaaggctaagc

SEQ ID NO: 5209703 - DNA, 15 bp, Homo sapiens
agggaagggagccaa

SEQ ID NO: 5209704 - DNA, 14 bp, Homo sapiens
agggaagggccacc

SEQ ID NO: 5209705 - DNA, 20 bp, Homo sapiens
agggaagggccaccctgctg

SEQ ID NO: 5209706 - DNA, 14 bp, Homo sapiens
agggaagggcctgc

SEQ ID NO: 5209707 - DNA, 16 bp, Homo sapiens
agggaagggcctgcca

SEQ ID NO: 5209708 - DNA, 15 bp, Homo sapiens
agggaaggggaatgg

SEQ ID NO: 5209709 - DNA, 19 bp, Homo sapiens
agggaaggggaatggaaga

SEQ ID NO: 5209710 - DNA, 20 bp, Homo sapiens
agggaaggggaggcagccgg

SEQ ID NO: 5209711 - DNA, 12 bp, Homo sapiens
agggaaggggcc

SEQ ID NO: 5209712 - DNA, 16 bp, Homo sapiens
agggaaggggcctccc

SEQ ID NO: 5209713 - DNA, 13 bp, Homo sapiens
agggaagggtgcc

SEQ ID NO: 5209714 - DNA, 15 bp, Homo sapiens
agggaagggtgcctg

SEQ ID NO: 5209715 - DNA, 19 bp, Homo sapiens
agggaagggtgcctggctg

SEQ ID NO: 5209716 - DNA, 13 bp, Homo sapiens
agggaaggtggcc

SEQ ID NO: 5209717 - DNA, 20 bp, Homo sapiens
agggaaggtggggccctgcc

SEQ ID NO: 5209718 - DNA, 17 bp, Homo sapiens
agggaagtaacagacac

SEQ ID NO: 5209719 - DNA, 14 bp, Homo sapiens
agggaagtaagatg

SEQ ID NO: 5209720 - DNA, 17 bp, Homo sapiens
agggaagtagttatcat

SEQ ID NO: 5209721 - DNA, 15 bp, Homo sapiens
agggaagtccccagg

SEQ ID NO: 5209722 - DNA, 15 bp, Homo sapiens
agggaagtcctggga

SEQ ID NO: 5209723 - DNA, 17 bp, Homo sapiens
agggaagtgcagagctt

SEQ ID NO: 5209724 - DNA, 14 bp, Homo sapiens
agggaagtggaggt

SEQ ID NO: 5209725 - DNA, 13 bp, Homo sapiens
agggaagtgggga

SEQ ID NO: 5209726 - DNA, 14 bp, Homo sapiens
agggaagtggggag

SEQ ID NO: 5209727 - DNA, 13 bp, Homo sapiens
agggaagtggtct

SEQ ID NO: 5209728 - DNA, 19 bp, Homo sapiens
agggaagttcaggctctga

SEQ ID NO: 5209729 - DNA, 23 bp, Homo sapiens
agggaagttgctggaaagagcat

SEQ ID NO: 5209730 - DNA, 18 bp, Homo sapiens
agggaataaatttttgtc

SEQ ID NO: 5209731 - DNA, 15 bp, Homo sapiens
agggaatcagggacc

SEQ ID NO: 5209732 - DNA, 16 bp, Homo sapiens
agggaatcagggacca

SEQ ID NO: 5209733 - DNA, 19 bp, Homo sapiens
agggaatcagggaccagct

SEQ ID NO: 5209734 - DNA, 15 bp, Homo sapiens
agggaatccaagcct

SEQ ID NO: 5209735 - DNA, 19 bp, Homo sapiens
agggaatccgcctgcagag

SEQ ID NO: 5209736 - DNA, 15 bp, Homo sapiens
agggaatctggatta

SEQ ID NO: 5209737 - DNA, 18 bp, Homo sapiens
agggaatgaacctggagg

SEQ ID NO: 5209738 - DNA, 14 bp, Homo sapiens
agggaatgaatcca

SEQ ID NO: 5209739 - DNA, 14 bp, Homo sapiens
agggaatgcagcag

SEQ ID NO: 5209740 - DNA, 18 bp, Homo sapiens
agggaatgcctgagtgcc

SEQ ID NO: 5209741 - DNA, 17 bp, Homo sapiens
agggaatgcctggaggg

SEQ ID NO: 5209742 - DNA, 18 bp, Homo sapiens
agggaatgcctggagggt

SEQ ID NO: 5209743 - DNA, 15 bp, Homo sapiens
agggaatggccacaa

SEQ ID NO: 5209744 - DNA, 18 bp, Homo sapiens
agggaatgggagacttga

SEQ ID NO: 5209745 - DNA, 18 bp, Homo sapiens
agggaatgttccctgcac

SEQ ID NO: 5209746 - DNA, 22 bp, Homo sapiens
agggaattaaaaagaagatgaa

SEQ ID NO: 5209747 - DNA, 18 bp, Homo sapiens
agggaattcgatgccccc

SEQ ID NO: 5209748 - DNA, 20 bp, Homo sapiens
agggaattcgatgcccccct

SEQ ID NO: 5209749 - DNA, 13 bp, Homo sapiens
agggaattcttac

SEQ ID NO: 5209750 - DNA, 12 bp, Homo sapiens
agggaattgctc

SEQ ID NO: 5209751 - DNA, 17 bp, Homo sapiens
agggaattgggggggtg

SEQ ID NO: 5209752 - DNA, 20 bp, Homo sapiens
agggaattgtttttataaaa

SEQ ID NO: 5209753 - DNA, 18 bp, Homo sapiens
agggaatttaatactttt

SEQ ID NO: 5209754 - DNA, 13 bp, Homo sapiens
agggaattttcat

SEQ ID NO: 5209755 - DNA, 17 bp, Homo sapiens
agggaattttcattttc

SEQ ID NO: 5209756 - DNA, 20 bp, Homo sapiens
agggacaaagaaatcccccc

SEQ ID NO: 5209757 - DNA, 13 bp, Homo sapiens
agggacaaagagg

SEQ ID NO: 5209758 - DNA, 21 bp, Homo sapiens
agggacaaaggagcctgtgaa

SEQ ID NO: 5209759 - DNA, 19 bp, Homo sapiens
agggacaaatttaaaacaa

SEQ ID NO: 5209760 - DNA, 14 bp, Homo sapiens
agggacaacatttt

SEQ ID NO: 5209761 - DNA, 13 bp, Homo sapiens
agggacaacccca

SEQ ID NO: 5209762 - DNA, 15 bp, Homo sapiens
agggacaagggattc

SEQ ID NO: 5209763 - DNA, 18 bp, Homo sapiens
agggacaagggattctgg

SEQ ID NO: 5209764 - DNA, 21 bp, Homo sapiens
agggacaagggattctgggaa

SEQ ID NO: 5209765 - DNA, 14 bp, Homo sapiens
agggacacacacac

SEQ ID NO: 5209766 - DNA, 17 bp, Homo sapiens
agggacacacagcctag

SEQ ID NO: 5209767 - DNA, 19 bp, Homo sapiens
agggacacacagcctagca

SEQ ID NO: 5209768 - DNA, 18 bp, Homo sapiens
agggacacagaggacagc

SEQ ID NO: 5209769 - DNA, 12 bp, Homo sapiens
agggacacagga

SEQ ID NO: 5209770 - DNA, 13 bp, Homo sapiens
agggacacaggag

SEQ ID NO: 5209771 - DNA, 14 bp, Homo sapiens
agggacacaggaga

SEQ ID NO: 5209772 - DNA, 14 bp, Homo sapiens
agggacaccagcca

SEQ ID NO: 5209773 - DNA, 18 bp, Homo sapiens
agggacaccagccaggct

SEQ ID NO: 5209774 - DNA, 21 bp, Homo sapiens
agggacacctgggagaaatct

SEQ ID NO: 5209775 - DNA, 16 bp, Homo sapiens
agggacactcctcctc

SEQ ID NO: 5209776 - DNA, 16 bp, Homo sapiens
agggacagaagcagga

SEQ ID NO: 5209777 - DNA, 15 bp, Homo sapiens
agggacagagatgga

SEQ ID NO: 5209778 - DNA, 17 bp, Homo sapiens
agggacagagatggagg

SEQ ID NO: 5209779 - DNA, 13 bp, Homo sapiens
agggacagagccc

SEQ ID NO: 5209780 - DNA, 15 bp, Homo sapiens
agggacagagcccgg

SEQ ID NO: 5209781 - DNA, 12 bp, Homo sapiens
agggacagaggc

SEQ ID NO: 5209782 - DNA, 14 bp, Homo sapiens
agggacagaggcca

SEQ ID NO: 5209783 - DNA, 18 bp, Homo sapiens
agggacagaggccaagga

SEQ ID NO: 5209784 - DNA, 17 bp, Homo sapiens
agggacagaggccccag

SEQ ID NO: 5209785 - DNA, 17 bp, Homo sapiens
agggacagcaagtgagc

SEQ ID NO: 5209786 - DNA, 20 bp, Homo sapiens
agggacagcaagtgagcaga

SEQ ID NO: 5209787 - DNA, 16 bp, Homo sapiens
agggacagcagcctcc

SEQ ID NO: 5209788 - DNA, 20 bp, Homo sapiens
agggacagcccacggtctgg

SEQ ID NO: 5209789 - DNA, 19 bp, Homo sapiens
aggagctgctatagcctgg

SEQ ID NO: 5209790 - DNA, 16 bp, Homo sapiens
aggagctgctggcttg

SEQ ID NO: 5209791 - DNA, 17 bp, Homo sapiens
aggagctgctggcttgc

SEQ ID NO: 5209792 - DNA, 21 bp, Homo sapiens
aggagctgctggcttgcagtg

SEQ ID NO: 5209793 - DNA, 22 bp, Homo sapiens
aggagctggaggggtggggagc

SEQ ID NO: 5209794 - DNA, 20 bp, Homo sapiens
aggagctggatttgggagct

SEQ ID NO: 5209795 - DNA, 18 bp, Homo sapiens
aggagctggcctgtggca

SEQ ID NO: 5209796 - DNA, 21 bp, Homo sapiens
aggagctggcctgtggcacag

SEQ ID NO: 5209797 - DNA, 10 bp, Homo sapiens
aggagctggg

SEQ ID NO: 5209798 - DNA, 12 bp, Homo sapiens
aggagctgggga

SEQ ID NO: 5209799 - DNA, 18 bp, Homo sapiens
aggagctgtggaaatggt

SEQ ID NO: 5209800 - DNA, 13 bp, Homo sapiens
aggagctgttact

SEQ ID NO: 5209801 - DNA, 18 bp, Homo sapiens
aggagctgttggggcagg

SEQ ID NO: 5209802 - DNA, 23 bp, Homo sapiens
aggagcttacccaagctgtggca

SEQ ID NO: 5209803 - DNA, 16 bp, Homo sapiens
aggagcttccagatgg

SEQ ID NO: 5209804 - DNA, 17 bp, Homo sapiens
aggagcttccagtgcat

SEQ ID NO: 5209805 - DNA, 23 bp, Homo sapiens
aggagcttccagtgcatgttgcc

SEQ ID NO: 5209806 - DNA, 19 bp, Homo sapiens
aggagcttcttcgttcctg

SEQ ID NO: 5209807 - DNA, 20 bp, Homo sapiens
aggagcttcttgtttccttg

SEQ ID NO: 5209808 - DNA, 22 bp, Homo sapiens
aggagcttcttgtttccttgtt

SEQ ID NO: 5209809 - DNA, 15 bp, Homo sapiens
aggagcttgggtctc

SEQ ID NO: 5209810 - DNA, 17 bp, Homo sapiens
aggagctttgactcagg

SEQ ID NO: 5209811 - DNA, 19 bp, Homo sapiens
aggaggaaaacgggaaaga

SEQ ID NO: 5209812 - DNA, 14 bp, Homo sapiens
aggaggaaaagaca

SEQ ID NO: 5209813 - DNA, 20 bp, Homo sapiens
aggaggaaaagacagagcct

SEQ ID NO: 5209814 - DNA, 20 bp, Homo sapiens
aggaggaaacgggttaaaaa

SEQ ID NO: 5209815 - DNA, 14 bp, Homo sapiens
aggaggaaagagag

SEQ ID NO: 5209816 - DNA, 15 bp, Homo sapiens
aggaggaaagagagt

SEQ ID NO: 5209817 - DNA, 17 bp, Homo sapiens
aggaggaaatcccttca

SEQ ID NO: 5209818 - DNA, 13 bp, Homo sapiens
aggaggaacaggt

SEQ ID NO: 5209819 - DNA, 20 bp, Homo sapiens
aggaggaacgggcagccaca

SEQ ID NO: 5209820 - DNA, 16 bp, Homo sapiens
aggaggaactggtcca

SEQ ID NO: 5209821 - DNA, 13 bp, Homo sapiens
aggaggaagcaga

SEQ ID NO: 5209822 - DNA, 13 bp, Homo sapiens
aggaggaagctta

SEQ ID NO: 5209823 - DNA, 13 bp, Homo sapiens
aggaggaaggcaa

SEQ ID NO: 5209824 - DNA, 16 bp, Homo sapiens
aggaggaaggcaaagc

SEQ ID NO: 5209825 - DNA, 18 bp, Homo sapiens
aggaggaagtagtccagc

SEQ ID NO: 5209826 - DNA, 15 bp, Homo sapiens
aggaggaagtcatgg

SEQ ID NO: 5209827 - DNA, 18 bp, Homo sapiens
aggaggaatactgaacat

SEQ ID NO: 5209828 - DNA, 17 bp, Homo sapiens
aggaggaatgctggact

SEQ ID NO: 5209829 - DNA, 23 bp, Homo sapiens
aggaggaattagttgggatgcca

SEQ ID NO: 5209830 - DNA, 17 bp, Homo sapiens
aggaggacaaaaggaat

SEQ ID NO: 5209831 - DNA, 12 bp, Homo sapiens
aggaggacaaga

SEQ ID NO: 5209832 - DNA, 16 bp, Homo sapiens
aggaggacaattgtca

SEQ ID NO: 5209833 - DNA, 17 bp, Homo sapiens
aggaggacacagcacaa

SEQ ID NO: 5209834 - DNA, 12 bp, Homo sapiens
aggaggacccag

SEQ ID NO: 5209835 - DNA, 16 bp, Homo sapiens
aggaggacccaggaca

SEQ ID NO: 5209836 - DNA, 16 bp, Homo sapiens
aggaggacccagggct

SEQ ID NO: 5209837 - DNA, 15 bp, Homo sapiens
aggaggacttgcagg

SEQ ID NO: 5209838 - DNA, 20 bp, Homo sapiens
aggaggacttggagggtctg

SEQ ID NO: 5209839 - DNA, 12 bp, Homo sapiens
aggaggagaagg

SEQ ID NO: 5209840 - DNA, 13 bp, Homo sapiens
aggaggagacaga

SEQ ID NO: 5209841 - DNA, 17 bp, Homo sapiens
aggaggagatggccata

SEQ ID NO: 5209842 - DNA, 13 bp, Homo sapiens
aggaggagcctgt

SEQ ID NO: 5209843 - DNA, 20 bp, Homo sapiens
aggaggagcctgtcctgcct

SEQ ID NO: 5209844 - DNA, 14 bp, Homo sapiens
aggaggagccttgc

SEQ ID NO: 5209845 - DNA, 22 bp, Homo sapiens
aggaggagccttgctgggccag

SEQ ID NO: 5209846 - DNA, 13 bp, Homo sapiens
aggaggagctctc

SEQ ID NO: 5209847 - DNA, 21 bp, Homo sapiens
aggaggagctctcaattttat

SEQ ID NO: 5209848 - DNA, 15 bp, Homo sapiens
aggaggagctgccgc

SEQ ID NO: 5209849 - DNA, 18 bp, Homo sapiens
aggaggagctgccgcaag

SEQ ID NO: 5209850 - DNA, 14 bp, Homo sapiens
aggaggaggacaca

SEQ ID NO: 5209851 - DNA, 17 bp, Homo sapiens
aggaggaggacacagca

SEQ ID NO: 5209852 - DNA, 13 bp, Homo sapiens
aggaggaggagcc

SEQ ID NO: 5209853 - DNA, 11 bp, Homo sapiens
aggaggaggct

SEQ ID NO: 5209854 - DNA, 12 bp, Homo sapiens
aggaggaggctg

SEQ ID NO: 5209855 - DNA, 17 bp, Homo sapiens
aggaggaggtgggggct

SEQ ID NO: 5209856 - DNA, 21 bp, Homo sapiens
aggaggaggtttaggtcaaga

SEQ ID NO: 5209857 - DNA, 17 bp, Homo sapiens
aggaggagtcagatgag

SEQ ID NO: 5209858 - DNA, 19 bp, Homo sapiens
aggaggatagaaaaaggat

SEQ ID NO: 5209859 - DNA, 16 bp, Homo sapiens
aggaggatcacttgag

SEQ ID NO: 5209860 - DNA, 22 bp, Homo sapiens
aggaggatgcctaacagagagt

SEQ ID NO: 5209861 - DNA, 15 bp, Homo sapiens
aggaggatgggctcg

SEQ ID NO: 5209862 - DNA, 18 bp, Homo sapiens
aggaggatgtaaggcctt

SEQ ID NO: 5209863 - DNA, 20 bp, Homo sapiens
aggaggatgtaaggccttag

SEQ ID NO: 5209864 - DNA, 15 bp, Homo sapiens
aggaggattgccttt

SEQ ID NO: 5209865 - DNA, 15 bp, Homo sapiens
aggaggattgtgctg

SEQ ID NO: 5209866 - DNA, 23 bp, Homo sapiens
aggaggcaagcgtgttctcagca

SEQ ID NO: 5209867 - DNA, 14 bp, Homo sapiens
aggaggcacagcag

SEQ ID NO: 5209868 - DNA, 21 bp, Homo sapiens
aggaggcacagcagtttcacc

SEQ ID NO: 5209869 - DNA, 12 bp, Homo sapiens
aggaggcagaga

SEQ ID NO: 5209870 - DNA, 14 bp, Homo sapiens
aggaggcagagagg

SEQ ID NO: 5209871 - DNA, 18 bp, Homo sapiens
aggaggcagccccctcca

SEQ ID NO: 5209872 - DNA, 20 bp, Homo sapiens
aggaggcagctgttgcagtg

SEQ ID NO: 5209873 - DNA, 14 bp, Homo sapiens
aggaggcaggagga

SEQ ID NO: 5209874 - DNA, 15 bp, Homo sapiens
aggaggcaggaggag

SEQ ID NO: 5209875 - DNA, 16 bp, Homo sapiens
aggaggcaggagttgg

SEQ ID NO: 5209876 - DNA, 21 bp, Homo sapiens
aggaggcatccaaaggctcct

SEQ ID NO: 5209877 - DNA, 22 bp, Homo sapiens
aggaggcatccaaaggctcctg

SEQ ID NO: 5209878 - DNA, 13 bp, Homo sapiens
aggaggccaataa

SEQ ID NO: 5209879 - DNA, 12 bp, Homo sapiens
aggaggccacct

SEQ ID NO: 5209880 - DNA, 17 bp, Homo sapiens
aggaggccacctctcca

SEQ ID NO: 5209881 - DNA, 20 bp, Homo sapiens
aggaggccacctctccaagg

SEQ ID NO: 5209882 - DNA, 22 bp, Homo sapiens
aggaggccacctctccaagggc

SEQ ID NO: 5209883 - DNA, 14 bp, Homo sapiens
aggaggccacgtga

SEQ ID NO: 5209884 - DNA, 13 bp, Homo sapiens
aggaggccagcct

SEQ ID NO: 5209885 - DNA, 20 bp, Homo sapiens
aggaggccagcctcacctca

SEQ ID NO: 5209886 - DNA, 21 bp, Homo sapiens
aggaggccagcctcacctcat

SEQ ID NO: 5209887 - DNA, 16 bp, Homo sapiens
aggaggccaggctcag

SEQ ID NO: 5209888 - DNA, 15 bp, Homo sapiens
aggaggccccaggct

SEQ ID NO: 5209889 - DNA, 20 bp, Homo sapiens
aggaggccccccgtgtggac

SEQ ID NO: 5209890 - DNA, 20 bp, Homo sapiens
aggaggccctggtgtcaggc

SEQ ID NO: 5209891 - DNA, 20 bp, Homo sapiens
aggaggccctgttccctgga

SEQ ID NO: 5209892 - DNA, 23 bp, Homo sapiens
aggaggcccttgtcgtgggatgg

SEQ ID NO: 5209893 - DNA, 18 bp, Homo sapiens
aggaggccgactgggctg

SEQ ID NO: 5209894 - DNA, 13 bp, Homo sapiens
aggaggcctggac

SEQ ID NO: 5209895 - DNA, 17 bp, Homo sapiens
aggaggcctggaccgag

SEQ ID NO: 5209896 - DNA, 19 bp, Homo sapiens
aggaggcctggaccgagat

SEQ ID NO: 5209897 - DNA, 14 bp, Homo sapiens
aggaggcctggcct

SEQ ID NO: 5209898 - DNA, 15 bp, Homo sapiens
aggaggcctgggaga

SEQ ID NO: 5209899 - DNA, 16 bp, Homo sapiens
aggaggcctgtcccaa

SEQ ID NO: 5209900 - DNA, 21 bp, Homo sapiens
aggaggccttgggctctgctg

SEQ ID NO: 5209901 - DNA, 20 bp, Homo sapiens
aggaggcgcccttggcttct

SEQ ID NO: 5209902 - DNA, 17 bp, Homo sapiens
aggaggcgcggcctccc

SEQ ID NO: 5209903 - DNA, 23 bp, Homo sapiens
aggaggcggcccggccagcgggc

SEQ ID NO: 5209904 - DNA, 16 bp, Homo sapiens
aggaggctagcaaagc

SEQ ID NO: 5209905 - DNA, 20 bp, Homo sapiens
aggaggctatgctcaggggc

SEQ ID NO: 5209906 - DNA, 23 bp, Homo sapiens
aggaggctatgctcaggggccct

SEQ ID NO: 5209907 - DNA, 20 bp, Homo sapiens
aggaggctccatccttctcc

SEQ ID NO: 5209908 - DNA, 19 bp, Homo sapiens
aggaggctccgtgagccct

SEQ ID NO: 5209909 - DNA, 20 bp, Homo sapiens
aggaggctccgtgagccctt

SEQ ID NO: 5209910 - DNA, 17 bp, Homo sapiens
aggaggctgagacagga

SEQ ID NO: 5209911 - DNA, 12 bp, Homo sapiens
aggaggctgagg

SEQ ID NO: 5209912 - DNA, 16 bp, Homo sapiens
aggaggctgaggcaga

SEQ ID NO: 5209913 - DNA, 13 bp, Homo sapiens
aggaggctgaggg

SEQ ID NO: 5209914 - DNA, 18 bp, Homo sapiens
aggaggctgcatgctctg

SEQ ID NO: 5209915 - DNA, 20 bp, Homo sapiens
aggaggctgcatgctctgga

SEQ ID NO: 5209916 - DNA, 21 bp, Homo sapiens
aggaggctgcatgctctggaa

SEQ ID NO: 5209917 - DNA, 18 bp, Homo sapiens
aggaggctgccctgaggg

SEQ ID NO: 5209918 - DNA, 21 bp, Homo sapiens
aggaggctgccggagggagcc

SEQ ID NO: 5209919 - DNA, 14 bp, Homo sapiens
aggaggctgcggcc

SEQ ID NO: 5209920 - DNA, 16 bp, Homo sapiens
aggaggctggaggaag

SEQ ID NO: 5209921 - DNA, 23 bp, Homo sapiens
aggaggctggccaaggtgtccag

SEQ ID NO: 5209922 - DNA, 21 bp, Homo sapiens
aggaggctgggacgctctgct

SEQ ID NO: 5209923 - DNA, 16 bp, Homo sapiens
aggaggctggtgacag

SEQ ID NO: 5209924 - DNA, 18 bp, Homo sapiens
aggaggctttctgggctc

SEQ ID NO: 5209925 - DNA, 21 bp, Homo sapiens
aggaggctttctgggctctgg

SEQ ID NO: 5209926 - DNA, 22 bp, Homo sapiens
aggaggctttctgggctctgga

SEQ ID NO: 5209927 - DNA, 15 bp, Homo sapiens
aggaggctttggtaa

SEQ ID NO: 5209928 - DNA, 23 bp, Homo sapiens
aggagggaatgattggtagcaaa

SEQ ID NO: 5209929 - DNA, 14 bp, Homo sapiens
aggagggacaaagg

SEQ ID NO: 5209930 - DNA, 21 bp, Homo sapiens
aggagggacaaaggagcctgt

SEQ ID NO: 5209931 - DNA, 23 bp, Homo sapiens
aggagggacaaaggagcctgtga

SEQ ID NO: 5209932 - DNA, 21 bp, Homo sapiens
aggagggacctactgaaccca

SEQ ID NO: 5209933 - DNA, 17 bp, Homo sapiens
aggagggagagagatgt

SEQ ID NO: 5209934 - DNA, 14 bp, Homo sapiens
aggagggagaggga

SEQ ID NO: 5209935 - DNA, 22 bp, Homo sapiens
aggagggaggcaggggaggggt

SEQ ID NO: 5209936 - DNA, 14 bp, Homo sapiens
aggagggaggccag

SEQ ID NO: 5209937 - DNA, 14 bp, Homo sapiens
aggagggaggggga

SEQ ID NO: 5209938 - DNA, 19 bp, Homo sapiens
aggagggatgctgcctgag

SEQ ID NO: 5209939 - DNA, 12 bp, Homo sapiens
aggagggatgtg

SEQ ID NO: 5209940 - DNA, 17 bp, Homo sapiens
aggagggatgttccagt

SEQ ID NO: 5209941 - DNA, 21 bp, Homo sapiens
aggagggatgttccagtggat

SEQ ID NO: 5209942 - DNA, 14 bp, Homo sapiens
aggagggcagcaga

SEQ ID NO: 5209943 - DNA, 23 bp, Homo sapiens
aggagggcatcagctttccctgg

SEQ ID NO: 5209944 - DNA, 18 bp, Homo sapiens
aggagggcatgggttggc

SEQ ID NO: 5209945 - DNA, 14 bp, Homo sapiens
aggagggcccggag

SEQ ID NO: 5209946 - DNA, 16 bp, Homo sapiens
aggagggccctgagga

SEQ ID NO: 5209947 - DNA, 19 bp, Homo sapiens
aggagggccctgaggaata

SEQ ID NO: 5209948 - DNA, 20 bp, Homo sapiens
aggagggcctcagagacagc

SEQ ID NO: 5209949 - DNA, 17 bp, Homo sapiens
aggagggcgtgactcac

SEQ ID NO: 5209950 - DNA, 17 bp, Homo sapiens
aggagggcgttcttagg

SEQ ID NO: 5209951 - DNA, 22 bp, Homo sapiens
aggagggcttgagagctcagcc

SEQ ID NO: 5209952 - DNA, 19 bp, Homo sapiens
aggagggctttgaatctgg

SEQ ID NO: 5209953 - DNA, 15 bp, Homo sapiens
aggaggggaaaaaat

SEQ ID NO: 5209954 - DNA, 16 bp, Homo sapiens
aggaggggaacactgc

SEQ ID NO: 5209955 - DNA, 16 bp, Homo sapiens
aggaggggaagaggcc

SEQ ID NO: 5209956 - DNA, 19 bp, Homo sapiens
aggaggggaagctgcagct

SEQ ID NO: 5209957 - DNA, 15 bp, Homo sapiens
aggaggggaaggggc

SEQ ID NO: 5209958 - DNA, 16 bp, Homo sapiens
aggaggggaaggggct

SEQ ID NO: 5209959 - DNA, 18 bp, Homo sapiens
aggaggggaaggggctga

SEQ ID NO: 5209960 - DNA, 17 bp, Homo sapiens
aggaggggacctctcca

SEQ ID NO: 5209961 - DNA, 17 bp, Homo sapiens
aggaggggacgggacag

SEQ ID NO: 5209962 - DNA, 21 bp, Homo sapiens
aggaggggcagcgcatgtgtg

SEQ ID NO: 5209963 - DNA, 19 bp, Homo sapiens
aggaggggcccccctgccc

SEQ ID NO: 5209964 - DNA, 20 bp, Homo sapiens
aggaggggcccgttgtctcc

SEQ ID NO: 5209965 - DNA, 22 bp, Homo sapiens
aggaggggcctgggcagcccca

SEQ ID NO: 5209966 - DNA, 13 bp, Homo sapiens
aggaggggcttct

SEQ ID NO: 5209967 - DNA, 14 bp, Homo sapiens
aggaggggcttctg

SEQ ID NO: 5209968 - DNA, 19 bp, Homo sapiens
agggacagctgcattccag

SEQ ID NO: 5209969 - DNA, 16 bp, Homo sapiens
agggacagctgctggg

SEQ ID NO: 5209970 - DNA, 13 bp, Homo sapiens
agggacaggaagg

SEQ ID NO: 5209971 - DNA, 21 bp, Homo sapiens
agggacaggaaggtctgattt

SEQ ID NO: 5209972 - DNA, 16 bp, Homo sapiens
agggacaggaccccag

SEQ ID NO: 5209973 - DNA, 17 bp, Homo sapiens
agggacaggaccccagc

SEQ ID NO: 5209974 - DNA, 21 bp, Homo sapiens
agggacaggaccccagctctg

SEQ ID NO: 5209975 - DNA, 12 bp, Homo sapiens
agggacaggaga

SEQ ID NO: 5209976 - DNA, 17 bp, Homo sapiens
agggacaggataagagg

SEQ ID NO: 5209977 - DNA, 17 bp, Homo sapiens
agggacaggctgaagag

SEQ ID NO: 5209978 - DNA, 20 bp, Homo sapiens
agggacaggctgaagagagg

SEQ ID NO: 5209979 - DNA, 22 bp, Homo sapiens
agggacagggaatgctgaggcc

SEQ ID NO: 5209980 - DNA, 14 bp, Homo sapiens
agggacagggccat

SEQ ID NO: 5209981 - DNA, 18 bp, Homo sapiens
agggacagggccatgggg

SEQ ID NO: 5209982 - DNA, 20 bp, Homo sapiens
agggacagggcttggggagc

SEQ ID NO: 5209983 - DNA, 16 bp, Homo sapiens
agggacagtattctca

SEQ ID NO: 5209984 - DNA, 13 bp, Homo sapiens
agggacagtctca

SEQ ID NO: 5209985 - DNA, 14 bp, Homo sapiens
agggacagtttgta

SEQ ID NO: 5209986 - DNA, 15 bp, Homo sapiens
agggacagtttgtaa

SEQ ID NO: 5209987 - DNA, 20 bp, Homo sapiens
agggacatgaaatttacaaa

SEQ ID NO: 5209988 - DNA, 19 bp, Homo sapiens
agggacatgccctgtgtgg

SEQ ID NO: 5209989 - DNA, 14 bp, Homo sapiens
agggacatgcttag

SEQ ID NO: 5209990 - DNA, 17 bp, Homo sapiens
agggacatggggcaagc

SEQ ID NO: 5209991 - DNA, 18 bp, Homo sapiens
agggacatggggcaagcc

SEQ ID NO: 5209992 - DNA, 19 bp, Homo sapiens
agggacatggggcaagcca

SEQ ID NO: 5209993 - DNA, 17 bp, Homo sapiens
agggacatgtctttggc

SEQ ID NO: 5209994 - DNA, 22 bp, Homo sapiens
agggacatgttttgataaagta

SEQ ID NO: 5209995 - DNA, 20 bp, Homo sapiens
agggacatttccaagctgtt

SEQ ID NO: 5209996 - DNA, 23 bp, Homo sapiens
agggacatttctataaaaatact

SEQ ID NO: 5209997 - DNA, 16 bp, Homo sapiens
agggaccaactgggcc

SEQ ID NO: 5209998 - DNA, 19 bp, Homo sapiens
agggaccaactgggcccaa

SEQ ID NO: 5209999 - DNA, 18 bp, Homo sapiens
agggaccaaggacccctc

SEQ ID NO: 5210000 - DNA, 13 bp, Homo sapiens
agggaccaaggag

SEQ ID NO: 5210001 - DNA, 23 bp, Homo sapiens
agggaccaaggcaaggcaggtgc

SEQ ID NO: 5210002 - DNA, 23 bp, Homo sapiens
agggaccaatattaccatcttaa

SEQ ID NO: 5210003 - DNA, 13 bp, Homo sapiens
agggaccacagca

SEQ ID NO: 5210004 - DNA, 14 bp, Homo sapiens
agggaccacagcaa

SEQ ID NO: 5210005 - DNA, 22 bp, Homo sapiens
agggaccacatccaccccagcc

SEQ ID NO: 5210006 - DNA, 19 bp, Homo sapiens
agggaccagcccagcctgc

SEQ ID NO: 5210007 - DNA, 15 bp, Homo sapiens
agggaccagctcccc

SEQ ID NO: 5210008 - DNA, 16 bp, Homo sapiens
agggaccagctccccg

SEQ ID NO: 5210009 - DNA, 23 bp, Homo sapiens
agggaccagctccccgggggcca

SEQ ID NO: 5210010 - DNA, 13 bp, Homo sapiens
agggaccagcttt

SEQ ID NO: 5210011 - DNA, 14 bp, Homo sapiens
agggaccagcttta

SEQ ID NO: 5210012 - DNA, 15 bp, Homo sapiens
agggaccagctttac

SEQ ID NO: 5210013 - DNA, 14 bp, Homo sapiens
agggaccagggcca

SEQ ID NO: 5210014 - DNA, 15 bp, Homo sapiens
agggaccagggccac

SEQ ID NO: 5210015 - DNA, 19 bp, Homo sapiens
agggaccagggccaccgca

SEQ ID NO: 5210016 - DNA, 16 bp, Homo sapiens
agggaccaggggagag

SEQ ID NO: 5210017 - DNA, 20 bp, Homo sapiens
agggaccaggtttgcaggag

SEQ ID NO: 5210018 - DNA, 13 bp, Homo sapiens
agggaccatgtgt

SEQ ID NO: 5210019 - DNA, 19 bp, Homo sapiens
agggacccaaagcaggatg

SEQ ID NO: 5210020 - DNA, 14 bp, Homo sapiens
agggacccacctgc

SEQ ID NO: 5210021 - DNA, 15 bp, Homo sapiens
agggacccacctgct

SEQ ID NO: 5210022 - DNA, 19 bp, Homo sapiens
agggacccacctgctagtc

SEQ ID NO: 5210023 - DNA, 19 bp, Homo sapiens
agggacccaggtgtgcctg

SEQ ID NO: 5210024 - DNA, 20 bp, Homo sapiens
agggacccaggtgtgcctgt

SEQ ID NO: 5210025 - DNA, 22 bp, Homo sapiens
agggaccccagatacctgtgag

SEQ ID NO: 5210026 - DNA, 23 bp, Homo sapiens
agggaccccagatacctgtgagg

SEQ ID NO: 5210027 - DNA, 13 bp, Homo sapiens
agggacccccaga

SEQ ID NO: 5210028 - DNA, 16 bp, Homo sapiens
agggacccccccccaa

SEQ ID NO: 5210029 - DNA, 23 bp, Homo sapiens
agggacccccgaggcccccctct

SEQ ID NO: 5210030 - DNA, 24 bp, Homo sapiens
agggacccccgaggcccccctctg

SEQ ID NO: 5210031 - DNA, 12 bp, Homo sapiens
agggacccctcc

SEQ ID NO: 5210032 - DNA, 20 bp, Homo sapiens
agggacccctcgccccagcc

SEQ ID NO: 5210033 - DNA, 22 bp, Homo sapiens
agggacccggggtctcctggac

SEQ ID NO: 5210034 - DNA, 22 bp, Homo sapiens
agggacccttgcctgcctccta

SEQ ID NO: 5210035 - DNA, 23 bp, Homo sapiens
agggacccttgcctgcctcctag

SEQ ID NO: 5210036 - DNA, 18 bp, Homo sapiens
agggaccggcagagctct

SEQ ID NO: 5210037 - DNA, 17 bp, Homo sapiens
agggaccgggagcctgc

SEQ ID NO: 5210038 - DNA, 20 bp, Homo sapiens
agggaccggtgctgcaggag

SEQ ID NO: 5210039 - DNA, 16 bp, Homo sapiens
agggacctcaggggca

SEQ ID NO: 5210040 - DNA, 19 bp, Homo sapiens
agggacctcaggggcacct

SEQ ID NO: 5210041 - DNA, 16 bp, Homo sapiens
agggacctctcccagg

SEQ ID NO: 5210042 - DNA, 13 bp, Homo sapiens
agggacctgctca

SEQ ID NO: 5210043 - DNA, 13 bp, Homo sapiens
agggacctgctgc

SEQ ID NO: 5210044 - DNA, 18 bp, Homo sapiens
agggacctgctgctcagt

SEQ ID NO: 5210045 - DNA, 12 bp, Homo sapiens
agggacctgggg

SEQ ID NO: 5210046 - DNA, 13 bp, Homo sapiens
agggacctgggga

SEQ ID NO: 5210047 - DNA, 16 bp, Homo sapiens
agggacctggggaagc

SEQ ID NO: 5210048 - DNA, 16 bp, Homo sapiens
agggaccttcagggag

SEQ ID NO: 5210049 - DNA, 22 bp, Homo sapiens
agggaccttcagggagagctgg

SEQ ID NO: 5210050 - DNA, 15 bp, Homo sapiens
agggaccttgaaggg

SEQ ID NO: 5210051 - DNA, 18 bp, Homo sapiens
agggaccttggagagctc

SEQ ID NO: 5210052 - DNA, 23 bp, Homo sapiens
agggacctttttggtcatggagg

SEQ ID NO: 5210053 - DNA, 17 bp, Homo sapiens
agggacgaagaagagcc

SEQ ID NO: 5210054 - DNA, 15 bp, Homo sapiens
agggacgagcagagc

SEQ ID NO: 5210055 - DNA, 17 bp, Homo sapiens
agggacgcacagcactg

SEQ ID NO: 5210056 - DNA, 20 bp, Homo sapiens
agggacgcacagcactgcct

SEQ ID NO: 5210057 - DNA, 22 bp, Homo sapiens
agggacgcacagcactgcctgc

SEQ ID NO: 5210058 - DNA, 23 bp, Homo sapiens
agggacgcacagcactgcctgcc

SEQ ID NO: 5210059 - DNA, 18 bp, Homo sapiens
agggacgcctgggggtgc

SEQ ID NO: 5210060 - DNA, 17 bp, Homo sapiens
agggacgcggaggagga

SEQ ID NO: 5210061 - DNA, 18 bp, Homo sapiens
agggacgcggaggaggaa

SEQ ID NO: 5210062 - DNA, 17 bp, Homo sapiens
agggacgctacccggga

SEQ ID NO: 5210063 - DNA, 19 bp, Homo sapiens
agggacggccaagaatgta

SEQ ID NO: 5210064 - DNA, 20 bp, Homo sapiens
agggacggccaagaatgtac

SEQ ID NO: 5210065 - DNA, 16 bp, Homo sapiens
agggacggctgtggga

SEQ ID NO: 5210066 - DNA, 21 bp, Homo sapiens
agggacggggcccgccccagg

SEQ ID NO: 5210067 - DNA, 22 bp, Homo sapiens
agggacggggcccgccccaggc

SEQ ID NO: 5210068 - DNA, 16 bp, Homo sapiens
agggacgggggtggga

SEQ ID NO: 5210069 - DNA, 19 bp, Homo sapiens
agggacgtgataatgcaga

SEQ ID NO: 5210070 - DNA, 17 bp, Homo sapiens
agggactaaatttgtaa

SEQ ID NO: 5210071 - DNA, 19 bp, Homo sapiens
agggactacccatagacat

SEQ ID NO: 5210072 - DNA, 17 bp, Homo sapiens
agggactacctctgtgc

SEQ ID NO: 5210073 - DNA, 19 bp, Homo sapiens
agggactagggcagtttgg

SEQ ID NO: 5210074 - DNA, 20 bp, Homo sapiens
agggactcatcatttccatt

SEQ ID NO: 5210075 - DNA, 14 bp, Homo sapiens
agggactccaagcc

SEQ ID NO: 5210076 - DNA, 19 bp, Homo sapiens
agggactccaagccctggg

SEQ ID NO: 5210077 - DNA, 14 bp, Homo sapiens
agggactctgaagc

SEQ ID NO: 5210078 - DNA, 22 bp, Homo sapiens
agggactctgaagcctctggga

SEQ ID NO: 5210079 - DNA, 14 bp, Homo sapiens
agggactctgggct

SEQ ID NO: 5210080 - DNA, 21 bp, Homo sapiens
agggactctgggctgtgcctg

SEQ ID NO: 5210081 - DNA, 15 bp, Homo sapiens
agggactctgtctgg

SEQ ID NO: 5210082 - DNA, 16 bp, Homo sapiens
agggactgaccagcag

SEQ ID NO: 5210083 - DNA, 13 bp, Homo sapiens
agggactgagaaa

SEQ ID NO: 5210084 - DNA, 14 bp, Homo sapiens
agggactgagaaat

SEQ ID NO: 5210085 - DNA, 17 bp, Homo sapiens
agggactgagaaattta

SEQ ID NO: 5210086 - DNA, 13 bp, Homo sapiens
agggactgagaga

SEQ ID NO: 5210087 - DNA, 18 bp, Homo sapiens
agggactgccaggctgtt

SEQ ID NO: 5210088 - DNA, 17 bp, Homo sapiens
agggactgcctctgcca

SEQ ID NO: 5210089 - DNA, 15 bp, Homo sapiens
agggactggaaccag

SEQ ID NO: 5210090 - DNA, 18 bp, Homo sapiens
agggactggaaccaggga

SEQ ID NO: 5210091 - DNA, 15 bp, Homo sapiens
agggactggacagcc

SEQ ID NO: 5210092 - DNA, 21 bp, Homo sapiens
agggactggacagccagggca

SEQ ID NO: 5210093 - DNA, 22 bp, Homo sapiens
agggactggacagccagggcag

SEQ ID NO: 5210094 - DNA, 18 bp, Homo sapiens
agggactgggatgagaga

SEQ ID NO: 5210095 - DNA, 14 bp, Homo sapiens
agggactgggggtg

SEQ ID NO: 5210096 - DNA, 13 bp, Homo sapiens
agggactggtcca

SEQ ID NO: 5210097 - DNA, 17 bp, Homo sapiens
agggactgtacctgtag

SEQ ID NO: 5210098 - DNA, 18 bp, Homo sapiens
agggactgtataaacaag

SEQ ID NO: 5210099 - DNA, 14 bp, Homo sapiens
agggactgtcagct

SEQ ID NO: 5210100 - DNA, 16 bp, Homo sapiens
agggactgtcttttct

SEQ ID NO: 5210101 - DNA, 16 bp, Homo sapiens
agggacttaacttgtt

SEQ ID NO: 5210102 - DNA, 18 bp, Homo sapiens
agggacttcgcagaggca

SEQ ID NO: 5210103 - DNA, 15 bp, Homo sapiens
agggacttgaagttg

SEQ ID NO: 5210104 - DNA, 16 bp, Homo sapiens
agggacttgcctccac

SEQ ID NO: 5210105 - DNA, 15 bp, Homo sapiens
agggacttggaagct

SEQ ID NO: 5210106 - DNA, 13 bp, Homo sapiens
agggacttggaca

SEQ ID NO: 5210107 - DNA, 21 bp, Homo sapiens
agggacttgtttagagagcct

SEQ ID NO: 5210108 - DNA, 22 bp, Homo sapiens
agggacttgtttagagagcctg

SEQ ID NO: 5210109 - DNA, 18 bp, Homo sapiens
agggacttttattttctt

SEQ ID NO: 5210110 - DNA, 11 bp, Homo sapiens
agggacttttg

SEQ ID NO: 5210111 - DNA, 13 bp, Homo sapiens
agggagaaaagag

SEQ ID NO: 5210112 - DNA, 14 bp, Homo sapiens
agggagaaaagaga

SEQ ID NO: 5210113 - DNA, 20 bp, Homo sapiens
agggagaaaatccaggtcat

SEQ ID NO: 5210114 - DNA, 22 bp, Homo sapiens
agggagaaacaagtggacctcg

SEQ ID NO: 5210115 - DNA, 16 bp, Homo sapiens
agggagaaagaaaact

SEQ ID NO: 5210116 - DNA, 14 bp, Homo sapiens
agggagaaaggaga

SEQ ID NO: 5210117 - DNA, 15 bp, Homo sapiens
agggagaaaggagaa

SEQ ID NO: 5210118 - DNA, 21 bp, Homo sapiens
agggagaaaggagaaattttg

SEQ ID NO: 5210119 - DNA, 14 bp, Homo sapiens
agggagaacttatg

SEQ ID NO: 5210120 - DNA, 10 bp, Homo sapiens
agggagaaga

SEQ ID NO: 5210121 - DNA, 17 bp, Homo sapiens
agggagaagacaacaga

SEQ ID NO: 5210122 - DNA, 21 bp, Homo sapiens
agggagaagacaacagaaaga

SEQ ID NO: 5210123 - DNA, 16 bp, Homo sapiens
agggagaagacactgc

SEQ ID NO: 5210124 - DNA, 14 bp, Homo sapiens
agggagaagagaaa

SEQ ID NO: 5210125 - DNA, 17 bp, Homo sapiens
agggagaaggaagggca

SEQ ID NO: 5210126 - DNA, 19 bp, Homo sapiens
agggagaaggaagggcaga

SEQ ID NO: 5210127 - DNA, 15 bp, Homo sapiens
agggagaaggagagg

SEQ ID NO: 5210128 - DNA, 18 bp, Homo sapiens
agggagaagggatggagg

SEQ ID NO: 5210129 - DNA, 21 bp, Homo sapiens
agggagaagtagctagtagca

SEQ ID NO: 5210130 - DNA, 18 bp, Homo sapiens
agggagaagttgagcagg

SEQ ID NO: 5210131 - DNA, 16 bp, Homo sapiens
agggagaatccaaggg

SEQ ID NO: 5210132 - DNA, 13 bp, Homo sapiens
agggagaatctga

SEQ ID NO: 5210133 - DNA, 21 bp, Homo sapiens
agggagaatggtgctgtttaa

SEQ ID NO: 5210134 - DNA, 14 bp, Homo sapiens
agggagacaagagg

SEQ ID NO: 5210135 - DNA, 18 bp, Homo sapiens
agggagacaatctaaaaa

SEQ ID NO: 5210136 - DNA, 22 bp, Homo sapiens
agggagacaggcagggagggct

SEQ ID NO: 5210137 - DNA, 21 bp, Homo sapiens
agggagacaggcctttccctg

SEQ ID NO: 5210138 - DNA, 17 bp, Homo sapiens
agggagacatctgcacc

SEQ ID NO: 5210139 - DNA, 12 bp, Homo sapiens
agggagacccaa

SEQ ID NO: 5210140 - DNA, 20 bp, Homo sapiens
agggagacccaataaagaat

SEQ ID NO: 5210141 - DNA, 13 bp, Homo sapiens
agggagaccctgg

SEQ ID NO: 5210142 - DNA, 21 bp, Homo sapiens
agggagacggccctgctgggg

SEQ ID NO: 5210143 - DNA, 22 bp, Homo sapiens
agggagacggccctgctggggc

SEQ ID NO: 5210144 - DNA, 22 bp, Homo sapiens
agggagactgacccattcacat

SEQ ID NO: 5210145 - DNA, 16 bp, Homo sapiens
agggagagacctcatc

SEQ ID NO: 5210146 - DNA, 11 bp, Homo sapiens
agggagagaga

SEQ ID NO: 5210147 - DNA, 17 bp, Homo sapiens
aggagggggaggacgga

SEQ ID NO: 5210148 - DNA, 20 bp, Homo sapiens
aggagggggcccggctgggc

SEQ ID NO: 5210149 - DNA, 19 bp, Homo sapiens
aggagggggccgggcgcgg

SEQ ID NO: 5210150 - DNA, 17 bp, Homo sapiens
aggaggggggagggaag

SEQ ID NO: 5210151 - DNA, 20 bp, Homo sapiens
aggagggggttcttcctcac

SEQ ID NO: 5210152 - DNA, 19 bp, Homo sapiens
aggaggggtaaatatatgt

SEQ ID NO: 5210153 - DNA, 14 bp, Homo sapiens
aggaggggtacatt

SEQ ID NO: 5210154 - DNA, 18 bp, Homo sapiens
aggagggtcaggaaggat

SEQ ID NO: 5210155 - DNA, 19 bp, Homo sapiens
aggagggtccccagctggt

SEQ ID NO: 5210156 - DNA, 17 bp, Homo sapiens
aggagggtcggtgcctt

SEQ ID NO: 5210157 - DNA, 21 bp, Homo sapiens
aggagggtctcgaactcctgg

SEQ ID NO: 5210158 - DNA, 19 bp, Homo sapiens
aggagggtgacgcccagct

SEQ ID NO: 5210159 - DNA, 23 bp, Homo sapiens
aggagggtgcagtatctcttgct

SEQ ID NO: 5210160 - DNA, 18 bp, Homo sapiens
aggagggtgcccctggga

SEQ ID NO: 5210161 - DNA, 18 bp, Homo sapiens
aggagggtggaggaaggt

SEQ ID NO: 5210162 - DNA, 15 bp, Homo sapiens
aggagggtgggaagg

SEQ ID NO: 5210163 - DNA, 13 bp, Homo sapiens
aggagggtggggg

SEQ ID NO: 5210164 - DNA, 18 bp, Homo sapiens
aggagggtttgggcagag

SEQ ID NO: 5210165 - DNA, 23 bp, Homo sapiens
aggaggtaaaggatgagggttca

SEQ ID NO: 5210166 - DNA, 22 bp, Homo sapiens
aggaggtaacatagatgcctgg

SEQ ID NO: 5210167 - DNA, 23 bp, Homo sapiens
aggaggtaacatagatgcctggg

SEQ ID NO: 5210168 - DNA, 20 bp, Homo sapiens
aggaggtcatctgaccttca

SEQ ID NO: 5210169 - DNA, 17 bp, Homo sapiens
aggaggtcccaggaagt

SEQ ID NO: 5210170 - DNA, 18 bp, Homo sapiens
aggaggtccttaggcctc

SEQ ID NO: 5210171 - DNA, 13 bp, Homo sapiens
aggaggtgcttga

SEQ ID NO: 5210172 - DNA, 16 bp, Homo sapiens
aggaggtgcttgaggc

SEQ ID NO: 5210173 - DNA, 20 bp, Homo sapiens
aggaggtggaggctgcagtg

SEQ ID NO: 5210174 - DNA, 14 bp, Homo sapiens
aggaggtggaggtt

SEQ ID NO: 5210175 - DNA, 20 bp, Homo sapiens
aggaggtggaggttgcagtg

SEQ ID NO: 5210176 - DNA, 17 bp, Homo sapiens
aggaggtggcagccctg

SEQ ID NO: 5210177 - DNA, 15 bp, Homo sapiens
aggaggtgggggctg

SEQ ID NO: 5210178 - DNA, 15 bp, Homo sapiens
aggaggtgtcccaag

SEQ ID NO: 5210179 - DNA, 17 bp, Homo sapiens
aggaggtgtcccaagct

SEQ ID NO: 5210180 - DNA, 15 bp, Homo sapiens
aggaggtgtctcagg

SEQ ID NO: 5210181 - DNA, 19 bp, Homo sapiens
aggaggtgtctggggtgag

SEQ ID NO: 5210182 - DNA, 14 bp, Homo sapiens
aggaggtgtgaatg

SEQ ID NO: 5210183 - DNA, 13 bp, Homo sapiens
aggaggtgtgagg

SEQ ID NO: 5210184 - DNA, 20 bp, Homo sapiens
aggaggtgtgaggaggaggc

SEQ ID NO: 5210185 - DNA, 17 bp, Homo sapiens
aggaggtgtggagtgga

SEQ ID NO: 5210186 - DNA, 19 bp, Homo sapiens
aggaggtgtggagtggagg

SEQ ID NO: 5210187 - DNA, 21 bp, Homo sapiens
aggaggtgtggagtggagggg

SEQ ID NO: 5210188 - DNA, 20 bp, Homo sapiens
aggaggttcgggattccctg

SEQ ID NO: 5210189 - DNA, 22 bp, Homo sapiens
aggaggttctcccagcccatct

SEQ ID NO: 5210190 - DNA, 14 bp, Homo sapiens
aggaggttgggagg

SEQ ID NO: 5210191 - DNA, 16 bp, Homo sapiens
aggaggttggtgactg

SEQ ID NO: 5210192 - DNA, 14 bp, Homo sapiens
aggaggtttgcagg

SEQ ID NO: 5210193 - DNA, 13 bp, Homo sapiens
aggagtaaaagag

SEQ ID NO: 5210194 - DNA, 16 bp, Homo sapiens
aggagtaaaattcagt

SEQ ID NO: 5210195 - DNA, 20 bp, Homo sapiens
aggagtaaagataaaaggat

SEQ ID NO: 5210196 - DNA, 22 bp, Homo sapiens
aggagtaaagataaaaggatag

SEQ ID NO: 5210197 - DNA, 20 bp, Homo sapiens
aggagtaaataattggaaaa

SEQ ID NO: 5210198 - DNA, 19 bp, Homo sapiens
aggagtaacaatacaaatg

SEQ ID NO: 5210199 - DNA, 18 bp, Homo sapiens
aggagtaagacaagtggg

SEQ ID NO: 5210200 - DNA, 16 bp, Homo sapiens
aggagtacaaaacaat

SEQ ID NO: 5210201 - DNA, 18 bp, Homo sapiens
aggagtacaggtgaagca

SEQ ID NO: 5210202 - DNA, 12 bp, Homo sapiens
aggagtactttc

SEQ ID NO: 5210203 - DNA, 11 bp, Homo sapiens
aggagtagaat

SEQ ID NO: 5210204 - DNA, 15 bp, Homo sapiens
aggagtagctgagag

SEQ ID NO: 5210205 - DNA, 17 bp, Homo sapiens
aggagtagctgagagga

SEQ ID NO: 5210206 - DNA, 15 bp, Homo sapiens
aggagtagctgagct

SEQ ID NO: 5210207 - DNA, 16 bp, Homo sapiens
aggagtagttttctat

SEQ ID NO: 5210208 - DNA, 15 bp, Homo sapiens
aggagtcaactggct

SEQ ID NO: 5210209 - DNA, 21 bp, Homo sapiens
aggagtcaactggctggccag

SEQ ID NO: 5210210 - DNA, 22 bp, Homo sapiens
aggagtcaactggctggccagt

SEQ ID NO: 5210211 - DNA, 18 bp, Homo sapiens
aggagtcaccatgcaagg

SEQ ID NO: 5210212 - DNA, 14 bp, Homo sapiens
aggagtcactgaga

SEQ ID NO: 5210213 - DNA, 17 bp, Homo sapiens
aggagtcagatgaggcc

SEQ ID NO: 5210214 - DNA, 14 bp, Homo sapiens
aggagtcagatggc

SEQ ID NO: 5210215 - DNA, 14 bp, Homo sapiens
aggagtcaggggct

SEQ ID NO: 5210216 - DNA, 15 bp, Homo sapiens
aggagtcaggggctc

SEQ ID NO: 5210217 - DNA, 19 bp, Homo sapiens
aggagtcaggggctctgtg

SEQ ID NO: 5210218 - DNA, 21 bp, Homo sapiens
aggagtcaggggctctgtgtt

SEQ ID NO: 5210219 - DNA, 19 bp, Homo sapiens
aggagtcagtctctttctg

SEQ ID NO: 5210220 - DNA, 15 bp, Homo sapiens
aggagtccaaacctt

SEQ ID NO: 5210221 - DNA, 18 bp, Homo sapiens
aggagtccaaaccttcta

SEQ ID NO: 5210222 - DNA, 13 bp, Homo sapiens
aggagtccagacc

SEQ ID NO: 5210223 - DNA, 18 bp, Homo sapiens
aggagtccagacccccca

SEQ ID NO: 5210224 - DNA, 19 bp, Homo sapiens
aggagtccagcccctcctc

SEQ ID NO: 5210225 - DNA, 22 bp, Homo sapiens
aggagtccagcccctcctccct

SEQ ID NO: 5210226 - DNA, 11 bp, Homo sapiens
aggagtccagg

SEQ ID NO: 5210227 - DNA, 14 bp, Homo sapiens
aggagtccaggccc

SEQ ID NO: 5210228 - DNA, 14 bp, Homo sapiens
aggagtccagggcg

SEQ ID NO: 5210229 - DNA, 23 bp, Homo sapiens
aggagtcccactccaagccagca

SEQ ID NO: 5210230 - DNA, 23 bp, Homo sapiens
aggagtcctttttgtcatgccct

SEQ ID NO: 5210231 - DNA, 21 bp, Homo sapiens
aggagtctctgccacccactc

SEQ ID NO: 5210232 - DNA, 22 bp, Homo sapiens
aggagtctctgccacccactca

SEQ ID NO: 5210233 - DNA, 20 bp, Homo sapiens
aggagtctgaggactgtcct

SEQ ID NO: 5210234 - DNA, 19 bp, Homo sapiens
aggagtctgaggtcctgag

SEQ ID NO: 5210235 - DNA, 20 bp, Homo sapiens
aggagtctgaggtcctgagc

SEQ ID NO: 5210236 - DNA, 22 bp, Homo sapiens
aggagtctgaggtcctgagcac

SEQ ID NO: 5210237 - DNA, 23 bp, Homo sapiens
aggagtctgaggtcctgagcact

SEQ ID NO: 5210238 - DNA, 17 bp, Homo sapiens
aggagtctgccacttgt

SEQ ID NO: 5210239 - DNA, 13 bp, Homo sapiens
aggagtctgtgct

SEQ ID NO: 5210240 - DNA, 16 bp, Homo sapiens
aggagtctgtgctctt

SEQ ID NO: 5210241 - DNA, 17 bp, Homo sapiens
aggagtctgtgctcttt

SEQ ID NO: 5210242 - DNA, 17 bp, Homo sapiens
aggagtcttcagaccca

SEQ ID NO: 5210243 - DNA, 22 bp, Homo sapiens
aggagtcttcagacccagagaa

SEQ ID NO: 5210244 - DNA, 21 bp, Homo sapiens
aggagtgacagatcacagggt

SEQ ID NO: 5210245 - DNA, 23 bp, Homo sapiens
aggagtgactctggctgccaaga

SEQ ID NO: 5210246 - DNA, 22 bp, Homo sapiens
aggagtgaggaaggcaggaaga

SEQ ID NO: 5210247 - DNA, 16 bp, Homo sapiens
aggagtgagtgtatgt

SEQ ID NO: 5210248 - DNA, 21 bp, Homo sapiens
aggagtgagtgtatgtgtgtg

SEQ ID NO: 5210249 - DNA, 16 bp, Homo sapiens
aggagtgatgggcaag

SEQ ID NO: 5210250 - DNA, 21 bp, Homo sapiens
aggagtgattgaaccagctca

SEQ ID NO: 5210251 - DNA, 16 bp, Homo sapiens
aggagtgcagccttct

SEQ ID NO: 5210252 - DNA, 13 bp, Homo sapiens
aggagtgccagga

SEQ ID NO: 5210253 - DNA, 20 bp, Homo sapiens
aggagtgccaggaccagcct

SEQ ID NO: 5210254 - DNA, 23 bp, Homo sapiens
aggagtgccataccttctcccag

SEQ ID NO: 5210255 - DNA, 17 bp, Homo sapiens
aggagtgcgctagagca

SEQ ID NO: 5210256 - DNA, 12 bp, Homo sapiens
aggagtgctggc

SEQ ID NO: 5210257 - DNA, 22 bp, Homo sapiens
aggagtggattcctccccaccc

SEQ ID NO: 5210258 - DNA, 23 bp, Homo sapiens
aggagtggcagctgtcccctctc

SEQ ID NO: 5210259 - DNA, 17 bp, Homo sapiens
aggagtggcaggaaaga

SEQ ID NO: 5210260 - DNA, 18 bp, Homo sapiens
aggagtggcaggaaagag

SEQ ID NO: 5210261 - DNA, 14 bp, Homo sapiens
aggagtggccacag

SEQ ID NO: 5210262 - DNA, 17 bp, Homo sapiens
aggagtggccctgatcc

SEQ ID NO: 5210263 - DNA, 23 bp, Homo sapiens
aggagtggccggggaagctggca

SEQ ID NO: 5210264 - DNA, 21 bp, Homo sapiens
aggagtgggaaaacactgcca

SEQ ID NO: 5210265 - DNA, 13 bp, Homo sapiens
aggagtgggacag

SEQ ID NO: 5210266 - DNA, 14 bp, Homo sapiens
aggagtgggacaga

SEQ ID NO: 5210267 - DNA, 20 bp, Homo sapiens
aggagtgggacagacagcag

SEQ ID NO: 5210268 - DNA, 14 bp, Homo sapiens
aggagtgggctctg

SEQ ID NO: 5210269 - DNA, 14 bp, Homo sapiens
aggagtggtgcaga

SEQ ID NO: 5210270 - DNA, 21 bp, Homo sapiens
aggagtgtcctgtctgctggg

SEQ ID NO: 5210271 - DNA, 17 bp, Homo sapiens
aggagtgtgctcaggcc

SEQ ID NO: 5210272 - DNA, 18 bp, Homo sapiens
aggagtgtgtgatttttt

SEQ ID NO: 5210273 - DNA, 15 bp, Homo sapiens
aggagtgttattgca

SEQ ID NO: 5210274 - DNA, 17 bp, Homo sapiens
aggagtgttattgcatg

SEQ ID NO: 5210275 - DNA, 17 bp, Homo sapiens
aggagttaagagtagca

SEQ ID NO: 5210276 - DNA, 16 bp, Homo sapiens
aggagttaatgatcgt

SEQ ID NO: 5210277 - DNA, 19 bp, Homo sapiens
aggagttagaaccacagca

SEQ ID NO: 5210278 - DNA, 21 bp, Homo sapiens
aggagttagaaccacagcaga

SEQ ID NO: 5210279 - DNA, 24 bp, Homo sapiens
aggagttagaaccacagcagacac

SEQ ID NO: 5210280 - DNA, 20 bp, Homo sapiens
aggagttagaggccagcctg

SEQ ID NO: 5210281 - DNA, 21 bp, Homo sapiens
aggagttcaagaccagcctgg

SEQ ID NO: 5210282 - DNA, 14 bp, Homo sapiens
aggagttcaatgat

SEQ ID NO: 5210283 - DNA, 16 bp, Homo sapiens
aggagttcgagaccag

SEQ ID NO: 5210284 - DNA, 17 bp, Homo sapiens
aggagttcgagaccagc

SEQ ID NO: 5210285 - DNA, 21 bp, Homo sapiens
aggagttcgagagcagcctgg

SEQ ID NO: 5210286 - DNA, 22 bp, Homo sapiens
aggagttcgaggcgagcctggc

SEQ ID NO: 5210287 - DNA, 16 bp, Homo sapiens
aggagttcgaggctgc

SEQ ID NO: 5210288 - DNA, 23 bp, Homo sapiens
aggagttcgagttacagcctggg

SEQ ID NO: 5210289 - DNA, 18 bp, Homo sapiens
aggagttctaacacattt

SEQ ID NO: 5210290 - DNA, 16 bp, Homo sapiens
aggagttctcctggag

SEQ ID NO: 5210291 - DNA, 17 bp, Homo sapiens
aggagttctcctggagc

SEQ ID NO: 5210292 - DNA, 20 bp, Homo sapiens
aggagttctctgatgcagaa

SEQ ID NO: 5210293 - DNA, 15 bp, Homo sapiens
aggagttctcttccg

SEQ ID NO: 5210294 - DNA, 17 bp, Homo sapiens
aggagttctcttccgca

SEQ ID NO: 5210295 - DNA, 18 bp, Homo sapiens
aggagttctttggctcta

SEQ ID NO: 5210296 - DNA, 12 bp, Homo sapiens
aggagttgcctg

SEQ ID NO: 5210297 - DNA, 21 bp, Homo sapiens
aggagttgctgtttgtttgac

SEQ ID NO: 5210298 - DNA, 21 bp, Homo sapiens
aggagttgggggcaggtcagg

SEQ ID NO: 5210299 - DNA, 15 bp, Homo sapiens
aggagttgtctgtcc

SEQ ID NO: 5210300 - DNA, 19 bp, Homo sapiens
aggagttgtctgtcctggt

SEQ ID NO: 5210301 - DNA, 18 bp, Homo sapiens
aggagttgtttctgaccc

SEQ ID NO: 5210302 - DNA, 19 bp, Homo sapiens
aggagtttaagaccagcct

SEQ ID NO: 5210303 - DNA, 21 bp, Homo sapiens
aggagtttaagaccagcctgg

SEQ ID NO: 5210304 - DNA, 23 bp, Homo sapiens
aggagtttatctatcggaagaac

SEQ ID NO: 5210305 - DNA, 14 bp, Homo sapiens
aggagtttatgttc

SEQ ID NO: 5210306 - DNA, 23 bp, Homo sapiens
aggagtttatgttccattaaacg

SEQ ID NO: 5210307 - DNA, 18 bp, Homo sapiens
aggagtttattacaatgt

SEQ ID NO: 5210308 - DNA, 14 bp, Homo sapiens
aggagtttcatgtt

SEQ ID NO: 5210309 - DNA, 20 bp, Homo sapiens
aggagtttcctaaaagttca

SEQ ID NO: 5210310 - DNA, 21 bp, Homo sapiens
aggagtttgagacaagccctg

SEQ ID NO: 5210311 - DNA, 24 bp, Homo sapiens
aggagtttgagacaagccctggca

SEQ ID NO: 5210312 - DNA, 19 bp, Homo sapiens
aggagtttgagaccagcct

SEQ ID NO: 5210313 - DNA, 16 bp, Homo sapiens
aggagtttgaggctgc

SEQ ID NO: 5210314 - DNA, 20 bp, Homo sapiens
aggagtttgaggctgcagcg

SEQ ID NO: 5210315 - DNA, 24 bp, Homo sapiens
aggagtttgaggctgcagcgagct

SEQ ID NO: 5210316 - DNA, 14 bp, Homo sapiens
aggagtttggagga

SEQ ID NO: 5210317 - DNA, 13 bp, Homo sapiens
aggagtttggcca

SEQ ID NO: 5210318 - DNA, 14 bp, Homo sapiens
aggagtttggccag

SEQ ID NO: 5210319 - DNA, 13 bp, Homo sapiens
aggagtttgtggt

SEQ ID NO: 5210320 - DNA, 17 bp, Homo sapiens
aggagttttctgtgtgg

SEQ ID NO: 5210321 - DNA, 19 bp, Homo sapiens
aggagttttctgtgtggtc

SEQ ID NO: 5210322 - DNA, 21 bp, Homo sapiens
aggagttttgttccagaggag

SEQ ID NO: 5210323 - DNA, 21 bp, Homo sapiens
agggagagagaagcaggcaga

SEQ ID NO: 5210324 - DNA, 14 bp, Homo sapiens
agggagagcacctt

SEQ ID NO: 5210325 - DNA, 19 bp, Homo sapiens
agggagagcccaggagctc

SEQ ID NO: 5210326 - DNA, 21 bp, Homo sapiens
agggagagcccaggagctccc

SEQ ID NO: 5210327 - DNA, 16 bp, Homo sapiens
agggagagcggggcag

SEQ ID NO: 5210328 - DNA, 16 bp, Homo sapiens
agggagagctgagcca

SEQ ID NO: 5210329 - DNA, 20 bp, Homo sapiens
agggagagctgggcagacag

SEQ ID NO: 5210330 - DNA, 15 bp, Homo sapiens
agggagaggaagcac

SEQ ID NO: 5210331 - DNA, 17 bp, Homo sapiens
agggagaggaggggctg

SEQ ID NO: 5210332 - DNA, 12 bp, Homo sapiens
agggagaggcct

SEQ ID NO: 5210333 - DNA, 19 bp, Homo sapiens
agggagaggcctcggctgt

SEQ ID NO: 5210334 - DNA, 14 bp, Homo sapiens
agggagaggctgtg

SEQ ID NO: 5210335 - DNA, 15 bp, Homo sapiens
agggagaggctgtgt

SEQ ID NO: 5210336 - DNA, 17 bp, Homo sapiens
agggagaggctgtgtcc

SEQ ID NO: 5210337 - DNA, 13 bp, Homo sapiens
agggagagggaag

SEQ ID NO: 5210338 - DNA, 13 bp, Homo sapiens
agggagagggagg

SEQ ID NO: 5210339 - DNA, 13 bp, Homo sapiens
agggagaggggaa

SEQ ID NO: 5210340 - DNA, 13 bp, Homo sapiens
agggagagggggc

SEQ ID NO: 5210341 - DNA, 19 bp, Homo sapiens
agggagagtctcccaggga

SEQ ID NO: 5210342 - DNA, 20 bp, Homo sapiens
agggagagttggggaaggca

SEQ ID NO: 5210343 - DNA, 21 bp, Homo sapiens
agggagagttggggaaggcaa

SEQ ID NO: 5210344 - DNA, 19 bp, Homo sapiens
agggagatgatccagagac

SEQ ID NO: 5210345 - DNA, 22 bp, Homo sapiens
agggagattcaaaaaaaaaata

SEQ ID NO: 5210346 - DNA, 14 bp, Homo sapiens
agggagattttgag

SEQ ID NO: 5210347 - DNA, 16 bp, Homo sapiens
agggagcaagccctac

SEQ ID NO: 5210348 - DNA, 19 bp, Homo sapiens
agggagcaagtccttccct

SEQ ID NO: 5210349 - DNA, 23 bp, Homo sapiens
agggagcacaacccccagctccc

SEQ ID NO: 5210350 - DNA, 17 bp, Homo sapiens
agggagcaccctgccca

SEQ ID NO: 5210351 - DNA, 17 bp, Homo sapiens
agggagcacctgtctgg

SEQ ID NO: 5210352 - DNA, 16 bp, Homo sapiens
agggagcactggaggc

SEQ ID NO: 5210353 - DNA, 19 bp, Homo sapiens
agggagcactggaggcctc

SEQ ID NO: 5210354 - DNA, 15 bp, Homo sapiens
agggagcactgttca

SEQ ID NO: 5210355 - DNA, 17 bp, Homo sapiens
agggagcagacaggagg

SEQ ID NO: 5210356 - DNA, 23 bp, Homo sapiens
agggagcagagaaggccaggggc

SEQ ID NO: 5210357 - DNA, 16 bp, Homo sapiens
agggagcagggaaggc

SEQ ID NO: 5210358 - DNA, 17 bp, Homo sapiens
agggagcatagaaggca

SEQ ID NO: 5210359 - DNA, 21 bp, Homo sapiens
agggagcatagaaggcaggtg

SEQ ID NO: 5210360 - DNA, 18 bp, Homo sapiens
agggagcattgcagccta

SEQ ID NO: 5210361 - DNA, 16 bp, Homo sapiens
agggagccaagggatg

SEQ ID NO: 5210362 - DNA, 17 bp, Homo sapiens
agggagccacaggctct

SEQ ID NO: 5210363 - DNA, 18 bp, Homo sapiens
agggagccatcccttccc

SEQ ID NO: 5210364 - DNA, 16 bp, Homo sapiens
agggagccatgctctt

SEQ ID NO: 5210365 - DNA, 21 bp, Homo sapiens
agggagccatggaaggtgcca

SEQ ID NO: 5210366 - DNA, 23 bp, Homo sapiens
agggagccatggaaggtgccaga

SEQ ID NO: 5210367 - DNA, 16 bp, Homo sapiens
agggagccctgagcct

SEQ ID NO: 5210368 - DNA, 19 bp, Homo sapiens
agggagccctgggccaggg

SEQ ID NO: 5210369 - DNA, 23 bp, Homo sapiens
agggagccctgggccagggcgtg

SEQ ID NO: 5210370 - DNA, 18 bp, Homo sapiens
agggagccggcggcctct

SEQ ID NO: 5210371 - DNA, 19 bp, Homo sapiens
agggagccggcggcctctc

SEQ ID NO: 5210372 - DNA, 20 bp, Homo sapiens
agggagccggtttgggagag

SEQ ID NO: 5210373 - DNA, 10 bp, Homo sapiens
agggagcctc

SEQ ID NO: 5210374 - DNA, 11 bp, Homo sapiens
agggagcctcc

SEQ ID NO: 5210375 - DNA, 13 bp, Homo sapiens
agggagcctcctg

SEQ ID NO: 5210376 - DNA, 14 bp, Homo sapiens
agggagcctcctgc

SEQ ID NO: 5210377 - DNA, 17 bp, Homo sapiens
agggagcctcctgccca

SEQ ID NO: 5210378 - DNA, 14 bp, Homo sapiens
agggagcctggccc

SEQ ID NO: 5210379 - DNA, 19 bp, Homo sapiens
agggagcgaggtcagagga

SEQ ID NO: 5210380 - DNA, 18 bp, Homo sapiens
agggagcgatccagggga

SEQ ID NO: 5210381 - DNA, 20 bp, Homo sapiens
agggagcgatccaggggaag

SEQ ID NO: 5210382 - DNA, 17 bp, Homo sapiens
agggagcggaaagcagc

SEQ ID NO: 5210383 - DNA, 17 bp, Homo sapiens
agggagcgtagaatctg

SEQ ID NO: 5210384 - DNA, 22 bp, Homo sapiens
agggagctaaattgaatacaca

SEQ ID NO: 5210385 - DNA, 23 bp, Homo sapiens
agggagctcttgacagaaagcag

SEQ ID NO: 5210386 - DNA, 15 bp, Homo sapiens
agggagctgaggcct

SEQ ID NO: 5210387 - DNA, 13 bp, Homo sapiens
agggagctgctgg

SEQ ID NO: 5210388 - DNA, 15 bp, Homo sapiens
agggagctgctggct

SEQ ID NO: 5210389 - DNA, 17 bp, Homo sapiens
agggagctgctggctga

SEQ ID NO: 5210390 - DNA, 19 bp, Homo sapiens
agggagctggctccagcct

SEQ ID NO: 5210391 - DNA, 24 bp, Homo sapiens
agggagcttattcaatatttactg

SEQ ID NO: 5210392 - DNA, 14 bp, Homo sapiens
agggagcttcctgg

SEQ ID NO: 5210393 - DNA, 21 bp, Homo sapiens
agggagcttcctggctctggg

SEQ ID NO: 5210394 - DNA, 14 bp, Homo sapiens
agggaggaagatat

SEQ ID NO: 5210395 - DNA, 16 bp, Homo sapiens
agggaggaaggccttt

SEQ ID NO: 5210396 - DNA, 19 bp, Homo sapiens
agggaggaaggcctttctt

SEQ ID NO: 5210397 - DNA, 21 bp, Homo sapiens
agggaggaaggcctttcttct

SEQ ID NO: 5210398 - DNA, 22 bp, Homo sapiens
agggaggaatcgaggaaccaga

SEQ ID NO: 5210399 - DNA, 23 bp, Homo sapiens
agggaggacccacactgctacac

SEQ ID NO: 5210400 - DNA, 14 bp, Homo sapiens
agggaggacctggg

SEQ ID NO: 5210401 - DNA, 17 bp, Homo sapiens
agggaggacctggggca

SEQ ID NO: 5210402 - DNA, 20 bp, Homo sapiens
agggaggacctggggcacag

SEQ ID NO: 5210403 - DNA, 12 bp, Homo sapiens
agggaggaggag

SEQ ID NO: 5210404 - DNA, 21 bp, Homo sapiens
agggaggaggccacctctcca

SEQ ID NO: 5210405 - DNA, 14 bp, Homo sapiens
agggaggatgccac

SEQ ID NO: 5210406 - DNA, 13 bp, Homo sapiens
agggaggcaagcc

SEQ ID NO: 5210407 - DNA, 15 bp, Homo sapiens
agggaggcaagccct

SEQ ID NO: 5210408 - DNA, 16 bp, Homo sapiens
agggaggcaagccctg

SEQ ID NO: 5210409 - DNA, 16 bp, Homo sapiens
agggaggcagcctcca

SEQ ID NO: 5210410 - DNA, 18 bp, Homo sapiens
agggaggcagcgtgggct

SEQ ID NO: 5210411 - DNA, 23 bp, Homo sapiens
agggaggcagcgtgggctctgcc

SEQ ID NO: 5210412 - DNA, 15 bp, Homo sapiens
agggaggcagtggct

SEQ ID NO: 5210413 - DNA, 12 bp, Homo sapiens
agggaggccaca

SEQ ID NO: 5210414 - DNA, 22 bp, Homo sapiens
agggaggccacgtcccacccca

SEQ ID NO: 5210415 - DNA, 14 bp, Homo sapiens
agggaggcccagcg

SEQ ID NO: 5210416 - DNA, 15 bp, Homo sapiens
agggaggcccatgtg

SEQ ID NO: 5210417 - DNA, 11 bp, Homo sapiens
agggaggcccc

SEQ ID NO: 5210418 - DNA, 23 bp, Homo sapiens
agggaggccgaagctaacaggga

SEQ ID NO: 5210419 - DNA, 12 bp, Homo sapiens
agggaggcgcag

SEQ ID NO: 5210420 - DNA, 17 bp, Homo sapiens
agggaggcgcagggaca

SEQ ID NO: 5210421 - DNA, 14 bp, Homo sapiens
agggaggcggggag

SEQ ID NO: 5210422 - DNA, 20 bp, Homo sapiens
agggaggcgggggctgccct

SEQ ID NO: 5210423 - DNA, 14 bp, Homo sapiens
agggaggctcccgg

SEQ ID NO: 5210424 - DNA, 17 bp, Homo sapiens
agggaggcttcctgact

SEQ ID NO: 5210425 - DNA, 17 bp, Homo sapiens
agggagggaaggggatg

SEQ ID NO: 5210426 - DNA, 15 bp, Homo sapiens
agggagggactggga

SEQ ID NO: 5210427 - DNA, 13 bp, Homo sapiens
agggagggagcaa

SEQ ID NO: 5210428 - DNA, 14 bp, Homo sapiens
agggagggagcaag

SEQ ID NO: 5210429 - DNA, 17 bp, Homo sapiens
agggagggagggctcca

SEQ ID NO: 5210430 - DNA, 20 bp, Homo sapiens
agggagggcagagctggtgc

SEQ ID NO: 5210431 - DNA, 18 bp, Homo sapiens
agggagggccagggaggc

SEQ ID NO: 5210432 - DNA, 13 bp, Homo sapiens
agggagggcctgg

SEQ ID NO: 5210433 - DNA, 15 bp, Homo sapiens
agggagggctccaga

SEQ ID NO: 5210434 - DNA, 17 bp, Homo sapiens
agggagggctccagaca

SEQ ID NO: 5210435 - DNA, 13 bp, Homo sapiens
agggagggctctg

SEQ ID NO: 5210436 - DNA, 16 bp, Homo sapiens
agggagggctctgagg

SEQ ID NO: 5210437 - DNA, 18 bp, Homo sapiens
agggagggctctgaggcg

SEQ ID NO: 5210438 - DNA, 17 bp, Homo sapiens
agggagggctgacccag

SEQ ID NO: 5210439 - DNA, 15 bp, Homo sapiens
agggagggctgtcat

SEQ ID NO: 5210440 - DNA, 15 bp, Homo sapiens
agggagggcttctgc

SEQ ID NO: 5210441 - DNA, 21 bp, Homo sapiens
agggaggggaaaagcattttt

SEQ ID NO: 5210442 - DNA, 17 bp, Homo sapiens
agggaggggaaatgtaa

SEQ ID NO: 5210443 - DNA, 11 bp, Homo sapiens
agggaggggag

SEQ ID NO: 5210444 - DNA, 14 bp, Homo sapiens
agggaggggagggg

SEQ ID NO: 5210445 - DNA, 19 bp, Homo sapiens
agggaggggccggccctgt

SEQ ID NO: 5210446 - DNA, 13 bp, Homo sapiens
agggaggggctga

SEQ ID NO: 5210447 - DNA, 23 bp, Homo sapiens
agggaggggctgagtctggctag

SEQ ID NO: 5210448 - DNA, 23 bp, Homo sapiens
agggagggggaagtcgaaggatg

SEQ ID NO: 5210449 - DNA, 20 bp, Homo sapiens
agggagggggcgctcaggac

SEQ ID NO: 5210450 - DNA, 23 bp, Homo sapiens
agggagggggcgctcaggaccca

SEQ ID NO: 5210451 - DNA, 15 bp, Homo sapiens
agggagggggctggg

SEQ ID NO: 5210452 - DNA, 23 bp, Homo sapiens
agggagggggctgggaaagaact

SEQ ID NO: 5210453 - DNA, 20 bp, Homo sapiens
agggaggggtcctgatttca

SEQ ID NO: 5210454 - DNA, 16 bp, Homo sapiens
agggagggtcagtgcc

SEQ ID NO: 5210455 - DNA, 14 bp, Homo sapiens
agggagggtgcagc

SEQ ID NO: 5210456 - DNA, 18 bp, Homo sapiens
agggagggtgcagccctc

SEQ ID NO: 5210457 - DNA, 19 bp, Homo sapiens
agggagggtggcagagaca

SEQ ID NO: 5210458 - DNA, 16 bp, Homo sapiens
agggagggtttctctc

SEQ ID NO: 5210459 - DNA, 17 bp, Homo sapiens
agggagggtttctctcc

SEQ ID NO: 5210460 - DNA, 20 bp, Homo sapiens
agggaggtcaagttgtttgt

SEQ ID NO: 5210461 - DNA, 20 bp, Homo sapiens
agggaggtcactggaaaggg

SEQ ID NO: 5210462 - DNA, 16 bp, Homo sapiens
agggaggtcaggccct

SEQ ID NO: 5210463 - DNA, 22 bp, Homo sapiens
agggaggtcaggccctggaact

SEQ ID NO: 5210464 - DNA, 22 bp, Homo sapiens
agggaggtgaatactcttgaaa

SEQ ID NO: 5210465 - DNA, 22 bp, Homo sapiens
agggaggtggaaggaccctgtg

SEQ ID NO: 5210466 - DNA, 14 bp, Homo sapiens
agggaggtggcagg

SEQ ID NO: 5210467 - DNA, 22 bp, Homo sapiens
agggaggtgtttaaagagaggt

SEQ ID NO: 5210468 - DNA, 18 bp, Homo sapiens
agggaggtttgtgagagc

SEQ ID NO: 5210469 - DNA, 19 bp, Homo sapiens
agggagtacaaagacaggg

SEQ ID NO: 5210470 - DNA, 19 bp, Homo sapiens
agggagtacctgctgcccc

SEQ ID NO: 5210471 - DNA, 17 bp, Homo sapiens
agggagtcccagagccc

SEQ ID NO: 5210472 - DNA, 15 bp, Homo sapiens
agggagtcccctccc

SEQ ID NO: 5210473 - DNA, 20 bp, Homo sapiens
agggagtccgaaagggactt

SEQ ID NO: 5210474 - DNA, 16 bp, Homo sapiens
agggagtctcaggagg

SEQ ID NO: 5210475 - DNA, 20 bp, Homo sapiens
agggagtctcaggaggaggc

SEQ ID NO: 5210476 - DNA, 14 bp, Homo sapiens
agggagtctctctt

SEQ ID NO: 5210477 - DNA, 21 bp, Homo sapiens
agggagtctggggtgggaggg

SEQ ID NO: 5210478 - DNA, 15 bp, Homo sapiens
agggagtgaagccac

SEQ ID NO: 5210479 - DNA, 17 bp, Homo sapiens
agggagtgacagaggca

SEQ ID NO: 5210480 - DNA, 20 bp, Homo sapiens
agggagtgacagaggcagcc

SEQ ID NO: 5210481 - DNA, 15 bp, Homo sapiens
agggagtgagcagct

SEQ ID NO: 5210482 - DNA, 19 bp, Homo sapiens
agggagtgaggggctgtga

SEQ ID NO: 5210483 - DNA, 22 bp, Homo sapiens
agggagtgatgatttgggggag

SEQ ID NO: 5210484 - DNA, 15 bp, Homo sapiens
agggagtgctggctc

SEQ ID NO: 5210485 - DNA, 18 bp, Homo sapiens
agggagtgctggctcaca

SEQ ID NO: 5210486 - DNA, 24 bp, Homo sapiens
agggagtgctggctcacagtacag

SEQ ID NO: 5210487 - DNA, 18 bp, Homo sapiens
agggagtggggaggagag

SEQ ID NO: 5210488 - DNA, 23 bp, Homo sapiens
agggagtggggctggggaaaggg

SEQ ID NO: 5210489 - DNA, 17 bp, Homo sapiens
agggagtgtactcccag

SEQ ID NO: 5210490 - DNA, 19 bp, Homo sapiens
agggagtgtttgtgtctga

SEQ ID NO: 5210491 - DNA, 20 bp, Homo sapiens
agggagttgctcactcagga

SEQ ID NO: 5210492 - DNA, 23 bp, Homo sapiens
agggagttgctcactcaggactt

SEQ ID NO: 5210493 - DNA, 12 bp, Homo sapiens
agggagttggct

SEQ ID NO: 5210494 - DNA, 19 bp, Homo sapiens
agggagttttaaagaaatt

SEQ ID NO: 5210495 - DNA, 20 bp, Homo sapiens
agggagttttaaagaaattt

SEQ ID NO: 5210496 - DNA, 21 bp, Homo sapiens
agggagttttgtctgtctccc

SEQ ID NO: 5210497 - DNA, 20 bp, Homo sapiens
agggataaagaaaaaaatac

SEQ ID NO: 5210498 - DNA, 16 bp, Homo sapiens
agggatacaagagagg

SEQ ID NO: 5210499 - DNA, 16 bp, Homo sapiens
agggatacatgctctt

SEQ ID NO: 5210500 - DNA, 16 bp, Homo sapiens
agggatagaggggggc

SEQ ID NO: 5210501 - DNA, 22 bp, Homo sapiens
aggagttttgttccagaggagc

SEQ ID NO: 5210502 - DNA, 16 bp, Homo sapiens
aggataaaaaggaagg

SEQ ID NO: 5210503 - DNA, 18 bp, Homo sapiens
aggataaaaaggaaggag

SEQ ID NO: 5210504 - DNA, 19 bp, Homo sapiens
aggataaaaaggaaggaga

SEQ ID NO: 5210505 - DNA, 12 bp, Homo sapiens
aggataaaataa

SEQ ID NO: 5210506 - DNA, 19 bp, Homo sapiens
aggataaaataatgctttg

SEQ ID NO: 5210507 - DNA, 21 bp, Homo sapiens
aggataaataataaaggttct

SEQ ID NO: 5210508 - DNA, 22 bp, Homo sapiens
aggataaataataaaggttcta

SEQ ID NO: 5210509 - DNA, 15 bp, Homo sapiens
aggataaattacatt

SEQ ID NO: 5210510 - DNA, 22 bp, Homo sapiens
aggataaattgccataatatga

SEQ ID NO: 5210511 - DNA, 13 bp, Homo sapiens
aggataactctgt

SEQ ID NO: 5210512 - DNA, 22 bp, Homo sapiens
aggataactgatggcaatatta

SEQ ID NO: 5210513 - DNA, 22 bp, Homo sapiens
aggataacttccttgcccctgc

SEQ ID NO: 5210514 - DNA, 19 bp, Homo sapiens
aggataacttgctttcttc

SEQ ID NO: 5210515 - DNA, 16 bp, Homo sapiens
aggataactttttaaa

SEQ ID NO: 5210516 - DNA, 22 bp, Homo sapiens
aggataagaaagcctaaaattg

SEQ ID NO: 5210517 - DNA, 14 bp, Homo sapiens
aggataagaaataa

SEQ ID NO: 5210518 - DNA, 16 bp, Homo sapiens
aggataaggagactga

SEQ ID NO: 5210519 - DNA, 21 bp, Homo sapiens
aggataatggtgaacatttta

SEQ ID NO: 5210520 - DNA, 21 bp, Homo sapiens
aggatacaaaagcatgtgaga

SEQ ID NO: 5210521 - DNA, 14 bp, Homo sapiens
aggatacatgtgcc

SEQ ID NO: 5210522 - DNA, 13 bp, Homo sapiens
aggatacatttaa

SEQ ID NO: 5210523 - DNA, 14 bp, Homo sapiens
aggatacatttaat

SEQ ID NO: 5210524 - DNA, 16 bp, Homo sapiens
aggatacatttaataa

SEQ ID NO: 5210525 - DNA, 15 bp, Homo sapiens
aggataccatataca

SEQ ID NO: 5210526 - DNA, 16 bp, Homo sapiens
aggataccccaaagtc

SEQ ID NO: 5210527 - DNA, 17 bp, Homo sapiens
aggatactcaaagtgga

SEQ ID NO: 5210528 - DNA, 18 bp, Homo sapiens
aggatactcaaagtggaa

SEQ ID NO: 5210529 - DNA, 15 bp, Homo sapiens
aggatactgcctccc

SEQ ID NO: 5210530 - DNA, 15 bp, Homo sapiens
aggatactggacgct

SEQ ID NO: 5210531 - DNA, 18 bp, Homo sapiens
aggatactggcacagagg

SEQ ID NO: 5210532 - DNA, 14 bp, Homo sapiens
aggatacttaacaa

SEQ ID NO: 5210533 - DNA, 20 bp, Homo sapiens
aggatacttaacaaatacat

SEQ ID NO: 5210534 - DNA, 14 bp, Homo sapiens
aggatagaaaaagg

SEQ ID NO: 5210535 - DNA, 14 bp, Homo sapiens
aggatagagactgg

SEQ ID NO: 5210536 - DNA, 15 bp, Homo sapiens
aggatagagacttgc

SEQ ID NO: 5210537 - DNA, 15 bp, Homo sapiens
aggatagatgctggc

SEQ ID NO: 5210538 - DNA, 21 bp, Homo sapiens
aggatagatgctggcccaggg

SEQ ID NO: 5210539 - DNA, 14 bp, Homo sapiens
aggatagcctcagc

SEQ ID NO: 5210540 - DNA, 18 bp, Homo sapiens
aggatagcctcagccaca

SEQ ID NO: 5210541 - DNA, 20 bp, Homo sapiens
aggatagctaactgtaaatc

SEQ ID NO: 5210542 - DNA, 23 bp, Homo sapiens
aggatagctaactgtaaatcatg

SEQ ID NO: 5210543 - DNA, 17 bp, Homo sapiens
aggatagctatatttta

SEQ ID NO: 5210544 - DNA, 14 bp, Homo sapiens
aggatagtattttt

SEQ ID NO: 5210545 - DNA, 14 bp, Homo sapiens
aggatataaaagga

SEQ ID NO: 5210546 - DNA, 13 bp, Homo sapiens
aggatatatttta

SEQ ID NO: 5210547 - DNA, 14 bp, Homo sapiens
aggatatattttca

SEQ ID NO: 5210548 - DNA, 15 bp, Homo sapiens
aggatatccccaggg

SEQ ID NO: 5210549 - DNA, 19 bp, Homo sapiens
aggatatccttatcagagc

SEQ ID NO: 5210550 - DNA, 23 bp, Homo sapiens
aggatatccttatcagagctaag

SEQ ID NO: 5210551 - DNA, 23 bp, Homo sapiens
aggatatgaaactctacatttaa

SEQ ID NO: 5210552 - DNA, 13 bp, Homo sapiens
aggatatgattaa

SEQ ID NO: 5210553 - DNA, 20 bp, Homo sapiens
aggatatgccctcctggtga

SEQ ID NO: 5210554 - DNA, 14 bp, Homo sapiens
aggatatgcctgct

SEQ ID NO: 5210555 - DNA, 13 bp, Homo sapiens
aggatatgcttta

SEQ ID NO: 5210556 - DNA, 18 bp, Homo sapiens
aggatatggacactggtg

SEQ ID NO: 5210557 - DNA, 15 bp, Homo sapiens
aggatatggcaggga

SEQ ID NO: 5210558 - DNA, 17 bp, Homo sapiens
aggatattaaaatgcta

SEQ ID NO: 5210559 - DNA, 16 bp, Homo sapiens
aggatattaaacgtgt

SEQ ID NO: 5210560 - DNA, 20 bp, Homo sapiens
aggatattaaacgtgtaaat

SEQ ID NO: 5210561 - DNA, 21 bp, Homo sapiens
aggatattaaacgtgtaaatt

SEQ ID NO: 5210562 - DNA, 22 bp, Homo sapiens
aggatattacaatggccagccc

SEQ ID NO: 5210563 - DNA, 21 bp, Homo sapiens
aggatattagttaatgagcca

SEQ ID NO: 5210564 - DNA, 23 bp, Homo sapiens
aggatattatctacctgttctgt

SEQ ID NO: 5210565 - DNA, 19 bp, Homo sapiens
aggatattcagatgtatgt

SEQ ID NO: 5210566 - DNA, 20 bp, Homo sapiens
aggatattccaaaataaaag

SEQ ID NO: 5210567 - DNA, 15 bp, Homo sapiens
aggatattcttctct

SEQ ID NO: 5210568 - DNA, 19 bp, Homo sapiens
aggatattgatttaaaatt

SEQ ID NO: 5210569 - DNA, 20 bp, Homo sapiens
aggatattgctaattgtgta

SEQ ID NO: 5210570 - DNA, 14 bp, Homo sapiens
aggatattggcatt

SEQ ID NO: 5210571 - DNA, 17 bp, Homo sapiens
aggatattggttcttcc

SEQ ID NO: 5210572 - DNA, 17 bp, Homo sapiens
aggatatttaagaaaat

SEQ ID NO: 5210573 - DNA, 14 bp, Homo sapiens
aggatatttcaaat

SEQ ID NO: 5210574 - DNA, 18 bp, Homo sapiens
aggatatttcaaatgatt

SEQ ID NO: 5210575 - DNA, 11 bp, Homo sapiens
aggatatttga

SEQ ID NO: 5210576 - DNA, 20 bp, Homo sapiens
aggatattttcaacaattag

SEQ ID NO: 5210577 - DNA, 22 bp, Homo sapiens
aggatattttggggggcagaga

SEQ ID NO: 5210578 - DNA, 19 bp, Homo sapiens
aggatattttgtcaccaga

SEQ ID NO: 5210579 - DNA, 15 bp, Homo sapiens
aggatcaagaaagtg

SEQ ID NO: 5210580 - DNA, 16 bp, Homo sapiens
aggatcacagattttt

SEQ ID NO: 5210581 - DNA, 14 bp, Homo sapiens
aggatcaccccagc

SEQ ID NO: 5210582 - DNA, 18 bp, Homo sapiens
aggatcaccccagccccc

SEQ ID NO: 5210583 - DNA, 20 bp, Homo sapiens
aggatcaccccagcccccac

SEQ ID NO: 5210584 - DNA, 22 bp, Homo sapiens
aggatcactctctgctggcagg

SEQ ID NO: 5210585 - DNA, 18 bp, Homo sapiens
aggatcacttaagcccag

SEQ ID NO: 5210586 - DNA, 12 bp, Homo sapiens
aggatcacttga

SEQ ID NO: 5210587 - DNA, 18 bp, Homo sapiens
aggatcacttgagcccag

SEQ ID NO: 5210588 - DNA, 13 bp, Homo sapiens
aggatcagaaagt

SEQ ID NO: 5210589 - DNA, 13 bp, Homo sapiens
aggatcagatgac

SEQ ID NO: 5210590 - DNA, 20 bp, Homo sapiens
aggatcagatgactctctcc

SEQ ID NO: 5210591 - DNA, 17 bp, Homo sapiens
aggatcagattcttgct

SEQ ID NO: 5210592 - DNA, 18 bp, Homo sapiens
aggatcagattcttgctg

SEQ ID NO: 5210593 - DNA, 20 bp, Homo sapiens
aggatcagattcttgctgtg

SEQ ID NO: 5210594 - DNA, 13 bp, Homo sapiens
aggatcagccagg

SEQ ID NO: 5210595 - DNA, 14 bp, Homo sapiens
aggatcaggctgct

SEQ ID NO: 5210596 - DNA, 16 bp, Homo sapiens
aggatcaggctgctgg

SEQ ID NO: 5210597 - DNA, 15 bp, Homo sapiens
aggatcagggctcct

SEQ ID NO: 5210598 - DNA, 13 bp, Homo sapiens
aggatcagtctga

SEQ ID NO: 5210599 - DNA, 23 bp, Homo sapiens
aggatcagttaactattgcattt

SEQ ID NO: 5210600 - DNA, 23 bp, Homo sapiens
aggatcatcatttaaaaaaaaag

SEQ ID NO: 5210601 - DNA, 18 bp, Homo sapiens
aggatcatggtgtaataa

SEQ ID NO: 5210602 - DNA, 20 bp, Homo sapiens
aggatcatttgttggaatga

SEQ ID NO: 5210603 - DNA, 15 bp, Homo sapiens
aggatccagagagca

SEQ ID NO: 5210604 - DNA, 21 bp, Homo sapiens
aggatccagagagcagctccc

SEQ ID NO: 5210605 - DNA, 19 bp, Homo sapiens
aggatccagatagcctagg

SEQ ID NO: 5210606 - DNA, 24 bp, Homo sapiens
aggatccagggcagcaggccagag

SEQ ID NO: 5210607 - DNA, 13 bp, Homo sapiens
aggatccagtgac

SEQ ID NO: 5210608 - DNA, 17 bp, Homo sapiens
aggatccagtgacatga

SEQ ID NO: 5210609 - DNA, 22 bp, Homo sapiens
aggatccagtgacatgattctg

SEQ ID NO: 5210610 - DNA, 19 bp, Homo sapiens
aggatcccatgagctcctt

SEQ ID NO: 5210611 - DNA, 14 bp, Homo sapiens
aggatcccccttct

SEQ ID NO: 5210612 - DNA, 18 bp, Homo sapiens
aggatcccctccaagcct

SEQ ID NO: 5210613 - DNA, 16 bp, Homo sapiens
aggatcccctgtcccc

SEQ ID NO: 5210614 - DNA, 20 bp, Homo sapiens
aggatcccctgtcccctggg

SEQ ID NO: 5210615 - DNA, 18 bp, Homo sapiens
aggatccctcccagatcc

SEQ ID NO: 5210616 - DNA, 16 bp, Homo sapiens
aggatccctctctgga

SEQ ID NO: 5210617 - DNA, 19 bp, Homo sapiens
aggatccctctctggattg

SEQ ID NO: 5210618 - DNA, 17 bp, Homo sapiens
aggatccgctgccacca

SEQ ID NO: 5210619 - DNA, 21 bp, Homo sapiens
aggatcctattctcaccagga

SEQ ID NO: 5210620 - DNA, 22 bp, Homo sapiens
aggatcctattctcaccaggaa

SEQ ID NO: 5210621 - DNA, 13 bp, Homo sapiens
aggatcctcctgg

SEQ ID NO: 5210622 - DNA, 18 bp, Homo sapiens
aggatcctcctggagcag

SEQ ID NO: 5210623 - DNA, 14 bp, Homo sapiens
aggatcctctccac

SEQ ID NO: 5210624 - DNA, 16 bp, Homo sapiens
aggatcctgagccaga

SEQ ID NO: 5210625 - DNA, 19 bp, Homo sapiens
aggatcctgagctgctgtt

SEQ ID NO: 5210626 - DNA, 14 bp, Homo sapiens
aggatcctggaggc

SEQ ID NO: 5210627 - DNA, 17 bp, Homo sapiens
aggatcctggcctgaga

SEQ ID NO: 5210628 - DNA, 15 bp, Homo sapiens
aggatccttccctgt

SEQ ID NO: 5210629 - DNA, 18 bp, Homo sapiens
aggatccttttcctaatt

SEQ ID NO: 5210630 - DNA, 23 bp, Homo sapiens
aggatcgaagggtttttagagaa

SEQ ID NO: 5210631 - DNA, 12 bp, Homo sapiens
aggatcgaggca

SEQ ID NO: 5210632 - DNA, 15 bp, Homo sapiens
aggatcgaggcatgg

SEQ ID NO: 5210633 - DNA, 17 bp, Homo sapiens
aggatcggactctgccc

SEQ ID NO: 5210634 - DNA, 19 bp, Homo sapiens
aggatcggactctgcccct

SEQ ID NO: 5210635 - DNA, 20 bp, Homo sapiens
aggatcggactctgcccctg

SEQ ID NO: 5210636 - DNA, 15 bp, Homo sapiens
aggatcggcttcctc

SEQ ID NO: 5210637 - DNA, 18 bp, Homo sapiens
aggatcggcttcctcagg

SEQ ID NO: 5210638 - DNA, 15 bp, Homo sapiens
aggatctaagggaag

SEQ ID NO: 5210639 - DNA, 22 bp, Homo sapiens
aggatctaggatgggagagcta

SEQ ID NO: 5210640 - DNA, 22 bp, Homo sapiens
aggatctatgcaatttttaaac

SEQ ID NO: 5210641 - DNA, 18 bp, Homo sapiens
aggatctatttttggagg

SEQ ID NO: 5210642 - DNA, 20 bp, Homo sapiens
aggatctatttttggaggtt

SEQ ID NO: 5210643 - DNA, 14 bp, Homo sapiens
aggatctcaagcca

SEQ ID NO: 5210644 - DNA, 16 bp, Homo sapiens
aggatctcaagccagc

SEQ ID NO: 5210645 - DNA, 20 bp, Homo sapiens
aggatctccactggaccctt

SEQ ID NO: 5210646 - DNA, 22 bp, Homo sapiens
aggatctcctgccagcccagct

SEQ ID NO: 5210647 - DNA, 23 bp, Homo sapiens
aggatctcctgccagcccagctg

SEQ ID NO: 5210648 - DNA, 21 bp, Homo sapiens
aggatctcctgtttttttcag

SEQ ID NO: 5210649 - DNA, 21 bp, Homo sapiens
aggatctcgcctggaaacaga

SEQ ID NO: 5210650 - DNA, 22 bp, Homo sapiens
aggatctcgcctggaaacagag

SEQ ID NO: 5210651 - DNA, 19 bp, Homo sapiens
aggatctctaaagagcatc

SEQ ID NO: 5210652 - DNA, 14 bp, Homo sapiens
aggatctctcagga

SEQ ID NO: 5210653 - DNA, 22 bp, Homo sapiens
aggatctctcaggagcacaggc

SEQ ID NO: 5210654 - DNA, 23 bp, Homo sapiens
aggatctctgagaccacagaggc

SEQ ID NO: 5210655 - DNA, 14 bp, Homo sapiens
aggatctgcccaca

SEQ ID NO: 5210656 - DNA, 22 bp, Homo sapiens
aggatctgcccacacctcggcc

SEQ ID NO: 5210657 - DNA, 12 bp, Homo sapiens
aggatctgctga

SEQ ID NO: 5210658 - DNA, 16 bp, Homo sapiens
aggatctgctgaggcc

SEQ ID NO: 5210659 - DNA, 14 bp, Homo sapiens
aggatctggagaac

SEQ ID NO: 5210660 - DNA, 22 bp, Homo sapiens
aggatctgtctgtgcacatgcc

SEQ ID NO: 5210661 - DNA, 17 bp, Homo sapiens
aggatctgtgattggct

SEQ ID NO: 5210662 - DNA, 18 bp, Homo sapiens
aggatctgtgattggctg

SEQ ID NO: 5210663 - DNA, 23 bp, Homo sapiens
aggatctttcacccacagaaaga

SEQ ID NO: 5210664 - DNA, 15 bp, Homo sapiens
aggatctttgtggcc

SEQ ID NO: 5210665 - DNA, 16 bp, Homo sapiens
aggatctttgtggcca

SEQ ID NO: 5210666 - DNA, 17 bp, Homo sapiens
aggatctttgtggccaa

SEQ ID NO: 5210667 - DNA, 15 bp, Homo sapiens
aggatcttttgtaaa

SEQ ID NO: 5210668 - DNA, 16 bp, Homo sapiens
aggatcttttgtaaat

SEQ ID NO: 5210669 - DNA, 13 bp, Homo sapiens
aggatgaaagaca

SEQ ID NO: 5210670 - DNA, 22 bp, Homo sapiens
aggatgaaagacaaagaaggaa

SEQ ID NO: 5210671 - DNA, 16 bp, Homo sapiens
aggatgaacaatgtat

SEQ ID NO: 5210672 - DNA, 22 bp, Homo sapiens
aggatgaacatcttttaactgc

SEQ ID NO: 5210673 - DNA, 21 bp, Homo sapiens
aggatgaagaacacagcatgt

SEQ ID NO: 5210674 - DNA, 12 bp, Homo sapiens
aggatgaaggaa

SEQ ID NO: 5210675 - DNA, 15 bp, Homo sapiens
aggatgaaggaaggg

SEQ ID NO: 5210676 - DNA, 18 bp, Homo sapiens
aggatgaaggctgtgaaa

SEQ ID NO: 5210677 - DNA, 22 bp, Homo sapiens
aggatgaaggggccagaccacg

SEQ ID NO: 5210678 - DNA, 17 bp, Homo sapiens
aggatgaatgggaaagt

SEQ ID NO: 5210679 - DNA, 17 bp, Homo sapiens
agggatagcactgagca

SEQ ID NO: 5210680 - DNA, 21 bp, Homo sapiens
agggataggaagtgccccagg

SEQ ID NO: 5210681 - DNA, 19 bp, Homo sapiens
agggatagtactaagcatt

SEQ ID NO: 5210682 - DNA, 19 bp, Homo sapiens
agggatagtcaccttttaa

SEQ ID NO: 5210683 - DNA, 23 bp, Homo sapiens
agggatataaaaacagattctga

SEQ ID NO: 5210684 - DNA, 14 bp, Homo sapiens
agggatataaaatg

SEQ ID NO: 5210685 - DNA, 18 bp, Homo sapiens
agggatatataagatgga

SEQ ID NO: 5210686 - DNA, 21 bp, Homo sapiens
agggatatctactgtggtctg

SEQ ID NO: 5210687 - DNA, 15 bp, Homo sapiens
agggatatggcagga

SEQ ID NO: 5210688 - DNA, 16 bp, Homo sapiens
agggatattttttagt

SEQ ID NO: 5210689 - DNA, 20 bp, Homo sapiens
agggatattttttagtttgt

SEQ ID NO: 5210690 - DNA, 16 bp, Homo sapiens
agggatcacagaccac

SEQ ID NO: 5210691 - DNA, 19 bp, Homo sapiens
agggatcacagaccacagg

SEQ ID NO: 5210692 - DNA, 17 bp, Homo sapiens
agggatcacagggcccc

SEQ ID NO: 5210693 - DNA, 22 bp, Homo sapiens
agggatcacagggccccagaag

SEQ ID NO: 5210694 - DNA, 17 bp, Homo sapiens
agggatccacttctctg

SEQ ID NO: 5210695 - DNA, 20 bp, Homo sapiens
agggatccccaggaggcctg

SEQ ID NO: 5210696 - DNA, 15 bp, Homo sapiens
agggatccctcatct

SEQ ID NO: 5210697 - DNA, 16 bp, Homo sapiens
agggatccctcatctg

SEQ ID NO: 5210698 - DNA, 22 bp, Homo sapiens
agggatccctcatctgtccctc

SEQ ID NO: 5210699 - DNA, 21 bp, Homo sapiens
agggatcctaatcccttcctc

SEQ ID NO: 5210700 - DNA, 19 bp, Homo sapiens
agggatctctagtttttgt

SEQ ID NO: 5210701 - DNA, 19 bp, Homo sapiens
agggatctctctacaagag

SEQ ID NO: 5210702 - DNA, 14 bp, Homo sapiens
agggatctgaaatc

SEQ ID NO: 5210703 - DNA, 20 bp, Homo sapiens
agggatctgagtaggtctgg

SEQ ID NO: 5210704 - DNA, 13 bp, Homo sapiens
agggatctgctta

SEQ ID NO: 5210705 - DNA, 16 bp, Homo sapiens
agggatctgcttaaag

SEQ ID NO: 5210706 - DNA, 17 bp, Homo sapiens
agggatctggggaagga

SEQ ID NO: 5210707 - DNA, 22 bp, Homo sapiens
agggatctggtcctacccatcc

SEQ ID NO: 5210708 - DNA, 16 bp, Homo sapiens
agggatcttctccctc

SEQ ID NO: 5210709 - DNA, 22 bp, Homo sapiens
agggatcttgcattcccagtgg

SEQ ID NO: 5210710 - DNA, 13 bp, Homo sapiens
agggatgaccttc

SEQ ID NO: 5210711 - DNA, 12 bp, Homo sapiens
agggatgagcca

SEQ ID NO: 5210712 - DNA, 14 bp, Homo sapiens
agggatgatgaggg

SEQ ID NO: 5210713 - DNA, 18 bp, Homo sapiens
agggatgatggcagagcc

SEQ ID NO: 5210714 - DNA, 22 bp, Homo sapiens
agggatgatggcagagccaggc

SEQ ID NO: 5210715 - DNA, 23 bp, Homo sapiens
agggatgattaaaggcagcattt

SEQ ID NO: 5210716 - DNA, 19 bp, Homo sapiens
agggatgattcaagccatt

SEQ ID NO: 5210717 - DNA, 18 bp, Homo sapiens
agggatgcaggctcccct

SEQ ID NO: 5210718 - DNA, 13 bp, Homo sapiens
agggatgcaggtg

SEQ ID NO: 5210719 - DNA, 15 bp, Homo sapiens
agggatgcatggaga

SEQ ID NO: 5210720 - DNA, 17 bp, Homo sapiens
agggatgcccccaggca

SEQ ID NO: 5210721 - DNA, 18 bp, Homo sapiens
agggatgcccccaggcag

SEQ ID NO: 5210722 - DNA, 14 bp, Homo sapiens
agggatgctcattc

SEQ ID NO: 5210723 - DNA, 16 bp, Homo sapiens
agggatgctgcctgag

SEQ ID NO: 5210724 - DNA, 17 bp, Homo sapiens
agggatgctgggctggg

SEQ ID NO: 5210725 - DNA, 17 bp, Homo sapiens
agggatggactgatgct

SEQ ID NO: 5210726 - DNA, 18 bp, Homo sapiens
agggatggagaaagaagt

SEQ ID NO: 5210727 - DNA, 21 bp, Homo sapiens
agggatggagaaagaagtgga

SEQ ID NO: 5210728 - DNA, 17 bp, Homo sapiens
agggatggagaggcggc

SEQ ID NO: 5210729 - DNA, 19 bp, Homo sapiens
agggatggagatgggaagg

SEQ ID NO: 5210730 - DNA, 15 bp, Homo sapiens
agggatggagggaag

SEQ ID NO: 5210731 - DNA, 20 bp, Homo sapiens
agggatggagggaagacctg

SEQ ID NO: 5210732 - DNA, 16 bp, Homo sapiens
agggatggattccaac

SEQ ID NO: 5210733 - DNA, 17 bp, Homo sapiens
agggatggattccaacc

SEQ ID NO: 5210734 - DNA, 16 bp, Homo sapiens
agggatggcagtggct

SEQ ID NO: 5210735 - DNA, 17 bp, Homo sapiens
agggatggcagtggctg

SEQ ID NO: 5210736 - DNA, 15 bp, Homo sapiens
agggatggccacaag

SEQ ID NO: 5210737 - DNA, 15 bp, Homo sapiens
agggatggccgttgg

SEQ ID NO: 5210738 - DNA, 13 bp, Homo sapiens
agggatggcgggt

SEQ ID NO: 5210739 - DNA, 24 bp, Homo sapiens
agggatgggatttcatgtaaccaa

SEQ ID NO: 5210740 - DNA, 16 bp, Homo sapiens
agggatgggcctggca

SEQ ID NO: 5210741 - DNA, 18 bp, Homo sapiens
agggatggggaaaactac

SEQ ID NO: 5210742 - DNA, 18 bp, Homo sapiens
agggatggggagcagctg

SEQ ID NO: 5210743 - DNA, 14 bp, Homo sapiens
agggatgggggaag

SEQ ID NO: 5210744 - DNA, 15 bp, Homo sapiens
agggatggtcaggcc

SEQ ID NO: 5210745 - DNA, 13 bp, Homo sapiens
agggatggtgccc

SEQ ID NO: 5210746 - DNA, 23 bp, Homo sapiens
agggatggtggagtgagagcctt

SEQ ID NO: 5210747 - DNA, 14 bp, Homo sapiens
agggatggtgttca

SEQ ID NO: 5210748 - DNA, 12 bp, Homo sapiens
agggatgtattt

SEQ ID NO: 5210749 - DNA, 15 bp, Homo sapiens
agggatgtgggtaag

SEQ ID NO: 5210750 - DNA, 19 bp, Homo sapiens
agggatgtgggtaagagga

SEQ ID NO: 5210751 - DNA, 12 bp, Homo sapiens
agggatgttcca

SEQ ID NO: 5210752 - DNA, 18 bp, Homo sapiens
agggatgttccagtggat

SEQ ID NO: 5210753 - DNA, 18 bp, Homo sapiens
agggatgttctggccctc

SEQ ID NO: 5210754 - DNA, 16 bp, Homo sapiens
agggatgttgcaaagg

SEQ ID NO: 5210755 - DNA, 18 bp, Homo sapiens
agggattaacctctgcac

SEQ ID NO: 5210756 - DNA, 14 bp, Homo sapiens
agggattcaggctg

SEQ ID NO: 5210757 - DNA, 19 bp, Homo sapiens
agggattcaggctgcttgg

SEQ ID NO: 5210758 - DNA, 16 bp, Homo sapiens
agggattctcacaata

SEQ ID NO: 5210759 - DNA, 20 bp, Homo sapiens
agggattctggttccagggt

SEQ ID NO: 5210760 - DNA, 18 bp, Homo sapiens
agggattgaagtttatta

SEQ ID NO: 5210761 - DNA, 16 bp, Homo sapiens
agggattgaggagttg

SEQ ID NO: 5210762 - DNA, 18 bp, Homo sapiens
agggattgaggagttgcc

SEQ ID NO: 5210763 - DNA, 15 bp, Homo sapiens
agggattgctgaggc

SEQ ID NO: 5210764 - DNA, 16 bp, Homo sapiens
agggattgctgaggca

SEQ ID NO: 5210765 - DNA, 14 bp, Homo sapiens
agggattgtccctg

SEQ ID NO: 5210766 - DNA, 15 bp, Homo sapiens
agggatttgcctcac

SEQ ID NO: 5210767 - DNA, 19 bp, Homo sapiens
agggattttagtcacacgt

SEQ ID NO: 5210768 - DNA, 12 bp, Homo sapiens
agggcaaaatcg

SEQ ID NO: 5210769 - DNA, 17 bp, Homo sapiens
agggcaaaccaggctgc

SEQ ID NO: 5210770 - DNA, 18 bp, Homo sapiens
agggcaaaccaggctgca

SEQ ID NO: 5210771 - DNA, 18 bp, Homo sapiens
agggcaaagccaggtccc

SEQ ID NO: 5210772 - DNA, 21 bp, Homo sapiens
agggcaaagccaggtccctct

SEQ ID NO: 5210773 - DNA, 13 bp, Homo sapiens
agggcaaagctga

SEQ ID NO: 5210774 - DNA, 18 bp, Homo sapiens
agggcaaatgacatgcac

SEQ ID NO: 5210775 - DNA, 23 bp, Homo sapiens
agggcaaatgacatgcactgacc

SEQ ID NO: 5210776 - DNA, 14 bp, Homo sapiens
agggcaaattattt

SEQ ID NO: 5210777 - DNA, 20 bp, Homo sapiens
agggcaacaataaaatagca

SEQ ID NO: 5210778 - DNA, 15 bp, Homo sapiens
agggcaactcttgga

SEQ ID NO: 5210779 - DNA, 17 bp, Homo sapiens
agggcaactcttggaag

SEQ ID NO: 5210780 - DNA, 13 bp, Homo sapiens
agggcaagaaatg

SEQ ID NO: 5210781 - DNA, 22 bp, Homo sapiens
agggcaagaacccaagtgcctc

SEQ ID NO: 5210782 - DNA, 18 bp, Homo sapiens
agggcaagaggatgaagg

SEQ ID NO: 5210783 - DNA, 15 bp, Homo sapiens
agggcaagccaccaa

SEQ ID NO: 5210784 - DNA, 12 bp, Homo sapiens
agggcaagccct

SEQ ID NO: 5210785 - DNA, 22 bp, Homo sapiens
agggcaagcctctagtgtacca

SEQ ID NO: 5210786 - DNA, 20 bp, Homo sapiens
agggcaagctccgcaggact

SEQ ID NO: 5210787 - DNA, 20 bp, Homo sapiens
agggcaaggagtttattaca

SEQ ID NO: 5210788 - DNA, 19 bp, Homo sapiens
agggcaagggtgcctcagg

SEQ ID NO: 5210789 - DNA, 19 bp, Homo sapiens
agggcaagtggatgggaat

SEQ ID NO: 5210790 - DNA, 12 bp, Homo sapiens
agggcaataaat

SEQ ID NO: 5210791 - DNA, 17 bp, Homo sapiens
agggcaatgccatcagc

SEQ ID NO: 5210792 - DNA, 17 bp, Homo sapiens
agggcacaaactgcagc

SEQ ID NO: 5210793 - DNA, 20 bp, Homo sapiens
agggcacaaactgcagctgt

SEQ ID NO: 5210794 - DNA, 14 bp, Homo sapiens
agggcacacactgt

SEQ ID NO: 5210795 - DNA, 16 bp, Homo sapiens
agggcacaccgccatc

SEQ ID NO: 5210796 - DNA, 22 bp, Homo sapiens
agggcacagaaaatggaagaca

SEQ ID NO: 5210797 - DNA, 13 bp, Homo sapiens
agggcacagaagg

SEQ ID NO: 5210798 - DNA, 14 bp, Homo sapiens
agggcacagaaggc

SEQ ID NO: 5210799 - DNA, 13 bp, Homo sapiens
agggcacagatga

SEQ ID NO: 5210800 - DNA, 19 bp, Homo sapiens
agggcacagatgaccaaag

SEQ ID NO: 5210801 - DNA, 19 bp, Homo sapiens
agggcacagccctccgacc

SEQ ID NO: 5210802 - DNA, 16 bp, Homo sapiens
agggcacagctgccct

SEQ ID NO: 5210803 - DNA, 12 bp, Homo sapiens
agggcacaggag

SEQ ID NO: 5210804 - DNA, 23 bp, Homo sapiens
agggcacaggagctacctgtgtg

SEQ ID NO: 5210805 - DNA, 14 bp, Homo sapiens
agggcacaggccat

SEQ ID NO: 5210806 - DNA, 19 bp, Homo sapiens
agggcacaggccatggatg

SEQ ID NO: 5210807 - DNA, 15 bp, Homo sapiens
agggcacagggcctg

SEQ ID NO: 5210808 - DNA, 18 bp, Homo sapiens
agggcacagggcctggcc

SEQ ID NO: 5210809 - DNA, 15 bp, Homo sapiens
agggcacatctccag

SEQ ID NO: 5210810 - DNA, 20 bp, Homo sapiens
agggcacattaactccctcc

SEQ ID NO: 5210811 - DNA, 21 bp, Homo sapiens
agggcacattccttgcctgca

SEQ ID NO: 5210812 - DNA, 14 bp, Homo sapiens
agggcaccagaggc

SEQ ID NO: 5210813 - DNA, 15 bp, Homo sapiens
agggcaccagaggcc

SEQ ID NO: 5210814 - DNA, 15 bp, Homo sapiens
agggcacccaggcag

SEQ ID NO: 5210815 - DNA, 22 bp, Homo sapiens
agggcacccccaaattcaaaga

SEQ ID NO: 5210816 - DNA, 21 bp, Homo sapiens
agggcaccctagttctacctc

SEQ ID NO: 5210817 - DNA, 16 bp, Homo sapiens
agggcaccgagaactc

SEQ ID NO: 5210818 - DNA, 19 bp, Homo sapiens
agggcacgaggctctagaa

SEQ ID NO: 5210819 - DNA, 16 bp, Homo sapiens
agggcacgcaggacca

SEQ ID NO: 5210820 - DNA, 17 bp, Homo sapiens
agggcacggggacctgg

SEQ ID NO: 5210821 - DNA, 18 bp, Homo sapiens
agggcacggggacctgga

SEQ ID NO: 5210822 - DNA, 16 bp, Homo sapiens
agggcactaaccccat

SEQ ID NO: 5210823 - DNA, 17 bp, Homo sapiens
agggcactcccaaccct

SEQ ID NO: 5210824 - DNA, 20 bp, Homo sapiens
agggcactctctgccagctc

SEQ ID NO: 5210825 - DNA, 21 bp, Homo sapiens
agggcactctctgccagctcc

SEQ ID NO: 5210826 - DNA, 22 bp, Homo sapiens
agggcactctctgccagctcca

SEQ ID NO: 5210827 - DNA, 19 bp, Homo sapiens
agggcactctgttcccctc

SEQ ID NO: 5210828 - DNA, 22 bp, Homo sapiens
agggcactctgttcccctcccc

SEQ ID NO: 5210829 - DNA, 17 bp, Homo sapiens
agggcactgccagccca

SEQ ID NO: 5210830 - DNA, 13 bp, Homo sapiens
agggcactggagc

SEQ ID NO: 5210831 - DNA, 13 bp, Homo sapiens
agggcactgggct

SEQ ID NO: 5210832 - DNA, 16 bp, Homo sapiens
agggcactgggctgtt

SEQ ID NO: 5210833 - DNA, 18 bp, Homo sapiens
agggcactgtctgcgtga

SEQ ID NO: 5210834 - DNA, 16 bp, Homo sapiens
agggcacttaatttgt

SEQ ID NO: 5210835 - DNA, 18 bp, Homo sapiens
agggcacttaatttgtaa

SEQ ID NO: 5210836 - DNA, 23 bp, Homo sapiens
agggcacttaatttgtaaacttc

SEQ ID NO: 5210837 - DNA, 13 bp, Homo sapiens
agggcacttcagg

SEQ ID NO: 5210838 - DNA, 22 bp, Homo sapiens
agggcacttcaggtccgtgggc

SEQ ID NO: 5210839 - DNA, 16 bp, Homo sapiens
agggcacttcctccac

SEQ ID NO: 5210840 - DNA, 22 bp, Homo sapiens
agggcagaacactaacctgacc

SEQ ID NO: 5210841 - DNA, 23 bp, Homo sapiens
agggcagaagagaaaccatcctc

SEQ ID NO: 5210842 - DNA, 15 bp, Homo sapiens
agggcagaatgaatc

SEQ ID NO: 5210843 - DNA, 20 bp, Homo sapiens
agggcagactggggcatcct

SEQ ID NO: 5210844 - DNA, 20 bp, Homo sapiens
agggcagagaactgtctttc

SEQ ID NO: 5210845 - DNA, 18 bp, Homo sapiens
agggcagagaatggctgg

SEQ ID NO: 5210846 - DNA, 21 bp, Homo sapiens
agggcagagaatggctgggtc

SEQ ID NO: 5210847 - DNA, 21 bp, Homo sapiens
agggcagagccatgggcctgg

SEQ ID NO: 5210848 - DNA, 23 bp, Homo sapiens
agggcagagccatgggcctgggc

SEQ ID NO: 5210849 - DNA, 13 bp, Homo sapiens
agggcagagctgg

SEQ ID NO: 5210850 - DNA, 18 bp, Homo sapiens
agggcagaggaagagaca

SEQ ID NO: 5210851 - DNA, 23 bp, Homo sapiens
agggcagaggaatgtagggcctg

SEQ ID NO: 5210852 - DNA, 22 bp, Homo sapiens
agggcagaggcaaggatggtgg

SEQ ID NO: 5210853 - DNA, 14 bp, Homo sapiens
agggcagaggctgg

SEQ ID NO: 5210854 - DNA, 22 bp, Homo sapiens
agggcagaggctggaggcaggg

SEQ ID NO: 5210855 - DNA, 16 bp, Homo sapiens
agggcagagtgggctg

SEQ ID NO: 5210856 - DNA, 22 bp, Homo sapiens
agggcagagtgggctgcctggg

SEQ ID NO: 5210857 - DNA, 18 bp, Homo sapiens
aggatgaatgtatgtgca

SEQ ID NO: 5210858 - DNA, 19 bp, Homo sapiens
aggatgaattttctgcagc

SEQ ID NO: 5210859 - DNA, 22 bp, Homo sapiens
aggatgaattttctgcagctgt

SEQ ID NO: 5210860 - DNA, 20 bp, Homo sapiens
aggatgacaggctctcctgg

SEQ ID NO: 5210861 - DNA, 18 bp, Homo sapiens
aggatgactttttttctg

SEQ ID NO: 5210862 - DNA, 19 bp, Homo sapiens
aggatgagaatgtgacctt

SEQ ID NO: 5210863 - DNA, 15 bp, Homo sapiens
aggatgagacccagc

SEQ ID NO: 5210864 - DNA, 16 bp, Homo sapiens
aggatgagacccagcc

SEQ ID NO: 5210865 - DNA, 13 bp, Homo sapiens
aggatgagagccc

SEQ ID NO: 5210866 - DNA, 15 bp, Homo sapiens
aggatgagagcccag

SEQ ID NO: 5210867 - DNA, 17 bp, Homo sapiens
aggatgagagcccagag

SEQ ID NO: 5210868 - DNA, 12 bp, Homo sapiens
aggatgagcaga

SEQ ID NO: 5210869 - DNA, 16 bp, Homo sapiens
aggatgagcagagccc

SEQ ID NO: 5210870 - DNA, 15 bp, Homo sapiens
aggatgagcagaggg

SEQ ID NO: 5210871 - DNA, 20 bp, Homo sapiens
aggatgagctctacccaggg

SEQ ID NO: 5210872 - DNA, 15 bp, Homo sapiens
aggatgagctggaag

SEQ ID NO: 5210873 - DNA, 23 bp, Homo sapiens
aggatgaggaacctcaaactggg

SEQ ID NO: 5210874 - DNA, 13 bp, Homo sapiens
aggatgaggatgt

SEQ ID NO: 5210875 - DNA, 22 bp, Homo sapiens
aggatgagggaaaagaaaaaga

SEQ ID NO: 5210876 - DNA, 22 bp, Homo sapiens
aggatgaggggttaatttatca

SEQ ID NO: 5210877 - DNA, 22 bp, Homo sapiens
aggatgagggttcatcatccct

SEQ ID NO: 5210878 - DNA, 17 bp, Homo sapiens
aggatgatctaggaaga

SEQ ID NO: 5210879 - DNA, 22 bp, Homo sapiens
aggatgatctaggaagactttg

SEQ ID NO: 5210880 - DNA, 15 bp, Homo sapiens
aggatgatggaaaaa

SEQ ID NO: 5210881 - DNA, 16 bp, Homo sapiens
aggatgatggaaaaat

SEQ ID NO: 5210882 - DNA, 19 bp, Homo sapiens
aggatgatgtaattaaaaa

SEQ ID NO: 5210883 - DNA, 15 bp, Homo sapiens
aggatgatttcagaa

SEQ ID NO: 5210884 - DNA, 21 bp, Homo sapiens
aggatgatttcagaaggagaa

SEQ ID NO: 5210885 - DNA, 16 bp, Homo sapiens
aggatgattttggcct

SEQ ID NO: 5210886 - DNA, 15 bp, Homo sapiens
aggatgcacatttct

SEQ ID NO: 5210887 - DNA, 19 bp, Homo sapiens
aggatgcacatttctggat

SEQ ID NO: 5210888 - DNA, 21 bp, Homo sapiens
aggatgcacatttctggattg

SEQ ID NO: 5210889 - DNA, 18 bp, Homo sapiens
aggatgcacggtttctgt

SEQ ID NO: 5210890 - DNA, 12 bp, Homo sapiens
aggatgcactgg

SEQ ID NO: 5210891 - DNA, 19 bp, Homo sapiens
aggatgcagagtcagcaga

SEQ ID NO: 5210892 - DNA, 23 bp, Homo sapiens
aggatgcagcgccgtgtcctctc

SEQ ID NO: 5210893 - DNA, 14 bp, Homo sapiens
aggatgcatgcagg

SEQ ID NO: 5210894 - DNA, 23 bp, Homo sapiens
aggatgcattctgataggagggg

SEQ ID NO: 5210895 - DNA, 16 bp, Homo sapiens
aggatgccacagcccc

SEQ ID NO: 5210896 - DNA, 17 bp, Homo sapiens
aggatgccacagcccca

SEQ ID NO: 5210897 - DNA, 21 bp, Homo sapiens
aggatgccacagccccacagc

SEQ ID NO: 5210898 - DNA, 20 bp, Homo sapiens
aggatgccacgcctggaagg

SEQ ID NO: 5210899 - DNA, 19 bp, Homo sapiens
aggatgccagcccctgcct

SEQ ID NO: 5210900 - DNA, 20 bp, Homo sapiens
aggatgccagcccctgcctg

SEQ ID NO: 5210901 - DNA, 23 bp, Homo sapiens
aggatgccagcccctgcctgggt

SEQ ID NO: 5210902 - DNA, 19 bp, Homo sapiens
aggatgcccaaagatgcag

SEQ ID NO: 5210903 - DNA, 14 bp, Homo sapiens
aggatgcccagggc

SEQ ID NO: 5210904 - DNA, 13 bp, Homo sapiens
aggatgcctgagc

SEQ ID NO: 5210905 - DNA, 14 bp, Homo sapiens
aggatgcctgagcc

SEQ ID NO: 5210906 - DNA, 15 bp, Homo sapiens
aggatgcctgagccc

SEQ ID NO: 5210907 - DNA, 15 bp, Homo sapiens
aggatgccttatctc

SEQ ID NO: 5210908 - DNA, 15 bp, Homo sapiens
aggatgccttttctg

SEQ ID NO: 5210909 - DNA, 21 bp, Homo sapiens
aggatgcggctttctctgcct

SEQ ID NO: 5210910 - DNA, 23 bp, Homo sapiens
aggatgcggctttctctgcctct

SEQ ID NO: 5210911 - DNA, 23 bp, Homo sapiens
aggatgctaacatctaaaaatag

SEQ ID NO: 5210912 - DNA, 21 bp, Homo sapiens
aggatgctcagttgctaaaca

SEQ ID NO: 5210913 - DNA, 18 bp, Homo sapiens
aggatgctcccccaggga

SEQ ID NO: 5210914 - DNA, 19 bp, Homo sapiens
aggatgctctttcccagga

SEQ ID NO: 5210915 - DNA, 20 bp, Homo sapiens
aggatgctctttcccaggac

SEQ ID NO: 5210916 - DNA, 17 bp, Homo sapiens
aggatgctgcagcagag

SEQ ID NO: 5210917 - DNA, 14 bp, Homo sapiens
aggatgctgcagtg

SEQ ID NO: 5210918 - DNA, 15 bp, Homo sapiens
aggatgctgctgttg

SEQ ID NO: 5210919 - DNA, 15 bp, Homo sapiens
aggatgctgggtggc

SEQ ID NO: 5210920 - DNA, 14 bp, Homo sapiens
aggatgctgtcagg

SEQ ID NO: 5210921 - DNA, 15 bp, Homo sapiens
aggatgctgtcagga

SEQ ID NO: 5210922 - DNA, 16 bp, Homo sapiens
aggatgctgtcaggag

SEQ ID NO: 5210923 - DNA, 15 bp, Homo sapiens
aggatgctgtgcctc

SEQ ID NO: 5210924 - DNA, 18 bp, Homo sapiens
aggatgctgtgttgtcaa

SEQ ID NO: 5210925 - DNA, 18 bp, Homo sapiens
aggatgcttctgctcaca

SEQ ID NO: 5210926 - DNA, 13 bp, Homo sapiens
aggatgcttggga

SEQ ID NO: 5210927 - DNA, 15 bp, Homo sapiens
aggatgcttgtacat

SEQ ID NO: 5210928 - DNA, 18 bp, Homo sapiens
aggatgcttgtacataat

SEQ ID NO: 5210929 - DNA, 15 bp, Homo sapiens
aggatggaaaaataa

SEQ ID NO: 5210930 - DNA, 17 bp, Homo sapiens
aggatggaaactggact

SEQ ID NO: 5210931 - DNA, 17 bp, Homo sapiens
aggatggaagaaagaag

SEQ ID NO: 5210932 - DNA, 19 bp, Homo sapiens
aggatggaagaaagaagca

SEQ ID NO: 5210933 - DNA, 13 bp, Homo sapiens
aggatggagagag

SEQ ID NO: 5210934 - DNA, 14 bp, Homo sapiens
aggatggagagagg

SEQ ID NO: 5210935 - DNA, 16 bp, Homo sapiens
aggatggagagagggg

SEQ ID NO: 5210936 - DNA, 17 bp, Homo sapiens
aggatggagagagggga

SEQ ID NO: 5210937 - DNA, 14 bp, Homo sapiens
aggatggagcaagc

SEQ ID NO: 5210938 - DNA, 19 bp, Homo sapiens
aggatggaggggtggtcct

SEQ ID NO: 5210939 - DNA, 21 bp, Homo sapiens
aggatggatagaaggaaacat

SEQ ID NO: 5210940 - DNA, 15 bp, Homo sapiens
aggatggatggcacc

SEQ ID NO: 5210941 - DNA, 16 bp, Homo sapiens
aggatggatggcaccc

SEQ ID NO: 5210942 - DNA, 22 bp, Homo sapiens
aggatggatggcaccctggaac

SEQ ID NO: 5210943 - DNA, 17 bp, Homo sapiens
aggatggattgcagtcc

SEQ ID NO: 5210944 - DNA, 15 bp, Homo sapiens
aggatggcagcaatg

SEQ ID NO: 5210945 - DNA, 17 bp, Homo sapiens
aggatggcagcaatggc

SEQ ID NO: 5210946 - DNA, 21 bp, Homo sapiens
aggatggcagcaatggcgctg

SEQ ID NO: 5210947 - DNA, 13 bp, Homo sapiens
aggatggcagcct

SEQ ID NO: 5210948 - DNA, 19 bp, Homo sapiens
aggatggccagtgtctgtc

SEQ ID NO: 5210949 - DNA, 22 bp, Homo sapiens
aggatggcctggccagggcctg

SEQ ID NO: 5210950 - DNA, 14 bp, Homo sapiens
aggatggcctttcc

SEQ ID NO: 5210951 - DNA, 16 bp, Homo sapiens
aggatggcctttcctt

SEQ ID NO: 5210952 - DNA, 22 bp, Homo sapiens
aggatggctggctctgcacctg

SEQ ID NO: 5210953 - DNA, 20 bp, Homo sapiens
aggatgggaaaaactgcagt

SEQ ID NO: 5210954 - DNA, 16 bp, Homo sapiens
aggatgggaacaagga

SEQ ID NO: 5210955 - DNA, 20 bp, Homo sapiens
aggatgggaacaaggaagga

SEQ ID NO: 5210956 - DNA, 12 bp, Homo sapiens
aggatgggaagg

SEQ ID NO: 5210957 - DNA, 21 bp, Homo sapiens
aggatgggagagctagaaagt

SEQ ID NO: 5210958 - DNA, 23 bp, Homo sapiens
aggatgggcagctggggggctgt

SEQ ID NO: 5210959 - DNA, 15 bp, Homo sapiens
aggatgggctgagct

SEQ ID NO: 5210960 - DNA, 16 bp, Homo sapiens
aggatgggcttctgtg

SEQ ID NO: 5210961 - DNA, 13 bp, Homo sapiens
aggatggggcacg

SEQ ID NO: 5210962 - DNA, 22 bp, Homo sapiens
aggatggggcacggctctgggg

SEQ ID NO: 5210963 - DNA, 16 bp, Homo sapiens
aggatggggctcccag

SEQ ID NO: 5210964 - DNA, 17 bp, Homo sapiens
aggatggggctcccagc

SEQ ID NO: 5210965 - DNA, 18 bp, Homo sapiens
aggatggggctcccagct

SEQ ID NO: 5210966 - DNA, 19 bp, Homo sapiens
aggatggggttctggaaat

SEQ ID NO: 5210967 - DNA, 17 bp, Homo sapiens
aggatgggtcagagcta

SEQ ID NO: 5210968 - DNA, 16 bp, Homo sapiens
aggatgggtcccctcc

SEQ ID NO: 5210969 - DNA, 22 bp, Homo sapiens
aggatgggtctggtttgcagag

SEQ ID NO: 5210970 - DNA, 13 bp, Homo sapiens
aggatggtcacac

SEQ ID NO: 5210971 - DNA, 20 bp, Homo sapiens
aggatggtctcgatctcctg

SEQ ID NO: 5210972 - DNA, 16 bp, Homo sapiens
aggatggtgggcagga

SEQ ID NO: 5210973 - DNA, 18 bp, Homo sapiens
aggatggtgggcaggatc

SEQ ID NO: 5210974 - DNA, 13 bp, Homo sapiens
aggatggtggggc

SEQ ID NO: 5210975 - DNA, 17 bp, Homo sapiens
aggatggtggggccccc

SEQ ID NO: 5210976 - DNA, 19 bp, Homo sapiens
aggatggtggttattttaa

SEQ ID NO: 5210977 - DNA, 15 bp, Homo sapiens
aggatggtgttactg

SEQ ID NO: 5210978 - DNA, 22 bp, Homo sapiens
aggatgtaaacagtgcctgctg

SEQ ID NO: 5210979 - DNA, 18 bp, Homo sapiens
aggatgtaactttataaa

SEQ ID NO: 5210980 - DNA, 16 bp, Homo sapiens
aggatgtaaggcctta

SEQ ID NO: 5210981 - DNA, 23 bp, Homo sapiens
aggatgtaataaagaattttatt

SEQ ID NO: 5210982 - DNA, 19 bp, Homo sapiens
aggatgtactgttgaaaaa

SEQ ID NO: 5210983 - DNA, 23 bp, Homo sapiens
aggatgtactgttgaaaaagata

SEQ ID NO: 5210984 - DNA, 14 bp, Homo sapiens
aggatgtagctttt

SEQ ID NO: 5210985 - DNA, 14 bp, Homo sapiens
aggatgtatgctgt

SEQ ID NO: 5210986 - DNA, 16 bp, Homo sapiens
aggatgtcacagggcc

SEQ ID NO: 5210987 - DNA, 19 bp, Homo sapiens
aggatgtcactcagatgga

SEQ ID NO: 5210988 - DNA, 17 bp, Homo sapiens
aggatgtcatgtctgct

SEQ ID NO: 5210989 - DNA, 20 bp, Homo sapiens
aggatgtccctgggccaggg

SEQ ID NO: 5210990 - DNA, 17 bp, Homo sapiens
aggatgtctcaaacttc

SEQ ID NO: 5210991 - DNA, 14 bp, Homo sapiens
aggatgtgatatat

SEQ ID NO: 5210992 - DNA, 20 bp, Homo sapiens
aggatgtgattgtggaatgg

SEQ ID NO: 5210993 - DNA, 16 bp, Homo sapiens
aggatgtgctgcagtg

SEQ ID NO: 5210994 - DNA, 20 bp, Homo sapiens
aggatgtggaaacctccttc

SEQ ID NO: 5210995 - DNA, 20 bp, Homo sapiens
aggatgtggcaggggcagtg

SEQ ID NO: 5210996 - DNA, 21 bp, Homo sapiens
aggatgtgggggaagacctgg

SEQ ID NO: 5210997 - DNA, 15 bp, Homo sapiens
aggatgtgtgggcca

SEQ ID NO: 5210998 - DNA, 13 bp, Homo sapiens
aggatgtgtttgc

SEQ ID NO: 5210999 - DNA, 18 bp, Homo sapiens
aggatgtgtttgctttct

SEQ ID NO: 5211000 - DNA, 15 bp, Homo sapiens
aggatgttacaagtt

SEQ ID NO: 5211001 - DNA, 19 bp, Homo sapiens
aggatgttacaagtttgct

SEQ ID NO: 5211002 - DNA, 21 bp, Homo sapiens
aggatgttacaagtttgctaa

SEQ ID NO: 5211003 - DNA, 22 bp, Homo sapiens
aggatgttacaagtttgctaaa

SEQ ID NO: 5211004 - DNA, 23 bp, Homo sapiens
aggatgttagacttgctccctct

SEQ ID NO: 5211005 - DNA, 12 bp, Homo sapiens
aggatgttctgg

SEQ ID NO: 5211006 - DNA, 20 bp, Homo sapiens
aggatgttctgggacacagt

SEQ ID NO: 5211007 - DNA, 17 bp, Homo sapiens
aggatgttgaaaaagtt

SEQ ID NO: 5211008 - DNA, 23 bp, Homo sapiens
aggatgttgcttctgaatcactg

SEQ ID NO: 5211009 - DNA, 23 bp, Homo sapiens
aggatgtttttctttatttttgt

SEQ ID NO: 5211010 - DNA, 16 bp, Homo sapiens
aggattaaacacacac

SEQ ID NO: 5211011 - DNA, 20 bp, Homo sapiens
aggattaaataatgtaaata

SEQ ID NO: 5211012 - DNA, 21 bp, Homo sapiens
aggattaagttcgaggtggct

SEQ ID NO: 5211013 - DNA, 13 bp, Homo sapiens
aggattaatgaaa

SEQ ID NO: 5211014 - DNA, 23 bp, Homo sapiens
aggattacagaaactgatgccaa

SEQ ID NO: 5211015 - DNA, 16 bp, Homo sapiens
aggattacatgcatgt

SEQ ID NO: 5211016 - DNA, 22 bp, Homo sapiens
aggattacttagattgtgttcc

SEQ ID NO: 5211017 - DNA, 20 bp, Homo sapiens
aggattagacagtaagagtt

SEQ ID NO: 5211018 - DNA, 21 bp, Homo sapiens
aggattagacagtaagagttt

SEQ ID NO: 5211019 - DNA, 22 bp, Homo sapiens
aggattaggcaaaaataattta

SEQ ID NO: 5211020 - DNA, 18 bp, Homo sapiens
aggattaggggatgggga

SEQ ID NO: 5211021 - DNA, 16 bp, Homo sapiens
aggattagtttagaac

SEQ ID NO: 5211022 - DNA, 18 bp, Homo sapiens
aggattagtttagaacag

SEQ ID NO: 5211023 - DNA, 21 bp, Homo sapiens
aggattatgggtcctgcaatt

SEQ ID NO: 5211024 - DNA, 13 bp, Homo sapiens
aggattattgata

SEQ ID NO: 5211025 - DNA, 18 bp, Homo sapiens
aggattattgatagtact

SEQ ID NO: 5211026 - DNA, 14 bp, Homo sapiens
aggattcacacccc

SEQ ID NO: 5211027 - DNA, 18 bp, Homo sapiens
aggattcacaccccacct

SEQ ID NO: 5211028 - DNA, 19 bp, Homo sapiens
aggattcacaccccacctg

SEQ ID NO: 5211029 - DNA, 12 bp, Homo sapiens
aggattcagatc

SEQ ID NO: 5211030 - DNA, 14 bp, Homo sapiens
aggattcaggcagc

SEQ ID NO: 5211031 - DNA, 14 bp, Homo sapiens
aggattcaggggct

SEQ ID NO: 5211032 - DNA, 15 bp, Homo sapiens
aggattcatggctta

SEQ ID NO: 5211033 - DNA, 21 bp, Homo sapiens
aggattccaaaaacattttat

SEQ ID NO: 5211034 - DNA, 15 bp, Homo sapiens
aggattccagttgcg

SEQ ID NO: 5211035 - DNA, 19 bp, Homo sapiens
agggcagattcggaccact

SEQ ID NO: 5211036 - DNA, 14 bp, Homo sapiens
agggcagcaaggga

SEQ ID NO: 5211037 - DNA, 18 bp, Homo sapiens
agggcagcagccagccct

SEQ ID NO: 5211038 - DNA, 19 bp, Homo sapiens
agggcagcagccagccctg

SEQ ID NO: 5211039 - DNA, 20 bp, Homo sapiens
agggcagcaggccagagaaa

SEQ ID NO: 5211040 - DNA, 14 bp, Homo sapiens
agggcagcatggag

SEQ ID NO: 5211041 - DNA, 12 bp, Homo sapiens
agggcagccagg

SEQ ID NO: 5211042 - DNA, 15 bp, Homo sapiens
agggcagccagggag

SEQ ID NO: 5211043 - DNA, 23 bp, Homo sapiens
agggcagccagggagagcccagg

SEQ ID NO: 5211044 - DNA, 14 bp, Homo sapiens
agggcagccagggg

SEQ ID NO: 5211045 - DNA, 15 bp, Homo sapiens
agggcagccaggggc

SEQ ID NO: 5211046 - DNA, 16 bp, Homo sapiens
agggcagcccccactt

SEQ ID NO: 5211047 - DNA, 19 bp, Homo sapiens
agggcagccccctccctag

SEQ ID NO: 5211048 - DNA, 12 bp, Homo sapiens
agggcagccccg

SEQ ID NO: 5211049 - DNA, 13 bp, Homo sapiens
agggcagccccgc

SEQ ID NO: 5211050 - DNA, 22 bp, Homo sapiens
agggcagccccgcgaccacccc

SEQ ID NO: 5211051 - DNA, 23 bp, Homo sapiens
agggcagccccgcgaccacccct

SEQ ID NO: 5211052 - DNA, 14 bp, Homo sapiens
agggcagcccctgc

SEQ ID NO: 5211053 - DNA, 12 bp, Homo sapiens
agggcagccctc

SEQ ID NO: 5211054 - DNA, 14 bp, Homo sapiens
agggcagccctcca

SEQ ID NO: 5211055 - DNA, 16 bp, Homo sapiens
agggcagccctccatg

SEQ ID NO: 5211056 - DNA, 15 bp, Homo sapiens
agggcagccctcctt

SEQ ID NO: 5211057 - DNA, 20 bp, Homo sapiens
agggcagccgtcacccctgc

SEQ ID NO: 5211058 - DNA, 11 bp, Homo sapiens
agggcagcctc

SEQ ID NO: 5211059 - DNA, 16 bp, Homo sapiens
agggcagcctgcctgg

SEQ ID NO: 5211060 - DNA, 17 bp, Homo sapiens
agggcagcctggatccc

SEQ ID NO: 5211061 - DNA, 16 bp, Homo sapiens
agggcagcctgtggga

SEQ ID NO: 5211062 - DNA, 16 bp, Homo sapiens
agggcagcgccaggct

SEQ ID NO: 5211063 - DNA, 12 bp, Homo sapiens
agggcagcggct

SEQ ID NO: 5211064 - DNA, 14 bp, Homo sapiens
agggcagcggctcc

SEQ ID NO: 5211065 - DNA, 18 bp, Homo sapiens
agggcagctgcctggcca

SEQ ID NO: 5211066 - DNA, 22 bp, Homo sapiens
agggcagctggcccccagccct

SEQ ID NO: 5211067 - DNA, 15 bp, Homo sapiens
agggcagctgggccc

SEQ ID NO: 5211068 - DNA, 13 bp, Homo sapiens
agggcagcttgcc

SEQ ID NO: 5211069 - DNA, 21 bp, Homo sapiens
agggcaggaagacttccagct

SEQ ID NO: 5211070 - DNA, 14 bp, Homo sapiens
agggcaggaagggg

SEQ ID NO: 5211071 - DNA, 18 bp, Homo sapiens
agggcaggaccagcccac

SEQ ID NO: 5211072 - DNA, 14 bp, Homo sapiens
agggcaggagccta

SEQ ID NO: 5211073 - DNA, 17 bp, Homo sapiens
agggcaggagcctagag

SEQ ID NO: 5211074 - DNA, 18 bp, Homo sapiens
agggcaggagcctagagg

SEQ ID NO: 5211075 - DNA, 15 bp, Homo sapiens
agggcaggagctgct

SEQ ID NO: 5211076 - DNA, 20 bp, Homo sapiens
agggcaggatggcctttcct

SEQ ID NO: 5211077 - DNA, 16 bp, Homo sapiens
agggcaggcagagctc

SEQ ID NO: 5211078 - DNA, 14 bp, Homo sapiens
agggcaggcctgtt

SEQ ID NO: 5211079 - DNA, 20 bp, Homo sapiens
agggcaggccttgctggggt

SEQ ID NO: 5211080 - DNA, 15 bp, Homo sapiens
agggcaggcgggccc

SEQ ID NO: 5211081 - DNA, 19 bp, Homo sapiens
agggcaggcttggggaaaa

SEQ ID NO: 5211082 - DNA, 18 bp, Homo sapiens
agggcagggacagggccg

SEQ ID NO: 5211083 - DNA, 15 bp, Homo sapiens
agggcagggcagcct

SEQ ID NO: 5211084 - DNA, 13 bp, Homo sapiens
agggcagggccac

SEQ ID NO: 5211085 - DNA, 14 bp, Homo sapiens
agggcagggcccac

SEQ ID NO: 5211086 - DNA, 18 bp, Homo sapiens
agggcagggcccacgtgt

SEQ ID NO: 5211087 - DNA, 19 bp, Homo sapiens
agggcagggcccacgtgta

SEQ ID NO: 5211088 - DNA, 23 bp, Homo sapiens
agggcagggcccacgtgtatagt

SEQ ID NO: 5211089 - DNA, 17 bp, Homo sapiens
agggcagggccccaggc

SEQ ID NO: 5211090 - DNA, 16 bp, Homo sapiens
agggcagggcgagctg

SEQ ID NO: 5211091 - DNA, 20 bp, Homo sapiens
agggcagggcgagctgcagg

SEQ ID NO: 5211092 - DNA, 14 bp, Homo sapiens
agggcaggggtgct

SEQ ID NO: 5211093 - DNA, 11 bp, Homo sapiens
agggcagggtc

SEQ ID NO: 5211094 - DNA, 22 bp, Homo sapiens
agggcagggtccacgcctctgc

SEQ ID NO: 5211095 - DNA, 23 bp, Homo sapiens
agggcagggtgggcagcctatgg

SEQ ID NO: 5211096 - DNA, 19 bp, Homo sapiens
agggcagggttctagaagg

SEQ ID NO: 5211097 - DNA, 20 bp, Homo sapiens
agggcagggttctagaaggg

SEQ ID NO: 5211098 - DNA, 14 bp, Homo sapiens
agggcaggtccagc

SEQ ID NO: 5211099 - DNA, 23 bp, Homo sapiens
agggcaggtccagctctgtgggc

SEQ ID NO: 5211100 - DNA, 24 bp, Homo sapiens
agggcaggtccagctctgtgggcc

SEQ ID NO: 5211101 - DNA, 16 bp, Homo sapiens
agggcaggtcttcata

SEQ ID NO: 5211102 - DNA, 11 bp, Homo sapiens
agggcaggtgg

SEQ ID NO: 5211103 - DNA, 16 bp, Homo sapiens
agggcagtacctggga

SEQ ID NO: 5211104 - DNA, 21 bp, Homo sapiens
agggcagtccttactccccca

SEQ ID NO: 5211105 - DNA, 20 bp, Homo sapiens
agggcagtcgatagagctgt

SEQ ID NO: 5211106 - DNA, 19 bp, Homo sapiens
agggcagtctagtcctggg

SEQ ID NO: 5211107 - DNA, 21 bp, Homo sapiens
agggcagtgacaagtggaggg

SEQ ID NO: 5211108 - DNA, 21 bp, Homo sapiens
agggcagtgctagtgagctgg

SEQ ID NO: 5211109 - DNA, 13 bp, Homo sapiens
agggcagtggcca

SEQ ID NO: 5211110 - DNA, 15 bp, Homo sapiens
agggcagtggccaag

SEQ ID NO: 5211111 - DNA, 20 bp, Homo sapiens
agggcagtggccaagcctgc

SEQ ID NO: 5211112 - DNA, 22 bp, Homo sapiens
agggcagtgtggtgggaggggt

SEQ ID NO: 5211113 - DNA, 18 bp, Homo sapiens
agggcagtgtttcctttt

SEQ ID NO: 5211114 - DNA, 22 bp, Homo sapiens
agggcagttcgcagccaccctg

SEQ ID NO: 5211115 - DNA, 16 bp, Homo sapiens
agggcagttctgcacc

SEQ ID NO: 5211116 - DNA, 20 bp, Homo sapiens
agggcagttctgcacccagc

SEQ ID NO: 5211117 - DNA, 19 bp, Homo sapiens
agggcataaaacagctttg

SEQ ID NO: 5211118 - DNA, 22 bp, Homo sapiens
agggcataatgatgatgggaat

SEQ ID NO: 5211119 - DNA, 19 bp, Homo sapiens
agggcataccttgtgcatt

SEQ ID NO: 5211120 - DNA, 21 bp, Homo sapiens
agggcatcagctttccctggc

SEQ ID NO: 5211121 - DNA, 14 bp, Homo sapiens
agggcatccatacc

SEQ ID NO: 5211122 - DNA, 21 bp, Homo sapiens
agggcatccataccagctcgc

SEQ ID NO: 5211123 - DNA, 14 bp, Homo sapiens
agggcatctccagg

SEQ ID NO: 5211124 - DNA, 15 bp, Homo sapiens
agggcatctccagga

SEQ ID NO: 5211125 - DNA, 22 bp, Homo sapiens
agggcatctccaggaaggcggg

SEQ ID NO: 5211126 - DNA, 14 bp, Homo sapiens
agggcatctctggg

SEQ ID NO: 5211127 - DNA, 17 bp, Homo sapiens
agggcatctctgggctg

SEQ ID NO: 5211128 - DNA, 18 bp, Homo sapiens
agggcatctctgggctgg

SEQ ID NO: 5211129 - DNA, 17 bp, Homo sapiens
agggcatcttagcttct

SEQ ID NO: 5211130 - DNA, 12 bp, Homo sapiens
agggcatgaaat

SEQ ID NO: 5211131 - DNA, 20 bp, Homo sapiens
agggcatgcacgggcatgca

SEQ ID NO: 5211132 - DNA, 18 bp, Homo sapiens
agggcatgcattttgcag

SEQ ID NO: 5211133 - DNA, 14 bp, Homo sapiens
agggcatgcctggc

SEQ ID NO: 5211134 - DNA, 15 bp, Homo sapiens
agggcatgccttgtg

SEQ ID NO: 5211135 - DNA, 17 bp, Homo sapiens
agggcatgcgcacaagg

SEQ ID NO: 5211136 - DNA, 15 bp, Homo sapiens
agggcatggcttgcc

SEQ ID NO: 5211137 - DNA, 17 bp, Homo sapiens
agggcatgtgatatttt

SEQ ID NO: 5211138 - DNA, 13 bp, Homo sapiens
agggcatgtgcag

SEQ ID NO: 5211139 - DNA, 19 bp, Homo sapiens
agggcatgtgcggctgaac

SEQ ID NO: 5211140 - DNA, 16 bp, Homo sapiens
agggcatgtgtatgtg

SEQ ID NO: 5211141 - DNA, 16 bp, Homo sapiens
agggcattcaaatggg

SEQ ID NO: 5211142 - DNA, 18 bp, Homo sapiens
agggcattcgggccacag

SEQ ID NO: 5211143 - DNA, 21 bp, Homo sapiens
agggcattcgggccacagggc

SEQ ID NO: 5211144 - DNA, 19 bp, Homo sapiens
agggcattctgttggccta

SEQ ID NO: 5211145 - DNA, 14 bp, Homo sapiens
agggcattctttcc

SEQ ID NO: 5211146 - DNA, 17 bp, Homo sapiens
agggcattgctcagccc

SEQ ID NO: 5211147 - DNA, 22 bp, Homo sapiens
agggcatttgagaaatgcatat

SEQ ID NO: 5211148 - DNA, 20 bp, Homo sapiens
agggcatttgctgccccagc

SEQ ID NO: 5211149 - DNA, 15 bp, Homo sapiens
agggcatttggcttc

SEQ ID NO: 5211150 - DNA, 19 bp, Homo sapiens
agggcatttggcttcctct

SEQ ID NO: 5211151 - DNA, 24 bp, Homo sapiens
agggcatttggcttcctctgctgc

SEQ ID NO: 5211152 - DNA, 15 bp, Homo sapiens
agggcatttttcttg

SEQ ID NO: 5211153 - DNA, 14 bp, Homo sapiens
agggccaaaagctt

SEQ ID NO: 5211154 - DNA, 20 bp, Homo sapiens
agggccaaaatatttggaat

SEQ ID NO: 5211155 - DNA, 18 bp, Homo sapiens
agggccaaagcacagctg

SEQ ID NO: 5211156 - DNA, 22 bp, Homo sapiens
agggccaaagcacagctgggca

SEQ ID NO: 5211157 - DNA, 16 bp, Homo sapiens
agggccaacccttctc

SEQ ID NO: 5211158 - DNA, 15 bp, Homo sapiens
agggccaagagagac

SEQ ID NO: 5211159 - DNA, 19 bp, Homo sapiens
agggccaagagatctgtgt

SEQ ID NO: 5211160 - DNA, 20 bp, Homo sapiens
agggccaagagatctgtgtg

SEQ ID NO: 5211161 - DNA, 22 bp, Homo sapiens
agggccaagagatctgtgtggc

SEQ ID NO: 5211162 - DNA, 13 bp, Homo sapiens
agggccaagccgg

SEQ ID NO: 5211163 - DNA, 17 bp, Homo sapiens
agggccaatggagaaaa

SEQ ID NO: 5211164 - DNA, 18 bp, Homo sapiens
agggccaatggagaaaat

SEQ ID NO: 5211165 - DNA, 18 bp, Homo sapiens
agggccacactattacca

SEQ ID NO: 5211166 - DNA, 24 bp, Homo sapiens
agggccacactattaccatgagaa

SEQ ID NO: 5211167 - DNA, 15 bp, Homo sapiens
agggccaccccactc

SEQ ID NO: 5211168 - DNA, 17 bp, Homo sapiens
agggccaccccactcta

SEQ ID NO: 5211169 - DNA, 12 bp, Homo sapiens
agggccaccctg

SEQ ID NO: 5211170 - DNA, 13 bp, Homo sapiens
agggccaccctga

SEQ ID NO: 5211171 - DNA, 13 bp, Homo sapiens
agggccaccctgc

SEQ ID NO: 5211172 - DNA, 17 bp, Homo sapiens
agggccaccctgctgca

SEQ ID NO: 5211173 - DNA, 23 bp, Homo sapiens
agggccaccctgctgcactagga

SEQ ID NO: 5211174 - DNA, 21 bp, Homo sapiens
agggccaccggtgggcagtgg

SEQ ID NO: 5211175 - DNA, 17 bp, Homo sapiens
agggccacctccacacc

SEQ ID NO: 5211176 - DNA, 21 bp, Homo sapiens
agggccacctccacacccacc

SEQ ID NO: 5211177 - DNA, 17 bp, Homo sapiens
agggccacgctccagct

SEQ ID NO: 5211178 - DNA, 20 bp, Homo sapiens
agggccacgctccagctgcc

SEQ ID NO: 5211179 - DNA, 19 bp, Homo sapiens
agggccacgtgccaggccc

SEQ ID NO: 5211180 - DNA, 14 bp, Homo sapiens
agggccagaaggag

SEQ ID NO: 5211181 - DNA, 21 bp, Homo sapiens
agggccagaaggagggcagag

SEQ ID NO: 5211182 - DNA, 18 bp, Homo sapiens
agggccagacagaccttc

SEQ ID NO: 5211183 - DNA, 18 bp, Homo sapiens
agggccagactggaagac

SEQ ID NO: 5211184 - DNA, 16 bp, Homo sapiens
agggccagagcagctc

SEQ ID NO: 5211185 - DNA, 12 bp, Homo sapiens
agggccagagcc

SEQ ID NO: 5211186 - DNA, 13 bp, Homo sapiens
agggccagagcca

SEQ ID NO: 5211187 - DNA, 15 bp, Homo sapiens
agggccagagccagg

SEQ ID NO: 5211188 - DNA, 14 bp, Homo sapiens
agggccagagcctg

SEQ ID NO: 5211189 - DNA, 13 bp, Homo sapiens
agggccagagcta

SEQ ID NO: 5211190 - DNA, 19 bp, Homo sapiens
agggccagagctagggctg

SEQ ID NO: 5211191 - DNA, 12 bp, Homo sapiens
agggccagaggg

SEQ ID NO: 5211192 - DNA, 14 bp, Homo sapiens
agggccagagggag

SEQ ID NO: 5211193 - DNA, 18 bp, Homo sapiens
agggccagagttccacaa

SEQ ID NO: 5211194 - DNA, 12 bp, Homo sapiens
agggccagcagg

SEQ ID NO: 5211195 - DNA, 18 bp, Homo sapiens
agggccagcaggcagcgc

SEQ ID NO: 5211196 - DNA, 23 bp, Homo sapiens
agggccagcaggctcctggctgt

SEQ ID NO: 5211197 - DNA, 18 bp, Homo sapiens
agggccagcctctagagc

SEQ ID NO: 5211198 - DNA, 12 bp, Homo sapiens
agggccaggact

SEQ ID NO: 5211199 - DNA, 18 bp, Homo sapiens
agggccaggagagagatc

SEQ ID NO: 5211200 - DNA, 20 bp, Homo sapiens
agggccaggattcaggcctc

SEQ ID NO: 5211201 - DNA, 18 bp, Homo sapiens
agggccaggattcctctc

SEQ ID NO: 5211202 - DNA, 14 bp, Homo sapiens
agggccaggcaccc

SEQ ID NO: 5211203 - DNA, 17 bp, Homo sapiens
agggccaggcacccaca

SEQ ID NO: 5211204 - DNA, 14 bp, Homo sapiens
agggccaggcaggt

SEQ ID NO: 5211205 - DNA, 14 bp, Homo sapiens
agggccaggcccag

SEQ ID NO: 5211206 - DNA, 18 bp, Homo sapiens
agggccaggcccaggcct

SEQ ID NO: 5211207 - DNA, 23 bp, Homo sapiens
agggccagggacccaggtgtgcc

SEQ ID NO: 5211208 - DNA, 13 bp, Homo sapiens
agggccagggcaa

SEQ ID NO: 5211209 - DNA, 14 bp, Homo sapiens
agggccagggccct

SEQ ID NO: 5211210 - DNA, 22 bp, Homo sapiens
agggccagggccctgcagaggg

SEQ ID NO: 5211211 - DNA, 13 bp, Homo sapiens
agggccagggctc

SEQ ID NO: 5211212 - DNA, 20 bp, Homo sapiens
agggccaggtcctcacagca

SEQ ID NO: 5211213 - DNA, 12 bp, Homo sapiens
agggccaggtgc

SEQ ID NO: 5211214 - DNA, 15 bp, Homo sapiens
agggccaggtgcaga

SEQ ID NO: 5211215 - DNA, 15 bp, Homo sapiens
aggattcccccagcc

SEQ ID NO: 5211216 - DNA, 16 bp, Homo sapiens
aggattcccccagcca

SEQ ID NO: 5211217 - DNA, 18 bp, Homo sapiens
aggattccccctgccctg

SEQ ID NO: 5211218 - DNA, 22 bp, Homo sapiens
aggattccccctgccctgtgcc

SEQ ID NO: 5211219 - DNA, 12 bp, Homo sapiens
aggattcccttc

SEQ ID NO: 5211220 - DNA, 15 bp, Homo sapiens
aggattcctccccca

SEQ ID NO: 5211221 - DNA, 14 bp, Homo sapiens
aggattcctctctc

SEQ ID NO: 5211222 - DNA, 16 bp, Homo sapiens
aggattcctcttttct

SEQ ID NO: 5211223 - DNA, 13 bp, Homo sapiens
aggattctatgag

SEQ ID NO: 5211224 - DNA, 15 bp, Homo sapiens
aggattctatgaggc

SEQ ID NO: 5211225 - DNA, 16 bp, Homo sapiens
aggattctatgaggca

SEQ ID NO: 5211226 - DNA, 22 bp, Homo sapiens
aggattctcatgggaaggggag

SEQ ID NO: 5211227 - DNA, 21 bp, Homo sapiens
aggattctctaattagaaatt

SEQ ID NO: 5211228 - DNA, 23 bp, Homo sapiens
aggattctctaattagaaattta

SEQ ID NO: 5211229 - DNA, 13 bp, Homo sapiens
aggattctctgca

SEQ ID NO: 5211230 - DNA, 14 bp, Homo sapiens
aggattctctgcag

SEQ ID NO: 5211231 - DNA, 13 bp, Homo sapiens
aggattctgtaat

SEQ ID NO: 5211232 - DNA, 13 bp, Homo sapiens
aggattcttcccg

SEQ ID NO: 5211233 - DNA, 17 bp, Homo sapiens
aggattcttcctccctc

SEQ ID NO: 5211234 - DNA, 19 bp, Homo sapiens
aggattcttcctccctccc

SEQ ID NO: 5211235 - DNA, 16 bp, Homo sapiens
aggattctttccccag

SEQ ID NO: 5211236 - DNA, 23 bp, Homo sapiens
aggattcttttttcaatgtactg

SEQ ID NO: 5211237 - DNA, 19 bp, Homo sapiens
aggattgaacttctttgaa

SEQ ID NO: 5211238 - DNA, 13 bp, Homo sapiens
aggattgaagagc

SEQ ID NO: 5211239 - DNA, 22 bp, Homo sapiens
aggattgattcagctaagcaaa

SEQ ID NO: 5211240 - DNA, 20 bp, Homo sapiens
aggattgcaggtgcctggct

SEQ ID NO: 5211241 - DNA, 21 bp, Homo sapiens
aggattgcaggtgcctggctt

SEQ ID NO: 5211242 - DNA, 15 bp, Homo sapiens
aggattgctactgtc

SEQ ID NO: 5211243 - DNA, 18 bp, Homo sapiens
aggattgctactgtccta

SEQ ID NO: 5211244 - DNA, 22 bp, Homo sapiens
aggattgctactgtcctaccca

SEQ ID NO: 5211245 - DNA, 14 bp, Homo sapiens
aggattgctatctg

SEQ ID NO: 5211246 - DNA, 15 bp, Homo sapiens
aggattgctgccaga

SEQ ID NO: 5211247 - DNA, 17 bp, Homo sapiens
aggattgctgccagaga

SEQ ID NO: 5211248 - DNA, 20 bp, Homo sapiens
aggattgctgccagagaagt

SEQ ID NO: 5211249 - DNA, 14 bp, Homo sapiens
aggattgcttgagc

SEQ ID NO: 5211250 - DNA, 17 bp, Homo sapiens
aggattgcttgagccca

SEQ ID NO: 5211251 - DNA, 22 bp, Homo sapiens
aggattgcttgagcccaggagt

SEQ ID NO: 5211252 - DNA, 16 bp, Homo sapiens
aggattggcctgtgtc

SEQ ID NO: 5211253 - DNA, 20 bp, Homo sapiens
aggattgtccacaaatgtcc

SEQ ID NO: 5211254 - DNA, 15 bp, Homo sapiens
aggattgtctgctgc

SEQ ID NO: 5211255 - DNA, 21 bp, Homo sapiens
aggattgtctgctgcctccaa

SEQ ID NO: 5211256 - DNA, 13 bp, Homo sapiens
aggattgtggaaa

SEQ ID NO: 5211257 - DNA, 12 bp, Homo sapiens
aggatttaacag

SEQ ID NO: 5211258 - DNA, 18 bp, Homo sapiens
aggatttaacagtcattt

SEQ ID NO: 5211259 - DNA, 13 bp, Homo sapiens
aggatttaagcaa

SEQ ID NO: 5211260 - DNA, 14 bp, Homo sapiens
aggatttacttttt

SEQ ID NO: 5211261 - DNA, 16 bp, Homo sapiens
aggatttataaagcaa

SEQ ID NO: 5211262 - DNA, 21 bp, Homo sapiens
aggatttatacatacagagat

SEQ ID NO: 5211263 - DNA, 14 bp, Homo sapiens
aggatttattctca

SEQ ID NO: 5211264 - DNA, 17 bp, Homo sapiens
aggatttattctcagaa

SEQ ID NO: 5211265 - DNA, 16 bp, Homo sapiens
aggatttcaagcctgc

SEQ ID NO: 5211266 - DNA, 13 bp, Homo sapiens
aggatttcttaaa

SEQ ID NO: 5211267 - DNA, 18 bp, Homo sapiens
aggatttcttaaattttt

SEQ ID NO: 5211268 - DNA, 21 bp, Homo sapiens
aggatttcttcaaatctcagc

SEQ ID NO: 5211269 - DNA, 14 bp, Homo sapiens
aggatttcttgtat

SEQ ID NO: 5211270 - DNA, 18 bp, Homo sapiens
aggatttgatgcttttct

SEQ ID NO: 5211271 - DNA, 13 bp, Homo sapiens
aggatttgcactg

SEQ ID NO: 5211272 - DNA, 13 bp, Homo sapiens
aggatttggccac

SEQ ID NO: 5211273 - DNA, 13 bp, Homo sapiens
aggatttggctcg

SEQ ID NO: 5211274 - DNA, 20 bp, Homo sapiens
aggatttggtccgtcataac

SEQ ID NO: 5211275 - DNA, 17 bp, Homo sapiens
aggatttggtttttctc

SEQ ID NO: 5211276 - DNA, 18 bp, Homo sapiens
aggatttggtttttctct

SEQ ID NO: 5211277 - DNA, 20 bp, Homo sapiens
aggatttggtttttctcttt

SEQ ID NO: 5211278 - DNA, 12 bp, Homo sapiens
aggatttgtgtt

SEQ ID NO: 5211279 - DNA, 10 bp, Homo sapiens
aggattttaa

SEQ ID NO: 5211280 - DNA, 16 bp, Homo sapiens
aggattttaaatgctg

SEQ ID NO: 5211281 - DNA, 19 bp, Homo sapiens
aggattttaacaaaagcaa

SEQ ID NO: 5211282 - DNA, 18 bp, Homo sapiens
aggattttaccaaagcat

SEQ ID NO: 5211283 - DNA, 12 bp, Homo sapiens
aggattttcaag

SEQ ID NO: 5211284 - DNA, 20 bp, Homo sapiens
aggattttcaagttattcag

SEQ ID NO: 5211285 - DNA, 22 bp, Homo sapiens
aggattttcaagttattcagaa

SEQ ID NO: 5211286 - DNA, 14 bp, Homo sapiens
aggattttcttttt

SEQ ID NO: 5211287 - DNA, 17 bp, Homo sapiens
aggattttctttttaac

SEQ ID NO: 5211288 - DNA, 16 bp, Homo sapiens
aggattttggaaaaga

SEQ ID NO: 5211289 - DNA, 20 bp, Homo sapiens
aggattttggaaaagaaaca

SEQ ID NO: 5211290 - DNA, 18 bp, Homo sapiens
aggattttggcttaaaaa

SEQ ID NO: 5211291 - DNA, 14 bp, Homo sapiens
aggattttgtattg

SEQ ID NO: 5211292 - DNA, 16 bp, Homo sapiens
aggattttgtgttttt

SEQ ID NO: 5211293 - DNA, 12 bp, Homo sapiens
aggatttttaga

SEQ ID NO: 5211294 - DNA, 21 bp, Homo sapiens
aggatttttagagcattaaaa

SEQ ID NO: 5211295 - DNA, 15 bp, Homo sapiens
aggatttttggtata

SEQ ID NO: 5211296 - DNA, 17 bp, Homo sapiens
aggattttttaaaaatt

SEQ ID NO: 5211297 - DNA, 22 bp, Homo sapiens
aggcaaaaataatttattttgc

SEQ ID NO: 5211298 - DNA, 19 bp, Homo sapiens
aggcaaaaatctacagtgt

SEQ ID NO: 5211299 - DNA, 22 bp, Homo sapiens
aggcaaaaatgtccagccaccc

SEQ ID NO: 5211300 - DNA, 13 bp, Homo sapiens
aggcaaaattgca

SEQ ID NO: 5211301 - DNA, 16 bp, Homo sapiens
aggcaaaattgtgaag

SEQ ID NO: 5211302 - DNA, 13 bp, Homo sapiens
aggcaaacaatcc

SEQ ID NO: 5211303 - DNA, 18 bp, Homo sapiens
aggcaaacattttctctt

SEQ ID NO: 5211304 - DNA, 20 bp, Homo sapiens
aggcaaaccaatttgttctg

SEQ ID NO: 5211305 - DNA, 22 bp, Homo sapiens
aggcaaacccatcaacaaaaat

SEQ ID NO: 5211306 - DNA, 18 bp, Homo sapiens
aggcaaactgaggcagca

SEQ ID NO: 5211307 - DNA, 16 bp, Homo sapiens
aggcaaacttttatgc

SEQ ID NO: 5211308 - DNA, 16 bp, Homo sapiens
aggcaaagaaaggaga

SEQ ID NO: 5211309 - DNA, 14 bp, Homo sapiens
aggcaaagaggtgc

SEQ ID NO: 5211310 - DNA, 21 bp, Homo sapiens
aggcaaagataatttatttca

SEQ ID NO: 5211311 - DNA, 15 bp, Homo sapiens
aggcaaaggcagagg

SEQ ID NO: 5211312 - DNA, 20 bp, Homo sapiens
aggcaaaggccagcagcaga

SEQ ID NO: 5211313 - DNA, 15 bp, Homo sapiens
aggcaaaggcctgga

SEQ ID NO: 5211314 - DNA, 17 bp, Homo sapiens
aggcaaagtacaaaatt

SEQ ID NO: 5211315 - DNA, 20 bp, Homo sapiens
aggcaaagtttacagatgtt

SEQ ID NO: 5211316 - DNA, 18 bp, Homo sapiens
aggcaaagttttccattt

SEQ ID NO: 5211317 - DNA, 20 bp, Homo sapiens
aggcaaagttttccattttt

SEQ ID NO: 5211318 - DNA, 15 bp, Homo sapiens
aggcaaataaagatg

SEQ ID NO: 5211319 - DNA, 17 bp, Homo sapiens
aggcaaatattgaagtt

SEQ ID NO: 5211320 - DNA, 20 bp, Homo sapiens
aggcaaatattgaagttgtt

SEQ ID NO: 5211321 - DNA, 22 bp, Homo sapiens
aggcaaatcaggtaaaatagtc

SEQ ID NO: 5211322 - DNA, 14 bp, Homo sapiens
aggcaaatcatttg

SEQ ID NO: 5211323 - DNA, 18 bp, Homo sapiens
aggcaaatccgaaatcag

SEQ ID NO: 5211324 - DNA, 18 bp, Homo sapiens
aggcaaatctaaaattta

SEQ ID NO: 5211325 - DNA, 15 bp, Homo sapiens
aggcaaatgcagttt

SEQ ID NO: 5211326 - DNA, 14 bp, Homo sapiens
aggcaaatgcccaa

SEQ ID NO: 5211327 - DNA, 11 bp, Homo sapiens
aggcaaatgtc

SEQ ID NO: 5211328 - DNA, 12 bp, Homo sapiens
aggcaaatgtcc

SEQ ID NO: 5211329 - DNA, 15 bp, Homo sapiens
aggcaaatgtccaag

SEQ ID NO: 5211330 - DNA, 14 bp, Homo sapiens
aggcaaatgtttat

SEQ ID NO: 5211331 - DNA, 21 bp, Homo sapiens
aggcaaattgttcaaaaataa

SEQ ID NO: 5211332 - DNA, 15 bp, Homo sapiens
aggcaacaatttggt

SEQ ID NO: 5211333 - DNA, 13 bp, Homo sapiens
aggcaacactgat

SEQ ID NO: 5211334 - DNA, 18 bp, Homo sapiens
aggcaacataattcttcc

SEQ ID NO: 5211335 - DNA, 16 bp, Homo sapiens
aggcaacatccaaaat

SEQ ID NO: 5211336 - DNA, 20 bp, Homo sapiens
aggcaaccaataaaagccag

SEQ ID NO: 5211337 - DNA, 22 bp, Homo sapiens
aggcaacccccggtatatcatg

SEQ ID NO: 5211338 - DNA, 16 bp, Homo sapiens
aggcaacctcccatcc

SEQ ID NO: 5211339 - DNA, 20 bp, Homo sapiens
aggcaactagtggagagaac

SEQ ID NO: 5211340 - DNA, 18 bp, Homo sapiens
aggcaactcaaagatgat

SEQ ID NO: 5211341 - DNA, 16 bp, Homo sapiens
aggcaactcagcaggc

SEQ ID NO: 5211342 - DNA, 14 bp, Homo sapiens
aggcaactgaggca

SEQ ID NO: 5211343 - DNA, 19 bp, Homo sapiens
aggcaactgcattggcttt

SEQ ID NO: 5211344 - DNA, 15 bp, Homo sapiens
aggcaacttgaagaa

SEQ ID NO: 5211345 - DNA, 19 bp, Homo sapiens
aggcaacttttaaagctca

SEQ ID NO: 5211346 - DNA, 12 bp, Homo sapiens
aggcaagaaaag

SEQ ID NO: 5211347 - DNA, 23 bp, Homo sapiens
aggcaagaaaagcgcagagaaat

SEQ ID NO: 5211348 - DNA, 18 bp, Homo sapiens
aggcaagaaaaggacaaa

SEQ ID NO: 5211349 - DNA, 20 bp, Homo sapiens
aggcaagaaagcttccttca

SEQ ID NO: 5211350 - DNA, 13 bp, Homo sapiens
aggcaagaagtgg

SEQ ID NO: 5211351 - DNA, 13 bp, Homo sapiens
aggcaagagaaat

SEQ ID NO: 5211352 - DNA, 12 bp, Homo sapiens
aggcaagagaat

SEQ ID NO: 5211353 - DNA, 14 bp, Homo sapiens
aggcaagagacaga

SEQ ID NO: 5211354 - DNA, 13 bp, Homo sapiens
aggcaagagggag

SEQ ID NO: 5211355 - DNA, 16 bp, Homo sapiens
aggcaagatggcacag

SEQ ID NO: 5211356 - DNA, 14 bp, Homo sapiens
aggcaagcaggacc

SEQ ID NO: 5211357 - DNA, 13 bp, Homo sapiens
aggcaagcccctc

SEQ ID NO: 5211358 - DNA, 14 bp, Homo sapiens
aggcaagcccctca

SEQ ID NO: 5211359 - DNA, 19 bp, Homo sapiens
aggcaagcccctcagccct

SEQ ID NO: 5211360 - DNA, 20 bp, Homo sapiens
aggcaagcccctcagccctt

SEQ ID NO: 5211361 - DNA, 13 bp, Homo sapiens
aggcaagcccttc

SEQ ID NO: 5211362 - DNA, 22 bp, Homo sapiens
aggcaagcccttcggtcacctg

SEQ ID NO: 5211363 - DNA, 14 bp, Homo sapiens
aggcaagcctggcc

SEQ ID NO: 5211364 - DNA, 18 bp, Homo sapiens
aggcaagctggcaggagg

SEQ ID NO: 5211365 - DNA, 19 bp, Homo sapiens
aggcaagctggcaggaggg

SEQ ID NO: 5211366 - DNA, 21 bp, Homo sapiens
aggcaagcttgaggccaagat

SEQ ID NO: 5211367 - DNA, 19 bp, Homo sapiens
aggcaagcttgtgtgggcc

SEQ ID NO: 5211368 - DNA, 14 bp, Homo sapiens
aggcaaggaacaga

SEQ ID NO: 5211369 - DNA, 13 bp, Homo sapiens
aggcaaggaggag

SEQ ID NO: 5211370 - DNA, 20 bp, Homo sapiens
aggcaaggaggaggagtcag

SEQ ID NO: 5211371 - DNA, 14 bp, Homo sapiens
aggcaaggatgaaa

SEQ ID NO: 5211372 - DNA, 15 bp, Homo sapiens
aggcaaggatggtgg

SEQ ID NO: 5211373 - DNA, 18 bp, Homo sapiens
aggcaaggcagctcccag

SEQ ID NO: 5211374 - DNA, 13 bp, Homo sapiens
aggcaaggcaggt

SEQ ID NO: 5211375 - DNA, 13 bp, Homo sapiens
aggcaaggcccag

SEQ ID NO: 5211376 - DNA, 16 bp, Homo sapiens
aggcaaggcccagacc

SEQ ID NO: 5211377 - DNA, 16 bp, Homo sapiens
aggcaaggccctgccc

SEQ ID NO: 5211378 - DNA, 18 bp, Homo sapiens
aggcaaggctgacttctc

SEQ ID NO: 5211379 - DNA, 12 bp, Homo sapiens
aggcaaggctgc

SEQ ID NO: 5211380 - DNA, 13 bp, Homo sapiens
aggcaaggctgcc

SEQ ID NO: 5211381 - DNA, 22 bp, Homo sapiens
aggcaaggctgtggaccatgga

SEQ ID NO: 5211382 - DNA, 22 bp, Homo sapiens
aggcaaggtttacactgcggaa

SEQ ID NO: 5211383 - DNA, 15 bp, Homo sapiens
aggcaagtcacactg

SEQ ID NO: 5211384 - DNA, 20 bp, Homo sapiens
aggcaagtcacactgcattg

SEQ ID NO: 5211385 - DNA, 16 bp, Homo sapiens
aggcaagtccacccca

SEQ ID NO: 5211386 - DNA, 15 bp, Homo sapiens
aggcaagtgggacca

SEQ ID NO: 5211387 - DNA, 18 bp, Homo sapiens
aggcaagtttctagctag

SEQ ID NO: 5211388 - DNA, 15 bp, Homo sapiens
aggcaagtttgttca

SEQ ID NO: 5211389 - DNA, 17 bp, Homo sapiens
aggcaataaaaatcata

SEQ ID NO: 5211390 - DNA, 21 bp, Homo sapiens
aggcaataagaattactttgt

SEQ ID NO: 5211391 - DNA, 19 bp, Homo sapiens
aggcaataccaacctgaaa

SEQ ID NO: 5211392 - DNA, 21 bp, Homo sapiens
aggcaataccaacctgaaagt

SEQ ID NO: 5211393 - DNA, 15 bp, Homo sapiens
aggcaatagtcaaaa

SEQ ID NO: 5211394 - DNA, 15 bp, Homo sapiens
aggcaatcctacctt

SEQ ID NO: 5211395 - DNA, 17 bp, Homo sapiens
aggcaatcgttctgctg

SEQ ID NO: 5211396 - DNA, 19 bp, Homo sapiens
aggcaatgactgcgcagag

SEQ ID NO: 5211397 - DNA, 18 bp, Homo sapiens
agggccaggtgcggcctg

SEQ ID NO: 5211398 - DNA, 16 bp, Homo sapiens
agggccagtcctgcct

SEQ ID NO: 5211399 - DNA, 23 bp, Homo sapiens
agggccagtcctgcctggccagg

SEQ ID NO: 5211400 - DNA, 15 bp, Homo sapiens
agggccagtctgggc

SEQ ID NO: 5211401 - DNA, 16 bp, Homo sapiens
agggccagtgatgatg

SEQ ID NO: 5211402 - DNA, 20 bp, Homo sapiens
agggccagtggggcctgtgg

SEQ ID NO: 5211403 - DNA, 21 bp, Homo sapiens
agggccagtggggcctgtgga

SEQ ID NO: 5211404 - DNA, 15 bp, Homo sapiens
agggccatccactgt

SEQ ID NO: 5211405 - DNA, 22 bp, Homo sapiens
agggccatctgactgccaagcc

SEQ ID NO: 5211406 - DNA, 14 bp, Homo sapiens
agggccatggctca

SEQ ID NO: 5211407 - DNA, 21 bp, Homo sapiens
agggccattgaactctgagag

SEQ ID NO: 5211408 - DNA, 19 bp, Homo sapiens
agggccattttggtgctta

SEQ ID NO: 5211409 - DNA, 17 bp, Homo sapiens
agggcccaaataacagt

SEQ ID NO: 5211410 - DNA, 19 bp, Homo sapiens
agggcccaagtccctgttt

SEQ ID NO: 5211411 - DNA, 19 bp, Homo sapiens
agggcccacccatgtcacc

SEQ ID NO: 5211412 - DNA, 14 bp, Homo sapiens
agggcccaccccag

SEQ ID NO: 5211413 - DNA, 13 bp, Homo sapiens
agggcccacctcc

SEQ ID NO: 5211414 - DNA, 23 bp, Homo sapiens
agggcccacttgtatcctctggt

SEQ ID NO: 5211415 - DNA, 11 bp, Homo sapiens
agggcccagac

SEQ ID NO: 5211416 - DNA, 18 bp, Homo sapiens
agggcccagagagggtgg

SEQ ID NO: 5211417 - DNA, 12 bp, Homo sapiens
agggcccagagc

SEQ ID NO: 5211418 - DNA, 15 bp, Homo sapiens
agggcccagagcagg

SEQ ID NO: 5211419 - DNA, 17 bp, Homo sapiens
agggcccagagcaggaa

SEQ ID NO: 5211420 - DNA, 16 bp, Homo sapiens
agggcccagagcccag

SEQ ID NO: 5211421 - DNA, 19 bp, Homo sapiens
agggcccagagcccttgac

SEQ ID NO: 5211422 - DNA, 13 bp, Homo sapiens
agggcccagaggg

SEQ ID NO: 5211423 - DNA, 22 bp, Homo sapiens
agggcccagaggggcggggcca

SEQ ID NO: 5211424 - DNA, 11 bp, Homo sapiens
agggcccagcc

SEQ ID NO: 5211425 - DNA, 12 bp, Homo sapiens
agggcccagccc

SEQ ID NO: 5211426 - DNA, 15 bp, Homo sapiens
agggcccagcccaga

SEQ ID NO: 5211427 - DNA, 17 bp, Homo sapiens
agggcccagcccagagc

SEQ ID NO: 5211428 - DNA, 13 bp, Homo sapiens
agggcccagctgt

SEQ ID NO: 5211429 - DNA, 22 bp, Homo sapiens
agggcccagctgtagccatggc

SEQ ID NO: 5211430 - DNA, 23 bp, Homo sapiens
agggcccagctgtagccatggct

SEQ ID NO: 5211431 - DNA, 14 bp, Homo sapiens
agggcccaggcagg

SEQ ID NO: 5211432 - DNA, 17 bp, Homo sapiens
agggcccaggcaggcca

SEQ ID NO: 5211433 - DNA, 14 bp, Homo sapiens
agggcccaggccat

SEQ ID NO: 5211434 - DNA, 14 bp, Homo sapiens
agggcccaggcctg

SEQ ID NO: 5211435 - DNA, 15 bp, Homo sapiens
agggcccagggaggt

SEQ ID NO: 5211436 - DNA, 20 bp, Homo sapiens
agggcccagttaaatatgat

SEQ ID NO: 5211437 - DNA, 17 bp, Homo sapiens
agggcccatcaggcagt

SEQ ID NO: 5211438 - DNA, 18 bp, Homo sapiens
agggcccatcaggcagtg

SEQ ID NO: 5211439 - DNA, 23 bp, Homo sapiens
agggcccatctgccgcctggggc

SEQ ID NO: 5211440 - DNA, 16 bp, Homo sapiens
agggcccatgggaggg

SEQ ID NO: 5211441 - DNA, 17 bp, Homo sapiens
agggcccatgggaggga

SEQ ID NO: 5211442 - DNA, 18 bp, Homo sapiens
agggcccatgggagggag

SEQ ID NO: 5211443 - DNA, 16 bp, Homo sapiens
agggcccatgtagctg

SEQ ID NO: 5211444 - DNA, 14 bp, Homo sapiens
agggccccagcact

SEQ ID NO: 5211445 - DNA, 14 bp, Homo sapiens
agggccccaggggc

SEQ ID NO: 5211446 - DNA, 15 bp, Homo sapiens
agggccccaggggca

SEQ ID NO: 5211447 - DNA, 16 bp, Homo sapiens
agggcccccaataaac

SEQ ID NO: 5211448 - DNA, 13 bp, Homo sapiens
agggcccccacag

SEQ ID NO: 5211449 - DNA, 14 bp, Homo sapiens
agggcccccacagg

SEQ ID NO: 5211450 - DNA, 17 bp, Homo sapiens
agggcccccacaggagc

SEQ ID NO: 5211451 - DNA, 13 bp, Homo sapiens
agggcccccaccg

SEQ ID NO: 5211452 - DNA, 21 bp, Homo sapiens
agggccccccaaatcccaggg

SEQ ID NO: 5211453 - DNA, 21 bp, Homo sapiens
agggcccccctccccccactt

SEQ ID NO: 5211454 - DNA, 15 bp, Homo sapiens
agggcccccggccac

SEQ ID NO: 5211455 - DNA, 22 bp, Homo sapiens
agggcccccggccacgctccct

SEQ ID NO: 5211456 - DNA, 18 bp, Homo sapiens
agggcccccggctcggcc

SEQ ID NO: 5211457 - DNA, 13 bp, Homo sapiens
agggcccctagaa

SEQ ID NO: 5211458 - DNA, 14 bp, Homo sapiens
agggcccctcactg

SEQ ID NO: 5211459 - DNA, 17 bp, Homo sapiens
agggcccctccctctgc

SEQ ID NO: 5211460 - DNA, 13 bp, Homo sapiens
agggcccctctgc

SEQ ID NO: 5211461 - DNA, 14 bp, Homo sapiens
agggcccctctgcc

SEQ ID NO: 5211462 - DNA, 15 bp, Homo sapiens
agggcccctctgccc

SEQ ID NO: 5211463 - DNA, 19 bp, Homo sapiens
agggcccctctgcccagct

SEQ ID NO: 5211464 - DNA, 16 bp, Homo sapiens
agggcccctgaagtga

SEQ ID NO: 5211465 - DNA, 23 bp, Homo sapiens
agggcccctgaagtgaccccagc

SEQ ID NO: 5211466 - DNA, 12 bp, Homo sapiens
agggcccctgcg

SEQ ID NO: 5211467 - DNA, 22 bp, Homo sapiens
agggcccctggatctcctccct

SEQ ID NO: 5211468 - DNA, 16 bp, Homo sapiens
agggcccggccacacc

SEQ ID NO: 5211469 - DNA, 19 bp, Homo sapiens
agggcccgggcacccacaa

SEQ ID NO: 5211470 - DNA, 16 bp, Homo sapiens
agggcccgggcccagg

SEQ ID NO: 5211471 - DNA, 13 bp, Homo sapiens
agggccctaggcc

SEQ ID NO: 5211472 - DNA, 19 bp, Homo sapiens
agggccctcagaggaaagg

SEQ ID NO: 5211473 - DNA, 16 bp, Homo sapiens
agggccctcccagccc

SEQ ID NO: 5211474 - DNA, 11 bp, Homo sapiens
agggccctctg

SEQ ID NO: 5211475 - DNA, 16 bp, Homo sapiens
agggccctctggggct

SEQ ID NO: 5211476 - DNA, 19 bp, Homo sapiens
agggccctgaaatggcctg

SEQ ID NO: 5211477 - DNA, 18 bp, Homo sapiens
agggccctgagctgaggg

SEQ ID NO: 5211478 - DNA, 13 bp, Homo sapiens
agggccctgagga

SEQ ID NO: 5211479 - DNA, 15 bp, Homo sapiens
agggccctgaggaat

SEQ ID NO: 5211480 - DNA, 22 bp, Homo sapiens
agggccctgaggaataaagctt

SEQ ID NO: 5211481 - DNA, 15 bp, Homo sapiens
agggccctgccccag

SEQ ID NO: 5211482 - DNA, 20 bp, Homo sapiens
agggccctgccccaggcctg

SEQ ID NO: 5211483 - DNA, 20 bp, Homo sapiens
agggccctgctcaggcctca

SEQ ID NO: 5211484 - DNA, 12 bp, Homo sapiens
agggccctggag

SEQ ID NO: 5211485 - DNA, 14 bp, Homo sapiens
agggccctggccag

SEQ ID NO: 5211486 - DNA, 17 bp, Homo sapiens
agggccctggccagccg

SEQ ID NO: 5211487 - DNA, 18 bp, Homo sapiens
agggccctgggcctgcct

SEQ ID NO: 5211488 - DNA, 23 bp, Homo sapiens
agggccctggggtctctgagcag

SEQ ID NO: 5211489 - DNA, 13 bp, Homo sapiens
agggccctggtgt

SEQ ID NO: 5211490 - DNA, 14 bp, Homo sapiens
agggccctgtggag

SEQ ID NO: 5211491 - DNA, 19 bp, Homo sapiens
agggccctgtggagtccag

SEQ ID NO: 5211492 - DNA, 21 bp, Homo sapiens
agggccctgtggagtccagct

SEQ ID NO: 5211493 - DNA, 22 bp, Homo sapiens
agggccctgtggctccaggagc

SEQ ID NO: 5211494 - DNA, 20 bp, Homo sapiens
agggcccttcccaacctccc

SEQ ID NO: 5211495 - DNA, 17 bp, Homo sapiens
agggcccttcccctccc

SEQ ID NO: 5211496 - DNA, 17 bp, Homo sapiens
agggccctttttcaata

SEQ ID NO: 5211497 - DNA, 22 bp, Homo sapiens
agggccgaccagaggagccttt

SEQ ID NO: 5211498 - DNA, 14 bp, Homo sapiens
agggccgagacagg

SEQ ID NO: 5211499 - DNA, 20 bp, Homo sapiens
agggccgaggaggtgcctgg

SEQ ID NO: 5211500 - DNA, 15 bp, Homo sapiens
agggccgagtgagag

SEQ ID NO: 5211501 - DNA, 20 bp, Homo sapiens
agggccgccagggagacctg

SEQ ID NO: 5211502 - DNA, 14 bp, Homo sapiens
agggccgcctgcct

SEQ ID NO: 5211503 - DNA, 15 bp, Homo sapiens
agggccgcgagaggc

SEQ ID NO: 5211504 - DNA, 16 bp, Homo sapiens
agggccgcttctcctg

SEQ ID NO: 5211505 - DNA, 16 bp, Homo sapiens
agggccggcggctctg

SEQ ID NO: 5211506 - DNA, 21 bp, Homo sapiens
agggccggcggctctgagcag

SEQ ID NO: 5211507 - DNA, 22 bp, Homo sapiens
agggccggcggctctgagcagg

SEQ ID NO: 5211508 - DNA, 14 bp, Homo sapiens
agggccgggcaggg

SEQ ID NO: 5211509 - DNA, 19 bp, Homo sapiens
agggccggggaactggcca

SEQ ID NO: 5211510 - DNA, 23 bp, Homo sapiens
agggccggggaactggccaagct

SEQ ID NO: 5211511 - DNA, 14 bp, Homo sapiens
agggccggggatgg

SEQ ID NO: 5211512 - DNA, 18 bp, Homo sapiens
agggccggggatggatct

SEQ ID NO: 5211513 - DNA, 16 bp, Homo sapiens
agggccgtaccccacc

SEQ ID NO: 5211514 - DNA, 14 bp, Homo sapiens
agggccgtcaagga

SEQ ID NO: 5211515 - DNA, 22 bp, Homo sapiens
agggccgtgcccttgcccttgg

SEQ ID NO: 5211516 - DNA, 16 bp, Homo sapiens
agggcctactgccacc

SEQ ID NO: 5211517 - DNA, 19 bp, Homo sapiens
agggcctagctgctacaaa

SEQ ID NO: 5211518 - DNA, 17 bp, Homo sapiens
agggcctcacctttccc

SEQ ID NO: 5211519 - DNA, 20 bp, Homo sapiens
agggcctcactctgttgctc

SEQ ID NO: 5211520 - DNA, 14 bp, Homo sapiens
agggcctcagagcc

SEQ ID NO: 5211521 - DNA, 15 bp, Homo sapiens
agggcctcagagcct

SEQ ID NO: 5211522 - DNA, 17 bp, Homo sapiens
agggcctcagagcctga

SEQ ID NO: 5211523 - DNA, 21 bp, Homo sapiens
agggcctcagagcctgacctg

SEQ ID NO: 5211524 - DNA, 15 bp, Homo sapiens
agggcctccagccct

SEQ ID NO: 5211525 - DNA, 12 bp, Homo sapiens
agggcctccagg

SEQ ID NO: 5211526 - DNA, 13 bp, Homo sapiens
agggcctccagga

SEQ ID NO: 5211527 - DNA, 14 bp, Homo sapiens
agggcctccagggc

SEQ ID NO: 5211528 - DNA, 12 bp, Homo sapiens
agggcctcccag

SEQ ID NO: 5211529 - DNA, 17 bp, Homo sapiens
agggcctcccagccccc

SEQ ID NO: 5211530 - DNA, 20 bp, Homo sapiens
agggcctcccagcccccaac

SEQ ID NO: 5211531 - DNA, 15 bp, Homo sapiens
agggcctccctgttc

SEQ ID NO: 5211532 - DNA, 18 bp, Homo sapiens
agggcctcggaggctcct

SEQ ID NO: 5211533 - DNA, 19 bp, Homo sapiens
agggcctcggaggctcctc

SEQ ID NO: 5211534 - DNA, 21 bp, Homo sapiens
agggcctctccttggaaggtc

SEQ ID NO: 5211535 - DNA, 12 bp, Homo sapiens
agggcctctgga

SEQ ID NO: 5211536 - DNA, 17 bp, Homo sapiens
agggcctctggcttccc

SEQ ID NO: 5211537 - DNA, 22 bp, Homo sapiens
agggcctctggcttccctgccc

SEQ ID NO: 5211538 - DNA, 23 bp, Homo sapiens
agggcctctggcttccctgccca

SEQ ID NO: 5211539 - DNA, 20 bp, Homo sapiens
agggcctctggtgttcctgg

SEQ ID NO: 5211540 - DNA, 21 bp, Homo sapiens
agggcctctggtgttcctggc

SEQ ID NO: 5211541 - DNA, 21 bp, Homo sapiens
agggcctctgtcaattgtacg

SEQ ID NO: 5211542 - DNA, 22 bp, Homo sapiens
agggcctgaaacccgccctcag

SEQ ID NO: 5211543 - DNA, 17 bp, Homo sapiens
agggcctgacaccccct

SEQ ID NO: 5211544 - DNA, 20 bp, Homo sapiens
agggcctgacaccccctccc

SEQ ID NO: 5211545 - DNA, 12 bp, Homo sapiens
agggcctgactc

SEQ ID NO: 5211546 - DNA, 17 bp, Homo sapiens
agggcctgacttgagcc

SEQ ID NO: 5211547 - DNA, 20 bp, Homo sapiens
agggcctgacttgagccact

SEQ ID NO: 5211548 - DNA, 15 bp, Homo sapiens
agggcctgagcctgg

SEQ ID NO: 5211549 - DNA, 18 bp, Homo sapiens
agggcctgagcctggcca

SEQ ID NO: 5211550 - DNA, 20 bp, Homo sapiens
agggcctgagcctggccagc

SEQ ID NO: 5211551 - DNA, 16 bp, Homo sapiens
agggcctgaggtctgg

SEQ ID NO: 5211552 - DNA, 23 bp, Homo sapiens
agggcctgagtgctttaccttta

SEQ ID NO: 5211553 - DNA, 19 bp, Homo sapiens
agggcctgatggggtggaa

SEQ ID NO: 5211554 - DNA, 20 bp, Homo sapiens
agggcctgcaggacctgcct

SEQ ID NO: 5211555 - DNA, 19 bp, Homo sapiens
agggcctgcatggagaagg

SEQ ID NO: 5211556 - DNA, 23 bp, Homo sapiens
agggcctgcatggagaagggttc

SEQ ID NO: 5211557 - DNA, 14 bp, Homo sapiens
agggcctgccccct

SEQ ID NO: 5211558 - DNA, 17 bp, Homo sapiens
agggcctgccccctggg

SEQ ID NO: 5211559 - DNA, 19 bp, Homo sapiens
agggcctgccccctgggga

SEQ ID NO: 5211560 - DNA, 11 bp, Homo sapiens
agggcctgctc

SEQ ID NO: 5211561 - DNA, 15 bp, Homo sapiens
agggcctgctctgct

SEQ ID NO: 5211562 - DNA, 16 bp, Homo sapiens
agggcctgctctgctt

SEQ ID NO: 5211563 - DNA, 21 bp, Homo sapiens
agggcctgctgagttgcttct

SEQ ID NO: 5211564 - DNA, 14 bp, Homo sapiens
agggcctgctggag

SEQ ID NO: 5211565 - DNA, 18 bp, Homo sapiens
agggcctgctggaggcct

SEQ ID NO: 5211566 - DNA, 12 bp, Homo sapiens
agggcctggacg

SEQ ID NO: 5211567 - DNA, 13 bp, Homo sapiens
agggcctggagcc

SEQ ID NO: 5211568 - DNA, 14 bp, Homo sapiens
agggcctggagccc

SEQ ID NO: 5211569 - DNA, 15 bp, Homo sapiens
agggcctggcaggcc

SEQ ID NO: 5211570 - DNA, 23 bp, Homo sapiens
agggcctggcaggccagtgtctg

SEQ ID NO: 5211571 - DNA, 12 bp, Homo sapiens
agggcctggcat

SEQ ID NO: 5211572 - DNA, 13 bp, Homo sapiens
agggcctggccca

SEQ ID NO: 5211573 - DNA, 14 bp, Homo sapiens
agggcctggcctga

SEQ ID NO: 5211574 - DNA, 16 bp, Homo sapiens
agggcctggcctgagc

SEQ ID NO: 5211575 - DNA, 17 bp, Homo sapiens
agggcctggcctgagct

SEQ ID NO: 5211576 - DNA, 18 bp, Homo sapiens
agggcctggctcaggtgg

SEQ ID NO: 5211577 - DNA, 14 bp, Homo sapiens
aggcaatgccctgc

SEQ ID NO: 5211578 - DNA, 21 bp, Homo sapiens
aggcaatgctcaaacacccaa

SEQ ID NO: 5211579 - DNA, 17 bp, Homo sapiens
aggcaatgtcaggaaca

SEQ ID NO: 5211580 - DNA, 17 bp, Homo sapiens
aggcaattagagaaagt

SEQ ID NO: 5211581 - DNA, 14 bp, Homo sapiens
aggcaattctcctg

SEQ ID NO: 5211582 - DNA, 20 bp, Homo sapiens
aggcaattttagtgtattaa

SEQ ID NO: 5211583 - DNA, 21 bp, Homo sapiens
aggcaatttttacaacctgag

SEQ ID NO: 5211584 - DNA, 22 bp, Homo sapiens
aggcacaaaaccagaagtttct

SEQ ID NO: 5211585 - DNA, 16 bp, Homo sapiens
aggcacaaactctgca

SEQ ID NO: 5211586 - DNA, 20 bp, Homo sapiens
aggcacaaagggcaggcctg

SEQ ID NO: 5211587 - DNA, 20 bp, Homo sapiens
aggcacaacttcagcagggg

SEQ ID NO: 5211588 - DNA, 14 bp, Homo sapiens
aggcacacacagcc

SEQ ID NO: 5211589 - DNA, 15 bp, Homo sapiens
aggcacacacagccc

SEQ ID NO: 5211590 - DNA, 23 bp, Homo sapiens
aggcacacactgtgctttctatt

SEQ ID NO: 5211591 - DNA, 18 bp, Homo sapiens
aggcacacagatcccctg

SEQ ID NO: 5211592 - DNA, 14 bp, Homo sapiens
aggcacacagcagc

SEQ ID NO: 5211593 - DNA, 15 bp, Homo sapiens
aggcacacagcagcc

SEQ ID NO: 5211594 - DNA, 18 bp, Homo sapiens
aggcacacagcagccccc

SEQ ID NO: 5211595 - DNA, 20 bp, Homo sapiens
aggcacacagcagcccccca

SEQ ID NO: 5211596 - DNA, 18 bp, Homo sapiens
aggcacacagctgcagag

SEQ ID NO: 5211597 - DNA, 20 bp, Homo sapiens
aggcacacagggcccggcca

SEQ ID NO: 5211598 - DNA, 15 bp, Homo sapiens
aggcacacttcttct

SEQ ID NO: 5211599 - DNA, 16 bp, Homo sapiens
aggcacacttcttctt

SEQ ID NO: 5211600 - DNA, 13 bp, Homo sapiens
aggcacactttct

SEQ ID NO: 5211601 - DNA, 15 bp, Homo sapiens
aggcacactttctgg

SEQ ID NO: 5211602 - DNA, 12 bp, Homo sapiens
aggcacagagct

SEQ ID NO: 5211603 - DNA, 14 bp, Homo sapiens
aggcacagaggagg

SEQ ID NO: 5211604 - DNA, 12 bp, Homo sapiens
aggcacagcagt

SEQ ID NO: 5211605 - DNA, 14 bp, Homo sapiens
aggcacagctgagt

SEQ ID NO: 5211606 - DNA, 14 bp, Homo sapiens
aggcacaggcagga

SEQ ID NO: 5211607 - DNA, 18 bp, Homo sapiens
aggcacaggcaggaagag

SEQ ID NO: 5211608 - DNA, 20 bp, Homo sapiens
aggcacaggcaggaagagag

SEQ ID NO: 5211609 - DNA, 15 bp, Homo sapiens
aggcacagtgggagc

SEQ ID NO: 5211610 - DNA, 20 bp, Homo sapiens
aggcacagtgggagctgagc

SEQ ID NO: 5211611 - DNA, 22 bp, Homo sapiens
aggcacagtgggagctgagctg

SEQ ID NO: 5211612 - DNA, 13 bp, Homo sapiens
aggcacatggctg

SEQ ID NO: 5211613 - DNA, 16 bp, Homo sapiens
aggcacatgtcagcaa

SEQ ID NO: 5211614 - DNA, 14 bp, Homo sapiens
aggcacattaactg

SEQ ID NO: 5211615 - DNA, 15 bp, Homo sapiens
aggcacattaactgt

SEQ ID NO: 5211616 - DNA, 19 bp, Homo sapiens
aggcacattgaaatacttg

SEQ ID NO: 5211617 - DNA, 15 bp, Homo sapiens
aggcaccaccaggag

SEQ ID NO: 5211618 - DNA, 18 bp, Homo sapiens
aggcaccaccaggagcag

SEQ ID NO: 5211619 - DNA, 19 bp, Homo sapiens
aggcaccaccaggagcagc

SEQ ID NO: 5211620 - DNA, 22 bp, Homo sapiens
aggcaccaccaggagcagcagc

SEQ ID NO: 5211621 - DNA, 12 bp, Homo sapiens
aggcaccagcat

SEQ ID NO: 5211622 - DNA, 14 bp, Homo sapiens
aggcaccagcatcc

SEQ ID NO: 5211623 - DNA, 15 bp, Homo sapiens
aggcaccagcatcca

SEQ ID NO: 5211624 - DNA, 21 bp, Homo sapiens
aggcaccagctctgtggcctg

SEQ ID NO: 5211625 - DNA, 22 bp, Homo sapiens
aggcaccagctctgtggcctgt

SEQ ID NO: 5211626 - DNA, 15 bp, Homo sapiens
aggcaccagtccctg

SEQ ID NO: 5211627 - DNA, 20 bp, Homo sapiens
aggcaccagtgtcctcccct

SEQ ID NO: 5211628 - DNA, 16 bp, Homo sapiens
aggcaccatagaagaa

SEQ ID NO: 5211629 - DNA, 19 bp, Homo sapiens
aggcaccatagaagaacag

SEQ ID NO: 5211630 - DNA, 14 bp, Homo sapiens
aggcaccatctgcc

SEQ ID NO: 5211631 - DNA, 21 bp, Homo sapiens
aggcaccatctgccaatgcca

SEQ ID NO: 5211632 - DNA, 12 bp, Homo sapiens
aggcaccattca

SEQ ID NO: 5211633 - DNA, 22 bp, Homo sapiens
aggcacccaccaccatgcccag

SEQ ID NO: 5211634 - DNA, 14 bp, Homo sapiens
aggcacccccagaa

SEQ ID NO: 5211635 - DNA, 16 bp, Homo sapiens
aggcaccccctggaga

SEQ ID NO: 5211636 - DNA, 19 bp, Homo sapiens
aggcaccccctggagagaa

SEQ ID NO: 5211637 - DNA, 20 bp, Homo sapiens
aggcacccctccgtgtggag

SEQ ID NO: 5211638 - DNA, 23 bp, Homo sapiens
aggcacccctttccccagcctct

SEQ ID NO: 5211639 - DNA, 22 bp, Homo sapiens
aggcacccggggccagagacat

SEQ ID NO: 5211640 - DNA, 15 bp, Homo sapiens
aggcaccgcagcctg

SEQ ID NO: 5211641 - DNA, 20 bp, Homo sapiens
aggcaccgcagcctgtcagc

SEQ ID NO: 5211642 - DNA, 14 bp, Homo sapiens
aggcaccgccacgt

SEQ ID NO: 5211643 - DNA, 20 bp, Homo sapiens
aggcaccgccacgtcccagc

SEQ ID NO: 5211644 - DNA, 23 bp, Homo sapiens
aggcaccgccagagtgtcctgct

SEQ ID NO: 5211645 - DNA, 22 bp, Homo sapiens
aggcaccgctgggttctgactc

SEQ ID NO: 5211646 - DNA, 23 bp, Homo sapiens
aggcaccggacgctggagaccct

SEQ ID NO: 5211647 - DNA, 15 bp, Homo sapiens
aggcaccggcgctgc

SEQ ID NO: 5211648 - DNA, 12 bp, Homo sapiens
aggcacctcaag

SEQ ID NO: 5211649 - DNA, 19 bp, Homo sapiens
aggcacctcacagaaatga

SEQ ID NO: 5211650 - DNA, 20 bp, Homo sapiens
aggcacctcacaggccccag

SEQ ID NO: 5211651 - DNA, 12 bp, Homo sapiens
aggcacctccag

SEQ ID NO: 5211652 - DNA, 17 bp, Homo sapiens
aggcacctccaggcagg

SEQ ID NO: 5211653 - DNA, 23 bp, Homo sapiens
aggcacctccccgctctccctgt

SEQ ID NO: 5211654 - DNA, 14 bp, Homo sapiens
aggcacctcttcct

SEQ ID NO: 5211655 - DNA, 14 bp, Homo sapiens
aggcacctgcaggt

SEQ ID NO: 5211656 - DNA, 19 bp, Homo sapiens
aggcacctgcccccacagc

SEQ ID NO: 5211657 - DNA, 14 bp, Homo sapiens
aggcacctgctccc

SEQ ID NO: 5211658 - DNA, 16 bp, Homo sapiens
aggcacctgctggaaa

SEQ ID NO: 5211659 - DNA, 15 bp, Homo sapiens
aggcacctggcctgc

SEQ ID NO: 5211660 - DNA, 16 bp, Homo sapiens
aggcacctggcctgct

SEQ ID NO: 5211661 - DNA, 18 bp, Homo sapiens
aggcacctggcctgctgg

SEQ ID NO: 5211662 - DNA, 21 bp, Homo sapiens
aggcacctggtggccatgctc

SEQ ID NO: 5211663 - DNA, 16 bp, Homo sapiens
aggcaccttaactgga

SEQ ID NO: 5211664 - DNA, 19 bp, Homo sapiens
aggcaccttagtggctttt

SEQ ID NO: 5211665 - DNA, 15 bp, Homo sapiens
aggcacgaagcaatt

SEQ ID NO: 5211666 - DNA, 17 bp, Homo sapiens
aggcacgggtggtcccc

SEQ ID NO: 5211667 - DNA, 15 bp, Homo sapiens
aggcacgtctcctgc

SEQ ID NO: 5211668 - DNA, 20 bp, Homo sapiens
aggcactaagtcatggtcct

SEQ ID NO: 5211669 - DNA, 15 bp, Homo sapiens
aggcactagcctttg

SEQ ID NO: 5211670 - DNA, 15 bp, Homo sapiens
aggcactcagtgagc

SEQ ID NO: 5211671 - DNA, 19 bp, Homo sapiens
aggcactcagtgagcctcc

SEQ ID NO: 5211672 - DNA, 14 bp, Homo sapiens
aggcactctagatt

SEQ ID NO: 5211673 - DNA, 15 bp, Homo sapiens
aggcactctagattc

SEQ ID NO: 5211674 - DNA, 20 bp, Homo sapiens
aggcactctgttatttagac

SEQ ID NO: 5211675 - DNA, 18 bp, Homo sapiens
aggcactgaacaggctgg

SEQ ID NO: 5211676 - DNA, 11 bp, Homo sapiens
aggcactgaag

SEQ ID NO: 5211677 - DNA, 15 bp, Homo sapiens
aggcactgaccctcg

SEQ ID NO: 5211678 - DNA, 16 bp, Homo sapiens
aggcactgagcaggga

SEQ ID NO: 5211679 - DNA, 19 bp, Homo sapiens
aggcactgagcagggatct

SEQ ID NO: 5211680 - DNA, 12 bp, Homo sapiens
aggcactgagcg

SEQ ID NO: 5211681 - DNA, 19 bp, Homo sapiens
aggcactgagggatctgag

SEQ ID NO: 5211682 - DNA, 19 bp, Homo sapiens
aggcactgcaaaccgccac

SEQ ID NO: 5211683 - DNA, 15 bp, Homo sapiens
aggcactgccctggt

SEQ ID NO: 5211684 - DNA, 14 bp, Homo sapiens
aggcactgcctgat

SEQ ID NO: 5211685 - DNA, 20 bp, Homo sapiens
aggcactgccttctcctctc

SEQ ID NO: 5211686 - DNA, 14 bp, Homo sapiens
aggcactgctgccc

SEQ ID NO: 5211687 - DNA, 16 bp, Homo sapiens
aggcactgggcatgag

SEQ ID NO: 5211688 - DNA, 14 bp, Homo sapiens
aggcactgggctcc

SEQ ID NO: 5211689 - DNA, 23 bp, Homo sapiens
aggcactgggggcagcgggggcc

SEQ ID NO: 5211690 - DNA, 16 bp, Homo sapiens
aggcactgtactaggc

SEQ ID NO: 5211691 - DNA, 18 bp, Homo sapiens
aggcactgtggcccttct

SEQ ID NO: 5211692 - DNA, 19 bp, Homo sapiens
aggcactgtggcccttctg

SEQ ID NO: 5211693 - DNA, 16 bp, Homo sapiens
aggcacttaagcacaa

SEQ ID NO: 5211694 - DNA, 20 bp, Homo sapiens
aggcacttatcgaagctgat

SEQ ID NO: 5211695 - DNA, 14 bp, Homo sapiens
aggcacttattgta

SEQ ID NO: 5211696 - DNA, 19 bp, Homo sapiens
aggcacttgagggggaagg

SEQ ID NO: 5211697 - DNA, 15 bp, Homo sapiens
aggcacttggcagcc

SEQ ID NO: 5211698 - DNA, 18 bp, Homo sapiens
aggcacttggcagccttg

SEQ ID NO: 5211699 - DNA, 21 bp, Homo sapiens
aggcacttgtcactatgctat

SEQ ID NO: 5211700 - DNA, 15 bp, Homo sapiens
aggcactttaaaaca

SEQ ID NO: 5211701 - DNA, 15 bp, Homo sapiens
aggcactttagaaat

SEQ ID NO: 5211702 - DNA, 22 bp, Homo sapiens
aggcactttagggctgtaaaat

SEQ ID NO: 5211703 - DNA, 14 bp, Homo sapiens
aggcactttggggg

SEQ ID NO: 5211704 - DNA, 22 bp, Homo sapiens
aggcactttgggggtttgaggg

SEQ ID NO: 5211705 - DNA, 18 bp, Homo sapiens
aggcacttttattttcat

SEQ ID NO: 5211706 - DNA, 15 bp, Homo sapiens
aggcactttttaaca

SEQ ID NO: 5211707 - DNA, 19 bp, Homo sapiens
aggcactttttaacattct

SEQ ID NO: 5211708 - DNA, 23 bp, Homo sapiens
aggcactttttaacattctcaat

SEQ ID NO: 5211709 - DNA, 12 bp, Homo sapiens
aggcagaaagat

SEQ ID NO: 5211710 - DNA, 24 bp, Homo sapiens
aggcagaaagatacagacattcaa

SEQ ID NO: 5211711 - DNA, 20 bp, Homo sapiens
aggcagaaagatttggaaaa

SEQ ID NO: 5211712 - DNA, 14 bp, Homo sapiens
aggcagaaagcaaa

SEQ ID NO: 5211713 - DNA, 18 bp, Homo sapiens
aggcagaaagcagaggct

SEQ ID NO: 5211714 - DNA, 23 bp, Homo sapiens
aggcagaaagcagaggctggcct

SEQ ID NO: 5211715 - DNA, 15 bp, Homo sapiens
aggcagaaagggaaa

SEQ ID NO: 5211716 - DNA, 20 bp, Homo sapiens
aggcagaaatataaacacat

SEQ ID NO: 5211717 - DNA, 21 bp, Homo sapiens
aggcagaaccggtcccagcct

SEQ ID NO: 5211718 - DNA, 17 bp, Homo sapiens
aggcagaacctggtggc

SEQ ID NO: 5211719 - DNA, 22 bp, Homo sapiens
aggcagaactcatctaggtaaa

SEQ ID NO: 5211720 - DNA, 13 bp, Homo sapiens
aggcagaagaatc

SEQ ID NO: 5211721 - DNA, 15 bp, Homo sapiens
aggcagaagaattga

SEQ ID NO: 5211722 - DNA, 21 bp, Homo sapiens
aggcagaagaattgaacccag

SEQ ID NO: 5211723 - DNA, 22 bp, Homo sapiens
aggcagaagaattgaacccagg

SEQ ID NO: 5211724 - DNA, 23 bp, Homo sapiens
aggcagaagaattgaacccagga

SEQ ID NO: 5211725 - DNA, 16 bp, Homo sapiens
aggcagaatggctgca

SEQ ID NO: 5211726 - DNA, 18 bp, Homo sapiens
aggcagaatggctgcacg

SEQ ID NO: 5211727 - DNA, 14 bp, Homo sapiens
aggcagaatggtgg

SEQ ID NO: 5211728 - DNA, 20 bp, Homo sapiens
aggcagaatggtgggctcca

SEQ ID NO: 5211729 - DNA, 11 bp, Homo sapiens
aggcagacaca

SEQ ID NO: 5211730 - DNA, 21 bp, Homo sapiens
aggcagacacaccgcggccag

SEQ ID NO: 5211731 - DNA, 22 bp, Homo sapiens
aggcagacacaccgcggccagg

SEQ ID NO: 5211732 - DNA, 21 bp, Homo sapiens
aggcagacacagggacttgaa

SEQ ID NO: 5211733 - DNA, 18 bp, Homo sapiens
aggcagacacggatctga

SEQ ID NO: 5211734 - DNA, 13 bp, Homo sapiens
aggcagacagcag

SEQ ID NO: 5211735 - DNA, 19 bp, Homo sapiens
aggcagacagcagctcagg

SEQ ID NO: 5211736 - DNA, 15 bp, Homo sapiens
aggcagacagcaggc

SEQ ID NO: 5211737 - DNA, 22 bp, Homo sapiens
aggcagacagcaggcagcgcca

SEQ ID NO: 5211738 - DNA, 23 bp, Homo sapiens
aggcagacagcaggcagcgccaa

SEQ ID NO: 5211739 - DNA, 13 bp, Homo sapiens
aggcagacaggaa

SEQ ID NO: 5211740 - DNA, 16 bp, Homo sapiens
aggcagacgatgtcaa

SEQ ID NO: 5211741 - DNA, 21 bp, Homo sapiens
aggcagacgtctgtcaggggc

SEQ ID NO: 5211742 - DNA, 19 bp, Homo sapiens
aggcagacgtggggagggt

SEQ ID NO: 5211743 - DNA, 14 bp, Homo sapiens
aggcagactcgagg

SEQ ID NO: 5211744 - DNA, 20 bp, Homo sapiens
aggcagagaaaacacacgct

SEQ ID NO: 5211745 - DNA, 19 bp, Homo sapiens
aggcagagaaagaagagac

SEQ ID NO: 5211746 - DNA, 13 bp, Homo sapiens
aggcagagaaatc

SEQ ID NO: 5211747 - DNA, 18 bp, Homo sapiens
aggcagagaacagaactg

SEQ ID NO: 5211748 - DNA, 16 bp, Homo sapiens
aggcagagaatctctt

SEQ ID NO: 5211749 - DNA, 14 bp, Homo sapiens
aggcagagacaata

SEQ ID NO: 5211750 - DNA, 20 bp, Homo sapiens
aggcagagacaataaaacat

SEQ ID NO: 5211751 - DNA, 14 bp, Homo sapiens
aggcagagagggtc

SEQ ID NO: 5211752 - DNA, 20 bp, Homo sapiens
aggcagagagtacagactgc

SEQ ID NO: 5211753 - DNA, 21 bp, Homo sapiens
aggcagagagtacagactgca

SEQ ID NO: 5211754 - DNA, 22 bp, Homo sapiens
aggcagagattgggggggcttg

SEQ ID NO: 5211755 - DNA, 23 bp, Homo sapiens
aggcagagattgggggggcttgg

SEQ ID NO: 5211756 - DNA, 16 bp, Homo sapiens
agggcctgggcctggc

SEQ ID NO: 5211757 - DNA, 20 bp, Homo sapiens
agggcctggggcctgagaga

SEQ ID NO: 5211758 - DNA, 22 bp, Homo sapiens
agggcctgggttttcatgtttt

SEQ ID NO: 5211759 - DNA, 21 bp, Homo sapiens
agggcctggtccctgggagga

SEQ ID NO: 5211760 - DNA, 13 bp, Homo sapiens
agggcctgtctcc

SEQ ID NO: 5211761 - DNA, 19 bp, Homo sapiens
agggcctgtgggagcctgc

SEQ ID NO: 5211762 - DNA, 16 bp, Homo sapiens
agggccttaaaagcca

SEQ ID NO: 5211763 - DNA, 17 bp, Homo sapiens
agggccttaaaagccat

SEQ ID NO: 5211764 - DNA, 18 bp, Homo sapiens
agggccttaaaagccatc

SEQ ID NO: 5211765 - DNA, 23 bp, Homo sapiens
agggccttaaaagccatcatgta

SEQ ID NO: 5211766 - DNA, 15 bp, Homo sapiens
agggccttctgcctg

SEQ ID NO: 5211767 - DNA, 16 bp, Homo sapiens
agggccttctgcctgc

SEQ ID NO: 5211768 - DNA, 17 bp, Homo sapiens
agggccttgagcatctg

SEQ ID NO: 5211769 - DNA, 22 bp, Homo sapiens
agggccttgatttccagccgca

SEQ ID NO: 5211770 - DNA, 18 bp, Homo sapiens
agggccttgcccagagat

SEQ ID NO: 5211771 - DNA, 14 bp, Homo sapiens
agggccttgcttct

SEQ ID NO: 5211772 - DNA, 15 bp, Homo sapiens
agggccttggcccag

SEQ ID NO: 5211773 - DNA, 15 bp, Homo sapiens
agggcctttctcctc

SEQ ID NO: 5211774 - DNA, 16 bp, Homo sapiens
agggccttttgtggat

SEQ ID NO: 5211775 - DNA, 18 bp, Homo sapiens
agggcgacgtcttcagag

SEQ ID NO: 5211776 - DNA, 19 bp, Homo sapiens
agggcgagactctgtctca

SEQ ID NO: 5211777 - DNA, 15 bp, Homo sapiens
agggcgagctgcagg

SEQ ID NO: 5211778 - DNA, 21 bp, Homo sapiens
agggcgaggcgggggagcctg

SEQ ID NO: 5211779 - DNA, 22 bp, Homo sapiens
agggcgaggcgggggagcctgg

SEQ ID NO: 5211780 - DNA, 22 bp, Homo sapiens
agggcgaggcgggggatcctgg

SEQ ID NO: 5211781 - DNA, 19 bp, Homo sapiens
agggcgcaggaaccgagga

SEQ ID NO: 5211782 - DNA, 13 bp, Homo sapiens
agggcgcaggccg

SEQ ID NO: 5211783 - DNA, 13 bp, Homo sapiens
agggcgccaagtc

SEQ ID NO: 5211784 - DNA, 14 bp, Homo sapiens
agggcgccagggtg

SEQ ID NO: 5211785 - DNA, 19 bp, Homo sapiens
agggcgcccagcagcctgc

SEQ ID NO: 5211786 - DNA, 14 bp, Homo sapiens
agggcgcccagccc

SEQ ID NO: 5211787 - DNA, 17 bp, Homo sapiens
agggcgcccagcccagg

SEQ ID NO: 5211788 - DNA, 15 bp, Homo sapiens
agggcgcccagcgcc

SEQ ID NO: 5211789 - DNA, 22 bp, Homo sapiens
agggcgcccattcgtctgtccc

SEQ ID NO: 5211790 - DNA, 23 bp, Homo sapiens
agggcgcccattcgtctgtccca

SEQ ID NO: 5211791 - DNA, 15 bp, Homo sapiens
agggcgcccctggga

SEQ ID NO: 5211792 - DNA, 14 bp, Homo sapiens
agggcgcctgggtc

SEQ ID NO: 5211793 - DNA, 15 bp, Homo sapiens
agggcgctcagacgg

SEQ ID NO: 5211794 - DNA, 20 bp, Homo sapiens
agggcgctcagacggcggcc

SEQ ID NO: 5211795 - DNA, 21 bp, Homo sapiens
agggcgctcagacggcggcca

SEQ ID NO: 5211796 - DNA, 16 bp, Homo sapiens
agggcgctccggcaga

SEQ ID NO: 5211797 - DNA, 23 bp, Homo sapiens
agggcgctccggcagaggcaggg

SEQ ID NO: 5211798 - DNA, 15 bp, Homo sapiens
agggcgctgagggca

SEQ ID NO: 5211799 - DNA, 12 bp, Homo sapiens
agggcggaagag

SEQ ID NO: 5211800 - DNA, 13 bp, Homo sapiens
agggcggcactca

SEQ ID NO: 5211801 - DNA, 23 bp, Homo sapiens
agggcggcaggggcctggagatc

SEQ ID NO: 5211802 - DNA, 14 bp, Homo sapiens
agggcggccaggga

SEQ ID NO: 5211803 - DNA, 15 bp, Homo sapiens
agggcggccagggac

SEQ ID NO: 5211804 - DNA, 17 bp, Homo sapiens
agggcggccagggacag

SEQ ID NO: 5211805 - DNA, 18 bp, Homo sapiens
agggcggccagggacaga

SEQ ID NO: 5211806 - DNA, 20 bp, Homo sapiens
agggcggcccctctgttctg

SEQ ID NO: 5211807 - DNA, 12 bp, Homo sapiens
agggcggctgcc

SEQ ID NO: 5211808 - DNA, 15 bp, Homo sapiens
agggcgggcaaggag

SEQ ID NO: 5211809 - DNA, 19 bp, Homo sapiens
agggcgggcagagggctgg

SEQ ID NO: 5211810 - DNA, 14 bp, Homo sapiens
agggcgggccagga

SEQ ID NO: 5211811 - DNA, 12 bp, Homo sapiens
agggcgggcctg

SEQ ID NO: 5211812 - DNA, 23 bp, Homo sapiens
agggcggggcacagattggagag

SEQ ID NO: 5211813 - DNA, 21 bp, Homo sapiens
agggcggggctggccagctgt

SEQ ID NO: 5211814 - DNA, 17 bp, Homo sapiens
agggcgggggtggcggc

SEQ ID NO: 5211815 - DNA, 15 bp, Homo sapiens
agggcgtcaggcaga

SEQ ID NO: 5211816 - DNA, 13 bp, Homo sapiens
agggcgtcctctc

SEQ ID NO: 5211817 - DNA, 21 bp, Homo sapiens
agggcgtcgctggacaaccca

SEQ ID NO: 5211818 - DNA, 22 bp, Homo sapiens
agggcgtcgctggacaacccag

SEQ ID NO: 5211819 - DNA, 23 bp, Homo sapiens
agggcgtcgctggacaacccaga

SEQ ID NO: 5211820 - DNA, 15 bp, Homo sapiens
agggcgtgactcacc

SEQ ID NO: 5211821 - DNA, 19 bp, Homo sapiens
agggcgtggaaaggggcag

SEQ ID NO: 5211822 - DNA, 14 bp, Homo sapiens
agggcgtggctctg

SEQ ID NO: 5211823 - DNA, 17 bp, Homo sapiens
agggcgtggctctgggt

SEQ ID NO: 5211824 - DNA, 14 bp, Homo sapiens
agggcgtgggagcg

SEQ ID NO: 5211825 - DNA, 22 bp, Homo sapiens
agggcgtgggcatgggcgcaga

SEQ ID NO: 5211826 - DNA, 19 bp, Homo sapiens
agggcgtgtggtttccctg

SEQ ID NO: 5211827 - DNA, 20 bp, Homo sapiens
agggcgtgtggtttccctgc

SEQ ID NO: 5211828 - DNA, 21 bp, Homo sapiens
agggctaaaaaggtcctgtaa

SEQ ID NO: 5211829 - DNA, 22 bp, Homo sapiens
agggctaaaaaggtcctgtaag

SEQ ID NO: 5211830 - DNA, 15 bp, Homo sapiens
agggctaaataaaga

SEQ ID NO: 5211831 - DNA, 19 bp, Homo sapiens
agggctaaataaagaggag

SEQ ID NO: 5211832 - DNA, 13 bp, Homo sapiens
agggctaagagct

SEQ ID NO: 5211833 - DNA, 20 bp, Homo sapiens
agggctaaggcctcttgctg

SEQ ID NO: 5211834 - DNA, 13 bp, Homo sapiens
agggctaattaga

SEQ ID NO: 5211835 - DNA, 22 bp, Homo sapiens
agggctaattatatattttgtt

SEQ ID NO: 5211836 - DNA, 14 bp, Homo sapiens
agggctacacagac

SEQ ID NO: 5211837 - DNA, 19 bp, Homo sapiens
agggctaccctcccccagg

SEQ ID NO: 5211838 - DNA, 22 bp, Homo sapiens
agggctaccctgagctgaggca

SEQ ID NO: 5211839 - DNA, 21 bp, Homo sapiens
agggctactgcagctttacat

SEQ ID NO: 5211840 - DNA, 17 bp, Homo sapiens
agggctagaacctggaa

SEQ ID NO: 5211841 - DNA, 22 bp, Homo sapiens
agggctagaacctggagggcta

SEQ ID NO: 5211842 - DNA, 23 bp, Homo sapiens
agggctagaacctggaggggcta

SEQ ID NO: 5211843 - DNA, 18 bp, Homo sapiens
agggctagaactggagag

SEQ ID NO: 5211844 - DNA, 18 bp, Homo sapiens
agggctagaatctggaga

SEQ ID NO: 5211845 - DNA, 16 bp, Homo sapiens
agggctagcatccctg

SEQ ID NO: 5211846 - DNA, 17 bp, Homo sapiens
agggctagccctgagcc

SEQ ID NO: 5211847 - DNA, 22 bp, Homo sapiens
agggctagccctgagcccggcc

SEQ ID NO: 5211848 - DNA, 15 bp, Homo sapiens
agggctaggaatata

SEQ ID NO: 5211849 - DNA, 20 bp, Homo sapiens
agggctagggaggtggggta

SEQ ID NO: 5211850 - DNA, 18 bp, Homo sapiens
agggctagtagaactgga

SEQ ID NO: 5211851 - DNA, 20 bp, Homo sapiens
agggctagtagaactggatc

SEQ ID NO: 5211852 - DNA, 23 bp, Homo sapiens
agggctagtcttcccttacctca

SEQ ID NO: 5211853 - DNA, 24 bp, Homo sapiens
agggctagtgacttgtgtcccatg

SEQ ID NO: 5211854 - DNA, 15 bp, Homo sapiens
agggctatggtgtgg

SEQ ID NO: 5211855 - DNA, 14 bp, Homo sapiens
agggctcaacactg

SEQ ID NO: 5211856 - DNA, 24 bp, Homo sapiens
agggctcaatctctgggggctgag

SEQ ID NO: 5211857 - DNA, 17 bp, Homo sapiens
agggctcacactcctgg

SEQ ID NO: 5211858 - DNA, 14 bp, Homo sapiens
agggctcacagggc

SEQ ID NO: 5211859 - DNA, 16 bp, Homo sapiens
agggctcacagggcag

SEQ ID NO: 5211860 - DNA, 17 bp, Homo sapiens
agggctcaccagctggg

SEQ ID NO: 5211861 - DNA, 14 bp, Homo sapiens
agggctcagaagag

SEQ ID NO: 5211862 - DNA, 15 bp, Homo sapiens
agggctcagaagagc

SEQ ID NO: 5211863 - DNA, 16 bp, Homo sapiens
agggctcagaagagca

SEQ ID NO: 5211864 - DNA, 17 bp, Homo sapiens
agggctcagagaggaca

SEQ ID NO: 5211865 - DNA, 14 bp, Homo sapiens
agggctcagagctg

SEQ ID NO: 5211866 - DNA, 22 bp, Homo sapiens
agggctcagagtgaccctcagc

SEQ ID NO: 5211867 - DNA, 23 bp, Homo sapiens
agggctcagatggggcctgggct

SEQ ID NO: 5211868 - DNA, 24 bp, Homo sapiens
agggctcaggatttcgtgggtctg

SEQ ID NO: 5211869 - DNA, 14 bp, Homo sapiens
agggctcagggcag

SEQ ID NO: 5211870 - DNA, 13 bp, Homo sapiens
agggctcatgatt

SEQ ID NO: 5211871 - DNA, 17 bp, Homo sapiens
agggctccacgggggcc

SEQ ID NO: 5211872 - DNA, 20 bp, Homo sapiens
agggctccacgggggcctag

SEQ ID NO: 5211873 - DNA, 20 bp, Homo sapiens
agggctccagacacatgtcc

SEQ ID NO: 5211874 - DNA, 18 bp, Homo sapiens
agggctccagcatccagc

SEQ ID NO: 5211875 - DNA, 14 bp, Homo sapiens
agggctccagcccc

SEQ ID NO: 5211876 - DNA, 15 bp, Homo sapiens
agggctccagcccct

SEQ ID NO: 5211877 - DNA, 20 bp, Homo sapiens
agggctccagcccctcttgg

SEQ ID NO: 5211878 - DNA, 13 bp, Homo sapiens
agggctccagcct

SEQ ID NO: 5211879 - DNA, 15 bp, Homo sapiens
agggctccagcctgt

SEQ ID NO: 5211880 - DNA, 12 bp, Homo sapiens
agggctcccatg

SEQ ID NO: 5211881 - DNA, 16 bp, Homo sapiens
agggctccctcctgga

SEQ ID NO: 5211882 - DNA, 15 bp, Homo sapiens
agggctccctgccct

SEQ ID NO: 5211883 - DNA, 23 bp, Homo sapiens
agggctcccttatgtccaccact

SEQ ID NO: 5211884 - DNA, 19 bp, Homo sapiens
agggctccgaggagctggg

SEQ ID NO: 5211885 - DNA, 11 bp, Homo sapiens
agggctcctcc

SEQ ID NO: 5211886 - DNA, 15 bp, Homo sapiens
agggctcctccatgg

SEQ ID NO: 5211887 - DNA, 12 bp, Homo sapiens
agggctcctccc

SEQ ID NO: 5211888 - DNA, 17 bp, Homo sapiens
agggctcctccctggag

SEQ ID NO: 5211889 - DNA, 19 bp, Homo sapiens
agggctcctccctggagct

SEQ ID NO: 5211890 - DNA, 19 bp, Homo sapiens
agggctcctctccagtctg

SEQ ID NO: 5211891 - DNA, 11 bp, Homo sapiens
agggctcctgc

SEQ ID NO: 5211892 - DNA, 14 bp, Homo sapiens
agggctcctggggc

SEQ ID NO: 5211893 - DNA, 15 bp, Homo sapiens
agggctcctggggca

SEQ ID NO: 5211894 - DNA, 17 bp, Homo sapiens
agggctcctggggcaga

SEQ ID NO: 5211895 - DNA, 18 bp, Homo sapiens
agggctcgaggggtgggc

SEQ ID NO: 5211896 - DNA, 23 bp, Homo sapiens
agggctcgggcgctgtggctcct

SEQ ID NO: 5211897 - DNA, 13 bp, Homo sapiens
agggctctccaag

SEQ ID NO: 5211898 - DNA, 14 bp, Homo sapiens
agggctctccaagc

SEQ ID NO: 5211899 - DNA, 12 bp, Homo sapiens
agggctctcctg

SEQ ID NO: 5211900 - DNA, 21 bp, Homo sapiens
agggctctgagccaaccttgc

SEQ ID NO: 5211901 - DNA, 13 bp, Homo sapiens
agggctctgaggc

SEQ ID NO: 5211902 - DNA, 21 bp, Homo sapiens
agggctctgatattccatgaa

SEQ ID NO: 5211903 - DNA, 22 bp, Homo sapiens
agggctctgatattccatgaat

SEQ ID NO: 5211904 - DNA, 12 bp, Homo sapiens
agggctctgccc

SEQ ID NO: 5211905 - DNA, 12 bp, Homo sapiens
agggctctttct

SEQ ID NO: 5211906 - DNA, 22 bp, Homo sapiens
agggctgaaaacggagagggaa

SEQ ID NO: 5211907 - DNA, 13 bp, Homo sapiens
agggctgaaggga

SEQ ID NO: 5211908 - DNA, 14 bp, Homo sapiens
agggctgaagggag

SEQ ID NO: 5211909 - DNA, 19 bp, Homo sapiens
agggctgaagggagggcct

SEQ ID NO: 5211910 - DNA, 20 bp, Homo sapiens
agggctgacacgtccacccc

SEQ ID NO: 5211911 - DNA, 21 bp, Homo sapiens
agggctgacacgtccacccca

SEQ ID NO: 5211912 - DNA, 15 bp, Homo sapiens
agggctgacctgcct

SEQ ID NO: 5211913 - DNA, 16 bp, Homo sapiens
agggctgacctgcctc

SEQ ID NO: 5211914 - DNA, 13 bp, Homo sapiens
agggctgacttct

SEQ ID NO: 5211915 - DNA, 17 bp, Homo sapiens
agggctgacttctccag

SEQ ID NO: 5211916 - DNA, 15 bp, Homo sapiens
agggctgagccatgg

SEQ ID NO: 5211917 - DNA, 12 bp, Homo sapiens
agggctgagccc

SEQ ID NO: 5211918 - DNA, 13 bp, Homo sapiens
agggctgagcccc

SEQ ID NO: 5211919 - DNA, 15 bp, Homo sapiens
agggctgagcccctc

SEQ ID NO: 5211920 - DNA, 14 bp, Homo sapiens
agggctgaggagca

SEQ ID NO: 5211921 - DNA, 16 bp, Homo sapiens
agggctgaggagcagc

SEQ ID NO: 5211922 - DNA, 15 bp, Homo sapiens
agggctgaggggcct

SEQ ID NO: 5211923 - DNA, 17 bp, Homo sapiens
agggctgagtgttctgg

SEQ ID NO: 5211924 - DNA, 21 bp, Homo sapiens
agggctgagtttgcacagtgg

SEQ ID NO: 5211925 - DNA, 17 bp, Homo sapiens
agggctgatggaggaaa

SEQ ID NO: 5211926 - DNA, 19 bp, Homo sapiens
agggctgcacattgcctgt

SEQ ID NO: 5211927 - DNA, 11 bp, Homo sapiens
agggctgcagt

SEQ ID NO: 5211928 - DNA, 13 bp, Homo sapiens
agggctgcagtca

SEQ ID NO: 5211929 - DNA, 13 bp, Homo sapiens
agggctgccagca

SEQ ID NO: 5211930 - DNA, 14 bp, Homo sapiens
agggctgccaggag

SEQ ID NO: 5211931 - DNA, 13 bp, Homo sapiens
agggctgccctga

SEQ ID NO: 5211932 - DNA, 20 bp, Homo sapiens
agggctgccttctggccttg

SEQ ID NO: 5211933 - DNA, 21 bp, Homo sapiens
agggctgcggcgtacaggctg

SEQ ID NO: 5211934 - DNA, 23 bp, Homo sapiens
agggctgcggcgtacaggctggc

SEQ ID NO: 5211935 - DNA, 16 bp, Homo sapiens
agggctgctctttcca

SEQ ID NO: 5211936 - DNA, 14 bp, Homo sapiens
aggcagagcgggag

SEQ ID NO: 5211937 - DNA, 21 bp, Homo sapiens
aggcagagctcagcacagcct

SEQ ID NO: 5211938 - DNA, 11 bp, Homo sapiens
aggcagagctg

SEQ ID NO: 5211939 - DNA, 22 bp, Homo sapiens
aggcagagctgacgggaggccc

SEQ ID NO: 5211940 - DNA, 21 bp, Homo sapiens
aggcagagctgagggccctgt

SEQ ID NO: 5211941 - DNA, 17 bp, Homo sapiens
aggcagaggatgttctg

SEQ ID NO: 5211942 - DNA, 14 bp, Homo sapiens
aggcagaggcccag

SEQ ID NO: 5211943 - DNA, 19 bp, Homo sapiens
aggcagaggcccaggctgc

SEQ ID NO: 5211944 - DNA, 20 bp, Homo sapiens
aggcagaggcccaggctgcc

SEQ ID NO: 5211945 - DNA, 18 bp, Homo sapiens
aggcagaggcctgggctg

SEQ ID NO: 5211946 - DNA, 15 bp, Homo sapiens
aggcagaggctggca

SEQ ID NO: 5211947 - DNA, 14 bp, Homo sapiens
aggcagagtcttct

SEQ ID NO: 5211948 - DNA, 15 bp, Homo sapiens
aggcagagtcttctt

SEQ ID NO: 5211949 - DNA, 20 bp, Homo sapiens
aggcagagtgccccacctgc

SEQ ID NO: 5211950 - DNA, 22 bp, Homo sapiens
aggcagagtgccccacctgcca

SEQ ID NO: 5211951 - DNA, 16 bp, Homo sapiens
aggcagagttctgtgg

SEQ ID NO: 5211952 - DNA, 16 bp, Homo sapiens
aggcagatagcactgg

SEQ ID NO: 5211953 - DNA, 16 bp, Homo sapiens
aggcagatccaggact

SEQ ID NO: 5211954 - DNA, 17 bp, Homo sapiens
aggcagatccaggacta

SEQ ID NO: 5211955 - DNA, 15 bp, Homo sapiens
aggcagatctgtgcc

SEQ ID NO: 5211956 - DNA, 18 bp, Homo sapiens
aggcagatctttaaatac

SEQ ID NO: 5211957 - DNA, 18 bp, Homo sapiens
aggcagatgcccttgctg

SEQ ID NO: 5211958 - DNA, 20 bp, Homo sapiens
aggcagatgcccttgctggg

SEQ ID NO: 5211959 - DNA, 21 bp, Homo sapiens
aggcagatggccactgctctt

SEQ ID NO: 5211960 - DNA, 15 bp, Homo sapiens
aggcagattaataac

SEQ ID NO: 5211961 - DNA, 22 bp, Homo sapiens
aggcagattaataacagaaata

SEQ ID NO: 5211962 - DNA, 16 bp, Homo sapiens
aggcagattgaaaagg

SEQ ID NO: 5211963 - DNA, 16 bp, Homo sapiens
aggcagatttgaggtt

SEQ ID NO: 5211964 - DNA, 22 bp, Homo sapiens
aggcagattttacagagcgcac

SEQ ID NO: 5211965 - DNA, 20 bp, Homo sapiens
aggcagcaacaggaccagga

SEQ ID NO: 5211966 - DNA, 17 bp, Homo sapiens
aggcagcaaggcccgag

SEQ ID NO: 5211967 - DNA, 16 bp, Homo sapiens
aggcagcaccacactg

SEQ ID NO: 5211968 - DNA, 18 bp, Homo sapiens
aggcagcacgtgcacaaa

SEQ ID NO: 5211969 - DNA, 15 bp, Homo sapiens
aggcagcagacacat

SEQ ID NO: 5211970 - DNA, 13 bp, Homo sapiens
aggcagcagagag

SEQ ID NO: 5211971 - DNA, 22 bp, Homo sapiens
aggcagcagagagagaggacag

SEQ ID NO: 5211972 - DNA, 15 bp, Homo sapiens
aggcagcaggagcca

SEQ ID NO: 5211973 - DNA, 12 bp, Homo sapiens
aggcagcagggg

SEQ ID NO: 5211974 - DNA, 11 bp, Homo sapiens
aggcagcatgg

SEQ ID NO: 5211975 - DNA, 16 bp, Homo sapiens
aggcagcatgtatagt

SEQ ID NO: 5211976 - DNA, 14 bp, Homo sapiens
aggcagcatttgaa

SEQ ID NO: 5211977 - DNA, 15 bp, Homo sapiens
aggcagcatttgaat

SEQ ID NO: 5211978 - DNA, 19 bp, Homo sapiens
aggcagccaacctaagcaa

SEQ ID NO: 5211979 - DNA, 20 bp, Homo sapiens
aggcagccaccagtggacct

SEQ ID NO: 5211980 - DNA, 15 bp, Homo sapiens
aggcagccacggccc

SEQ ID NO: 5211981 - DNA, 19 bp, Homo sapiens
aggcagccagatccccagg

SEQ ID NO: 5211982 - DNA, 22 bp, Homo sapiens
aggcagccagatccccagggca

SEQ ID NO: 5211983 - DNA, 23 bp, Homo sapiens
aggcagccagatccccagggcag

SEQ ID NO: 5211984 - DNA, 15 bp, Homo sapiens
aggcagccagcatct

SEQ ID NO: 5211985 - DNA, 13 bp, Homo sapiens
aggcagccagcca

SEQ ID NO: 5211986 - DNA, 17 bp, Homo sapiens
aggcagccagccgtggc

SEQ ID NO: 5211987 - DNA, 15 bp, Homo sapiens
aggcagccaggccac

SEQ ID NO: 5211988 - DNA, 14 bp, Homo sapiens
aggcagccagggct

SEQ ID NO: 5211989 - DNA, 22 bp, Homo sapiens
aggcagccagtgccctgagcca

SEQ ID NO: 5211990 - DNA, 20 bp, Homo sapiens
aggcagcccagcagtgtgga

SEQ ID NO: 5211991 - DNA, 23 bp, Homo sapiens
aggcagcccagctcctgaataaa

SEQ ID NO: 5211992 - DNA, 21 bp, Homo sapiens
aggcagcccaggaagtctcat

SEQ ID NO: 5211993 - DNA, 16 bp, Homo sapiens
aggcagccccattctg

SEQ ID NO: 5211994 - DNA, 22 bp, Homo sapiens
aggcagccccattctgcctgcc

SEQ ID NO: 5211995 - DNA, 12 bp, Homo sapiens
aggcagccccct

SEQ ID NO: 5211996 - DNA, 14 bp, Homo sapiens
aggcagccccctcc

SEQ ID NO: 5211997 - DNA, 15 bp, Homo sapiens
aggcagccccctcca

SEQ ID NO: 5211998 - DNA, 20 bp, Homo sapiens
aggcagccctgtctgaagga

SEQ ID NO: 5211999 - DNA, 15 bp, Homo sapiens
aggcagccctttggg

SEQ ID NO: 5212000 - DNA, 20 bp, Homo sapiens
aggcagccgaggcctggcca

SEQ ID NO: 5212001 - DNA, 20 bp, Homo sapiens
aggcagccgaggtccctgct

SEQ ID NO: 5212002 - DNA, 13 bp, Homo sapiens
aggcagccgccct

SEQ ID NO: 5212003 - DNA, 23 bp, Homo sapiens
aggcagccgtgggccccaccctc

SEQ ID NO: 5212004 - DNA, 22 bp, Homo sapiens
aggcagcctagcctatgtctgg

SEQ ID NO: 5212005 - DNA, 22 bp, Homo sapiens
aggcagcctccagagccagcct

SEQ ID NO: 5212006 - DNA, 16 bp, Homo sapiens
aggcagcctccagcct

SEQ ID NO: 5212007 - DNA, 13 bp, Homo sapiens
aggcagcctcctt

SEQ ID NO: 5212008 - DNA, 21 bp, Homo sapiens
aggcagcctctggggggtggc

SEQ ID NO: 5212009 - DNA, 19 bp, Homo sapiens
aggcagcctgagagctggc

SEQ ID NO: 5212010 - DNA, 16 bp, Homo sapiens
aggcagcctgcaggga

SEQ ID NO: 5212011 - DNA, 14 bp, Homo sapiens
aggcagcctgccgc

SEQ ID NO: 5212012 - DNA, 22 bp, Homo sapiens
aggcagcctggacatagagagg

SEQ ID NO: 5212013 - DNA, 12 bp, Homo sapiens
aggcagcgaccc

SEQ ID NO: 5212014 - DNA, 16 bp, Homo sapiens
aggcagcgcagggctg

SEQ ID NO: 5212015 - DNA, 17 bp, Homo sapiens
aggcagcgcagggctgg

SEQ ID NO: 5212016 - DNA, 17 bp, Homo sapiens
aggcagcgcattgtttt

SEQ ID NO: 5212017 - DNA, 19 bp, Homo sapiens
aggcagcgccaagcaacct

SEQ ID NO: 5212018 - DNA, 17 bp, Homo sapiens
aggcagcgccactgtcc

SEQ ID NO: 5212019 - DNA, 16 bp, Homo sapiens
aggcagcgccccacca

SEQ ID NO: 5212020 - DNA, 15 bp, Homo sapiens
aggcagcgcctgtcc

SEQ ID NO: 5212021 - DNA, 19 bp, Homo sapiens
aggcagcgcctgtcccctc

SEQ ID NO: 5212022 - DNA, 16 bp, Homo sapiens
aggcagcgtgggctct

SEQ ID NO: 5212023 - DNA, 18 bp, Homo sapiens
aggcagcgtgggctctgc

SEQ ID NO: 5212024 - DNA, 22 bp, Homo sapiens
aggcagcgtgggctctgccaat

SEQ ID NO: 5212025 - DNA, 18 bp, Homo sapiens
aggcagcgttagggctgc

SEQ ID NO: 5212026 - DNA, 14 bp, Homo sapiens
aggcagctcaggat

SEQ ID NO: 5212027 - DNA, 14 bp, Homo sapiens
aggcagctcccagg

SEQ ID NO: 5212028 - DNA, 16 bp, Homo sapiens
aggcagctccctcctg

SEQ ID NO: 5212029 - DNA, 15 bp, Homo sapiens
aggcagctcctgttt

SEQ ID NO: 5212030 - DNA, 20 bp, Homo sapiens
aggcagctctaaatgtcaat

SEQ ID NO: 5212031 - DNA, 14 bp, Homo sapiens
aggcagctctgagc

SEQ ID NO: 5212032 - DNA, 15 bp, Homo sapiens
aggcagctctgagcc

SEQ ID NO: 5212033 - DNA, 15 bp, Homo sapiens
aggcagctgagacca

SEQ ID NO: 5212034 - DNA, 20 bp, Homo sapiens
aggcagctgagaccagggtc

SEQ ID NO: 5212035 - DNA, 13 bp, Homo sapiens
aggcagctgcagt

SEQ ID NO: 5212036 - DNA, 11 bp, Homo sapiens
aggcagctgcc

SEQ ID NO: 5212037 - DNA, 23 bp, Homo sapiens
aggcagctgcctctgctccctct

SEQ ID NO: 5212038 - DNA, 22 bp, Homo sapiens
aggcagctggatgagacttcca

SEQ ID NO: 5212039 - DNA, 12 bp, Homo sapiens
aggcagctggca

SEQ ID NO: 5212040 - DNA, 23 bp, Homo sapiens
aggcagctgtgtctgagcccaac

SEQ ID NO: 5212041 - DNA, 20 bp, Homo sapiens
aggcagcttctactcctgcc

SEQ ID NO: 5212042 - DNA, 15 bp, Homo sapiens
aggcagcttgaaact

SEQ ID NO: 5212043 - DNA, 22 bp, Homo sapiens
aggcagctttaaccattaaaac

SEQ ID NO: 5212044 - DNA, 19 bp, Homo sapiens
aggcaggaacaaacagggc

SEQ ID NO: 5212045 - DNA, 16 bp, Homo sapiens
aggcaggaacatacag

SEQ ID NO: 5212046 - DNA, 14 bp, Homo sapiens
aggcaggaagagag

SEQ ID NO: 5212047 - DNA, 23 bp, Homo sapiens
aggcaggaagagagagagagagg

SEQ ID NO: 5212048 - DNA, 16 bp, Homo sapiens
aggcaggaagggcagg

SEQ ID NO: 5212049 - DNA, 11 bp, Homo sapiens
aggcaggaagt

SEQ ID NO: 5212050 - DNA, 19 bp, Homo sapiens
aggcaggaagtcaggagcc

SEQ ID NO: 5212051 - DNA, 15 bp, Homo sapiens
aggcaggaatggggg

SEQ ID NO: 5212052 - DNA, 14 bp, Homo sapiens
aggcaggacatgct

SEQ ID NO: 5212053 - DNA, 22 bp, Homo sapiens
aggcaggaccttcgggctgtgc

SEQ ID NO: 5212054 - DNA, 18 bp, Homo sapiens
aggcaggacttctcacca

SEQ ID NO: 5212055 - DNA, 18 bp, Homo sapiens
aggcaggagaactacttg

SEQ ID NO: 5212056 - DNA, 22 bp, Homo sapiens
aggcaggagcatgtatgtctgc

SEQ ID NO: 5212057 - DNA, 13 bp, Homo sapiens
aggcaggagcctt

SEQ ID NO: 5212058 - DNA, 17 bp, Homo sapiens
aggcaggagggcatgtg

SEQ ID NO: 5212059 - DNA, 19 bp, Homo sapiens
aggcaggagttgggggcag

SEQ ID NO: 5212060 - DNA, 21 bp, Homo sapiens
aggcaggagttgggggcaggt

SEQ ID NO: 5212061 - DNA, 16 bp, Homo sapiens
aggcaggattggggaa

SEQ ID NO: 5212062 - DNA, 22 bp, Homo sapiens
aggcaggcacctgggctttctg

SEQ ID NO: 5212063 - DNA, 20 bp, Homo sapiens
aggcaggcatggccctgggc

SEQ ID NO: 5212064 - DNA, 13 bp, Homo sapiens
aggcaggcattga

SEQ ID NO: 5212065 - DNA, 19 bp, Homo sapiens
aggcaggccaggctgcctc

SEQ ID NO: 5212066 - DNA, 15 bp, Homo sapiens
aggcaggcccagcct

SEQ ID NO: 5212067 - DNA, 21 bp, Homo sapiens
aggcaggcccagcctctgccc

SEQ ID NO: 5212068 - DNA, 12 bp, Homo sapiens
aggcaggcctcc

SEQ ID NO: 5212069 - DNA, 12 bp, Homo sapiens
aggcaggcctga

SEQ ID NO: 5212070 - DNA, 14 bp, Homo sapiens
aggcaggcggctcc

SEQ ID NO: 5212071 - DNA, 17 bp, Homo sapiens
aggcaggcggctcctcc

SEQ ID NO: 5212072 - DNA, 20 bp, Homo sapiens
aggcaggcggctcctcctca

SEQ ID NO: 5212073 - DNA, 21 bp, Homo sapiens
aggcaggctgggtgggaggga

SEQ ID NO: 5212074 - DNA, 14 bp, Homo sapiens
aggcaggctttctg

SEQ ID NO: 5212075 - DNA, 21 bp, Homo sapiens
aggcagggaaaggaaaagaag

SEQ ID NO: 5212076 - DNA, 22 bp, Homo sapiens
aggcagggaaaggctctgaaag

SEQ ID NO: 5212077 - DNA, 21 bp, Homo sapiens
aggcagggaagtgtaagaaac

SEQ ID NO: 5212078 - DNA, 13 bp, Homo sapiens
aggcagggagaag

SEQ ID NO: 5212079 - DNA, 23 bp, Homo sapiens
aggcagggagagagtagctgcag

SEQ ID NO: 5212080 - DNA, 22 bp, Homo sapiens
aggcagggaggaggcagagaag

SEQ ID NO: 5212081 - DNA, 21 bp, Homo sapiens
aggcagggagggaaacccggg

SEQ ID NO: 5212082 - DNA, 23 bp, Homo sapiens
aggcagggagggaaacccgggga

SEQ ID NO: 5212083 - DNA, 13 bp, Homo sapiens
aggcagggagggg

SEQ ID NO: 5212084 - DNA, 14 bp, Homo sapiens
aggcagggagggga

SEQ ID NO: 5212085 - DNA, 16 bp, Homo sapiens
aggcagggagggggct

SEQ ID NO: 5212086 - DNA, 20 bp, Homo sapiens
aggcagggagggggctggga

SEQ ID NO: 5212087 - DNA, 23 bp, Homo sapiens
aggcagggagggggctgggaaag

SEQ ID NO: 5212088 - DNA, 15 bp, Homo sapiens
aggcagggatttgag

SEQ ID NO: 5212089 - DNA, 16 bp, Homo sapiens
aggcagggcaaatgac

SEQ ID NO: 5212090 - DNA, 14 bp, Homo sapiens
aggcagggcagagg

SEQ ID NO: 5212091 - DNA, 15 bp, Homo sapiens
aggcagggcaggacc

SEQ ID NO: 5212092 - DNA, 12 bp, Homo sapiens
aggcagggccct

SEQ ID NO: 5212093 - DNA, 16 bp, Homo sapiens
aggcagggccctgaaa

SEQ ID NO: 5212094 - DNA, 23 bp, Homo sapiens
aggcagggccttgcccagagatg

SEQ ID NO: 5212095 - DNA, 13 bp, Homo sapiens
aggcagggctcct

SEQ ID NO: 5212096 - DNA, 16 bp, Homo sapiens
aggcagggctcctccc

SEQ ID NO: 5212097 - DNA, 22 bp, Homo sapiens
aggcagggctcctccctggagc

SEQ ID NO: 5212098 - DNA, 17 bp, Homo sapiens
aggcagggctctcctgg

SEQ ID NO: 5212099 - DNA, 21 bp, Homo sapiens
aggcagggctctcctggcttc

SEQ ID NO: 5212100 - DNA, 22 bp, Homo sapiens
aggcagggctctcctggcttcc

SEQ ID NO: 5212101 - DNA, 23 bp, Homo sapiens
aggcagggctctcctggcttccc

SEQ ID NO: 5212102 - DNA, 13 bp, Homo sapiens
aggcagggctgga

SEQ ID NO: 5212103 - DNA, 15 bp, Homo sapiens
aggcagggctgggcc

SEQ ID NO: 5212104 - DNA, 17 bp, Homo sapiens
aggcagggctgggccag

SEQ ID NO: 5212105 - DNA, 23 bp, Homo sapiens
aggcagggctgggccaggtctcc

SEQ ID NO: 5212106 - DNA, 14 bp, Homo sapiens
aggcaggggaatgt

SEQ ID NO: 5212107 - DNA, 13 bp, Homo sapiens
aggcaggggccca

SEQ ID NO: 5212108 - DNA, 17 bp, Homo sapiens
aggcaggggccctgcag

SEQ ID NO: 5212109 - DNA, 18 bp, Homo sapiens
aggcaggggccctgcagc

SEQ ID NO: 5212110 - DNA, 21 bp, Homo sapiens
aggcaggggccctgcagctct

SEQ ID NO: 5212111 - DNA, 16 bp, Homo sapiens
aggcaggggcctccat

SEQ ID NO: 5212112 - DNA, 16 bp, Homo sapiens
aggcaggggctctgct

SEQ ID NO: 5212113 - DNA, 12 bp, Homo sapiens
aggcaggggctg

SEQ ID NO: 5212114 - DNA, 15 bp, Homo sapiens
aggcaggggctgctg

SEQ ID NO: 5212115 - DNA, 17 bp, Homo sapiens
agggctgctgcttctgc

SEQ ID NO: 5212116 - DNA, 19 bp, Homo sapiens
agggctgctgcttctgctc

SEQ ID NO: 5212117 - DNA, 22 bp, Homo sapiens
agggctgctgcttctgctccag

SEQ ID NO: 5212118 - DNA, 20 bp, Homo sapiens
agggctgctgggggcaactg

SEQ ID NO: 5212119 - DNA, 12 bp, Homo sapiens
agggctgctgtg

SEQ ID NO: 5212120 - DNA, 13 bp, Homo sapiens
agggctgctgtgg

SEQ ID NO: 5212121 - DNA, 14 bp, Homo sapiens
agggctgcttttct

SEQ ID NO: 5212122 - DNA, 18 bp, Homo sapiens
agggctggaaaagtcaca

SEQ ID NO: 5212123 - DNA, 24 bp, Homo sapiens
agggctggacatttgtggcagtgc

SEQ ID NO: 5212124 - DNA, 22 bp, Homo sapiens
agggctggactctggcacccag

SEQ ID NO: 5212125 - DNA, 14 bp, Homo sapiens
agggctggactgag

SEQ ID NO: 5212126 - DNA, 15 bp, Homo sapiens
agggctggactgagg

SEQ ID NO: 5212127 - DNA, 16 bp, Homo sapiens
agggctggactgaggc

SEQ ID NO: 5212128 - DNA, 17 bp, Homo sapiens
agggctggactgaggcc

SEQ ID NO: 5212129 - DNA, 18 bp, Homo sapiens
agggctggactgaggcct

SEQ ID NO: 5212130 - DNA, 21 bp, Homo sapiens
agggctggagacttcctctgg

SEQ ID NO: 5212131 - DNA, 16 bp, Homo sapiens
agggctggagcctggg

SEQ ID NO: 5212132 - DNA, 15 bp, Homo sapiens
agggctggaggccca

SEQ ID NO: 5212133 - DNA, 21 bp, Homo sapiens
agggctggaggcccaggctgg

SEQ ID NO: 5212134 - DNA, 14 bp, Homo sapiens
agggctggatggac

SEQ ID NO: 5212135 - DNA, 17 bp, Homo sapiens
agggctggatggacaga

SEQ ID NO: 5212136 - DNA, 18 bp, Homo sapiens
agggctggattggcaggt

SEQ ID NO: 5212137 - DNA, 22 bp, Homo sapiens
agggctggcacgtgacaggctc

SEQ ID NO: 5212138 - DNA, 14 bp, Homo sapiens
agggctggcccagc

SEQ ID NO: 5212139 - DNA, 15 bp, Homo sapiens
agggctggcccagcc

SEQ ID NO: 5212140 - DNA, 18 bp, Homo sapiens
agggctggcccagccctg

SEQ ID NO: 5212141 - DNA, 20 bp, Homo sapiens
agggctggcccagccctgct

SEQ ID NO: 5212142 - DNA, 16 bp, Homo sapiens
agggctggcccgggga

SEQ ID NO: 5212143 - DNA, 12 bp, Homo sapiens
agggctggccct

SEQ ID NO: 5212144 - DNA, 13 bp, Homo sapiens
agggctggcccta

SEQ ID NO: 5212145 - DNA, 11 bp, Homo sapiens
agggctggctc

SEQ ID NO: 5212146 - DNA, 13 bp, Homo sapiens
agggctggctccc

SEQ ID NO: 5212147 - DNA, 22 bp, Homo sapiens
agggctggctccccctccccag

SEQ ID NO: 5212148 - DNA, 14 bp, Homo sapiens
agggctggctctgc

SEQ ID NO: 5212149 - DNA, 23 bp, Homo sapiens
agggctggctctgcactaagaga

SEQ ID NO: 5212150 - DNA, 16 bp, Homo sapiens
agggctggctggagga

SEQ ID NO: 5212151 - DNA, 22 bp, Homo sapiens
agggctggctggaggaaggaaa

SEQ ID NO: 5212152 - DNA, 13 bp, Homo sapiens
agggctggctggc

SEQ ID NO: 5212153 - DNA, 17 bp, Homo sapiens
agggctggctggcctca

SEQ ID NO: 5212154 - DNA, 22 bp, Homo sapiens
agggctgggcaaggaaaaagaa

SEQ ID NO: 5212155 - DNA, 21 bp, Homo sapiens
agggctgggcactcctcccct

SEQ ID NO: 5212156 - DNA, 14 bp, Homo sapiens
agggctgggcagct

SEQ ID NO: 5212157 - DNA, 20 bp, Homo sapiens
agggctgggcaggtcctggg

SEQ ID NO: 5212158 - DNA, 11 bp, Homo sapiens
agggctgggcc

SEQ ID NO: 5212159 - DNA, 16 bp, Homo sapiens
agggctgggccaccag

SEQ ID NO: 5212160 - DNA, 20 bp, Homo sapiens
agggctgggccaccagggat

SEQ ID NO: 5212161 - DNA, 15 bp, Homo sapiens
agggctgggccaggt

SEQ ID NO: 5212162 - DNA, 13 bp, Homo sapiens
agggctgggcctg

SEQ ID NO: 5212163 - DNA, 20 bp, Homo sapiens
agggctgggcgcctctgtcc

SEQ ID NO: 5212164 - DNA, 22 bp, Homo sapiens
agggctgggctctgtcttcctg

SEQ ID NO: 5212165 - DNA, 10 bp, Homo sapiens
agggctgggg

SEQ ID NO: 5212166 - DNA, 15 bp, Homo sapiens
agggctggggacaga

SEQ ID NO: 5212167 - DNA, 15 bp, Homo sapiens
agggctggggactgg

SEQ ID NO: 5212168 - DNA, 17 bp, Homo sapiens
agggctggggatgcgcc

SEQ ID NO: 5212169 - DNA, 19 bp, Homo sapiens
agggctggggatgcgcctg

SEQ ID NO: 5212170 - DNA, 13 bp, Homo sapiens
agggctggggcca

SEQ ID NO: 5212171 - DNA, 17 bp, Homo sapiens
agggctggggtgagcct

SEQ ID NO: 5212172 - DNA, 18 bp, Homo sapiens
agggctggggtgagcctg

SEQ ID NO: 5212173 - DNA, 17 bp, Homo sapiens
agggctggggttgccag

SEQ ID NO: 5212174 - DNA, 19 bp, Homo sapiens
agggctggggttgccagag

SEQ ID NO: 5212175 - DNA, 20 bp, Homo sapiens
agggctggggttgccagagg

SEQ ID NO: 5212176 - DNA, 19 bp, Homo sapiens
agggctgggtaggcaggtg

SEQ ID NO: 5212177 - DNA, 15 bp, Homo sapiens
agggctgggtcacag

SEQ ID NO: 5212178 - DNA, 14 bp, Homo sapiens
agggctgggtcagg

SEQ ID NO: 5212179 - DNA, 15 bp, Homo sapiens
agggctgggtcaggg

SEQ ID NO: 5212180 - DNA, 17 bp, Homo sapiens
agggctgggtcaggggt

SEQ ID NO: 5212181 - DNA, 12 bp, Homo sapiens
agggctgggtgt

SEQ ID NO: 5212182 - DNA, 19 bp, Homo sapiens
agggctggtccttatttat

SEQ ID NO: 5212183 - DNA, 16 bp, Homo sapiens
agggctggttaatgta

SEQ ID NO: 5212184 - DNA, 15 bp, Homo sapiens
agggctggtttgttc

SEQ ID NO: 5212185 - DNA, 18 bp, Homo sapiens
agggctgtaactgccagg

SEQ ID NO: 5212186 - DNA, 14 bp, Homo sapiens
agggctgtcatctg

SEQ ID NO: 5212187 - DNA, 20 bp, Homo sapiens
agggctgtcatctgtgcact

SEQ ID NO: 5212188 - DNA, 19 bp, Homo sapiens
agggctgtggcctccctgc

SEQ ID NO: 5212189 - DNA, 22 bp, Homo sapiens
agggctgttataatctttcaca

SEQ ID NO: 5212190 - DNA, 17 bp, Homo sapiens
agggctgttccctccag

SEQ ID NO: 5212191 - DNA, 21 bp, Homo sapiens
agggctgttgatttatgcttt

SEQ ID NO: 5212192 - DNA, 12 bp, Homo sapiens
agggctgttgct

SEQ ID NO: 5212193 - DNA, 17 bp, Homo sapiens
agggctgttggacagct

SEQ ID NO: 5212194 - DNA, 21 bp, Homo sapiens
agggctgttggacagctgctt

SEQ ID NO: 5212195 - DNA, 22 bp, Homo sapiens
agggctgttggacagctgcttg

SEQ ID NO: 5212196 - DNA, 19 bp, Homo sapiens
agggctgttggaggacccc

SEQ ID NO: 5212197 - DNA, 15 bp, Homo sapiens
agggctgttttgcct

SEQ ID NO: 5212198 - DNA, 23 bp, Homo sapiens
agggcttacctgtacactgactt

SEQ ID NO: 5212199 - DNA, 20 bp, Homo sapiens
agggcttacggccctggcct

SEQ ID NO: 5212200 - DNA, 16 bp, Homo sapiens
agggcttattgactct

SEQ ID NO: 5212201 - DNA, 21 bp, Homo sapiens
agggcttccccatcagctccc

SEQ ID NO: 5212202 - DNA, 13 bp, Homo sapiens
agggcttcctcaa

SEQ ID NO: 5212203 - DNA, 22 bp, Homo sapiens
agggcttcctcaaatacatgca

SEQ ID NO: 5212204 - DNA, 21 bp, Homo sapiens
agggcttcctctagaagccaa

SEQ ID NO: 5212205 - DNA, 22 bp, Homo sapiens
agggcttctcctgcgggggcga

SEQ ID NO: 5212206 - DNA, 15 bp, Homo sapiens
agggcttctgcaccc

SEQ ID NO: 5212207 - DNA, 16 bp, Homo sapiens
agggcttctgcaccct

SEQ ID NO: 5212208 - DNA, 16 bp, Homo sapiens
agggcttcttcttata

SEQ ID NO: 5212209 - DNA, 21 bp, Homo sapiens
agggcttgatggtgacagctg

SEQ ID NO: 5212210 - DNA, 22 bp, Homo sapiens
agggcttggatcgtggaagaag

SEQ ID NO: 5212211 - DNA, 15 bp, Homo sapiens
agggcttggccagcg

SEQ ID NO: 5212212 - DNA, 17 bp, Homo sapiens
agggcttggcccagcgc

SEQ ID NO: 5212213 - DNA, 21 bp, Homo sapiens
agggcttggcccagcgccaag

SEQ ID NO: 5212214 - DNA, 22 bp, Homo sapiens
agggcttggggagcaggtctct

SEQ ID NO: 5212215 - DNA, 20 bp, Homo sapiens
agggcttggggctgcacctc

SEQ ID NO: 5212216 - DNA, 21 bp, Homo sapiens
agggcttggggctgcacctcc

SEQ ID NO: 5212217 - DNA, 21 bp, Homo sapiens
agggcttggtggccaagcctg

SEQ ID NO: 5212218 - DNA, 16 bp, Homo sapiens
agggcttgtagttctt

SEQ ID NO: 5212219 - DNA, 12 bp, Homo sapiens
agggcttgtttt

SEQ ID NO: 5212220 - DNA, 19 bp, Homo sapiens
agggcttgtttttcttcag

SEQ ID NO: 5212221 - DNA, 15 bp, Homo sapiens
agggctttaaaattc

SEQ ID NO: 5212222 - DNA, 16 bp, Homo sapiens
agggctttaaaattct

SEQ ID NO: 5212223 - DNA, 19 bp, Homo sapiens
agggctttaaaattctctt

SEQ ID NO: 5212224 - DNA, 20 bp, Homo sapiens
agggctttaaaattctcttc

SEQ ID NO: 5212225 - DNA, 19 bp, Homo sapiens
agggctttaaataaaagag

SEQ ID NO: 5212226 - DNA, 22 bp, Homo sapiens
agggctttcagcgcccccaggc

SEQ ID NO: 5212227 - DNA, 23 bp, Homo sapiens
agggctttctgggtgtgtccagg

SEQ ID NO: 5212228 - DNA, 16 bp, Homo sapiens
agggctttggggggca

SEQ ID NO: 5212229 - DNA, 19 bp, Homo sapiens
agggctttggggggcacta

SEQ ID NO: 5212230 - DNA, 21 bp, Homo sapiens
agggctttggggggcactaga

SEQ ID NO: 5212231 - DNA, 21 bp, Homo sapiens
agggctttggttccttctctg

SEQ ID NO: 5212232 - DNA, 18 bp, Homo sapiens
agggctttgttttgcaca

SEQ ID NO: 5212233 - DNA, 21 bp, Homo sapiens
agggcttttctctttcctcta

SEQ ID NO: 5212234 - DNA, 21 bp, Homo sapiens
agggcttttttttgagaatac

SEQ ID NO: 5212235 - DNA, 15 bp, Homo sapiens
aggggaaaaaatcat

SEQ ID NO: 5212236 - DNA, 22 bp, Homo sapiens
aggggaaaaaatcatattctaa

SEQ ID NO: 5212237 - DNA, 15 bp, Homo sapiens
aggggaaaacctcag

SEQ ID NO: 5212238 - DNA, 14 bp, Homo sapiens
aggggaaaatagta

SEQ ID NO: 5212239 - DNA, 18 bp, Homo sapiens
aggggaaaatcagcctgc

SEQ ID NO: 5212240 - DNA, 13 bp, Homo sapiens
aggggaaaatgaa

SEQ ID NO: 5212241 - DNA, 20 bp, Homo sapiens
aggggaaaccagtgtagcct

SEQ ID NO: 5212242 - DNA, 20 bp, Homo sapiens
aggggaaacctgtgaaagct

SEQ ID NO: 5212243 - DNA, 16 bp, Homo sapiens
aggggaaacgagaagg

SEQ ID NO: 5212244 - DNA, 17 bp, Homo sapiens
aggggaaacgtctccca

SEQ ID NO: 5212245 - DNA, 20 bp, Homo sapiens
aggggaaagacttccatcta

SEQ ID NO: 5212246 - DNA, 14 bp, Homo sapiens
aggggaaaggcctg

SEQ ID NO: 5212247 - DNA, 14 bp, Homo sapiens
aggggaaagtccag

SEQ ID NO: 5212248 - DNA, 16 bp, Homo sapiens
aggggaaatgaatgtg

SEQ ID NO: 5212249 - DNA, 13 bp, Homo sapiens
aggggaaatgtaa

SEQ ID NO: 5212250 - DNA, 17 bp, Homo sapiens
aggggaacactgccctc

SEQ ID NO: 5212251 - DNA, 16 bp, Homo sapiens
aggggaacagaccagt

SEQ ID NO: 5212252 - DNA, 14 bp, Homo sapiens
aggggaacagactg

SEQ ID NO: 5212253 - DNA, 14 bp, Homo sapiens
aggggaacctgcca

SEQ ID NO: 5212254 - DNA, 15 bp, Homo sapiens
aggggaagaaggaaa

SEQ ID NO: 5212255 - DNA, 15 bp, Homo sapiens
aggggaagaatgaaa

SEQ ID NO: 5212256 - DNA, 14 bp, Homo sapiens
aggggaagaattta

SEQ ID NO: 5212257 - DNA, 13 bp, Homo sapiens
aggggaagagaag

SEQ ID NO: 5212258 - DNA, 18 bp, Homo sapiens
aggggaagagaagacaaa

SEQ ID NO: 5212259 - DNA, 22 bp, Homo sapiens
aggggaagagacaaagtgggtg

SEQ ID NO: 5212260 - DNA, 16 bp, Homo sapiens
aggggaagagatgttt

SEQ ID NO: 5212261 - DNA, 14 bp, Homo sapiens
aggggaagccttgc

SEQ ID NO: 5212262 - DNA, 14 bp, Homo sapiens
aggggaagctgcag

SEQ ID NO: 5212263 - DNA, 14 bp, Homo sapiens
aggggaagctgggc

SEQ ID NO: 5212264 - DNA, 15 bp, Homo sapiens
aggggaagctgggcc

SEQ ID NO: 5212265 - DNA, 17 bp, Homo sapiens
aggggaagctgggccca

SEQ ID NO: 5212266 - DNA, 13 bp, Homo sapiens
aggggaagggcag

SEQ ID NO: 5212267 - DNA, 14 bp, Homo sapiens
aggggaagggccag

SEQ ID NO: 5212268 - DNA, 23 bp, Homo sapiens
aggggaagggccagtctgggctg

SEQ ID NO: 5212269 - DNA, 15 bp, Homo sapiens
aggggaaggggccgg

SEQ ID NO: 5212270 - DNA, 21 bp, Homo sapiens
aggggaaggggccggggaggg

SEQ ID NO: 5212271 - DNA, 20 bp, Homo sapiens
aggggaagtatgtgtgggta

SEQ ID NO: 5212272 - DNA, 23 bp, Homo sapiens
aggggaagtctcttcctgcctcc

SEQ ID NO: 5212273 - DNA, 17 bp, Homo sapiens
aggggaagtgtgctgag

SEQ ID NO: 5212274 - DNA, 21 bp, Homo sapiens
aggggaataaactgttgagtc

SEQ ID NO: 5212275 - DNA, 18 bp, Homo sapiens
aggggaataatagaagaa

SEQ ID NO: 5212276 - DNA, 19 bp, Homo sapiens
aggggaataatagaagaac

SEQ ID NO: 5212277 - DNA, 19 bp, Homo sapiens
aggggaatattttattcaa

SEQ ID NO: 5212278 - DNA, 22 bp, Homo sapiens
aggggaatattttattcaaggt

SEQ ID NO: 5212279 - DNA, 15 bp, Homo sapiens
aggggaatcagaact

SEQ ID NO: 5212280 - DNA, 23 bp, Homo sapiens
aggggaatgaaccatggcacctt

SEQ ID NO: 5212281 - DNA, 20 bp, Homo sapiens
aggggaatgagggggctcag

SEQ ID NO: 5212282 - DNA, 18 bp, Homo sapiens
aggggaatgtgtcctcct

SEQ ID NO: 5212283 - DNA, 12 bp, Homo sapiens
aggggaatgttt

SEQ ID NO: 5212284 - DNA, 13 bp, Homo sapiens
aggggaatgtttg

SEQ ID NO: 5212285 - DNA, 21 bp, Homo sapiens
aggggaatgtttgcctctgcc

SEQ ID NO: 5212286 - DNA, 16 bp, Homo sapiens
aggggaattttctctc

SEQ ID NO: 5212287 - DNA, 23 bp, Homo sapiens
aggggacaagggaggcagtggct

SEQ ID NO: 5212288 - DNA, 18 bp, Homo sapiens
aggggacacctgtacatt

SEQ ID NO: 5212289 - DNA, 14 bp, Homo sapiens
aggggacagagctg

SEQ ID NO: 5212290 - DNA, 15 bp, Homo sapiens
aggggacagaggccc

SEQ ID NO: 5212291 - DNA, 13 bp, Homo sapiens
aggggacaggcct

SEQ ID NO: 5212292 - DNA, 15 bp, Homo sapiens
aggggacaggcctca

SEQ ID NO: 5212293 - DNA, 17 bp, Homo sapiens
aggggacaggcctcacc

SEQ ID NO: 5212294 - DNA, 17 bp, Homo sapiens
aggcaggggctgggcag

SEQ ID NO: 5212295 - DNA, 16 bp, Homo sapiens
aggcaggggcttccca

SEQ ID NO: 5212296 - DNA, 19 bp, Homo sapiens
aggcaggggcttggctgcc

SEQ ID NO: 5212297 - DNA, 21 bp, Homo sapiens
aggcaggggcttggctgcccc

SEQ ID NO: 5212298 - DNA, 22 bp, Homo sapiens
aggcaggggcttggctgcccca

SEQ ID NO: 5212299 - DNA, 16 bp, Homo sapiens
aggcagggggccctgc

SEQ ID NO: 5212300 - DNA, 18 bp, Homo sapiens
aggcagggggccctgccc

SEQ ID NO: 5212301 - DNA, 20 bp, Homo sapiens
aggcagggggccctgcccca

SEQ ID NO: 5212302 - DNA, 18 bp, Homo sapiens
aggcaggggtcctgcagg

SEQ ID NO: 5212303 - DNA, 23 bp, Homo sapiens
aggcaggggtgagagcacccact

SEQ ID NO: 5212304 - DNA, 17 bp, Homo sapiens
aggcaggggtgggagag

SEQ ID NO: 5212305 - DNA, 18 bp, Homo sapiens
aggcaggggtgggagagc

SEQ ID NO: 5212306 - DNA, 19 bp, Homo sapiens
aggcaggggtgggggtgga

SEQ ID NO: 5212307 - DNA, 20 bp, Homo sapiens
aggcagggtcaggagagggg

SEQ ID NO: 5212308 - DNA, 18 bp, Homo sapiens
aggcagggtctcactctg

SEQ ID NO: 5212309 - DNA, 22 bp, Homo sapiens
aggcagggtctcactctgtcgc

SEQ ID NO: 5212310 - DNA, 14 bp, Homo sapiens
aggcagggtgcagt

SEQ ID NO: 5212311 - DNA, 15 bp, Homo sapiens
aggcaggtagccagg

SEQ ID NO: 5212312 - DNA, 18 bp, Homo sapiens
aggcaggtagggggtccc

SEQ ID NO: 5212313 - DNA, 11 bp, Homo sapiens
aggcaggtccc

SEQ ID NO: 5212314 - DNA, 16 bp, Homo sapiens
aggcaggtccccagac

SEQ ID NO: 5212315 - DNA, 22 bp, Homo sapiens
aggcaggtctgcaagggcccag

SEQ ID NO: 5212316 - DNA, 21 bp, Homo sapiens
aggcaggtcttgaactcctgg

SEQ ID NO: 5212317 - DNA, 22 bp, Homo sapiens
aggcaggtcttgaactcctggc

SEQ ID NO: 5212318 - DNA, 17 bp, Homo sapiens
aggcaggtgagaaccca

SEQ ID NO: 5212319 - DNA, 15 bp, Homo sapiens
aggcaggtgccagga

SEQ ID NO: 5212320 - DNA, 14 bp, Homo sapiens
aggcaggtgcctcc

SEQ ID NO: 5212321 - DNA, 20 bp, Homo sapiens
aggcaggtgcctccaggtgt

SEQ ID NO: 5212322 - DNA, 12 bp, Homo sapiens
aggcaggtgctt

SEQ ID NO: 5212323 - DNA, 14 bp, Homo sapiens
aggcaggtgctttt

SEQ ID NO: 5212324 - DNA, 21 bp, Homo sapiens
aggcaggtggacgctgcagac

SEQ ID NO: 5212325 - DNA, 17 bp, Homo sapiens
aggcaggtgggatggat

SEQ ID NO: 5212326 - DNA, 15 bp, Homo sapiens
aggcaggtgggcaga

SEQ ID NO: 5212327 - DNA, 16 bp, Homo sapiens
aggcaggtgggcagac

SEQ ID NO: 5212328 - DNA, 19 bp, Homo sapiens
aggcaggtgggggctgcgt

SEQ ID NO: 5212329 - DNA, 20 bp, Homo sapiens
aggcaggtttcatttcttat

SEQ ID NO: 5212330 - DNA, 17 bp, Homo sapiens
aggcaggtttgccagtg

SEQ ID NO: 5212331 - DNA, 22 bp, Homo sapiens
aggcagtagatcattttttgtc

SEQ ID NO: 5212332 - DNA, 17 bp, Homo sapiens
aggcagtagatgtgctt

SEQ ID NO: 5212333 - DNA, 15 bp, Homo sapiens
aggcagtagcctcct

SEQ ID NO: 5212334 - DNA, 19 bp, Homo sapiens
aggcagtatggcggaggcc

SEQ ID NO: 5212335 - DNA, 22 bp, Homo sapiens
aggcagtatggcggaggccatg

SEQ ID NO: 5212336 - DNA, 15 bp, Homo sapiens
aggcagtattccctt

SEQ ID NO: 5212337 - DNA, 14 bp, Homo sapiens
aggcagtccagagc

SEQ ID NO: 5212338 - DNA, 15 bp, Homo sapiens
aggcagtccagagct

SEQ ID NO: 5212339 - DNA, 19 bp, Homo sapiens
aggcagtccaggcctctct

SEQ ID NO: 5212340 - DNA, 23 bp, Homo sapiens
aggcagtccaggcctctctctgc

SEQ ID NO: 5212341 - DNA, 15 bp, Homo sapiens
aggcagtcccgggag

SEQ ID NO: 5212342 - DNA, 20 bp, Homo sapiens
aggcagtcccgggagaaaag

SEQ ID NO: 5212343 - DNA, 21 bp, Homo sapiens
aggcagtcccgggagaaaaga

SEQ ID NO: 5212344 - DNA, 18 bp, Homo sapiens
aggcagtcgggggctggc

SEQ ID NO: 5212345 - DNA, 23 bp, Homo sapiens
aggcagtcgggggctggcctagg

SEQ ID NO: 5212346 - DNA, 11 bp, Homo sapiens
aggcagtctct

SEQ ID NO: 5212347 - DNA, 20 bp, Homo sapiens
aggcagtctctatattatgt

SEQ ID NO: 5212348 - DNA, 21 bp, Homo sapiens
aggcagtctctatattatgtc

SEQ ID NO: 5212349 - DNA, 23 bp, Homo sapiens
aggcagtctctatattatgtctt

SEQ ID NO: 5212350 - DNA, 17 bp, Homo sapiens
aggcagtcttctaccaa

SEQ ID NO: 5212351 - DNA, 15 bp, Homo sapiens
aggcagtctttgctc

SEQ ID NO: 5212352 - DNA, 18 bp, Homo sapiens
aggcagtgatgacttgct

SEQ ID NO: 5212353 - DNA, 24 bp, Homo sapiens
aggcagtgatgacttgctgtccag

SEQ ID NO: 5212354 - DNA, 14 bp, Homo sapiens
aggcagtgcatgca

SEQ ID NO: 5212355 - DNA, 16 bp, Homo sapiens
aggcagtgcatgcatg

SEQ ID NO: 5212356 - DNA, 14 bp, Homo sapiens
aggcagtgcatgtg

SEQ ID NO: 5212357 - DNA, 22 bp, Homo sapiens
aggcagtgcatgtgaagcatgc

SEQ ID NO: 5212358 - DNA, 15 bp, Homo sapiens
aggcagtggcagcaa

SEQ ID NO: 5212359 - DNA, 14 bp, Homo sapiens
aggcagtggcaggg

SEQ ID NO: 5212360 - DNA, 17 bp, Homo sapiens
aggcagtggcaggggag

SEQ ID NO: 5212361 - DNA, 14 bp, Homo sapiens
aggcagtggcccag

SEQ ID NO: 5212362 - DNA, 16 bp, Homo sapiens
aggcagtggctagtgg

SEQ ID NO: 5212363 - DNA, 23 bp, Homo sapiens
aggcagtggcttggagcagaggt

SEQ ID NO: 5212364 - DNA, 22 bp, Homo sapiens
aggcagtggggctggaagcaga

SEQ ID NO: 5212365 - DNA, 23 bp, Homo sapiens
aggcagtggggctggaagcagaa

SEQ ID NO: 5212366 - DNA, 24 bp, Homo sapiens
aggcagtggggctggaagcagaaa

SEQ ID NO: 5212367 - DNA, 16 bp, Homo sapiens
aggcagtggggctggg

SEQ ID NO: 5212368 - DNA, 15 bp, Homo sapiens
aggcagtgtcatttg

SEQ ID NO: 5212369 - DNA, 19 bp, Homo sapiens
aggcagtgtcatttgctct

SEQ ID NO: 5212370 - DNA, 14 bp, Homo sapiens
aggcagtgtcttaa

SEQ ID NO: 5212371 - DNA, 21 bp, Homo sapiens
aggcagtgtggttatgttccc

SEQ ID NO: 5212372 - DNA, 22 bp, Homo sapiens
aggcagtgttcctcaccaataa

SEQ ID NO: 5212373 - DNA, 21 bp, Homo sapiens
aggcagttaccattaaaccat

SEQ ID NO: 5212374 - DNA, 21 bp, Homo sapiens
aggcagttagagatgcctccc

SEQ ID NO: 5212375 - DNA, 16 bp, Homo sapiens
aggcagttctgtgtcc

SEQ ID NO: 5212376 - DNA, 21 bp, Homo sapiens
aggcagttgacggggcagtca

SEQ ID NO: 5212377 - DNA, 16 bp, Homo sapiens
aggcagtttagtgcat

SEQ ID NO: 5212378 - DNA, 19 bp, Homo sapiens
aggcagtttagtgcatctt

SEQ ID NO: 5212379 - DNA, 22 bp, Homo sapiens
aggcagtttcagagatggacag

SEQ ID NO: 5212380 - DNA, 15 bp, Homo sapiens
aggcagtttgaggat

SEQ ID NO: 5212381 - DNA, 23 bp, Homo sapiens
aggcagtttttgttccttcctgc

SEQ ID NO: 5212382 - DNA, 13 bp, Homo sapiens
aggcataaattaa

SEQ ID NO: 5212383 - DNA, 17 bp, Homo sapiens
aggcataaattaaaatg

SEQ ID NO: 5212384 - DNA, 18 bp, Homo sapiens
aggcataaattagagaaa

SEQ ID NO: 5212385 - DNA, 21 bp, Homo sapiens
aggcatacctgtcctagcagg

SEQ ID NO: 5212386 - DNA, 20 bp, Homo sapiens
aggcatacgagagcagaggt

SEQ ID NO: 5212387 - DNA, 21 bp, Homo sapiens
aggcatacgagagcagaggtc

SEQ ID NO: 5212388 - DNA, 22 bp, Homo sapiens
aggcatagaggcttctccgcca

SEQ ID NO: 5212389 - DNA, 19 bp, Homo sapiens
aggcataggcctgggtgct

SEQ ID NO: 5212390 - DNA, 14 bp, Homo sapiens
aggcataggtctct

SEQ ID NO: 5212391 - DNA, 19 bp, Homo sapiens
aggcatatactttgtcttt

SEQ ID NO: 5212392 - DNA, 17 bp, Homo sapiens
aggcatattattttctg

SEQ ID NO: 5212393 - DNA, 20 bp, Homo sapiens
aggcatattccctgcacaca

SEQ ID NO: 5212394 - DNA, 22 bp, Homo sapiens
aggcatattccctgcacacaca

SEQ ID NO: 5212395 - DNA, 20 bp, Homo sapiens
aggcatattgctttttctaa

SEQ ID NO: 5212396 - DNA, 22 bp, Homo sapiens
aggcatattgctttttctaatg

SEQ ID NO: 5212397 - DNA, 21 bp, Homo sapiens
aggcatcagtccccctgtgca

SEQ ID NO: 5212398 - DNA, 15 bp, Homo sapiens
aggcatcattttcac

SEQ ID NO: 5212399 - DNA, 22 bp, Homo sapiens
aggcatccaaaggctcctgaga

SEQ ID NO: 5212400 - DNA, 23 bp, Homo sapiens
aggcatccagcagtctctgcctt

SEQ ID NO: 5212401 - DNA, 17 bp, Homo sapiens
aggcatcccagcctggg

SEQ ID NO: 5212402 - DNA, 23 bp, Homo sapiens
aggcatcccaggggaccacacct

SEQ ID NO: 5212403 - DNA, 20 bp, Homo sapiens
aggcatcctgcctgggtggg

SEQ ID NO: 5212404 - DNA, 15 bp, Homo sapiens
aggcatccttgtctt

SEQ ID NO: 5212405 - DNA, 16 bp, Homo sapiens
aggcatccttgtcttt

SEQ ID NO: 5212406 - DNA, 22 bp, Homo sapiens
aggcatccttgtcttttgagct

SEQ ID NO: 5212407 - DNA, 21 bp, Homo sapiens
aggcatcgggggtgaatcttg

SEQ ID NO: 5212408 - DNA, 19 bp, Homo sapiens
aggcatcgtcatgcacagt

SEQ ID NO: 5212409 - DNA, 18 bp, Homo sapiens
aggcatctacacagcctg

SEQ ID NO: 5212410 - DNA, 19 bp, Homo sapiens
aggcatctacacagcctgg

SEQ ID NO: 5212411 - DNA, 16 bp, Homo sapiens
aggcatctgatttgca

SEQ ID NO: 5212412 - DNA, 18 bp, Homo sapiens
aggcatctgtaagaagta

SEQ ID NO: 5212413 - DNA, 21 bp, Homo sapiens
aggcatctgtaagaagtagag

SEQ ID NO: 5212414 - DNA, 20 bp, Homo sapiens
aggcatctgttagcagagtc

SEQ ID NO: 5212415 - DNA, 21 bp, Homo sapiens
aggcatctgttagcagagtct

SEQ ID NO: 5212416 - DNA, 23 bp, Homo sapiens
aggcatctttctgaatttcattc

SEQ ID NO: 5212417 - DNA, 14 bp, Homo sapiens
aggcatcttttcta

SEQ ID NO: 5212418 - DNA, 22 bp, Homo sapiens
aggcatcttttctagagacaca

SEQ ID NO: 5212419 - DNA, 14 bp, Homo sapiens
aggcatgacagctg

SEQ ID NO: 5212420 - DNA, 18 bp, Homo sapiens
aggcatgactaatgcttt

SEQ ID NO: 5212421 - DNA, 18 bp, Homo sapiens
aggcatgagccactgagc

SEQ ID NO: 5212422 - DNA, 22 bp, Homo sapiens
aggcatgagggatcacagggcc

SEQ ID NO: 5212423 - DNA, 23 bp, Homo sapiens
aggcatgagggatcacagggccc

SEQ ID NO: 5212424 - DNA, 20 bp, Homo sapiens
aggcatgagttactgtgcat

SEQ ID NO: 5212425 - DNA, 13 bp, Homo sapiens
aggcatgcacatc

SEQ ID NO: 5212426 - DNA, 16 bp, Homo sapiens
aggcatgcagctgcct

SEQ ID NO: 5212427 - DNA, 19 bp, Homo sapiens
aggcatgcagctgcctggg

SEQ ID NO: 5212428 - DNA, 22 bp, Homo sapiens
aggcatgcagctgcctggggcc

SEQ ID NO: 5212429 - DNA, 15 bp, Homo sapiens
aggcatgcctctgat

SEQ ID NO: 5212430 - DNA, 17 bp, Homo sapiens
aggcatgcctctgatat

SEQ ID NO: 5212431 - DNA, 13 bp, Homo sapiens
aggcatgcctgtg

SEQ ID NO: 5212432 - DNA, 14 bp, Homo sapiens
aggcatgcctgtgt

SEQ ID NO: 5212433 - DNA, 19 bp, Homo sapiens
aggcatgcgaatgagctgg

SEQ ID NO: 5212434 - DNA, 15 bp, Homo sapiens
aggcatggaaagatg

SEQ ID NO: 5212435 - DNA, 18 bp, Homo sapiens
aggcatggagacagcgaa

SEQ ID NO: 5212436 - DNA, 16 bp, Homo sapiens
aggcatggcccagcct

SEQ ID NO: 5212437 - DNA, 18 bp, Homo sapiens
aggcatggcccagcctgg

SEQ ID NO: 5212438 - DNA, 19 bp, Homo sapiens
aggcatggcccagcctgga

SEQ ID NO: 5212439 - DNA, 22 bp, Homo sapiens
aggcatggcccagcctggagcc

SEQ ID NO: 5212440 - DNA, 13 bp, Homo sapiens
aggcatggccctg

SEQ ID NO: 5212441 - DNA, 16 bp, Homo sapiens
aggcatggccctgggg

SEQ ID NO: 5212442 - DNA, 12 bp, Homo sapiens
aggcatggctgg

SEQ ID NO: 5212443 - DNA, 19 bp, Homo sapiens
aggcatggctggtgcctga

SEQ ID NO: 5212444 - DNA, 20 bp, Homo sapiens
aggcatggctggtgcctgaa

SEQ ID NO: 5212445 - DNA, 18 bp, Homo sapiens
aggcatggggcatgtcct

SEQ ID NO: 5212446 - DNA, 18 bp, Homo sapiens
aggcatgggggcccaaag

SEQ ID NO: 5212447 - DNA, 19 bp, Homo sapiens
aggcatgggggcccaaagg

SEQ ID NO: 5212448 - DNA, 18 bp, Homo sapiens
aggcatgtacaaaaatta

SEQ ID NO: 5212449 - DNA, 19 bp, Homo sapiens
aggcatgtaggaccctgca

SEQ ID NO: 5212450 - DNA, 15 bp, Homo sapiens
aggcatgtcccaccc

SEQ ID NO: 5212451 - DNA, 16 bp, Homo sapiens
aggcatgtcccaccca

SEQ ID NO: 5212452 - DNA, 14 bp, Homo sapiens
aggcatgtcctgga

SEQ ID NO: 5212453 - DNA, 17 bp, Homo sapiens
aggcatgtgatgagagg

SEQ ID NO: 5212454 - DNA, 21 bp, Homo sapiens
aggcatgtgatgagaggaaat

SEQ ID NO: 5212455 - DNA, 22 bp, Homo sapiens
aggcatgtgccacccacccaac

SEQ ID NO: 5212456 - DNA, 14 bp, Homo sapiens
aggcatgttcaggg

SEQ ID NO: 5212457 - DNA, 17 bp, Homo sapiens
aggcatgttcagggatg

SEQ ID NO: 5212458 - DNA, 20 bp, Homo sapiens
aggcatgttctctgaggaca

SEQ ID NO: 5212459 - DNA, 20 bp, Homo sapiens
aggcatgttggactctgagc

SEQ ID NO: 5212460 - DNA, 14 bp, Homo sapiens
aggcattaaatgca

SEQ ID NO: 5212461 - DNA, 15 bp, Homo sapiens
aggcattaaatgcaa

SEQ ID NO: 5212462 - DNA, 22 bp, Homo sapiens
aggcattaaattttagcaaaga

SEQ ID NO: 5212463 - DNA, 19 bp, Homo sapiens
aggcattaatgtttctatc

SEQ ID NO: 5212464 - DNA, 20 bp, Homo sapiens
aggcattacttgctttcaat

SEQ ID NO: 5212465 - DNA, 22 bp, Homo sapiens
aggcattacttgctttcaattg

SEQ ID NO: 5212466 - DNA, 17 bp, Homo sapiens
aggcattatttaatgtt

SEQ ID NO: 5212467 - DNA, 16 bp, Homo sapiens
aggcattcagcaatta

SEQ ID NO: 5212468 - DNA, 13 bp, Homo sapiens
aggcattccacag

SEQ ID NO: 5212469 - DNA, 19 bp, Homo sapiens
aggggacaggcctcacctc

SEQ ID NO: 5212470 - DNA, 14 bp, Homo sapiens
aggggaccagaggg

SEQ ID NO: 5212471 - DNA, 18 bp, Homo sapiens
aggggaccagagggatgg

SEQ ID NO: 5212472 - DNA, 22 bp, Homo sapiens
aggggaccatgaagagactctc

SEQ ID NO: 5212473 - DNA, 12 bp, Homo sapiens
aggggacccagc

SEQ ID NO: 5212474 - DNA, 15 bp, Homo sapiens
aggggacccagctcc

SEQ ID NO: 5212475 - DNA, 17 bp, Homo sapiens
aggggacccatgggggc

SEQ ID NO: 5212476 - DNA, 16 bp, Homo sapiens
aggggaccccactccc

SEQ ID NO: 5212477 - DNA, 14 bp, Homo sapiens
aggggacccccgcc

SEQ ID NO: 5212478 - DNA, 15 bp, Homo sapiens
aggggacccccgccc

SEQ ID NO: 5212479 - DNA, 22 bp, Homo sapiens
aggggaccccgagaaccctgag

SEQ ID NO: 5212480 - DNA, 23 bp, Homo sapiens
aggggaccccgagaaccctgagc

SEQ ID NO: 5212481 - DNA, 23 bp, Homo sapiens
aggggacctggaagggaggtggg

SEQ ID NO: 5212482 - DNA, 20 bp, Homo sapiens
aggggacctggagctgccag

SEQ ID NO: 5212483 - DNA, 24 bp, Homo sapiens
aggggaccttggcgctctcagctt

SEQ ID NO: 5212484 - DNA, 20 bp, Homo sapiens
aggggacgcaggcccctctc

SEQ ID NO: 5212485 - DNA, 14 bp, Homo sapiens
aggggacgctggta

SEQ ID NO: 5212486 - DNA, 13 bp, Homo sapiens
aggggacgggaca

SEQ ID NO: 5212487 - DNA, 14 bp, Homo sapiens
aggggacgggcaag

SEQ ID NO: 5212488 - DNA, 16 bp, Homo sapiens
aggggacgggcaagtg

SEQ ID NO: 5212489 - DNA, 21 bp, Homo sapiens
aggggactaattcactggcga

SEQ ID NO: 5212490 - DNA, 23 bp, Homo sapiens
aggggactctgggctatggacac

SEQ ID NO: 5212491 - DNA, 20 bp, Homo sapiens
aggggactgagctggggagg

SEQ ID NO: 5212492 - DNA, 16 bp, Homo sapiens
aggggactgccacctc

SEQ ID NO: 5212493 - DNA, 17 bp, Homo sapiens
aggggactgccacctcc

SEQ ID NO: 5212494 - DNA, 12 bp, Homo sapiens
aggggactgggg

SEQ ID NO: 5212495 - DNA, 20 bp, Homo sapiens
aggggactgggggactggga

SEQ ID NO: 5212496 - DNA, 21 bp, Homo sapiens
aggggacttggataggagctt

SEQ ID NO: 5212497 - DNA, 16 bp, Homo sapiens
aggggacttgtgccag

SEQ ID NO: 5212498 - DNA, 18 bp, Homo sapiens
aggggacttgtgccagca

SEQ ID NO: 5212499 - DNA, 15 bp, Homo sapiens
aggggagaaactgaa

SEQ ID NO: 5212500 - DNA, 16 bp, Homo sapiens
aggggagaaaggaact

SEQ ID NO: 5212501 - DNA, 17 bp, Homo sapiens
aggggagaagccaaggg

SEQ ID NO: 5212502 - DNA, 15 bp, Homo sapiens
aggggagaagggcca

SEQ ID NO: 5212503 - DNA, 23 bp, Homo sapiens
aggggagaagggccagccctaca

SEQ ID NO: 5212504 - DNA, 14 bp, Homo sapiens
aggggagacagagc

SEQ ID NO: 5212505 - DNA, 17 bp, Homo sapiens
aggggagacagggcaat

SEQ ID NO: 5212506 - DNA, 20 bp, Homo sapiens
aggggagacattagaaaaaa

SEQ ID NO: 5212507 - DNA, 14 bp, Homo sapiens
aggggagacgaggc

SEQ ID NO: 5212508 - DNA, 23 bp, Homo sapiens
aggggagacttaggccagaggtg

SEQ ID NO: 5212509 - DNA, 13 bp, Homo sapiens
aggggagactttg

SEQ ID NO: 5212510 - DNA, 13 bp, Homo sapiens
aggggagagaagg

SEQ ID NO: 5212511 - DNA, 18 bp, Homo sapiens
aggggagagacaggcagc

SEQ ID NO: 5212512 - DNA, 22 bp, Homo sapiens
aggggagagagcagagaagtac

SEQ ID NO: 5212513 - DNA, 22 bp, Homo sapiens
aggggagagcctgctggcaccc

SEQ ID NO: 5212514 - DNA, 10 bp, Homo sapiens
aggggagagg

SEQ ID NO: 5212515 - DNA, 14 bp, Homo sapiens
aggggagaggggtc

SEQ ID NO: 5212516 - DNA, 19 bp, Homo sapiens
aggggagagtccagtgagt

SEQ ID NO: 5212517 - DNA, 12 bp, Homo sapiens
aggggagcaagc

SEQ ID NO: 5212518 - DNA, 13 bp, Homo sapiens
aggggagcagagg

SEQ ID NO: 5212519 - DNA, 16 bp, Homo sapiens
aggggagcagaggggc

SEQ ID NO: 5212520 - DNA, 20 bp, Homo sapiens
aggggagcagcggctctggt

SEQ ID NO: 5212521 - DNA, 23 bp, Homo sapiens
aggggagcatgcttccctgcagc

SEQ ID NO: 5212522 - DNA, 24 bp, Homo sapiens
aggggagcatgcttccctgcagct

SEQ ID NO: 5212523 - DNA, 12 bp, Homo sapiens
aggggagccaga

SEQ ID NO: 5212524 - DNA, 20 bp, Homo sapiens
aggggagccagaaatgggca

SEQ ID NO: 5212525 - DNA, 21 bp, Homo sapiens
aggggagccagaaatgggcag

SEQ ID NO: 5212526 - DNA, 22 bp, Homo sapiens
aggggagccagaaatgggcagt

SEQ ID NO: 5212527 - DNA, 13 bp, Homo sapiens
aggggagccagct

SEQ ID NO: 5212528 - DNA, 17 bp, Homo sapiens
aggggagccagctgctt

SEQ ID NO: 5212529 - DNA, 24 bp, Homo sapiens
aggggagcccactgtcctgggcct

SEQ ID NO: 5212530 - DNA, 17 bp, Homo sapiens
aggggagctctgtctgt

SEQ ID NO: 5212531 - DNA, 16 bp, Homo sapiens
aggggagctgctggcc

SEQ ID NO: 5212532 - DNA, 19 bp, Homo sapiens
aggggagcttgagggacaa

SEQ ID NO: 5212533 - DNA, 15 bp, Homo sapiens
aggggagcttgggac

SEQ ID NO: 5212534 - DNA, 17 bp, Homo sapiens
aggggaggaaaaaagaa

SEQ ID NO: 5212535 - DNA, 10 bp, Homo sapiens
aggggaggag

SEQ ID NO: 5212536 - DNA, 12 bp, Homo sapiens
aggggaggaggg

SEQ ID NO: 5212537 - DNA, 14 bp, Homo sapiens
aggggaggagggcg

SEQ ID NO: 5212538 - DNA, 15 bp, Homo sapiens
aggggaggccatctg

SEQ ID NO: 5212539 - DNA, 20 bp, Homo sapiens
aggggaggctgctttctgcc

SEQ ID NO: 5212540 - DNA, 17 bp, Homo sapiens
aggggagggaaaagcta

SEQ ID NO: 5212541 - DNA, 18 bp, Homo sapiens
aggggagggagggaagtc

SEQ ID NO: 5212542 - DNA, 13 bp, Homo sapiens
aggggagggcagg

SEQ ID NO: 5212543 - DNA, 16 bp, Homo sapiens
aggggagggctcctgg

SEQ ID NO: 5212544 - DNA, 20 bp, Homo sapiens
aggggagggctcctggggca

SEQ ID NO: 5212545 - DNA, 16 bp, Homo sapiens
aggggaggggcctagg

SEQ ID NO: 5212546 - DNA, 21 bp, Homo sapiens
aggggaggggcctagggagcc

SEQ ID NO: 5212547 - DNA, 15 bp, Homo sapiens
aggggaggggcctcc

SEQ ID NO: 5212548 - DNA, 17 bp, Homo sapiens
aggggaggggcgcaccc

SEQ ID NO: 5212549 - DNA, 22 bp, Homo sapiens
aggggaggggcgcaccccacag

SEQ ID NO: 5212550 - DNA, 23 bp, Homo sapiens
aggggaggggcgcaccccacagc

SEQ ID NO: 5212551 - DNA, 18 bp, Homo sapiens
aggggagggggatccgac

SEQ ID NO: 5212552 - DNA, 17 bp, Homo sapiens
aggggaggggggagcca

SEQ ID NO: 5212553 - DNA, 16 bp, Homo sapiens
aggggaggggggaggg

SEQ ID NO: 5212554 - DNA, 18 bp, Homo sapiens
aggggaggggggaggggg

SEQ ID NO: 5212555 - DNA, 16 bp, Homo sapiens
aggggaggtggccagc

SEQ ID NO: 5212556 - DNA, 20 bp, Homo sapiens
aggggaggtggccagcccgc

SEQ ID NO: 5212557 - DNA, 13 bp, Homo sapiens
aggggagtctgct

SEQ ID NO: 5212558 - DNA, 12 bp, Homo sapiens
aggggagtgtgg

SEQ ID NO: 5212559 - DNA, 13 bp, Homo sapiens
aggggagtgtggg

SEQ ID NO: 5212560 - DNA, 15 bp, Homo sapiens
aggggagtgtgggtg

SEQ ID NO: 5212561 - DNA, 16 bp, Homo sapiens
aggggatagagagaga

SEQ ID NO: 5212562 - DNA, 17 bp, Homo sapiens
aggggatataggagagg

SEQ ID NO: 5212563 - DNA, 14 bp, Homo sapiens
aggggatatatgtt

SEQ ID NO: 5212564 - DNA, 14 bp, Homo sapiens
aggggatatttaag

SEQ ID NO: 5212565 - DNA, 21 bp, Homo sapiens
aggggatatttaaggtagctt

SEQ ID NO: 5212566 - DNA, 14 bp, Homo sapiens
aggggatcaaagtt

SEQ ID NO: 5212567 - DNA, 19 bp, Homo sapiens
aggggatcataaagttaga

SEQ ID NO: 5212568 - DNA, 20 bp, Homo sapiens
aggggatctaaaaggaggac

SEQ ID NO: 5212569 - DNA, 13 bp, Homo sapiens
aggggatggaggc

SEQ ID NO: 5212570 - DNA, 15 bp, Homo sapiens
aggggatggaggcca

SEQ ID NO: 5212571 - DNA, 17 bp, Homo sapiens
aggggatggaggccaga

SEQ ID NO: 5212572 - DNA, 20 bp, Homo sapiens
aggggatggaggccagagtc

SEQ ID NO: 5212573 - DNA, 19 bp, Homo sapiens
aggggatggagtgagccca

SEQ ID NO: 5212574 - DNA, 14 bp, Homo sapiens
aggggatggcagac

SEQ ID NO: 5212575 - DNA, 24 bp, Homo sapiens
aggggatggcagacagtcaaggag

SEQ ID NO: 5212576 - DNA, 13 bp, Homo sapiens
aggggatgggtgt

SEQ ID NO: 5212577 - DNA, 15 bp, Homo sapiens
aggggatgggtgtgg

SEQ ID NO: 5212578 - DNA, 17 bp, Homo sapiens
aggggatggtagacctt

SEQ ID NO: 5212579 - DNA, 20 bp, Homo sapiens
aggggatggttagtcacctg

SEQ ID NO: 5212580 - DNA, 22 bp, Homo sapiens
aggggatgtatccatgggggca

SEQ ID NO: 5212581 - DNA, 20 bp, Homo sapiens
aggggatgtttacctggtgc

SEQ ID NO: 5212582 - DNA, 22 bp, Homo sapiens
aggggatgtttacctggtgctc

SEQ ID NO: 5212583 - DNA, 13 bp, Homo sapiens
aggggattctcta

SEQ ID NO: 5212584 - DNA, 14 bp, Homo sapiens
aggggattctctac

SEQ ID NO: 5212585 - DNA, 15 bp, Homo sapiens
aggggattctctact

SEQ ID NO: 5212586 - DNA, 19 bp, Homo sapiens
aggggattgaagccctcca

SEQ ID NO: 5212587 - DNA, 15 bp, Homo sapiens
aggggattttgctga

SEQ ID NO: 5212588 - DNA, 22 bp, Homo sapiens
aggggatttttttgatgtgcct

SEQ ID NO: 5212589 - DNA, 14 bp, Homo sapiens
aggggcaaaaatat

SEQ ID NO: 5212590 - DNA, 15 bp, Homo sapiens
aggggcaaaaatttg

SEQ ID NO: 5212591 - DNA, 18 bp, Homo sapiens
aggggcaaagaactgccc

SEQ ID NO: 5212592 - DNA, 18 bp, Homo sapiens
aggggcaacgaagaaaaa

SEQ ID NO: 5212593 - DNA, 19 bp, Homo sapiens
aggggcaacgaagaaaaaa

SEQ ID NO: 5212594 - DNA, 20 bp, Homo sapiens
aggggcaacgaagaaaaaaa

SEQ ID NO: 5212595 - DNA, 18 bp, Homo sapiens
aggggcaagctaggcccc

SEQ ID NO: 5212596 - DNA, 18 bp, Homo sapiens
aggggcacacaatgctat

SEQ ID NO: 5212597 - DNA, 11 bp, Homo sapiens
aggggcacacc

SEQ ID NO: 5212598 - DNA, 19 bp, Homo sapiens
aggggcacaccactgccct

SEQ ID NO: 5212599 - DNA, 22 bp, Homo sapiens
aggggcacaccactgccctgcc

SEQ ID NO: 5212600 - DNA, 16 bp, Homo sapiens
aggggcacactacaga

SEQ ID NO: 5212601 - DNA, 18 bp, Homo sapiens
aggggcacactacagagc

SEQ ID NO: 5212602 - DNA, 22 bp, Homo sapiens
aggggcacactacagagcagct

SEQ ID NO: 5212603 - DNA, 22 bp, Homo sapiens
aggggcacacttccccttggga

SEQ ID NO: 5212604 - DNA, 15 bp, Homo sapiens
aggggcacagggtct

SEQ ID NO: 5212605 - DNA, 18 bp, Homo sapiens
aggggcacctccggctgc

SEQ ID NO: 5212606 - DNA, 13 bp, Homo sapiens
aggggcacctgcc

SEQ ID NO: 5212607 - DNA, 14 bp, Homo sapiens
aggggcacctgcca

SEQ ID NO: 5212608 - DNA, 22 bp, Homo sapiens
aggggcacctgggaaaacagag

SEQ ID NO: 5212609 - DNA, 14 bp, Homo sapiens
aggggcactctccc

SEQ ID NO: 5212610 - DNA, 16 bp, Homo sapiens
aggggcactctcccct

SEQ ID NO: 5212611 - DNA, 19 bp, Homo sapiens
aggggcacttcattgagag

SEQ ID NO: 5212612 - DNA, 17 bp, Homo sapiens
aggggcagaaggaggaa

SEQ ID NO: 5212613 - DNA, 18 bp, Homo sapiens
aggggcagagaggaagtg

SEQ ID NO: 5212614 - DNA, 14 bp, Homo sapiens
aggggcagagccag

SEQ ID NO: 5212615 - DNA, 16 bp, Homo sapiens
aggggcagagccagga

SEQ ID NO: 5212616 - DNA, 15 bp, Homo sapiens
aggggcagaggaggc

SEQ ID NO: 5212617 - DNA, 13 bp, Homo sapiens
aggggcagaggcc

SEQ ID NO: 5212618 - DNA, 23 bp, Homo sapiens
aggggcagattggttcatgcctg

SEQ ID NO: 5212619 - DNA, 13 bp, Homo sapiens
aggggcagcaagg

SEQ ID NO: 5212620 - DNA, 18 bp, Homo sapiens
aggggcagcaaggccttg

SEQ ID NO: 5212621 - DNA, 12 bp, Homo sapiens
aggggcagcagg

SEQ ID NO: 5212622 - DNA, 22 bp, Homo sapiens
aggggcagcaggaggagtggaa

SEQ ID NO: 5212623 - DNA, 14 bp, Homo sapiens
aggggcagccagcc

SEQ ID NO: 5212624 - DNA, 11 bp, Homo sapiens
aggggcagccc

SEQ ID NO: 5212625 - DNA, 14 bp, Homo sapiens
aggggcagccctga

SEQ ID NO: 5212626 - DNA, 15 bp, Homo sapiens
aggggcagccctgag

SEQ ID NO: 5212627 - DNA, 21 bp, Homo sapiens
aggggcagccctgagtggtca

SEQ ID NO: 5212628 - DNA, 13 bp, Homo sapiens
aggggcagcctgc

SEQ ID NO: 5212629 - DNA, 17 bp, Homo sapiens
aggggcagcctgtgcct

SEQ ID NO: 5212630 - DNA, 20 bp, Homo sapiens
aggggcagcgcatgtgtgca

SEQ ID NO: 5212631 - DNA, 15 bp, Homo sapiens
aggggcagctcctga

SEQ ID NO: 5212632 - DNA, 15 bp, Homo sapiens
aggggcagctgacca

SEQ ID NO: 5212633 - DNA, 11 bp, Homo sapiens
aggggcagctt

SEQ ID NO: 5212634 - DNA, 14 bp, Homo sapiens
aggggcagcttcta

SEQ ID NO: 5212635 - DNA, 14 bp, Homo sapiens
aggggcaggactga

SEQ ID NO: 5212636 - DNA, 15 bp, Homo sapiens
aggggcaggactgag

SEQ ID NO: 5212637 - DNA, 19 bp, Homo sapiens
aggggcaggagaggctggg

SEQ ID NO: 5212638 - DNA, 12 bp, Homo sapiens
aggggcaggagc

SEQ ID NO: 5212639 - DNA, 13 bp, Homo sapiens
aggggcaggcaca

SEQ ID NO: 5212640 - DNA, 14 bp, Homo sapiens
aggggcaggcacag

SEQ ID NO: 5212641 - DNA, 14 bp, Homo sapiens
aggggcaggcagct

SEQ ID NO: 5212642 - DNA, 22 bp, Homo sapiens
aggggcaggcagctaggcaggg

SEQ ID NO: 5212643 - DNA, 14 bp, Homo sapiens
aggggcaggcaggg

SEQ ID NO: 5212644 - DNA, 15 bp, Homo sapiens
aggggcaggcagggc

SEQ ID NO: 5212645 - DNA, 16 bp, Homo sapiens
aggggcaggcagggct

SEQ ID NO: 5212646 - DNA, 19 bp, Homo sapiens
aggggcaggccctgcactg

SEQ ID NO: 5212647 - DNA, 12 bp, Homo sapiens
aggggcaggcct

SEQ ID NO: 5212648 - DNA, 15 bp, Homo sapiens
aggggcaggcctggg

SEQ ID NO: 5212649 - DNA, 13 bp, Homo sapiens
aggggcaggcctt

SEQ ID NO: 5212650 - DNA, 15 bp, Homo sapiens
aggcattccacagga

SEQ ID NO: 5212651 - DNA, 16 bp, Homo sapiens
aggcattccacaggat

SEQ ID NO: 5212652 - DNA, 17 bp, Homo sapiens
aggcattccccaggagg

SEQ ID NO: 5212653 - DNA, 20 bp, Homo sapiens
aggcattccccaggaggcca

SEQ ID NO: 5212654 - DNA, 22 bp, Homo sapiens
aggcattccccaggaggccagc

SEQ ID NO: 5212655 - DNA, 14 bp, Homo sapiens
aggcattcctcatc

SEQ ID NO: 5212656 - DNA, 14 bp, Homo sapiens
aggcattctcccag

SEQ ID NO: 5212657 - DNA, 20 bp, Homo sapiens
aggcattctcccagctctag

SEQ ID NO: 5212658 - DNA, 13 bp, Homo sapiens
aggcattctctga

SEQ ID NO: 5212659 - DNA, 21 bp, Homo sapiens
aggcattctgtataaatgcaa

SEQ ID NO: 5212660 - DNA, 19 bp, Homo sapiens
aggcattgacataggtcat

SEQ ID NO: 5212661 - DNA, 14 bp, Homo sapiens
aggcattgaggaag

SEQ ID NO: 5212662 - DNA, 19 bp, Homo sapiens
aggcattgaggaagagtct

SEQ ID NO: 5212663 - DNA, 21 bp, Homo sapiens
aggcattgcactaaaagtgat

SEQ ID NO: 5212664 - DNA, 16 bp, Homo sapiens
aggcattgccaagggc

SEQ ID NO: 5212665 - DNA, 20 bp, Homo sapiens
aggcattgccaagggctttg

SEQ ID NO: 5212666 - DNA, 21 bp, Homo sapiens
aggcattgccaagggctttgt

SEQ ID NO: 5212667 - DNA, 23 bp, Homo sapiens
aggcattgccttctctgcccaca

SEQ ID NO: 5212668 - DNA, 13 bp, Homo sapiens
aggcattggatat

SEQ ID NO: 5212669 - DNA, 20 bp, Homo sapiens
aggcatttaaaatggaaaag

SEQ ID NO: 5212670 - DNA, 15 bp, Homo sapiens
aggcatttaggaact

SEQ ID NO: 5212671 - DNA, 20 bp, Homo sapiens
aggcatttaggccatgggac

SEQ ID NO: 5212672 - DNA, 15 bp, Homo sapiens
aggcatttcctgctg

SEQ ID NO: 5212673 - DNA, 15 bp, Homo sapiens
aggcatttcctgggt

SEQ ID NO: 5212674 - DNA, 16 bp, Homo sapiens
aggcatttgagcagct

SEQ ID NO: 5212675 - DNA, 22 bp, Homo sapiens
aggcatttgattaaattatgaa

SEQ ID NO: 5212676 - DNA, 19 bp, Homo sapiens
aggcattttactatgcctg

SEQ ID NO: 5212677 - DNA, 23 bp, Homo sapiens
aggcattttatatgaattataaa

SEQ ID NO: 5212678 - DNA, 21 bp, Homo sapiens
aggcattttcccccttggctc

SEQ ID NO: 5212679 - DNA, 12 bp, Homo sapiens
aggcattttgtt

SEQ ID NO: 5212680 - DNA, 23 bp, Homo sapiens
aggcatttttgtaatgagccatt

SEQ ID NO: 5212681 - DNA, 15 bp, Homo sapiens
aggccaaaatcaaga

SEQ ID NO: 5212682 - DNA, 22 bp, Homo sapiens
aggccaaacacccaagcacaaa

SEQ ID NO: 5212683 - DNA, 16 bp, Homo sapiens
aggccaaacctctgtt

SEQ ID NO: 5212684 - DNA, 17 bp, Homo sapiens
aggccaaacctctgttc

SEQ ID NO: 5212685 - DNA, 16 bp, Homo sapiens
aggccaaactcacctg

SEQ ID NO: 5212686 - DNA, 17 bp, Homo sapiens
aggccaaactgctggac

SEQ ID NO: 5212687 - DNA, 21 bp, Homo sapiens
aggccaaactggcaaacttca

SEQ ID NO: 5212688 - DNA, 14 bp, Homo sapiens
aggccaaactgtcc

SEQ ID NO: 5212689 - DNA, 16 bp, Homo sapiens
aggccaaactgtccct

SEQ ID NO: 5212690 - DNA, 16 bp, Homo sapiens
aggccaaagaaggagg

SEQ ID NO: 5212691 - DNA, 21 bp, Homo sapiens
aggccaaagagtctccagttt

SEQ ID NO: 5212692 - DNA, 16 bp, Homo sapiens
aggccaaaggaagcac

SEQ ID NO: 5212693 - DNA, 18 bp, Homo sapiens
aggccaaaggaagcacat

SEQ ID NO: 5212694 - DNA, 21 bp, Homo sapiens
aggccaaaggggacctggaag

SEQ ID NO: 5212695 - DNA, 14 bp, Homo sapiens
aggccaaatgcaca

SEQ ID NO: 5212696 - DNA, 14 bp, Homo sapiens
aggccaacagcacc

SEQ ID NO: 5212697 - DNA, 14 bp, Homo sapiens
aggccaactgcctc

SEQ ID NO: 5212698 - DNA, 17 bp, Homo sapiens
aggccaagaaacgtctt

SEQ ID NO: 5212699 - DNA, 21 bp, Homo sapiens
aggccaagaaacgtcttctaa

SEQ ID NO: 5212700 - DNA, 14 bp, Homo sapiens
aggccaagagcaga

SEQ ID NO: 5212701 - DNA, 17 bp, Homo sapiens
aggccaagagcagaggc

SEQ ID NO: 5212702 - DNA, 20 bp, Homo sapiens
aggccaagagcagaggcagc

SEQ ID NO: 5212703 - DNA, 14 bp, Homo sapiens
aggccaagaggctg

SEQ ID NO: 5212704 - DNA, 13 bp, Homo sapiens
aggccaagaggtt

SEQ ID NO: 5212705 - DNA, 14 bp, Homo sapiens
aggccaagaggttt

SEQ ID NO: 5212706 - DNA, 21 bp, Homo sapiens
aggccaagaggtttggctcct

SEQ ID NO: 5212707 - DNA, 16 bp, Homo sapiens
aggccaagagtggccc

SEQ ID NO: 5212708 - DNA, 21 bp, Homo sapiens
aggccaagagtggccccacct

SEQ ID NO: 5212709 - DNA, 23 bp, Homo sapiens
aggccaagagtggccccacctgg

SEQ ID NO: 5212710 - DNA, 21 bp, Homo sapiens
aggccaagagtttgagaccaa

SEQ ID NO: 5212711 - DNA, 16 bp, Homo sapiens
aggccaagatcccctc

SEQ ID NO: 5212712 - DNA, 16 bp, Homo sapiens
aggccaagatggctgc

SEQ ID NO: 5212713 - DNA, 18 bp, Homo sapiens
aggccaagatggctgctg

SEQ ID NO: 5212714 - DNA, 23 bp, Homo sapiens
aggccaagatggctgctgcctgc

SEQ ID NO: 5212715 - DNA, 21 bp, Homo sapiens
aggccaagcagtgcctgccta

SEQ ID NO: 5212716 - DNA, 15 bp, Homo sapiens
aggccaagctgagga

SEQ ID NO: 5212717 - DNA, 18 bp, Homo sapiens
aggccaaggcgggtggat

SEQ ID NO: 5212718 - DNA, 13 bp, Homo sapiens
aggccaaggggag

SEQ ID NO: 5212719 - DNA, 22 bp, Homo sapiens
aggccaaggggagtcaccttcc

SEQ ID NO: 5212720 - DNA, 13 bp, Homo sapiens
aggccaaggtgct

SEQ ID NO: 5212721 - DNA, 17 bp, Homo sapiens
aggccaaggtgggcgga

SEQ ID NO: 5212722 - DNA, 21 bp, Homo sapiens
aggccaaggtgtcctacagaa

SEQ ID NO: 5212723 - DNA, 22 bp, Homo sapiens
aggccaagtctaatgaagagaa

SEQ ID NO: 5212724 - DNA, 15 bp, Homo sapiens
aggccaagtgcaggc

SEQ ID NO: 5212725 - DNA, 22 bp, Homo sapiens
aggccaagtgtgataaataaac

SEQ ID NO: 5212726 - DNA, 23 bp, Homo sapiens
aggccaagtttgtatcaggtgcc

SEQ ID NO: 5212727 - DNA, 15 bp, Homo sapiens
aggccaataaaaagt

SEQ ID NO: 5212728 - DNA, 18 bp, Homo sapiens
aggccaatagttttagat

SEQ ID NO: 5212729 - DNA, 22 bp, Homo sapiens
aggccaatatattttgaaatat

SEQ ID NO: 5212730 - DNA, 20 bp, Homo sapiens
aggccaatcccttctccact

SEQ ID NO: 5212731 - DNA, 22 bp, Homo sapiens
aggccaatgaaggctgaatcaa

SEQ ID NO: 5212732 - DNA, 14 bp, Homo sapiens
aggccacaaaaaca

SEQ ID NO: 5212733 - DNA, 15 bp, Homo sapiens
aggccacaaaaacaa

SEQ ID NO: 5212734 - DNA, 16 bp, Homo sapiens
aggccacaaaaacaat

SEQ ID NO: 5212735 - DNA, 21 bp, Homo sapiens
aggccacaccatctcctttca

SEQ ID NO: 5212736 - DNA, 22 bp, Homo sapiens
aggccacaccatctcctttcag

SEQ ID NO: 5212737 - DNA, 22 bp, Homo sapiens
aggccacacgcactggtgccaa

SEQ ID NO: 5212738 - DNA, 21 bp, Homo sapiens
aggccacacgctgcccaggct

SEQ ID NO: 5212739 - DNA, 12 bp, Homo sapiens
aggccacactgg

SEQ ID NO: 5212740 - DNA, 21 bp, Homo sapiens
aggccacacttcaaactactt

SEQ ID NO: 5212741 - DNA, 22 bp, Homo sapiens
aggccacagaaggtgaactttg

SEQ ID NO: 5212742 - DNA, 19 bp, Homo sapiens
aggccacagagaacctgag

SEQ ID NO: 5212743 - DNA, 15 bp, Homo sapiens
aggccacagcccctg

SEQ ID NO: 5212744 - DNA, 18 bp, Homo sapiens
aggccacagcccctggca

SEQ ID NO: 5212745 - DNA, 13 bp, Homo sapiens
aggccacagccgc

SEQ ID NO: 5212746 - DNA, 14 bp, Homo sapiens
aggccacaggccac

SEQ ID NO: 5212747 - DNA, 22 bp, Homo sapiens
aggccacagtggggctgcaggc

SEQ ID NO: 5212748 - DNA, 15 bp, Homo sapiens
aggccacatacctct

SEQ ID NO: 5212749 - DNA, 20 bp, Homo sapiens
aggccacatccacagtctcc

SEQ ID NO: 5212750 - DNA, 18 bp, Homo sapiens
aggccacatgagtcccag

SEQ ID NO: 5212751 - DNA, 19 bp, Homo sapiens
aggccacatgagtcccagt

SEQ ID NO: 5212752 - DNA, 21 bp, Homo sapiens
aggccacatgggagcagtcca

SEQ ID NO: 5212753 - DNA, 23 bp, Homo sapiens
aggccacatggggctgggcagct

SEQ ID NO: 5212754 - DNA, 24 bp, Homo sapiens
aggccacattactagagttggcat

SEQ ID NO: 5212755 - DNA, 18 bp, Homo sapiens
aggccacattgctggctg

SEQ ID NO: 5212756 - DNA, 12 bp, Homo sapiens
aggccacccact

SEQ ID NO: 5212757 - DNA, 13 bp, Homo sapiens
aggccacccactg

SEQ ID NO: 5212758 - DNA, 18 bp, Homo sapiens
aggccacccactgaccca

SEQ ID NO: 5212759 - DNA, 12 bp, Homo sapiens
aggccaccccaa

SEQ ID NO: 5212760 - DNA, 14 bp, Homo sapiens
aggccaccccaaac

SEQ ID NO: 5212761 - DNA, 16 bp, Homo sapiens
aggccaccccaacctc

SEQ ID NO: 5212762 - DNA, 12 bp, Homo sapiens
aggccaccccca

SEQ ID NO: 5212763 - DNA, 20 bp, Homo sapiens
aggccaccccctatcctctg

SEQ ID NO: 5212764 - DNA, 23 bp, Homo sapiens
aggccaccccctatcctctgagt

SEQ ID NO: 5212765 - DNA, 15 bp, Homo sapiens
aggccaccctgcctc

SEQ ID NO: 5212766 - DNA, 20 bp, Homo sapiens
aggccaccctgtgcagaagg

SEQ ID NO: 5212767 - DNA, 14 bp, Homo sapiens
aggccaccgggaca

SEQ ID NO: 5212768 - DNA, 21 bp, Homo sapiens
aggccacctcagtctcacctg

SEQ ID NO: 5212769 - DNA, 16 bp, Homo sapiens
aggccacctccagaaa

SEQ ID NO: 5212770 - DNA, 14 bp, Homo sapiens
aggccacctcccac

SEQ ID NO: 5212771 - DNA, 15 bp, Homo sapiens
aggccacctcccact

SEQ ID NO: 5212772 - DNA, 22 bp, Homo sapiens
aggccacctcccactcctgctg

SEQ ID NO: 5212773 - DNA, 15 bp, Homo sapiens
aggccacctccccag

SEQ ID NO: 5212774 - DNA, 22 bp, Homo sapiens
aggccacctcctaaaaggccca

SEQ ID NO: 5212775 - DNA, 13 bp, Homo sapiens
aggccacctctcc

SEQ ID NO: 5212776 - DNA, 16 bp, Homo sapiens
aggccacctctccaag

SEQ ID NO: 5212777 - DNA, 17 bp, Homo sapiens
aggccacctctgcctct

SEQ ID NO: 5212778 - DNA, 14 bp, Homo sapiens
aggccacctcttcc

SEQ ID NO: 5212779 - DNA, 11 bp, Homo sapiens
aggccacctgc

SEQ ID NO: 5212780 - DNA, 14 bp, Homo sapiens
aggccacctgcagg

SEQ ID NO: 5212781 - DNA, 15 bp, Homo sapiens
aggccacctgccccc

SEQ ID NO: 5212782 - DNA, 20 bp, Homo sapiens
aggccacctgtcttctctcc

SEQ ID NO: 5212783 - DNA, 16 bp, Homo sapiens
aggccaccttggagga

SEQ ID NO: 5212784 - DNA, 13 bp, Homo sapiens
aggccacggcagc

SEQ ID NO: 5212785 - DNA, 19 bp, Homo sapiens
aggccacgtatagtcctag

SEQ ID NO: 5212786 - DNA, 17 bp, Homo sapiens
aggccacgtccaggtcc

SEQ ID NO: 5212787 - DNA, 17 bp, Homo sapiens
aggccacgtcccacccc

SEQ ID NO: 5212788 - DNA, 21 bp, Homo sapiens
aggccacgtcccaccccacct

SEQ ID NO: 5212789 - DNA, 22 bp, Homo sapiens
aggccacgtcccaccccacctc

SEQ ID NO: 5212790 - DNA, 19 bp, Homo sapiens
aggccacgtgatgtggagg

SEQ ID NO: 5212791 - DNA, 15 bp, Homo sapiens
aggccactagtgaca

SEQ ID NO: 5212792 - DNA, 22 bp, Homo sapiens
aggccactcagaggcccccagt

SEQ ID NO: 5212793 - DNA, 14 bp, Homo sapiens
aggccactgaagag

SEQ ID NO: 5212794 - DNA, 18 bp, Homo sapiens
aggccactgaagaggagg

SEQ ID NO: 5212795 - DNA, 20 bp, Homo sapiens
aggccactgaagaggaggag

SEQ ID NO: 5212796 - DNA, 14 bp, Homo sapiens
aggccactgtgagc

SEQ ID NO: 5212797 - DNA, 18 bp, Homo sapiens
aggccactgtgagcgctg

SEQ ID NO: 5212798 - DNA, 14 bp, Homo sapiens
aggccactgtggcc

SEQ ID NO: 5212799 - DNA, 19 bp, Homo sapiens
aggccactgtggccagagc

SEQ ID NO: 5212800 - DNA, 22 bp, Homo sapiens
aggccactgtggccagagctgg

SEQ ID NO: 5212801 - DNA, 20 bp, Homo sapiens
aggccactgtgggtgaagcg

SEQ ID NO: 5212802 - DNA, 19 bp, Homo sapiens
aggccactgtttggaaata

SEQ ID NO: 5212803 - DNA, 16 bp, Homo sapiens
aggccacttgctcaga

SEQ ID NO: 5212804 - DNA, 15 bp, Homo sapiens
aggccagaaaaagaa

SEQ ID NO: 5212805 - DNA, 17 bp, Homo sapiens
aggccagaaaaggcagc

SEQ ID NO: 5212806 - DNA, 18 bp, Homo sapiens
aggccagaaaaggcagcc

SEQ ID NO: 5212807 - DNA, 19 bp, Homo sapiens
aggccagaaaaggcagcca

SEQ ID NO: 5212808 - DNA, 18 bp, Homo sapiens
aggccagaaggaggggga

SEQ ID NO: 5212809 - DNA, 14 bp, Homo sapiens
aggccagacacagg

SEQ ID NO: 5212810 - DNA, 19 bp, Homo sapiens
aggccagacacaggccgtg

SEQ ID NO: 5212811 - DNA, 20 bp, Homo sapiens
aggccagacacaggccgtgg

SEQ ID NO: 5212812 - DNA, 15 bp, Homo sapiens
aggccagacatggtg

SEQ ID NO: 5212813 - DNA, 16 bp, Homo sapiens
aggccagacatggtgt

SEQ ID NO: 5212814 - DNA, 17 bp, Homo sapiens
aggccagaccatggaca

SEQ ID NO: 5212815 - DNA, 12 bp, Homo sapiens
aggccagacctg

SEQ ID NO: 5212816 - DNA, 21 bp, Homo sapiens
aggccagagaaagcaaaggtg

SEQ ID NO: 5212817 - DNA, 13 bp, Homo sapiens
aggccagagacac

SEQ ID NO: 5212818 - DNA, 14 bp, Homo sapiens
aggccagagccaag

SEQ ID NO: 5212819 - DNA, 15 bp, Homo sapiens
aggccagagccatgc

SEQ ID NO: 5212820 - DNA, 11 bp, Homo sapiens
aggccagagga

SEQ ID NO: 5212821 - DNA, 13 bp, Homo sapiens
aggccagaggaag

SEQ ID NO: 5212822 - DNA, 16 bp, Homo sapiens
aggccagaggaaggga

SEQ ID NO: 5212823 - DNA, 16 bp, Homo sapiens
aggccagagtggcctg

SEQ ID NO: 5212824 - DNA, 19 bp, Homo sapiens
aggccagagtggcctggcc

SEQ ID NO: 5212825 - DNA, 22 bp, Homo sapiens
aggccagatggcccctccactg

SEQ ID NO: 5212826 - DNA, 18 bp, Homo sapiens
aggccagattacaaatta

SEQ ID NO: 5212827 - DNA, 19 bp, Homo sapiens
aggccagcaaatgttcctt

SEQ ID NO: 5212828 - DNA, 12 bp, Homo sapiens
aggggcaggcgc

SEQ ID NO: 5212829 - DNA, 15 bp, Homo sapiens
aggggcaggcgcaga

SEQ ID NO: 5212830 - DNA, 19 bp, Homo sapiens
aggggcaggcgcagaggtc

SEQ ID NO: 5212831 - DNA, 13 bp, Homo sapiens
aggggcagggaag

SEQ ID NO: 5212832 - DNA, 23 bp, Homo sapiens
aggggcagggaaggacaggaccc

SEQ ID NO: 5212833 - DNA, 16 bp, Homo sapiens
aggggcagggatgggg

SEQ ID NO: 5212834 - DNA, 19 bp, Homo sapiens
aggggcaggtggtggaggg

SEQ ID NO: 5212835 - DNA, 22 bp, Homo sapiens
aggggcaggtgtttctttcctg

SEQ ID NO: 5212836 - DNA, 13 bp, Homo sapiens
aggggcagtccca

SEQ ID NO: 5212837 - DNA, 20 bp, Homo sapiens
aggggcagtttgggaaggtg

SEQ ID NO: 5212838 - DNA, 16 bp, Homo sapiens
aggggcatctgcccct

SEQ ID NO: 5212839 - DNA, 18 bp, Homo sapiens
aggggcatggccagcagc

SEQ ID NO: 5212840 - DNA, 21 bp, Homo sapiens
aggggcatgtattggcctgga

SEQ ID NO: 5212841 - DNA, 23 bp, Homo sapiens
aggggcatttcacagtgcccaag

SEQ ID NO: 5212842 - DNA, 22 bp, Homo sapiens
aggggccaaatatattctcttt

SEQ ID NO: 5212843 - DNA, 23 bp, Homo sapiens
aggggccaaatatattctctttg

SEQ ID NO: 5212844 - DNA, 21 bp, Homo sapiens
aggggccaacctcaggctcct

SEQ ID NO: 5212845 - DNA, 16 bp, Homo sapiens
aggggccaataaaatg

SEQ ID NO: 5212846 - DNA, 15 bp, Homo sapiens
aggggccacctcctc

SEQ ID NO: 5212847 - DNA, 18 bp, Homo sapiens
aggggccacctcctcccc

SEQ ID NO: 5212848 - DNA, 13 bp, Homo sapiens
aggggccactggg

SEQ ID NO: 5212849 - DNA, 19 bp, Homo sapiens
aggggccactgggccccat

SEQ ID NO: 5212850 - DNA, 17 bp, Homo sapiens
aggggccagaagatgaa

SEQ ID NO: 5212851 - DNA, 12 bp, Homo sapiens
aggggccagacc

SEQ ID NO: 5212852 - DNA, 19 bp, Homo sapiens
aggggccagaccctgccca

SEQ ID NO: 5212853 - DNA, 12 bp, Homo sapiens
aggggccagagg

SEQ ID NO: 5212854 - DNA, 13 bp, Homo sapiens
aggggccagaggc

SEQ ID NO: 5212855 - DNA, 18 bp, Homo sapiens
aggggccagcggccctcc

SEQ ID NO: 5212856 - DNA, 21 bp, Homo sapiens
aggggccagcggccctcccag

SEQ ID NO: 5212857 - DNA, 13 bp, Homo sapiens
aggggccagctgc

SEQ ID NO: 5212858 - DNA, 14 bp, Homo sapiens
aggggccaggaagg

SEQ ID NO: 5212859 - DNA, 19 bp, Homo sapiens
aggggccaggagtggggag

SEQ ID NO: 5212860 - DNA, 17 bp, Homo sapiens
aggggccaggcccaggc

SEQ ID NO: 5212861 - DNA, 19 bp, Homo sapiens
aggggccaggcccaggcag

SEQ ID NO: 5212862 - DNA, 17 bp, Homo sapiens
aggggccaggggcaggc

SEQ ID NO: 5212863 - DNA, 24 bp, Homo sapiens
aggggccagtgagggctgggccca

SEQ ID NO: 5212864 - DNA, 18 bp, Homo sapiens
aggggccagtggattccc

SEQ ID NO: 5212865 - DNA, 12 bp, Homo sapiens
aggggccatgcc

SEQ ID NO: 5212866 - DNA, 19 bp, Homo sapiens
aggggccatgtcctctctt

SEQ ID NO: 5212867 - DNA, 16 bp, Homo sapiens
aggggccatttggcat

SEQ ID NO: 5212868 - DNA, 17 bp, Homo sapiens
aggggcccaagagagac

SEQ ID NO: 5212869 - DNA, 17 bp, Homo sapiens
aggggcccaagccccat

SEQ ID NO: 5212870 - DNA, 20 bp, Homo sapiens
aggggcccaaggcggcccct

SEQ ID NO: 5212871 - DNA, 12 bp, Homo sapiens
aggggcccacaa

SEQ ID NO: 5212872 - DNA, 13 bp, Homo sapiens
aggggcccacaaa

SEQ ID NO: 5212873 - DNA, 18 bp, Homo sapiens
aggggcccacaaagggga

SEQ ID NO: 5212874 - DNA, 19 bp, Homo sapiens
aggggcccacaaaggggag

SEQ ID NO: 5212875 - DNA, 14 bp, Homo sapiens
aggggcccacaggg

SEQ ID NO: 5212876 - DNA, 19 bp, Homo sapiens
aggggcccacagggaaccc

SEQ ID NO: 5212877 - DNA, 11 bp, Homo sapiens
aggggcccagg

SEQ ID NO: 5212878 - DNA, 15 bp, Homo sapiens
aggggcccaggctcc

SEQ ID NO: 5212879 - DNA, 20 bp, Homo sapiens
aggggcccaggctcccctgc

SEQ ID NO: 5212880 - DNA, 21 bp, Homo sapiens
aggggcccaggctcccctgcc

SEQ ID NO: 5212881 - DNA, 23 bp, Homo sapiens
aggggcccaggctcccctgcccg

SEQ ID NO: 5212882 - DNA, 20 bp, Homo sapiens
aggggccccagatctgcctg

SEQ ID NO: 5212883 - DNA, 20 bp, Homo sapiens
aggggccccagcgtctgcag

SEQ ID NO: 5212884 - DNA, 20 bp, Homo sapiens
aggggccccggggctggcaa

SEQ ID NO: 5212885 - DNA, 21 bp, Homo sapiens
aggggccccggggctggcaag

SEQ ID NO: 5212886 - DNA, 18 bp, Homo sapiens
aggggcccctcctccaga

SEQ ID NO: 5212887 - DNA, 22 bp, Homo sapiens
aggggcccctcctctgtgctcc

SEQ ID NO: 5212888 - DNA, 14 bp, Homo sapiens
aggggcccctctca

SEQ ID NO: 5212889 - DNA, 14 bp, Homo sapiens
aggggcccctggcc

SEQ ID NO: 5212890 - DNA, 18 bp, Homo sapiens
aggggcccctggcccagg

SEQ ID NO: 5212891 - DNA, 15 bp, Homo sapiens
aggggcccctgggga

SEQ ID NO: 5212892 - DNA, 23 bp, Homo sapiens
aggggcccggccagccatgtctg

SEQ ID NO: 5212893 - DNA, 22 bp, Homo sapiens
aggggcccgggaactcctgcca

SEQ ID NO: 5212894 - DNA, 17 bp, Homo sapiens
aggggcccggtggcggc

SEQ ID NO: 5212895 - DNA, 15 bp, Homo sapiens
aggggccctacctgg

SEQ ID NO: 5212896 - DNA, 19 bp, Homo sapiens
aggggccctcactcttgaa

SEQ ID NO: 5212897 - DNA, 19 bp, Homo sapiens
aggggccctccatgcgcag

SEQ ID NO: 5212898 - DNA, 14 bp, Homo sapiens
aggggccctgagcc

SEQ ID NO: 5212899 - DNA, 15 bp, Homo sapiens
aggggccctgagcca

SEQ ID NO: 5212900 - DNA, 15 bp, Homo sapiens
aggggccctggagca

SEQ ID NO: 5212901 - DNA, 17 bp, Homo sapiens
aggggccctggagcagc

SEQ ID NO: 5212902 - DNA, 12 bp, Homo sapiens
aggggccctggt

SEQ ID NO: 5212903 - DNA, 15 bp, Homo sapiens
aggggccctgtacag

SEQ ID NO: 5212904 - DNA, 17 bp, Homo sapiens
aggggcccttgggacag

SEQ ID NO: 5212905 - DNA, 23 bp, Homo sapiens
aggggcccttgggacagccagag

SEQ ID NO: 5212906 - DNA, 12 bp, Homo sapiens
aggggccgccct

SEQ ID NO: 5212907 - DNA, 16 bp, Homo sapiens
aggggccgctgccacc

SEQ ID NO: 5212908 - DNA, 19 bp, Homo sapiens
aggggccgcttcgccatgt

SEQ ID NO: 5212909 - DNA, 19 bp, Homo sapiens
aggggccggggagggggca

SEQ ID NO: 5212910 - DNA, 23 bp, Homo sapiens
aggggccggggagggggcacggc

SEQ ID NO: 5212911 - DNA, 17 bp, Homo sapiens
aggggcctagggagccg

SEQ ID NO: 5212912 - DNA, 16 bp, Homo sapiens
aggggcctcaggtcct

SEQ ID NO: 5212913 - DNA, 17 bp, Homo sapiens
aggggcctcatcttccc

SEQ ID NO: 5212914 - DNA, 22 bp, Homo sapiens
aggggcctccatgggccccagg

SEQ ID NO: 5212915 - DNA, 20 bp, Homo sapiens
aggggcctcccggggcccag

SEQ ID NO: 5212916 - DNA, 15 bp, Homo sapiens
aggggcctctctcct

SEQ ID NO: 5212917 - DNA, 16 bp, Homo sapiens
aggggcctctctcctg

SEQ ID NO: 5212918 - DNA, 13 bp, Homo sapiens
aggggcctctgaa

SEQ ID NO: 5212919 - DNA, 20 bp, Homo sapiens
aggggcctctgaaatttccc

SEQ ID NO: 5212920 - DNA, 20 bp, Homo sapiens
aggggcctcttatgggctgg

SEQ ID NO: 5212921 - DNA, 12 bp, Homo sapiens
aggggcctgagt

SEQ ID NO: 5212922 - DNA, 13 bp, Homo sapiens
aggggcctgagtg

SEQ ID NO: 5212923 - DNA, 19 bp, Homo sapiens
aggggcctgccacctggac

SEQ ID NO: 5212924 - DNA, 16 bp, Homo sapiens
aggggcctgccactct

SEQ ID NO: 5212925 - DNA, 22 bp, Homo sapiens
aggggcctgccactctcctgag

SEQ ID NO: 5212926 - DNA, 13 bp, Homo sapiens
aggggcctgccca

SEQ ID NO: 5212927 - DNA, 13 bp, Homo sapiens
aggggcctgccct

SEQ ID NO: 5212928 - DNA, 12 bp, Homo sapiens
aggggcctgcct

SEQ ID NO: 5212929 - DNA, 14 bp, Homo sapiens
aggggcctgcgccc

SEQ ID NO: 5212930 - DNA, 16 bp, Homo sapiens
aggggcctgcgcccag

SEQ ID NO: 5212931 - DNA, 11 bp, Homo sapiens
aggggcctgga

SEQ ID NO: 5212932 - DNA, 14 bp, Homo sapiens
aggggcctggagat

SEQ ID NO: 5212933 - DNA, 14 bp, Homo sapiens
aggggcctggaggt

SEQ ID NO: 5212934 - DNA, 13 bp, Homo sapiens
aggggcctggcag

SEQ ID NO: 5212935 - DNA, 23 bp, Homo sapiens
aggggcctggcagccgtgccttc

SEQ ID NO: 5212936 - DNA, 14 bp, Homo sapiens
aggggcctggcctg

SEQ ID NO: 5212937 - DNA, 15 bp, Homo sapiens
aggggcctgggcagc

SEQ ID NO: 5212938 - DNA, 17 bp, Homo sapiens
aggggcctgggcagccc

SEQ ID NO: 5212939 - DNA, 21 bp, Homo sapiens
aggggcctgggcagccccaca

SEQ ID NO: 5212940 - DNA, 13 bp, Homo sapiens
aggggcctgggcc

SEQ ID NO: 5212941 - DNA, 15 bp, Homo sapiens
aggggcctgggctgt

SEQ ID NO: 5212942 - DNA, 18 bp, Homo sapiens
aggggcctgggctgtgag

SEQ ID NO: 5212943 - DNA, 17 bp, Homo sapiens
aggggccttagggcact

SEQ ID NO: 5212944 - DNA, 20 bp, Homo sapiens
aggggccttagggcactggg

SEQ ID NO: 5212945 - DNA, 18 bp, Homo sapiens
aggggccttgctctgagc

SEQ ID NO: 5212946 - DNA, 19 bp, Homo sapiens
aggggccttgctctgagca

SEQ ID NO: 5212947 - DNA, 21 bp, Homo sapiens
aggggccttgctctgagcaca

SEQ ID NO: 5212948 - DNA, 14 bp, Homo sapiens
aggggccttgctga

SEQ ID NO: 5212949 - DNA, 16 bp, Homo sapiens
aggggcctttgctgcc

SEQ ID NO: 5212950 - DNA, 14 bp, Homo sapiens
aggggcgcacccca

SEQ ID NO: 5212951 - DNA, 16 bp, Homo sapiens
aggggcgcgggagggg

SEQ ID NO: 5212952 - DNA, 17 bp, Homo sapiens
aggggcgctcctcccag

SEQ ID NO: 5212953 - DNA, 22 bp, Homo sapiens
aggggcgctcctcccagctgta

SEQ ID NO: 5212954 - DNA, 20 bp, Homo sapiens
aggggcgctcgcttccgcat

SEQ ID NO: 5212955 - DNA, 13 bp, Homo sapiens
aggggcgctggcc

SEQ ID NO: 5212956 - DNA, 16 bp, Homo sapiens
aggggcgctggcccag

SEQ ID NO: 5212957 - DNA, 17 bp, Homo sapiens
aggggcgctggcccagc

SEQ ID NO: 5212958 - DNA, 21 bp, Homo sapiens
aggggcgctggcccagccggc

SEQ ID NO: 5212959 - DNA, 13 bp, Homo sapiens
aggggcgctgtcc

SEQ ID NO: 5212960 - DNA, 14 bp, Homo sapiens
aggggcgctgtcct

SEQ ID NO: 5212961 - DNA, 15 bp, Homo sapiens
aggggcgctgtcctg

SEQ ID NO: 5212962 - DNA, 16 bp, Homo sapiens
aggggcgctgtcctgc

SEQ ID NO: 5212963 - DNA, 14 bp, Homo sapiens
aggggcggcaggag

SEQ ID NO: 5212964 - DNA, 18 bp, Homo sapiens
aggggcgggacccaggca

SEQ ID NO: 5212965 - DNA, 19 bp, Homo sapiens
aggggcgggacccaggcac

SEQ ID NO: 5212966 - DNA, 16 bp, Homo sapiens
aggggcgggcggaggg

SEQ ID NO: 5212967 - DNA, 19 bp, Homo sapiens
aggggcgggcggagggagg

SEQ ID NO: 5212968 - DNA, 14 bp, Homo sapiens
aggggcggggcagg

SEQ ID NO: 5212969 - DNA, 14 bp, Homo sapiens
aggggcggggccag

SEQ ID NO: 5212970 - DNA, 20 bp, Homo sapiens
aggggcgggggcggaggagg

SEQ ID NO: 5212971 - DNA, 20 bp, Homo sapiens
aggggcgggtggatcacctg

SEQ ID NO: 5212972 - DNA, 22 bp, Homo sapiens
aggggcgtctgttcccccttca

SEQ ID NO: 5212973 - DNA, 20 bp, Homo sapiens
aggggcgtgggagtggcctg

SEQ ID NO: 5212974 - DNA, 14 bp, Homo sapiens
aggggcgtgtccct

SEQ ID NO: 5212975 - DNA, 21 bp, Homo sapiens
aggggcgtgtccctcctcttc

SEQ ID NO: 5212976 - DNA, 15 bp, Homo sapiens
aggggctacaagagg

SEQ ID NO: 5212977 - DNA, 17 bp, Homo sapiens
aggggctacaagaggga

SEQ ID NO: 5212978 - DNA, 18 bp, Homo sapiens
aggggctacaagagggaa

SEQ ID NO: 5212979 - DNA, 19 bp, Homo sapiens
aggggctaccctgggaagc

SEQ ID NO: 5212980 - DNA, 16 bp, Homo sapiens
aggggctatcctggga

SEQ ID NO: 5212981 - DNA, 17 bp, Homo sapiens
aggggctatcctgggac

SEQ ID NO: 5212982 - DNA, 20 bp, Homo sapiens
aggggctcagcaaggtgtga

SEQ ID NO: 5212983 - DNA, 15 bp, Homo sapiens
aggggctcagttctg

SEQ ID NO: 5212984 - DNA, 18 bp, Homo sapiens
aggggctccatgccagcc

SEQ ID NO: 5212985 - DNA, 13 bp, Homo sapiens
aggggctccctcc

SEQ ID NO: 5212986 - DNA, 15 bp, Homo sapiens
aggggctcctgagtg

SEQ ID NO: 5212987 - DNA, 23 bp, Homo sapiens
aggggctcctggaaaggctcagt

SEQ ID NO: 5212988 - DNA, 16 bp, Homo sapiens
aggggctcctgggttg

SEQ ID NO: 5212989 - DNA, 20 bp, Homo sapiens
aggggctcgagtgcccctgc

SEQ ID NO: 5212990 - DNA, 21 bp, Homo sapiens
aggggctcgagtgcccctgca

SEQ ID NO: 5212991 - DNA, 22 bp, Homo sapiens
aggggctcgagtgcccctgcag

SEQ ID NO: 5212992 - DNA, 18 bp, Homo sapiens
aggggctctgtgttagga

SEQ ID NO: 5212993 - DNA, 20 bp, Homo sapiens
aggggctgcagccccctgct

SEQ ID NO: 5212994 - DNA, 14 bp, Homo sapiens
aggggctgcaggga

SEQ ID NO: 5212995 - DNA, 19 bp, Homo sapiens
aggggctgcatcctcagcc

SEQ ID NO: 5212996 - DNA, 22 bp, Homo sapiens
aggggctgcatcctcagcccca

SEQ ID NO: 5212997 - DNA, 21 bp, Homo sapiens
aggggctgcccgagtctgttt

SEQ ID NO: 5212998 - DNA, 22 bp, Homo sapiens
aggggctgcgtctgacatcctg

SEQ ID NO: 5212999 - DNA, 22 bp, Homo sapiens
aggggctgcgtgtgggaggctg

SEQ ID NO: 5213000 - DNA, 20 bp, Homo sapiens
aggggctgctcatcacccag

SEQ ID NO: 5213001 - DNA, 21 bp, Homo sapiens
aggggctgctcatcacccagt

SEQ ID NO: 5213002 - DNA, 14 bp, Homo sapiens
aggggctgctccag

SEQ ID NO: 5213003 - DNA, 11 bp, Homo sapiens
aggggctgctg

SEQ ID NO: 5213004 - DNA, 15 bp, Homo sapiens
aggggctgctgcctt

SEQ ID NO: 5213005 - DNA, 12 bp, Homo sapiens
aggggctgctgg

SEQ ID NO: 5213006 - DNA, 16 bp, Homo sapiens
aggggctgctggggca

SEQ ID NO: 5213007 - DNA, 22 bp, Homo sapiens
aggccagcaaggtggagtggat

SEQ ID NO: 5213008 - DNA, 17 bp, Homo sapiens
aggccagcacccaaagg

SEQ ID NO: 5213009 - DNA, 21 bp, Homo sapiens
aggccagcacccaaagggtta

SEQ ID NO: 5213010 - DNA, 14 bp, Homo sapiens
aggccagcagcctt

SEQ ID NO: 5213011 - DNA, 15 bp, Homo sapiens
aggccagcagccttc

SEQ ID NO: 5213012 - DNA, 17 bp, Homo sapiens
aggccagcagccttcca

SEQ ID NO: 5213013 - DNA, 14 bp, Homo sapiens
aggccagcaggggc

SEQ ID NO: 5213014 - DNA, 13 bp, Homo sapiens
aggccagccagtg

SEQ ID NO: 5213015 - DNA, 22 bp, Homo sapiens
aggccagcccacacagcccgag

SEQ ID NO: 5213016 - DNA, 15 bp, Homo sapiens
aggccagcccactgg

SEQ ID NO: 5213017 - DNA, 22 bp, Homo sapiens
aggccagcccactgggccctgg

SEQ ID NO: 5213018 - DNA, 12 bp, Homo sapiens
aggccagcccag

SEQ ID NO: 5213019 - DNA, 13 bp, Homo sapiens
aggccagcccagc

SEQ ID NO: 5213020 - DNA, 15 bp, Homo sapiens
aggccagcccagcca

SEQ ID NO: 5213021 - DNA, 18 bp, Homo sapiens
aggccagcccagccaggc

SEQ ID NO: 5213022 - DNA, 13 bp, Homo sapiens
aggccagccccac

SEQ ID NO: 5213023 - DNA, 18 bp, Homo sapiens
aggccagccccacccagg

SEQ ID NO: 5213024 - DNA, 13 bp, Homo sapiens
aggccagccccat

SEQ ID NO: 5213025 - DNA, 15 bp, Homo sapiens
aggccagccccatct

SEQ ID NO: 5213026 - DNA, 20 bp, Homo sapiens
aggccagccccatcttggtc

SEQ ID NO: 5213027 - DNA, 14 bp, Homo sapiens
aggccagccccccc

SEQ ID NO: 5213028 - DNA, 21 bp, Homo sapiens
aggccagcccggacctctgga

SEQ ID NO: 5213029 - DNA, 18 bp, Homo sapiens
aggccagcctccgagagg

SEQ ID NO: 5213030 - DNA, 19 bp, Homo sapiens
aggccagcctggcctcctg

SEQ ID NO: 5213031 - DNA, 20 bp, Homo sapiens
aggccagcctggcctcctgc

SEQ ID NO: 5213032 - DNA, 22 bp, Homo sapiens
aggccagcctggcctcctgcct

SEQ ID NO: 5213033 - DNA, 16 bp, Homo sapiens
aggccagcctgtccct

SEQ ID NO: 5213034 - DNA, 21 bp, Homo sapiens
aggccagcctgtccctgaaag

SEQ ID NO: 5213035 - DNA, 13 bp, Homo sapiens
aggccagccttga

SEQ ID NO: 5213036 - DNA, 15 bp, Homo sapiens
aggccagccttgacc

SEQ ID NO: 5213037 - DNA, 15 bp, Homo sapiens
aggccagccttggca

SEQ ID NO: 5213038 - DNA, 19 bp, Homo sapiens
aggccagcgaggcgaggct

SEQ ID NO: 5213039 - DNA, 17 bp, Homo sapiens
aggccagcggtgaccag

SEQ ID NO: 5213040 - DNA, 17 bp, Homo sapiens
aggccagctatctgcct

SEQ ID NO: 5213041 - DNA, 20 bp, Homo sapiens
aggccagctatctgcctgac

SEQ ID NO: 5213042 - DNA, 16 bp, Homo sapiens
aggccagctcaggaat

SEQ ID NO: 5213043 - DNA, 12 bp, Homo sapiens
aggccagctcct

SEQ ID NO: 5213044 - DNA, 19 bp, Homo sapiens
aggccagctgccccagcca

SEQ ID NO: 5213045 - DNA, 23 bp, Homo sapiens
aggccagctgcttgggcttcatc

SEQ ID NO: 5213046 - DNA, 14 bp, Homo sapiens
aggccagctggcag

SEQ ID NO: 5213047 - DNA, 17 bp, Homo sapiens
aggccagctggcagcag

SEQ ID NO: 5213048 - DNA, 19 bp, Homo sapiens
aggccagctggcagcagag

SEQ ID NO: 5213049 - DNA, 20 bp, Homo sapiens
aggccagctgtggttttctt

SEQ ID NO: 5213050 - DNA, 18 bp, Homo sapiens
aggccagcttcgtgctgg

SEQ ID NO: 5213051 - DNA, 20 bp, Homo sapiens
aggccagcttcgtgctggag

SEQ ID NO: 5213052 - DNA, 21 bp, Homo sapiens
aggccaggaccaagggcagag

SEQ ID NO: 5213053 - DNA, 13 bp, Homo sapiens
aggccaggaccac

SEQ ID NO: 5213054 - DNA, 24 bp, Homo sapiens
aggccaggaccacacagtccccag

SEQ ID NO: 5213055 - DNA, 18 bp, Homo sapiens
aggccaggacgggccaca

SEQ ID NO: 5213056 - DNA, 18 bp, Homo sapiens
aggccaggactctgcagc

SEQ ID NO: 5213057 - DNA, 19 bp, Homo sapiens
aggccaggactctgcagcc

SEQ ID NO: 5213058 - DNA, 20 bp, Homo sapiens
aggccaggactctgcagcct

SEQ ID NO: 5213059 - DNA, 22 bp, Homo sapiens
aggccaggactctgcagcctca

SEQ ID NO: 5213060 - DNA, 21 bp, Homo sapiens
aggccaggagtttgagaccag

SEQ ID NO: 5213061 - DNA, 18 bp, Homo sapiens
aggccaggatgcctgagc

SEQ ID NO: 5213062 - DNA, 12 bp, Homo sapiens
aggccaggccct

SEQ ID NO: 5213063 - DNA, 16 bp, Homo sapiens
aggccaggccctctgc

SEQ ID NO: 5213064 - DNA, 17 bp, Homo sapiens
aggccaggccctctgcc

SEQ ID NO: 5213065 - DNA, 19 bp, Homo sapiens
aggccaggccctctgccca

SEQ ID NO: 5213066 - DNA, 23 bp, Homo sapiens
aggccaggctcccgaccccatcc

SEQ ID NO: 5213067 - DNA, 14 bp, Homo sapiens
aggccagggcacag

SEQ ID NO: 5213068 - DNA, 13 bp, Homo sapiens
aggccagggcaga

SEQ ID NO: 5213069 - DNA, 13 bp, Homo sapiens
aggccagggcagc

SEQ ID NO: 5213070 - DNA, 14 bp, Homo sapiens
aggccagggcagca

SEQ ID NO: 5213071 - DNA, 19 bp, Homo sapiens
aggccagggcagcaaggga

SEQ ID NO: 5213072 - DNA, 20 bp, Homo sapiens
aggccagggcagcaagggac

SEQ ID NO: 5213073 - DNA, 13 bp, Homo sapiens
aggccagggcagt

SEQ ID NO: 5213074 - DNA, 16 bp, Homo sapiens
aggccagggctcctgt

SEQ ID NO: 5213075 - DNA, 12 bp, Homo sapiens
aggccagggctg

SEQ ID NO: 5213076 - DNA, 13 bp, Homo sapiens
aggccagggctgg

SEQ ID NO: 5213077 - DNA, 23 bp, Homo sapiens
aggccagggctgggtcacaggaa

SEQ ID NO: 5213078 - DNA, 14 bp, Homo sapiens
aggccaggggaggg

SEQ ID NO: 5213079 - DNA, 19 bp, Homo sapiens
aggccagggggccagtccc

SEQ ID NO: 5213080 - DNA, 12 bp, Homo sapiens
aggccagggtca

SEQ ID NO: 5213081 - DNA, 23 bp, Homo sapiens
aggccagggtcactgaaggcctg

SEQ ID NO: 5213082 - DNA, 13 bp, Homo sapiens
aggccaggtagca

SEQ ID NO: 5213083 - DNA, 15 bp, Homo sapiens
aggccaggtccagag

SEQ ID NO: 5213084 - DNA, 18 bp, Homo sapiens
aggccaggtgcaaccagg

SEQ ID NO: 5213085 - DNA, 13 bp, Homo sapiens
aggccaggtgccc

SEQ ID NO: 5213086 - DNA, 17 bp, Homo sapiens
aggccaggtgcccagga

SEQ ID NO: 5213087 - DNA, 18 bp, Homo sapiens
aggccaggtgcccaggaa

SEQ ID NO: 5213088 - DNA, 17 bp, Homo sapiens
aggccaggtgggcggac

SEQ ID NO: 5213089 - DNA, 18 bp, Homo sapiens
aggccagtaatcccagtg

SEQ ID NO: 5213090 - DNA, 20 bp, Homo sapiens
aggccagtactactgctctc

SEQ ID NO: 5213091 - DNA, 13 bp, Homo sapiens
aggccagtacttt

SEQ ID NO: 5213092 - DNA, 20 bp, Homo sapiens
aggccagtccccatttctgc

SEQ ID NO: 5213093 - DNA, 14 bp, Homo sapiens
aggccagtgccagg

SEQ ID NO: 5213094 - DNA, 15 bp, Homo sapiens
aggccagtgccagga

SEQ ID NO: 5213095 - DNA, 16 bp, Homo sapiens
aggccagtgccaggac

SEQ ID NO: 5213096 - DNA, 18 bp, Homo sapiens
aggccagtgccaggacag

SEQ ID NO: 5213097 - DNA, 20 bp, Homo sapiens
aggccagtgccaggacagct

SEQ ID NO: 5213098 - DNA, 21 bp, Homo sapiens
aggccagtgccaggacagctg

SEQ ID NO: 5213099 - DNA, 17 bp, Homo sapiens
aggccagtgctgtgagc

SEQ ID NO: 5213100 - DNA, 15 bp, Homo sapiens
aggccagtggaagaa

SEQ ID NO: 5213101 - DNA, 17 bp, Homo sapiens
aggccagtggacagagg

SEQ ID NO: 5213102 - DNA, 21 bp, Homo sapiens
aggccagtggacagagggaga

SEQ ID NO: 5213103 - DNA, 22 bp, Homo sapiens
aggccagtggcccccgggcctg

SEQ ID NO: 5213104 - DNA, 14 bp, Homo sapiens
aggccagtgggcct

SEQ ID NO: 5213105 - DNA, 20 bp, Homo sapiens
aggccagtgggcctggtagc

SEQ ID NO: 5213106 - DNA, 14 bp, Homo sapiens
aggccagtgtggtg

SEQ ID NO: 5213107 - DNA, 19 bp, Homo sapiens
aggccagtgttgtgggctt

SEQ ID NO: 5213108 - DNA, 18 bp, Homo sapiens
aggccataccaggtgcta

SEQ ID NO: 5213109 - DNA, 12 bp, Homo sapiens
aggccatatttg

SEQ ID NO: 5213110 - DNA, 23 bp, Homo sapiens
aggccatattttaaaaaatcaaa

SEQ ID NO: 5213111 - DNA, 13 bp, Homo sapiens
aggccatcagggc

SEQ ID NO: 5213112 - DNA, 14 bp, Homo sapiens
aggccatcagggcc

SEQ ID NO: 5213113 - DNA, 20 bp, Homo sapiens
aggccatcagggccctgccc

SEQ ID NO: 5213114 - DNA, 21 bp, Homo sapiens
aggccatccttccctgtctgc

SEQ ID NO: 5213115 - DNA, 15 bp, Homo sapiens
aggccatctcaggag

SEQ ID NO: 5213116 - DNA, 18 bp, Homo sapiens
aggccatctcaggagatg

SEQ ID NO: 5213117 - DNA, 10 bp, Homo sapiens
aggccatctg

SEQ ID NO: 5213118 - DNA, 21 bp, Homo sapiens
aggccatctggagagcccaga

SEQ ID NO: 5213119 - DNA, 13 bp, Homo sapiens
aggccatctgtaa

SEQ ID NO: 5213120 - DNA, 18 bp, Homo sapiens
aggccatcttccaggtgg

SEQ ID NO: 5213121 - DNA, 15 bp, Homo sapiens
aggccatgcaagggt

SEQ ID NO: 5213122 - DNA, 18 bp, Homo sapiens
aggccatggactctgtcc

SEQ ID NO: 5213123 - DNA, 20 bp, Homo sapiens
aggccatggactctgtcctg

SEQ ID NO: 5213124 - DNA, 21 bp, Homo sapiens
aggccatggactctgtcctga

SEQ ID NO: 5213125 - DNA, 17 bp, Homo sapiens
aggccatggagagctgg

SEQ ID NO: 5213126 - DNA, 21 bp, Homo sapiens
aggccatggagagctggagcc

SEQ ID NO: 5213127 - DNA, 22 bp, Homo sapiens
aggccatggagagctggagcct

SEQ ID NO: 5213128 - DNA, 15 bp, Homo sapiens
aggccatggcagaat

SEQ ID NO: 5213129 - DNA, 13 bp, Homo sapiens
aggccatggccaa

SEQ ID NO: 5213130 - DNA, 21 bp, Homo sapiens
aggccatgggcactgtgggta

SEQ ID NO: 5213131 - DNA, 14 bp, Homo sapiens
aggccatgggcctc

SEQ ID NO: 5213132 - DNA, 16 bp, Homo sapiens
aggccatgggcctcct

SEQ ID NO: 5213133 - DNA, 14 bp, Homo sapiens
aggccatggggcag

SEQ ID NO: 5213134 - DNA, 15 bp, Homo sapiens
aggccatggggcagc

SEQ ID NO: 5213135 - DNA, 16 bp, Homo sapiens
aggccatggggcagcc

SEQ ID NO: 5213136 - DNA, 23 bp, Homo sapiens
aggccatggggcagcctccagtc

SEQ ID NO: 5213137 - DNA, 22 bp, Homo sapiens
aggccatgggggcccctcggca

SEQ ID NO: 5213138 - DNA, 15 bp, Homo sapiens
aggccatgtgagcca

SEQ ID NO: 5213139 - DNA, 16 bp, Homo sapiens
aggccatgtgagccac

SEQ ID NO: 5213140 - DNA, 20 bp, Homo sapiens
aggccatgtgagccaccgct

SEQ ID NO: 5213141 - DNA, 22 bp, Homo sapiens
aggccatgtgagccaccgctgc

SEQ ID NO: 5213142 - DNA, 18 bp, Homo sapiens
aggccatgtggcctgccc

SEQ ID NO: 5213143 - DNA, 19 bp, Homo sapiens
aggccatgtggcctgccca

SEQ ID NO: 5213144 - DNA, 23 bp, Homo sapiens
aggccatgttccaataaacagga

SEQ ID NO: 5213145 - DNA, 19 bp, Homo sapiens
aggccattatgcctggcta

SEQ ID NO: 5213146 - DNA, 23 bp, Homo sapiens
aggccattccccaacggggtggg

SEQ ID NO: 5213147 - DNA, 14 bp, Homo sapiens
aggccattctttcc

SEQ ID NO: 5213148 - DNA, 19 bp, Homo sapiens
aggccattgtgaaccaatg

SEQ ID NO: 5213149 - DNA, 21 bp, Homo sapiens
aggccatttgctgccctgggg

SEQ ID NO: 5213150 - DNA, 15 bp, Homo sapiens
aggccatttgtattt

SEQ ID NO: 5213151 - DNA, 13 bp, Homo sapiens
aggcccaaagcct

SEQ ID NO: 5213152 - DNA, 22 bp, Homo sapiens
aggcccaaattatcaagctaat

SEQ ID NO: 5213153 - DNA, 14 bp, Homo sapiens
aggcccaacctcct

SEQ ID NO: 5213154 - DNA, 14 bp, Homo sapiens
aggcccaactgtga

SEQ ID NO: 5213155 - DNA, 20 bp, Homo sapiens
aggcccaagagatgaagagt

SEQ ID NO: 5213156 - DNA, 22 bp, Homo sapiens
aggcccaagagcagagtctggg

SEQ ID NO: 5213157 - DNA, 13 bp, Homo sapiens
aggcccaaggagc

SEQ ID NO: 5213158 - DNA, 22 bp, Homo sapiens
aggcccaaggagcttacccaag

SEQ ID NO: 5213159 - DNA, 14 bp, Homo sapiens
aggcccaaggaggg

SEQ ID NO: 5213160 - DNA, 18 bp, Homo sapiens
aggcccaaggagggtcca

SEQ ID NO: 5213161 - DNA, 17 bp, Homo sapiens
aggcccaaggctcccgg

SEQ ID NO: 5213162 - DNA, 14 bp, Homo sapiens
aggcccacacacag

SEQ ID NO: 5213163 - DNA, 16 bp, Homo sapiens
aggcccacacacaggt

SEQ ID NO: 5213164 - DNA, 12 bp, Homo sapiens
aggcccacagga

SEQ ID NO: 5213165 - DNA, 13 bp, Homo sapiens
aggcccacaggag

SEQ ID NO: 5213166 - DNA, 19 bp, Homo sapiens
aggcccacattggaagagc

SEQ ID NO: 5213167 - DNA, 10 bp, Homo sapiens
aggcccacca

SEQ ID NO: 5213168 - DNA, 12 bp, Homo sapiens
aggcccaccctg

SEQ ID NO: 5213169 - DNA, 22 bp, Homo sapiens
aggcccacctaccttcaaagct

SEQ ID NO: 5213170 - DNA, 23 bp, Homo sapiens
aggcccacctaccttcaaagctg

SEQ ID NO: 5213171 - DNA, 17 bp, Homo sapiens
aggcccacgaggagcag

SEQ ID NO: 5213172 - DNA, 18 bp, Homo sapiens
aggcccacgaggagcagc

SEQ ID NO: 5213173 - DNA, 19 bp, Homo sapiens
aggcccacgaggagcagca

SEQ ID NO: 5213174 - DNA, 23 bp, Homo sapiens
aggcccacggtttcagctagaca

SEQ ID NO: 5213175 - DNA, 17 bp, Homo sapiens
aggcccactagagggcc

SEQ ID NO: 5213176 - DNA, 19 bp, Homo sapiens
aggcccactagagggccca

SEQ ID NO: 5213177 - DNA, 21 bp, Homo sapiens
aggcccactccccagccccag

SEQ ID NO: 5213178 - DNA, 20 bp, Homo sapiens
aggcccactgtgtctaggca

SEQ ID NO: 5213179 - DNA, 17 bp, Homo sapiens
aggcccagaagggtagc

SEQ ID NO: 5213180 - DNA, 14 bp, Homo sapiens
aggcccagacctgg

SEQ ID NO: 5213181 - DNA, 18 bp, Homo sapiens
aggcccagacctggcctc

SEQ ID NO: 5213182 - DNA, 21 bp, Homo sapiens
aggcccagacctggcctctgc

SEQ ID NO: 5213183 - DNA, 23 bp, Homo sapiens
aggcccagacctggcctctgcca

SEQ ID NO: 5213184 - DNA, 13 bp, Homo sapiens
aggcccagagagg

SEQ ID NO: 5213185 - DNA, 18 bp, Homo sapiens
aggcccagaggagccaag

SEQ ID NO: 5213186 - DNA, 15 bp, Homo sapiens
aggggctgctggggg

SEQ ID NO: 5213187 - DNA, 20 bp, Homo sapiens
aggggctgcttcctcctgga

SEQ ID NO: 5213188 - DNA, 17 bp, Homo sapiens
aggggctgcttctgggg

SEQ ID NO: 5213189 - DNA, 15 bp, Homo sapiens
aggggctggactggc

SEQ ID NO: 5213190 - DNA, 18 bp, Homo sapiens
aggggctggactggctgt

SEQ ID NO: 5213191 - DNA, 13 bp, Homo sapiens
aggggctggaggg

SEQ ID NO: 5213192 - DNA, 17 bp, Homo sapiens
aggggctggagggctgg

SEQ ID NO: 5213193 - DNA, 19 bp, Homo sapiens
aggggctggccttcctgcc

SEQ ID NO: 5213194 - DNA, 13 bp, Homo sapiens
aggggctgggcag

SEQ ID NO: 5213195 - DNA, 14 bp, Homo sapiens
aggggctgggcaga

SEQ ID NO: 5213196 - DNA, 16 bp, Homo sapiens
aggggctgggcagagg

SEQ ID NO: 5213197 - DNA, 18 bp, Homo sapiens
aggggctgggctgggctg

SEQ ID NO: 5213198 - DNA, 13 bp, Homo sapiens
aggggctggggac

SEQ ID NO: 5213199 - DNA, 13 bp, Homo sapiens
aggggctggggcc

SEQ ID NO: 5213200 - DNA, 16 bp, Homo sapiens
aggggctgtcctcctt

SEQ ID NO: 5213201 - DNA, 19 bp, Homo sapiens
aggggctgtcctccttcct

SEQ ID NO: 5213202 - DNA, 23 bp, Homo sapiens
aggggctgtcctccttcctggga

SEQ ID NO: 5213203 - DNA, 16 bp, Homo sapiens
aggggcttcaggtcca

SEQ ID NO: 5213204 - DNA, 22 bp, Homo sapiens
aggggcttcccacagcctcttc

SEQ ID NO: 5213205 - DNA, 21 bp, Homo sapiens
aggggcttctaatgacccaga

SEQ ID NO: 5213206 - DNA, 20 bp, Homo sapiens
aggggcttctccccctcagc

SEQ ID NO: 5213207 - DNA, 14 bp, Homo sapiens
aggggcttgagaag

SEQ ID NO: 5213208 - DNA, 23 bp, Homo sapiens
aggggcttgagaaggttactgag

SEQ ID NO: 5213209 - DNA, 20 bp, Homo sapiens
aggggcttggagcagagacg

SEQ ID NO: 5213210 - DNA, 14 bp, Homo sapiens
aggggcttggattt

SEQ ID NO: 5213211 - DNA, 18 bp, Homo sapiens
aggggcttggctgcccca

SEQ ID NO: 5213212 - DNA, 13 bp, Homo sapiens
aggggctttctct

SEQ ID NO: 5213213 - DNA, 14 bp, Homo sapiens
aggggctttctctt

SEQ ID NO: 5213214 - DNA, 16 bp, Homo sapiens
aggggctttctcttcc

SEQ ID NO: 5213215 - DNA, 21 bp, Homo sapiens
aggggctttctcttccccttc

SEQ ID NO: 5213216 - DNA, 14 bp, Homo sapiens
aggggctttctgga

SEQ ID NO: 5213217 - DNA, 20 bp, Homo sapiens
aggggctttctggagaggag

SEQ ID NO: 5213218 - DNA, 14 bp, Homo sapiens
aggggctttgggcc

SEQ ID NO: 5213219 - DNA, 15 bp, Homo sapiens
aggggctttgggccc

SEQ ID NO: 5213220 - DNA, 19 bp, Homo sapiens
aggggctttgggcccaaga

SEQ ID NO: 5213221 - DNA, 22 bp, Homo sapiens
aggggcttttcccaccttcacc

SEQ ID NO: 5213222 - DNA, 17 bp, Homo sapiens
agggggaaaaggtggga

SEQ ID NO: 5213223 - DNA, 19 bp, Homo sapiens
agggggaagaagcagagag

SEQ ID NO: 5213224 - DNA, 15 bp, Homo sapiens
agggggaagagaaat

SEQ ID NO: 5213225 - DNA, 16 bp, Homo sapiens
agggggaagagatccc

SEQ ID NO: 5213226 - DNA, 12 bp, Homo sapiens
agggggaagcaa

SEQ ID NO: 5213227 - DNA, 14 bp, Homo sapiens
agggggaagcaaag

SEQ ID NO: 5213228 - DNA, 15 bp, Homo sapiens
agggggaagcaaagg

SEQ ID NO: 5213229 - DNA, 18 bp, Homo sapiens
agggggaagcaccagcct

SEQ ID NO: 5213230 - DNA, 19 bp, Homo sapiens
agggggaagcaccagcctc

SEQ ID NO: 5213231 - DNA, 21 bp, Homo sapiens
agggggaagcaccagcctcag

SEQ ID NO: 5213232 - DNA, 19 bp, Homo sapiens
agggggaaggctgcaaagt

SEQ ID NO: 5213233 - DNA, 16 bp, Homo sapiens
agggggaatattttaa

SEQ ID NO: 5213234 - DNA, 17 bp, Homo sapiens
agggggaattcctggaa

SEQ ID NO: 5213235 - DNA, 16 bp, Homo sapiens
agggggacagcaggga

SEQ ID NO: 5213236 - DNA, 17 bp, Homo sapiens
agggggaccatggggag

SEQ ID NO: 5213237 - DNA, 16 bp, Homo sapiens
agggggacctcgggct

SEQ ID NO: 5213238 - DNA, 17 bp, Homo sapiens
agggggacctcgggctg

SEQ ID NO: 5213239 - DNA, 23 bp, Homo sapiens
agggggacctgccaccagggagc

SEQ ID NO: 5213240 - DNA, 16 bp, Homo sapiens
agggggacgtttctgg

SEQ ID NO: 5213241 - DNA, 15 bp, Homo sapiens
agggggaggagtcag

SEQ ID NO: 5213242 - DNA, 23 bp, Homo sapiens
agggggaggagtcaggggctctg

SEQ ID NO: 5213243 - DNA, 18 bp, Homo sapiens
agggggaggggagaagcc

SEQ ID NO: 5213244 - DNA, 18 bp, Homo sapiens
agggggaggggtggtact

SEQ ID NO: 5213245 - DNA, 20 bp, Homo sapiens
agggggaggtgaaaagggca

SEQ ID NO: 5213246 - DNA, 23 bp, Homo sapiens
agggggaggtgaaaagggcagag

SEQ ID NO: 5213247 - DNA, 18 bp, Homo sapiens
agggggagtagccaagct

SEQ ID NO: 5213248 - DNA, 21 bp, Homo sapiens
agggggagtttttagtttgtt

SEQ ID NO: 5213249 - DNA, 21 bp, Homo sapiens
agggggatatgggtcctctgg

SEQ ID NO: 5213250 - DNA, 16 bp, Homo sapiens
agggggatgccactcc

SEQ ID NO: 5213251 - DNA, 16 bp, Homo sapiens
agggggattctgagca

SEQ ID NO: 5213252 - DNA, 16 bp, Homo sapiens
agggggcaagaggaat

SEQ ID NO: 5213253 - DNA, 14 bp, Homo sapiens
agggggcagagtgg

SEQ ID NO: 5213254 - DNA, 22 bp, Homo sapiens
agggggcagagtggcctgtgag

SEQ ID NO: 5213255 - DNA, 13 bp, Homo sapiens
agggggcaggccc

SEQ ID NO: 5213256 - DNA, 12 bp, Homo sapiens
agggggcagggg

SEQ ID NO: 5213257 - DNA, 15 bp, Homo sapiens
agggggcattgccgg

SEQ ID NO: 5213258 - DNA, 10 bp, Homo sapiens
agggggccac

SEQ ID NO: 5213259 - DNA, 18 bp, Homo sapiens
agggggccagctggggag

SEQ ID NO: 5213260 - DNA, 13 bp, Homo sapiens
agggggccccgcc

SEQ ID NO: 5213261 - DNA, 18 bp, Homo sapiens
agggggccccgccagggc

SEQ ID NO: 5213262 - DNA, 13 bp, Homo sapiens
agggggccctgct

SEQ ID NO: 5213263 - DNA, 17 bp, Homo sapiens
agggggccctggcttgg

SEQ ID NO: 5213264 - DNA, 17 bp, Homo sapiens
agggggccctggggcct

SEQ ID NO: 5213265 - DNA, 16 bp, Homo sapiens
agggggcccttccaga

SEQ ID NO: 5213266 - DNA, 21 bp, Homo sapiens
agggggccggggggaggggac

SEQ ID NO: 5213267 - DNA, 19 bp, Homo sapiens
agggggcctttaaagactt

SEQ ID NO: 5213268 - DNA, 15 bp, Homo sapiens
agggggcgcctgtgg

SEQ ID NO: 5213269 - DNA, 18 bp, Homo sapiens
agggggcgctcaggaccc

SEQ ID NO: 5213270 - DNA, 16 bp, Homo sapiens
agggggcggcagggct

SEQ ID NO: 5213271 - DNA, 12 bp, Homo sapiens
agggggcggcct

SEQ ID NO: 5213272 - DNA, 21 bp, Homo sapiens
agggggcggtaggggctgcag

SEQ ID NO: 5213273 - DNA, 17 bp, Homo sapiens
agggggctaagctatgg

SEQ ID NO: 5213274 - DNA, 20 bp, Homo sapiens
agggggctattccctggaga

SEQ ID NO: 5213275 - DNA, 11 bp, Homo sapiens
agggggctctc

SEQ ID NO: 5213276 - DNA, 21 bp, Homo sapiens
agggggctctccaaaggggct

SEQ ID NO: 5213277 - DNA, 22 bp, Homo sapiens
agggggctctccaaaggggctg

SEQ ID NO: 5213278 - DNA, 14 bp, Homo sapiens
agggggctctgccc

SEQ ID NO: 5213279 - DNA, 21 bp, Homo sapiens
agggggctctgccccaggccc

SEQ ID NO: 5213280 - DNA, 16 bp, Homo sapiens
agggggctgcacggga

SEQ ID NO: 5213281 - DNA, 22 bp, Homo sapiens
agggggctgctcccacctggct

SEQ ID NO: 5213282 - DNA, 19 bp, Homo sapiens
agggggctggaggagccca

SEQ ID NO: 5213283 - DNA, 12 bp, Homo sapiens
agggggctggga

SEQ ID NO: 5213284 - DNA, 16 bp, Homo sapiens
agggggctgggctcac

SEQ ID NO: 5213285 - DNA, 16 bp, Homo sapiens
agggggcttgaagcca

SEQ ID NO: 5213286 - DNA, 18 bp, Homo sapiens
agggggcttgaagccaaa

SEQ ID NO: 5213287 - DNA, 16 bp, Homo sapiens
aggggggagccagagg

SEQ ID NO: 5213288 - DNA, 17 bp, Homo sapiens
aggggggagccagaggc

SEQ ID NO: 5213289 - DNA, 13 bp, Homo sapiens
aggggggagctgg

SEQ ID NO: 5213290 - DNA, 12 bp, Homo sapiens
aggggggagggt

SEQ ID NO: 5213291 - DNA, 13 bp, Homo sapiens
aggggggccaggg

SEQ ID NO: 5213292 - DNA, 17 bp, Homo sapiens
aggggggctgcctggcc

SEQ ID NO: 5213293 - DNA, 18 bp, Homo sapiens
agggggggctacattata

SEQ ID NO: 5213294 - DNA, 14 bp, Homo sapiens
aggggggggtgggg

SEQ ID NO: 5213295 - DNA, 24 bp, Homo sapiens
aggggggtcggaagcctgtcctca

SEQ ID NO: 5213296 - DNA, 16 bp, Homo sapiens
aggggggtgggagggg

SEQ ID NO: 5213297 - DNA, 21 bp, Homo sapiens
aggggggttgggttccagaca

SEQ ID NO: 5213298 - DNA, 15 bp, Homo sapiens
agggggtaggagagc

SEQ ID NO: 5213299 - DNA, 21 bp, Homo sapiens
agggggtaggagagcactgcc

SEQ ID NO: 5213300 - DNA, 18 bp, Homo sapiens
agggggtatgcagagctt

SEQ ID NO: 5213301 - DNA, 18 bp, Homo sapiens
agggggtcagttgggccc

SEQ ID NO: 5213302 - DNA, 16 bp, Homo sapiens
agggggtcccagtggg

SEQ ID NO: 5213303 - DNA, 24 bp, Homo sapiens
agggggtcccagtgggaggggcag

SEQ ID NO: 5213304 - DNA, 22 bp, Homo sapiens
agggggtccgtggtagaggcct

SEQ ID NO: 5213305 - DNA, 19 bp, Homo sapiens
agggggtcgtggagagcta

SEQ ID NO: 5213306 - DNA, 21 bp, Homo sapiens
agggggtgagaggcaggaatg

SEQ ID NO: 5213307 - DNA, 20 bp, Homo sapiens
agggggtgcaaagactctga

SEQ ID NO: 5213308 - DNA, 23 bp, Homo sapiens
agggggtgcaaagactctgagcc

SEQ ID NO: 5213309 - DNA, 15 bp, Homo sapiens
agggggtggcctccc

SEQ ID NO: 5213310 - DNA, 20 bp, Homo sapiens
agggggtggcctcccaactc

SEQ ID NO: 5213311 - DNA, 16 bp, Homo sapiens
agggggtgggctgtca

SEQ ID NO: 5213312 - DNA, 21 bp, Homo sapiens
agggggtggttattggactcc

SEQ ID NO: 5213313 - DNA, 21 bp, Homo sapiens
agggggtgtaatgaaaatgat

SEQ ID NO: 5213314 - DNA, 17 bp, Homo sapiens
agggggtgtcagaagct

SEQ ID NO: 5213315 - DNA, 21 bp, Homo sapiens
agggggtgtcagaagctggga

SEQ ID NO: 5213316 - DNA, 22 bp, Homo sapiens
agggggtgtctgcaccttagaa

SEQ ID NO: 5213317 - DNA, 21 bp, Homo sapiens
agggggttcttattttgcatt

SEQ ID NO: 5213318 - DNA, 20 bp, Homo sapiens
agggggtttgctggggaact

SEQ ID NO: 5213319 - DNA, 13 bp, Homo sapiens
aggggtaaatata

SEQ ID NO: 5213320 - DNA, 14 bp, Homo sapiens
aggggtaaatatat

SEQ ID NO: 5213321 - DNA, 16 bp, Homo sapiens
aggggtaacctggcca

SEQ ID NO: 5213322 - DNA, 23 bp, Homo sapiens
aggggtacacagagctaaggcca

SEQ ID NO: 5213323 - DNA, 23 bp, Homo sapiens
aggggtacattctagctgagaag

SEQ ID NO: 5213324 - DNA, 17 bp, Homo sapiens
aggggtagctggtggtt

SEQ ID NO: 5213325 - DNA, 18 bp, Homo sapiens
aggggtaggatgtacagg

SEQ ID NO: 5213326 - DNA, 15 bp, Homo sapiens
aggggtaggggctgg

SEQ ID NO: 5213327 - DNA, 19 bp, Homo sapiens
aggggtaggggctgggaac

SEQ ID NO: 5213328 - DNA, 21 bp, Homo sapiens
aggggtatcatgtatggtgat

SEQ ID NO: 5213329 - DNA, 22 bp, Homo sapiens
aggggtatgttccctcttgtcc

SEQ ID NO: 5213330 - DNA, 12 bp, Homo sapiens
aggggtatttaa

SEQ ID NO: 5213331 - DNA, 14 bp, Homo sapiens
aggggtcaaagaaa

SEQ ID NO: 5213332 - DNA, 20 bp, Homo sapiens
aggggtcagcagagcttcag

SEQ ID NO: 5213333 - DNA, 14 bp, Homo sapiens
aggggtcagctctg

SEQ ID NO: 5213334 - DNA, 24 bp, Homo sapiens
aggggtcagggaccaaggacccct

SEQ ID NO: 5213335 - DNA, 14 bp, Homo sapiens
aggggtcaggtgtc

SEQ ID NO: 5213336 - DNA, 17 bp, Homo sapiens
aggggtcaggtgtcagg

SEQ ID NO: 5213337 - DNA, 23 bp, Homo sapiens
aggggtccctgcaaaactccagg

SEQ ID NO: 5213338 - DNA, 23 bp, Homo sapiens
aggggtcctgatttcagggaaat

SEQ ID NO: 5213339 - DNA, 14 bp, Homo sapiens
aggggtcctgcagg

SEQ ID NO: 5213340 - DNA, 20 bp, Homo sapiens
aggggtcctgcaggtcctgg

SEQ ID NO: 5213341 - DNA, 19 bp, Homo sapiens
aggggtctccaggaggaga

SEQ ID NO: 5213342 - DNA, 18 bp, Homo sapiens
aggggtctccctgagcct

SEQ ID NO: 5213343 - DNA, 20 bp, Homo sapiens
aggggtctccctgagcctgc

SEQ ID NO: 5213344 - DNA, 23 bp, Homo sapiens
aggggtctccctgagcctgcccc

SEQ ID NO: 5213345 - DNA, 19 bp, Homo sapiens
aggggtctccctggagtgc

SEQ ID NO: 5213346 - DNA, 15 bp, Homo sapiens
aggggtctccctggc

SEQ ID NO: 5213347 - DNA, 17 bp, Homo sapiens
aggggtctccctggctc

SEQ ID NO: 5213348 - DNA, 16 bp, Homo sapiens
aggggtctgctcctgt

SEQ ID NO: 5213349 - DNA, 22 bp, Homo sapiens
aggggtctgggagtcaggcccg

SEQ ID NO: 5213350 - DNA, 22 bp, Homo sapiens
aggggtcttgcaaaattcctga

SEQ ID NO: 5213351 - DNA, 16 bp, Homo sapiens
aggggtgacacagact

SEQ ID NO: 5213352 - DNA, 16 bp, Homo sapiens
aggggtgacggccctc

SEQ ID NO: 5213353 - DNA, 20 bp, Homo sapiens
aggggtgagagacctgctca

SEQ ID NO: 5213354 - DNA, 14 bp, Homo sapiens
aggggtgagccccg

SEQ ID NO: 5213355 - DNA, 15 bp, Homo sapiens
aggggtgagccccgc

SEQ ID NO: 5213356 - DNA, 15 bp, Homo sapiens
aggggtgaggatagg

SEQ ID NO: 5213357 - DNA, 20 bp, Homo sapiens
aggggtgattgaaagaaaaa

SEQ ID NO: 5213358 - DNA, 13 bp, Homo sapiens
aggggtgatttca

SEQ ID NO: 5213359 - DNA, 14 bp, Homo sapiens
aggggtgcacaata

SEQ ID NO: 5213360 - DNA, 22 bp, Homo sapiens
aggggtgcacccactcaccagg

SEQ ID NO: 5213361 - DNA, 16 bp, Homo sapiens
aggggtgccccctcct

SEQ ID NO: 5213362 - DNA, 20 bp, Homo sapiens
aggggtgccccctcctctcc

SEQ ID NO: 5213363 - DNA, 13 bp, Homo sapiens
aggggtgccctct

SEQ ID NO: 5213364 - DNA, 15 bp, Homo sapiens
aggcccagagggcct

SEQ ID NO: 5213365 - DNA, 15 bp, Homo sapiens
aggcccagcatgcag

SEQ ID NO: 5213366 - DNA, 14 bp, Homo sapiens
aggcccagccctca

SEQ ID NO: 5213367 - DNA, 16 bp, Homo sapiens
aggcccagccctcaga

SEQ ID NO: 5213368 - DNA, 15 bp, Homo sapiens
aggcccagccctcct

SEQ ID NO: 5213369 - DNA, 13 bp, Homo sapiens
aggcccagccctg

SEQ ID NO: 5213370 - DNA, 15 bp, Homo sapiens
aggcccagccctggg

SEQ ID NO: 5213371 - DNA, 23 bp, Homo sapiens
aggcccagccgcaggaaggcaga

SEQ ID NO: 5213372 - DNA, 18 bp, Homo sapiens
aggcccagcctctctggc

SEQ ID NO: 5213373 - DNA, 14 bp, Homo sapiens
aggcccagcctctg

SEQ ID NO: 5213374 - DNA, 15 bp, Homo sapiens
aggcccagcctctgc

SEQ ID NO: 5213375 - DNA, 13 bp, Homo sapiens
aggcccagcctgt

SEQ ID NO: 5213376 - DNA, 14 bp, Homo sapiens
aggcccagcctgtc

SEQ ID NO: 5213377 - DNA, 18 bp, Homo sapiens
aggcccagcctgtcctgg

SEQ ID NO: 5213378 - DNA, 19 bp, Homo sapiens
aggcccagcctgtcctggt

SEQ ID NO: 5213379 - DNA, 24 bp, Homo sapiens
aggcccagctggggcccctcggct

SEQ ID NO: 5213380 - DNA, 22 bp, Homo sapiens
aggcccagctttccctgccagg

SEQ ID NO: 5213381 - DNA, 23 bp, Homo sapiens
aggcccagctttccctgccaggc

SEQ ID NO: 5213382 - DNA, 19 bp, Homo sapiens
aggcccaggagacctccag

SEQ ID NO: 5213383 - DNA, 21 bp, Homo sapiens
aggcccaggagacctccagct

SEQ ID NO: 5213384 - DNA, 23 bp, Homo sapiens
aggcccaggcaccaccaggagca

SEQ ID NO: 5213385 - DNA, 17 bp, Homo sapiens
aggcccaggcagagctg

SEQ ID NO: 5213386 - DNA, 14 bp, Homo sapiens
aggcccaggcaggc

SEQ ID NO: 5213387 - DNA, 18 bp, Homo sapiens
aggcccaggcaggcccag

SEQ ID NO: 5213388 - DNA, 11 bp, Homo sapiens
aggcccaggcc

SEQ ID NO: 5213389 - DNA, 12 bp, Homo sapiens
aggcccaggcca

SEQ ID NO: 5213390 - DNA, 19 bp, Homo sapiens
aggcccaggcctcaccacc

SEQ ID NO: 5213391 - DNA, 18 bp, Homo sapiens
aggcccaggctgccgtcc

SEQ ID NO: 5213392 - DNA, 13 bp, Homo sapiens
aggcccaggctgg

SEQ ID NO: 5213393 - DNA, 15 bp, Homo sapiens
aggcccaggctggga

SEQ ID NO: 5213394 - DNA, 13 bp, Homo sapiens
aggcccagggagg

SEQ ID NO: 5213395 - DNA, 22 bp, Homo sapiens
aggcccagggagggaagtgtga

SEQ ID NO: 5213396 - DNA, 19 bp, Homo sapiens
aggcccaggggtggggccc

SEQ ID NO: 5213397 - DNA, 24 bp, Homo sapiens
aggcccaggtcaacatctaagcct

SEQ ID NO: 5213398 - DNA, 22 bp, Homo sapiens
aggcccagtgacaaagactcct

SEQ ID NO: 5213399 - DNA, 22 bp, Homo sapiens
aggcccagttctcgtgccctta

SEQ ID NO: 5213400 - DNA, 20 bp, Homo sapiens
aggcccatctcaggtgccac

SEQ ID NO: 5213401 - DNA, 14 bp, Homo sapiens
aggcccatgccccc

SEQ ID NO: 5213402 - DNA, 16 bp, Homo sapiens
aggcccatgccccctt

SEQ ID NO: 5213403 - DNA, 16 bp, Homo sapiens
aggcccatgggaggct

SEQ ID NO: 5213404 - DNA, 18 bp, Homo sapiens
aggcccatgggcagaaga

SEQ ID NO: 5213405 - DNA, 23 bp, Homo sapiens
aggcccatgggcagaagatagag

SEQ ID NO: 5213406 - DNA, 21 bp, Homo sapiens
aggccccaaaaccacagccct

SEQ ID NO: 5213407 - DNA, 23 bp, Homo sapiens
aggccccaaaaccacagccctgt

SEQ ID NO: 5213408 - DNA, 22 bp, Homo sapiens
aggccccaactcaagtgtcacc

SEQ ID NO: 5213409 - DNA, 19 bp, Homo sapiens
aggccccaataccccatgg

SEQ ID NO: 5213410 - DNA, 15 bp, Homo sapiens
aggccccacaaggcc

SEQ ID NO: 5213411 - DNA, 17 bp, Homo sapiens
aggccccacaaggcctg

SEQ ID NO: 5213412 - DNA, 18 bp, Homo sapiens
aggccccacaaggcctgg

SEQ ID NO: 5213413 - DNA, 19 bp, Homo sapiens
aggccccacaaggcctggt

SEQ ID NO: 5213414 - DNA, 17 bp, Homo sapiens
aggccccacctgaaggg

SEQ ID NO: 5213415 - DNA, 13 bp, Homo sapiens
aggccccacgccc

SEQ ID NO: 5213416 - DNA, 20 bp, Homo sapiens
aggccccacgccctctcctc

SEQ ID NO: 5213417 - DNA, 16 bp, Homo sapiens
aggccccactccttcc

SEQ ID NO: 5213418 - DNA, 19 bp, Homo sapiens
aggccccactgatgctgtt

SEQ ID NO: 5213419 - DNA, 13 bp, Homo sapiens
aggccccactggg

SEQ ID NO: 5213420 - DNA, 17 bp, Homo sapiens
aggccccactggggaaa

SEQ ID NO: 5213421 - DNA, 23 bp, Homo sapiens
aggccccactttcaagaatcaga

SEQ ID NO: 5213422 - DNA, 17 bp, Homo sapiens
aggccccagacagggtg

SEQ ID NO: 5213423 - DNA, 17 bp, Homo sapiens
aggccccagaggccctg

SEQ ID NO: 5213424 - DNA, 22 bp, Homo sapiens
aggccccagaggccctggaggt

SEQ ID NO: 5213425 - DNA, 18 bp, Homo sapiens
aggccccagccaagtgcc

SEQ ID NO: 5213426 - DNA, 19 bp, Homo sapiens
aggccccagcctccaggcc

SEQ ID NO: 5213427 - DNA, 17 bp, Homo sapiens
aggccccagctctgagg

SEQ ID NO: 5213428 - DNA, 12 bp, Homo sapiens
aggccccaggaa

SEQ ID NO: 5213429 - DNA, 12 bp, Homo sapiens
aggccccaggct

SEQ ID NO: 5213430 - DNA, 14 bp, Homo sapiens
aggccccaggctgg

SEQ ID NO: 5213431 - DNA, 13 bp, Homo sapiens
aggccccagggac

SEQ ID NO: 5213432 - DNA, 15 bp, Homo sapiens
aggccccagggacag

SEQ ID NO: 5213433 - DNA, 20 bp, Homo sapiens
aggccccagggacagaggcc

SEQ ID NO: 5213434 - DNA, 13 bp, Homo sapiens
aggccccagggga

SEQ ID NO: 5213435 - DNA, 13 bp, Homo sapiens
aggccccaggtca

SEQ ID NO: 5213436 - DNA, 16 bp, Homo sapiens
aggccccatgacctcc

SEQ ID NO: 5213437 - DNA, 20 bp, Homo sapiens
aggccccatgacctccagct

SEQ ID NO: 5213438 - DNA, 22 bp, Homo sapiens
aggcccccaaacatagcccctg

SEQ ID NO: 5213439 - DNA, 22 bp, Homo sapiens
aggcccccaaattgccttcagc

SEQ ID NO: 5213440 - DNA, 14 bp, Homo sapiens
aggcccccaccaca

SEQ ID NO: 5213441 - DNA, 15 bp, Homo sapiens
aggcccccaccacac

SEQ ID NO: 5213442 - DNA, 18 bp, Homo sapiens
aggcccccaccacacatc

SEQ ID NO: 5213443 - DNA, 13 bp, Homo sapiens
aggcccccaccct

SEQ ID NO: 5213444 - DNA, 18 bp, Homo sapiens
aggcccccacccttgggc

SEQ ID NO: 5213445 - DNA, 16 bp, Homo sapiens
aggcccccacctctgt

SEQ ID NO: 5213446 - DNA, 17 bp, Homo sapiens
aggcccccacctggctc

SEQ ID NO: 5213447 - DNA, 20 bp, Homo sapiens
aggcccccacttgcctcttc

SEQ ID NO: 5213448 - DNA, 14 bp, Homo sapiens
aggcccccagccca

SEQ ID NO: 5213449 - DNA, 17 bp, Homo sapiens
aggcccccagcccaggg

SEQ ID NO: 5213450 - DNA, 19 bp, Homo sapiens
aggcccccagcccagggct

SEQ ID NO: 5213451 - DNA, 15 bp, Homo sapiens
aggcccccagcccct

SEQ ID NO: 5213452 - DNA, 23 bp, Homo sapiens
aggcccccagcccctcctccctc

SEQ ID NO: 5213453 - DNA, 19 bp, Homo sapiens
aggcccccatcatcctctg

SEQ ID NO: 5213454 - DNA, 22 bp, Homo sapiens
aggccccccgcagcaccctgca

SEQ ID NO: 5213455 - DNA, 15 bp, Homo sapiens
aggcccccctctgcc

SEQ ID NO: 5213456 - DNA, 21 bp, Homo sapiens
aggcccccgcacgcaagcctc

SEQ ID NO: 5213457 - DNA, 20 bp, Homo sapiens
aggcccccggctttcctccg

SEQ ID NO: 5213458 - DNA, 19 bp, Homo sapiens
aggcccccgtcagggagag

SEQ ID NO: 5213459 - DNA, 13 bp, Homo sapiens
aggccccctcctc

SEQ ID NO: 5213460 - DNA, 17 bp, Homo sapiens
aggccccgcccaggctt

SEQ ID NO: 5213461 - DNA, 21 bp, Homo sapiens
aggccccgccttttcccccac

SEQ ID NO: 5213462 - DNA, 21 bp, Homo sapiens
aggccccgcttgtccagcgcc

SEQ ID NO: 5213463 - DNA, 22 bp, Homo sapiens
aggccccgcttgtccagcgcct

SEQ ID NO: 5213464 - DNA, 14 bp, Homo sapiens
aggccccgggcttc

SEQ ID NO: 5213465 - DNA, 17 bp, Homo sapiens
aggccccggtatgtgat

SEQ ID NO: 5213466 - DNA, 21 bp, Homo sapiens
aggcccctatgtagtccgtgc

SEQ ID NO: 5213467 - DNA, 23 bp, Homo sapiens
aggcccctcctagacccaggtgg

SEQ ID NO: 5213468 - DNA, 16 bp, Homo sapiens
aggcccctctcctccg

SEQ ID NO: 5213469 - DNA, 21 bp, Homo sapiens
aggcccctctgcaactggaga

SEQ ID NO: 5213470 - DNA, 20 bp, Homo sapiens
aggcccctgaggcagcccag

SEQ ID NO: 5213471 - DNA, 13 bp, Homo sapiens
aggcccctgaggg

SEQ ID NO: 5213472 - DNA, 13 bp, Homo sapiens
aggcccctgccac

SEQ ID NO: 5213473 - DNA, 21 bp, Homo sapiens
aggcccctgccaccctgggga

SEQ ID NO: 5213474 - DNA, 14 bp, Homo sapiens
aggcccctgccccc

SEQ ID NO: 5213475 - DNA, 13 bp, Homo sapiens
aggcccctgccct

SEQ ID NO: 5213476 - DNA, 13 bp, Homo sapiens
aggcccctggagg

SEQ ID NO: 5213477 - DNA, 19 bp, Homo sapiens
aggcccctggaggctgcct

SEQ ID NO: 5213478 - DNA, 16 bp, Homo sapiens
aggcccctggagttgt

SEQ ID NO: 5213479 - DNA, 16 bp, Homo sapiens
aggcccctggcccagc

SEQ ID NO: 5213480 - DNA, 14 bp, Homo sapiens
aggcccctgggctc

SEQ ID NO: 5213481 - DNA, 20 bp, Homo sapiens
aggcccctgggctctcaccc

SEQ ID NO: 5213482 - DNA, 22 bp, Homo sapiens
aggcccctgggctctcacccag

SEQ ID NO: 5213483 - DNA, 12 bp, Homo sapiens
aggcccctgggg

SEQ ID NO: 5213484 - DNA, 17 bp, Homo sapiens
aggcccctggggctccc

SEQ ID NO: 5213485 - DNA, 19 bp, Homo sapiens
aggcccctggtctgccctg

SEQ ID NO: 5213486 - DNA, 18 bp, Homo sapiens
aggcccctgtgcagtaga

SEQ ID NO: 5213487 - DNA, 20 bp, Homo sapiens
aggccccttccacgggggct

SEQ ID NO: 5213488 - DNA, 23 bp, Homo sapiens
aggccccttcccacgtccctcga

SEQ ID NO: 5213489 - DNA, 16 bp, Homo sapiens
aggccccttgctgctg

SEQ ID NO: 5213490 - DNA, 19 bp, Homo sapiens
aggccccttgctgctggct

SEQ ID NO: 5213491 - DNA, 14 bp, Homo sapiens
aggcccgacagaga

SEQ ID NO: 5213492 - DNA, 17 bp, Homo sapiens
aggcccgacagagagat

SEQ ID NO: 5213493 - DNA, 21 bp, Homo sapiens
aggcccgacagagagatgaag

SEQ ID NO: 5213494 - DNA, 14 bp, Homo sapiens
aggcccgagcagct

SEQ ID NO: 5213495 - DNA, 19 bp, Homo sapiens
aggcccgagcagctgagca

SEQ ID NO: 5213496 - DNA, 21 bp, Homo sapiens
aggcccgagcagctgagcagg

SEQ ID NO: 5213497 - DNA, 17 bp, Homo sapiens
aggcccgcactgggggc

SEQ ID NO: 5213498 - DNA, 16 bp, Homo sapiens
aggcccgcgggcacag

SEQ ID NO: 5213499 - DNA, 17 bp, Homo sapiens
aggcccgcgggcacagc

SEQ ID NO: 5213500 - DNA, 21 bp, Homo sapiens
aggcccgcgggcacagccagc

SEQ ID NO: 5213501 - DNA, 20 bp, Homo sapiens
aggcccgctctacatcttct

SEQ ID NO: 5213502 - DNA, 19 bp, Homo sapiens
aggcccggaagcgccaggc

SEQ ID NO: 5213503 - DNA, 20 bp, Homo sapiens
aggcccggaagcgccaggct

SEQ ID NO: 5213504 - DNA, 21 bp, Homo sapiens
aggcccggaagcgccaggctg

SEQ ID NO: 5213505 - DNA, 14 bp, Homo sapiens
aggcccggccccat

SEQ ID NO: 5213506 - DNA, 13 bp, Homo sapiens
aggcccggcctat

SEQ ID NO: 5213507 - DNA, 15 bp, Homo sapiens
aggcccggcctctca

SEQ ID NO: 5213508 - DNA, 13 bp, Homo sapiens
aggcccggctcca

SEQ ID NO: 5213509 - DNA, 18 bp, Homo sapiens
aggcccggctccaggctc

SEQ ID NO: 5213510 - DNA, 20 bp, Homo sapiens
aggcccggctccaggctcct

SEQ ID NO: 5213511 - DNA, 18 bp, Homo sapiens
aggcccggctgagccccc

SEQ ID NO: 5213512 - DNA, 15 bp, Homo sapiens
aggcccgggaggagg

SEQ ID NO: 5213513 - DNA, 16 bp, Homo sapiens
aggcccgggaggagga

SEQ ID NO: 5213514 - DNA, 14 bp, Homo sapiens
aggcccggggctgg

SEQ ID NO: 5213515 - DNA, 16 bp, Homo sapiens
aggcccggtgaggcca

SEQ ID NO: 5213516 - DNA, 15 bp, Homo sapiens
aggcccgtcggagct

SEQ ID NO: 5213517 - DNA, 16 bp, Homo sapiens
aggcccgtcggagctg

SEQ ID NO: 5213518 - DNA, 20 bp, Homo sapiens
aggcccgtcggagctgcctg

SEQ ID NO: 5213519 - DNA, 15 bp, Homo sapiens
aggcccgtctgtcca

SEQ ID NO: 5213520 - DNA, 21 bp, Homo sapiens
aggcccgtctgtccatctgcc

SEQ ID NO: 5213521 - DNA, 23 bp, Homo sapiens
aggcccgtctgtccatctgcccg

SEQ ID NO: 5213522 - DNA, 21 bp, Homo sapiens
aggccctaccagagggaacac

SEQ ID NO: 5213523 - DNA, 22 bp, Homo sapiens
aggccctaggattcctccccca

SEQ ID NO: 5213524 - DNA, 19 bp, Homo sapiens
aggccctcaatccaccttc

SEQ ID NO: 5213525 - DNA, 12 bp, Homo sapiens
aggccctcagtg

SEQ ID NO: 5213526 - DNA, 14 bp, Homo sapiens
aggccctcagtgag

SEQ ID NO: 5213527 - DNA, 17 bp, Homo sapiens
aggccctccacacctgc

SEQ ID NO: 5213528 - DNA, 19 bp, Homo sapiens
aggccctccacacctgcgg

SEQ ID NO: 5213529 - DNA, 20 bp, Homo sapiens
aggccctccacacctgcggc

SEQ ID NO: 5213530 - DNA, 21 bp, Homo sapiens
aggccctccacacctgcggcc

SEQ ID NO: 5213531 - DNA, 13 bp, Homo sapiens
aggccctccagtg

SEQ ID NO: 5213532 - DNA, 15 bp, Homo sapiens
aggccctcccaaaga

SEQ ID NO: 5213533 - DNA, 23 bp, Homo sapiens
aggccctccctgactccctgtgg

SEQ ID NO: 5213534 - DNA, 16 bp, Homo sapiens
aggccctccctgtctc

SEQ ID NO: 5213535 - DNA, 20 bp, Homo sapiens
aggccctccctgttccccag

SEQ ID NO: 5213536 - DNA, 22 bp, Homo sapiens
aggccctccctgttccccagag

SEQ ID NO: 5213537 - DNA, 19 bp, Homo sapiens
aggccctcctccctcccag

SEQ ID NO: 5213538 - DNA, 21 bp, Homo sapiens
aggccctcctctcccatcctt

SEQ ID NO: 5213539 - DNA, 23 bp, Homo sapiens
aggccctcctctcccatccttga

SEQ ID NO: 5213540 - DNA, 23 bp, Homo sapiens
aggccctcctgctggctgaggct

SEQ ID NO: 5213541 - DNA, 21 bp, Homo sapiens
aggccctcctgtgctggggga

SEQ ID NO: 5213542 - DNA, 16 bp, Homo sapiens
aggggtgccctctgga

SEQ ID NO: 5213543 - DNA, 22 bp, Homo sapiens
aggggtgcggcggtcccagctc

SEQ ID NO: 5213544 - DNA, 12 bp, Homo sapiens
aggggtgctcct

SEQ ID NO: 5213545 - DNA, 20 bp, Homo sapiens
aggggtgctggggcagagtg

SEQ ID NO: 5213546 - DNA, 23 bp, Homo sapiens
aggggtgctggggcagagtggag

SEQ ID NO: 5213547 - DNA, 20 bp, Homo sapiens
aggggtgcttcctcctcagg

SEQ ID NO: 5213548 - DNA, 21 bp, Homo sapiens
aggggtggaagggcaggagct

SEQ ID NO: 5213549 - DNA, 23 bp, Homo sapiens
aggggtggaagggcaggagctca

SEQ ID NO: 5213550 - DNA, 14 bp, Homo sapiens
aggggtggagaagt

SEQ ID NO: 5213551 - DNA, 20 bp, Homo sapiens
aggggtggagactgcttccc

SEQ ID NO: 5213552 - DNA, 16 bp, Homo sapiens
aggggtggagtttctg

SEQ ID NO: 5213553 - DNA, 18 bp, Homo sapiens
aggggtggcccagagcca

SEQ ID NO: 5213554 - DNA, 21 bp, Homo sapiens
aggggtggccgggcacagtgg

SEQ ID NO: 5213555 - DNA, 18 bp, Homo sapiens
aggggtgggacaccctgt

SEQ ID NO: 5213556 - DNA, 15 bp, Homo sapiens
aggggtgggagagcc

SEQ ID NO: 5213557 - DNA, 18 bp, Homo sapiens
aggggtgggagagccagc

SEQ ID NO: 5213558 - DNA, 23 bp, Homo sapiens
aggggtgggcatccctcctggta

SEQ ID NO: 5213559 - DNA, 12 bp, Homo sapiens
aggggtggggag

SEQ ID NO: 5213560 - DNA, 17 bp, Homo sapiens
aggggtggggcccatgg

SEQ ID NO: 5213561 - DNA, 22 bp, Homo sapiens
aggggtgggggtgccgctctct

SEQ ID NO: 5213562 - DNA, 20 bp, Homo sapiens
aggggtgggttcctcttccc

SEQ ID NO: 5213563 - DNA, 17 bp, Homo sapiens
aggggtggtacttggca

SEQ ID NO: 5213564 - DNA, 23 bp, Homo sapiens
aggggtggtacttggcaccaata

SEQ ID NO: 5213565 - DNA, 15 bp, Homo sapiens
aggggtggtcctgac

SEQ ID NO: 5213566 - DNA, 21 bp, Homo sapiens
aggggtggtgagggcagttct

SEQ ID NO: 5213567 - DNA, 13 bp, Homo sapiens
aggggtgtcccag

SEQ ID NO: 5213568 - DNA, 22 bp, Homo sapiens
aggggtgtcccagtcccagcct

SEQ ID NO: 5213569 - DNA, 17 bp, Homo sapiens
aggggtgtccgagaggc

SEQ ID NO: 5213570 - DNA, 24 bp, Homo sapiens
aggggtgtcttgggcagagctggc

SEQ ID NO: 5213571 - DNA, 18 bp, Homo sapiens
aggggtgtggcagtggtt

SEQ ID NO: 5213572 - DNA, 15 bp, Homo sapiens
aggggtgtgggaaga

SEQ ID NO: 5213573 - DNA, 15 bp, Homo sapiens
aggggtgttaaaaca

SEQ ID NO: 5213574 - DNA, 21 bp, Homo sapiens
aggggtgttgtgagagctggg

SEQ ID NO: 5213575 - DNA, 18 bp, Homo sapiens
aggggttaacttggtcag

SEQ ID NO: 5213576 - DNA, 15 bp, Homo sapiens
aggggttacctccct

SEQ ID NO: 5213577 - DNA, 17 bp, Homo sapiens
aggggttacctccctcg

SEQ ID NO: 5213578 - DNA, 15 bp, Homo sapiens
aggggttagagcagg

SEQ ID NO: 5213579 - DNA, 19 bp, Homo sapiens
aggggttcccactggctcc

SEQ ID NO: 5213580 - DNA, 20 bp, Homo sapiens
aggggttcccactggctcct

SEQ ID NO: 5213581 - DNA, 18 bp, Homo sapiens
aggggttcccttgagggc

SEQ ID NO: 5213582 - DNA, 24 bp, Homo sapiens
aggggttcccttttttggctgctg

SEQ ID NO: 5213583 - DNA, 20 bp, Homo sapiens
aggggttcctcaaatttttt

SEQ ID NO: 5213584 - DNA, 22 bp, Homo sapiens
aggggttcctcccctccagctc

SEQ ID NO: 5213585 - DNA, 15 bp, Homo sapiens
aggggttcgagacca

SEQ ID NO: 5213586 - DNA, 20 bp, Homo sapiens
aggggttcgagaccagtctg

SEQ ID NO: 5213587 - DNA, 15 bp, Homo sapiens
aggggttgagggaag

SEQ ID NO: 5213588 - DNA, 21 bp, Homo sapiens
aggggttgccacaggcctccc

SEQ ID NO: 5213589 - DNA, 22 bp, Homo sapiens
aggggttgccacaggcctccct

SEQ ID NO: 5213590 - DNA, 17 bp, Homo sapiens
aggggttgcgggggagc

SEQ ID NO: 5213591 - DNA, 13 bp, Homo sapiens
aggggttggcagc

SEQ ID NO: 5213592 - DNA, 16 bp, Homo sapiens
aggggttggggaaaca

SEQ ID NO: 5213593 - DNA, 21 bp, Homo sapiens
aggggttggggtgacagtcat

SEQ ID NO: 5213594 - DNA, 19 bp, Homo sapiens
aggggttggtatctcaggt

SEQ ID NO: 5213595 - DNA, 20 bp, Homo sapiens
aggggttggtatctcaggtc

SEQ ID NO: 5213596 - DNA, 19 bp, Homo sapiens
aggggttggtgggagggtt

SEQ ID NO: 5213597 - DNA, 16 bp, Homo sapiens
aggggttgtcaagaga

SEQ ID NO: 5213598 - DNA, 15 bp, Homo sapiens
aggggtttacagtga

SEQ ID NO: 5213599 - DNA, 15 bp, Homo sapiens
aggggtttctaacac

SEQ ID NO: 5213600 - DNA, 21 bp, Homo sapiens
aggggtttgggagtcaggcct

SEQ ID NO: 5213601 - DNA, 14 bp, Homo sapiens
agggtaaacaatat

SEQ ID NO: 5213602 - DNA, 22 bp, Homo sapiens
agggtaaataaaccactgtgcg

SEQ ID NO: 5213603 - DNA, 22 bp, Homo sapiens
agggtaacttgtttttattgca

SEQ ID NO: 5213604 - DNA, 16 bp, Homo sapiens
agggtaattttctaac

SEQ ID NO: 5213605 - DNA, 20 bp, Homo sapiens
agggtacagatccccagccc

SEQ ID NO: 5213606 - DNA, 14 bp, Homo sapiens
agggtacagcccag

SEQ ID NO: 5213607 - DNA, 14 bp, Homo sapiens
agggtacatggtgc

SEQ ID NO: 5213608 - DNA, 18 bp, Homo sapiens
agggtacatggtgctggg

SEQ ID NO: 5213609 - DNA, 13 bp, Homo sapiens
agggtacatttat

SEQ ID NO: 5213610 - DNA, 21 bp, Homo sapiens
agggtaccaatcctggcagga

SEQ ID NO: 5213611 - DNA, 15 bp, Homo sapiens
agggtaccagcagaa

SEQ ID NO: 5213612 - DNA, 18 bp, Homo sapiens
agggtaccaggataaagc

SEQ ID NO: 5213613 - DNA, 18 bp, Homo sapiens
agggtaccctttggggag

SEQ ID NO: 5213614 - DNA, 21 bp, Homo sapiens
agggtaccctttggggagcag

SEQ ID NO: 5213615 - DNA, 15 bp, Homo sapiens
agggtacctgaaaga

SEQ ID NO: 5213616 - DNA, 19 bp, Homo sapiens
agggtactaaaagaaacta

SEQ ID NO: 5213617 - DNA, 13 bp, Homo sapiens
agggtactaaatt

SEQ ID NO: 5213618 - DNA, 17 bp, Homo sapiens
agggtactaaatttaaa

SEQ ID NO: 5213619 - DNA, 19 bp, Homo sapiens
agggtactttattttgctt

SEQ ID NO: 5213620 - DNA, 19 bp, Homo sapiens
agggtagaaaactccaggg

SEQ ID NO: 5213621 - DNA, 22 bp, Homo sapiens
agggtagaattgtttggcaatg

SEQ ID NO: 5213622 - DNA, 17 bp, Homo sapiens
agggtagagcaaaggag

SEQ ID NO: 5213623 - DNA, 21 bp, Homo sapiens
agggtagcagcagaggcagga

SEQ ID NO: 5213624 - DNA, 20 bp, Homo sapiens
agggtagccccctcatctgc

SEQ ID NO: 5213625 - DNA, 13 bp, Homo sapiens
agggtaggcaagg

SEQ ID NO: 5213626 - DNA, 18 bp, Homo sapiens
agggtaggcagcctgaga

SEQ ID NO: 5213627 - DNA, 16 bp, Homo sapiens
agggtaggcaggattg

SEQ ID NO: 5213628 - DNA, 14 bp, Homo sapiens
agggtagggcagca

SEQ ID NO: 5213629 - DNA, 17 bp, Homo sapiens
agggtagggcagcagat

SEQ ID NO: 5213630 - DNA, 19 bp, Homo sapiens
agggtaggggagggtgggg

SEQ ID NO: 5213631 - DNA, 14 bp, Homo sapiens
agggtaggggagtg

SEQ ID NO: 5213632 - DNA, 12 bp, Homo sapiens
agggtagggtgg

SEQ ID NO: 5213633 - DNA, 14 bp, Homo sapiens
agggtaggtggggc

SEQ ID NO: 5213634 - DNA, 21 bp, Homo sapiens
agggtatatacaaattaaaac

SEQ ID NO: 5213635 - DNA, 21 bp, Homo sapiens
agggtatcaggtgctgccatc

SEQ ID NO: 5213636 - DNA, 20 bp, Homo sapiens
agggtatccaagttggactg

SEQ ID NO: 5213637 - DNA, 16 bp, Homo sapiens
agggtatgaagagctg

SEQ ID NO: 5213638 - DNA, 17 bp, Homo sapiens
agggtatgggaagccat

SEQ ID NO: 5213639 - DNA, 21 bp, Homo sapiens
agggtatgtcagctacatgaa

SEQ ID NO: 5213640 - DNA, 20 bp, Homo sapiens
agggtcaacatcttttacat

SEQ ID NO: 5213641 - DNA, 15 bp, Homo sapiens
agggtcaagcctctt

SEQ ID NO: 5213642 - DNA, 22 bp, Homo sapiens
agggtcaccaggttgggaacat

SEQ ID NO: 5213643 - DNA, 20 bp, Homo sapiens
agggtcactggcctctcccc

SEQ ID NO: 5213644 - DNA, 19 bp, Homo sapiens
agggtcactggggcccaag

SEQ ID NO: 5213645 - DNA, 23 bp, Homo sapiens
agggtcagccagggcctgcgagg

SEQ ID NO: 5213646 - DNA, 13 bp, Homo sapiens
agggtcaggaagg

SEQ ID NO: 5213647 - DNA, 13 bp, Homo sapiens
agggtcaggcccg

SEQ ID NO: 5213648 - DNA, 14 bp, Homo sapiens
agggtcaggccttt

SEQ ID NO: 5213649 - DNA, 22 bp, Homo sapiens
agggtcaggcctttgagctcag

SEQ ID NO: 5213650 - DNA, 17 bp, Homo sapiens
agggtcaggcggagctg

SEQ ID NO: 5213651 - DNA, 12 bp, Homo sapiens
agggtcatttct

SEQ ID NO: 5213652 - DNA, 19 bp, Homo sapiens
agggtcattttcctttctg

SEQ ID NO: 5213653 - DNA, 13 bp, Homo sapiens
agggtccacagct

SEQ ID NO: 5213654 - DNA, 16 bp, Homo sapiens
agggtccacagctgga

SEQ ID NO: 5213655 - DNA, 23 bp, Homo sapiens
agggtccacaggaagtgaagaat

SEQ ID NO: 5213656 - DNA, 19 bp, Homo sapiens
agggtccagaaggagacag

SEQ ID NO: 5213657 - DNA, 14 bp, Homo sapiens
agggtccagactgt

SEQ ID NO: 5213658 - DNA, 13 bp, Homo sapiens
agggtccagccct

SEQ ID NO: 5213659 - DNA, 20 bp, Homo sapiens
agggtccaggaatggtgctt

SEQ ID NO: 5213660 - DNA, 17 bp, Homo sapiens
agggtcccaagctgggc

SEQ ID NO: 5213661 - DNA, 23 bp, Homo sapiens
agggtcccacccccaacccccag

SEQ ID NO: 5213662 - DNA, 13 bp, Homo sapiens
agggtcccagggc

SEQ ID NO: 5213663 - DNA, 15 bp, Homo sapiens
agggtcccagggctg

SEQ ID NO: 5213664 - DNA, 20 bp, Homo sapiens
agggtcccatttctcactga

SEQ ID NO: 5213665 - DNA, 15 bp, Homo sapiens
agggtccccagctgg

SEQ ID NO: 5213666 - DNA, 22 bp, Homo sapiens
agggtcccggtgtatcctggcc

SEQ ID NO: 5213667 - DNA, 12 bp, Homo sapiens
agggtccctctg

SEQ ID NO: 5213668 - DNA, 15 bp, Homo sapiens
agggtccctctgtgt

SEQ ID NO: 5213669 - DNA, 20 bp, Homo sapiens
agggtccctctgtgtatttg

SEQ ID NO: 5213670 - DNA, 21 bp, Homo sapiens
agggtccctgaacgccctggt

SEQ ID NO: 5213671 - DNA, 16 bp, Homo sapiens
agggtccctgcccact

SEQ ID NO: 5213672 - DNA, 12 bp, Homo sapiens
agggtccctggg

SEQ ID NO: 5213673 - DNA, 14 bp, Homo sapiens
agggtccctggtgg

SEQ ID NO: 5213674 - DNA, 16 bp, Homo sapiens
agggtccctggtggca

SEQ ID NO: 5213675 - DNA, 22 bp, Homo sapiens
agggtccgcaccagctgctctg

SEQ ID NO: 5213676 - DNA, 23 bp, Homo sapiens
agggtccgcaccagctgctctgc

SEQ ID NO: 5213677 - DNA, 24 bp, Homo sapiens
agggtccgcaccagctgctctgcc

SEQ ID NO: 5213678 - DNA, 22 bp, Homo sapiens
agggtcctcaggcagtggccca

SEQ ID NO: 5213679 - DNA, 21 bp, Homo sapiens
agggtcctctcttccacagtg

SEQ ID NO: 5213680 - DNA, 15 bp, Homo sapiens
agggtcctcttttcc

SEQ ID NO: 5213681 - DNA, 14 bp, Homo sapiens
agggtcctgctttc

SEQ ID NO: 5213682 - DNA, 22 bp, Homo sapiens
agggtcctgtcgaaggggaggc

SEQ ID NO: 5213683 - DNA, 23 bp, Homo sapiens
agggtcctgtcgaaggggaggca

SEQ ID NO: 5213684 - DNA, 14 bp, Homo sapiens
agggtccttccctc

SEQ ID NO: 5213685 - DNA, 20 bp, Homo sapiens
agggtcctttagtacctgaa

SEQ ID NO: 5213686 - DNA, 22 bp, Homo sapiens
agggtccttttgacactgctct

SEQ ID NO: 5213687 - DNA, 14 bp, Homo sapiens
agggtcgaaagctc

SEQ ID NO: 5213688 - DNA, 16 bp, Homo sapiens
agggtcgaaagctcta

SEQ ID NO: 5213689 - DNA, 22 bp, Homo sapiens
agggtcgaaagctctagaatct

SEQ ID NO: 5213690 - DNA, 16 bp, Homo sapiens
agggtcggggaggagg

SEQ ID NO: 5213691 - DNA, 22 bp, Homo sapiens
agggtcgtgggaaaggggagta

SEQ ID NO: 5213692 - DNA, 20 bp, Homo sapiens
agggtctagccgctgccctg

SEQ ID NO: 5213693 - DNA, 15 bp, Homo sapiens
agggtctagggagag

SEQ ID NO: 5213694 - DNA, 16 bp, Homo sapiens
agggtctatcttgtaa

SEQ ID NO: 5213695 - DNA, 19 bp, Homo sapiens
agggtctatcttgtaaata

SEQ ID NO: 5213696 - DNA, 23 bp, Homo sapiens
agggtctcactatgttgcccagg

SEQ ID NO: 5213697 - DNA, 15 bp, Homo sapiens
agggtctcactctgt

SEQ ID NO: 5213698 - DNA, 18 bp, Homo sapiens
agggtctcactctgttga

SEQ ID NO: 5213699 - DNA, 23 bp, Homo sapiens
agggtctccctatgttgcccagg

SEQ ID NO: 5213700 - DNA, 16 bp, Homo sapiens
agggtctccctgggca

SEQ ID NO: 5213701 - DNA, 21 bp, Homo sapiens
agggtctcgaactcctggcct

SEQ ID NO: 5213702 - DNA, 18 bp, Homo sapiens
agggtctcgctgtcactg

SEQ ID NO: 5213703 - DNA, 17 bp, Homo sapiens
agggtctctctccaggt

SEQ ID NO: 5213704 - DNA, 19 bp, Homo sapiens
agggtctctctccaggtca

SEQ ID NO: 5213705 - DNA, 20 bp, Homo sapiens
agggtctctctccaggtcag

SEQ ID NO: 5213706 - DNA, 14 bp, Homo sapiens
agggtctctgctcc

SEQ ID NO: 5213707 - DNA, 17 bp, Homo sapiens
agggtctctgctccagc

SEQ ID NO: 5213708 - DNA, 13 bp, Homo sapiens
agggtctctgctg

SEQ ID NO: 5213709 - DNA, 14 bp, Homo sapiens
agggtctctgctgc

SEQ ID NO: 5213710 - DNA, 15 bp, Homo sapiens
agggtctctgctgcc

SEQ ID NO: 5213711 - DNA, 15 bp, Homo sapiens
agggtctcttccttc

SEQ ID NO: 5213712 - DNA, 10 bp, Homo sapiens
agggtctgaa

SEQ ID NO: 5213713 - DNA, 13 bp, Homo sapiens
agggtctgaaagg

SEQ ID NO: 5213714 - DNA, 15 bp, Homo sapiens
agggtctgaaagggg

SEQ ID NO: 5213715 - DNA, 11 bp, Homo sapiens
agggtctgagt

SEQ ID NO: 5213716 - DNA, 17 bp, Homo sapiens
agggtctgcagggaatt

SEQ ID NO: 5213717 - DNA, 17 bp, Homo sapiens
agggtctgcctccagcc

SEQ ID NO: 5213718 - DNA, 18 bp, Homo sapiens
agggtctgcctccagcca

SEQ ID NO: 5213719 - DNA, 13 bp, Homo sapiens
aggccctcggagc

SEQ ID NO: 5213720 - DNA, 19 bp, Homo sapiens
aggccctcggagctggctg

SEQ ID NO: 5213721 - DNA, 18 bp, Homo sapiens
aggccctcgggcccagcc

SEQ ID NO: 5213722 - DNA, 15 bp, Homo sapiens
aggccctctctgcag

SEQ ID NO: 5213723 - DNA, 12 bp, Homo sapiens
aggccctctgcc

SEQ ID NO: 5213724 - DNA, 15 bp, Homo sapiens
aggccctctgcccac

SEQ ID NO: 5213725 - DNA, 17 bp, Homo sapiens
aggccctctgcccactc

SEQ ID NO: 5213726 - DNA, 21 bp, Homo sapiens
aggccctctgcccactccctg

SEQ ID NO: 5213727 - DNA, 22 bp, Homo sapiens
aggccctctgcccactccctgc

SEQ ID NO: 5213728 - DNA, 13 bp, Homo sapiens
aggccctctggag

SEQ ID NO: 5213729 - DNA, 13 bp, Homo sapiens
aggccctctgtgg

SEQ ID NO: 5213730 - DNA, 16 bp, Homo sapiens
aggccctgactcctct

SEQ ID NO: 5213731 - DNA, 17 bp, Homo sapiens
aggccctgactcctctg

SEQ ID NO: 5213732 - DNA, 18 bp, Homo sapiens
aggccctgactcctctgg

SEQ ID NO: 5213733 - DNA, 19 bp, Homo sapiens
aggccctgactcctctggc

SEQ ID NO: 5213734 - DNA, 16 bp, Homo sapiens
aggccctgcactgtcc

SEQ ID NO: 5213735 - DNA, 23 bp, Homo sapiens
aggccctgcactgtcctgctcca

SEQ ID NO: 5213736 - DNA, 11 bp, Homo sapiens
aggccctgcat

SEQ ID NO: 5213737 - DNA, 18 bp, Homo sapiens
aggccctgcatctgtctg

SEQ ID NO: 5213738 - DNA, 19 bp, Homo sapiens
aggccctgcatctgtctgc

SEQ ID NO: 5213739 - DNA, 12 bp, Homo sapiens
aggccctgcatg

SEQ ID NO: 5213740 - DNA, 20 bp, Homo sapiens
aggccctgccattggcctct

SEQ ID NO: 5213741 - DNA, 11 bp, Homo sapiens
aggccctgccc

SEQ ID NO: 5213742 - DNA, 12 bp, Homo sapiens
aggccctgccca

SEQ ID NO: 5213743 - DNA, 21 bp, Homo sapiens
aggccctgcccagccagccat

SEQ ID NO: 5213744 - DNA, 14 bp, Homo sapiens
aggccctgccccca

SEQ ID NO: 5213745 - DNA, 14 bp, Homo sapiens
aggccctgccctgc

SEQ ID NO: 5213746 - DNA, 17 bp, Homo sapiens
aggccctgccctgccca

SEQ ID NO: 5213747 - DNA, 14 bp, Homo sapiens
aggccctgcctccg

SEQ ID NO: 5213748 - DNA, 13 bp, Homo sapiens
aggccctgcctga

SEQ ID NO: 5213749 - DNA, 16 bp, Homo sapiens
aggccctgccttcagc

SEQ ID NO: 5213750 - DNA, 18 bp, Homo sapiens
aggccctgctcctgcagc

SEQ ID NO: 5213751 - DNA, 19 bp, Homo sapiens
aggccctgctcctgcagca

SEQ ID NO: 5213752 - DNA, 21 bp, Homo sapiens
aggccctgctcctgcagcatg

SEQ ID NO: 5213753 - DNA, 22 bp, Homo sapiens
aggccctgctcctgcagcatgg

SEQ ID NO: 5213754 - DNA, 15 bp, Homo sapiens
aggccctgctgccca

SEQ ID NO: 5213755 - DNA, 13 bp, Homo sapiens
aggccctggaggg

SEQ ID NO: 5213756 - DNA, 17 bp, Homo sapiens
aggccctggagggaagg

SEQ ID NO: 5213757 - DNA, 14 bp, Homo sapiens
aggccctggagggc

SEQ ID NO: 5213758 - DNA, 17 bp, Homo sapiens
aggccctggagggcaga

SEQ ID NO: 5213759 - DNA, 21 bp, Homo sapiens
aggccctggatcagcgtggcc

SEQ ID NO: 5213760 - DNA, 23 bp, Homo sapiens
aggccctggatcagcgtggcctt

SEQ ID NO: 5213761 - DNA, 22 bp, Homo sapiens
aggccctggatgtgcccacagg

SEQ ID NO: 5213762 - DNA, 10 bp, Homo sapiens
aggccctggc

SEQ ID NO: 5213763 - DNA, 13 bp, Homo sapiens
aggccctggccct

SEQ ID NO: 5213764 - DNA, 19 bp, Homo sapiens
aggccctggccctttcccc

SEQ ID NO: 5213765 - DNA, 22 bp, Homo sapiens
aggccctggcctcccctgccac

SEQ ID NO: 5213766 - DNA, 23 bp, Homo sapiens
aggccctggcctcccctgccacc

SEQ ID NO: 5213767 - DNA, 17 bp, Homo sapiens
aggccctgggcctccac

SEQ ID NO: 5213768 - DNA, 13 bp, Homo sapiens
aggccctgggctg

SEQ ID NO: 5213769 - DNA, 17 bp, Homo sapiens
aggccctgggtaagaag

SEQ ID NO: 5213770 - DNA, 13 bp, Homo sapiens
aggccctggtctg

SEQ ID NO: 5213771 - DNA, 16 bp, Homo sapiens
aggccctggtctggct

SEQ ID NO: 5213772 - DNA, 17 bp, Homo sapiens
aggccctggtctggctt

SEQ ID NO: 5213773 - DNA, 20 bp, Homo sapiens
aggccctggtgtcaggcagg

SEQ ID NO: 5213774 - DNA, 13 bp, Homo sapiens
aggccctgtccca

SEQ ID NO: 5213775 - DNA, 14 bp, Homo sapiens
aggccctgtcccag

SEQ ID NO: 5213776 - DNA, 14 bp, Homo sapiens
aggccctgtctgta

SEQ ID NO: 5213777 - DNA, 11 bp, Homo sapiens
aggccctgtga

SEQ ID NO: 5213778 - DNA, 17 bp, Homo sapiens
aggccctgtgagcacaa

SEQ ID NO: 5213779 - DNA, 18 bp, Homo sapiens
aggccctgtgagcacaaa

SEQ ID NO: 5213780 - DNA, 13 bp, Homo sapiens
aggccctgtgccc

SEQ ID NO: 5213781 - DNA, 19 bp, Homo sapiens
aggccctgtggtctgggga

SEQ ID NO: 5213782 - DNA, 17 bp, Homo sapiens
aggccctgttccctgga

SEQ ID NO: 5213783 - DNA, 16 bp, Homo sapiens
aggcccttagagggaa

SEQ ID NO: 5213784 - DNA, 17 bp, Homo sapiens
aggcccttagggaagtt

SEQ ID NO: 5213785 - DNA, 16 bp, Homo sapiens
aggcccttattttcaa

SEQ ID NO: 5213786 - DNA, 18 bp, Homo sapiens
aggcccttcctctccact

SEQ ID NO: 5213787 - DNA, 19 bp, Homo sapiens
aggcccttctctccagccc

SEQ ID NO: 5213788 - DNA, 20 bp, Homo sapiens
aggcccttctctccagcccc

SEQ ID NO: 5213789 - DNA, 23 bp, Homo sapiens
aggcccttctctccagcccctgg

SEQ ID NO: 5213790 - DNA, 22 bp, Homo sapiens
aggcccttggggttcccccaga

SEQ ID NO: 5213791 - DNA, 23 bp, Homo sapiens
aggcccttggggttcccccagac

SEQ ID NO: 5213792 - DNA, 13 bp, Homo sapiens
aggcccttgtcct

SEQ ID NO: 5213793 - DNA, 15 bp, Homo sapiens
aggcccttgtcctgc

SEQ ID NO: 5213794 - DNA, 17 bp, Homo sapiens
aggcccttgtcgtggga

SEQ ID NO: 5213795 - DNA, 16 bp, Homo sapiens
aggccctttcctcagg

SEQ ID NO: 5213796 - DNA, 16 bp, Homo sapiens
aggccctttcctttgg

SEQ ID NO: 5213797 - DNA, 13 bp, Homo sapiens
aggccctttggct

SEQ ID NO: 5213798 - DNA, 16 bp, Homo sapiens
aggccctttggcttct

SEQ ID NO: 5213799 - DNA, 17 bp, Homo sapiens
aggccctttggcttctg

SEQ ID NO: 5213800 - DNA, 14 bp, Homo sapiens
aggcccttttctgg

SEQ ID NO: 5213801 - DNA, 17 bp, Homo sapiens
aggcccttttctggctc

SEQ ID NO: 5213802 - DNA, 18 bp, Homo sapiens
aggcccttttctggctcc

SEQ ID NO: 5213803 - DNA, 17 bp, Homo sapiens
aggccgaagaagggtcc

SEQ ID NO: 5213804 - DNA, 22 bp, Homo sapiens
aggccgaagaagggtccttccc

SEQ ID NO: 5213805 - DNA, 16 bp, Homo sapiens
aggccgaagctctggc

SEQ ID NO: 5213806 - DNA, 17 bp, Homo sapiens
aggccgaagctctggct

SEQ ID NO: 5213807 - DNA, 18 bp, Homo sapiens
aggccgaaggtgcctcag

SEQ ID NO: 5213808 - DNA, 20 bp, Homo sapiens
aggccgacaggaggccatgc

SEQ ID NO: 5213809 - DNA, 22 bp, Homo sapiens
aggccgacaggaggccatgccc

SEQ ID NO: 5213810 - DNA, 18 bp, Homo sapiens
aggccgacgttttctccg

SEQ ID NO: 5213811 - DNA, 22 bp, Homo sapiens
aggccgactgggctgctggggc

SEQ ID NO: 5213812 - DNA, 17 bp, Homo sapiens
aggccgagaagccagtg

SEQ ID NO: 5213813 - DNA, 15 bp, Homo sapiens
aggccgagagcctta

SEQ ID NO: 5213814 - DNA, 17 bp, Homo sapiens
aggccgagcccacacca

SEQ ID NO: 5213815 - DNA, 18 bp, Homo sapiens
aggccgagcgttcccagc

SEQ ID NO: 5213816 - DNA, 21 bp, Homo sapiens
aggccgagcgttcccagcagg

SEQ ID NO: 5213817 - DNA, 23 bp, Homo sapiens
aggccgagcgttcccagcagggg

SEQ ID NO: 5213818 - DNA, 20 bp, Homo sapiens
aggccgaggaccaccagcag

SEQ ID NO: 5213819 - DNA, 16 bp, Homo sapiens
aggccgaggagagagg

SEQ ID NO: 5213820 - DNA, 14 bp, Homo sapiens
aggccgaggcaggg

SEQ ID NO: 5213821 - DNA, 19 bp, Homo sapiens
aggccgaggcaggggctgg

SEQ ID NO: 5213822 - DNA, 16 bp, Homo sapiens
aggccgaggcaggtgg

SEQ ID NO: 5213823 - DNA, 13 bp, Homo sapiens
aggccgagggcca

SEQ ID NO: 5213824 - DNA, 13 bp, Homo sapiens
aggccgaggtagg

SEQ ID NO: 5213825 - DNA, 16 bp, Homo sapiens
aggccgaggtgggcag

SEQ ID NO: 5213826 - DNA, 16 bp, Homo sapiens
aggccgagtctgtcct

SEQ ID NO: 5213827 - DNA, 14 bp, Homo sapiens
aggccgcaagggga

SEQ ID NO: 5213828 - DNA, 14 bp, Homo sapiens
aggccgcatggccc

SEQ ID NO: 5213829 - DNA, 12 bp, Homo sapiens
aggccgccagcg

SEQ ID NO: 5213830 - DNA, 21 bp, Homo sapiens
aggccgccagcgtgtggagca

SEQ ID NO: 5213831 - DNA, 22 bp, Homo sapiens
aggccgccagcgtgtggagcag

SEQ ID NO: 5213832 - DNA, 24 bp, Homo sapiens
aggccgccctgagcatcctggttc

SEQ ID NO: 5213833 - DNA, 15 bp, Homo sapiens
aggccgccgtgacct

SEQ ID NO: 5213834 - DNA, 13 bp, Homo sapiens
aggccgcctgcca

SEQ ID NO: 5213835 - DNA, 14 bp, Homo sapiens
aggccgcctgccat

SEQ ID NO: 5213836 - DNA, 12 bp, Homo sapiens
aggccgcgccca

SEQ ID NO: 5213837 - DNA, 16 bp, Homo sapiens
aggccgcgcccagcag

SEQ ID NO: 5213838 - DNA, 14 bp, Homo sapiens
aggccgctgcaggg

SEQ ID NO: 5213839 - DNA, 19 bp, Homo sapiens
aggccgctgccccagcccc

SEQ ID NO: 5213840 - DNA, 14 bp, Homo sapiens
aggccgctgcccct

SEQ ID NO: 5213841 - DNA, 16 bp, Homo sapiens
aggccgctgctgacca

SEQ ID NO: 5213842 - DNA, 16 bp, Homo sapiens
aggccgcttagtgctg

SEQ ID NO: 5213843 - DNA, 23 bp, Homo sapiens
aggccgcttagtgctgctttgct

SEQ ID NO: 5213844 - DNA, 18 bp, Homo sapiens
aggccggaaccacagggc

SEQ ID NO: 5213845 - DNA, 20 bp, Homo sapiens
aggccggaaccacagggcca

SEQ ID NO: 5213846 - DNA, 21 bp, Homo sapiens
aggccggaaccacagggccag

SEQ ID NO: 5213847 - DNA, 23 bp, Homo sapiens
aggccggaaccacagggccagag

SEQ ID NO: 5213848 - DNA, 19 bp, Homo sapiens
aggccggagacccacagcc

SEQ ID NO: 5213849 - DNA, 16 bp, Homo sapiens
aggccggagagctggt

SEQ ID NO: 5213850 - DNA, 23 bp, Homo sapiens
aggccggagaggagttcaggaac

SEQ ID NO: 5213851 - DNA, 13 bp, Homo sapiens
aggccggagccca

SEQ ID NO: 5213852 - DNA, 16 bp, Homo sapiens
aggccggcagccccag

SEQ ID NO: 5213853 - DNA, 22 bp, Homo sapiens
aggccggcagccccagcctgct

SEQ ID NO: 5213854 - DNA, 18 bp, Homo sapiens
aggccggcagcgggcgga

SEQ ID NO: 5213855 - DNA, 15 bp, Homo sapiens
aggccggccagctcc

SEQ ID NO: 5213856 - DNA, 14 bp, Homo sapiens
aggccggccctgcc

SEQ ID NO: 5213857 - DNA, 15 bp, Homo sapiens
aggccggccctgccc

SEQ ID NO: 5213858 - DNA, 19 bp, Homo sapiens
aggccggccctgcccctcc

SEQ ID NO: 5213859 - DNA, 21 bp, Homo sapiens
aggccggccctgcccctccct

SEQ ID NO: 5213860 - DNA, 24 bp, Homo sapiens
aggccggccctgcccctccctaga

SEQ ID NO: 5213861 - DNA, 21 bp, Homo sapiens
aggccgggaagagccacctgg

SEQ ID NO: 5213862 - DNA, 14 bp, Homo sapiens
aggccgggcagagc

SEQ ID NO: 5213863 - DNA, 20 bp, Homo sapiens
aggccgggcctgtacagtct

SEQ ID NO: 5213864 - DNA, 17 bp, Homo sapiens
aggccgggcttgggccc

SEQ ID NO: 5213865 - DNA, 23 bp, Homo sapiens
aggccgggcttgggccctgcaca

SEQ ID NO: 5213866 - DNA, 17 bp, Homo sapiens
aggccggggggagcagg

SEQ ID NO: 5213867 - DNA, 14 bp, Homo sapiens
aggccggtgtgcct

SEQ ID NO: 5213868 - DNA, 23 bp, Homo sapiens
aggccgtatgaagacagaggcag

SEQ ID NO: 5213869 - DNA, 13 bp, Homo sapiens
aggccgtcctccc

SEQ ID NO: 5213870 - DNA, 23 bp, Homo sapiens
aggccgtgcctggtggggcggac

SEQ ID NO: 5213871 - DNA, 18 bp, Homo sapiens
aggccgtgggacccaggc

SEQ ID NO: 5213872 - DNA, 23 bp, Homo sapiens
aggccgtgggacccaggctccca

SEQ ID NO: 5213873 - DNA, 14 bp, Homo sapiens
aggccgtgtctctg

SEQ ID NO: 5213874 - DNA, 13 bp, Homo sapiens
aggccgttcccct

SEQ ID NO: 5213875 - DNA, 21 bp, Homo sapiens
aggccgttccccttggcttcc

SEQ ID NO: 5213876 - DNA, 14 bp, Homo sapiens
aggccgtttgcttt

SEQ ID NO: 5213877 - DNA, 15 bp, Homo sapiens
aggccgtttgctttt

SEQ ID NO: 5213878 - DNA, 16 bp, Homo sapiens
aggcctaaaagtaaac

SEQ ID NO: 5213879 - DNA, 13 bp, Homo sapiens
aggcctaagacat

SEQ ID NO: 5213880 - DNA, 16 bp, Homo sapiens
aggcctaccccagttc

SEQ ID NO: 5213881 - DNA, 23 bp, Homo sapiens
aggcctaccccagttcctagcac

SEQ ID NO: 5213882 - DNA, 20 bp, Homo sapiens
aggcctacctcaagttcttg

SEQ ID NO: 5213883 - DNA, 21 bp, Homo sapiens
aggcctacctcaagttcttgg

SEQ ID NO: 5213884 - DNA, 22 bp, Homo sapiens
aggcctacctcaagttcttgga

SEQ ID NO: 5213885 - DNA, 18 bp, Homo sapiens
aggcctacctgctcccct

SEQ ID NO: 5213886 - DNA, 16 bp, Homo sapiens
aggcctagactctgtc

SEQ ID NO: 5213887 - DNA, 17 bp, Homo sapiens
aggcctagagtggcagc

SEQ ID NO: 5213888 - DNA, 17 bp, Homo sapiens
aggcctaggacctatgt

SEQ ID NO: 5213889 - DNA, 18 bp, Homo sapiens
aggcctaggacctatgtt

SEQ ID NO: 5213890 - DNA, 20 bp, Homo sapiens
aggcctaggctaggacgttg

SEQ ID NO: 5213891 - DNA, 21 bp, Homo sapiens
aggcctagtacaatcttggga

SEQ ID NO: 5213892 - DNA, 20 bp, Homo sapiens
aggcctagtcagccacatgg

SEQ ID NO: 5213893 - DNA, 22 bp, Homo sapiens
aggcctataatgaagctttata

SEQ ID NO: 5213894 - DNA, 14 bp, Homo sapiens
aggcctatcaacct

SEQ ID NO: 5213895 - DNA, 22 bp, Homo sapiens
aggcctatgcagacatctctgg

SEQ ID NO: 5213896 - DNA, 18 bp, Homo sapiens
aggcctatttaacaagat

SEQ ID NO: 5213897 - DNA, 14 bp, Homo sapiens
aggcctatttcatc

SEQ ID NO: 5213898 - DNA, 21 bp, Homo sapiens
agggtctgctctttctctgcc

SEQ ID NO: 5213899 - DNA, 14 bp, Homo sapiens
agggtctggagaag

SEQ ID NO: 5213900 - DNA, 12 bp, Homo sapiens
agggtctggcag

SEQ ID NO: 5213901 - DNA, 20 bp, Homo sapiens
agggtctggcagagcctctg

SEQ ID NO: 5213902 - DNA, 23 bp, Homo sapiens
agggtctggcagagcctctgaga

SEQ ID NO: 5213903 - DNA, 22 bp, Homo sapiens
agggtctgggaaatgagcaggg

SEQ ID NO: 5213904 - DNA, 12 bp, Homo sapiens
agggtctgggac

SEQ ID NO: 5213905 - DNA, 13 bp, Homo sapiens
agggtctgggatc

SEQ ID NO: 5213906 - DNA, 15 bp, Homo sapiens
agggtctgggatgaa

SEQ ID NO: 5213907 - DNA, 18 bp, Homo sapiens
agggtctgggggcagctg

SEQ ID NO: 5213908 - DNA, 21 bp, Homo sapiens
agggtctgggggcagctgtcc

SEQ ID NO: 5213909 - DNA, 23 bp, Homo sapiens
agggtctgggggcagctgtcctg

SEQ ID NO: 5213910 - DNA, 20 bp, Homo sapiens
agggtctgtaggttgcacac

SEQ ID NO: 5213911 - DNA, 13 bp, Homo sapiens
agggtctgtgtga

SEQ ID NO: 5213912 - DNA, 18 bp, Homo sapiens
agggtctgtgtgaatgtg

SEQ ID NO: 5213913 - DNA, 15 bp, Homo sapiens
agggtctgttgtaaa

SEQ ID NO: 5213914 - DNA, 17 bp, Homo sapiens
agggtcttccctacctc

SEQ ID NO: 5213915 - DNA, 18 bp, Homo sapiens
agggtcttcttggcagct

SEQ ID NO: 5213916 - DNA, 15 bp, Homo sapiens
agggtcttgagggga

SEQ ID NO: 5213917 - DNA, 23 bp, Homo sapiens
agggtcttgggctactggcagct

SEQ ID NO: 5213918 - DNA, 22 bp, Homo sapiens
agggtctttctgatgacgcctg

SEQ ID NO: 5213919 - DNA, 14 bp, Homo sapiens
agggtctttgcaga

SEQ ID NO: 5213920 - DNA, 19 bp, Homo sapiens
agggtcttttaccctgtgt

SEQ ID NO: 5213921 - DNA, 18 bp, Homo sapiens
agggtcttttcatctggg

SEQ ID NO: 5213922 - DNA, 18 bp, Homo sapiens
agggtctttttctagggt

SEQ ID NO: 5213923 - DNA, 15 bp, Homo sapiens
agggtgaaaattatt

SEQ ID NO: 5213924 - DNA, 19 bp, Homo sapiens
agggtgaaacttaaaaaaa

SEQ ID NO: 5213925 - DNA, 14 bp, Homo sapiens
agggtgaaggagaa

SEQ ID NO: 5213926 - DNA, 15 bp, Homo sapiens
agggtgaataaagca

SEQ ID NO: 5213927 - DNA, 19 bp, Homo sapiens
agggtgaataaagcaggga

SEQ ID NO: 5213928 - DNA, 17 bp, Homo sapiens
agggtgacatcccagga

SEQ ID NO: 5213929 - DNA, 22 bp, Homo sapiens
agggtgacccacagctctgggc

SEQ ID NO: 5213930 - DNA, 15 bp, Homo sapiens
agggtgacgcccagc

SEQ ID NO: 5213931 - DNA, 16 bp, Homo sapiens
agggtgacgcccagct

SEQ ID NO: 5213932 - DNA, 15 bp, Homo sapiens
agggtgacgcctgag

SEQ ID NO: 5213933 - DNA, 16 bp, Homo sapiens
agggtgacgcctgaga

SEQ ID NO: 5213934 - DNA, 21 bp, Homo sapiens
agggtgacgcctgagacagca

SEQ ID NO: 5213935 - DNA, 14 bp, Homo sapiens
agggtgagaagcta

SEQ ID NO: 5213936 - DNA, 13 bp, Homo sapiens
agggtgagaaggg

SEQ ID NO: 5213937 - DNA, 17 bp, Homo sapiens
agggtgagaagggcagg

SEQ ID NO: 5213938 - DNA, 23 bp, Homo sapiens
agggtgagcagggccctcagagg

SEQ ID NO: 5213939 - DNA, 24 bp, Homo sapiens
agggtgagcagggccctcagagga

SEQ ID NO: 5213940 - DNA, 21 bp, Homo sapiens
agggtgagcagggtcaagcct

SEQ ID NO: 5213941 - DNA, 12 bp, Homo sapiens
agggtgagccca

SEQ ID NO: 5213942 - DNA, 19 bp, Homo sapiens
agggtgagctggtgcctgc

SEQ ID NO: 5213943 - DNA, 20 bp, Homo sapiens
agggtgagctggtgcctgct

SEQ ID NO: 5213944 - DNA, 19 bp, Homo sapiens
agggtgagggccttcttaa

SEQ ID NO: 5213945 - DNA, 17 bp, Homo sapiens
agggtgagttaaagaga

SEQ ID NO: 5213946 - DNA, 18 bp, Homo sapiens
agggtgagtttgaagagg

SEQ ID NO: 5213947 - DNA, 19 bp, Homo sapiens
agggtgatgccaggttcta

SEQ ID NO: 5213948 - DNA, 19 bp, Homo sapiens
agggtgatggaacaagaga

SEQ ID NO: 5213949 - DNA, 23 bp, Homo sapiens
agggtgcaagccccattcacggc

SEQ ID NO: 5213950 - DNA, 14 bp, Homo sapiens
agggtgcagcccaa

SEQ ID NO: 5213951 - DNA, 17 bp, Homo sapiens
agggtgcagccctcttg

SEQ ID NO: 5213952 - DNA, 13 bp, Homo sapiens
agggtgcagggac

SEQ ID NO: 5213953 - DNA, 19 bp, Homo sapiens
agggtgcagtatctcttgc

SEQ ID NO: 5213954 - DNA, 21 bp, Homo sapiens
agggtgcagtatctcttgctg

SEQ ID NO: 5213955 - DNA, 18 bp, Homo sapiens
agggtgccagttgggctc

SEQ ID NO: 5213956 - DNA, 23 bp, Homo sapiens
agggtgccctctgctcaggcctc

SEQ ID NO: 5213957 - DNA, 18 bp, Homo sapiens
agggtgcccttttccagc

SEQ ID NO: 5213958 - DNA, 20 bp, Homo sapiens
agggtgccggaaagagagct

SEQ ID NO: 5213959 - DNA, 15 bp, Homo sapiens
agggtgccgtgtccc

SEQ ID NO: 5213960 - DNA, 14 bp, Homo sapiens
agggtgcctgctct

SEQ ID NO: 5213961 - DNA, 14 bp, Homo sapiens
agggtgcctggctg

SEQ ID NO: 5213962 - DNA, 18 bp, Homo sapiens
agggtgccttaaaaataa

SEQ ID NO: 5213963 - DNA, 16 bp, Homo sapiens
agggtgcggggcctgc

SEQ ID NO: 5213964 - DNA, 20 bp, Homo sapiens
agggtgctaacgtatctcta

SEQ ID NO: 5213965 - DNA, 22 bp, Homo sapiens
agggtgctacgtacatgtgagg

SEQ ID NO: 5213966 - DNA, 19 bp, Homo sapiens
agggtgctcagtctccttg

SEQ ID NO: 5213967 - DNA, 19 bp, Homo sapiens
agggtgctctgaggtcaat

SEQ ID NO: 5213968 - DNA, 17 bp, Homo sapiens
agggtgctgcttccctc

SEQ ID NO: 5213969 - DNA, 21 bp, Homo sapiens
agggtgctgcttccctctgcc

SEQ ID NO: 5213970 - DNA, 20 bp, Homo sapiens
agggtgctgtcccctcccct

SEQ ID NO: 5213971 - DNA, 12 bp, Homo sapiens
agggtggaaata

SEQ ID NO: 5213972 - DNA, 19 bp, Homo sapiens
agggtggaaataatttgaa

SEQ ID NO: 5213973 - DNA, 12 bp, Homo sapiens
agggtggacaga

SEQ ID NO: 5213974 - DNA, 14 bp, Homo sapiens
agggtggacagaag

SEQ ID NO: 5213975 - DNA, 16 bp, Homo sapiens
agggtggacagaagct

SEQ ID NO: 5213976 - DNA, 15 bp, Homo sapiens
agggtggaccaggcc

SEQ ID NO: 5213977 - DNA, 19 bp, Homo sapiens
agggtggaccaggcctgga

SEQ ID NO: 5213978 - DNA, 20 bp, Homo sapiens
agggtggaccaggcctggag

SEQ ID NO: 5213979 - DNA, 16 bp, Homo sapiens
agggtggacttagaaa

SEQ ID NO: 5213980 - DNA, 16 bp, Homo sapiens
agggtggagagggaga

SEQ ID NO: 5213981 - DNA, 19 bp, Homo sapiens
agggtggaggaaggtgact

SEQ ID NO: 5213982 - DNA, 20 bp, Homo sapiens
agggtggatccactgtgcag

SEQ ID NO: 5213983 - DNA, 20 bp, Homo sapiens
agggtggatgacagggcaga

SEQ ID NO: 5213984 - DNA, 15 bp, Homo sapiens
agggtggcacatctg

SEQ ID NO: 5213985 - DNA, 16 bp, Homo sapiens
agggtggcagagacag

SEQ ID NO: 5213986 - DNA, 21 bp, Homo sapiens
agggtggcagagacagtgggc

SEQ ID NO: 5213987 - DNA, 16 bp, Homo sapiens
agggtggcagcaacaa

SEQ ID NO: 5213988 - DNA, 14 bp, Homo sapiens
agggtggcaggtca

SEQ ID NO: 5213989 - DNA, 22 bp, Homo sapiens
agggtggcaggtcactgtcact

SEQ ID NO: 5213990 - DNA, 14 bp, Homo sapiens
agggtggcaggtga

SEQ ID NO: 5213991 - DNA, 21 bp, Homo sapiens
agggtggcatcccagtggcct

SEQ ID NO: 5213992 - DNA, 15 bp, Homo sapiens
agggtggccacacag

SEQ ID NO: 5213993 - DNA, 21 bp, Homo sapiens
agggtggccacacaggcaggg

SEQ ID NO: 5213994 - DNA, 22 bp, Homo sapiens
agggtggccacacctctatccc

SEQ ID NO: 5213995 - DNA, 13 bp, Homo sapiens
agggtggccagca

SEQ ID NO: 5213996 - DNA, 22 bp, Homo sapiens
agggtggccccctgtgccagct

SEQ ID NO: 5213997 - DNA, 16 bp, Homo sapiens
agggtggcctcaagaa

SEQ ID NO: 5213998 - DNA, 19 bp, Homo sapiens
agggtggcctgttccctag

SEQ ID NO: 5213999 - DNA, 16 bp, Homo sapiens
agggtggctgccagcc

SEQ ID NO: 5214000 - DNA, 17 bp, Homo sapiens
agggtggctgccagccc

SEQ ID NO: 5214001 - DNA, 16 bp, Homo sapiens
agggtggctttaattg

SEQ ID NO: 5214002 - DNA, 18 bp, Homo sapiens
agggtggctttaattgta

SEQ ID NO: 5214003 - DNA, 19 bp, Homo sapiens
agggtggctttaattgtat

SEQ ID NO: 5214004 - DNA, 12 bp, Homo sapiens
agggtggctttg

SEQ ID NO: 5214005 - DNA, 18 bp, Homo sapiens
agggtggctttgctgttg

SEQ ID NO: 5214006 - DNA, 13 bp, Homo sapiens
agggtgggaggga

SEQ ID NO: 5214007 - DNA, 15 bp, Homo sapiens
agggtgggagggagg

SEQ ID NO: 5214008 - DNA, 16 bp, Homo sapiens
agggtgggaggggcca

SEQ ID NO: 5214009 - DNA, 18 bp, Homo sapiens
agggtgggatgagcctct

SEQ ID NO: 5214010 - DNA, 17 bp, Homo sapiens
agggtgggatggaggag

SEQ ID NO: 5214011 - DNA, 17 bp, Homo sapiens
agggtgggccactctcc

SEQ ID NO: 5214012 - DNA, 12 bp, Homo sapiens
agggtgggccag

SEQ ID NO: 5214013 - DNA, 18 bp, Homo sapiens
agggtgggccccagccgt

SEQ ID NO: 5214014 - DNA, 15 bp, Homo sapiens
agggtgggccctgga

SEQ ID NO: 5214015 - DNA, 22 bp, Homo sapiens
agggtgggctctaaatccatta

SEQ ID NO: 5214016 - DNA, 15 bp, Homo sapiens
agggtgggctgggga

SEQ ID NO: 5214017 - DNA, 16 bp, Homo sapiens
agggtgggctggggac

SEQ ID NO: 5214018 - DNA, 12 bp, Homo sapiens
agggtggggaga

SEQ ID NO: 5214019 - DNA, 20 bp, Homo sapiens
agggtggggcaatggggaga

SEQ ID NO: 5214020 - DNA, 18 bp, Homo sapiens
agggtgggggagggaggt

SEQ ID NO: 5214021 - DNA, 18 bp, Homo sapiens
agggtgggggccacctgc

SEQ ID NO: 5214022 - DNA, 23 bp, Homo sapiens
agggtgggggccacctgcctgcg

SEQ ID NO: 5214023 - DNA, 11 bp, Homo sapiens
agggtgggggg

SEQ ID NO: 5214024 - DNA, 23 bp, Homo sapiens
agggtggggggatttgtagcata

SEQ ID NO: 5214025 - DNA, 14 bp, Homo sapiens
agggtggggggcca

SEQ ID NO: 5214026 - DNA, 12 bp, Homo sapiens
agggtggggggt

SEQ ID NO: 5214027 - DNA, 22 bp, Homo sapiens
agggtgggggtgctctctctga

SEQ ID NO: 5214028 - DNA, 21 bp, Homo sapiens
agggtggggtctgggaggggg

SEQ ID NO: 5214029 - DNA, 22 bp, Homo sapiens
agggtggggtgggatttgcagg

SEQ ID NO: 5214030 - DNA, 23 bp, Homo sapiens
agggtggggttttatgtgtggga

SEQ ID NO: 5214031 - DNA, 21 bp, Homo sapiens
agggtgggtgagctctcaggc

SEQ ID NO: 5214032 - DNA, 15 bp, Homo sapiens
agggtgggtgctcag

SEQ ID NO: 5214033 - DNA, 18 bp, Homo sapiens
agggtgggtttgagatgt

SEQ ID NO: 5214034 - DNA, 19 bp, Homo sapiens
agggtgggtttgagatgtt

SEQ ID NO: 5214035 - DNA, 19 bp, Homo sapiens
agggtggtagttttcccta

SEQ ID NO: 5214036 - DNA, 23 bp, Homo sapiens
agggtggtctcttcttggggccc

SEQ ID NO: 5214037 - DNA, 20 bp, Homo sapiens
agggtggtctgagcaccccc

SEQ ID NO: 5214038 - DNA, 23 bp, Homo sapiens
agggtggtcttcaagcctggccc

SEQ ID NO: 5214039 - DNA, 16 bp, Homo sapiens
agggtggtgacctctg

SEQ ID NO: 5214040 - DNA, 18 bp, Homo sapiens
agggtggtgacctctgcc

SEQ ID NO: 5214041 - DNA, 19 bp, Homo sapiens
agggtggtgacctctgcct

SEQ ID NO: 5214042 - DNA, 17 bp, Homo sapiens
agggtggtgctgggact

SEQ ID NO: 5214043 - DNA, 23 bp, Homo sapiens
agggtggttcctgttctcagcat

SEQ ID NO: 5214044 - DNA, 12 bp, Homo sapiens
agggtggtttac

SEQ ID NO: 5214045 - DNA, 19 bp, Homo sapiens
agggtgtagcctacagaca

SEQ ID NO: 5214046 - DNA, 15 bp, Homo sapiens
agggtgtaggggcca

SEQ ID NO: 5214047 - DNA, 18 bp, Homo sapiens
agggtgtaggggccacct

SEQ ID NO: 5214048 - DNA, 19 bp, Homo sapiens
agggtgtaggggccacctc

SEQ ID NO: 5214049 - DNA, 21 bp, Homo sapiens
agggtgtaggggccacctcct

SEQ ID NO: 5214050 - DNA, 15 bp, Homo sapiens
agggtgtatagtgtt

SEQ ID NO: 5214051 - DNA, 19 bp, Homo sapiens
agggtgtatagtgttcaca

SEQ ID NO: 5214052 - DNA, 17 bp, Homo sapiens
agggtgtatctagctct

SEQ ID NO: 5214053 - DNA, 17 bp, Homo sapiens
agggtgtcacgagccca

SEQ ID NO: 5214054 - DNA, 15 bp, Homo sapiens
agggtgtcctgaggt

SEQ ID NO: 5214055 - DNA, 22 bp, Homo sapiens
agggtgtcgtcctgcagtgtga

SEQ ID NO: 5214056 - DNA, 23 bp, Homo sapiens
agggtgtgactcgggagctgcac

SEQ ID NO: 5214057 - DNA, 24 bp, Homo sapiens
agggtgtgactcgggagctgcaca

SEQ ID NO: 5214058 - DNA, 16 bp, Homo sapiens
agggtgtgaggccaca

SEQ ID NO: 5214059 - DNA, 15 bp, Homo sapiens
agggtgtgccctcac

SEQ ID NO: 5214060 - DNA, 16 bp, Homo sapiens
agggtgtggcatttgg

SEQ ID NO: 5214061 - DNA, 15 bp, Homo sapiens
agggtgtggctccta

SEQ ID NO: 5214062 - DNA, 19 bp, Homo sapiens
agggtgtggctcctaccag

SEQ ID NO: 5214063 - DNA, 13 bp, Homo sapiens
agggtgtggcttg

SEQ ID NO: 5214064 - DNA, 16 bp, Homo sapiens
agggtgtggctttcca

SEQ ID NO: 5214065 - DNA, 23 bp, Homo sapiens
agggtgtggggccatgcctcctc

SEQ ID NO: 5214066 - DNA, 17 bp, Homo sapiens
agggtgtgggtgccctg

SEQ ID NO: 5214067 - DNA, 20 bp, Homo sapiens
agggtgtgtgccacacccca

SEQ ID NO: 5214068 - DNA, 22 bp, Homo sapiens
agggtgtgtgcccccagattta

SEQ ID NO: 5214069 - DNA, 20 bp, Homo sapiens
agggtgtgtgttcaccttca

SEQ ID NO: 5214070 - DNA, 20 bp, Homo sapiens
agggtgtgtttgaaatcatc

SEQ ID NO: 5214071 - DNA, 17 bp, Homo sapiens
agggtgtttcctctaaa

SEQ ID NO: 5214072 - DNA, 17 bp, Homo sapiens
agggttaagaaaagaga

SEQ ID NO: 5214073 - DNA, 15 bp, Homo sapiens
agggttaaggcctga

SEQ ID NO: 5214074 - DNA, 20 bp, Homo sapiens
agggttagacaagcctggag

SEQ ID NO: 5214075 - DNA, 22 bp, Homo sapiens
aggcctcaaatgacagtagcat

SEQ ID NO: 5214076 - DNA, 20 bp, Homo sapiens
aggcctcaactcctcccata

SEQ ID NO: 5214077 - DNA, 20 bp, Homo sapiens
aggcctcacacccagagggt

SEQ ID NO: 5214078 - DNA, 16 bp, Homo sapiens
aggcctcaccacctga

SEQ ID NO: 5214079 - DNA, 18 bp, Homo sapiens
aggcctcacccctcccct

SEQ ID NO: 5214080 - DNA, 19 bp, Homo sapiens
aggcctcacccctcccctg

SEQ ID NO: 5214081 - DNA, 23 bp, Homo sapiens
aggcctcaccctgcttggggcct

SEQ ID NO: 5214082 - DNA, 21 bp, Homo sapiens
aggcctcacctcccagggcta

SEQ ID NO: 5214083 - DNA, 22 bp, Homo sapiens
aggcctcacctcccagggctac

SEQ ID NO: 5214084 - DNA, 17 bp, Homo sapiens
aggcctcacctctaccc

SEQ ID NO: 5214085 - DNA, 19 bp, Homo sapiens
aggcctcacctctacccaa

SEQ ID NO: 5214086 - DNA, 22 bp, Homo sapiens
aggcctcacctggcttcccagg

SEQ ID NO: 5214087 - DNA, 23 bp, Homo sapiens
aggcctcactactcgagcccacc

SEQ ID NO: 5214088 - DNA, 13 bp, Homo sapiens
aggcctcactggc

SEQ ID NO: 5214089 - DNA, 19 bp, Homo sapiens
aggcctcagatagacctgt

SEQ ID NO: 5214090 - DNA, 21 bp, Homo sapiens
aggcctcagatagacctgtga

SEQ ID NO: 5214091 - DNA, 13 bp, Homo sapiens
aggcctcagccag

SEQ ID NO: 5214092 - DNA, 14 bp, Homo sapiens
aggcctcagccaga

SEQ ID NO: 5214093 - DNA, 13 bp, Homo sapiens
aggcctcagcctc

SEQ ID NO: 5214094 - DNA, 12 bp, Homo sapiens
aggcctcaggag

SEQ ID NO: 5214095 - DNA, 15 bp, Homo sapiens
aggcctcaggcctcc

SEQ ID NO: 5214096 - DNA, 21 bp, Homo sapiens
aggcctcaggtgctgtccatg

SEQ ID NO: 5214097 - DNA, 13 bp, Homo sapiens
aggcctcagtgga

SEQ ID NO: 5214098 - DNA, 12 bp, Homo sapiens
aggcctcagtgt

SEQ ID NO: 5214099 - DNA, 21 bp, Homo sapiens
aggcctcagtttctccatcag

SEQ ID NO: 5214100 - DNA, 14 bp, Homo sapiens
aggcctcatcctcc

SEQ ID NO: 5214101 - DNA, 14 bp, Homo sapiens
aggcctcatctcct

SEQ ID NO: 5214102 - DNA, 18 bp, Homo sapiens
aggcctcatctcctttat

SEQ ID NO: 5214103 - DNA, 17 bp, Homo sapiens
aggcctcatgcctgctg

SEQ ID NO: 5214104 - DNA, 20 bp, Homo sapiens
aggcctcatgcctgctgaga

SEQ ID NO: 5214105 - DNA, 14 bp, Homo sapiens
aggcctcatttctt

SEQ ID NO: 5214106 - DNA, 15 bp, Homo sapiens
aggcctcatttcttt

SEQ ID NO: 5214107 - DNA, 18 bp, Homo sapiens
aggcctccaacgcccctg

SEQ ID NO: 5214108 - DNA, 21 bp, Homo sapiens
aggcctccaacgcccctgtgg

SEQ ID NO: 5214109 - DNA, 14 bp, Homo sapiens
aggcctccactcct

SEQ ID NO: 5214110 - DNA, 12 bp, Homo sapiens
aggcctccagaa

SEQ ID NO: 5214111 - DNA, 15 bp, Homo sapiens
aggcctccagcccca

SEQ ID NO: 5214112 - DNA, 13 bp, Homo sapiens
aggcctccagcct

SEQ ID NO: 5214113 - DNA, 14 bp, Homo sapiens
aggcctccagcctc

SEQ ID NO: 5214114 - DNA, 15 bp, Homo sapiens
aggcctccagcctct

SEQ ID NO: 5214115 - DNA, 21 bp, Homo sapiens
aggcctccagcctctcccggc

SEQ ID NO: 5214116 - DNA, 18 bp, Homo sapiens
aggcctccagctcagcag

SEQ ID NO: 5214117 - DNA, 17 bp, Homo sapiens
aggcctccatctcatgt

SEQ ID NO: 5214118 - DNA, 18 bp, Homo sapiens
aggcctccatcttctcat

SEQ ID NO: 5214119 - DNA, 15 bp, Homo sapiens
aggcctcccaagctg

SEQ ID NO: 5214120 - DNA, 15 bp, Homo sapiens
aggcctcccacagtg

SEQ ID NO: 5214121 - DNA, 12 bp, Homo sapiens
aggcctccccaa

SEQ ID NO: 5214122 - DNA, 20 bp, Homo sapiens
aggcctcccccagccaggac

SEQ ID NO: 5214123 - DNA, 13 bp, Homo sapiens
aggcctcccctga

SEQ ID NO: 5214124 - DNA, 23 bp, Homo sapiens
aggcctcccgcatgctgcctgcc

SEQ ID NO: 5214125 - DNA, 22 bp, Homo sapiens
aggcctccctagcacctccccc

SEQ ID NO: 5214126 - DNA, 15 bp, Homo sapiens
aggcctccctagcca

SEQ ID NO: 5214127 - DNA, 13 bp, Homo sapiens
aggcctccctcaa

SEQ ID NO: 5214128 - DNA, 19 bp, Homo sapiens
aggcctccctcgggctggt

SEQ ID NO: 5214129 - DNA, 21 bp, Homo sapiens
aggcctccctcgggctggtgt

SEQ ID NO: 5214130 - DNA, 15 bp, Homo sapiens
aggcctccctgcaga

SEQ ID NO: 5214131 - DNA, 22 bp, Homo sapiens
aggcctcccttgagtaggccct

SEQ ID NO: 5214132 - DNA, 20 bp, Homo sapiens
aggcctccctttggggagag

SEQ ID NO: 5214133 - DNA, 16 bp, Homo sapiens
aggcctccgtcttccc

SEQ ID NO: 5214134 - DNA, 15 bp, Homo sapiens
aggcctccgttgtct

SEQ ID NO: 5214135 - DNA, 19 bp, Homo sapiens
aggcctcctaggggaaggg

SEQ ID NO: 5214136 - DNA, 20 bp, Homo sapiens
aggcctcctaggggaagggg

SEQ ID NO: 5214137 - DNA, 21 bp, Homo sapiens
aggcctcctgtggcctgccag

SEQ ID NO: 5214138 - DNA, 23 bp, Homo sapiens
aggcctcctgtggcctgccagtc

SEQ ID NO: 5214139 - DNA, 16 bp, Homo sapiens
aggcctcgagcagaga

SEQ ID NO: 5214140 - DNA, 17 bp, Homo sapiens
aggcctcgagcagagag

SEQ ID NO: 5214141 - DNA, 22 bp, Homo sapiens
aggcctcgcacttgcagaggag

SEQ ID NO: 5214142 - DNA, 17 bp, Homo sapiens
aggcctcgcaggaagac

SEQ ID NO: 5214143 - DNA, 13 bp, Homo sapiens
aggcctcgcctgc

SEQ ID NO: 5214144 - DNA, 15 bp, Homo sapiens
aggcctcgcctgccc

SEQ ID NO: 5214145 - DNA, 23 bp, Homo sapiens
aggcctcggcagaactctctgtc

SEQ ID NO: 5214146 - DNA, 21 bp, Homo sapiens
aggcctcggctgtctcctgtc

SEQ ID NO: 5214147 - DNA, 20 bp, Homo sapiens
aggcctcgtaccagccagga

SEQ ID NO: 5214148 - DNA, 13 bp, Homo sapiens
aggcctctctctg

SEQ ID NO: 5214149 - DNA, 14 bp, Homo sapiens
aggcctctctctgc

SEQ ID NO: 5214150 - DNA, 16 bp, Homo sapiens
aggcctctctgcctgg

SEQ ID NO: 5214151 - DNA, 11 bp, Homo sapiens
aggcctctctt

SEQ ID NO: 5214152 - DNA, 19 bp, Homo sapiens
aggcctctgaggagcccac

SEQ ID NO: 5214153 - DNA, 20 bp, Homo sapiens
aggcctctgaggagcccacg

SEQ ID NO: 5214154 - DNA, 13 bp, Homo sapiens
aggcctctgcaga

SEQ ID NO: 5214155 - DNA, 11 bp, Homo sapiens
aggcctctgcc

SEQ ID NO: 5214156 - DNA, 23 bp, Homo sapiens
aggcctctgggacccacagaact

SEQ ID NO: 5214157 - DNA, 11 bp, Homo sapiens
aggcctctggt

SEQ ID NO: 5214158 - DNA, 12 bp, Homo sapiens
aggcctctggtt

SEQ ID NO: 5214159 - DNA, 21 bp, Homo sapiens
aggcctctggttgcctccccc

SEQ ID NO: 5214160 - DNA, 15 bp, Homo sapiens
aggcctctgtgccgc

SEQ ID NO: 5214161 - DNA, 23 bp, Homo sapiens
aggcctctgtgctgtcctgccct

SEQ ID NO: 5214162 - DNA, 13 bp, Homo sapiens
aggcctctgtgtc

SEQ ID NO: 5214163 - DNA, 22 bp, Homo sapiens
aggcctctgtgtccttccctgc

SEQ ID NO: 5214164 - DNA, 14 bp, Homo sapiens
aggcctcttcctgt

SEQ ID NO: 5214165 - DNA, 22 bp, Homo sapiens
aggcctcttcctgttgtgactg

SEQ ID NO: 5214166 - DNA, 22 bp, Homo sapiens
aggcctcttgctggtgcacatg

SEQ ID NO: 5214167 - DNA, 22 bp, Homo sapiens
aggcctcttggacctctgctct

SEQ ID NO: 5214168 - DNA, 21 bp, Homo sapiens
aggcctcttgtgctcacgctc

SEQ ID NO: 5214169 - DNA, 21 bp, Homo sapiens
aggcctgaaagaggctgaggc

SEQ ID NO: 5214170 - DNA, 17 bp, Homo sapiens
aggcctgaaatcctggt

SEQ ID NO: 5214171 - DNA, 19 bp, Homo sapiens
aggcctgaaatgacatttc

SEQ ID NO: 5214172 - DNA, 21 bp, Homo sapiens
aggcctgaaatgacatttcac

SEQ ID NO: 5214173 - DNA, 18 bp, Homo sapiens
aggcctgaaatgtttcca

SEQ ID NO: 5214174 - DNA, 19 bp, Homo sapiens
aggcctgaaatgtttccag

SEQ ID NO: 5214175 - DNA, 12 bp, Homo sapiens
aggcctgaacta

SEQ ID NO: 5214176 - DNA, 20 bp, Homo sapiens
aggcctgaactaggtgctgg

SEQ ID NO: 5214177 - DNA, 21 bp, Homo sapiens
aggcctgaagccagctgccct

SEQ ID NO: 5214178 - DNA, 14 bp, Homo sapiens
aggcctgaagtctt

SEQ ID NO: 5214179 - DNA, 19 bp, Homo sapiens
aggcctgaatcatgagcct

SEQ ID NO: 5214180 - DNA, 22 bp, Homo sapiens
aggcctgaatcatgagcctgct

SEQ ID NO: 5214181 - DNA, 23 bp, Homo sapiens
aggcctgaatccaaaagaaaaac

SEQ ID NO: 5214182 - DNA, 17 bp, Homo sapiens
aggcctgacacaggcca

SEQ ID NO: 5214183 - DNA, 13 bp, Homo sapiens
aggcctgaccagg

SEQ ID NO: 5214184 - DNA, 15 bp, Homo sapiens
aggcctgacctcaag

SEQ ID NO: 5214185 - DNA, 21 bp, Homo sapiens
aggcctgacctcaagcaacca

SEQ ID NO: 5214186 - DNA, 18 bp, Homo sapiens
aggcctgactactgccca

SEQ ID NO: 5214187 - DNA, 22 bp, Homo sapiens
aggcctgactgccaagccatgg

SEQ ID NO: 5214188 - DNA, 21 bp, Homo sapiens
aggcctgacttctgctggcat

SEQ ID NO: 5214189 - DNA, 13 bp, Homo sapiens
aggcctgacttgg

SEQ ID NO: 5214190 - DNA, 16 bp, Homo sapiens
aggcctgagacccagg

SEQ ID NO: 5214191 - DNA, 16 bp, Homo sapiens
aggcctgagatttcat

SEQ ID NO: 5214192 - DNA, 17 bp, Homo sapiens
aggcctgagatttcatc

SEQ ID NO: 5214193 - DNA, 14 bp, Homo sapiens
aggcctgagcccct

SEQ ID NO: 5214194 - DNA, 21 bp, Homo sapiens
aggcctgagcgctcctgccgc

SEQ ID NO: 5214195 - DNA, 18 bp, Homo sapiens
aggcctgagctgcttcac

SEQ ID NO: 5214196 - DNA, 24 bp, Homo sapiens
aggcctgagctgcttcactaggga

SEQ ID NO: 5214197 - DNA, 18 bp, Homo sapiens
aggcctgaggatgagctg

SEQ ID NO: 5214198 - DNA, 13 bp, Homo sapiens
aggcctgaggcct

SEQ ID NO: 5214199 - DNA, 17 bp, Homo sapiens
aggcctgagggaagccc

SEQ ID NO: 5214200 - DNA, 20 bp, Homo sapiens
aggcctgagggaagcccacc

SEQ ID NO: 5214201 - DNA, 21 bp, Homo sapiens
aggcctgagggaagcccaccc

SEQ ID NO: 5214202 - DNA, 20 bp, Homo sapiens
aggcctgagttagctgttta

SEQ ID NO: 5214203 - DNA, 16 bp, Homo sapiens
aggcctgatctgccca

SEQ ID NO: 5214204 - DNA, 16 bp, Homo sapiens
aggcctgatgctgccc

SEQ ID NO: 5214205 - DNA, 19 bp, Homo sapiens
aggcctgattcactggcct

SEQ ID NO: 5214206 - DNA, 20 bp, Homo sapiens
aggcctgattcactggcctg

SEQ ID NO: 5214207 - DNA, 23 bp, Homo sapiens
aggcctgattcactggcctggcg

SEQ ID NO: 5214208 - DNA, 20 bp, Homo sapiens
aggcctgcaaaccttcctgg

SEQ ID NO: 5214209 - DNA, 12 bp, Homo sapiens
aggcctgcacac

SEQ ID NO: 5214210 - DNA, 18 bp, Homo sapiens
aggcctgcagacagacct

SEQ ID NO: 5214211 - DNA, 14 bp, Homo sapiens
aggcctgcagggcc

SEQ ID NO: 5214212 - DNA, 15 bp, Homo sapiens
aggcctgcagggcct

SEQ ID NO: 5214213 - DNA, 18 bp, Homo sapiens
aggcctgcagggcctctg

SEQ ID NO: 5214214 - DNA, 22 bp, Homo sapiens
aggcctgccccccttcccaccc

SEQ ID NO: 5214215 - DNA, 23 bp, Homo sapiens
aggcctgccccccttcccacccc

SEQ ID NO: 5214216 - DNA, 19 bp, Homo sapiens
aggcctgccctcccatgtt

SEQ ID NO: 5214217 - DNA, 17 bp, Homo sapiens
aggcctgccgctttgat

SEQ ID NO: 5214218 - DNA, 20 bp, Homo sapiens
aggcctgccgctttgatgga

SEQ ID NO: 5214219 - DNA, 22 bp, Homo sapiens
aggcctgcctcccacttcactg

SEQ ID NO: 5214220 - DNA, 18 bp, Homo sapiens
aggcctgccttctcaggg

SEQ ID NO: 5214221 - DNA, 20 bp, Homo sapiens
aggcctgcgaccctgggggc

SEQ ID NO: 5214222 - DNA, 21 bp, Homo sapiens
aggcctgcgaccctgggggca

SEQ ID NO: 5214223 - DNA, 21 bp, Homo sapiens
aggcctgcgggcccctggtga

SEQ ID NO: 5214224 - DNA, 18 bp, Homo sapiens
aggcctgcgtgcgctggt

SEQ ID NO: 5214225 - DNA, 16 bp, Homo sapiens
aggcctgctagtcact

SEQ ID NO: 5214226 - DNA, 18 bp, Homo sapiens
aggcctgctcagggactg

SEQ ID NO: 5214227 - DNA, 12 bp, Homo sapiens
aggcctgctccc

SEQ ID NO: 5214228 - DNA, 22 bp, Homo sapiens
aggcctgctgccagtgcagcca

SEQ ID NO: 5214229 - DNA, 12 bp, Homo sapiens
aggcctgctggc

SEQ ID NO: 5214230 - DNA, 12 bp, Homo sapiens
aggcctgcttcc

SEQ ID NO: 5214231 - DNA, 17 bp, Homo sapiens
aggcctgcttccccctc

SEQ ID NO: 5214232 - DNA, 18 bp, Homo sapiens
aggcctgcttccccctcc

SEQ ID NO: 5214233 - DNA, 19 bp, Homo sapiens
aggcctgcttccccctccc

SEQ ID NO: 5214234 - DNA, 23 bp, Homo sapiens
aggcctgcttgactttccagaat

SEQ ID NO: 5214235 - DNA, 19 bp, Homo sapiens
aggcctgctttgtctcctc

SEQ ID NO: 5214236 - DNA, 20 bp, Homo sapiens
aggcctgctttgtctcctct

SEQ ID NO: 5214237 - DNA, 20 bp, Homo sapiens
aggcctgcttttgtgtccca

SEQ ID NO: 5214238 - DNA, 22 bp, Homo sapiens
aggcctggaagagctgagacct

SEQ ID NO: 5214239 - DNA, 20 bp, Homo sapiens
aggcctggaccgagatgtga

SEQ ID NO: 5214240 - DNA, 22 bp, Homo sapiens
aggcctggaccgagatgtgagt

SEQ ID NO: 5214241 - DNA, 13 bp, Homo sapiens
aggcctggagttg

SEQ ID NO: 5214242 - DNA, 19 bp, Homo sapiens
aggcctggagttgggctgg

SEQ ID NO: 5214243 - DNA, 15 bp, Homo sapiens
aggcctggcacagtg

SEQ ID NO: 5214244 - DNA, 17 bp, Homo sapiens
aggcctggcatcttctg

SEQ ID NO: 5214245 - DNA, 20 bp, Homo sapiens
aggcctggcatcttctggag

SEQ ID NO: 5214246 - DNA, 12 bp, Homo sapiens
aggcctggccca

SEQ ID NO: 5214247 - DNA, 15 bp, Homo sapiens
aggcctggcccagcc

SEQ ID NO: 5214248 - DNA, 16 bp, Homo sapiens
aggcctggcccagcca

SEQ ID NO: 5214249 - DNA, 18 bp, Homo sapiens
aggcctggcccagccagc

SEQ ID NO: 5214250 - DNA, 20 bp, Homo sapiens
aggcctggcccagccagcag

SEQ ID NO: 5214251 - DNA, 12 bp, Homo sapiens
aggcctggccct

SEQ ID NO: 5214252 - DNA, 21 bp, Homo sapiens
agggttagacaagcctggagg

SEQ ID NO: 5214253 - DNA, 22 bp, Homo sapiens
agggttagacaagcctggagga

SEQ ID NO: 5214254 - DNA, 16 bp, Homo sapiens
agggttagcctgcacc

SEQ ID NO: 5214255 - DNA, 21 bp, Homo sapiens
agggttaggaatcctagcact

SEQ ID NO: 5214256 - DNA, 18 bp, Homo sapiens
agggttaggaatctcttc

SEQ ID NO: 5214257 - DNA, 19 bp, Homo sapiens
agggttaggaatctcttca

SEQ ID NO: 5214258 - DNA, 16 bp, Homo sapiens
agggttcagagactca

SEQ ID NO: 5214259 - DNA, 19 bp, Homo sapiens
agggttcatcatccctccc

SEQ ID NO: 5214260 - DNA, 13 bp, Homo sapiens
agggttcatctgt

SEQ ID NO: 5214261 - DNA, 12 bp, Homo sapiens
agggttccagac

SEQ ID NO: 5214262 - DNA, 15 bp, Homo sapiens
agggttcccccagcc

SEQ ID NO: 5214263 - DNA, 18 bp, Homo sapiens
agggttcccccagccctg

SEQ ID NO: 5214264 - DNA, 13 bp, Homo sapiens
agggttcccctgg

SEQ ID NO: 5214265 - DNA, 15 bp, Homo sapiens
agggttcccctggcc

SEQ ID NO: 5214266 - DNA, 18 bp, Homo sapiens
agggttcctcttaggtca

SEQ ID NO: 5214267 - DNA, 21 bp, Homo sapiens
agggttcctgtagacctaggg

SEQ ID NO: 5214268 - DNA, 22 bp, Homo sapiens
agggttctaaatgcaataagat

SEQ ID NO: 5214269 - DNA, 13 bp, Homo sapiens
agggttctagaag

SEQ ID NO: 5214270 - DNA, 22 bp, Homo sapiens
agggttctagaaggggcgaggc

SEQ ID NO: 5214271 - DNA, 18 bp, Homo sapiens
agggttctatatttactg

SEQ ID NO: 5214272 - DNA, 14 bp, Homo sapiens
agggttctgccctg

SEQ ID NO: 5214273 - DNA, 18 bp, Homo sapiens
agggttctgccctgcctg

SEQ ID NO: 5214274 - DNA, 20 bp, Homo sapiens
agggttctgcctctccaggc

SEQ ID NO: 5214275 - DNA, 18 bp, Homo sapiens
agggttctgcttttaagt

SEQ ID NO: 5214276 - DNA, 14 bp, Homo sapiens
agggttctggctgc

SEQ ID NO: 5214277 - DNA, 21 bp, Homo sapiens
agggttctggtgtttggtttc

SEQ ID NO: 5214278 - DNA, 21 bp, Homo sapiens
agggttgaagacggaaaacaa

SEQ ID NO: 5214279 - DNA, 21 bp, Homo sapiens
agggttgaaggcagtctgaac

SEQ ID NO: 5214280 - DNA, 16 bp, Homo sapiens
agggttgaccccagag

SEQ ID NO: 5214281 - DNA, 17 bp, Homo sapiens
agggttgaccccagagg

SEQ ID NO: 5214282 - DNA, 18 bp, Homo sapiens
agggttgatatattcttt

SEQ ID NO: 5214283 - DNA, 15 bp, Homo sapiens
agggttgattaaggc

SEQ ID NO: 5214284 - DNA, 23 bp, Homo sapiens
agggttgctggtcctgcacatga

SEQ ID NO: 5214285 - DNA, 14 bp, Homo sapiens
agggttggagaagg

SEQ ID NO: 5214286 - DNA, 12 bp, Homo sapiens
agggttggcacc

SEQ ID NO: 5214287 - DNA, 17 bp, Homo sapiens
agggttggcccctgccc

SEQ ID NO: 5214288 - DNA, 23 bp, Homo sapiens
agggttggcccctgcccggctgc

SEQ ID NO: 5214289 - DNA, 18 bp, Homo sapiens
agggttggcctgagttag

SEQ ID NO: 5214290 - DNA, 22 bp, Homo sapiens
agggttggtgggctggcccagc

SEQ ID NO: 5214291 - DNA, 19 bp, Homo sapiens
agggttgtgattttgtctg

SEQ ID NO: 5214292 - DNA, 21 bp, Homo sapiens
agggttgttctgggagtcctg

SEQ ID NO: 5214293 - DNA, 22 bp, Homo sapiens
agggtttaatccccagtaaaat

SEQ ID NO: 5214294 - DNA, 18 bp, Homo sapiens
agggtttacccagtggga

SEQ ID NO: 5214295 - DNA, 20 bp, Homo sapiens
agggtttatgtttaggatgt

SEQ ID NO: 5214296 - DNA, 15 bp, Homo sapiens
agggtttcaccatgt

SEQ ID NO: 5214297 - DNA, 22 bp, Homo sapiens
agggtttccctactgaagccct

SEQ ID NO: 5214298 - DNA, 19 bp, Homo sapiens
agggtttcgactggtccag

SEQ ID NO: 5214299 - DNA, 17 bp, Homo sapiens
agggtttcgagaagctg

SEQ ID NO: 5214300 - DNA, 12 bp, Homo sapiens
agggtttctctc

SEQ ID NO: 5214301 - DNA, 17 bp, Homo sapiens
agggtttcttaaatata

SEQ ID NO: 5214302 - DNA, 23 bp, Homo sapiens
agggtttgaattgttttctttaa

SEQ ID NO: 5214303 - DNA, 17 bp, Homo sapiens
agggtttgacatttcat

SEQ ID NO: 5214304 - DNA, 13 bp, Homo sapiens
agggtttgagcac

SEQ ID NO: 5214305 - DNA, 14 bp, Homo sapiens
agggtttggaccac

SEQ ID NO: 5214306 - DNA, 15 bp, Homo sapiens
agggtttgggcagag

SEQ ID NO: 5214307 - DNA, 16 bp, Homo sapiens
agggtttgggcagagc

SEQ ID NO: 5214308 - DNA, 19 bp, Homo sapiens
agggtttgtaatggtgctt

SEQ ID NO: 5214309 - DNA, 15 bp, Homo sapiens
agggtttgtgacagg

SEQ ID NO: 5214310 - DNA, 21 bp, Homo sapiens
agggtttgtttgctgcttttg

SEQ ID NO: 5214311 - DNA, 14 bp, Homo sapiens
agggttttccaatg

SEQ ID NO: 5214312 - DNA, 18 bp, Homo sapiens
agggttttccaccctgga

SEQ ID NO: 5214313 - DNA, 15 bp, Homo sapiens
agggttttcttttct

SEQ ID NO: 5214314 - DNA, 16 bp, Homo sapiens
agggttttcttttctt

SEQ ID NO: 5214315 - DNA, 20 bp, Homo sapiens
agggttttcttttttaaatg

SEQ ID NO: 5214316 - DNA, 17 bp, Homo sapiens
agggttttgcaataact

SEQ ID NO: 5214317 - DNA, 14 bp, Homo sapiens
agggttttggcctg

SEQ ID NO: 5214318 - DNA, 16 bp, Homo sapiens
agggttttggcctgcc

SEQ ID NO: 5214319 - DNA, 19 bp, Homo sapiens
agggttttggggtcctggg

SEQ ID NO: 5214320 - DNA, 13 bp, Homo sapiens
agggttttgtatt

SEQ ID NO: 5214321 - DNA, 21 bp, Homo sapiens
agggttttttcttctttcttt

SEQ ID NO: 5214322 - DNA, 20 bp, Homo sapiens
agggttttttttttttcctt

SEQ ID NO: 5214323 - DNA, 16 bp, Homo sapiens
aggtaaaaaaaagaag

SEQ ID NO: 5214324 - DNA, 16 bp, Homo sapiens
aggtaaaaacccagcg

SEQ ID NO: 5214325 - DNA, 12 bp, Homo sapiens
aggtaaaaagtt

SEQ ID NO: 5214326 - DNA, 22 bp, Homo sapiens
aggtaaaacaaaacaaaacaac

SEQ ID NO: 5214327 - DNA, 22 bp, Homo sapiens
aggtaaaagagccaagttcaaa

SEQ ID NO: 5214328 - DNA, 17 bp, Homo sapiens
aggtaaaagtgtgagca

SEQ ID NO: 5214329 - DNA, 13 bp, Homo sapiens
aggtaaaatcact

SEQ ID NO: 5214330 - DNA, 18 bp, Homo sapiens
aggtaaaatcacttcaga

SEQ ID NO: 5214331 - DNA, 20 bp, Homo sapiens
aggtaaaatcacttcagatc

SEQ ID NO: 5214332 - DNA, 13 bp, Homo sapiens
aggtaaaattcta

SEQ ID NO: 5214333 - DNA, 13 bp, Homo sapiens
aggtaaacagttc

SEQ ID NO: 5214334 - DNA, 14 bp, Homo sapiens
aggtaaactcctgt

SEQ ID NO: 5214335 - DNA, 15 bp, Homo sapiens
aggtaaactcctgtc

SEQ ID NO: 5214336 - DNA, 16 bp, Homo sapiens
aggtaaactgatgctt

SEQ ID NO: 5214337 - DNA, 18 bp, Homo sapiens
aggtaaagggacactgga

SEQ ID NO: 5214338 - DNA, 18 bp, Homo sapiens
aggtaaagggcaaataat

SEQ ID NO: 5214339 - DNA, 19 bp, Homo sapiens
aggtaaagggcaaataatg

SEQ ID NO: 5214340 - DNA, 16 bp, Homo sapiens
aggtaaataatcatac

SEQ ID NO: 5214341 - DNA, 14 bp, Homo sapiens
aggtaaatacaagt

SEQ ID NO: 5214342 - DNA, 16 bp, Homo sapiens
aggtaaatacaagtga

SEQ ID NO: 5214343 - DNA, 21 bp, Homo sapiens
aggtaaatagagtgcataaat

SEQ ID NO: 5214344 - DNA, 16 bp, Homo sapiens
aggtaaatcttagtga

SEQ ID NO: 5214345 - DNA, 19 bp, Homo sapiens
aggtaaatggttaaatttt

SEQ ID NO: 5214346 - DNA, 21 bp, Homo sapiens
aggtaaatggttaaattttac

SEQ ID NO: 5214347 - DNA, 14 bp, Homo sapiens
aggtaacactacag

SEQ ID NO: 5214348 - DNA, 16 bp, Homo sapiens
aggtaacaggtgtgta

SEQ ID NO: 5214349 - DNA, 20 bp, Homo sapiens
aggtaacatttatagaagaa

SEQ ID NO: 5214350 - DNA, 21 bp, Homo sapiens
aggtaacatttatagaagaaa

SEQ ID NO: 5214351 - DNA, 22 bp, Homo sapiens
aggtaacgtgattgattcagta

SEQ ID NO: 5214352 - DNA, 23 bp, Homo sapiens
aggtaacgtgattgattcagtat

SEQ ID NO: 5214353 - DNA, 19 bp, Homo sapiens
aggtaactaactgcttcat

SEQ ID NO: 5214354 - DNA, 20 bp, Homo sapiens
aggtaactactgctaatgtt

SEQ ID NO: 5214355 - DNA, 13 bp, Homo sapiens
aggtaactaggta

SEQ ID NO: 5214356 - DNA, 17 bp, Homo sapiens
aggtaactatcaatatt

SEQ ID NO: 5214357 - DNA, 22 bp, Homo sapiens
aggtaactggctttcctgctgg

SEQ ID NO: 5214358 - DNA, 19 bp, Homo sapiens
aggtaacttctcccttctc

SEQ ID NO: 5214359 - DNA, 23 bp, Homo sapiens
aggtaagaagtaataatgagtaa

SEQ ID NO: 5214360 - DNA, 16 bp, Homo sapiens
aggtaagatgttaatc

SEQ ID NO: 5214361 - DNA, 17 bp, Homo sapiens
aggtaagctcaggatat

SEQ ID NO: 5214362 - DNA, 15 bp, Homo sapiens
aggtaagctgtgcct

SEQ ID NO: 5214363 - DNA, 18 bp, Homo sapiens
aggtaaggaaaaggattt

SEQ ID NO: 5214364 - DNA, 16 bp, Homo sapiens
aggtaagggccgccgg

SEQ ID NO: 5214365 - DNA, 19 bp, Homo sapiens
aggtaagggtgacaaatgg

SEQ ID NO: 5214366 - DNA, 13 bp, Homo sapiens
aggtaagtggcag

SEQ ID NO: 5214367 - DNA, 14 bp, Homo sapiens
aggtaataaaactc

SEQ ID NO: 5214368 - DNA, 15 bp, Homo sapiens
aggtaataaatacac

SEQ ID NO: 5214369 - DNA, 20 bp, Homo sapiens
aggtaataggaagaacagta

SEQ ID NO: 5214370 - DNA, 17 bp, Homo sapiens
aggtaatcgacctgcct

SEQ ID NO: 5214371 - DNA, 17 bp, Homo sapiens
aggtaatgagggactgg

SEQ ID NO: 5214372 - DNA, 13 bp, Homo sapiens
aggtaatgcacat

SEQ ID NO: 5214373 - DNA, 22 bp, Homo sapiens
aggtaatgcacatcctcattca

SEQ ID NO: 5214374 - DNA, 14 bp, Homo sapiens
aggtaatggatatg

SEQ ID NO: 5214375 - DNA, 22 bp, Homo sapiens
aggtaatggatatgaaagagaa

SEQ ID NO: 5214376 - DNA, 16 bp, Homo sapiens
aggtaatgtgaataaa

SEQ ID NO: 5214377 - DNA, 19 bp, Homo sapiens
aggtaatgttttgtatata

SEQ ID NO: 5214378 - DNA, 21 bp, Homo sapiens
aggtaatgttttgtatataca

SEQ ID NO: 5214379 - DNA, 21 bp, Homo sapiens
aggtaattgttttttaaagca

SEQ ID NO: 5214380 - DNA, 16 bp, Homo sapiens
aggtaatttcttgtgc

SEQ ID NO: 5214381 - DNA, 16 bp, Homo sapiens
aggtaattttttgtct

SEQ ID NO: 5214382 - DNA, 17 bp, Homo sapiens
aggtaatttttttcacc

SEQ ID NO: 5214383 - DNA, 15 bp, Homo sapiens
aggtacaaaagttac

SEQ ID NO: 5214384 - DNA, 15 bp, Homo sapiens
aggtacaaaatcttg

SEQ ID NO: 5214385 - DNA, 23 bp, Homo sapiens
aggtacaaataatttagaaataa

SEQ ID NO: 5214386 - DNA, 17 bp, Homo sapiens
aggtacaacctgttctg

SEQ ID NO: 5214387 - DNA, 13 bp, Homo sapiens
aggtacacctccc

SEQ ID NO: 5214388 - DNA, 16 bp, Homo sapiens
aggtacactgtttcca

SEQ ID NO: 5214389 - DNA, 14 bp, Homo sapiens
aggtacacttgtga

SEQ ID NO: 5214390 - DNA, 17 bp, Homo sapiens
aggtacacttgtgaata

SEQ ID NO: 5214391 - DNA, 14 bp, Homo sapiens
aggtacagaaaaca

SEQ ID NO: 5214392 - DNA, 18 bp, Homo sapiens
aggtacagcgggctgtgc

SEQ ID NO: 5214393 - DNA, 21 bp, Homo sapiens
aggtacagcgggctgtgcccg

SEQ ID NO: 5214394 - DNA, 22 bp, Homo sapiens
aggtacaggagaggcagcatgc

SEQ ID NO: 5214395 - DNA, 22 bp, Homo sapiens
aggtaccaaacaaggaagccaa

SEQ ID NO: 5214396 - DNA, 20 bp, Homo sapiens
aggtaccacccttcagaccc

SEQ ID NO: 5214397 - DNA, 20 bp, Homo sapiens
aggtacccaatagctgccca

SEQ ID NO: 5214398 - DNA, 14 bp, Homo sapiens
aggtaccctgggtg

SEQ ID NO: 5214399 - DNA, 20 bp, Homo sapiens
aggtaccctgggtgtccccg

SEQ ID NO: 5214400 - DNA, 19 bp, Homo sapiens
aggtacctttcacatagag

SEQ ID NO: 5214401 - DNA, 19 bp, Homo sapiens
aggtacctttccacccaga

SEQ ID NO: 5214402 - DNA, 20 bp, Homo sapiens
aggtacctttccacccagac

SEQ ID NO: 5214403 - DNA, 21 bp, Homo sapiens
aggtacctttccacccagacc

SEQ ID NO: 5214404 - DNA, 19 bp, Homo sapiens
aggtacgattatacttgag

SEQ ID NO: 5214405 - DNA, 13 bp, Homo sapiens
aggtacgcacaga

SEQ ID NO: 5214406 - DNA, 15 bp, Homo sapiens
aggtacgcacagaca

SEQ ID NO: 5214407 - DNA, 15 bp, Homo sapiens
aggtacggagaagaa

SEQ ID NO: 5214408 - DNA, 19 bp, Homo sapiens
aggtactacctatgtactt

SEQ ID NO: 5214409 - DNA, 17 bp, Homo sapiens
aggtactatctgtgaag

SEQ ID NO: 5214410 - DNA, 22 bp, Homo sapiens
aggtactcctgccagggaactg

SEQ ID NO: 5214411 - DNA, 21 bp, Homo sapiens
aggtactgcattctctcccat

SEQ ID NO: 5214412 - DNA, 18 bp, Homo sapiens
aggtactggtgagggcaa

SEQ ID NO: 5214413 - DNA, 19 bp, Homo sapiens
aggtactggtgagggcaag

SEQ ID NO: 5214414 - DNA, 19 bp, Homo sapiens
aggtactgtatgatcaaat

SEQ ID NO: 5214415 - DNA, 22 bp, Homo sapiens
aggtactgtatgatcaaatgtt

SEQ ID NO: 5214416 - DNA, 13 bp, Homo sapiens
aggtacttcctcc

SEQ ID NO: 5214417 - DNA, 17 bp, Homo sapiens
aggtacttggagggctc

SEQ ID NO: 5214418 - DNA, 17 bp, Homo sapiens
aggtacttttggaatct

SEQ ID NO: 5214419 - DNA, 13 bp, Homo sapiens
aggtagaaaaagg

SEQ ID NO: 5214420 - DNA, 18 bp, Homo sapiens
aggtagaaaaagggtcaa

SEQ ID NO: 5214421 - DNA, 15 bp, Homo sapiens
aggtagaacgccagg

SEQ ID NO: 5214422 - DNA, 14 bp, Homo sapiens
aggtagaaggcaca

SEQ ID NO: 5214423 - DNA, 14 bp, Homo sapiens
aggtagaatgtaaa

SEQ ID NO: 5214424 - DNA, 19 bp, Homo sapiens
aggtagaatgtaaagcttg

SEQ ID NO: 5214425 - DNA, 22 bp, Homo sapiens
aggtagaattatctaatttata

SEQ ID NO: 5214426 - DNA, 20 bp, Homo sapiens
aggtagaccaggatttctaa

SEQ ID NO: 5214427 - DNA, 20 bp, Homo sapiens
aggtagacttttatgagaac

SEQ ID NO: 5214428 - DNA, 12 bp, Homo sapiens
aggtagaggaaa

SEQ ID NO: 5214429 - DNA, 16 bp, Homo sapiens
aggtagaggaaaatca

SEQ ID NO: 5214430 - DNA, 22 bp, Homo sapiens
aggcctggccctttcacccctc

SEQ ID NO: 5214431 - DNA, 16 bp, Homo sapiens
aggcctggccgcagtc

SEQ ID NO: 5214432 - DNA, 12 bp, Homo sapiens
aggcctggcctc

SEQ ID NO: 5214433 - DNA, 13 bp, Homo sapiens
aggcctggcctca

SEQ ID NO: 5214434 - DNA, 22 bp, Homo sapiens
aggcctggcctcggggcagggc

SEQ ID NO: 5214435 - DNA, 23 bp, Homo sapiens
aggcctggcctcggggcagggca

SEQ ID NO: 5214436 - DNA, 16 bp, Homo sapiens
aggcctggcctctggg

SEQ ID NO: 5214437 - DNA, 21 bp, Homo sapiens
aggcctggcctctgggcagtg

SEQ ID NO: 5214438 - DNA, 12 bp, Homo sapiens
aggcctggcctt

SEQ ID NO: 5214439 - DNA, 23 bp, Homo sapiens
aggcctggcgtcggccagagggg

SEQ ID NO: 5214440 - DNA, 18 bp, Homo sapiens
aggcctggctccccgagg

SEQ ID NO: 5214441 - DNA, 16 bp, Homo sapiens
aggcctggctctggag

SEQ ID NO: 5214442 - DNA, 18 bp, Homo sapiens
aggcctggctctggagcc

SEQ ID NO: 5214443 - DNA, 22 bp, Homo sapiens
aggcctggctggaggagcagca

SEQ ID NO: 5214444 - DNA, 15 bp, Homo sapiens
aggcctgggacccag

SEQ ID NO: 5214445 - DNA, 23 bp, Homo sapiens
aggcctgggacccagctactctg

SEQ ID NO: 5214446 - DNA, 16 bp, Homo sapiens
aggcctgggatgcagt

SEQ ID NO: 5214447 - DNA, 16 bp, Homo sapiens
aggcctgggcaggacc

SEQ ID NO: 5214448 - DNA, 19 bp, Homo sapiens
aggcctgggcaggaccctg

SEQ ID NO: 5214449 - DNA, 22 bp, Homo sapiens
aggcctgggcaggaccctgctg

SEQ ID NO: 5214450 - DNA, 13 bp, Homo sapiens
aggcctgggcagt

SEQ ID NO: 5214451 - DNA, 14 bp, Homo sapiens
aggcctgggcagtg

SEQ ID NO: 5214452 - DNA, 12 bp, Homo sapiens
aggcctgggccg

SEQ ID NO: 5214453 - DNA, 19 bp, Homo sapiens
aggcctgggccgctgccac

SEQ ID NO: 5214454 - DNA, 21 bp, Homo sapiens
aggcctggggccggtagaggc

SEQ ID NO: 5214455 - DNA, 22 bp, Homo sapiens
aggcctgggggacccctggctc

SEQ ID NO: 5214456 - DNA, 20 bp, Homo sapiens
aggcctgggggctgggcaga

SEQ ID NO: 5214457 - DNA, 15 bp, Homo sapiens
aggcctggggtggga

SEQ ID NO: 5214458 - DNA, 21 bp, Homo sapiens
aggcctggggtgggacaggga

SEQ ID NO: 5214459 - DNA, 22 bp, Homo sapiens
aggcctgggtcacgctcaagga

SEQ ID NO: 5214460 - DNA, 16 bp, Homo sapiens
aggcctgggtgctggc

SEQ ID NO: 5214461 - DNA, 12 bp, Homo sapiens
aggcctgggtgt

SEQ ID NO: 5214462 - DNA, 18 bp, Homo sapiens
aggcctggtcagcagagc

SEQ ID NO: 5214463 - DNA, 14 bp, Homo sapiens
aggcctggtctgga

SEQ ID NO: 5214464 - DNA, 16 bp, Homo sapiens
aggcctggtctggagc

SEQ ID NO: 5214465 - DNA, 22 bp, Homo sapiens
aggcctggtctggagcccctat

SEQ ID NO: 5214466 - DNA, 23 bp, Homo sapiens
aggcctggtctggagcccctatc

SEQ ID NO: 5214467 - DNA, 20 bp, Homo sapiens
aggcctggtgccctggccca

SEQ ID NO: 5214468 - DNA, 16 bp, Homo sapiens
aggcctgtccaccctg

SEQ ID NO: 5214469 - DNA, 18 bp, Homo sapiens
aggcctgtccaccctgcc

SEQ ID NO: 5214470 - DNA, 12 bp, Homo sapiens
aggcctgtgccc

SEQ ID NO: 5214471 - DNA, 17 bp, Homo sapiens
aggcctgtgcccactcc

SEQ ID NO: 5214472 - DNA, 17 bp, Homo sapiens
aggcctgtggctccctt

SEQ ID NO: 5214473 - DNA, 17 bp, Homo sapiens
aggcctgtggggagccg

SEQ ID NO: 5214474 - DNA, 22 bp, Homo sapiens
aggcctgtgtagctgtgacctg

SEQ ID NO: 5214475 - DNA, 17 bp, Homo sapiens
aggcctgttccctgagg

SEQ ID NO: 5214476 - DNA, 18 bp, Homo sapiens
aggcctgtttggcctctc

SEQ ID NO: 5214477 - DNA, 21 bp, Homo sapiens
aggccttagtacggctgctgc

SEQ ID NO: 5214478 - DNA, 21 bp, Homo sapiens
aggccttcagggttcagcagt

SEQ ID NO: 5214479 - DNA, 14 bp, Homo sapiens
aggccttcagttta

SEQ ID NO: 5214480 - DNA, 22 bp, Homo sapiens
aggccttcatcctcctccccag

SEQ ID NO: 5214481 - DNA, 13 bp, Homo sapiens
aggccttccactg

SEQ ID NO: 5214482 - DNA, 22 bp, Homo sapiens
aggccttccagaaagcaggagc

SEQ ID NO: 5214483 - DNA, 15 bp, Homo sapiens
aggccttccagctgc

SEQ ID NO: 5214484 - DNA, 15 bp, Homo sapiens
aggccttccctggcc

SEQ ID NO: 5214485 - DNA, 19 bp, Homo sapiens
aggccttcctcctctcaaa

SEQ ID NO: 5214486 - DNA, 18 bp, Homo sapiens
aggccttctctgaaggac

SEQ ID NO: 5214487 - DNA, 17 bp, Homo sapiens
aggccttctgtggggct

SEQ ID NO: 5214488 - DNA, 20 bp, Homo sapiens
aggccttctgtggggctggg

SEQ ID NO: 5214489 - DNA, 21 bp, Homo sapiens
aggccttctgtggggctgggc

SEQ ID NO: 5214490 - DNA, 18 bp, Homo sapiens
aggccttcttgtgatctt

SEQ ID NO: 5214491 - DNA, 15 bp, Homo sapiens
aggccttgagcacaa

SEQ ID NO: 5214492 - DNA, 16 bp, Homo sapiens
aggccttgcctggcct

SEQ ID NO: 5214493 - DNA, 12 bp, Homo sapiens
aggccttgcctt

SEQ ID NO: 5214494 - DNA, 14 bp, Homo sapiens
aggccttgccttgt

SEQ ID NO: 5214495 - DNA, 15 bp, Homo sapiens
aggccttgcgctgtt

SEQ ID NO: 5214496 - DNA, 11 bp, Homo sapiens
aggccttgctc

SEQ ID NO: 5214497 - DNA, 24 bp, Homo sapiens
aggccttgctcactcactcactcc

SEQ ID NO: 5214498 - DNA, 14 bp, Homo sapiens
aggccttgctgact

SEQ ID NO: 5214499 - DNA, 22 bp, Homo sapiens
aggccttgctggggtccagggc

SEQ ID NO: 5214500 - DNA, 23 bp, Homo sapiens
aggccttggggcatgacccagtg

SEQ ID NO: 5214501 - DNA, 21 bp, Homo sapiens
aggccttgggtgttccacctg

SEQ ID NO: 5214502 - DNA, 14 bp, Homo sapiens
aggccttgtcccag

SEQ ID NO: 5214503 - DNA, 17 bp, Homo sapiens
aggccttgtgtgtcagg

SEQ ID NO: 5214504 - DNA, 15 bp, Homo sapiens
aggcctttaaaattt

SEQ ID NO: 5214505 - DNA, 15 bp, Homo sapiens
aggcctttccccagt

SEQ ID NO: 5214506 - DNA, 16 bp, Homo sapiens
aggcctttccctaagc

SEQ ID NO: 5214507 - DNA, 16 bp, Homo sapiens
aggcctttcctctgca

SEQ ID NO: 5214508 - DNA, 18 bp, Homo sapiens
aggcctttcctctgcacg

SEQ ID NO: 5214509 - DNA, 20 bp, Homo sapiens
aggcctttcctctgcacgct

SEQ ID NO: 5214510 - DNA, 22 bp, Homo sapiens
aggcctttctagaattttcttt

SEQ ID NO: 5214511 - DNA, 15 bp, Homo sapiens
aggcctttcttctgt

SEQ ID NO: 5214512 - DNA, 18 bp, Homo sapiens
aggcctttcttctgtgtt

SEQ ID NO: 5214513 - DNA, 19 bp, Homo sapiens
aggcctttcttctgtgtta

SEQ ID NO: 5214514 - DNA, 20 bp, Homo sapiens
aggcctttcttctgtgttaa

SEQ ID NO: 5214515 - DNA, 10 bp, Homo sapiens
aggcctttgg

SEQ ID NO: 5214516 - DNA, 17 bp, Homo sapiens
aggcctttggaggggaa

SEQ ID NO: 5214517 - DNA, 17 bp, Homo sapiens
aggccttttaacatttt

SEQ ID NO: 5214518 - DNA, 22 bp, Homo sapiens
aggccttttatgtaatttcttt

SEQ ID NO: 5214519 - DNA, 16 bp, Homo sapiens
aggccttttggaatgt

SEQ ID NO: 5214520 - DNA, 21 bp, Homo sapiens
aggcgaaagaaaactctattt

SEQ ID NO: 5214521 - DNA, 12 bp, Homo sapiens
aggcgaataaat

SEQ ID NO: 5214522 - DNA, 13 bp, Homo sapiens
aggcgaataaatg

SEQ ID NO: 5214523 - DNA, 18 bp, Homo sapiens
aggcgacaaaatctcctg

SEQ ID NO: 5214524 - DNA, 15 bp, Homo sapiens
aggcgaccaccgccc

SEQ ID NO: 5214525 - DNA, 17 bp, Homo sapiens
aggcgaccgggcctccc

SEQ ID NO: 5214526 - DNA, 18 bp, Homo sapiens
aggcgacgcggttttttc

SEQ ID NO: 5214527 - DNA, 18 bp, Homo sapiens
aggcgacttcctctccag

SEQ ID NO: 5214528 - DNA, 23 bp, Homo sapiens
aggcgacttcctctccagccttc

SEQ ID NO: 5214529 - DNA, 18 bp, Homo sapiens
aggcgagaagggctgctt

SEQ ID NO: 5214530 - DNA, 14 bp, Homo sapiens
aggcgagcagggca

SEQ ID NO: 5214531 - DNA, 13 bp, Homo sapiens
aggcgagccaggc

SEQ ID NO: 5214532 - DNA, 14 bp, Homo sapiens
aggcgagcctggcc

SEQ ID NO: 5214533 - DNA, 18 bp, Homo sapiens
aggcgagcctggccaaca

SEQ ID NO: 5214534 - DNA, 13 bp, Homo sapiens
aggcgaggccctt

SEQ ID NO: 5214535 - DNA, 14 bp, Homo sapiens
aggcgaggctgccc

SEQ ID NO: 5214536 - DNA, 17 bp, Homo sapiens
aggcgaggctgcctctg

SEQ ID NO: 5214537 - DNA, 22 bp, Homo sapiens
aggcgaggctgcctctgggtga

SEQ ID NO: 5214538 - DNA, 22 bp, Homo sapiens
aggcgaggggacagcccagcgc

SEQ ID NO: 5214539 - DNA, 18 bp, Homo sapiens
aggcgagtcaccctcctc

SEQ ID NO: 5214540 - DNA, 22 bp, Homo sapiens
aggcgagtcaccctcctcacag

SEQ ID NO: 5214541 - DNA, 23 bp, Homo sapiens
aggcgagtctggggacctggcac

SEQ ID NO: 5214542 - DNA, 20 bp, Homo sapiens
aggcgatcacaacgtgcatt

SEQ ID NO: 5214543 - DNA, 21 bp, Homo sapiens
aggcgatcacaacgtgcattg

SEQ ID NO: 5214544 - DNA, 15 bp, Homo sapiens
aggcgatgccacgct

SEQ ID NO: 5214545 - DNA, 20 bp, Homo sapiens
aggcgatggggcaagacaga

SEQ ID NO: 5214546 - DNA, 22 bp, Homo sapiens
aggcgatgtggtgaccccaccc

SEQ ID NO: 5214547 - DNA, 19 bp, Homo sapiens
aggcgcaagggaggcccag

SEQ ID NO: 5214548 - DNA, 22 bp, Homo sapiens
aggcgcactttcctcctggcag

SEQ ID NO: 5214549 - DNA, 22 bp, Homo sapiens
aggcgcagaggtcccagcccca

SEQ ID NO: 5214550 - DNA, 22 bp, Homo sapiens
aggcgcagcccgaagcccagtt

SEQ ID NO: 5214551 - DNA, 20 bp, Homo sapiens
aggcgcagggacatggggca

SEQ ID NO: 5214552 - DNA, 20 bp, Homo sapiens
aggcgcatgagtatctgtgg

SEQ ID NO: 5214553 - DNA, 14 bp, Homo sapiens
aggcgcatgtctgc

SEQ ID NO: 5214554 - DNA, 16 bp, Homo sapiens
aggcgcatgtctgcac

SEQ ID NO: 5214555 - DNA, 18 bp, Homo sapiens
aggcgcatgtgccagttg

SEQ ID NO: 5214556 - DNA, 12 bp, Homo sapiens
aggcgcccacct

SEQ ID NO: 5214557 - DNA, 13 bp, Homo sapiens
aggcgcccacctg

SEQ ID NO: 5214558 - DNA, 15 bp, Homo sapiens
aggcgcccacctgcc

SEQ ID NO: 5214559 - DNA, 17 bp, Homo sapiens
aggcgcccacctgccca

SEQ ID NO: 5214560 - DNA, 12 bp, Homo sapiens
aggcgcccccgc

SEQ ID NO: 5214561 - DNA, 13 bp, Homo sapiens
aggcgcccctggg

SEQ ID NO: 5214562 - DNA, 15 bp, Homo sapiens
aggcgcccctggggt

SEQ ID NO: 5214563 - DNA, 18 bp, Homo sapiens
aggcgcccctggggtggg

SEQ ID NO: 5214564 - DNA, 16 bp, Homo sapiens
aggcgccctcccttcc

SEQ ID NO: 5214565 - DNA, 20 bp, Homo sapiens
aggcgcctataatcccagct

SEQ ID NO: 5214566 - DNA, 13 bp, Homo sapiens
aggcgcctggcac

SEQ ID NO: 5214567 - DNA, 19 bp, Homo sapiens
aggcgcctggcacatttca

SEQ ID NO: 5214568 - DNA, 14 bp, Homo sapiens
aggcgcctggtgtg

SEQ ID NO: 5214569 - DNA, 15 bp, Homo sapiens
aggcgccttcctggg

SEQ ID NO: 5214570 - DNA, 22 bp, Homo sapiens
aggcgcgcacaccacgcccagc

SEQ ID NO: 5214571 - DNA, 12 bp, Homo sapiens
aggcgcgcaccg

SEQ ID NO: 5214572 - DNA, 14 bp, Homo sapiens
aggcgcgcaccgcc

SEQ ID NO: 5214573 - DNA, 21 bp, Homo sapiens
aggcgcgcaccgcccaacccc

SEQ ID NO: 5214574 - DNA, 19 bp, Homo sapiens
aggcgcggcggctctgccc

SEQ ID NO: 5214575 - DNA, 16 bp, Homo sapiens
aggcgcgtctgcccca

SEQ ID NO: 5214576 - DNA, 19 bp, Homo sapiens
aggcgcgtctgccccaccc

SEQ ID NO: 5214577 - DNA, 22 bp, Homo sapiens
aggcgcgtctgccccaccctca

SEQ ID NO: 5214578 - DNA, 17 bp, Homo sapiens
aggcgcgtttgtgcata

SEQ ID NO: 5214579 - DNA, 14 bp, Homo sapiens
aggcgctaatttat

SEQ ID NO: 5214580 - DNA, 19 bp, Homo sapiens
aggcgctgagactgtgctg

SEQ ID NO: 5214581 - DNA, 18 bp, Homo sapiens
aggcgctgggtgcctgca

SEQ ID NO: 5214582 - DNA, 15 bp, Homo sapiens
aggcgcttcccaact

SEQ ID NO: 5214583 - DNA, 17 bp, Homo sapiens
aggcggaaaccttgcag

SEQ ID NO: 5214584 - DNA, 19 bp, Homo sapiens
aggcggacaaagttcagtg

SEQ ID NO: 5214585 - DNA, 20 bp, Homo sapiens
aggcggagagtacagtgagc

SEQ ID NO: 5214586 - DNA, 24 bp, Homo sapiens
aggcggagagtacagtgagccaag

SEQ ID NO: 5214587 - DNA, 17 bp, Homo sapiens
aggcggagcccagccct

SEQ ID NO: 5214588 - DNA, 20 bp, Homo sapiens
aggcggagggtctccctggg

SEQ ID NO: 5214589 - DNA, 15 bp, Homo sapiens
aggcggcacagaggc

SEQ ID NO: 5214590 - DNA, 19 bp, Homo sapiens
aggcggcacattggcagtg

SEQ ID NO: 5214591 - DNA, 23 bp, Homo sapiens
aggcggcactccaacctaacctg

SEQ ID NO: 5214592 - DNA, 14 bp, Homo sapiens
aggcggcagctctt

SEQ ID NO: 5214593 - DNA, 12 bp, Homo sapiens
aggcggcagctg

SEQ ID NO: 5214594 - DNA, 15 bp, Homo sapiens
aggcggcagctgggg

SEQ ID NO: 5214595 - DNA, 17 bp, Homo sapiens
aggcggcaggcagagaa

SEQ ID NO: 5214596 - DNA, 11 bp, Homo sapiens
aggcggccagg

SEQ ID NO: 5214597 - DNA, 14 bp, Homo sapiens
aggcggccagggcg

SEQ ID NO: 5214598 - DNA, 15 bp, Homo sapiens
aggcggcccggccag

SEQ ID NO: 5214599 - DNA, 13 bp, Homo sapiens
aggcggccctggg

SEQ ID NO: 5214600 - DNA, 21 bp, Homo sapiens
aggcggccggccgcactggga

SEQ ID NO: 5214601 - DNA, 16 bp, Homo sapiens
aggcggcgatttttgt

SEQ ID NO: 5214602 - DNA, 18 bp, Homo sapiens
aggcggcgtgggcgaggc

SEQ ID NO: 5214603 - DNA, 16 bp, Homo sapiens
aggcggctcctcctca

SEQ ID NO: 5214604 - DNA, 21 bp, Homo sapiens
aggcggctctggttcctccag

SEQ ID NO: 5214605 - DNA, 14 bp, Homo sapiens
aggcgggaaggagg

SEQ ID NO: 5214606 - DNA, 20 bp, Homo sapiens
aggcgggaggaggtgtgagg

SEQ ID NO: 5214607 - DNA, 19 bp, Homo sapiens
aggcgggaggatcacttga

SEQ ID NO: 5214608 - DNA, 18 bp, Homo sapiens
aggtagaggaaaatcaat

SEQ ID NO: 5214609 - DNA, 16 bp, Homo sapiens
aggtagagtcattcat

SEQ ID NO: 5214610 - DNA, 17 bp, Homo sapiens
aggtagagtcattcata

SEQ ID NO: 5214611 - DNA, 18 bp, Homo sapiens
aggtagagtcattcatat

SEQ ID NO: 5214612 - DNA, 21 bp, Homo sapiens
aggtagagtggtcagttgaac

SEQ ID NO: 5214613 - DNA, 21 bp, Homo sapiens
aggtagagtttgaaggaggtg

SEQ ID NO: 5214614 - DNA, 20 bp, Homo sapiens
aggtagatcgcttgagccca

SEQ ID NO: 5214615 - DNA, 15 bp, Homo sapiens
aggtagcaacaacag

SEQ ID NO: 5214616 - DNA, 17 bp, Homo sapiens
aggtagcaagagagcag

SEQ ID NO: 5214617 - DNA, 13 bp, Homo sapiens
aggtagcacagtg

SEQ ID NO: 5214618 - DNA, 22 bp, Homo sapiens
aggtagcactctcagagtgttt

SEQ ID NO: 5214619 - DNA, 15 bp, Homo sapiens
aggtagcagcaaata

SEQ ID NO: 5214620 - DNA, 21 bp, Homo sapiens
aggtagcatgggtccaagaga

SEQ ID NO: 5214621 - DNA, 16 bp, Homo sapiens
aggtagcattgaaaaa

SEQ ID NO: 5214622 - DNA, 15 bp, Homo sapiens
aggtagcccagcact

SEQ ID NO: 5214623 - DNA, 17 bp, Homo sapiens
aggtagcccagcactgt

SEQ ID NO: 5214624 - DNA, 18 bp, Homo sapiens
aggtagccccctcttccc

SEQ ID NO: 5214625 - DNA, 15 bp, Homo sapiens
aggtagccgggctct

SEQ ID NO: 5214626 - DNA, 17 bp, Homo sapiens
aggtagccgggctctgc

SEQ ID NO: 5214627 - DNA, 13 bp, Homo sapiens
aggtagcctgctg

SEQ ID NO: 5214628 - DNA, 15 bp, Homo sapiens
aggtagcctgctggt

SEQ ID NO: 5214629 - DNA, 17 bp, Homo sapiens
aggtagcctgctgtggg

SEQ ID NO: 5214630 - DNA, 16 bp, Homo sapiens
aggtagccttgtgttc

SEQ ID NO: 5214631 - DNA, 19 bp, Homo sapiens
aggtagccttgtgttctga

SEQ ID NO: 5214632 - DNA, 15 bp, Homo sapiens
aggtagcgagctgct

SEQ ID NO: 5214633 - DNA, 17 bp, Homo sapiens
aggtagcgagctgctct

SEQ ID NO: 5214634 - DNA, 23 bp, Homo sapiens
aggtagctatagttgcagcccaa

SEQ ID NO: 5214635 - DNA, 19 bp, Homo sapiens
aggtagctgaaaggggaag

SEQ ID NO: 5214636 - DNA, 18 bp, Homo sapiens
aggtaggaagcaacagct

SEQ ID NO: 5214637 - DNA, 20 bp, Homo sapiens
aggtaggaatattatatttg

SEQ ID NO: 5214638 - DNA, 20 bp, Homo sapiens
aggtaggcaccacagagaag

SEQ ID NO: 5214639 - DNA, 20 bp, Homo sapiens
aggtaggcccttgtcctgcc

SEQ ID NO: 5214640 - DNA, 22 bp, Homo sapiens
aggtaggcccttgtcctgccag

SEQ ID NO: 5214641 - DNA, 20 bp, Homo sapiens
aggtagggccagctcacaag

SEQ ID NO: 5214642 - DNA, 13 bp, Homo sapiens
aggtagggctggc

SEQ ID NO: 5214643 - DNA, 12 bp, Homo sapiens
aggtagggttta

SEQ ID NO: 5214644 - DNA, 15 bp, Homo sapiens
aggtagggtttaatc

SEQ ID NO: 5214645 - DNA, 14 bp, Homo sapiens
aggtaggtgtattc

SEQ ID NO: 5214646 - DNA, 14 bp, Homo sapiens
aggtaggttttaaa

SEQ ID NO: 5214647 - DNA, 17 bp, Homo sapiens
aggtagtcatgctgtgc

SEQ ID NO: 5214648 - DNA, 21 bp, Homo sapiens
aggtagtcatgctgtgcattt

SEQ ID NO: 5214649 - DNA, 19 bp, Homo sapiens
aggtagttcaagaaatgaa

SEQ ID NO: 5214650 - DNA, 18 bp, Homo sapiens
aggtagttgggtagaaaa

SEQ ID NO: 5214651 - DNA, 19 bp, Homo sapiens
aggtagttgggtagaaaaa

SEQ ID NO: 5214652 - DNA, 20 bp, Homo sapiens
aggtagttgggtagaaaaat

SEQ ID NO: 5214653 - DNA, 23 bp, Homo sapiens
aggtagttgggtagaaaaattat

SEQ ID NO: 5214654 - DNA, 15 bp, Homo sapiens
aggtagtttcaaagg

SEQ ID NO: 5214655 - DNA, 19 bp, Homo sapiens
aggtagtttcaaaggccac

SEQ ID NO: 5214656 - DNA, 19 bp, Homo sapiens
aggtagtttggatattttt

SEQ ID NO: 5214657 - DNA, 21 bp, Homo sapiens
aggtagtttggatatttttgt

SEQ ID NO: 5214658 - DNA, 15 bp, Homo sapiens
aggtataaaaaataa

SEQ ID NO: 5214659 - DNA, 19 bp, Homo sapiens
aggtataaaaaataagtaa

SEQ ID NO: 5214660 - DNA, 16 bp, Homo sapiens
aggtataaggatcttt

SEQ ID NO: 5214661 - DNA, 13 bp, Homo sapiens
aggtataattaaa

SEQ ID NO: 5214662 - DNA, 15 bp, Homo sapiens
aggtataattgtgtg

SEQ ID NO: 5214663 - DNA, 15 bp, Homo sapiens
aggtataattttatg

SEQ ID NO: 5214664 - DNA, 15 bp, Homo sapiens
aggtatacaatgttc

SEQ ID NO: 5214665 - DNA, 13 bp, Homo sapiens
aggtatactatgt

SEQ ID NO: 5214666 - DNA, 17 bp, Homo sapiens
aggtatactatgtaagg

SEQ ID NO: 5214667 - DNA, 14 bp, Homo sapiens
aggtatatactttg

SEQ ID NO: 5214668 - DNA, 16 bp, Homo sapiens
aggtatatagaacaca

SEQ ID NO: 5214669 - DNA, 21 bp, Homo sapiens
aggtatatgatgagcagactt

SEQ ID NO: 5214670 - DNA, 17 bp, Homo sapiens
aggtatcaaaatagttt

SEQ ID NO: 5214671 - DNA, 22 bp, Homo sapiens
aggtatcaactaggggaggaga

SEQ ID NO: 5214672 - DNA, 21 bp, Homo sapiens
aggtatcacacactttctgac

SEQ ID NO: 5214673 - DNA, 20 bp, Homo sapiens
aggtatcaggcacaggcagg

SEQ ID NO: 5214674 - DNA, 18 bp, Homo sapiens
aggtatcctgggggaaga

SEQ ID NO: 5214675 - DNA, 19 bp, Homo sapiens
aggtatcctgggggaagag

SEQ ID NO: 5214676 - DNA, 21 bp, Homo sapiens
aggtatcctgggggaagagga

SEQ ID NO: 5214677 - DNA, 15 bp, Homo sapiens
aggtatctagagctt

SEQ ID NO: 5214678 - DNA, 17 bp, Homo sapiens
aggtatctgatgatgtt

SEQ ID NO: 5214679 - DNA, 21 bp, Homo sapiens
aggtatctgatgatgttctga

SEQ ID NO: 5214680 - DNA, 15 bp, Homo sapiens
aggtatctggtatct

SEQ ID NO: 5214681 - DNA, 18 bp, Homo sapiens
aggtatcttttttaaatg

SEQ ID NO: 5214682 - DNA, 20 bp, Homo sapiens
aggtatgaccttctaggaag

SEQ ID NO: 5214683 - DNA, 23 bp, Homo sapiens
aggtatgaccttctaggaagctc

SEQ ID NO: 5214684 - DNA, 18 bp, Homo sapiens
aggtatgatctcttctgg

SEQ ID NO: 5214685 - DNA, 15 bp, Homo sapiens
aggtatgatgtgctg

SEQ ID NO: 5214686 - DNA, 19 bp, Homo sapiens
aggtatgatgtgctgctgg

SEQ ID NO: 5214687 - DNA, 17 bp, Homo sapiens
aggtatgcaatcaaatc

SEQ ID NO: 5214688 - DNA, 21 bp, Homo sapiens
aggtatgcaatcaaatctgct

SEQ ID NO: 5214689 - DNA, 12 bp, Homo sapiens
aggtatggccat

SEQ ID NO: 5214690 - DNA, 16 bp, Homo sapiens
aggtatggccatgccc

SEQ ID NO: 5214691 - DNA, 20 bp, Homo sapiens
aggtatggccatgccctaga

SEQ ID NO: 5214692 - DNA, 23 bp, Homo sapiens
aggtatggctctgcacccctctg

SEQ ID NO: 5214693 - DNA, 14 bp, Homo sapiens
aggtatgggacctg

SEQ ID NO: 5214694 - DNA, 13 bp, Homo sapiens
aggtatgggctgg

SEQ ID NO: 5214695 - DNA, 14 bp, Homo sapiens
aggtatgggctggg

SEQ ID NO: 5214696 - DNA, 17 bp, Homo sapiens
aggtatgggctgggggc

SEQ ID NO: 5214697 - DNA, 18 bp, Homo sapiens
aggtatgggctgggggct

SEQ ID NO: 5214698 - DNA, 17 bp, Homo sapiens
aggtatgtctgtgccat

SEQ ID NO: 5214699 - DNA, 21 bp, Homo sapiens
aggtatgtgcccctcctgggt

SEQ ID NO: 5214700 - DNA, 14 bp, Homo sapiens
aggtatgttgcctt

SEQ ID NO: 5214701 - DNA, 20 bp, Homo sapiens
aggtatgttgcctttatggt

SEQ ID NO: 5214702 - DNA, 23 bp, Homo sapiens
aggtattaaaggttaaattgctt

SEQ ID NO: 5214703 - DNA, 19 bp, Homo sapiens
aggtattacaagtaatgta

SEQ ID NO: 5214704 - DNA, 18 bp, Homo sapiens
aggtattattatctttaa

SEQ ID NO: 5214705 - DNA, 23 bp, Homo sapiens
aggtattgattgaaaaaagagaa

SEQ ID NO: 5214706 - DNA, 14 bp, Homo sapiens
aggtattgcactac

SEQ ID NO: 5214707 - DNA, 17 bp, Homo sapiens
aggtattggcctgttca

SEQ ID NO: 5214708 - DNA, 19 bp, Homo sapiens
aggtattggtaggttactc

SEQ ID NO: 5214709 - DNA, 21 bp, Homo sapiens
aggtattgtctactctgaaga

SEQ ID NO: 5214710 - DNA, 15 bp, Homo sapiens
aggtatttaagactg

SEQ ID NO: 5214711 - DNA, 17 bp, Homo sapiens
aggtatttaagactgat

SEQ ID NO: 5214712 - DNA, 17 bp, Homo sapiens
aggtatttagaagcaga

SEQ ID NO: 5214713 - DNA, 19 bp, Homo sapiens
aggtatttcagaaggagaa

SEQ ID NO: 5214714 - DNA, 12 bp, Homo sapiens
aggtatttgaaa

SEQ ID NO: 5214715 - DNA, 23 bp, Homo sapiens
aggtatttgggaaacttgtcact

SEQ ID NO: 5214716 - DNA, 19 bp, Homo sapiens
aggtattttgtttctttta

SEQ ID NO: 5214717 - DNA, 20 bp, Homo sapiens
aggtattttgtttcttttaa

SEQ ID NO: 5214718 - DNA, 17 bp, Homo sapiens
aggtatttttgaaagca

SEQ ID NO: 5214719 - DNA, 15 bp, Homo sapiens
aggtatttttgaagt

SEQ ID NO: 5214720 - DNA, 17 bp, Homo sapiens
aggtatttttttaaatc

SEQ ID NO: 5214721 - DNA, 22 bp, Homo sapiens
aggtatttttttaaatcaagga

SEQ ID NO: 5214722 - DNA, 17 bp, Homo sapiens
aggtcaaaaacaaacta

SEQ ID NO: 5214723 - DNA, 20 bp, Homo sapiens
aggtcaaaatagtgccacta

SEQ ID NO: 5214724 - DNA, 18 bp, Homo sapiens
aggtcaaacaggctgtaa

SEQ ID NO: 5214725 - DNA, 13 bp, Homo sapiens
aggtcaacagaat

SEQ ID NO: 5214726 - DNA, 22 bp, Homo sapiens
aggtcaacagaatgaaaaatga

SEQ ID NO: 5214727 - DNA, 17 bp, Homo sapiens
aggtcaacagagaaggc

SEQ ID NO: 5214728 - DNA, 19 bp, Homo sapiens
aggtcaacagagaaggcag

SEQ ID NO: 5214729 - DNA, 21 bp, Homo sapiens
aggtcaacagagaaggcagga

SEQ ID NO: 5214730 - DNA, 13 bp, Homo sapiens
aggtcaacatcta

SEQ ID NO: 5214731 - DNA, 18 bp, Homo sapiens
aggtcaagaaatgtgact

SEQ ID NO: 5214732 - DNA, 17 bp, Homo sapiens
aggtcaagaccagcctg

SEQ ID NO: 5214733 - DNA, 15 bp, Homo sapiens
aggtcaagactgtgg

SEQ ID NO: 5214734 - DNA, 16 bp, Homo sapiens
aggtcaagactgtggt

SEQ ID NO: 5214735 - DNA, 14 bp, Homo sapiens
aggtcaagcccaga

SEQ ID NO: 5214736 - DNA, 16 bp, Homo sapiens
aggtcaagcccaggag

SEQ ID NO: 5214737 - DNA, 15 bp, Homo sapiens
aggtcaaggaaggaa

SEQ ID NO: 5214738 - DNA, 16 bp, Homo sapiens
aggtcaagttgtcagg

SEQ ID NO: 5214739 - DNA, 17 bp, Homo sapiens
aggtcaagttgtcaggt

SEQ ID NO: 5214740 - DNA, 19 bp, Homo sapiens
aggtcaagttgtcaggtta

SEQ ID NO: 5214741 - DNA, 14 bp, Homo sapiens
aggtcaataaactt

SEQ ID NO: 5214742 - DNA, 22 bp, Homo sapiens
aggtcaataaagcagagccaag

SEQ ID NO: 5214743 - DNA, 13 bp, Homo sapiens
aggtcaataacac

SEQ ID NO: 5214744 - DNA, 17 bp, Homo sapiens
aggtcaataaggtcaag

SEQ ID NO: 5214745 - DNA, 21 bp, Homo sapiens
aggtcaatacagtacaggcag

SEQ ID NO: 5214746 - DNA, 15 bp, Homo sapiens
aggtcaatgaaatat

SEQ ID NO: 5214747 - DNA, 19 bp, Homo sapiens
aggtcaatgaaatatttgc

SEQ ID NO: 5214748 - DNA, 22 bp, Homo sapiens
aggtcacacgaccggggccagc

SEQ ID NO: 5214749 - DNA, 23 bp, Homo sapiens
aggtcacacgaggggccccgtgt

SEQ ID NO: 5214750 - DNA, 18 bp, Homo sapiens
aggtcacagctggatctg

SEQ ID NO: 5214751 - DNA, 20 bp, Homo sapiens
aggtcacatatgtctgtatc

SEQ ID NO: 5214752 - DNA, 18 bp, Homo sapiens
aggtcacattcaggaaga

SEQ ID NO: 5214753 - DNA, 19 bp, Homo sapiens
aggtcacattcaggaagat

SEQ ID NO: 5214754 - DNA, 14 bp, Homo sapiens
aggtcaccagctgc

SEQ ID NO: 5214755 - DNA, 15 bp, Homo sapiens
aggtcaccagctgct

SEQ ID NO: 5214756 - DNA, 22 bp, Homo sapiens
aggtcaccaggggaggagcctg

SEQ ID NO: 5214757 - DNA, 16 bp, Homo sapiens
aggtcaccatcctcag

SEQ ID NO: 5214758 - DNA, 16 bp, Homo sapiens
aggtcacccatcagga

SEQ ID NO: 5214759 - DNA, 14 bp, Homo sapiens
aggtcacctcactc

SEQ ID NO: 5214760 - DNA, 18 bp, Homo sapiens
aggtcacgttggccctca

SEQ ID NO: 5214761 - DNA, 14 bp, Homo sapiens
aggtcactccacca

SEQ ID NO: 5214762 - DNA, 18 bp, Homo sapiens
aggtcactccaccatccc

SEQ ID NO: 5214763 - DNA, 14 bp, Homo sapiens
aggtcactcctggg

SEQ ID NO: 5214764 - DNA, 15 bp, Homo sapiens
aggtcactctccagc

SEQ ID NO: 5214765 - DNA, 17 bp, Homo sapiens
aggtcactctccagcag

SEQ ID NO: 5214766 - DNA, 18 bp, Homo sapiens
aggtcactctgggcctgg

SEQ ID NO: 5214767 - DNA, 21 bp, Homo sapiens
aggtcactcttcctgcaagga

SEQ ID NO: 5214768 - DNA, 12 bp, Homo sapiens
aggtcactgcta

SEQ ID NO: 5214769 - DNA, 16 bp, Homo sapiens
aggtcactggaaaggg

SEQ ID NO: 5214770 - DNA, 20 bp, Homo sapiens
aggtcactggaaaggggaga

SEQ ID NO: 5214771 - DNA, 14 bp, Homo sapiens
aggtcactggctct

SEQ ID NO: 5214772 - DNA, 15 bp, Homo sapiens
aggtcactggctctc

SEQ ID NO: 5214773 - DNA, 17 bp, Homo sapiens
aggtcactggctctcca

SEQ ID NO: 5214774 - DNA, 19 bp, Homo sapiens
aggtcactggctctccaag

SEQ ID NO: 5214775 - DNA, 16 bp, Homo sapiens
aggtcactgtttcctg

SEQ ID NO: 5214776 - DNA, 23 bp, Homo sapiens
aggtcactttttttttttttccc

SEQ ID NO: 5214777 - DNA, 12 bp, Homo sapiens
aggtcagagatg

SEQ ID NO: 5214778 - DNA, 18 bp, Homo sapiens
aggtcagagatgggctga

SEQ ID NO: 5214779 - DNA, 15 bp, Homo sapiens
aggtcagagcccagg

SEQ ID NO: 5214780 - DNA, 16 bp, Homo sapiens
aggtcagagcccagga

SEQ ID NO: 5214781 - DNA, 14 bp, Homo sapiens
aggtcagagcctgc

SEQ ID NO: 5214782 - DNA, 15 bp, Homo sapiens
aggtcagagcctgca

SEQ ID NO: 5214783 - DNA, 17 bp, Homo sapiens
aggtcagagcctgcagt

SEQ ID NO: 5214784 - DNA, 21 bp, Homo sapiens
aggtcagcacatctcaacagg

SEQ ID NO: 5214785 - DNA, 12 bp, Homo sapiens
aggtcagcccat

SEQ ID NO: 5214786 - DNA, 17 bp, Homo sapiens
aggtcagcccatggagg

SEQ ID NO: 5214787 - DNA, 14 bp, Homo sapiens
aggcgggagggcct

SEQ ID NO: 5214788 - DNA, 14 bp, Homo sapiens
aggcgggagtggag

SEQ ID NO: 5214789 - DNA, 13 bp, Homo sapiens
aggcgggccagcc

SEQ ID NO: 5214790 - DNA, 16 bp, Homo sapiens
aggcgggccagccagg

SEQ ID NO: 5214791 - DNA, 14 bp, Homo sapiens
aggcgggcccatga

SEQ ID NO: 5214792 - DNA, 15 bp, Homo sapiens
aggcgggcggtcagg

SEQ ID NO: 5214793 - DNA, 14 bp, Homo sapiens
aggcgggctcaagg

SEQ ID NO: 5214794 - DNA, 14 bp, Homo sapiens
aggcgggcttggaa

SEQ ID NO: 5214795 - DNA, 15 bp, Homo sapiens
aggcggggcgcccca

SEQ ID NO: 5214796 - DNA, 13 bp, Homo sapiens
aggcggggctcta

SEQ ID NO: 5214797 - DNA, 16 bp, Homo sapiens
aggcggggcttgcctt

SEQ ID NO: 5214798 - DNA, 23 bp, Homo sapiens
aggcgggggagcctggagcccct

SEQ ID NO: 5214799 - DNA, 17 bp, Homo sapiens
aggcgggggctgccctt

SEQ ID NO: 5214800 - DNA, 21 bp, Homo sapiens
aggcggggggggcgcctggag

SEQ ID NO: 5214801 - DNA, 20 bp, Homo sapiens
aggcgggggtttgagccctg

SEQ ID NO: 5214802 - DNA, 21 bp, Homo sapiens
aggcgggggtttgagccctgg

SEQ ID NO: 5214803 - DNA, 22 bp, Homo sapiens
aggcgggggtttgagccctgga

SEQ ID NO: 5214804 - DNA, 20 bp, Homo sapiens
aggcggggtggcggtggacc

SEQ ID NO: 5214805 - DNA, 17 bp, Homo sapiens
aggcggtatccagaggt

SEQ ID NO: 5214806 - DNA, 21 bp, Homo sapiens
aggcggtccccatccccacca

SEQ ID NO: 5214807 - DNA, 23 bp, Homo sapiens
aggcggtccccatccccaccagc

SEQ ID NO: 5214808 - DNA, 14 bp, Homo sapiens
aggcggtgggcacc

SEQ ID NO: 5214809 - DNA, 15 bp, Homo sapiens
aggcggtttccagga

SEQ ID NO: 5214810 - DNA, 18 bp, Homo sapiens
aggcggtttccaggaaga

SEQ ID NO: 5214811 - DNA, 18 bp, Homo sapiens
aggcgtagggccagggct

SEQ ID NO: 5214812 - DNA, 21 bp, Homo sapiens
aggcgtagggccagggctctg

SEQ ID NO: 5214813 - DNA, 17 bp, Homo sapiens
aggcgtcccgcacctgt

SEQ ID NO: 5214814 - DNA, 19 bp, Homo sapiens
aggcgtcccgcacctgtct

SEQ ID NO: 5214815 - DNA, 21 bp, Homo sapiens
aggcgtcccgcacctgtctga

SEQ ID NO: 5214816 - DNA, 17 bp, Homo sapiens
aggcgtcctggtgagga

SEQ ID NO: 5214817 - DNA, 19 bp, Homo sapiens
aggcgtcttcatctccctg

SEQ ID NO: 5214818 - DNA, 20 bp, Homo sapiens
aggcgtcttcatctccctgc

SEQ ID NO: 5214819 - DNA, 16 bp, Homo sapiens
aggcgtcttgtatttt

SEQ ID NO: 5214820 - DNA, 15 bp, Homo sapiens
aggcgtgactcagca

SEQ ID NO: 5214821 - DNA, 21 bp, Homo sapiens
aggcgtgagccaccgtgcctg

SEQ ID NO: 5214822 - DNA, 16 bp, Homo sapiens
aggcgtgcaaggggct

SEQ ID NO: 5214823 - DNA, 20 bp, Homo sapiens
aggcgtgcccccctcctcca

SEQ ID NO: 5214824 - DNA, 16 bp, Homo sapiens
aggcgtggagctgcct

SEQ ID NO: 5214825 - DNA, 17 bp, Homo sapiens
aggcgtggaggagagga

SEQ ID NO: 5214826 - DNA, 18 bp, Homo sapiens
aggcgtggcttctgcagg

SEQ ID NO: 5214827 - DNA, 23 bp, Homo sapiens
aggcgtgggatccagagagaagc

SEQ ID NO: 5214828 - DNA, 14 bp, Homo sapiens
aggcgtgtggcagc

SEQ ID NO: 5214829 - DNA, 15 bp, Homo sapiens
aggcgtgtggcagcc

SEQ ID NO: 5214830 - DNA, 19 bp, Homo sapiens
aggcgttagtgggcaggtg

SEQ ID NO: 5214831 - DNA, 18 bp, Homo sapiens
aggcgttcttcgaggtgg

SEQ ID NO: 5214832 - DNA, 17 bp, Homo sapiens
aggcgttgctttcactc

SEQ ID NO: 5214833 - DNA, 14 bp, Homo sapiens
aggcgtttggagaa

SEQ ID NO: 5214834 - DNA, 21 bp, Homo sapiens
aggcgtttggagaaggtctgt

SEQ ID NO: 5214835 - DNA, 21 bp, Homo sapiens
aggctaaaacaaatctcagaa

SEQ ID NO: 5214836 - DNA, 18 bp, Homo sapiens
aggctaaaaggcttccag

SEQ ID NO: 5214837 - DNA, 19 bp, Homo sapiens
aggctaaaaggcttccagg

SEQ ID NO: 5214838 - DNA, 17 bp, Homo sapiens
aggctaaaatgttttca

SEQ ID NO: 5214839 - DNA, 18 bp, Homo sapiens
aggctaaaatgttttcag

SEQ ID NO: 5214840 - DNA, 13 bp, Homo sapiens
aggctaaaattag

SEQ ID NO: 5214841 - DNA, 21 bp, Homo sapiens
aggctaaacatccaatatttt

SEQ ID NO: 5214842 - DNA, 19 bp, Homo sapiens
aggctaaagaagacacaca

SEQ ID NO: 5214843 - DNA, 22 bp, Homo sapiens
aggctaaagaagacacacagcc

SEQ ID NO: 5214844 - DNA, 21 bp, Homo sapiens
aggctaaagcccagagacagc

SEQ ID NO: 5214845 - DNA, 19 bp, Homo sapiens
aggctaaattactcaggaa

SEQ ID NO: 5214846 - DNA, 17 bp, Homo sapiens
aggctaacatcccactt

SEQ ID NO: 5214847 - DNA, 14 bp, Homo sapiens
aggctaagaaagaa

SEQ ID NO: 5214848 - DNA, 16 bp, Homo sapiens
aggctaagaccctgtg

SEQ ID NO: 5214849 - DNA, 14 bp, Homo sapiens
aggctaagctgccg

SEQ ID NO: 5214850 - DNA, 19 bp, Homo sapiens
aggctaaggcgtggagctg

SEQ ID NO: 5214851 - DNA, 18 bp, Homo sapiens
aggctaagttcagttctg

SEQ ID NO: 5214852 - DNA, 16 bp, Homo sapiens
aggctaatacaggaaa

SEQ ID NO: 5214853 - DNA, 15 bp, Homo sapiens
aggctaatcaatacc

SEQ ID NO: 5214854 - DNA, 20 bp, Homo sapiens
aggctaatcaatacccttgg

SEQ ID NO: 5214855 - DNA, 23 bp, Homo sapiens
aggctaatgttggcagatgcagc

SEQ ID NO: 5214856 - DNA, 21 bp, Homo sapiens
aggctaattcagtgtcacatg

SEQ ID NO: 5214857 - DNA, 18 bp, Homo sapiens
aggctaatttttatattt

SEQ ID NO: 5214858 - DNA, 22 bp, Homo sapiens
aggctaatttttttgtatttta

SEQ ID NO: 5214859 - DNA, 13 bp, Homo sapiens
aggctacactgac

SEQ ID NO: 5214860 - DNA, 15 bp, Homo sapiens
aggctacagaactaa

SEQ ID NO: 5214861 - DNA, 13 bp, Homo sapiens
aggctacagaatg

SEQ ID NO: 5214862 - DNA, 14 bp, Homo sapiens
aggctacagagaag

SEQ ID NO: 5214863 - DNA, 16 bp, Homo sapiens
aggctacagagaagcc

SEQ ID NO: 5214864 - DNA, 17 bp, Homo sapiens
aggctacagagaagcct

SEQ ID NO: 5214865 - DNA, 19 bp, Homo sapiens
aggctacagagaagccttc

SEQ ID NO: 5214866 - DNA, 14 bp, Homo sapiens
aggctacagctcca

SEQ ID NO: 5214867 - DNA, 20 bp, Homo sapiens
aggctacagctccacacgcc

SEQ ID NO: 5214868 - DNA, 14 bp, Homo sapiens
aggctacagggcca

SEQ ID NO: 5214869 - DNA, 22 bp, Homo sapiens
aggctacaggggttagcctgga

SEQ ID NO: 5214870 - DNA, 15 bp, Homo sapiens
aggctacaggtgccc

SEQ ID NO: 5214871 - DNA, 15 bp, Homo sapiens
aggctaccagaagag

SEQ ID NO: 5214872 - DNA, 12 bp, Homo sapiens
aggctacccctt

SEQ ID NO: 5214873 - DNA, 17 bp, Homo sapiens
aggctacccgctgtggc

SEQ ID NO: 5214874 - DNA, 18 bp, Homo sapiens
aggctacccgctgtggcc

SEQ ID NO: 5214875 - DNA, 22 bp, Homo sapiens
aggctacccgctgtggccggtg

SEQ ID NO: 5214876 - DNA, 22 bp, Homo sapiens
aggctaccctcctctagaaggc

SEQ ID NO: 5214877 - DNA, 21 bp, Homo sapiens
aggctactacagagaaggctg

SEQ ID NO: 5214878 - DNA, 22 bp, Homo sapiens
aggctactagaattctgtattg

SEQ ID NO: 5214879 - DNA, 13 bp, Homo sapiens
aggctactcacct

SEQ ID NO: 5214880 - DNA, 21 bp, Homo sapiens
aggctactgtaatgctgcctc

SEQ ID NO: 5214881 - DNA, 23 bp, Homo sapiens
aggctactgtaatgctgcctcag

SEQ ID NO: 5214882 - DNA, 17 bp, Homo sapiens
aggctactgtcagctcc

SEQ ID NO: 5214883 - DNA, 17 bp, Homo sapiens
aggctacttcggggctg

SEQ ID NO: 5214884 - DNA, 23 bp, Homo sapiens
aggctagaagtgtgaagtgcaga

SEQ ID NO: 5214885 - DNA, 15 bp, Homo sapiens
aggctagacagaaac

SEQ ID NO: 5214886 - DNA, 21 bp, Homo sapiens
aggctagacttagattcatta

SEQ ID NO: 5214887 - DNA, 20 bp, Homo sapiens
aggctagagtgcagtggcgt

SEQ ID NO: 5214888 - DNA, 15 bp, Homo sapiens
aggctagatgtatgt

SEQ ID NO: 5214889 - DNA, 17 bp, Homo sapiens
aggctagatgtatgtac

SEQ ID NO: 5214890 - DNA, 14 bp, Homo sapiens
aggctagccccagg

SEQ ID NO: 5214891 - DNA, 15 bp, Homo sapiens
aggctagccccaggg

SEQ ID NO: 5214892 - DNA, 18 bp, Homo sapiens
aggctagccccagggtga

SEQ ID NO: 5214893 - DNA, 16 bp, Homo sapiens
aggctagccctgccct

SEQ ID NO: 5214894 - DNA, 16 bp, Homo sapiens
aggctagctggagcct

SEQ ID NO: 5214895 - DNA, 15 bp, Homo sapiens
aggctagctgtgctg

SEQ ID NO: 5214896 - DNA, 16 bp, Homo sapiens
aggctaggaagaactt

SEQ ID NO: 5214897 - DNA, 14 bp, Homo sapiens
aggctaggacgttg

SEQ ID NO: 5214898 - DNA, 16 bp, Homo sapiens
aggctaggccagcagg

SEQ ID NO: 5214899 - DNA, 15 bp, Homo sapiens
aggctagggtgggga

SEQ ID NO: 5214900 - DNA, 16 bp, Homo sapiens
aggctagggtggggag

SEQ ID NO: 5214901 - DNA, 19 bp, Homo sapiens
aggctagggtggggagaga

SEQ ID NO: 5214902 - DNA, 14 bp, Homo sapiens
aggctagttccttt

SEQ ID NO: 5214903 - DNA, 17 bp, Homo sapiens
aggctagtttattttgt

SEQ ID NO: 5214904 - DNA, 21 bp, Homo sapiens
aggctatgaagggacagctgc

SEQ ID NO: 5214905 - DNA, 16 bp, Homo sapiens
aggctatgagtgggat

SEQ ID NO: 5214906 - DNA, 15 bp, Homo sapiens
aggctatgccatgtg

SEQ ID NO: 5214907 - DNA, 15 bp, Homo sapiens
aggctatggttgcca

SEQ ID NO: 5214908 - DNA, 19 bp, Homo sapiens
aggctatggttgccacccc

SEQ ID NO: 5214909 - DNA, 16 bp, Homo sapiens
aggctatgtataaaat

SEQ ID NO: 5214910 - DNA, 20 bp, Homo sapiens
aggctatgtataaaatacat

SEQ ID NO: 5214911 - DNA, 17 bp, Homo sapiens
aggctatgtgattacaa

SEQ ID NO: 5214912 - DNA, 16 bp, Homo sapiens
aggctattattttcac

SEQ ID NO: 5214913 - DNA, 19 bp, Homo sapiens
aggctattattttcactgt

SEQ ID NO: 5214914 - DNA, 16 bp, Homo sapiens
aggctattcctaggcc

SEQ ID NO: 5214915 - DNA, 14 bp, Homo sapiens
aggctattttctaa

SEQ ID NO: 5214916 - DNA, 15 bp, Homo sapiens
aggctcaactaggga

SEQ ID NO: 5214917 - DNA, 15 bp, Homo sapiens
aggctcaagaggccc

SEQ ID NO: 5214918 - DNA, 18 bp, Homo sapiens
aggctcaagaggcccagg

SEQ ID NO: 5214919 - DNA, 19 bp, Homo sapiens
aggctcaagaggcccaggg

SEQ ID NO: 5214920 - DNA, 20 bp, Homo sapiens
aggctcaagaggcccaggga

SEQ ID NO: 5214921 - DNA, 13 bp, Homo sapiens
aggctcaagctat

SEQ ID NO: 5214922 - DNA, 15 bp, Homo sapiens
aggctcaaggctgtg

SEQ ID NO: 5214923 - DNA, 18 bp, Homo sapiens
aggctcaaggctgtgcag

SEQ ID NO: 5214924 - DNA, 19 bp, Homo sapiens
aggctcacccccttctcca

SEQ ID NO: 5214925 - DNA, 21 bp, Homo sapiens
aggctcacccccttctccatc

SEQ ID NO: 5214926 - DNA, 15 bp, Homo sapiens
aggctcactctttcc

SEQ ID NO: 5214927 - DNA, 15 bp, Homo sapiens
aggctcactgcagcg

SEQ ID NO: 5214928 - DNA, 16 bp, Homo sapiens
aggctcactgccaggc

SEQ ID NO: 5214929 - DNA, 23 bp, Homo sapiens
aggctcactgccaggccagcctc

SEQ ID NO: 5214930 - DNA, 13 bp, Homo sapiens
aggctcagagact

SEQ ID NO: 5214931 - DNA, 20 bp, Homo sapiens
aggctcagagactgcaagct

SEQ ID NO: 5214932 - DNA, 14 bp, Homo sapiens
aggctcagagatgt

SEQ ID NO: 5214933 - DNA, 18 bp, Homo sapiens
aggctcagccctgagctg

SEQ ID NO: 5214934 - DNA, 19 bp, Homo sapiens
aggctcagccctgagctgg

SEQ ID NO: 5214935 - DNA, 20 bp, Homo sapiens
aggctcagccttggaagcaa

SEQ ID NO: 5214936 - DNA, 20 bp, Homo sapiens
aggctcaggcaggggcctcc

SEQ ID NO: 5214937 - DNA, 21 bp, Homo sapiens
aggctcaggcaggggcctcca

SEQ ID NO: 5214938 - DNA, 13 bp, Homo sapiens
aggctcaggccat

SEQ ID NO: 5214939 - DNA, 19 bp, Homo sapiens
aggctcagtctcaggagca

SEQ ID NO: 5214940 - DNA, 23 bp, Homo sapiens
aggctcagtctcaggagcatggg

SEQ ID NO: 5214941 - DNA, 20 bp, Homo sapiens
aggctcatagggaagacctg

SEQ ID NO: 5214942 - DNA, 15 bp, Homo sapiens
aggctcatctttctg

SEQ ID NO: 5214943 - DNA, 15 bp, Homo sapiens
aggctcatttaaaac

SEQ ID NO: 5214944 - DNA, 14 bp, Homo sapiens
aggctcatttactg

SEQ ID NO: 5214945 - DNA, 17 bp, Homo sapiens
aggctccaatggggcgg

SEQ ID NO: 5214946 - DNA, 21 bp, Homo sapiens
aggctccaatggggcggggct

SEQ ID NO: 5214947 - DNA, 14 bp, Homo sapiens
aggctccagagggc

SEQ ID NO: 5214948 - DNA, 18 bp, Homo sapiens
aggctccagcacatcccc

SEQ ID NO: 5214949 - DNA, 16 bp, Homo sapiens
aggctccaggactcca

SEQ ID NO: 5214950 - DNA, 20 bp, Homo sapiens
aggctccaggactccactgg

SEQ ID NO: 5214951 - DNA, 17 bp, Homo sapiens
aggctccaggagcagcc

SEQ ID NO: 5214952 - DNA, 23 bp, Homo sapiens
aggctccaggagcagccacattc

SEQ ID NO: 5214953 - DNA, 15 bp, Homo sapiens
aggctccaggcagca

SEQ ID NO: 5214954 - DNA, 14 bp, Homo sapiens
aggctccaggctga

SEQ ID NO: 5214955 - DNA, 22 bp, Homo sapiens
aggctccaggctgactgggggc

SEQ ID NO: 5214956 - DNA, 22 bp, Homo sapiens
aggctccatccttctccccaag

SEQ ID NO: 5214957 - DNA, 15 bp, Homo sapiens
aggctccatgcacct

SEQ ID NO: 5214958 - DNA, 22 bp, Homo sapiens
aggctccatgcacctcccttcc

SEQ ID NO: 5214959 - DNA, 14 bp, Homo sapiens
aggctcccagaccc

SEQ ID NO: 5214960 - DNA, 15 bp, Homo sapiens
aggctcccagaccca

SEQ ID NO: 5214961 - DNA, 12 bp, Homo sapiens
aggctcccagcc

SEQ ID NO: 5214962 - DNA, 23 bp, Homo sapiens
aggctcccagcctaagggagaca

SEQ ID NO: 5214963 - DNA, 20 bp, Homo sapiens
aggctccccagaactggctg

SEQ ID NO: 5214964 - DNA, 13 bp, Homo sapiens
aggctcccctgcc

SEQ ID NO: 5214965 - DNA, 12 bp, Homo sapiens
aggtcagcctgg

SEQ ID NO: 5214966 - DNA, 21 bp, Homo sapiens
aggtcagcctggaagggacag

SEQ ID NO: 5214967 - DNA, 12 bp, Homo sapiens
aggtcagccttg

SEQ ID NO: 5214968 - DNA, 15 bp, Homo sapiens
aggtcagctcagagc

SEQ ID NO: 5214969 - DNA, 18 bp, Homo sapiens
aggtcagctgggagccag

SEQ ID NO: 5214970 - DNA, 20 bp, Homo sapiens
aggtcagctgggagccagtg

SEQ ID NO: 5214971 - DNA, 20 bp, Homo sapiens
aggtcagctgttactttctt

SEQ ID NO: 5214972 - DNA, 21 bp, Homo sapiens
aggtcaggaagcaggggtggg

SEQ ID NO: 5214973 - DNA, 18 bp, Homo sapiens
aggtcaggaccaggaccc

SEQ ID NO: 5214974 - DNA, 17 bp, Homo sapiens
aggtcaggacggctcct

SEQ ID NO: 5214975 - DNA, 15 bp, Homo sapiens
aggtcaggagttcct

SEQ ID NO: 5214976 - DNA, 20 bp, Homo sapiens
aggtcaggagttcctaacca

SEQ ID NO: 5214977 - DNA, 15 bp, Homo sapiens
aggtcaggagttcga

SEQ ID NO: 5214978 - DNA, 21 bp, Homo sapiens
aggtcaggagttcgagaccag

SEQ ID NO: 5214979 - DNA, 22 bp, Homo sapiens
aggtcaggagttcgagaccagc

SEQ ID NO: 5214980 - DNA, 17 bp, Homo sapiens
aggtcaggccccactcc

SEQ ID NO: 5214981 - DNA, 14 bp, Homo sapiens
aggtcaggccctgg

SEQ ID NO: 5214982 - DNA, 15 bp, Homo sapiens
aggtcaggccctgga

SEQ ID NO: 5214983 - DNA, 15 bp, Homo sapiens
aggtcagggacttgg

SEQ ID NO: 5214984 - DNA, 18 bp, Homo sapiens
aggtcagggctcagagtg

SEQ ID NO: 5214985 - DNA, 16 bp, Homo sapiens
aggtcaggggctccct

SEQ ID NO: 5214986 - DNA, 22 bp, Homo sapiens
aggtcaggggtgacacagactc

SEQ ID NO: 5214987 - DNA, 15 bp, Homo sapiens
aggtcagtacccacc

SEQ ID NO: 5214988 - DNA, 19 bp, Homo sapiens
aggtcagtacccacctgag

SEQ ID NO: 5214989 - DNA, 20 bp, Homo sapiens
aggtcagtagactgtgattc

SEQ ID NO: 5214990 - DNA, 15 bp, Homo sapiens
aggtcagtgcaaata

SEQ ID NO: 5214991 - DNA, 21 bp, Homo sapiens
aggtcagtgttataaaatctg

SEQ ID NO: 5214992 - DNA, 20 bp, Homo sapiens
aggtcatacaatccattctt

SEQ ID NO: 5214993 - DNA, 21 bp, Homo sapiens
aggtcatacaatccattctta

SEQ ID NO: 5214994 - DNA, 22 bp, Homo sapiens
aggtcatactatctactctcct

SEQ ID NO: 5214995 - DNA, 16 bp, Homo sapiens
aggtcatagattcttg

SEQ ID NO: 5214996 - DNA, 14 bp, Homo sapiens
aggtcatatgttgt

SEQ ID NO: 5214997 - DNA, 18 bp, Homo sapiens
aggtcatattaatatatt

SEQ ID NO: 5214998 - DNA, 19 bp, Homo sapiens
aggtcatattaatatattt

SEQ ID NO: 5214999 - DNA, 17 bp, Homo sapiens
aggtcatcccttcctcc

SEQ ID NO: 5215000 - DNA, 15 bp, Homo sapiens
aggtcatctgtaaaa

SEQ ID NO: 5215001 - DNA, 16 bp, Homo sapiens
aggtcatctgtaaaat

SEQ ID NO: 5215002 - DNA, 18 bp, Homo sapiens
aggtcatgaacatggtca

SEQ ID NO: 5215003 - DNA, 12 bp, Homo sapiens
aggtcatgaagg

SEQ ID NO: 5215004 - DNA, 21 bp, Homo sapiens
aggtcatgaaggacactctgc

SEQ ID NO: 5215005 - DNA, 18 bp, Homo sapiens
aggtcatgatttctgtga

SEQ ID NO: 5215006 - DNA, 21 bp, Homo sapiens
aggtcatgatttctgtgaagc

SEQ ID NO: 5215007 - DNA, 23 bp, Homo sapiens
aggtcatgatttctgtgaagcaa

SEQ ID NO: 5215008 - DNA, 16 bp, Homo sapiens
aggtcatggagcagcc

SEQ ID NO: 5215009 - DNA, 21 bp, Homo sapiens
aggtcatggagcagcccccaa

SEQ ID NO: 5215010 - DNA, 19 bp, Homo sapiens
aggtcatggccacactgtg

SEQ ID NO: 5215011 - DNA, 22 bp, Homo sapiens
aggtcatgtctgtaatcccagc

SEQ ID NO: 5215012 - DNA, 13 bp, Homo sapiens
aggtcatttgtag

SEQ ID NO: 5215013 - DNA, 16 bp, Homo sapiens
aggtcatttgtagata

SEQ ID NO: 5215014 - DNA, 15 bp, Homo sapiens
aggtcattttctatt

SEQ ID NO: 5215015 - DNA, 21 bp, Homo sapiens
aggtccaaaaaaggctgccct

SEQ ID NO: 5215016 - DNA, 19 bp, Homo sapiens
aggtccaaacccttcaact

SEQ ID NO: 5215017 - DNA, 14 bp, Homo sapiens
aggtccaaatgttt

SEQ ID NO: 5215018 - DNA, 20 bp, Homo sapiens
aggtccaaattcaccttccc
